United States Patent 11,096,956 (ANTISENSE OLIGOMERS AND USES THEREOF) - sequence listing, part 3

SEQ ID NO: 6321 - RNA, 366299 nt, Homo sapiens
guguguggaugugugagugagagggaacgagaguaagagaaagaaagaagugaggggauguaaacucgaauaaauuucaaagugccuccgagggaugcaacgggcaaaaacugaacuguucaggcuucagauuguaacugacgaucugaggaaaaaugaggugcucgaugaauuuucguuuguauuuuuuggcgaggcgggggagguguugagauuuuuuuuuuuuccccucggggugggugcgagggggaugcauccuagccugcccgacccggagcaagucgcgucuccccgccggagcccccccacccauuucuuugcugaacuugcaauuccgugcgccucggcguguuucccccuccccccuucccuccguccccuccccuccccggagaagagaguugguguuaagagucagggaucuuggcugugugucugcggaucuguaguggcggcggcggcggcggcggcggggaggcagcaggcgcgggagcgggcgcaggagcaggcggcggcgguggcggcggcgguuagacaugaacgccgccucggcgccggcggugcacggagagccccuucucgcgcgcgggcgguagguaccggcgccugcggggcucggcggggcggaggcgcccggcggcgcgggguucgggcucggcggccccgcacgcggcuccgcgccucccgcgccgcgggcucccggcgcccggcgcucccagaagagacaccccuuccccucccgccgcuucccucccccucgccgccagcccccccgccccuccccuugaugcccccucggagggaccgaggacuuugccaggggccugacuuuaauuuuuauaaccccuuucuuucacaaauuagggugcuggacaauuagaggacccgacccuccacuccgcuccccccaacccugucaccccaccccucccccuuuggacguguuuucacuccagagacgcucaucuuuaauuucuugauagcuacuuugaaaagcggaggggaguggugugugcgagugugugugcgugugcgagugugagugugcgagggggguggggugcaggguggggggaaaguugagaucggaucguucucaguaguuucucuuuucucugugauccauucauuucucgcucuaccuccuguugcauaaaaugaugcgcugaagagcggcuuuuuuuuuuucuuucccugauuugguuuuauaguggauguuaccaguuugaucgucucuuuggaaauacaauaucgcuuuuuuuuuuuuuuuuuuuuuuuuuuuuuuuuuuuuugcuauugcugccuauuccaucuuaaaaaaacaaaaccaaacccaacccaacaacaagucucccaucccuuccuccuuuccaccuuaaucccacccgcccccacguccccacccccaaccccccagucuccaaaaauccgauuguguuuucuccaaggauugggacuggauuuucugauugcgguuauuuccauguuucuagguuugugugauuuugcuaaaaugcaucaccaacagcgaauggcugccuuagggacggacaaagagcugagugauuuacuggauuucagugcgguaagaaagaacgguggaaacuaacaacagcugugaaaaaaacaaaacaaaaacccaaacacuucagcuagaaaccaguaggaaucuaaaggacaguaauaauuuuuaauuggcugaauccuugguaaauaugaaggucuuuuugacaaguuuuuaacuauaauuuuguggugugauggaagauucaggcuuuuuuuuuuuuuugaguuuuauuacuggccuucaauucccuacccacugauuaccccaaauaauggaaucucaccccaguggaaagcaaaaauagacaccccuaaaacuaaaccaccccuaaaacuuggccaugucugaacacugagacuacuaauacuuugcacacuacucuucguuuuauuuauuguuuuuggaaauggaaaauagaaaauaggagacccaguugucucuuuaaaguuuuaagcuaaugaugcuuuggauugguaggaccuguuccuuacaucuuaccuccuaguuacaucuuuuccuaggauucuuaaaacuaguauggauaugcugagcauacauucuuuagaaccuuuuggacuguuuugguaaauuucguagucguaggaucagcacaaagcggaacuugacacacuuguggaguuuuacggcuguacuugguccuucuccaucccuuugcuuccuuuuccuaaaccaagucccagacaugucaggagaaugaauucauuuuuaaugccagaugaguuugguguaagaugcauuuguaaagcaaaauaaaaagaauccacaaaacacacaaauaaaauccaaaccgccuuccaaguggggcucuuucaugcugcugcugcugcugcugcugcugcugcugcugcugcugcugcugcugcugcugcugcugcugcugcugcugcuccuccuccuccuccuccuucuccuccuccuccuccucuucuagaccuucuuuuggagaaauggcuuucggaaguuuugccaggaaacguagcccuaggcaggcagcuuugcagcccccuuucugcuuguugcacuuucuccauucguuccuuugcuuuuugcaggcucugacucagggaaggugugcauuauccacuagauacgucgaagaagagggaaaccaauuagggucgaaauaaaugcuggagagagagggagugaaagagagagugagagugagagagagagagagucuugcuucaaauugcucuccuguuagagacgaaaugagaauuuagugcagguggcacuuuuauuuuuauuuggguucacauaugacaggcaaauccuauacgagauggaaauggacauugccacguuuauggccaagguuuucaauauaaaacaaaacaacuuuuuucuucuccuuggugaaacuaguguuuuucuagagaggcugcuggccuccaaccugaaucuugauaacauuauggggacuguguuuguuccaaauguagcaguaguacugcuuggccaucuaaugaaccugaggaaaaagaaagaacagagugauaaugggggcuggggugggaucuguaauguuguuucucuuuuaguuuuaaguuggauggugauguauuuuacuaaauaaacccuuagcauaaacucuaagcuguuugguaacaguaugaaagaucuuugaggagcucugaaggcacaagugucuucuuuucaacuguaauauuucuuuguuucuuuuagauguuuucaccuccugugagcagugggaaaaauggaccaacuucuuuggcaaguggacauuuuacuggcucaaguauguaaauucuuuucuuaguguuaaguuaaauguucugggcuguuuauuuacucaauuguauguuuuuggcucuguugaagaguucugaaaaagucauugaauuuuagccuguaaucauacgguuauugcauuacccaucagugguauaacuuacacaaaauguuaucuugugcgauuaaaauuaggucuuuuuuuuuaagucaaggaaacucucucaaaauuccaucacuuaauuuaagagcaauuuucuaauacaguuguaaucaaacacaugaagauaagaccaguguuaacauggggaauaaauuaauguuuucuauuugaaaauaaggggaaaaaaucucuaacauucauaaaaugggaaaaucccuuguaaauaauaucauuuauuagguacuguauacaauuaacccuuuuaaagaaaugaacacuuaauucugcaaaugaaugcuauguaguaaaccauagcuguaaauagccucuugcuaaucuuagaggcuaaauaugaauucauuuauauuuaaaauacccuuuuugaugcuuuagcuguuuuuuuuucccuaacgauuuacuugugcaaugaauuuuuacuguauuuaaaguugcaaaucuggaaggacuuuuacguuuuauaaaugaaagaucuuugggugaugcuuaaaaaagaugcuagcacuauucacaaaggaaucugugugcacagugauuaucuggaaucuaaggagggguuuauuacagggcuauucgaauaucucuuauuaaaagugcagagugaaaauauucauuuaaaauguauuuuuuuuaauccaaugaauuucaaauaagaaaaaguuauacauuguugccugcuauccuuuaaguccguggcuuaaguccauuuaugcuuguuaaacagcugcaguauuuuaggaguucuggcaaugguauauaacaguacauuaggccaaguacuauucuuaagucagacugguaaauguugacaucuuuuaacugugagaugccaguggaauugucugucaacuaugaauauaauuuaacaucuuuuaauauucauuuggugcuauagcaaugaaagaaguuuguucacuuaugugauuuguauaauugguauauuuuuauaaaacuaauggcuuuaaaaguugcucauuuccaaauaaguuccuucuccuucuauugccugccuaaguuuagggaauuugugucucgauaacuuguuuuaaaaaaugugagaugcuucuuguauuuuuauuuuaguuuucuggugcacauugauuaaaaggaccauugacagacaauauguuuguguuuuacuauccuggaccugguuauguuuuccacuuagggauuugggauaguuuuuauauuaguauuauaucuuuaaauuucuguaugguauccucuaugcaacuuuuaagauggaaaauauuaauaugcauguuugauguaaagguaaggacaaguaucuuuugugggcaaauuaauuuuucauguuagacaagaucaaaacuaacuguuuuugacaguaauuuuuuuaugacuuaacuuaaaaauguguauucaguuucaaucuaaaaguagcuuaugucagacagacacagagauagacuacuuuuaaagucaaugcuaaaaaacuaguuugcaauguugugaaaauaugcauuuagaauaacuuaaguauauuacauuagauauuuaauaaaguaagguguuuagaaauaugagauuguguuacauuuaaaaagacaacuguaugucugauccauuuucuauguucacauuuaaauaaaguucuugcugugauguuuaaauguuuauagagaguacaggcuuaauaaguugaauauguauuaaugcauuuugguaagugaugauauaucaacacuuacacaguucugaagacaauaacacacacacauacacacauacacacauacacauacacacauauguucaugcaugcaaaccuggagagagacuucacucuuaauaagucauguuacacugcuucuaaugcauacacagugauuauuuugaagguguggaacuuuaaguuacguuguaccagaaaugguguuuucaggaccaaauguuuacuuguaaggguaaaaaguguaaugguccuuuuauucuggcagccugaaugagaaugcaggguauucauuucauguaguaugauggugauuauaauauguaggguacagauuggaguguucaguuuuccucuaucaagauaguauuugaacacagggcuguuaguuaagaaaacggguuguauuuccacuuaaaagaguuaaaucuuuuaaaaagcguaauacauuuuaaaaaucaugaauacugcauuuugcccuuuaauuggaaggaucaacuaggaaacuuuggagagagaaauaauuuucuaaauuuaccucaaguuaauauccauugucuugaguggacucagaugucccuuucauggauugcuuugaaacuuggauuuaggaaagaucuaaacuauaaguagacuguuccuauuugaaaaaucagcuaugguuuuucaaagugaggcaugguaauaauucaugcuuaaaguucccaauagcuuuugauuccauuaauauaggaugcuccauagugauuugcaaugugagaauaaaaauaaaguguggccauauucccuuuaaucuuucauuucacaaacaugguuuuuccuaccaccuuaagaaauggugaggcugcuagggagaauggaauguaaccugagcuacagccugacauucccagggagcauuuuucacaugaaaggcuuuugucaacccaggaaaggacuagcaguuuuuguuugauguuugcagguguucagcagaaagcacuaaaacaauucagccaugaugguucagagcuucgaugaccuuaacagggaaaauuggugggcucuggaauuauuuuuaagaaauaguuauaaccuauaugguaacuuaaacaaagggauuuaauauccguuauaucauugaucuuaaaacaaacuaaaagcauccacaugccuggaugauuggaaaauuauucucauugaaaaguaggauaccuaaguuaccaaaaaaagaaaaucaucuaaagagucuauaauuuauugaugaguauggacuuaauuuucugauauagcagaaggacaguuuauuugguuacuuuugacucuugugaggaaaagauaaacauccuagcuuugacaucuuuuuaaaaagucguuuuaaaguugggccacuaaaaugauacauucuaaagaacuuguuagaucaggucuggucacaucuguuacauguauuuacugcuggucuaugacagauacuacaucuuucucccuuaguuuaaaaguugagcuuuuuccccugugacuguuuaguuuuacugagguguucagguauuguuaaaagauugucaaaugaacgaguguuugaacaauuaagagcagcguuaaaacacaccacaucucuguugugggucauuuuuggaagaggaaaguauugccugaaauuuaccuaaguuagcuaaccuauauccacaugacaccaacauaauaugccaauuuagugaauucauugaggcggaaaaaaaucaguccgguggguaguuuuguaugauacagaaaauuaacguggucacauccugaauuaguuuugaguucauagugauggcaugaaaaaaaaauugguuuccccuuaaagauauuuguugaggagagcugcuuaauauuguguguguguguauaagugagugaaaacacccuuaaaaucguaaaugguauaauucauaaggguucuguggcuuuuuguaaagggcagaguaauuuaacagguuaaaagaaguacaguggcguuaaacccauuauguuagaaucacagaauuuuggguauagaaacccauuagaaauguugcccagugccuucauuauacaggcaaagaaaacugaggcccaagauaaggaguuccaaacugugcuuucuuauuuguuauuuuaaaaaacaaguuuuuauuugcuaauucucuauggcccugcaaauccuuuauuggaaauaaccuuggucucacugcugucuuucuguccuuuguacugcguaauggggcuugaggauuagugugcugauauuugugcauguaaaugcuucuguauaugcaugugccuucugaaaacuuuuuuagguuuggagcugaauuuuggauuauugaucauucucuuuugccuggucuucccugugacuguuuugcaugauguuggguaaaauaauagugugggugagcaugucacagugcuucucaguguguuagagaggugugcuguguaccuuauaccuguuguauuuuuuaaauccuaacaagaaccuaaugagaugcaaggauuacuacuauccuguauucauagcugaggaaacagagacagauguuaaacaacuggaucuuaaggcagccaauaaugaaauuagguuuuaaccucagguuugucuagcucaaaguccugaguucuauacacacacacacacacacacacacacacacacacacaucagacagcucauuuuugcaagauuauauaggcaaacagugugauauugaggcuucgcacgaaaugcuaucugugaucuuuaggguagauagcauuuuuaaaaaugugucuaauguuguaaugaugucaaccauauccauuauuuuucccgccuuuguauccaaauaaacuacccuuccaauuuaugacagauaucaaugugacuaaauaugucuuucucauaucuuuauuaguuuuacuaagaaaauacaguagauauuuuaaaaguugugcuuucauucuguuguaaguugauagucuacauggaugccaaugaaaacauguuuuuauguagcuaaucaauucagaauuugagguaaccaagccugauguauuaauauguaaaaaaauaaggaucuccugucuuuaaauauaaaaaaguuuugcaguucguuguuagaucuuugaaacuuaauauucaagaacaauacccucaauucuaucugcaucacuaaaauaagcaguuuugaagguuugauaugucuguuaccagacaugugcuuaaaauguuacauuuucuaaauucagaaggcagaagcaguacucuauuugacacugacuuaaguaaauaaaaugcauuaaacaagcguggggauccaagaacuguugaaacugaaaugcuuaacauuuuugacagcaucagcaaauuauccuuacccuacuauuguaaugaggaaaucacuuaaauaacagaugaacagccaagucacauaaacauauauaauagaacuauguaaugaaaguuuaugcuguuaauugcucgaaucugucuuaaaugcuuagaaucauggagcaguaaagacugucauauaaacaguuuuguuuugagcuuaaaauuauuccuuuuugcuuucaucugcuaugauaaacaaaguaauuuuguaagcuuuaaagaucaaacauuuacuccuaaugguaaacuacauuuuauauuggaaguuugcaaccucguccaagucauagaguugaguccugguggccccaggccugugauuuucaacguuuaguauuaugaugcuauuuagaucuguucccauaagccaagauaacagaucuuaaguugccuaauaaggaacaugguguguuuugaaauguucuucaguuuacaagucuuaaaccaaaauguucuuggccaaaccuuuagaaucuauauguaaguugaauaagucagauuuuauacagacauagcaugaaaaugaagcuaaguaggaacagaaaaaucugcccuuucuuuauuauuuuuuuuuuuguauuuuaugagcuauuuuuuauggccagguguuuguucuuccaaguuaauuagauagugcuaaguauuagaaaauguaaaauacauuacagauuuuuuaaaagguuauuuuuguuacugguuucuuauuacucuggguaaaauuuucacaacugaccaccagguuuauuagcuuauaugugagcuacccauuuuguacauucgugagccaauugacuaggaauaagguaugcacauggguuuuauguggauacuuuugacccauaucucucuuaauacuuaggagagagauauaagagaaauaauaauuuaaucuuuggagaagauuaacacuuuguuauaaguuauauauagguaaauauauauauauauauuuauauuagacuugcaggaauagugaaaauguugaaaagguugucauguuuacuuucauuucaaagauaaaggcccaguuaaucagcauaucaaauacccagguguguuuaaaaucaguuuaugugggugaauuucagggcuguaagaaaguauuuuauuuaaaggugcagccacacgauugauuguucaaaugggugcuuuuguacuuuugugugacaauuaacauuuaaugaaugacuuucuggacuggcauuggugguaauuacuauauguaguuuauuaacugcaauccauuguuggaugugccuuuauugauuuguuuugcaaacaccccuucacaugugcggcaguauuugugcagccguauuuguacguuacuuuuuaaagaaccuguuucacuugcugaugcugacauugccucuaaaaauguuaguuuauaaauucucaugugccagaaugucucuuugauccaaguaauuuuagcugaaauacaaaauccgucaacuuuucugcuauaaaaaguuugcauucaaauccucagggaaucccaaaguaaugacacaauauuguuuuucaaguaaauaauuuauggaaauuuacauuuauaagagacuuuagagaugcucuauuuuuuagguaaggagccaagguucgggaggguuaaaagucuuuugcccaaaucaugcaguugguuauuggcuguaauaggacacaaauacacauguccugacccucuggucaaagaccucaugcugcuuuuaauuaaggcuuggacucaauucgaugguaccaacuguauauuucuuaagaagggaaaaauguguauaaucuaccauuucugaaaaaauuauuaaaaauugagauugugaaagauggacguuguaauccagcccacuugucaucacguguucuaauuuggccaaggcaguugacaaauaacuguuaaaauguauuguguuauuaaaaauaacaaaguaagacccaugauuaaauaucagggcuguaauuuaaucuugggggaucuggugcuguucauaaaccauuuggcuuuuuucuguaacggaugacgucaaaauccagcuugauugaauuaugacccuggguuacagcagcaccugcuggugccuuuuuacuucauggccugucagcauuuccauuacaaacuuuuuucucugacauuuuaaacuucaaauaguuaaacuggacugaugguuggcauauaaacuuucugcuccuugggaaaagaccacuugcucaauaaaaacagagaagguggugacaaagccccauuacaggauaccccuuagaauguucugcuuugcuuuaaucuuccauucauuuaaacauucuuuugggggguacuuagcugaauugcaaggcauccaaauggaagguuuuuaaucucaaauuucccaugugaagacuuaaguaugggguguuuacaggacugguaaagugcaaaaagaccuagcaucuaugcagguuauugaaacucuggacaauccaguuuucauacaguguguaaaaugcugaggagcaagccaugaaaaacaugcaaauuggcauaccuugucaguaauugcuuuuauauucacuuaagaugaguaaaaauugauaaugauuaugguuagaaaaguaucuuuauuuauauuuauaucuggagacugguagcauagcuucaguuuguccccuuggguuuuaauauguugggaauggagaugggauguuguuugcaucuagcuagucagcuuuucaucuaucuagucuaauucugauugauggaucaucauauauauauauguauauauacacauauauguauaaauauguauauacauauauaaauauauaaacguauauauacauuuauauaaauauauaaauguauauauacauuuauaaauauauaaauguauauauacauauauaaauauauaaauguauauauaaauauauaaauguauauauacauauauaaauauauaaauguauauauaauauauauauauauuuaguaccugcuauucucauaucuccauguuagcaauuagaggacauagagggcuuuauggaagagagaaccuucucucagagggcauauauucuaacacagggguguccaauauuuuggcuucccugggcuacacuggaagaagaagaaucaucuugggccacacauaaaauacacuaacgauaguugaugagcugaaaaacuuuugcaaaaaaaccucauguuuuaagaaaguucacgaguuuguguuaggcuguagguuggacaagcuucuucuaacaggagaaaauagaaaaguaaaaaugugauuaacaucuagcauugggaagacacaauaaugugggaguuuagagaaaugaaaacuuauuucuuucauggggaaauuaauaaugaaggguucauggaaaacucaauucuaauccuugaaggaaugguagaauuuugacaaguagguagugagacugagcgugcauaucaggaucacugugaaccaagcacagaugaaagaaacuggaaaggguagauuaaagagagcucccagaaagagaaguuucuuggcucuaaaguggagucaacucuggucuagacacaugggaugauuuccaggcaaaaaccccugucuugguugccguuuauuuucuugacugaguuugcguuucacucggggguguuaccgauuauaauccaguuccauccaaaaguauauguuuuuaaugguagugucgggauggaaauugaagauuuugugucccuacuucccaaaauucuuccuauaauaucacucagcaguggaaacuuucuugagccaaaugaagcugcuuuggagaaaauuguucauguagccaaauucuggaaaucuagguucuuuugcaauguuugcugguaaguagcuguuucauauugaggaagugguagaaucuuaaaggcugcaccucaaaacuaaacaaaaucgaaacucaccaguacaauucaagagggguuuucacauuuuuuaaaaaggaauacugcuguauuuaaaacauuuuaagauugcaaaaauucaucauuauaauuuuuauuaucaucacuggcaucaccaugaccagugucacauuguuuggucaaaagcuggaauggaaaugugauaguuaucuuugccauauuauauauugagaaaugcguuuaaaacuuuuccggagauaccgugaucuuagcaaaaacuaauguaauauuuguaaaaacauugugaaguggccagauauaccuuuuaaugaaacugaccagaaguacaucacaaauagaaaaauacacguguguguguauguguauaccaucccuucccccaaauauuguucagauuaaagugucuuucucucugugaccugcaaguaucuuaacuuagcauguguguccaauuuccauagugaagccaaaaauucaaaugaugguugauauuggcuuaggaagaauuuauuaaugaaugacugugcuugguauagaguaaaaaaaaaaauuuaugacaaagaggauauucuagacucauguaaaagauuucaguuaagaaccuaugaauuccucaaccuuuuucuucacuuuucaaaaaguaaaggauuuauauuggaaauauuuugcaacccuacaaccugaaacucaaagcuuuggucagcaggugguaauaauauuuccagguugaauauccaauuucauacauaacccaauuuguaaguuugaaaagaaauauuaaacgaugucaguuuuaaugcuuguuugaauaauuguucuuuguuaugugcccucuuggacauuauuguccacuagugccccaaaccauugaaugcuuuucuguucucuuauggccacugugauucuucaaucuaguuacuucuaacugcaagauuaauuuucuucugacaucuaauuuuccccugauuuuauuaacaucuuauuauucuuuuucuggcucauuuugaacaauuucucuuuuauaugggguguauauuuguagugucccacuuguaagggaauucuacacuuuaauccuuaguaauuuugguagaauugggauaagaugagagauaguccauaauuguuuaaggcuugauuguuuaaagaagguugaaagcuucagaaaaguggaaguggaugaaugcaugccauguucuuauuauuuuuucagugugaguguguuucacuggaguaacgauagaguuauuaggaauuauuaccuuuaauuuacuuaugugcacauucauucguccacucauucauucauucauucauucagugaaaguuuuuuuuuuuuugagagccaagauacaaguuauagugcuagaaauuauggugcuacaaagaacaacaaauuucaacuucagcacugggacauuauguugcaguuguuaaauaaaaguucuacaguaauucaaagaagguacuuuugaaauaaaugauguuggccaggcuggguggcucaugccuauaaucccggcacuuugggaggccaaggcaggcggaucauuugaagucaggaguuugagaccagccuggccaacaugauuuaauuauuuuguagaaaucccguuucuacuaaaaauacaaaaauuagcugggcgugguggcaggugccuguaaucucagcuacucgggaggcugaggcaggagaauggcuugaauccaggagguggaguuuguggugagcugaaauugcgccacugcccuccaguauuggcgacagagcaagacucugucucaaaaauaaaauaaaauaaaauauguugaaauaugcaaguauacuuuuucaaaggacacuuuucaaauauaaccaaguacagacuucacauuucuaacugaaacggaaauccuaaaaucucuguauauguguacauguucuaugugaauauaaaggaaggcgaauggauuugaaugcuuauggaaauuggcccuugaaguguaguguuaggaauguacucugaaauuuagugucagagguugucugggaggcaaugagaauuaaguuccauucguccuuuuugagcagaaauuaaaauuuuggauguguagaugguacucauuuacuucuaggacacuagauauacaugcuuaucuuuuuuauccccacacuugaauuauguuaauauuuguguuuaaauugauacacaguaaaauauucuuuuaaaauuaaguagaugauuauugagcaucuaccaugugucagguaauacuuuggcagcucuauauaaaaugaugagcaagacaggcauguuucugauguugccuacauggaggacacagacauuaauggauaaucagccaaagaaggucaaguacuacauuugagagguguguggccugagaagaguuugcaauagggauaucugaucaaggggagcagucaggaagggcucagagaucagcccaggugaacuguggucuuacagaugaggaggaguuaaguggauggagguugcuuggcugacagguagggcaugauuccagccgcuguggcugguggggguugguaggugucagaucccgcaagacugagccacagggagccuugacagugugcugcuaaucagauuugugucugggacauggacccaaaggggagucacuguggguggcccacaccaguugugaaguuuuugcagaaguuuaggugagagacaggguugcugguucuacagugugggugguaaaguuggagaauuaacuuuguagacuuuauuugaaaucuguaccuuuaggucauuggggagcauucauaguggcuacuuguuuuuuuuuuuuuuuuuggugaaacuuccuauaacuuucuaauacuugaaaaucuaccauacuuuauacauuccgacaguaauuaugagaccuaauucagcugugugauagccacugccuuuuuagcaaccaagcacuaacuagagaagugcucuuuuauuuucugagaaaaguuagauugaguuugcaauucugcgaggguacagggguggaagugggucuuauugaauggucuucaguaccauuuuggcuuuuuuuuuuugagacggaguuaagcucucauugcccaggcuggagugcaauggcgcggucucagcucacugcaaccucugccucccgaguucaagugauucuccugccucagcuuccccaguaguugaaauuacaagcaugugccaccacaccuggcuaauuuuguauuuuuaguagagacaggguuucuccguguuggucagacuggucucgaacucccgaccucaggugaucugcccaccucggccucccaaagugcugggauuacaggcgugagccaccgagccuagcccuguuuaggcuuuuuauagccuauguucuuaugagcaguaaacauuaugaugguuuaguuagaccuguugaauugaauucacuucuccugccuguggucagguaucagguagcacagccacagaaguuacugaaugucuuuguugguggacuuuaggagagugguuuaauuuaugugguauucuaucugggauugcagcaguauuguuagauugcauuuugucacagggaggaaauuaccugguaacuccugauuaggaacaaaaugaagcuuccccuuuuuacaaauccuggcuaacauuccauuuggcucucuucuguugaccaccucucucucuccccucccuccucacuccauuuucucaguuauuuuauuguuuacuauuggaagucaccucccaacucaggauacuuguuaguccauuuuaggaaaaauaucaccauucuuucacuauuauucucuguugaaguugaagaacagaauauuacuuuuuuucuuuccauuauugguuacaccagcuaguuagagacuugggguaauacugugggcauggguuggauccugauaucugugucaguuagugagaguugguucuaugacccuagagcucuuuguguccuucaaacgagggugcugaaacaagacgaacauagaacugucuauaccaagcaaaaaacuccugaaagcacaugcccacugcaggugaauugguagcauaguguggagauaagugggcagugcuugguccuguuucugccuccuagagaguaccucucagcauccagggaugcuuuaguaacucuuaguuaaaacgaaaugaacuauaauuaauuaccuuucuuuugggagggacacagagaguuucaacagcaucuacaaugcuuuuuuuuuuuuuuugaaaagaaaauaugauagaauauuaagauugacagagcuggggauggguuggaggcugaauuaugauguguguuuucuuuaugcuugaauuauuucauaauuaaaaacaaaacauauaauaacaaaaaaaaaaacacccucuaccucucauucacauuccccucuggccauagccucuuucuugacuuccuuccuagcaagacuuuuguuaaguguuuucuacacaggcugcuacugcaugcuucaaaauuuaaccccaagcaaauauuagaaaacauauuuuaucuuauaauacuugauaccuacagaauaaucuguguaacaaauguaaguugugaagcuuaauaauggagugaacaucuaugaacccaccaccaacauaaguacuggagcaaugucagauccauuggccggccuguggguuuguucccuguccaccuuccccuaucuuuccugccagagagaaacauucucaugcccuuuuuaaaguaguauugugacuggcauauguaucccuaaacaauacuguauguuguuugguuuugcuuguuuuggaggauuauaaaacugauagauuguuuugugcuacuugcuuuuucacuugguauguuauuguccauguuguugcaugugguguauguuaauuuucucugcugaugaauagguuguaguuuauuuaugcauguuccaguugaugaaccuuuguguuccucuuuuuuggaacuacaaacuuucuuguauguuucucuugaugcacauguguaagacuuucucugugggguauaugaguggauaucuaugaguagaauuguugguuuguagaguuacaugaaaguccagcauggcaggauaguguccaguuguuuuuuaaagauucuuacugaucugcacucccaccuguagcauaaaggauuacuauuggugcagucuacugguauaaaauagaaaauguaucccauuauagucuuuuuuuuuuuuuuuuuuugaggcagggucucacaucucacucuguugcucaggcuuggagggcaguuuugcaaccucggcucacugucuggucucgacuuucugggcucaaguuauccucuugccucagccucccggguagcaggaccacaggcacacacaucucacccagcuaauuuuuguauuuuuuguagagaagggguuucaccauguugcccgggcuggucucgaacuucugagcucaagcaauuugccuuccuuggcuucccaaagugcugagauuauaggcaugagccaccacacagggccgcauuguggucuuaauuugcauuuccuugauaauucgguuaaacaacuuuguauauauuuauuucagaucauucauguccacucuguggaaucuaccccgcccccauuuucuauuggguuauuuguuuuuucuuauugauuucuagguguucuugauauauuuuuggaugauaauuauuagucauacaugcugcaaauaccuucucuuauuuugugacuuuuacucucucuaugguagcucuugauaaaguccuuaaauuuaagauagucacguaauuauuuugaaggguuggaaaagccuucuuaccccaagguuguacauauauucucuuguauguuuccucugaaaaggauuugauaauuuugccuaucacauuuaaguuuuccaugcaguugggauugauuuuguguggaaauccauucacacguacugaaaaguccauccuuucuccagucauucacaauacuauuucugugauauuuuuaguuccuguauuuguggggucuuuccuucugggccuuuuauucuacuugguuaguuuggcuaccuugccucgguaucacauuauaauaaauguuauaacuguauuuuguuguuuguuagguaaagcccuuccuccccacuuuucgugucccauauguacacauuugacuuugggcuauuguggagccugaguucuucuacgugaauuuaaaauucagcuugucaaggucuuugagaacccuuugaggcauuuuuauugaaguugcauggaaacuaaagaucaauuuugggagaauuauuaugcauuuaaugauuaucucuacucauuuauaucuccauuguuuuaggugucugauaucucaaaacaauucuuuauaauuuuuuagcuguaauuucguaauuauaguuuuauaauuuucuccaugaaguuuuacauuuucugaugauuuauucuucaguaccuuauuuuucuguuucuauuauuaccaguauauuuuuuuaauuauucaaauuauuuguuacuuguauauagaaagucuuuuuuaaaauuuuuauuuauuuuuuauuuuuagagauggaaucucacucuguugcccgggcuggagugcaguggcgugaucuuagcucacugcaaccucugccuccuggguucaagugauucucuugccucagccucccaaguagcugggacuacaguugcccggcaccacaccuggcauucaauugauuuuuguauaucaauuuucauauucagccauguugcugagcucucuuauuaguucuaaaaaugucuuuguguuuuccuuagaguuuuuucuguagaucugucacaucaugugugacucaagacaauuuuauuguuuuuuccuuucaaaccccaauacuuggccuuuuuuuuuuuuugucuuuacugugcuauauaugaccuuaaguacacuguuaaauaggaauggcaauacugauuaucuugucuuauuccugauuuucaccaugaauagugauguugauguugauagauacuugauuaagaaaguuucauucuauucauauuucaugaagaguuuuuaucaugaacagguauugaauuuuaucaaauacuuuuucuacauaaaauuaaaugaugacuucuuuauuuccuuuaaucuguuaaugucgugagugacauccguauauuuuccugugguaagccaccuuugcauuuuguggaugaaauuaaugauguagcuucauuacucuuuuaaaaauauuguccuggacucaauuucaaauauuuucuucaguauuuuuacaucuaugcuuacaaguaagauuggcauauaauauuuuuuuccuccuacuuucuaagucuaguuuugucuacaaaguuagaauaaggaaguguucucacucuguauucucuggaauagucuuaaauaaggaugaaacaaucuguucuuugaaauuaggucaaacuuaucuguaaaauugguccuaguauaagaagauuuuaagccacugauauaauuuuuaaauauaauaauauugagagugagagcuuuacuuuuucugcagauacuuuaacaauuaaauauauauauaaacuuauauggauguguguguguauagauguguguguuguauacauauauauguaauauaugucaguuuucucucuauuucauuuacauuuuaaaauuuauuaccauaaaguuauacaaagguauucucuuagcuuuuuaaucucugcugacuccauaauuuucauuuuucauucauaacuuuauuuauguauuccuucuuuuuuucaugaucaagcuaauuugaaguuuuucuuauuuauuacucuuuucaaaccaacuuuuggcuuuguggauuauuuuucuuguguguuuucuacuucauuaauuuuuaaucuuuguuauuuccugcuuucuauguacuuaggcuuauuauucuguuuuuuuuuuuuucuaaauagaguugacuacuuagugcacuaauuuaucauaauuucuuuuuauaauauaagaauuuaaggcaauauaauacccucugaugacuguggugacuguauuacauagguuuuaauuuauuacauuuucaucaucuuauaaguauuuuaauauuuacaguaugauuucuucuuugauacuugcaauauuuuuuggugccuucaaaauuuuacaaaugaauguauuacuuaucuuuuuauuauugaccucuauuacaauuuaauuguugucagagaacuauucuguauggcaacaguucuuugauauuuguugaggcuugcuuuguugccaauuuugugaaucaguuuuaaaaguuccauugugugcuucagaagaauguguacucuaugaauucagggaucuauauguguccagaaauuaaagcuuguugauuguguccuuuuuuuuuuuugagauggagucucgcucugucucccaggcuggagugcaguggcgcgaucucggcucacugcaaccucagccuccuggguucaugcaauucuccuuccucagccucccaaguagcugggauuacaggcgugugccaacacacccagcuaauuuuuguauuuucaguagagacuggguuucaccauguuggccaggcuggucuugaacuccugaccucaagugauccacccaccucuguugauugugucuuaaagucaucucuacauuugcuaauauucgaaaucugccugacauauuuguuauugagaaaaguagauugaaauaauuugcuaugaugaugaauuuauaaauuuuucccuguauuucuauuuugacuuuauacauauugaaauuauauuauuacaugcauucauuuuaagaauuacuauauuuuccugguuaauuaaacccuuuauucaguuuguauguggcuauucucuuucugcccuuuuaucuuaaacucuguuuugucugauauugguauaauuauugcacuucccuuuuguguaguauuugucuauauaucuguuuuuuaauuuuuuguuuucaguuauuccauguugcuauguuuuaaauaugcagaguggcauuuuauuuuucuuaguauucugaugguuuuauucuacuguuuucugaauuucccuguggcucauaagaaguucaguaucuuucugauugccauucuuuucuaguagaucuacccuuuucccugacuguuuuuuggcauuuagcaguuuuacuguaauguaucuauuugugaauuuuaaaauucuauuuggucuacauuguucuucaugcaucuguggcuucaugucucccuccaauucagaaaaauuaucagcuuuuauuuccuuaaauauucugacuccuuuauucauucuguucucuucuuuggggauuccgauuacaugugugcuugaccuucuuuucuguccuucauucucuuaacuuuucucucauauuuucaguccccuuguaucugcugcauucuggguaauuucuuuagacccaucuuccaguuuacaaauucucccuucagguuucucuaacguguuaucuaaugcaaugauuaauuuuuuuuauuucauugcuuacuuuuucauuucuaaaaguuccauuugguucucucuaaauuaugccuacuaauuuuuaaauacuuucuuauuucuuguucauuuuugugauucugucuuuaaguucuucuuguauuuaugacaguuuuuguauuauauguauuuauuuauguguauaaauuuauaggguacaaguacaaaacgugacaugcauagauugugcaguggucaagucaggacuacauuguacccauuaaguaauuucuuagccacccgccuccugccccucuaccuuuccggaucuccguugucucucugcccacugauagacuacauccaugucuauacauuuuuauuuuuauuuuauuuuuauuuauuuuuuaguuuuugaggcagaaucucgcucugucgcccaggcuggagugcaguggcaugaucuuggcucacugcaugcuccgccucccugguucacaccauucuccugccucagccucccgaguagcugggacuacaggcacccgucaccacgccgggcuaauuuuuuuuuuuuuuuuuuuguauuuuuaguagagaugggguuucacuguguuagccaggauggucucgaucuccugaccucgugaucgccugccucagccucccaaacugcugugauuacaggcgugagccaccguaucuggccauccaugucuauacauuuuuuagcacccacuuaugagugagaacauguaauauuugccuuucuaugucugguuuguuucaccuaagauagugaccuccaguuucauccauguuacuacaaaagacaucauuuuauucugguuuuuuuuuuggcuucauaguauuccauuguguauauaugcuacauuuucuuuaauaauuguaaaauagacuaugcaauuuuauagauauuuucuaacaaauccaaugcuuaaauuccaugggcuugagguagucuuguuauuucuacuaacccucacuuaagcuucuuuguuuugcuuuugugagaugcuuaugaauucacaucugguggguauugaaucuaugaaaaucugggagucuaaagugagaauacuuucuccagagaggaauugcuuuugcuucauagucucuuuccuacucugggaguccuagucuucuuaucacagugcugauacuggcauuugcucucagagcaucccugcuucuugugccuaccuuucaguauugaaaacucaaguuuuguuuuauuuuuuggugcuuucaagauuuccuuauuucuugcauuuauacuuuuggagaauuuuuuuuuuuuuuaauguugaacauugguuguuuuguagugugagaggccuuggguguauugucauacuuuuggaagcagaauucugauuuacucuuuaacccuuuucagucugacuucugucaccauuuauuccaaugaaacuaguugugcuaagauuaccuauaacucccauucuucccagcaacuuuagagaaaauguucuuuuuaaaaaaauggaaacucugugcuucuagauucugcacaacacaguuuccucuccuaguguucuuucugccucucuuuuguuggaagaggaaauguuggggaucuuaccugggcuuucuuuuucucuucuauugagaggcaguuuggugcagugccucaaucuggaaucagacugaguuguuaucaucugguuauuagcaauaugaccuuguuuucucacuguaaaauggauagaaauaggguuguugggagaauucauuaacauaacacuugccaugcacucagcccauuucuaacacauaguaggcauccaguacaugucuacuuuuauucucugguacauuaucuucuuaagucaucucuuguuuccaagaugacagcucacguauauauugcuccaguaugaucugugcaucucagagucaguuuguagagccaucuguauguuauauuugauuuucuucugucuccuuaauguauaccuucccuaggcuucugcauauaggaaaugacacugccaugcaccuagaugauuaaaccaguuccggacacuuugaccuuaucauuuguguuaccaucucacaugauaauugugaguugugcucuccacaucugcuuucaccaguugaguucaagacaccaucauuucuugccuggucuacucuaguagccuccuaaguacuuucugcacuuugacuucuucccuguugaauccauauuucacagcaaccagagugauuuuuuaaauaagaaagucaaacagagcaugcuuucucccagcuucaauguuuuucucauagugccuagaauaacuucuguucuccuuaauauggacuugagguaccucuacaaccucauuugguuuccuucugcugcuguauacuguuuggcuacauugggauucuucuaggcuuuggacuuugucaagcuuuuucuugauucagggccuuugcacaugcaguagaacacaucuucucucacucugcguggcugauuccauucagagcucaucugaaaugccacuuucucacggcgacuuucuuuuauuuccuaguuuaaucaagacucuuugguucagugcgugcugaauuugcuuaauaaaugauuccauaaacauacauauuuugaauagaaucugcugauuaauaggaaugauaguucugugagaucaugcucauuuuaaauuuagucauagugucauuggaaaccacuacaugucuuuucuauucauuuaaugaauuuucaaggucauaaaaauuucugaugauauuauaauuuuugcauuugcaaauacacuuugcauaguauuuauugcuggauaaaauauuggcccaaaucagggguuggagaacugacauucacugagcaccauaugucacguucucuuaccuuaauaucguauguuaggcccugaaaucuaguuauccccgagucacugaagaggagcugagauucagagauuccccuaggcuggccaaggccauaccuuguggagggcacagccuaaguuuaguccaggaguuugaacucuaaggagagaacucuuuccauaucugcugccuuauuucuucucuaagcaaacuccuuaaguucacaaaguucuuucauguguauuacucauaauauguaugucaaguucuagagagugcagggcauuuuugacauuuuauuuuggaucaagcuuucauucacuaauuuuuuauuuuucugagcaucccuuugagguccuugaauucacggaugagaaaaauuaaacaaucagugauuaaguggacucucugugaaguuacacaauggaauauuaaauuguugauggauauuuuuuauuagccagagaaagaaaaaacgcagacuuuuuuuuuuuuuuuuuuuuugagacagggucucacucuguugccugggauggagugcaguggugugaucacggcucacugaggccucaaucuccuggucucaggugauccucccaccucaaccucccaacuagcuggaaccacaggagugcaccaccacagcuggcugauuuuuguauuauuguaaagacaggguuucagcauguugcccaggcugguccguaacucguaggcucaagugaucugccugccucggccucccaaaguguuggaauuacaggugugagcuacugugucuggcccaaagcauuuuuuauuccaguaguugugucagucuguuuucuuucuauguauguauguauaauuuauguaucuauguaucugccugucuaucuaccuaucucugguuaaauauguuuuagaaaaaauguaacuagcacaacuaggccuggacuuauagauauuauuuaugguagaaggcuaaguuguuuauuuuuuuaaguuaauuauuuauaaagaaaaauauuaaccauauacaaguacauuuaguacuuaguuauggcaaaaaucaagaaggugaaauagauauggaaaaugugauugggugaguugguuuuauuggacugguagggugugcccuuggccaaaccaaaggccagaggguacaaggaagucagggggacacacugcuggggagauagagagggggcugcccaguugugaggggaacuaacuucuuguccagaacuucccuagggccuucccuggcucuugccuucuuugcuguauauuuugguuacuggcaggacacugguucaaauauacauuuccgugguuugauuuuauaaagcuaaaaaagccucaugcuaauauucagucucuuauguuaugaauguuaccauuuuaccucuuagcuauauagguaucuauaaaggacauuuuuuaaaaaugaaaaucauccuuccucaguaaagaacuagagaauaaacauguuucugaaaguagaaugauguggacuagagcaggggucggcaaacuuucucugagaggggccaaaugguaaaucuuucuggcuuuguaaccacagacucucuguugcaaauacuaaauucugcuguuguagcaugaagccaguuauagacagcaaagaaaccaaugagcauuacuguauuuuaauaaaacuuuauuugcaaaacagacaguaguuguauuuugcccaggggacuguaguuuguagaccccuagaugaaagaaauguaucuuagggccuccccucuuagcccuuuccaucaucagcaaugugaucuuggacaauauacuuuaagucuuaaugaauuuauucauuugaaaaacugacauuuuauuuuagaucaggcuuuucauucacuaauuuuuuauugcucuggacaucacuuugagguccuggaauuuacagaugagaaaaauuaaacaaugaaugaggacaguuuucuuguaugagggauuuuuguuuucuucauauuuuuaauguguuuaauauacuggagugagcaugucuuauucuuguuaacagacaagcuaucuaaaaauuaaaacacaaacuaaaaguagaggaagauuguuaugagaaacaugucauguaugugaaauacauuuuauaaggaauagauuagauucuuuauggaaccaggauggguauaaauacaucacuagauaaauauuaaguaggaagaucauuauggacaaagauuguuucuuaggaauuuugcaucguauagcacuguguuagacagaguccuuaacugauuauuuuuguagcauuuguuuacacauucacuuauuaauuaauuuugccaauguauugagccaucuauggagauguguggaggucuguguugaaagcuugagauagaaaaaaugagaaauaaaauaguuuuggaucucgaggcacucacauugaaggagauaaacauguauauaaaauauuauccuauuguaugauaaguucucaauuagaagcauguauguauagggcaccacuaggaaaucuguaucauuggaguagagggaagcuaggcaagagaccugcacagaguuugagcaguugggucuugaaggaugaguagggauucuuagacaaaagaagauugaaaggcagcuugagcugagggaaaugucugugcaauugugaacuuuacaaaucauagguaguucuguaagauuauaacuggagucaugaagacaggugaaggaugggauacucaaaguuuggcuagggccaugcaaugaaagccagggaauuugaacauauucagaaccauggaaugcuuugggaaucuaaugaaagauaugauacauuucuauaggaaaaucaucuuacauaaaaauuucaauauuuugcuacaguuuuaggaauaaggauguagugaucacuuuaugaacaguacagacuuuuuauaugguucccuucugaaaaaaaaaaggaguucacagauagacacauacuucaucauccugcuugaugguggcagcaaaugcucuggaugcacuuaugugaaguuuaucaugacuuuauuacuuaagagccugggaguauaugagauugugccauacuguuauuuauaauuuccucaaagagauggcuaggcaugaucagagaagccuucuuacugguagauguccacauaugucaguugccuaggcaugaucagagaagccuucuuacugguagauguccacauaugucaguugccuaaaugcuggagaagucacguggcuucggauagaauuuccucauuuguaagauggugcuccucaaaggaccuaccugccauuagagugguaaggauugaauuaacucuucugaugacagcacugagcccuaaauuuagcacauacuaagagcucaauaaauguuagcaguuaauacccuuauuagaauuaugaaaagucgguaauuucauucauguauguucauauauggagugcucacaaauacuugaauucuuuuauugaacaugugaguuagucuugcauuacgcacugcauauauguccauguauuucuggaucaucaugggucauuuguuuggaauaaaacuucauuuacggaaaucgucuguacagcccugguuaauuuuuucucugugauggguugcauuacauauuuucuauauaaaacagcaauggugaagauaaguuaacuaaugaauauauauuauuaugugcuuuuauuuuacagcuucuaauauucaguggggaaauuuuucuuguuaagagacaauggcaaggccaguuggccuaaaauuagauccagcagcuguguuuugaaucaaggccccacaugugcacuuuauacuccccacccccugcgcugggcuugucugcuucuuuuucuugcuucaggaggcagcauuuuugggugaauguuaacauucauguuuuuccuaguacaaccagaaaggugcuucuguuuaauuguaaggcagguuuauuuacauuuacggaauggaaaaaaagauuuauuuaauuauuaauuuuacaaaaccacccuuuagcaccaagcauaaaacuuuggagcccaaaucaaggcacuaggucacuuauaauuugauuucuaccaaaauaaguuuuuuuuuuuuuaaagaaaaaacccuaugauaauuuuuaacauuuuugacagcuacaaguaauuuaaguuguguuuuaucaguuuauauucagaagccaauguuaacugguguuaauuuuauagguccuaguuucuuuguauuucuugcccuacuguuugguuaauaaaccuuuuuuaaagaauauauucauguacacacaacauuaucaugauucgguuuaaguauccguguuuauaagugcacuucauuucaccuaauuauguuauuuauucauuuacacauuagcaacguacuacauauuccacuuuuacaggaacuuauuuuaauuauaccuacaguucuguucugcuccauuauaucauagaucaagcugaauaauagcagucuuaaaaggcauaugcuaaaagugauuaugggucauuaaggccaaauuaagguaacauuucugauagccacaagcagaagucuaacuuacaauuacuuuuuuuuuuuuuuuuuugcuuuggggaacguguucuaguuggcuuugauguugacggucucaugguugaaugccuaguggguguauggauugauccuugaucagacugauuuuuuuuuuuuuuuuuaggggggagauauauacaaaccauacuuuuuauuuauccagaaaucuguauuuauccagaaauagucuauucaaugacuuuacugccauauuucucaaaauguaugcuuuuucuuuagcccucucucuuccugccugccauuaagagucacacaggcaaccaaucuccccaucuaggaaagugaguacuagaaugcauuaaagucacuuuuuuauugaucauuagcauaaagccucauugugccauuggagagugaccuaaauaaguauaucacauccuuucaaagagaaaugccccauggaaaccauaccuaaaaacgauaacaauaacuaacagaaucugcguuuuaaugaguugauuuuuaauucuuguuucgauuggcccaauguaaucuauuaagaaauuaaagggcaucuuucaagcuuauccauauacuuuuauaaucaggaugugugacucuaguguuguuaauuuuauuuuugagaaauacuuagauuuuguaugggcauaaguaauucaaaauuauuuuguugauuuuauagacauuuuacuagggagauccauuguuguuacuuauuuucuaguuucauaauugcugauuaaaauuaauaagauucaaaugggaaaaugacaguagaaauauuccaauuuagaguucuuaguagguuggcuuacuuuuugcuggauuuaugaugauuuuccuacauacucagauuuggaagauacagcaucauaaaauaaacuguaguuuauauggaaccucuacauuuugguuggagauacaaguuucuacuggcucagaaauuuuuucuuuuaguuuuugauuuuuuuuagagacagucucacccuguugccagacuggaguacaguaguaggauccuagcucacugcagccucgaacuccugggcucaagugauccuccuaccgccgccugcugaguaucugggaauacagguguaugccaccaugcccagcuaguuuuucauuuuuaaacuuuuuguagaaauugaaucaaacuauguugcccaggcuggucuggaacuccuggccucaagugauccucccaccuuggucuccccaaguucuggcauuuaaagaacucagcccagcucauguaauuuuuaaauauucccacuccaugugauuacuucagucuggacaugucagacugaacugucauuucaguuuacaugucaauuugucuuucauguaaaaagggggaaaauaggaauauaugcuuauauuuuguuguaucugcauuuaaaaaaacacaagaaaccaaagugguuaccugaguagggguggggaaggcaguaaagaauagugugauggggaugagacuuccaaauagauaacuuuuuguauuauuuugacccuugaaccaugugaauguauuuucucuaaauauauuuagauuuguuuuugaacaagaaaaaaauugauagcagcuaugaacauuuuuuucuuuuuuucauuuuccuccuugauauaaguuacauuuuaauugucuuuuggauuguuuucuucagaauuuuaaucauaaaauaaaugaaauaaauaaaugcaaucaucauuccauuccuaucaguaauuucuauuaguguggcuuuuucuguguuuguuuuugucauuuagagauggcaucucccuauauuacccaggcuggacuccagcuccagggcuccagugauccucuugugucagcuuccugaguagcugagacuacagguguacacuacugcucccuacuuugugugugugugucugugucugugucugugugucugugugucuguguguuugcauuaguuuaugggcaacuagaacacguuagaugcuuuuaagcaucgauuuggauaaagaagcaguauuaaaaauccaacugaugccauacuucauggaagaaaaucauugcauuaaacaggaauuacacauaccgauaugaauuaguugauccaaugguccuuugaaauggaaguuacauuuuuaggagauggguauagcaaaagcagagguguuuuuggaugaugagcaauaaauaggggguuguuccuagauucccagagacuuacauaaaguugggaaugggagaaguaagugauggggacaagcuaaauuuuaaauuacucuuaaaguacuuuguuuagauuauauuaaccugucaaugugacuaaaaugucaacagaauucucuuaaguuuuacagauuuguagaugcuaaaugcucaugaacugaacugaauaacaguaaugagguaugaugauuugguaauuuuauuuuaauuagcaacaugaguaacuuuaaccuuuauuuaagaaaauaaagguaauauacacauguguauuuauuauacaaugggaaaaguucccuuugaaauucuccaugugguuugguguauuggcuuaugccuguaauuccaguacuuugggaggccaaggcagguggauagcuugagcccaggaguuugagaccagccugggugacauggugaaaccccaucucuauuuuaaaaagaaagaaagaaagaaauucucagugcaacagucuuuaaaucaugaaacuguucaguuggagaauuugcauuugcuuauugauagcugcauaucuacuauugugaauuuaauaucuuauuuauuuacauuuaugaauauaauacuauugagaaauuaggcucuauucuuuuuacaguggcauuuuuacugauugaucuagucucaucaaauauaacugagauguggaagccauuaucauaguucuuaaacacuauugcucuugagcaggggaugugagauacagagcauuguggaaaaaaaugcuauucuggaaaaccacucacuccuuugaaagucaaagagaauaaacaauguggaauuugaaaaaaaaaucacacugaaagauaaagguauauaagcucacuuaacuauuaaugauacaaauuaaucugcaaagaauuaaaagcagcuuuguuaauggcagaagacacaugcaguuaauaaggacauuacuucucauuugggguuagauuggcuucuccuuuauuaauaucuguuuaaacuacaaauagaaagaacuccauucuuaccagacuucuugucacaagacccagucucuaaagagaaauaucauugauaggaaaccagaaagacuaaauagauguauuuggucucacaggcaguccauuaauuugcucaaauuaaauauuaucuuuaaauauugaaagguuaaauguacaccgauaauggauuuagacagcuauuaagcuguaauugcuuucuaaugcaguuacuaaaagacauuugauauaacauauugagaaggaaggauuagagacuucucuaccucaguuuuaacugagaguuuuauggcuuuaauucuggcaguuguaggaauuggauaacaacaguuuuuaugagaacgcacacaauaugcauaaaauauucagugggcagauuguugagggaaugcauuauguacaguguauuuauguucauaguuuuugcaaaucuguaccagcaguacuaucagaucaacuauucacccuaaauauuuuucuauuagaucuaaaagucguauuucugaaaauguuaccauuuuaugguuucgaccccucuaagcugaauuaauguguuuugugcccuggauauaugguuacaguagugaccaaauuaauuugaaaacuucucagucuguuggagagucacaucuaguucagguagucaaacugauggcuuucccugccuggguaggcagcuuucuuuuuaguauucgcauuguuugaauuuguaguaugagauuuucacauuuuuacagguugcauuuugugaguugagugucuagcugugacaaauuauuguuaaccuaagaacauaugcugauugauacagucagccacuugccuccagaguucaauggaaggacaaaaaauuuuuggaaaagaaauaugaaugagagcuaggcucuucaaaacauauuuuccuggugaauuauuuaaacauaaucuaaguaugaguaugggucaggaaaaaaaauuaccugcaguuaagauaucaagccaaaguauuuuuugaauugaauaaagaaagggaaggaaaaagccugcuguugaucccugucacucauguuuuuguauuaauaggcagcaucugcuauuuguucuauuaauguuuuauauuaacauuuucauuuaguuuccuuuuuaaaauggugaaguuacagaauucacuuugguuucacaaaccuuuauggagaaauaaaugcauaugaagaucuguucuggggccuggggaagauguuuaaauuccaggugaugccagggccacugcauggcacccccugggguuguacaugcacauuguauauggcagccgcuugcuuccuucaaagaagagugugauaauaucugugcuuucuguugaacuuucagaguacuuccacagauauguuuuuaauacuuuuaaauccucagaaauaauuugauuauuucaguuuuauacaugagaagucauguucagaggaguacacacgaauauaaggcagaaaauaaaaaauauaagaauuucauggauuacaaagaaauaaaccacuacuuccauucacuguaaaccagagaagaauauauagggaaguuagaauucaguguguacccuuauuaauaaaacuaguguuuuauuaauaaacuauaauaaacuaguguuuauuaauaaauuaaauuuuuucaaauuuuuucugcuuucucaauagaugcucuauuuucuccccuccuccuauuccacccuaaaauuaaaagagaaaauacauuucuaaauuuuacugagauaguuaagcacagaauggaauggcauuacccauaagagucuaauauauaauguuuauaauccuuuaaaaguagaauuaggguucugucaucucaauauacuaugcugacuuugagauuucuuuuagucauuaaaucuguucugcaaaucuuuuuuaaaaaaauuaugagugacuuuauguuuuguuuuagauaauuuuaucacuaccaucuaacuaauuuuucuuuauguauuuucaaaaauuuaauaaugaauaugauugcaauaugcuuugagaccaggauagaugcuugcuuguuuuuuucuuuuccuuuagacuaucaucuuuuacauaccuuucucuuucucuuaaaguaaguggaaaaauuggauucauugaauuggucuugauacuaucuaggguuauaacauccuaauauucugugagucuuauuuuaggacuugcauauuuaauacaguuuuuaagucuuugaucuccuaaauaugcuuauagcagccgcuaccuucaccacacccaaauccuugaauguuaugauacaucauacuacucaugcuggauauuuacugaucugcuguguucaagacagacugcugagcuucguaaacuuuaccacccaaacuaaagacagagaguaaauacauaaacacagggaguuggggacuuggcugaaaauugccacccaaagcuugaaauuuauuugcaugcuggaacaaagaauauccaugaacuugaaacucaggaugacguauguuugauguuuauccuguaucauuauguauucuagggcaccacuucuguauacccagauggaaaucccaauuuuaaagcaaugcucuuggguauugagggguauauuugcgaagucacagucaucauuuauuccauguucccuugccuucuuuucugucaaguacucugagagucuugauguugaggauuuauuggaagcaaacguuguuaccuaaaugaagucuagugaacaaaaccaccaaaagaggacaugaagugacugcuauguauguauauaugauauauuuuuccucagaauuaucuaagugcuuugguugguugcaaauguggaauuuugcuguuugucucuaagucacucuuauagaaaugaucugugugugugauaccauaggaugugcuuccacugggcuccugagcagugggaauauauaccugaaacaguaugugacacuucugugcuuuuucucccucugugguuucuguucuuccuauaauguacgcaagugcaaauaugagcagugagcgaguagagagaaaacccuguaaguuuugugcucuacuuuagguguaugugauugcuucucuugcugugccauucauuucugauuuaaaugucuaaugacucucaucaaacaacauuuaaacuuucuaugagauccuguaaauguuccuuuagaucauauuaugaguaacaauggaugaaacgagcuuuaauggggaggcugcgguucaguccggggguucugcagcuguuggugauggcagaacacgucaauugaacugcagccaugcguucaguggcauuuugcccauuaagcgauguauaaaaacaguauuccugguacaguuacauuucauuucugcagcguuuucacagucagcacuggugugucccguggccuggccuuuucuccucuuggcgacugaaaaaauaaaagcccagugcuuuaaggugguguugcuuaagcaugaaugaaaucacucaaaaaaugucuucuuagcauugaaaaaauuggucacaagucaguaauuaauucauuuuagaguaaguucaucuuggggcugacaaagagguguaguagcuaauuuuaaaagaugaguguaacaucuuucccaugucauacaugucaagauuaaacuuaaauuauguauuauauauuaaugaccuuaauuuuauucauaaacuacuguaaguacaacagaaaucaauuuaguucuauuucagccaucauuucugggugugaacuucuaguuucuauaaggaauaaagagauaggcaugaacuaguaccugaccucaugaagcauacacuguaguuggagacguauagaccaaaagcaauccuagauggaaugggauauuugaaugagcuaaauagaggauugcuuugcacuuagagaaccuucaguaaaugaguguugaaagaaaguguguucaagaguuaccuuugaauuuuagauauuuauaugucacuguggacuuccugggagcugacugaaaauggugauugucauugucauuugacauuuuuuagucuaccagucuggggccuaauucagcauugaaaauaguuuuuccuguuuuaccagaaaaaguagaagccaggaguuuguuuuucucucuuuuccuugugcucuuuuaaaucuuauuucccucacaguugagcaggaggaggaaaaaaaaaguccuauuuccuucaucuuauuuuccacuaggcuuuugaggaggacgagauauucugaagcauauuugaaauaaauugaggaccguaacuuggcaaguaugaggugcaggaauaauccaugugcaggagagacggugaaagauuacucagagguacagagccauggagagucggaaggaacacuggaaguuucucguggagauggaaaccugagaacuugacugugguuaggacagguuggaggaguccuggguggugcugaagaggcucgguuccggagucaggccguugagguugaagccuggcucugccauucgcuaacauugugaccuuggaaaagcuuaccuaccucucugagucucaguuugcucaucuguaaaauggcaagaguguccacuucauggauuugcgaggaguaaauaagcuaguccguguaaagugaugcauacagaaagcaccagaaguauuagcugugauugauugcaggagccacagcaugcagcaggagaaugauuuuugagguguuugaagaauaauauguaaagagggcugggugauaugacucacgccuguaaucccagcacuuugggaggcugaggugggcagaucacuugaggccaggaguuggagaccagucuggauaacauggcgaaaaugccaucucuacuaaaaguacaaaaauuagccaggcuuggugcugggugccuguaaucccagcuacucgggaggcugaggcaggagaauugcuugaaccugggagacggagguugcagugagccaagaucgcgccacugcacuccagccugggcuacagagugagacuucgugucauagaaaaaaaaaaagaauaacaugaggauguguuugguguuggcauuuuggucacauugaagcagggagggaauggacauuucuuucagaaccaugcagcccuaaacguuaaacagagagguuuuuggggauaaguguuaagauuuugauguggauauuuuagaagguugggcguaacagcugauucaacccuuuuuuaucaccaucaaugaaaagggcuacauaaagauuuaagaagaggaggacauucuuuucuccacagcuggucaugcgcccaguguaguuggcaggaaaacggauuguuuggaaugugucccuaaaauccuguaauuuaauuuucauuauuuauauaacgcaguccguauauguggcgcuguacuacaugcacacaagaccaaauuucuggccaguguaauuuuaccaaagaagagacuguaacugaaauauuuguaccuacuaaauuaucugcagcuugguaacucaccguuagggaguccaugugaucccaaucagcaacagggauuggaggaacgcauuguuggcagugaaauaaggggucaggaacuagaauaaauagugcugggaugguaaacgggcccauguuauacuaaauguaauauaaagucacugacuuugaggaguccagaaaaauaaguuuguaaauauugacauuaaaguagcaaccaguuugcaugcuacuauguaaaaggaaacuauuaaaauaauuauuauacguaguuuuuugcuugcagcacuuguuucauucuguucacuuuuagaaacacaaauuagaaaggagugagucucuugaugugugucuaagagaaguuagaguaagauuucuagaaaucacgagauauauaacuuggauaguuuauaguuuucuacaaguguuucauguuaaaaguuccuacauuaaugguccuucaaugaauaguauuuaccucuggaauccaggagauauauccacaguuaccguauuggucaugcuaggcaagggcaugauuuauuggacuugauauuaucuguauauaguucuugcuuuucaaaacagucaucuggaccgggaguaagcuaauaaggccaugcacugcauaauggcguuucggucagugguggacugcauguaccacuuuggucccauaagacuauaauggagcugaaaaauuccuaucuauauuucuuaucauuauuuagaguguacucauucuacuuccaggaaaaaaaaaaaguuaacuguaaacagccucaggcagguccuucaggagggauuccagaagaaggcuuuguuaucauaggagaugacagcaccaugcuguuguugccccugacagcgccaugcuguuguuguccagugagacaagguguggaagacugauauugaugacccagacccuauguaggccuagacuaauguaugcauuugcaucuuuguuugugacaagaaguuuaaaaaauaguaaaaaaagcuuauaaaauaaggauguaaagaaaaauguuuugugcagcuauauaguauguuuuguuuucagcuaaguguuauuacaaaagagucaaaaaguuuuacaagaguuaagaagcuuauaagguaaaaaaguuagaguaagcuaaggucaauuuuuuuuuuuuuauuaaagcaagaaaaaucuuuuuucuguuuuugagacagggucacucugucacccaggcuggagugcaguggugcgaucuuggcuuacugcagccuccgccuccugggcucaggugaucuuccucccucagccuucugaguagcuggaaccacaggugcgugccaucacgugcagcuaauuuuugcauuuuuuguggugacgggguuuugccguguuacucaagcuggucuuagacuccugagcucaagugauccaccugccuugaccuccuaaagugcugagauuacaggugugaaccaccaugccuguccaaagaaagaaaaauaagaaaaaaaaaauucaauguauccuuaauguacaauguugauaaagucuacgguaguguacaagaauguccuaggccuuugcauucacucaccauucacucaugacucaccuaaagcaacuucuuguccugcaagcuccauucauggcaagugcccuauauagguguacaaucuuuuaucuuuuauacuauauuuuaaauguaccuuuuuguauguuuggauaugcucagauacacaaauaccauugugauacccuugccuguggcuauuuaguacaauaacaugcugugcagguuuguagccuuggagcaauaggcuaugccauauagccuagguguauagcaggcuacaccaucuagguuuguguagguacacucuauaauguucucacaaugacgaaaucaccuaauguauuucucagaauguauccacaucaguaaguaacacauaacuaauuuauugcaaggggcagaauguaaaccauugguuuaguaguuuuagauugaguuaaaaaaaaaagauauccuugagguuagugagaggaaucaaaaucaggggacaguguaggcauuuggggucaaaauuuauucagcauaugcuagcaugccaccaggaaccagaaggaauaaauuauucugacuccauucuuggcaagaucuguguggcuacagaacguaauuauuuugcaaaucauuuaaguugcugaccacagcuaggagauuaccaccuaagugaagauuaccaccuagauggagugugauuccucccugggauucccuuucagaauugucagaaaacaaagcaguaaauccacauguuaaucauuaaaauaaacgaagugcaauaugcccagcaaaucauuucacacauuuucuauuucaaggaauugggauucaaaucuuaaccuaaauuuuacauauucacauuuuaaagcaucacucagacuuguucagauuacugagcggaguaaggguuucaucugaacacauagaagcuggcugcguucuugaaauggggaggaugggguuggugaggucacaaaacuucuuuucagcucccugguugcaaagaauaugagugcuaugacauuagaugggaauucaaguucuggucuaaauugauaaaauagaguuguuauuuuauggccucaucuuuguuuuuauauaucacagaaucacugcgaaaauggcaguuuguuuucuaaagaggccugagaccagagcagcaggucacaaagcgagcauuuuacagcguugucagucagccuauuuggcugaacugaauuucccagggcaaaaguuuucuuacaacguuucaaacaauucaucaaaaagauggccuaggaaguauuaaaugucuuacaauguaaauauagacaaggcuuuauuaggaaagugugcaccuguuuauuuauugacuuauuuauuauaauagccuuucaaguaguuuucuugauccuuacacucuucacacaaugaguguaaauagacaccagucauaguuguagguggugagcuacagagcucuguauugauuagaucuucaggcugucaaaacaacuagaaauuuuaauaaauguuuucaaacaagugaccaguuccaucuaacccaucagaauguuuuauuguaaauauaacauggcugucaguuugacagaaauugucuucccagaauaauuuauagugugauuucaaaaugcauccagucacaggcuuuuaggaauccugucauagaauauuauuuuaugccaucauguuuuaaaaagacacagugauaacauugaauaggaauagugcaaugacacugaagugcaguuuuagaugggaggggaagucuuccuugcuucagcaaaucagguguuugaaguuuaaaaacugcuuaaguggauuuguaguaaagcucugucuguuuuaaaguacuggugacucaacagcuguggggaaucugucuggaaucggcgcggaacuuuggagaauguuuucuccucaggagcuggaacucaacucuuccucagcccacacaaugcaggaucugugguuuucugucccuguuucuuuuucuccauuuuucuccccuucacuuacucugauugauggaaacacgugcugggagcuuucccugacauucuuuccaaagacugaaaguaagaaauguuaugguggugcuaugucuauuuuugaaaguaagucuguuaacguaaagccuguguugauauauugggaugaauuauaauggugauauuauuacagccuucaaagcugaaaauuuauuauuuuucucaccuacuuuugguugcugauacuugaucauaggaacaugcugugcaucugguuaauuuuggggaacccauuuguagauuuucaaaaguuaaacuuuauccuucuuuauaucuucuccaggcccucuuuuguuauugaaaaacaaauagaaauacaauccacuacaacuucggugcuucugcuuuucuggucacucucauuauuaaugcuuauaaugaagauauuuuuggaaacacugacuuaucauugguuuugcaaauacaguaaaaauaauauuguuuguuggaacucuucauuaugauucuuuuacuuuuaaauauuuaauucauaauuauucuuguuucuacaucuguauuuuaauuuuuauuuguuuuuauuuaguuuuaaagacagggucucucucuguugcccaggcuggagugcagaggcaucaucauagcucacugcagccugaaauuuccagguucaagccauccucccaccucagccuccugagucgcugggacuacaggcccgugccaccaagacuggcugauuuaaaaaauuuuuuuuguggagacgaggucucacuuuguuacggaggcuggucucuuacuccugggcucaaaucauucuccugccucggccucccaaagugcugagauuuacaggcaugagccacuggacccugcacuuacgucucuauuuucaaauguuaaaugucuuuauguauaggaggucauguuggauuuuaaaagucaacagaaauugauaggaagcagugugcagcccugaaugaaacucuuaaguuaugggggaaaaaaauaccagaaccuaugagugaaauuauuuuuuaaaaucucgucuugcugguagacagguuuuuuagagacagggaccgcaucuucuuuaaucuuugcuguaucccuuguucccagcauauugucuggcacagaguauuuaauacauuaagugggugaauaaaaaagugaauggcgccgggcguggugucucacgccuguaaucccagcacuuugggaggccgaggcaggcagauuaccugaggucaggaguucaagaccagccuggccaacauggcaaaacccugucucuacugaaaaauacaaaaauuagccaggugugguggugggcaccuguaaucccagcuacuugggaggcugagguaggagaauugcuugaacccgggaggcagagguugcagugagcugagaucccgccacugcacuccagccugaguaacauggugagacagugucucaaaaaaacaaaaacaaaacaaaacaaaaaaaaccccagaccaaacaauaacaaccaaaacaagugaaugggauaacuuggugcugaguuuaagagccaagguucauuuccuugguaccuguugcuugacuagaagacaaaucugucguaaaugaucaaaaaaauguuuacauagacggauguggaggagaauuuuauguaugcauacacacagaauacuaaguggcauuuuuuaugugacagauucauuuccaugcauauuccauauuguaagucagucuucacaacuguuuugugaaguagcagaucccuguuuugcagaugaggcaacugaugcauacauagguuagguucacuuuuccaaaguccuagaguuuuuauuuggcugagccaggauuugaaugucagcacuuuagucucuuucuagaguuucugugugcaaucacuacugucuauuaccucuagcaguuuaucacaugcacaauuguucguaacaccuggcugugcaugauguacaucuacagguagacacuucauguacuugcugugguaguacucuagaaacacugguaaguucacauguuaucaaagaaacuccuguauccgcucuccgagugcugaucuggucauuuucugcuugaugacgccagucuuuugaguuaacucguaggugugcauguugguuucuuuaaaguguuagauuaugaaccauagggcagcaggugauuaauuucugcaucauaagaauucagcuacuguuuuuaggaauuugcuuacaaaccaucaaguuugcuuauucuuacagaguuuugucuuuauuugugguauuguaauauauaauaguuaguaucugaccccaagagccuuacaaugaggccacgaagacaaacagaauuucgagaagucagaaugaagaaugguccucaaaagagaaaggauagaaucuugggguuuuauucuugugagggauguuagaaaugaucuuaucucuaaguaauggggagagaacuuagcaaaauccuuaaagagcaggggaguccacuuuagugugaguuauuuaacuucucugugauuuguuuaccuuucuucaaaaauggaaugauaaugauacucagcccccuaguauguugugaggauugaaugagggaauaaacauacauggaguacuuaaaacagcucuugcacacaggaagugcauaacaaauauuaucauugaaauuaucauuuuacaauugaggaaauugaaucccagagaaauuaaauuacuuacucaaggcuaauccagcuagcuaaugacugagccagggcuggaaucuugacauacaugucgucagcacucuuguaauauucaacagaauuacuguaaagcaauccucuauuugacaaguaauaauacauaaucucugcauuuacuugggaugcugaauauauacugaacuucuugcuguucuuuauuuuuucuucugggaacuauauauugggugauucuuuuaaaaaaugugguuauaugccaacauuaugggaaaggaaaaaaaaacuuaccagacuuuucuuccauacauaauccaaauuucaaauguauuaauuuugccgaaugccauggcaacauacauaucuguuuuucaguucaugaaagguauuuugggaauuauuggcucaugcaugcuugagcguuuucgucuuucagcuauagaaauacacuauguauccucuucauuuuguguuugugcuucuauucaagaugagaauaaaagcaguuaguuucuggguuguaauauucuucagugaacgguggcuuucuaaaacaguuacaccuugacugaaaugaaaacucugcuguaucauaaaagauauucuaauuacugcaucuaguuaaaaggagaauaaaucacugggagauuauuuuaagugccuuaaauauaauaaaaaagaauaauggacguugaacagcuugacagguuugaugaaugcagacuauggcugauuucugcugcuuucuaauggaaaaggagagcauuuuacuuucuagguguauugucaaagcaaauuuuuguuagggaagauaaggagaagccuuaucuuuguugagcacuugccuuguaccaggcauuagccaaggcaguguauuaucucauuuaauuucauuuaauccuccccaaccuuguagauaauguuauccccauuuugcaucuaagaaaaaugaggcucagagaauuugaauaacuugccucaggguauauagcugcaaaguaggauccagacuagguucuuucucuuuauuucauuaccccaguaggguugugaugaugauguaaauauaaauguaaauauaauugucuccacuguuacaaagauacuaauuucaucccauuuaauuuagaaugguuguguccaaacaauuuuaacuucuuugagccucuguaaaaugggaacagucaggucacugugaucuaaaaggagaauauaugugcaaaccucuuugcuuagugcuugacaguaaauggggagugccugggagauuuguuuuccauaucaucaacagacaaauggguguucccaacugauucuaaguuaagaguuuuagauguuuaauuaauagacucauaaauugugccuguaaauuuaaaacgguaucuguugaguuuuucuaaauguauuuuacagauuagauggugauagacuuucuuaaaauguuguguuuuccauuggauuuugccuucauaaauguaugaaaauauauuuaguuaguguggacaugauugcagugcuaauacauggcagauuguguguacauauauguguguguguguuggcuauuguucuaucuguaggaggguaaaaaucuaaauggugggcaaauaaaaucagaagaaaauguugguuaauuuuuggauuauguugucucuauaagagaauguuauuacugguaaguauuuugcaaaguuuuucauccauguagugaauaugaaacaugucuucuugguugacucauuuguaucuuuuacaguacauuuugggugccaguuuauagauucuuuuccuaaaaucugcaaaguaauagaagaguuagaauucaguaccuaagauacagagauucuauuacuccaacccccuugccauaugaagaucuguguuuaaaugagucaagaaaauuaacuuuuaagauucuauguggauguaugaauuuauucauauuccaacauucaguugauggcauuuaugggaacuauacucauggaaacucagaaacaaagaaacuuuuauuugccacuauauucacacacuuuaguaguucuuuccuaaaucucuuuugaaguaaagaauacuauaacaucauauaguuuuguguucacaguuuuacaccuaauuuuacacauucacauuuauagauaugcacaauuacuggacuuacucuuugcuuguguucaaauauaaaagcuuauagaaucuuguaccagcuaucaacacauucauccaaauguauuccggguuucuccauugcugcugugguaguaaauauaaaucuacauucucagugguauuaguuguucuuagucaagcaugagaggaacuguauaugagugucauuaucuaauaauuuuucuaacuguguuaaauaacgucguauucucccuuccuuugccaugcugaaucagcugaagagacaaauaaguacagaagggaugaguguggcuucauaaucagggaugaauguguuaugauccaucuugauccaauaagcagaugaauauuucacaacugcauuauuuuguaagugaggauacugucaguuuuguagcaaagguucugguagauaagauugucuuucuugaucuuuuauaaguaaauuuuuauuguaaauuauuuaacugcauucucugaaaaauguacuuuuguaucagagaaauaugcuuaggauauauauguguaagaauuuaaaggacagguuuaguuaugggccaaaaucuaauguuguagcaucaacaugauuuuuauuaagaaaagagaauuugauguugagaguuuucaguucacauacagaauaaguaaaccuuauccuauaaacuacacuuauuauugguauccguguuuuuaaauguuuuauguguaccucaucaaaaugagaucaugaucuccuaauuuauagugauugugauuauuuaaaacuagcugaacuaggauaacauaaauaguguaaaaagggaauccuacaauugugauuacuacauuaaaaaugcaauuugcaguauaaaaugccaugugaagguuaaaugauguuaaagauaauaauguguauaaugaaaucaagaauagagcauuuaacaggaauguaucacuuuaugggcauagaaggcaagagagaucuuuacacugucauuauuacguacaugguaguauuuucuaauucaguggucuucaaauuguauacuauggaacucacuauaugaaagagauaauuuuuuuacaugggcacaaacacacaauuaccuuagcaauggcugaagucuuauucuuaaaauauauucuuuguuuuguuguauauuuuucucuaaaauaaaauaauuugaacaaaauaaauauaggacuauccuuuucaaaguaauagucagcgauugaauuuuugaaguggaaagacugaaugaaggccuguggauaaagacgaaauccugaaauaucaaaaaacaauaguuuauucacaaaauagauguuugugaaauaaaaguuaugcccuuugcuuucucaauugugugauauuuauaugucuuaguguuaaugcuuguggaguagggacuuaauauuuguuaacugaauaaaacugccuaauucuaugaagaauacuaaguuuauaugccaggaauuucucuuauuuuuugcaaauauguaauaauaauguuuuuuauaacuccucagauauuaugauuuacucuugauuaggcaaacugugggaggaguaucagauuauacaacaugccaaaaaacauuaauuauauuucucuguaaugaagaccugcaaauaaguaaagauguuuguaagcagucaaaguagaugucaucaaguucauguguuaaauuuguuuugggcagauagugaacagucauuuacucuauuagacaaaauaucauaauuagugaaaacaauauucuguuuuuuuuguuuugagauauucccuuuguuuuggggguucugcagauuuccugugauaugucugcaucugauuuuguuuauuuagucugcuucuucaaugugcugacuucauaccuugcaaaaauucugaaaucuucucaacuaguauuuguguauugccucuuccuuacuccuccucuguuuuuuuaaugaaacuccucuaagaagguuuuggacaauucucauucuauauuaugucuauuuaugucuauuuaauauagucuacuuuuuuuuuugcaucucuguuucauucacuagaauauaagcucucugaggaccauagucuguuuuguucaauaacguauauugagcauuugaaagagugacucagaauggauguccggugcgcaaguggaagcauuuuuugaauaaaugaacgauuucuguguaauuuauucugaucuguuuuucacuuuaccuagcuuucauuggucucguguauuguauaauucaagcucuguuucaauggcuguauuuuuaauuuauugguguucuauuugauucccauucaaacuuaucuuuucauuaugauguacauuauuuuugucuguauuaacacuuuaaauaugaucauuuaaaaaaucucuuucaaauuacucuauuugucaagaucuugggggcacuaauccuccuuugugugucuacugacuuguccacaguggauaaguuuguguguguuucuaauuuuugauugugagcucaucuucaucugggauguuugucuccuuuggaaguuugugcucuggguuaugggacaguucuuacaaagugguuuucuguuaguuucugccaauuucucaggaauuucauugguuuggcauuaguuuuuacauuaauuuuauggcuugugguucccaaacuaagcaaauaguauaaauuuagauucugcaacugcauauggaaaaguuuucaggguuggauuacucauaggcaacucuuucuuugcccaccaaagcccuugccagacauguuuucuggccauuucccugaaucagugacauaagaaucaguagccuuuccaaaucucuggcuuugugcaggggucuuaggaccugugccucuguggguuuaaaaacuccagccccuaucccuuagggcccauagaucugcuaauguuuccaguucuguguuuuuuguucuggcuguaaauucccucucagaauuccauuucuuuugaguuuggguauguauuuaacuuuuuucucaucauguuuuauccaggcuuuuuuuuuuuaaauggagugugugugcgcgcacgugugugagaguguguuuggaggaguguauuauuugaaccaucauauugcugagacuagaaauccccucucauuucuaagaucaauuauuauguggauauuugcuuucuuuuucugaguguaauauuaaauacgaaauggacucgugaaccuggagaaugucugucagaaauaccgaaccuuccuucuuucauuuucgccuguaaaaucuuacaauuuuuuuaaagauagauauacagccaucuagagaauacacagaagagugauuugguguucaucuuuguguuugcuguuugcugaaggaucacucgcuaagauacgucuaacauugcuauaauuguucuguuucccuuugaauugaauauuuaggguaaggcacugauaugucaguaggaugaccaacacuaaaaguccaguauccugggaaaccucugucuuugguagaccuggauugucaccuuagucuuggauuccuuccggagacugaagaaauccuuuaaaaacuuuccugcuguggagucuucuggcucaggccccaacuacaguguuacauucagacuucuuuguuagaacaaaguuuuacauauauucaaauaguaaggauaaauauuaaucuguuuagaaagagagccuugaaaggauccuagucuuuuugcauaggaaaaauguccccaaucaaugagaaagucuaggagcaugaucaagacuuauuuuauauaguuugucuuuuaggggguacugguggauuauacuuuuagaguuacauucaguauuauuguggcuggacuaaaaaccccucaagaauacauuucacauugauuuuauuauagacaucugucaagcaaagcagaggcaaaugauagcauacucauuuaccaguaaugcaaaucaaaugagcuaguggcaacaaaaucacuccugacaccuuugcccuuuuucucuugauuugaacuaaugacgugugugugugugugugugugugugugugugugugugugugcgcgcgcgcagacuagcaaaauccagacuagcaaacaaaggccaaugacaggauaacuuucauaccuucaugccugggucacucaccauguacgauaggagcagugcauucucuugugaauuaaaaaucuauuuauccuuccugggugcauaagucccauagaaggcugggaggggaaguggaacucuuuauauaggaggggcuuagaccucaauagccugucccuuugaaugacaaaaugcccaccagccuugccacaaauagcuucugaaauaugagaaccuuuuuuaauucuuaagauccuugaccacugcaacuaauguaaagacacacuccgcaacaaacuuauacacacacacguacacacacauuuuauucuguuuuauaggaauggcagucuuuagcagugcauaauuuuuuuauuauuauuuuguuugagacugggucucacucucacucaggcuggagugcaguggcaugaucauggcucacugcagccuugacccccuccugggcucaagugauccucccacuucagcguuuugaguaguugggaucacaggcacgugccaccacgccuugguaguuuuuguguuuuuuguagagaugguguuucgccauguugcccaggcuguucuugaacuccugagcucaagcaaucugcccaccuuggucugggauuacaggcgugagccacugugcccggccaacauuccaucauuuuaaaagcugggcaaaaagggaaggaacuaguugagaaaggaagguucuauggccagaacaucagaaugcuuguuuuuaguuuuugcaaacauuggugaaauaauaguuggcuuuuuuguaaagccuuuccaguuggaaacugcaaguacuuuuuuuuuuuuuuuuuuuccgagacggagucucgcucuguugcccaggcuggagugcaguggugugaucuuugcucacugccagcucugccucccagguucaugccauucuccugccucagccucuccaguagcugggacuacaggcgcccgccaccacacccggcuaauuuucuguauuuuuaguagagaugggguuucaccauguuagccaggauguucucgaucuccugaccucgugaucugcccuccucggccucccaaagugcugggauuacaggcgugagccaccacacccggccagaaacuggaaguacuuuuaaaaguaugauggaagauacauacuuuguaauauacauacauacaaaauuuguucuuugagcaaauuuauucaguuuuacuggcaaugaaacucauaauguuuacuccucagaaauuuuaaaacauuuguuuguugaauguauuuauuguuucuaucggcagucuuuggaaaucugucuugugauaguucuaauaauaugguuugaauacagcauugucauaugucuuauauguuggggcaacauucuaauaacuauacauuuuuuaucuuccgauacguuuuucugaauaacucuuuguguugacugcaaguauguuuuugcagagucaccaaguucugaaaguaugcuuuuaggauggcacuagguuacuguguuuguauuaaguauaauuguguucuuuuguagauuuguuccuauagagcuaugguuucauggucugaagcugaaagagguuuaaagaggucaucacaguuccuccucccacccuuacuguuguuaaauaugaauguacguuugacuauuggaggaauuuuguuucuagaacuuucaagaguaauuguuuucuguaauuuauaguaggaaaauauugauuuauuaauaguuaaaauguucuuugggaugcuugaagaccaugaugugaaaaacuuaaaaaaauuagcauugauguuguuucuauauauuugccaaugggaguacuauaacuuugaaauguaggggauuguuugaaacaugaauugugaaaaauaacgcaacuuuaguuauuuuauauuggguccaggcuaguccgcugaagaguaugaaguacaguuuuauguaaaauauaucucagauugagaauguggaaacacuguucuuuaaaaaaauaaaaucuucaguaagauccuuuuaugaauuuacugguuuguucucauuugucaucggacuguuuccagauguaaaauauuacuuucuugaaauugcuguugagucuacuaucaagaccaggugcauguuguuuuacagcuauuuuacuucugauuuuuaaugcugaaacucauagaaugccuugaacugauaauuuguuuaacucucuaccuacuaauuggaccaagaaauaacuuuguaucuuuaucucuuuuccauuucauguuuuauuucuguuucaauuagugugugccuuuggcaaaaaggagaugauuuugcuuucuguuuuaggauuugccuccaagaaaaaauauauuuuauugccacauuuucucaauugauccaguagaguucacagacaaugaaaagaguaagaaaacuaauuuuuaaagcuugguaguguuauaauuuucuuccuuauaauaaucagaaaaagaauuuguauaacuuuuguuucuaauauagcaguucugaaaaucuaggcuuacacauuuuccuucccauuacugcuguuuauacuuaaguaaaacaaaaauggucgcugcagguuuuuuucucauuuuagugcagaguuugaauucuucaaagacugcuaagguuuucccaccuuaacaauuuaugacagacccuuauaucuucauaggcugaguccgcugcuaagaguuugcuaacucaugacuuuaauacaccaguagagaucacacuggaguuaaaacaaagagagcacgaacccugaaaugauuuaagacuguucuuagcugacuacuggaacacagugucucacgugguguuauugguaaccuuaaugcagauuauaauucuguaguuuaaccaggauguguuggcuaugguaaagugccuuuauaaggaauugugaaagggcacaaggaauggaaacagaaccucaguuuucucaguguaaaugaugaugacaagaauucccugugcacauuuguuguugugagaaagggugagauagaauagauuggacacauaguaggugcucacuguuaguuuuucucauucauucauuacugugucauucuauuggcaugcucacagucauguaguggaauaugaaguuacaucgugauauuuuucauucauucaccacugugucauucuguugacauguucacaggcauguaguggaauauaaaguuacaucaugauauuuuaaaagcuaccgaugugguagauuucacagucuugaaaagggguuuuuuuuaagcugaauuuucaguuucacuugagaagaguccugauuugcuuguacaaagagcaguaggguugcagagaaggaaagaaggcaacucuuuuaagucccagccgcuacucugcugugucuuauucucuaaaacagugaagaagucuggguggacauucuaguggucagaagccuaagcuuugucuuuugaugagugcagacaggggagggagcaacugacgagggaguagaggggcuuggagccccuucccaagucuaccaucccucacuuaugugucucuuccucaguaaagcacccccagugcccuuauuugcuguauuuuucuucauggaacuuacugucuaugggaccuauuugugcauucauuuauggugugucucugcauugcuuucccuuucacuacccauguaaguuccaugaaggcccagucuuaagcauuacagguugagcgucccuaaucugaaaugcuccaaauuccaaaaccuuugaacacugacaugagauagugacaccuuugcuuuuucuguuguuccaaaguacgcaaacuguuuuaugcacaaaauuaucaaaaauauuuuguaaaauuaccuuuagcccauguguguaagguauacaugaagcugcauaugaaacauaaaauacauuucauguugaaacuugguucucaccccaaaguugccucauguauaugcaaauauucaaaaaucccaaaaaauuagacauccaaaacacuucugauccuaagccuuugagauaagggauacuuaaccuguacuggguccucagugccuggcacaggguggaugcucaguaaguauuuucuuaaaagaaagaacaagggaaagguagaugagacgauaagagguggagguacagggaagaagaacacagaaacauggugaugaaaagaacagucugauaccuuauuugggccccagaaaaugauugguacugaagggauuuuauuaguggucauuuaagaaacuuguguuguacuguuuuuguguauuggaaggaggcuagacauuguuacauggaaauucacaguuacauuuucacuaaauguuucauugugaaaaacgucaagaaagguuggagaaggucuaggaaaacuuaucuuugaagauacugucuuaugaauuuccagcucagacuugcagcuuuugggagcugaggcuaugaggugaucuugagagcagcugaggaggcucuaauggguuccagcugugugcccagagaacccacccucucaggauaacauuaaccagguagacccugcccugacugacuuccucugggcuuuauggguccccguggucuguugcauugaucuugcauuuucagguuuuauagcaauucuaaacaugugaggguacauauuugcucuuugaugugcccuuugauagaagccagagugcuuuaccugagccugccuguaauaaugggggaagguggguugcaugcccugcagccauacgcucccugggaggcugguuuuauugcgguuguugauuggcagacuuuaaucagggguguuucuuguuguauuuuugaacaugaaguauauuaaggauaguuaaacauguaguccugcugguguuuuguuuuguuuugaaccacauuuuguuccauugugccacuugauagaaaggagggcagaauggaaacauauggggagcagaaauaguaacacuuaugucauauaacuacacuguguuggugauuuuuuguuuuuuuccauguuuuauaauaccuuuauguacaucccuauuaagaaggcagcuauugugucuccauuucacagagagguaaguuaaggaauguggaauuuggaaacaugcuugccgguuaguguggauggaaccuaaauuagaauucagagcucuuauuacuagauaggagaccaaucccaggcagucauggcauuucugugaacucuuucgaagaguaaagggacaggaauugccuuuucagaguagaacucagugcauaucaguggaauuauagaacuuuaggguuagaagggccuuugaugggaccauccuuuaagcuagaacugccucuugaaguuugcagugugcaugaccugcagcuccauuguuuauauuccaaaucuaugaaacuagugagagaauaggacacaucuuuguauguuuagguuugacaguacuuaucagaaguggucauauuacgguuuucuaucuuccuuugguggcuuuucagcuuuccuugguaccagccuuccaaaagaaauuagcucccuugugcccucacuuuaauuuggaagagauugguuuggaagagccaccaagggcccacuagacagcuccuuagaaguugcugugacuuggcagauggcaccugagguuuaaggauuggggaucuagccauggcguguugaugaugaugaugaugaggauggcaaugacuauuaacuccuuaauccauauuuaaucauaucaccagaacugaugguuguucauugaagauucacuucaugaaguacaagcuaggugauuccuuuuugaaaauaacacugugggccuaagauauauggaccuuauguggcuuaaaaugacccacuucucugugcuuacuccuaauuaccuucuuauuucuuugaauuuaguaaugggaguaaauccgacuuuaaagccauuugugguggcaaacccuaacuauucaaugaaauacaaauuugguacauuugcauccuaugcaaguuuuauauuuuugacagcuauuuuuguauuuaagcaagaagccgaaauaaaaauuucuaaacagauaugccagauuauauucaccauguuugaguauaguauugauuggucauggcugauguuuaucagacuaagcaaagugugucuguauuaguugucucaagagggucuuuauucuuaaaugcuuaugaauuccauaauaagucuuggaaaguggaacauacccaagcacaauuuauaacuuuucuaggcuuuauugguauucugagccauccagugaggacuggagucauucacaugauagaauaacacagauaccauuuauuaaucugcugaauauugaucacauuuagcaaauugcugaauauuaguagugaaauacuauuccucuacaaaauaguaguagccauaguaguagcaaaauuauccucauguguccaugcaugauuuauauguauguguguguuuauauauauacaguguauacauccauaucucuauauuucuauuuugcuaucuuuguugggauuuauaagguaacuuuuaauuauuuuccuucccccauucucuacuuagcgauccuuucuuuauaccaaucaucaugguaaacacugggaauauaaagauuaauaagucacaguaccuauccuuagagcuggaagcaaauacuuuuuauccagcauaaugaguguuacgagagaugguauagaaaaugcucugguaggccuggugugguggcucaugacuguaaucccagcaguuugggaggcugaggcagguggaucacuugaggucaggaguuggagaccagccucgccaacauggugaaaccccaucucuacuaaaaauacaaaaaaauuagcugggugugguggugggcaccuguacucccagcuacucgagaggcugaggcaggagaaucgcuugaacccgggaggcggaaguugcacugagccgagauuacaccacugcacucccgccuggaugacagaacaagacuccgucucaauuaaaaaaaaaaaaugcaaaaagaaaaugcucugguaucccagaaaaugccuacucuguuucaggaaugcaauucagaaagguguaccagagugucauuugcagucuagugguaguuucauagaaugucuguuucaagaggacccuucucuauagaucuguaguuuuuauuaguuauaauuucuucacacuucugucagaaauguuugcuguuaauuuugaacacuguuuuucaugugaauauauuuuuuaaguggauaucuuuuucauuuuguuuuuuuccuccuggcuuuuaaauauauauuuaaaauauuuuuauccauaucuaauuuuugcaacuuucaaaaaaacuuucuaagcagucaccuccugacccucuuuuucccccuuagcuguuucccccccccuuuucagggccaccuccccuccuucagagcccccgcauaaugcuauuccuuuaccguccagccaucugccuguuuuagccucuucuucacucucucuguuucuucuauauagauuuccccauaugucugcuucuuccuuuauccacaaguccagacacuccuccauagcuuucuuaccaccccauccuggugucccgucuguucauaaauaacucuuucauccgccuugaaucccaacccccuacucuuucuaaaaagagugugcaaauaaaccuaaagugcacggagccaagaugcauagcauaguuuugauucagaauagacuuucuccuuccaaucaccuguuuuaguccccauuuuuuguugcuuggcuucuuuguacagauccacaauugccguucaauuuuuguaugaaaguggaugcaaaguuauuuaaugucuucaugacaaaguuuuugccucuuacuggcagguuauuuugcccuaaucaguuacacagucuugugcagccuagugguugcuauuuuggaguagucagguuugaaccuuuuguucuucagaaauuaacguauuaucucagaaacagcagucucugcuugcgugcuuggcaacacaaaacugcguuagguccuuuucuaagucugaguucuaggacaugugccaugaaaggaguguuaacugaaucaccugcagaaauggccacaaggagggcuuuguaauguucuagauauuuaaaauguugguguccuccuccuagcauggugugcuagugacaggcuccuuucucccuggucaagaguaaacauuggcaauuuacuucccuuuagaaauguguuacuguagccaucgcggaguugccaguguuuuuccuuccuaaugucagugauaauuuuacucacagauucccugcagagauuuuagcucagcaggaaguaaaucuagguaagauugccuugaaaacugaucuaaaacaauaaaugcuaacuguaucauuccuuuuuauuuaaaaaaaauuggaggcauaacuaacuugauuauuuguaacuggugagaucuaauaaucgugguuaagaccccauucguucauacauucucucguucucucucucacugcuucuuugccuauagaaaaauaaaagucagagauugaaaugauucacacuauauuuuuuaaggaugaaauaucauaguagaaaugaaagguagaacuguuuacucaugagaugcugagaaaaucuaaacuguagcuuuccuagaguuuaggaagcuaaauauuuuauugguaucaaaaucagaaauaucuaaagaauaagauauuuaguuuuaaauguuucauacuuucuaaaaagaguuuuugcuuuguuuuguuuuguuuuuguuuuuugagacgagucuggcuguuaccacccgggcugaagugcaauggcacgaucuuggcucacugcaaccuccaccuccuggguucuaguaauucuccugcuucgaccuccugaguagcugagauuacaggcaccugccaccaugcccggcuaauuuuuguauauuuaguggagaugggguuucaccauauuggccaggcuggucuugaaguacugaccucaggugacccacgcaccuuggccucccgaaguacugggauuauaggcaugagccacuguguccagccaaggucuuuuguuguuguuguuguugauagucaagaaugagauuuuacugaaacaaggacaucagaauaaaaagaaauguaaaaaaugggaaagacacugaaaauuacaacaacccauauuacucauucagauucuuuuuggaauuucaaauagucaauaaugaagagacauaaauuccuuggagaaacguagcuuagggucagcuuuccuuuaaugacacuagugcuauagucacuuauauguaguauuuuugguguuguccaauuucuguggauucugaacauuagcuguacacagauccaagucuguggcuuuagcauauuuuugcuuuuacaucuugucaaaaauauacuguuagaauaucuuagacucgagaagauuuuagaaaucacuaauaauguaacaacuguuauugguuaugaaugaacaaagguucaguuaaagaguauuuccagguaaggcuguacauauccacaguauauuauagagacuucuggguuaugcacuggauauuaaugguuuggauuauggugauguuucugaaugugugaagggugaaguucuagacuucauuuuuauuaaaugaaauugauuuucuuacccccaccaaauuacuuaccaaacauuagauaccuaagaucuuaaacauagccauccucuaaauuauuuguucuuuaaguguccagagaauaucgugcagcuuccagaucauggagaaaccaguucugugcucuugaaguugcagugguaggagaaauagcagucuucuaugacagauuuuucaacuuuaacccucucacucucugcuaauuagaaucauacggucauacacuuuugguuuuuuuuguguguaacaaauuuuuucuaaagauucaacaaaagaguuucaagguuaccuucaaguagguacaaauaucuuagcucuggcuucuuuuucucccaaauuggcuguggacuguaggagcuuaauuaguucaggcucagugcaauugguuugcuccuagggugugucuauacuuaaaacauuuuuuuauaacagaaaauacguuuuugaccacuuuucauaacuuccucuuguuguuuaccaguuuuaauuuuaucuuggcaauugaaaaucuugggggaggccaaucuaaaaaaaauucuuggauuuucaaguuggauauacaucgguuuccuaaaaagaacucucuuuuucaauaacuuugauaucucauucauucagccuguauuuauugagagcuuaucaugcacgugguguuaugcuuuuuaauugcugguaccuugaauauuuagagaaaaaauaccucgugcauuuugucucuguguguuugacaugucaccuuguugaaucugcaccaagaaaaugaugaauuccaaugaucuaugguaguuacaaggccuuagaagaaccagggaugugaauuuuuggucugcuuccuccguauuuccuauucauugagaaacgugcuuguaugcauauaaacaauuccuuacuauuuuucuuucuggagaggaaacaguaauggguggauuuuaucacaggacaaagacucuuccagauagcuguuacagucccucccucugcucaccugauuuagaugaaccucucuuugacccaccacgauggugguaagucugccguugcaguuuuguagacauguaugugaaggcgauguuuguuauggggucaguguugccuuaaggaugcgggcuagagugaggggaccuuuguggugggcuuugcagacuucuuggcagagggaagcacagaugcgugagguuacuauuuucaccuaucuccuccuuucuuuauuguuuacaggaacacuugucuaaguggugcacaauuuugccuugcuuacgcuucuagagugaaaaauaucuguccagacucccugggauagguugguucuaacaucuugguggauugagccuggaccaggaguuuugacuuagaauucauggagagaggugucuguaaauguauauauaccccuuuauguuugggagaaagcaucuguggagcuuaucuggguagcaagaggauuuugugacccagcaaagguuaaggcacacugccuggaaaaaucaauuaggauccaguugaggguuagaucuggccauagacuuugccugguguugguaaauaaucugaaagccuuaaagcaucucagaguaaugaaaggggcccaaggguucacagugccuuuucucaggauugcugcaaggauucuggauuaaaaauccuucugcugucuguggaacagaacauuuccugggaucaauccuugagccuuccauagacaaagaauuucccaaaacuaaucuugccccauguggugucagagguaaaauaagugccaagcaugagaagccagaguaaccuuuacuggaguaaccucugcuagaucucuuguuaucuauguacucuuagaauaucuuagacucgagaagauguuagaaaucaccaauaauguaagaacuguuauugguuaugaaugaacaaagguucaauuaaagaguauuuccagauaaggcuauacauauccauaguauauuauagagaccucuggguuaugcacuggauauuaaugguuuggauuauggugauguuucugaaugugugaagggugaaguucuaaacccuuuuuagauaggcaagugugaugugagcaguagaguacauuuuuuguuuuuguuuccugaaguggggcacauuucucuccccuuugugguucuguaaauacauuguugaguccaguggaacuucaaagauggcacauagcuacugaugacacacacaaauauuguaaguugauaaggaugucugaaauguuauaaguggcuaccugaugccugaugucaaugcugguaucuguaaagcacacacacuaagaauagagacuggcagcucaaggguguugaugguaauuuuauuguaucuucaagaaaguguguuuccagagaauuauuaucaguaauaaugacuaccaccuuguuuucuuuugccucauuucucuuucuucuuccaugaaacugggguaagccuuauuguagagagaagcccacauggauauccagcaccuagguuccgccgagggcaaggcggaaaugaacugaguuauuccauuucuguguaaaucggcgucauuugcuacaugugcaaguuuugggccagagguguggaaauuggguucacuguuaaucuaacuagugauagccuuuuuaaucauguauuuuaauaggaagguagcacaguugagggaccucuuuugccucuugugccuaagacagcuggguuugaaacucaguuuuuaaugaauuauuuaacuuuacugugucucauuuucaaaucuauaaaaugggguuaauuguauuuugcaggauuauacuggagaagaugauaguacauuucagauuucuaccacaaauauggcccucgaauuuacuuuucucuacuacuaagcaacaaaauaaaauugaggaaaugggagucucucuaccuggucuuugauuuagagugugguauuucuucauuauggguagaagaguauuuuucuuuauagagagucauuaaccuucaggaaaaaaaaaucaaucaaagguuacguggaaugaagaagcgaugucauguaauugagauuuuuuuuuuuuugauucaaaauguaaacucacuugauuuagaauugauuggaacauggcaugugaaaaaaacacaggagacauuuaaaacuguaccuaaaucugauauaguaguuaagaaagcuagcuuuauaggaaauuaaagggggcugauuagaguaagauaggagagagagggggaaaggggauaugguggguagcuagaagaaaggcauacacaugcuuagaaguaggaagccagagauggaggaagaccuaggaugggcuuggaaaacuucugaagccuuaaugaacugaucuugucacacacagcuguucauuugaguugugggccucagaguauuauuccuuuuuaucacugucuuuugaaaugcuaauuagauaauugaccauuguucccaguucuuugguuacuuuuuauucuuaaacuucuagagacuaggccuugaaugggauacucagagcagcacaccagaugggaaauuauucucuggccuucaguugccaaaugaccaccacaguagugcuugggauguauaaaauccagcugagaggcagaacuagccuaaggggugguuagcauacuucuugggauaguccuucaucaauagauuuuuauuuuguaaugaugaaggggacugccuuuguauuuuuauacagauuuaucagauuuacuuaaucaauaacuuaaucaauauugauuacuuaaucaauaaucauggucuucuugaccaugaaaggcucauuuaaagaaaagaacacuugaagaauaucugaaaaugauuagcaagauaccuuugguuuuucaugaaacaccauuauaagucuaauguuugaagaauguuuuuauucuacuucugaccuaguuaacucauaguuuuuuuuuuaaauugaauuagauaauguguaugaaagcaucuugaagaauauacacucagcacaaauguaagauuugauuaauaaggugguuauuaaugaauaccauauaguaacaauauaucugagucuugcagaaaaacauucuugaccaacaggacgugaucuaguagaagagcugccuguucuacauauuuuauaaagagaacuaaucauuuuucuucuguauacucaauccgauaucaggaaaccucauuuaggucuauucacacuguagaggcagcaaaauaacaugccugaccuuuucuauguaaauauuaaaaauuauuaaaucugcauguuggaaagauugauuucggcaauaccuucuaaauuuucagugaauauuuaaguguaaguuugcagauaguuucaugaaaauaauugacuuuuaguuuugguacuagaacaauuggaauauuggugguauuuuucauuuuaaaucugugugaacuaaaauuuucuuauuugucuggcaugaacaucacagaaaaauccuuucccuucaagcuauuuuuuuaaaaaaauuguaaaggagauacuauguauugcagaacauuuagcaaauagugaaaaaauaaaaagggaaagucaaaaauucccucuuauuaguucaguacuguaacagucgauuguauugccugggcuauuuuuuuaaaaaaauuguaaaagagauacuauguauugcagaacauuuagcaaauagugaaaaaauaaaaagggaaagucaaaaauucccucuuauuaguuaaguacuguaacaguugauuguauugccuggugguagucuuuauaucuguacacauauacauacaauuuaaaauauguaugcaauuuuagauuauuuaaauaaauucauacuuauuguuauauauuuuucuuuuucuuuuuuuguauuugcauuuuuaaaaaacugauaagaccugccaggguuaugugugcuguaguguuuccugaauuuauuuaacuacuaugguuuuucuguuuucuaauuuauuaauucauuaaacauuuguuauuccuuuguuuucuugggucaguuuuauagaagucauuuuccuuaaauugacuguugaguuaaauuauuucacucuuauguuccagaucaugaauuuguauuguguaaaaauuuggcugcauuccauaaguuuuguugauaauguaauauucucuguguuacuaguuucugaaguuauuuuggcaguuuuuuccuuuuaauacaauagcuaacuugaacucucauuuaaauuucaaagagauuaucaaguuuagcuuuuaaaauuuucauaacuguuuucuaguuuuauuaaaguguggccaguaaagaaacaguguauuuucugugucuuaaaauuucuuauacucuuagugucccaacaaaugauauuuuaggaauuucucaguauuucagaugagauuuauuuuuauauuuguaauaguuggaaauguggcuuauuuucuguaguguacauuuuaauuugcuuuucaguuuuuaaaguuuuuucuuaacuagaucucuuuugaaccuagaaagauguguuaaacacucccacaaaauaauacauguuucucaugcauaagcgauucaugaugacuguguguuuaugguagauauuuucaucuuugaucuucaguacucccucuuuuauuauuaucucuuuuuuuccauguauuauuguaagagaacuuuucaaguuugucgucuacaucagugacaauuuuucuacaauuuuaugcaaauuuuaauuuuguuaaugcauuuuuaguuuucuuacaauauuuccuauuacauccaucugcuuuuacaucucuucacaaaucuuuuguguugacaccuauuuuauagaaauauucuauuuuauauaacugucaaaugugauguuuucuagacuccacuuguauuuuuuauagggugaaaauguuuuucaaaguauaauuucccucugaauuaugaguacauauuucccuauauuuuauugugcagauuuuuuucucacuacacaguuuuuaacauguuaaacuuuaggacgcugcaaaucugccuuucuuaauauauucugugauguugaggcuaacuacauauauuuuguaaagagguaugcuggucuccaugucagccucuaccaauaggaggcgcuggagggagaguagaaggcuagaggaggaagaacuuggccuuuccuguucuuguuaucaucacucugguaacaucagucuuuuccaguuuuuaguuuugucuacauuccuaaaauuaaccuccuuggagauaacagccccagucugcuggugucucuuccucaucacgucucucugagcuuacaggcucuggaaacccaaccgcuucccuguuuccccagccguggggaugguagcuguuuccauccgacuguucaugggugcuucuucucaagucuaaagccagaggacuguaaauguauguuguuuaagccacacauccaaccauacugguucaggaaggcagcggucuuccaguaguuaguuagcuuucuaaaaacucccuuuaaaaaugagacuuuagaaagaggaugacaaauccugaggacucgugucuuaagcaaauuuucugucuagauauuuauuauaaaccuaauugcaucugauaagugcuguguaugucauacucuaucaaagguaaaaggguuauuaaaguaaccugcacuuuuuagagcaaugguggauggccuugcagaaggcacauggccuuuaucagucaacucacuguggggaagcuggagaaauaaaguucaggugagaguaagccgacaguucuggugugauuuucuugggaggauaacguauaauguagguagcaaacacaugggagaaagaagguuuugcauuaugagauuugacuuaauguguacaguuugcuuuugguguuguaaagcaguaaagaggcuuauugacaucucuauugaaggucauugcagugcaugaaauguaaaucaaaguguuauucuuuauuagaagcuagaagauaacauuuacauaacaugcuuuuaagguaaugaguuaaguucauuauuuuuuauuacuauaacuguuugaagaaaguuauuuucaugcuaaaaauacuccuacuugaauccgauuugucauaauuuuugcaugauguauaaucuauuguuaggaaacgauaauuccauuuauuuuuguuucugggggaaaauuguuagacagcuguuucagucuuuccaaauaaacucgcuuccagaauuccuaguaaguagcaaugcugguugauaggaaugucaccauuuuucugaccccccucagccuuaucacaaagacauagugcagaagccauauaagaaauuugagaaaaggaaaagauaccaaggccuagguauuucacaaacuggauaauuagacucugaauugcgacgaauaggcugaaagaaaaaaaugucacaagccuauaguggcuuaaggaacacugauuucacagugaaaucuuucuacauaaauuuuaugguuaacugguaauaggaauaaaacuguggagcaaugucagacaauucuguuaugauuccugccuaaugaauggcaggcuuucccuugguauuuucuccuuaaccugcccauugcccuuucuguaugaucacauuuucuuuaaccaguucuuugcucauaaauaaagccguguguuccgguucaaaaguugcaucuucauuuauaaauucacagaauauguuuuucagggaaaaauguaacucaaucagcuuugcaugguuuacauaaugugauagucucauauuuacuaugugguuaacaagaaauaacuguuaccaacaaaaaucagagaauuuaaaaacaacgaacauuuugcuugggagccuauguauaucucuauauaaauacauauagacaucuauaaacaucaucgauccuucccaugugcacaugccauauauauguggaugugggaugauacuuguuuuuauauauacauaucuauauuuauauagcugaagaagugaaacauauugcuuuuuauuuaagugacucaaugcguuuauagacaagcuuuauuuuacaguacuuuaucaaugccgagaugauaagauacugcuuugauuuggucuucuaaaggucaaaauuugaaagaauaaauugauuccuagagacauucuuaugcuaucauuggccuuauauugaacagagaauuucuaggaaaauuauuauuccucaauggaaauaaaaauucauuuuagguagcuuaaucaauuugaauuauucauuuauggcauugcuuucaauuguugaugaguguauuuguguacuggguguggggaggucuucaggggaugggaagguggagggaugagaagauucuuauagcacuaaacugaauuuucaauucccugcuaaagugugaagaaagaagugaagugcuucauuuucuucuuuuuagaaucauuuagcaaccacaguucguacuuuauauuuuuuauggaguacuuucaacaacuugcuuuugcaguugggaaaugacacuuaccuggauuuucuuggguucuuuauucaugacaucaaugaagacuacugcuaaugaaccauagaugaaguuacacauaugcuaagcagggaaaugcaggaagaaugugaagguccuagaguaucucaauucagcauguaagugaguugugugcacaguagcacaguucugucuuauggcuggucaaugcuccauauuaugaauuuacauaggcuuuauuuuaggcucugaaauaauuauuuuuauuauauuucucaaauuugccaaaguaucucugagagagauucagaucccaucuguuugacagcugaggaaauggggacaguugguacaaugguuucucaacauuagaacacaucuuuuuuuuuuuuuuucuuuuuuugagacggggucucacucuguugcccaugcugaagugcagugguaccaucagggcacacugcagccuugaccugccuggcuuaagcaauccuccuaccucagccuccugaguagcugggaauacaggugugggccaccaugcauggcuaauuuuuguauuuuuuuguagagacaugguuucacaauguugcccaggcuggucucgaacucccaggcucaagugaucugcaugccuugggccucccaaaguuuugggauuaaggcaugagccagcacgccuggccagaacaugucuuaacuuuuuaagauucaugauccuguugggagucuuauguuguugcuaauguugcuuauguaauuuacuuucauaauguccuguuuccaccuauuuuucccucuuugugcugaagacuauugaagagcauugacuagugacauucagauaauagucuggugaguuuggguugaauguucuuuuuuguguggcaugcuuggauauguguaaauauguaagaauauagggaacuaaaucuuacuuuucaagaugcuaucgugacaccucugcuuguuaaaauguuggauaauugugagaaaacacacaaaaaaauacaaggaccccgucacacuucuuuauucucuuucagauuuuauacacuuaaacagauuuacagcaaaaaauccuccaaugacuuuuuaaaaacacuguuauguuacugauaaacugauuuuugucugugucccuucguauauauucacacaauuuucauauuucuggguuauucauccuugcuucacauguguuaucucacgguuaaaaaaauuuuuguuggaugaucaaaagcaauuaaaacauucuuauucagugcuuacauacuuuuguguucuuuuucugugucauuuuuucauauacagaauauguuuuccaauaguuuacauucugaauuuuuuaaugaccaguguuaaacuguuagacuuaccaucauuuacuuaagucucuccuacauauuuggugauuuugguuauuucuguaucuuugcacacguuuuuucauuuuuguuucuauuuucuaauaugcaguuuuuauagcuucuugauagagucuuugaaauuuuguuucugugaaauuguguaguuucauagaacuaaauuugcucuacuuaacuguaccugaugaauucauauuagcuauaaauauuuaaacauuuuauauaacagacagcaaaucaucauauugcugggaauguaaggaagauaaacuccaugcauucuagaagucauuagagauuuugcauauaaagaccacagcuaguuucaagaucuaaaucuugaagcaggcauucaagguguuucaauaaguacuuaacgguaggccauuaauucauguaaucauuuaggauaaaugaugggcagaaaaguuacugugcaaaaaguauuauuuggagaauaauggauauaugaaaacuuacauaaaugauuauuuauuguaauuuuuguuacuuucaauuucuuggucauggcaaaaauugaaaugcaaggucaaacagaagagagauggagaaagcucuaaccagcaagggccuggacucucacacuucccugauuggagcugcugugugugucugaggagucaccauugcuuuacugcuuauaccuaaacagaaguauauguagcuuugcuugcacugaggauguuuauaaauccucuggguuuuacauuugauuuacuuucuuccucagccuucccaucucauuugaagacaccuuuaguuuuuucauuucucagacuuaaccucuagggaauuauucauaucuccauuuucucuuauauuguacauuuaaagucuuccuaaauguuguuagcuuauauuuauuaucuaucgcugcauagcaaacauuccccaaacuuagugauuuaaaacaauaaccauuuuauuggcacacaaaucuguauguaguuuaccugcuuggacugagcucagccaguugguucucuuguugaugucaaugguggucacucaugaggauacagucugauggcggguggacaggagggccugguugguuuagggagccaucaacugaauuggcucacuucuguuccaugugguuuaggccuccagaggauagcucaggguucuucacaucaugguagaaaaucacccagccgcacaaaagagcaagaucaaaugaguaagcacuuuuuaagucucugcuuacaucaugcuugcagauacuccauuggucaaagcgugucauguggcauaguccaguaucagggugcuaagaaacuccacaaaaucaugggugaaggaugguguuauucauuaggagcucuuauuauaaccguuucccacaagguucugacuuuuaagaauucaaccacuuuuccuaaccucuguugcuaggacuuuguagcacucugguaauagucugcuaacuggacugccugcuuuagcccuugaccuuagucuguuuuuuaauggagcagugaucuuuaaaacauaauucagauguuauuccuccucuucucagaacacuucauugaccuuacaccuuauuuaguuaaagccaaagaccuuaaaaugguauguggcuucccugguaccucugugauaucauuugcuuucucucccacucuacaccagccacacucuuucuuaguguucugcaaaugcaccaugcaagcucccaccucagggucuucacauuuguuauccuuucuguuaggaacacuugacucagguucuccauaguuggguccuucaucucucucuucacucaaaugucauaucagaaagccuucccugaccacacucuugaagauuacagucauuuccucuucuaaugcucaccaucguguuuccuacuuaguuuuucuccauccaggccuccggaucacucuccauccugcucugugucucaagaggcuaaccuucuacaguugcauaaucagacugccuuucucucguucucucagucuucugguuggguucaccuaaugggaagcuguagcuuucccuucauuuugcuuauaaaccuuuaaaaaaaaacccaaaaaaccagacaguauauuauuuuagauuuagauaagaccaaacuaagauuuagugagcauuuuccaugaaccaauuucugugcuuucagauaugucauagaaaaaguuaagugaacugucaucccuguuuaagagucagggauacugagguugagguuaaaugacuuguucaagguaacaguuagaaaauaaacaaacaagacuuccaaacucacguccagucaucuuuuccaucuacagcccugucuccguaagucaucacugaaugaucgcuguuacacacaccuuuggaauuugucuuuuaucacauacacaccaccaccaccauuuucuggaaacuucuuuuaaacccaaucugacuuuuuaaucaagucuauauuugcuagucucaauagcuguuaccuucauccucuuacaucuaagggcauguucaccaggagucuuucuccggaaucaccaaccuccucuucucuccugacucuucagcauuuuaauaugcucauuucuccuaucuuaaaauuaaagauggauuuuuaaauuuaaagaugaauuuaaauacgcccaccccccuccaaauuuugagacuaacuuuucucuucauuuuguucuguccuuuucaagccaaguuuucucacacgacauucuguauauaaugugccaugaucuggcuucuuuccacaacacucucugaagauuccaccucaaaacgucaucaguagcaugugugauuggcuuugaccuuucuacugcuuuaccucuuugaagcguuggacuuuggaacacagccuucuucuauaccuccuacucucuuucaaaacucagcucaugucuaccucuucaugggaguuuuucuuaacacagaagacugaucugauugucccuccagcuuguccucuuguaugcuggggcauaugccagcaaucacagcugcugagaugcuuagucuuccugacggaacuguaguuuuuggaguggucaggaucaugucuucagaacuugcaccccagccaugugucugcacguaguucagugaccagaacauagucaacacucaguacaugccugaugaaugaacaaaugagugugaccauacuuaacuuggugaggccauuuuuuuccgugaguuuuauacucuggguuguuuuccuaccuuggauucucugacuuuuuucucucucaucuacuugccugacuuucuuaggucuuuuaacuuuguuucuccaucuuuacauuaaguguugggauacagggcugaacaagaacagguaacugucuuauggcuuuacguuuauguguuuuccucugaaauuaggcaaauuuccuaaucuugcugaaguuauuuucauccuuaagaaaguaauauuauaggucuuuauagaguggggcaggaucaaaugagcauguuuauuaauugcuuagcauuaugccuggcacaaauucaauuaccauuauaugguaauaauuuuaauaguaauaaaccauauauuacacauguauuauucauaaucagaugauguaugcauuauauaaaaauuguacuauucuauaaauauuguaaaaaaagaguaaauaauauacaucaauugcuuugugcauccauauauuuuuacgugugcuccuuuuauuaaaucauauguuuuuccucaguuuauugguugcuuuuuacuuaccaaaagcuucuguccaaaaaaaaucaaaugcugcggcugcccugagcagaguucaccuuggaagaggcuuuaauugugaugaaccuguaagaacaaaguuuaagaauugagauaaucagcagcuguguauuucuuuaaauuuuuauauuuaaugauuuauuugaauuaacuguuaccacguuuacaucuucuagauuaguuuuuaggccuuuacuuuuccuuggcuguggguacugaccagcauggugguagguaugauuggggugugugugugugugugugugugugugugugugugugugugcauggauagauguguguguaugcucauggaugugcaugugcaugcaugaaugcauaauauuucaaacacaugcucagugauugagucacugucaggaaguaaacuuggagaccauguugcucgaugccacaauaguccuguuauugcauugucaccacaggaugccauuaaaauagguaugaagaaugucaguguucauuaauuugguucucuucagagaacauuagccauggggaaaagauacaguagaaaucugagaagagauggaagauaggagagaaaccuggcuuuugaagaaugaucuuugaucuuucagaagaggaauacaugucaagagcuuaucuaugugaaagaauuuacaugcaaagcaaaucaagaacauagauuuugcuuaucuuuauagauuauaguuucaucuuagauggcaaagaaaagccaggcuucucuauacaaagggauuugcauguuuaugauaacucaauuagccuuaacagagacuaccaguauaugcuggcugucuggccucaaacuuuaaugcauauguauuuucaaagagaacuaaaagauuuugggauuguaacacagagaaagaagagauagagaauuaucaaacauuggggaucagcuuuaaaauuauaaaacaaauuauauauguucugaaaaauuacuucaggaauaagcagcuuuuuuuuaaauaugagaaagcaaaaucauauccuguaugccauuaaagguuauugcguuuuccaaauuuauaguugcaagugauggaaauuuucuuuaacaaacugaaggaugcauuuguagucuaaaugguagcuuugagaguaguuagauauuuauggaaaaauuauaagaagcaaugugcuuuuaaaauuuuuuuuucaaaaauagauauugguuaggaaaacuacacucuuucacuauuugguaaugcauauucugacucauucacacagucauuguggcaccuaaaguguugcaaaauuagacauuuauauggagaugggcuauugauguaaaaaaaaaaaaaaaagcugagggcuaggaaugauaagacaugaguagaggguuuuaaaaaugagcucuuuguuuuccacucuucaucaugccuagaucucagagagguuuuguccagugagaauaaagaacccaugggaauuaugcagaaaucacuguccaguaaaaggaauaguuuuccuucagugaccaagggugggaccugaagucagcacuagucagugacgcuguuuuaucgucuucaugccaggugaagauuugcauaggugaaaugcccacuuauuaggagaauuacacccugacagaaauccaaaagauggugccccuuuaucuucuaucaggggauuucaucuaauacuagaaggagcaguaagauaccaugaguuuguuaccaguuauucacuggccugauccugaaggucauugccuuucuucaguguuauuugcucaguauccugccugcuacccuuaagcacuuacuuugccuauugaaaucuuacuagcuauucauucagaaguaccaguauuucuuucaagguugaucuuaugaugcuacuguauuuuuucuugccuuuuaauuauuuuuuuaacuuuuuauuuugaaaaauuuuuaaacacaugcaauguauacacaguaguagaauaaucuucugugucaccaucauacaguuucaauauuuaccagcauucugccuucuuggcucaucuauauauaccacucccacucgauuuugauaaauucuuaauaauagacuaugagauccuugaaauuugaaacuauaauuaaauaucugucuauagacaccauacacauauauauacagcuauauaugcacauacacacauauaugcauagacacacacaccuaccccuuuauuuuauuuuuuauuaaaauguaacguauccucauuguggagauagccaauguuaauauuuugauuacuguguagauucuaucuuccauugguuuuuaaaaacauaacaugaaauuuguuuauugcuuuuaaacuucauauuuuaccaugaauauuuuccaauguccuugaauguuuugaaagugugauuuuuaaaggcagcguaauauuccaucacauggaucuuccauaauuuauuuuaagaguuugcaacuguugaccacaucuuaaacuccuugcacauaaacacuugucugcauuugcaaggauguuauuaggauaguuuccuagggaauuauuaggugaaaggcucuuuauguaucuugccaaguugcuaucuaggaaggcugugccaauuuguauuauuuuuaucuuauuaacgugguagucgacauaguaucugguuguguucuuuuagaaauuggcauuuucuggauuaaugacacugaacguuuuucauguucaugauucuuauuacauguguaaaauaagguguuaucuggaauuguagugaaugguacaugccauuuaguuuagcuccaaaucuagugcuuugcagcaaugauuaauuauuuuuaguauuucacaaaucaguuuuugcugucuuuggaccagaaugucugccuaagugcaaguuacauuaguugagaguuggucuuauuuuacuuuuugaguauuauuuuaaaaaauugucacuguguauaauuuucucccuuuaugucauguaacuuuauugagaaaugcaauucaaucaggaauaauuuaguuuagguaaaacuucuuuguccaagaaauauacugucagguccaaauacauuuuaaguuuugaaaaaaauauuuauuuagauaaaaauuuguaaucacucaggguauuugacuggauuugaagcauaauuuacuuccagaaugaauuuagaacucuguuguuaaaguacuugguacaauuuguauauccaguaaaauaaaaguugccauuuuugcaagucaguguuuuaaugcugauuugguacuuuugcuaugugaaauuccccauacuccaguauaggaacugaaugaaaacauauaccuuauuaaaauaguagagguaaguauuuucagcuuccuaaacagcagagaaugcuuuuuuuuuuuuuuuuuuuaaacuuuuggaauuacucuauuaccuacaucuaaguugcaaauccaaaaauaaaacuaggauuuuauuaacauauucugcccuucauugcuuccgguuauacuuugcugaacuguguucgaguauguugaaaaauaauuccguguauuguguguugaaaaugauauuaaaaguauauguguuauguggaagaaacaaucaaaacagaccuacucagacaucaacaggauauuauuaccccaaagaaaugacgacaguuugccagcuugaugcguaaaggaaggaaauuuacaaacaucuccaagagaggcauguugaacgguugaaggaaaugaggcacguccugcuuuuauugugcuuauugcagugggauucccagaagacugaacaaggcuguccugagaccucuguuuggcagagaucuuguugauucauauuuuauuuuuguuucagaaaaggucugcuauuguucaaauuucuaauguagcucauaaacacacagccaguaucauuuccccuucuacugacugauauauacaaauaaauuaaaaucuacggucaucauuaacucauguucuguuuccauggagcacaggagaguaacaaggaaggccccuuaaaagaaaggccuuuuaaaguggaggucucaguucacaaacuuuaaaaguuuacgaaguaguauuuuagaauuuuaaucaccagauauauugggggaauuuauuacuuccuauucauauggaagaggacagcagagguaaauauuuauguaacuuguauuuuaaaagcuuacucuugauuaaaauguuugaucuaucgacuucuguauccuuagaaguuugaauugcuggacauauuugacugggguuuuuacaaaggcuucuagguugaaaugcaugguucaggauuuugguuucaaauuucugucagguuggacacauauaaaugagaaaguaauguggaauauuauaaacauuucugcuuuuuuaagcucuaacuuuuuuuugcuaucucuaccaaaaugccugaaaaugucaugacucuuuagacggagaaauagaggaauggaaaccauucuggauccucugcugugacucagucagucuaaggggcagacugagcgcuauaucuggaguuuuacuuuaugaaugugcaccuuuaaccuugagucagaaaaugugguuacugucagucuuacucaguaaguggugcugcauagaacaucagggggagacuuggccuugguuuaguagaaacuugaaggagacaaacaugaaaagcagugucagaaaauggaagaccaguguuaaaaaucuuugguuuugcuuucauuucucuugguuauuucuuaggauuauugcuuuagaucauuuucccaggcauuuucauggaugaagaauuccaaagaaaguuauuauuucaacucuugaaagcuacgcuucagggugaagguagggcuugauuaucaaaggaauuucccuggcugcaguccuaacaguuuaacuuccugugauuuccccccgccccuuucccuuuauuuuuggcucagaacuucaguaaugucuggauugauggaauuccucugggaggcagauuugagggucuaaaggugcuucucaauaaagauuuugaggaaugauauuaacuuauuagaggcaacccucuauuguuuuaguauaaaggggaugagauuugggggaaucauuuuggaugucacauuaagccacuagccauuuuacucuugaugaccuuaguugccuuuaaacuguauuuuuaguggggaucauucuuucaacaguccauucuuuuuuaaacgcaauuugguuuauaauucugggggcugccucuacaugcuguacugucaagagagacaucaaauauuuucugaguaguuuucaacacagugaauuaaagcugaaaaaacaaguagcgauacuaccagcaucuuaacugaguaugugguggugguguuugaguguuugugugugugugugugugugucugucugugugaguguuuuauguugcuguaccuacuugcuuuuagguagcuacaguuuuaccagagaagagaauaacuuagauuauaucaaaguuuuuuuuuauauaaugguuuaaaaaccugcccugugucuaguacuccuuuacgaaguccgcaagacuuggggauaacaguggacaauaauguuccuuaaggacuuacagaaauaagacacacacagauauauuuaaauuccaauuaaucugauuuuuaguguggauuauugaagggcuaggaacuuagacucagaaauggaguauuuuuccuguuuaaaauguaaagagauuuaauaacauacaggagucuugcuaugauuuuugagaggagauuuacucuaauguuucagauaaucuguuuaacaguuaauaaaaauacgauuuacauuuuguuuggauuuuuuaaagucagcacauaauuucuaaaaguaagcaaauuucuugcagggauggugaaaugaaaccuuguagcauuuagcguguauugcgguuuuguuauuugcaguuuguuauuaaguguuccuaggaauaaaaggaggugcacagcaacaauguuuacugugccgauuucugguauuuuauaauuaaagagcaagugugagcugggaagggugggcuggaaagcauggauucuggcucuaaaucucagcucgaccacuuacuaccuguaaccuggggcaacacaguuauuuaauuucucuguaaaaugaggauaauacaagucccugcuucauugggcuaugggaauuaaaugagugaaugcaucuaacauugagaacaguguucagcccauaguaacugcucagugaguauuuuuaagcuauuagcaugaucaaauuuagagaggagaaauauaauggagcaguuucucaguucuuguuagaaauaaucauuacauuugaaaauccaacaaaauauuaacauucaaaacccauuuucagaagugguggugguagaauugcuauaacggaggaaaauuuaggaauggcagccugguuaaaagaaagggcggguagaccuggaguagguuauagaucaauuuaaagcagcaaaguuuucuaaaggugcuucuaguuuuacuuuaaaugaguuugcaguugcacauaucaaauaauaagguguuauuugccagaggcauuuuguugguggggggugggagaaaguuuugggguauauuguguguguuggggguacauuuccccggcugccuuuuuccacugcugcugguccucuggucaggaagccucccugucccgcacugguucuguuauuuguucuuggauagcaucaacuugaggaugagacuuuauaggcaacacauuagccucagugucuccuccugguuguagucauuucccgguuacaugggucaguuucuccaccuuacuugagugaaugccuagaaaggcuauuucagccuagagaauuuuuaggggaauggagaagcugaggguaacuccucagcaccaacacuugaacccaaucaauacuugauagauuacucccagcacacacaauacacccagaaaucuucuccccaauccacacccaauuaaguuucagccaagguuagaauucagugguucccucuguguguguccccuuagcuguugcuguucaggugcaaagguguucauuucuuugucuacccauguguaguugccugauauccaacuaaacugcaucaaaauauggaaccccuagguaggcaaaaaagauaauuagaauacaguaguccccccgccccccuuaucuguaguuucauuuucucuaguuuuaguuacuguccaucagcugugguccaaaaauauuaaauggaaaauuccagaaauaacuccuaaguucuaaauugcucgccauuugaugaaaucugcacuguccuuugccaucucauccgggacaugaauccuuacuuuguccagcagauucacacuccagacacucccugccuauaagucaccucuagguuuucagauugacuguuacuauggcagugcucagguucuagucacccuuuuuugacuuaacuauggccccaaagcacaaaaguagugaaucuggcaauucagauaugccaaaagaaagccaugaagugcauccuauaaguuacaagggcaaaguuccccacuuaagaaaaggccaggccugguggcucaugccuguaaucccagcacuuugggaggccaaggcgggcggaucaccugaggucaagagaucgagaccagccuggccaacauggugaaaccccaucucuacuaaaaauacaaaaauuagccagacguggugguggacgccuguaaucccagcuacuugggaggcugaggcaggagaauugcuugagucugagaggcggagguugcagugagccaagauugugccacugcacuccagccucagugacagagcaagccuccaucucaaaaaaaaaaaaagaaaaaaaaaagaaagaucauaugcugagguugcaguauauuauaauuguucuauguuacucuuaguuauuguugucagucucucacugugccugauuuaugaacuaacuuuaucauagguauauaugcauaggaaaaaucauagcguauauagaauuuugugcuaucugagguuucaggcaucugcuggagaucuuaaaaccuaucccucucuuagagugaguacugugauuauguuuaaauaaaugaaugcaugcuugcuuguggaaauauuuuugugugugggguauguauauguguguguguguguguugcauguggacauuuuaauguguguguauuauccuagcugaugguuuuccuuuggacauuuggguucauuuuguagaaagaaaaugcaguuuuagaaucaggaagcugauuggaugauuccaucugaauauauguguguguauaaauaaaauauauuaucaaaagccugacuugacuugggaacugggaaguagcagccucagguccuccuagguuuauuggaguuacacuuauuaguaaguagccuaauccucucugcaaagagaggaaguacaguuuuaugauagaaucacgugggaugaggaucauugaaccagagagaaacugcugcuguuugauuuccacugcaggucaucaguauuucuugaucuagaacaaugauaaaaaguguucuggucuuuaagcaaaacucagauuuaggcuuuauccuuagaaucugaucuuuaaaacuggaagcacaagcuuuccagcuuugaauucacuccauuucagagaugaagaaaccauuucucaaagaggugucucuguugagguuucacagugaacaagucaggucagcugaauccaggucuaguguuauuuccugcaaauacauuuuauuuuucauuuuugcaguaaucuuuagauuaaacccacuccuauacuguuggauuaguuaggcacauggacuggguguauguuucccagauuugaagguugguucuccaugucauaguuauuuguucugguugcuuuuuuuuuuuuuuuuuuuugagacggagucucgcucuguggcccaggcuggagugcaguggcgggaucucggcucacugcaagcuccgccucccggguucacgccauucuccugccucagccccccaaguagcugggacuacaggcgcccgccacuacgcccggcuaauuuuuuguauuuuuaguagagacgggguuucaccguuuuagccgggauggucucgaucuccugaccucgugauccgcccgccucggccuuccaaagugcugggauuacaggcgugagccaccgcgcccggcccgguugcuauuuuuucucaguuuucuuaucuguacaguggcgguaguuauuucauagaaucauacugaggacuaaauaaguuauuucuuguaaauuacuuacaugaguacccagcauaaguguuagcuauaauaauuauuauguuauuaaugauuaugucauuauuauguauuguugauaguaauauaauaauauauugcuuuuuagacacuuuaguuagcuauccagcauaugacaauaaaaagguggcucuauugaagagaaggauuccauaauuuucuugugaaauuagcgccauaaaucauugaacaucuugcuucaguuuugugugaauuauuuggauugacuaaguacucuugguacugggcugaguuaccaucugcuguguuuugcuuccauaggucaggcuuauucuccuagggaauggugagguggaaaaaaaugccaauaaccuaaccccaaaauguauccuaacugucuuguucacauuuauaggacaguuuuauugcuguagguaagacggauaacugggcacuauuccagcaucuuggcaguuuuccuuuuuucaagguacuaauauuaggauuagcauguuguuuuaaagccauugccuuucugcaccuuauaauugcuuguucuugggggaggcuuggaacauuugaauuacgguuuuucugccaaauaugggagagguugucuguuuuguuuuaauacuucgauugguuuuuaaaguugguacuacaguccauuuugccaacagacaacacaaauuagaggcagugugggcacacuguguauggggcagaugcagagaggggcagcgaauaugcaugagcgagaauguuauagcucugucaguuuuuguaugugugccucaguuuauuuuugguauugauaccaauguucggcaauacagugauuugccuccucuauuuuguuucuaaaucaaagccuuggcagauuaaaaugacuaggaaaagauuaaauuguuaaugguauaaucauauuuuucucuaaagcauugaagaauuacagugucuauacuuauuagcaugugauaacuuuagugauugaaauguuuagcuaguuuuacucaaauauuaguaggauuucuaauuuucauaggagagccuagugccacaaaaguuacugguaacuagcacucuucaguuuucaucuucauguaacuguugugagcauucaaggaaggagcugggaaaugguuuagucuucauagaugcucaacagaugugaguucucuuuucucccauguauacguuucuuaucuuuuuguagaguucaugggagcagcauuuauggauucagacuuauauuguugacaauguccuugcuaccugauagaugaucaguaaguguugcagaacgaauacauaugagagcagcagagauaggaguacauuagggcaauuagaauagauuccuuuuuuuguuuguuuuuugagacagagucuguugcccaggcuggagugagguggaucggucucacugcaacuucugccuccuggguucaagcgauucuugugccucagccuccucaguagcgggacuacaggcaugugccaccacaccuggcuaauuuuuauauuuuuaguagagauggaguuucaucacguuggccaggcuggucucgaauuccuggccucaagugauccguccaccucggccucccaaagugcugggauuacagguaugagccacagugcccggccauuagaauagauuucaaagaaaaguugacugugccaaucucugcucccuccuguauguuguuaagucuacagggccauauugccuaaagaaacggaguuccccaagaauguguuaggaauaacaaaaauucuguacuuugaccugaaaauugcgguucuugagcugguuauuuuucuagguauuguuggaaguuaugagucagaguuagguacuuauucguggauaacacaaggacuucugucagagaucuggaugcugucaguagaaucucuguuuacccucuugggcucaguuuauucaucuauucuaugaggaggaguaugccuguuuggccuuccucuuagguugcuuuugagaaugaaugaaauaauaugugaaaauucuguucauaaguguagaagauggcuagugaugaugaugaugaugaugaugaaauugaugaugcccaaaauauggagaaucuagacugaauuuauggcuuucuaacuucgaauuuucggcuuucuaacuucgaauuuucaggaaugcaugaugauagaauguuuuuauuucugauauccacugcauuguuucuauagaccuucaaaguuugacacaaauaacuaaauuauuuuguuuuguuggugaggaucacuuuuauuuuagcgguguauccuguuaaaauaaccuugcaugaggauucucaaaguuauacuaauguugcacuaguaacuaaggcaguuccaaaaagagacauuuagaaugaauaaggauaaaucaaaaguaauucauauccauugguaaggagguggcacauaccaagugucaacuguagauauuuuagaaauugaaguguuaccauggaaucaaaguauuccacuguaagguugaauaucucaggauaccuacuuuaagucgucgauuaagaugaaguuaauauucauuuuacauauccugcuugaaaccucuuaugcugugaaauuuuccugucuauuaagaauaguuuuagaaaaaugaauuagcuaauuccuuaacuuguauguaacuugaauauaaguuccuuuccuuaacuugugugaaaaucaguucuccuuugugaagagcaugagagauaccucaauaaaauaguaauuuuauauugacaucgguugcaguuucaaagucagaguuuuacacuuaugugccccuauauugucuagcuuuguaauccccacuuuaaaaggcaucccaaaauagcaacagaagaauaaauugugacuuggguguauuagauuuguaugaucuuguuuauugagcugcuuuguuauguaguuaccaaggaugauguaagcuucucauccaaguuuuccuuuacuaugcugcauuguccuuuaaaugucaugagaauacaaauauuuucaagguagcagugaggaacaaucuagaugagaugaccaaaaggaccucucauaugaaacugcagugagcaaagguuuauuggucuuuggaucucuaaauagagugacuuuagauaucuaaauuuagugaaaaccagaauucagugacuuuagauuucagaccauaagggguuguaacaccuacuccuuuucucuguaaugaagaaaaaugaccacaacaaugugguggauaucagaaauagaaacuuuucaucgucaugcauuccuggaaauuccagguuagaaaggcauaaaagagagagaaaaccugucauaguuaguauaucuaccuugguuaguguuuuucacuuaggggauugcaaauucauaugagaauugcugagagaaacaauuaauuuagaacaaauauucuccuuccauuguuacagccuguaaaauguuacuucugaguugcuacuuaucuaucaccauuucucuuucuccacuucauuguuaguguuuguaugauuagggugggcgggggucuucuggaugggguugcucacacuccacaaagccuuuucccucuucuguugaaagaagacacagcugaaaucagucucuuugccuuuucaugauauggggaugcgguggaaucaaagcaggcaggaugaaagcccaaaagcuuccuguuuccagcuguuuucuucagcgaagguuuuuuuuuuuucucccaaagaugaugcuuccuuucaagggguuuuuaaucugcuaacuguuuccucaguuuauuucacuacaguaaaauguguucccuuuaggucauaucugucucuuuuaaaacccaaccuguccuuuucagccguguuaguugcuacucaaaagaacaaacgugauuuauaaaaguccuuuuaaugagguacaaagaccaauaaaccuuugccacuagaguuucaucuuuucaguugcuuuauuuucauuuaugaaaaauuugagaugucaaaaagccauugagaacacuauugauuugaccauuuaauauuuguaaacaaagccguuaaaaauaaaauauauuguuauggccuuaagguugguugugguuuuuuuuucccuuccgaaugcaguauaaucauauguaauuuguuuaauguaaauucuuuaaaauuaaggcacuggaaacugcauaaaugcuaaaaugaauacuaagaguggcuugauuuauuaagugauaaugugcaugaaaauauggcuuuuuugcacugauguuuauugcuucacuuuuugcauugauguuguuuuggaauuuacauuucuaaauucugcauccucuagggauaaaugaaauauaaaaaugaauucuuuuaaucacucauuaaacauuaacuagaccuuucacccauuuccuagaucuuccaggguucucaguaauaaucaucaucauuauacauugauuuauaaaggaauaucagagugagucagaauuuuucuguuucuuuaucacuugucuuuccccaaauauccauacugaccuaaacguaggagaauuuaucagcaagaagguucacauugcugcccuguuauuugagcucauucuuugugauauaaugaagccaguggcauaugggggagaaccaccucauuucauuuucacuuuaaugcuaacucuaacauaugcuuuugaauugaaguggggucccaaaugccaauauauguuaaaagaauuaaacacuuugaaaaaagagaaaguuuucccuuauuuacuccuguugcccacucucuugagggugagaggcugauagcgcuuaaaaacaugagcaugccuauuuuaucuguacuguuuaauagagagcuaugaaaaaaauggcaauuaacauauucagacagaaaaucauccuggcugaaugacucauuaaauagucguauaaacaggaugugccgaaaugaacugguucagaauuuaguuccauuggucuuuucagcacacacugcucauuaucagcacuuuaagaagcagacuugugggugcuuagaggacacuuaaauuucuuuucucuuuauuuuuuucuuaaauacuucuccccuccuccacuccuuuccccugcuauuccuaauucuuugcaggcuaagauuacucgucuaaacaugaaacauucuguuggcaaucgaguuagggguaagagcuucugacuuucauccaggucggugguccuaaccccagaugacaaucaaaauguauuugaagauuuuuuuuuuuggagacaaagucucccucugucgcccaggcuggagugcaauggcacaaucuuggcucacuguagccucagccucccagguucaagcaauucuccugccucagccuccgaguagcugggauuacaggcguauaccaccaugccuggcuaauuuuuguauuuuuaguagagaugggguuucaccauguuggccaggcuggucucaaacuccugaccuugugugauccgccugccucagccucccaaagugcugggauuacaggcgugagccacugugccuggccauguuuuuaaaauaugcagacauugcugaaccucauuuuuuugggcuucccauucaguaggucuagaggcaaggccugguaguccguauuuuaauaaaagcucccaguaggauucagauagccagccgggcuuggaaacuauucacugauuuguguccccucacaguaaaaaugcucuuuccccagguacaggauauauggccaucuggccuggauaucagugguuugcagaccuggcugcaaauuagaaucacuuggggagcuuggagaauaaauacugauguuugaccccacccccaauuaaauuguugguggggggaguaguuaaaaccuccccaguugauucuaauguacagucaaguuagaguacuucuguccuacauaaacagauggagcuagguuuagcugaaaaagucuaguuuucuuuuagaauaugcuuuacccugugcuaaaacuccucuguuacugugccucccuagccacacacacagagcuuaaacguauugccucuacuaaggcuuucacauuuauugguacccuguucucaggugggaguagaaugcuaggcucucacguuguaucagauuccuguuucuuccuaccugaguaucacaucugugaugugcagauguguugguauagcaugagcaccccacaaaggcuaaguaauaaggaugaagaacaaaauugcaguuuagcaaaggaaggagcauccaucuuuugagucccuguauacuccaagaaaaauucugaguaaacaaguuucuucuuuagcaaguugugauauuaaaugggugccuuucauuacauuggcuaacauuugcauuucuuggaccuguucuggaaaagggucugagaugaacccaucguugaagaucuaaaaaacaaaaacuuucaccaugucaagggaaagaggaaagauuuccauaaguguaaucuuguauucuggaugguacaugaaaacucuacuuccuaacugcccacagggauuuaagggguauuuuaagggguacuuacaaauaaaaggaagaagauacauuacaucacauucucauuaccaaggagaaacucauccucucuaggaaagguuucucuccugucuuacgugugacuuuccaccugcuaaguccccuugaaguuacugagcaaagacacucuuacaacacuaagccauuggugcuagaaguggaaguagacggagccccugagguucaggugccagguccuuguaucucugauggcgugggaaacaaaagucagcagccauuucucuucacuagagacucagaggagguaaaaaggggggauucacgaagucaucuugauuuuuccguaucuuauggcgaagucuugugguagaccccagaacccugaugguuggucucacgcucguaaguuuacauaaggcuuucucaagaaacugacauccagagcgcuugccuuagagaagacagcugaccauggucaugacacuggcagguguuaggacuggcuggucuacucugguauggcagaaacccugggccccugaauaagggaggugauuaugcuuuaaagucuaggcuuaccauguguagggcugugggacucacugucaggguuguguaaggcgagggccaucgcuugcagaagucugagugugugagcacccccuuaaauauugcccccaggugcuguacuugcuuaaccccggacccagcccuggcagggagcaacagcaggagggaaaaccauugguaauuuaggucuucacaucuuaugcuucauuuaaugugguugauaaagagccuccuuguaaaaauaucuugguguagacucccagggaaggaaacacuugugugacugacaagcuggcagugcccauggccacgugugucacccugguggaggauaaucguccuauuauuuuuugucaguagguauaacaaguggguagugcuuuguguauuccacugugaugaauuaauuuuguguucauuguaguagcacugaucauaaugaauuaauuugguauucauguggaugucagagguuuuuuuuuccccuuccaauuucauguagcuuuaguuaauggauacuuuaaaguacaguacaucugaucugauuucuguucucucauucacuucucauaauuuuccccccgcuggauauugugaggucuucuguuuuuaaaacauuuaacuugaucuuuaaauaauuaauguuuuaauagcuuuacaugaacucaaacauuccuccugcuuuuaauuuauaaaauaaggaaaauaagguaaauaguuauaacaaauauaacugcuagguugaaugauauacuuaauaacuuguauauuuuaguuugguuuaaaaagaucugaacuaaucauuuguaauuuguagccuuauugaagacaaauauuguauccccuuaugcaaauaugaaauaaugaaaacugcaugccguauauaauaguuugcucuucuuuuaauuucuucucucuuucccucauagacaagauugauaaauguaugugcauauauuauuuaucuguucauauaaggacauguaauugacuauuagauaugguaauugcauaaauauaucuuauucaagcucauuuccuuuucuguuuauaaaauaaauguuuuuguuaaauuggaauauguacugaaauagaagugccuaauuuaggauucagaaacuagguacacaaacaaaaaucaaacaaaauucugggaaccuuugacaaacuuguucuuuaaccuauauguguuuaaaaaauuuguucaucauguuugcugauuauugaagauauuuauaauagaauaaggguuuccuucaucacuaacacaccugcucggcugauuugcucccaguggaaauaugguugaaccuuuagaaagaacgauguuuuuuugccuuacgaguaucaggaugccauuuuuggucuuucuuuaaauuuaaacuuggaaaugguauccuccauauauucucuuguggcuuuaaacuuuuuuuuuuuuuuuuuuuguaauuuuacagcucuuguucaguuugauucucagcagcagcuguauuccauuguagacugcuguguuucagcaauugauggauccuguauauauucuacuauuuagaguauauaaagaaguugggacucuugcaaguggcaaggacuauauaacuggguuacuauggcuuucauuauuuuuguuauuauugugacagauuguacaguaauaugcuaacaaagauuuauggcaucaugcagcaguaggaaauguugggauggaggagaaaacucauguuaaaacaaaugucuauaauaauaagaggaaaacaaaacuucaaaaaagcugagaauuguuucuaguauaaauauuuuuauuaacauuuguuaugguugaagaucuugagaggaacuguucaugcauuucugcaguuuagauuaugcuguaugccuauuugugcaucaucguucuuaggagauuguucuuucuucugguuuuuuuuuuuuuuaguuuuuuuguuuuacuggaacacauagguauugaauaugcaaugaacagaaaauuuauggagggcagaguuaugaguaucugaggaaaguuuaauuacuuuuauaauuuagauaagcuucauaauuuauuguaacacgcuguacuuuggcacaauuuguaacaauuauaaagcacuugaauuuagguucuuuacuuggcagcuaucaacagaguuagcuguaugaaaacuuuaagcauuuacuuuccuuccuccgccuugcauuacaggcuuacgcuguaguaguuuuguugcucccacuuucauuugccacaucucuggguuuuauguaucacaguauaguaggcuuguggcuauacacuaggaagcagacgaagagagaaccugaagauaccuccugaugcccaaaccuaggaaagggaaaaaugcagaagaacucagacgacucuuggaaaugauucuugccucaauuaaaaagaccucaccacucaccuccauguaaaggacaggucgugaauuauucaaaugauucagaaaucaacauuuaaaaaaaugaacauaaauuccuuuucauaauuaaagagcgguggaaaauggcucuuuucuuaggucuagauuauauugcuguuaaaggaauugcugccuaguauacaauuuuuugacauuguuuucuacaacaucaaucuuauuuguuguccuuuuuugucacgccuguuaaauguguauuuuucuguguugauauugaaacuaauguacaaagugugacaucuccaaaaacugauuugguuguuccuaaaaacauugguccuuaaaaguauauuuauuugcagcccaggaauuuuuagcuucacauuuuucuuuuaauaacuaaacuguagaacagaauuagcucucauaaaaccuuguacuugcugaacaacucucauaauuaaaugaauauaaugauuuuaugugacacuuugaacuucuaaaguucuuucacaucuauguauguuuaggacaagauuuaaaaguuaaauuauucuacaguuggaguagaaauaaguggccaaguauccaacuuuuguaucucaaauaccuucuuuuuuuuuuuuuuucccaaauaccuucuuauauucuccaccgacuuuuugggcuggcuaagugugacagaaaugggaacuuuaguucuggcuuuugauucucucauguuaauguagguuuuugauaagucacuuggugcaaaacacugaaacaacuuaucuauuggcuuaaaugagucaacagucugaaucaaacagguugugaauugguuaaaauaauaaaccaguaacccugugguugagcucuugaugauuaaagaaccagaccuaagaaugcauuuauagucuuuuaaaagagaguaaagacucccacuucuuugagcuguguuucuuuguguagauuucuuuuuuuuuuuuuuuaaagaaaggcuucauuaucuguuucagaucuuuauagauguugcaauaagguacuccuuucuauuaguauaggauugaaaggaucaaaguuaauaacuugaacugagaugcuuuaaaauaacaaaauaguuuauuaucucuuuccuuuucaagauuuauguucuuacaaggguacaauguucaugauugaaugugguccuacugguaaggcuuccauguaauagaagaguaauucccuugucuagcauucucuggguuguuuuaauguugcaggugaauguguucugcugugcaaauaaauguaguucucuuauucacauuccugaugacuugcauccuuaaacccuuuuggucaggguauuauuguccuuuauccugaaaaaugucugugauuguagugcccuaauacuauaaaucaauggggacugaauucagcgccugcuaaguagagugaggcaacccuuuaaaugcaaaugcaucagggcuaguuuuaauguaauuuuaauaaggcugaaaccauuuugaaguagacuuaaaucauaauacuaaucuuaaaagacucucuauuuagcugagaagucccuuuauucucacuggccauuuuuccucugugugcauccaaaccaccuuucaugugauuccacaguuuuucauuucuuuuuuuuuuuuucucaaauagaauauauguacaguuugugguuacuuuauuaguuggagaagagcuuguauugacuaaaauugcuucacuucuuuuucuuccugguuguacaugccugacuaaucuguguguguguguguguguguguguccauaauauuucaaucacauugcuguguuuuggucagagaaguaaaaaucuagcugucaaugccaacuggaguaguuauuuaagaauauaauauuuaaguaggggaguauaugcaaaguaauauaaaaaugaggaaaacauuuacaaaaucaaaugugaccucaaguccaauauuuuucaaucuucuaagucuguugguuucaccaccucacauuauuucaauguaugugaaauauaucuugcuguuuauauuuggguugaugggacaggugcaggaucuuugaccuggggaaauaaauuggauuaaggacuagcuuaacuagucuacagaaacuguagacuacaaaaacugaaggcaagaaccuacugucacaucuuuugcagagagacaaaggcauuuugguauuuggauauuuuacuugggauauguauuuuguguauuuguguaauuuuguauuaauuuacacaaacuuaaguaaacaauauauuaauaagauucaucaaguaauuuauaaauuaacuuucccacauuuuucuguguucaagaauuaucaaggagauguguaaauauugaagccuauacuauauuccauuauuugcuuuuaauguauuucauauaauucagaaaacaguaauuuaucauuuacauuacuucccuuuuccuauugagccuucugaaagaauaauguagaccagcauuuuaaaaaaaagcuuguuucaagacauguuaauagaaauuuuauuuucaguccauucugcauuaaauauuguaaaacaccccuagagagugauauuauuuguaaugauucccaaauugcuuugaccagagaacuccuuuuuucaugaaauaccucccauguggaacauucugcagaagaguuuugugaaaugcuaacucagcccaaaagguuuuuuaaauuaaggccuuucaaguugguaaugguauuuaguuucuuguuuuuuaaaauagacuuuguuuaggacaguuuucuagggucacugugccacucaugcugacuguccugucgucuugaaaaauacuacugguaacaugugaacagauauggagguccucuacccgaguauuuuaauaccaaauaauagcuauaucuucucagauauugguagcuaugucaauggagaugugaaauuggcucuaucgauggcuuuuguccauucuccaagagaggccugucuuuguggguggagguguugguggauauguguaugugucuccuucucuuacccucuuaacaguuuggucacaguggugaccagugaguauagagcagagccuugacaaugcaccugacuuugggcuuuagccagauaguaugaaugagugaagcagauguuaaggagaggugaguuuagggcaacuggggcauucgugcccccucauucauucaguuaacauuuccaagaauccugugcagggcaaauaagaucuaucucaggaccagcaauaucucauccuugguaugaagauaagaagucaggagacuugagcuguagguuugguugucuccuugccuggcaggcuugccuaauuuacagcaaguagaaaauaaucugugucuuguucaaaucuaaauaacaaugcuuuaaagguaguguagaauauuuguuaaaaagaacauauuaauuauguuuuuagaagcuucuguaaggaagaaagaaguuugaccccccaacuuuucucuuuucuagaacugcaaauuacugcuauuuuaaauagacuuuguuguuuaacuguacauccaggaaaaucuaggaaauuaaagaagcaugcauauaaaugauuguguagcagaacaugaacauuaaauucauacagugaagaaauuaaaguuagaaauacucucaaacauaagaagguucuagaaucaauccuuuaagcacagucugagacaugguauaucuuugcacuuacuuggaccuugguuucuauuccugugaugauuauuggauuugaugccaucugauguccuguuccucagauucuaugaagcugagucugagauuaacuuaggucugagauugacauaaaggggaaccggucccuagauuuccucagggcugagaaguuauugauuucucaaguauaauaggacugcacagacgcacaauuugcaccaaucggaacaaaauguuuaacaaguucugaguauagaaaacacuuugcaauuugaauuucuaugauuccaaaauucaaaaaagcuccuuuuugauuaaaugcacugcccucaaccacacaugcucauuuucucugucuacugcuuugucauucuguuuauuuaacuuuacuuggcauaccagaguuuuaacgcugagauuuuaaaguacauaugcaaaauuggaaugugucagagaaccuaggaacagauucaucaaaggagucaugaggcacauugcacaugcuuuaacaucaagguguaaacggagcccauuaaacuauuaguuaaguggugaucaggagcaagagccugauuagauuacaaaaucuucugugugugagcgcgguaugugaaaacauaacacuugauccucaccauagugccaggaagauucaauuagagaacugguaugugcccagauuuggggacauaaagggcaacuggauuuugaaggaaagaugguaaggaaacaccugcaaaaaucugcuucucugugcaacagacuggguaauugcauaugcagauggauaguuagggauauaauugcuugauuugugaacauaaaugcccuuucgauugugucaguguugaauuuugcagugacaggugccugcggauugcuguguguguauccuuugcaccccuguuuaaauauuuggccuggaguaugucuuccauucauugugaauggaaccaccgccgucccgcccccaugauggucuggggguauuguuauagcucuuaaugucucuccaacuuuuucucauaaauaauaaccuuaauuugaaaccuuaacuaaaagaaggacugcauagaggcauguggugaagggcuuacgaauuaugcacagaauucauuuuuuaaagcugcuggauguaacucauuaguuuucauuguuuucucaaaauaaggaaaacuauuaaccaacacugcagacuaauagccuggauuuuuuuucccccauaaucaacugaaguuuaauggaaaaucaucuuuugaaagacuuccuuuuuucuccuugcuuuuucuuaaccuuuccauuaauacuguuccaauaucuucucuaaucucucucaacuaaauagcauucucagucauuccuuuucuaugucaacauuucuauaccgcacugaagauguuuguaaaaauacuggugcaguccaaaugggauuuauuuuuaaauugaagaauuuguuaagcacuuacuuauguggaauggucaggucaucuccguauuccuuucucuggccuuauggagaaaguggaggaaauggugucugccuuuaaugagguugcuaacgugccugaacuacacaauaaguuauuaagucauauuuuaugugauuauucaguuucuuuuuuuuuuugcuccauucuaaaucaaacuaucuaaauuauuuuugucaaauaaagguuaauuucagcaguuguugauaauaaacacuugcauguacuauucauaucaacguguaugauacucugcuaaguauaguacaucaguaaucucauuuaaucugucaaacaguauauauuauucccauuucacagaugagcaaacugagcuauaagauuaaguauauuacuccugccauauaguuaauaaauagaaagggauuggaguucagaaauaugugccucucuagcccacguuuguugcuguuuuggcaucuaauuugcaaauauaaauaaauauaucuaaauaaauaaaaaauaucuugaaucugccuuuuuaaaggagccugccaaagagaggcaaaauaaccgcagaaaucccauuuugacuggcuuugauaugaagacuucacacaacucuuauuuuaauuucuugguauuuccuuaugcuuugcugcucuucugaggcacauuuucucaguaagauauucuuuaugcuuuuuaacuaaaaauguggggauuaaauuuuacccacaaaaagguuugaaaccguucuuucuaauucuucaugugucauuaaaaaaguauccgcauguauuuuggugcguguggagaaggagcuggcacugugugcucaaauaaugcucagaaccaccugcuuugaauguggucugauugaaucaaaugacgacugcuuuucaucaccgagccgggauugggaugugggggaaguguuuuguuuugauauuucacaugugcuuagguguucgugguuucagguuguuuaagaacagacucucauugaguguuggugaguccugugggggagauuugaaagcaacguugaggauuucuaggucuguuucaaaauuacauccucuuguguggugcauuuauuuguguucaggaugcagauugccuuguggaaaauggcaaaucauuuucccucauaaaagguuucuuuuguuuuuuuguuuguuuggucuucagcuauuuuuuuugguaguuuccccuccugaguucagauuaucaguacuuucaucauuuauaccacucgguucucuggaguucuuggugcacuguggguccacuuuucuuguuuggggugaugacuaacaucugcccugauacucgccugguacuugaggcucugaacuuuauuaucuucucuucaacugcagcucguggcacuuguaggcaacgugccucccaaagagccugaaagagauuacagcucacuuccugccaucagacaguauguggggaggucaaggggugggcagaggagaggcuuggugaaauucagacuuuugggccccaucuagaagaaucugcuucaguaucucuuggagcuacccaggaauauguauuuucaacagugcuccagaucugagggacaguuggaauuaggaaaacuguggcucuaacugaugccccaguacuucucaaagugggugcccccacauccugauaugcuggauguguuuuguaacugcagauuccugggcuccacugggagugguggcccuggaccagccucugucauguguccccaaccacacucuugggauucguauuuguaugaacuuuagagaaugaacugccacagagauucuaggugacaggaaauugugggguaaauuggaggauuacagaucaugcuucuaauaucagcacagguacacacaaucgucaaaauaggggacagguguguuuggaaagcuuguuuuguaaagaaagucuuuucucccuuugacuucucuucuuuacguggaagcuacacuucugaauuacaaagagacagagaaaaaagagaacaauaacaacaaaagguuccugaggcauaccuaagcugcaggagccaagggagugucccuuguuuuacuuggugauggcuguuugaacagccguuugcuuucuccuuccuguccucugaugugaggaugcaggauuggaaucauuagaaacccuagguuaguagcaucaggcucccugcccuguguagucucugggaggacagagcugcagcuuaaguugugcuuuugucuuggcaagcaccuuucaauuuuuauccuagcucaguugcuuuguuuggcauuuuacuggccaauacuccuuuuuuuuucccucucuucuccaucuccuaauucucaaccucuucuggggccaaaaacuuggaggaaagacuuuaaaaaaaccaauuucacuccuguuuauguaaucguuucuauauuacagaaggcuaugguauguuuuaaaauguauacaucucuuugcuuuucucccuugugacugaauuuuugaaaaaugcuugaaauacggacaccaaaacggaauguaugugugucacauuuaaacggaaaacccuguuuguuuuguauauuagacuauagccaaugaaaacccagggaguaaggauuuucaugaccacaacugaauauagaaccucauagguuucuguuauaaguauaaauauugagaauaguuuuguuuguuuaugccagugcaguuuuauagcaaauccuuucaaauggggugcaaagccauccauggauauuuguaaaggcuuugcaaaaucauacauaaaauaaauuguccauuugauuugaacaaguuuugcaauuauuuguggcuuuaacaggggcuuuugaagggcacuguauauaucuaccagcugguucuacuuuuuuuuuuuuaagaaaauggagagcuuuguauacaaucccuuggguaaaccaguaauaaacuauauaucagguagucaagucaugccauuucaaaucuguuuuacauuuuaaagggguaauaauuugugaauuucaucucauagaaauuuuuaugcuucaaaucaaguuguuaucccauccuugucuauuuuuuuuuuaucgauccccucacucaguguuuuagagaaauaaagcauacaauggaaucucuugcugggaaaaaauacuuucuuacuuauuauauuguaucuuguaauaauauauuucuaucaccauuuaaaaaacauucuuuuaguuauugaugauuauuuugucaaauuauaugaauuugguucuguuuucuuuuugugacaaagauucugaauuuucauguuuaauaaaugcacuucuucacaugacaaauguucauugagcccuuagccaggcauuggugucaacccugguucauaggugcccagaguuccuguccuucugaagcuugcauccugguggggaucaauaaacaaagauaccaaccaacaaauauaaauauauguauguauguaauugauugauugauaucugugugugaguguuuccucaauggcauuaugcauuuauuuauucauucuucaugcauuuguugugugggaaagaauguuuuccagguugaggaaagacacgagacucgacagccagggauauauuagguaacggugaggagucuggugugauugaggcacagaaggaagugccaguguaaaguaacaugagaagaaaguacacacagauccugagcaccuuaaaugcuagccuaaggaauuuuaaguuuauacccaaagcaauagggagccacugaagauuuuuguauggagaagugacaguugucaguggcucauaguagauuggagugggcaccuuugcugaaguuagggaaccuguuuucagguccuuauuaugagacgugcuaguuaaaagaggaaaggaggggaggggguuggcaaaggcugcaguuaguuacauugagugaggucaaguaaaauguuuugaagcauuucuauggagaagucccagaucuucuuaccuuucaugacuuuguuagacucacucuucagugaaauaagacuggucuugauuuuuccaugcgucuugaguuaaagcguuacccuuugcuaccugggcucuacgauuucaccuguucucuggccacaccuuggaauucacuucuuugugcucuccaauauuugauuuccuucuugucuucuuuucuuuguuguuguuuuuuguuuuugauacaagagucucacucugucacccacgcuggagugcaguggugugauguuggcucauugcaaccuucgccucccggguucaagcgauuuuccugccucagccuccugaguggcugggauuacaggugugcgccaccacgcccggcuaauuuuuguauuuuuaguagagauggaauuucaccauguuggccaggcaggucuccaacuucuggccccaagccaucugcccaccucagccucccaaagugcugggauuacaggcagcauggccaccaugcccggcuuuccuucuugccuuuucuuaagaguccugcuucaaggaaacuuccgucuccuuuucaaaaacuauuucaguaacaaucccuugguguuuauuuaccauuuguagcuuaaacuuaaaacuuuuucccuguauuaguuauuuuucaaauauacuuuuugucucuucaacuaaauuuugagcucaggauucauaauuuauuugaagagguacaaacagaaagguucugucccauauuucuaaguaguaggauuuauuuuuccuucuauugaaaugaaaauauaaauggccuuugaggcuccaggagagcccacaaaauuuuauuuaguccaaaauaccguaaaacuucaguauuauuaauacuuaaagaugguuugccucaagcaagaaauaugaagcucuggggaacacauucugugugugugacacauccagacagugugguuugccaaaugguagcugauccagagugagguucuuaaccuucaucaagucagggacugcuuugaaaauccaaugcaagcuguagacugucuucccagaaaaaugcguauagcuaaauacaugaggaaaauucugcaguccuuagucuguguauguagcauguguguagguaugauauugguaaauccaaaagaaaaaaugcuuuuuaguuaccuuuuguagccauuaacguuaccugugcuaagugcucauuaggcauuugcuggcugauucuauucaugugagggccacagggaccaggagaggugagagcaaagaugcaugcacagaucagagaaggguuaaauggggaauuaugcagcauguaacuuauacauuuccugaaaaugaugcuucuguggacuuagacaaaaaugaguggccaggagaggauugccguuggauagaugaagucuagauuuauccagaguugguauuucuuguuaaagaaccucagugagcaguaaguucauaaaccuacuggggugcugguggagggggagaucuacuguuuauuuuaggauguuuucagcugcaacaaaagaaaacccugacucaaauggacuuaaacauagggaaaugucuuacauuacguuaccuauuccaaaaucucuggugguuuccuuccuccguguacugccuucauccuaggaaugauaaggaaauuccugcuuugguucugggcaucacauccaaacagaaaaaucaucaaagaggauaaguggucgucuacugaugugucucuuuccuuggaguagggagauauuuccaagaacccaguagaggcugcaccuuugugucuuagugcucauuuugaaaccaguaucuggccuggggaaggcaaggggugugauuggcuguaggacuuggggguuucccucuggaacuggaaaugaggucaccuguuccugauccacuaggaggagugguggcuaugugaacaaauagcaauuauaccaaaaacugcugcacguucuacuaagaaggaagaagagaaaaauagauauuggaccaacagaacuaacagugucauuguaucuucugauaaacucacauucugaauaaaaaaggaagucauguuuguauuuuuaaaauuuaucuaaaucuguuguuauuuucucuaccacaacacaugggguacagucauaugcuuaaguccaugugagugagcuuuuauaauagauguucuguccacacaaggacugguuuccaaggcccgcacucaguuuacuuaugggccccacugccaugcacaauuaagaaaaagacgagauuuuagcaacuuggacugaacuauagacuuugccuaaacucauuauuuacagcagcacuuuucuucauaggugaauuguuaauagguuugauuacuuauucuugccuuggagaauuuucagguauggcuuacaaagugauaugaauugucaucucucaaaugcaucuuuaauuuaaacauauucucuauguuucuggguagaggaagaggaaaaaagucuaugaaaaugaauuuaaaaugcuucucagagucaguauuaauuuaaaccguugcgguuuucuguggggcauauuuaacccaaaagaaaagcccuuauaauuaggaaauugggauucugaauaauuaauuugaaagaggaaauauaacuuuuucuacagagaacaucuuucauccaaauuuggaguuccaguuucugcagaugucacuucucucucauaacauaagaaaauagguaagaggcaguuuggaaagagguugaaaggagaaauuauagguucuccucccagcuuuuccaauaacuugccuugaggacuuggaccaagcccugacuuucucugauguauaaaguuguaaaggaagaugaaauacugugcacgaaagugcuuugaaaaauugaaagcaguaaacugcucuaggauauuuauuguuaguguggugguucugguuauuauaaaugaagcagaacuuuaaauauuaaugguacucuuguucaucaauggggaaguuauaggggaaagguuuuccaaaaaaugcugagcuauaacugccauccaaguaagugacgcagaaugccuaacccaauuuguaucuugcuaucaccugaucacagaaagcuguuucacuguagagguaacaguuguuuucuccucuguccugaggccaaugauuauauaauauguaucaaaucacuagggugcauaucaaagugagcauaaagaggcaaauauuucccuuuacaaugaccauauaagagauuauuucugucaggggauaaggcauacaugaagucugacuguuucacugcauuuuuacuauagaaaucacugagcuugagacuuguacauuaacuccaucuggucaugugacuggcaagugaaguguuucaauguguuaagaggacugaucugcauauuucuugcugaaucuuaaucuguacuugcauauuugugaaacgaaugaguauuuaaauuauggagaaaagauguauugugccaaacuaaccuuuauagcauaccugugguuguaguuucucuagcuaacaguggacaagaugaaaacucauuauacauuuucaucauguuagguauucuucucaaagucacaggagcacugcagaaugguucguaacuuuaugaauucagcuggcauuuuggauauauggacggccccuuugaggggcuaaagacacagccauccauuucaccaagagucgccgagggugccuuauugccccuaccccgugcuggguacugagggugggauagaaggcaaaccagacacaucccuuguguuuaugcagcuuuuucuucagugggcaagacauuacuugagaauccuaaaaauauaaaauuacgucuaugacaaguccaaugaaggagaaggacaagacacuugauugaggaggacauuuauugcuagucaggggggacaaggaaagcugacccaaggaaaugaugauucagcugaguugauagaggagugaaauagucauaguaggaaaguggaguggugggaguugggaggaaaguacuguauuugaagaaccacguguucaaguucugcagcagaagggccaaugaaguacuugaguguugucaaaggcaaucaagguaacuggaagagagaacacgagggcgugaggguauguuaucaggaugaccuugauguucacaauuaagaaaguugcucuaauccugacaucaauaggaagacugaaguaucugaaggagggaguuugcaugucuguucacaaagaccucuuaagcaauacacuguacacuauuaauaugccagugguucuuggggcgcugucuccaaccugugguugucucacuacuguauacucuacuccuuccccagugugugcuaucugugugauuugugugggaucacuacaucccugguggacuacugugacuggacuaaaacaaucaagguaauccuaucccucucaucacggugauuaauucgggucauccaggccuaagcaaauccaugcaugguauuuuuuggcuuuagggauuguuccaugauggucccaaucaggacaaaguucagcaggaauuuugcucuuuuauagacugaacuugcugccauugaaagucaaugaggaagcaaguagaucuggaauccuaugaccaugagagaagccugcuuuagggugaaguugacauggaagugucagaggugagggguacaaagaaccauuuuguccuugcuaauauaguagauccacuguaucucagauugcaccugauaccuguugaaguuuucaggcuuuucucaccccuaggcccuucuccaauccugaugcuagcuguugacaacagucauuauuaaauaaauaucagaaaccucaucugaauucaaggaaucucccagcucuuucuaaacccauacuugcucauuguaacuguagcucaggccaagauggaauagacuaccuuggugaggacagguguaugaagaaucacugauuuaaagauuguucauaacguaucgcagucauuaggcauaagucuauuucuugagacauuguaagggauuauucuuggaaggacauagguccaaaauguugaauuggacgucuaggagucagggugguaaaaaugaaguauauauugauuaaguggagaguuacaugaguagagaagcaaaaugaagccgaguagaaaauuaaagguuuugggaggaguacugccugaauuuagauguuuuuaaaguacagcuuucugucuucaugggaauaucuuuucgauauacugagaaaaagaaauccagguguucuucacuuuuguaagcauccugguuuuucgugcagggagcacagacaacaggauuucuugccaaucaguuaccauugugaggccugauuuuucaucuguaaaaugaggauaauacagucuaccugaguaauggcugugaaaguuaaaugaagcaauuugaguacaaauaccucacaaugaaugauuguuuucauugauguggugguaaauguuuaauaaccucuuuuucaaagaauaaaagccguuauuggucauuuuugccaauuuccaugguguaaauacuuccaacauugugccaguuccgaguuaccaguguguuacaaaauugaaauggaguuagagaaauacacauauaaugccggagagcucaccaggaugccacugcuuucuuuccuucuuuccaaauuacauacaucccagauuuuuuuuuuuuuuuuuuuuuuuuuugagauggagucuugcucuguugcccagguuggagugcaguggcacagucuuggcucacugcagccuccgccuuccauguucaagugauucuccugccucagccucccaaguagcuaggauuacaggugccugccaccacgcccagcaauuuuuuguauuuuuaguagagacagaguuuuaccauauugccuaggcuggucucaaacuccuggccucaagugauacacccuccucagccucccgaaguguugggauuacaggcgugagccacugcacccggcccauaagccaccacgccuggccuaugccagauuuuguacaaaguaaaaucaauccuugucccccaccacugugauacuaggguuuguuugauuuuagugacaucuguauuaggguugacacagaauuaauaacugaaucaauaaagagaccgggaacagggccacgccuuacacaaggugacaugaaaaauguugagguguagcaguuuauucccuuagguuaaucaugaaccuuucuguuaggccccuuugaaauuuaguaucacucuguccuaaaucaccaguaccuugcaaguguugauucuagcccauauaacucaccuuucucaaaaauucugcuauguuuguuuuaguaaccaaauacuguauuuuauuuucguaagauuuucuucccaaucuagauuauauauuucagagagaaagcguccuauuuuauguacauuuuguauccuuuuggugucaaauaucaugcuaugaccauaacaguaaguguaauacacauaauauccuccccccgcccccccgcuuuuuuuuuuuuuuuuuuuuggaguuccuacuguguuccagguuccaugguaacauuuuccuuguuaucuguaaucaucacaacaguacuggaggguaaauacggucauucccauuuuacagaugaggauacauucaaugugagauguuaaagauguucuucagaauuucccagguagcaggcagcucaugguauucaaaagguaaugguuaagagaaagaauggauaaugaauaucuugugucuauuuucuugagacagacgagacugagcagccugagaacauuuggugcucagagggaggaaaugcuaagaggggaaaacaagucugaaagggaaagaaggauaguucaaagaccaguuuccccugcuucagaauucugacuggugccagcucuaacugcguauguuugcuuuacuuggaagauagaaucauagugccagaauucacggaagucuguuuuggaagaugcauuagucaggguaugcuaauugcuggaacaaacaauccccaaacuucaguagcuuaacacugcagaggguuauuacccuccggugucacagagcaacgugggugggcucugguccuagccuggcuucuuccauggcucaggucugcuauccccuaggaccuuggaguucacuagauauuggcaucaggcugaucaaagaggaaaaggagaguggugcauagacgauuacaugggaaauuuuaagggccaggucuggacaaggcaaguauuacuucugcucacauuuuauuggccaaauccuagucauaugaucccaugacugcaaaggaagauggggaauuucagauuccuagguggucacgggcagaaagagauggggauuggugaaaacauagccuggcuuuagccacagaggguuacaccagaggccugcaaguuuggugaccacuaguuuucagagguauuggguauuugauaaaauccagugucuuccagagguugagcaugagccacauauaaauaacuuucccagugacgggccaucagcaguccaaugaagacauugggucuucaugucuucauuggacugcugauggccugucauuggggaaguuauuuaccuucucugaggagaaaauaauaacuugcauuucagagugguuugggacacuaaaggaaaucagaagauggaacugauuuguuaacuagaaauggacauaaguauugguuacagguuuaaaaugaaacuugcaauguuugaggaagaaagggaaaauguuaaugcaaaaacaaaaaagguaaagaaauggugggaaguagauuauuggcacuuuuucuuuggaaacccauugccauauuucauguaauuaaacuucauuccuuuuaaugaaacaauucuucuaaauaauacagagauuucccaccaauauaauauuuaacauuuauaauuuucaccuuaaaguuugaacauuuuuaauuuuaaaacuguuuguugcaguuuaaaucuccuuaugccacagaacuguggacuuucucugguugcaaaauucuuuacagugucuugaauugaaaagggcuuaaguaaaaaaagcugggggaagugggggccuuuuacaaacaaauuacaacucauuugguacaauaaggauaauucauuuugucuuguuuugcauggcuguauauuguuuugaauucauucugcauuucggaagcuugcaguauuucuuuucuguagguuucuuacuuguaacugcagauuucgcgguuucuuuuguguaccacuugccucccagaauuuggcccaacaguuuugaguagcugaacaauuuaucggggacagaucagcugaaauguggcucaacuugaguaaagcagaaggaaugacauaagguuaggugacugaugugugaguuuuugaauuugauuugguuuuacauggaaagguugaagcaaugauccauguauucuaauaaaaaucaucaguacaaaucaaauaaaaucuggcuuaguggcuauuuucccacuguaucacucauggcuagccugugcuguuacagaccacauuuggcaggcacggcuuuuuccuacaacaaaucuuaaaguaacauugcaaucuuugcuguguuaaaaaggcaucuuuucuaaucaaacugucugcuaaucucaucagauaaaucauuauucucuacugacagcuccggcuuucccggaaccccuucccugcuucuuguuuucucucaagaugucugguuaucgucauucuucaggucuuugccucuaucuccuuucacacuaaugacauaucuuccauuccugaggaagaguuacagcuuuuuaccauuccacuuacugaauugguaagaccaguaccucagagcagcucaucucuuucugaccgguauuccacuaguuaucagaugggcaaaaggcaggaugcauccaaguugcagaccuacuagaaccaaaaaugccuauucccaggaauuugaugugauuaaaccuaagaaaucaucaguugaugcguucucaucucuuucagcuggacuaguaaaguaaggcagauguauuuucacuacuucaguagugaacauguuuuauagaaccugaaagugaaaguaagggaagcagcaugguuuagaggaaaccuugguccauuuuuccgucauagaccuguccugcuagcaaaguccugggcguuucuuaaacugauggcaacugcgugugcccugguggugaaaugguguugcaguaugccugggcacugcccugugaaaaaggacacacagaggggagacucacaguuuuguuuucauugcugacaugguuuaaaaauguacguugcuagcugugaaaacucagucauuauaacaccguacaccuuucuucuuucagcaaguauuccuugugaacauuagcaaguauucuauucucuguuagaauuaaacagguaaucguaauagcaugaaagggugaaaguaugucuuaugcaaaauagccucuuuuauauagggcaucuaccaauuuucuugugauuuuuguuuuuuccucuuuugaaaaaugauuuuagucugcucguguuuagguagguaacuucucuugaucccaauuuuauacuuuaaaugaucccagauauugcauuuuaaaugagaugaguauauaaaaaauaggaagcagaaagcauaauuaaaaauugugguuacauuaucgugagaccaaaugaccagucagacuccucugaccaauuucauagaaaauaaggagguaucauuugaacaaguuguaacauaugggaacuguuuuaaacaccaucauugauaucaagaaacuauuaggaaaugcaaguuuguguaucguguguguguguaugcugauuuuacacacacaggcacaugcacacacaugcacacacacauuuauaagcccaaguaagagaaaccuuugccaaugucugccaggcauuuggcugaaguggaauugugaggaacauuuucucagccuuuauaaaucacaguugaaauaugucagcacuguucaguuuauaaaaugacaagggcuguaggcugggcaugguggcucacgccuauaaucccagcauuuugggaggcugaggugggaggauugccugagcccaggagucggagaucaaccugagcaacauagugagacccugucucuacaaaaaauucacugggugugguggugugugccuguggucccagcuacucaggagggugaggugggaggauugcuugagucugggagguugagguugcagcgagcccugaucgcaccacugcacuacauauacccuagaugaagagcaggaccccaucucaaaaaaaaacaaaaacaaaaaacaaaaaacaaaaaaacaacgagggcuucaucuaaagguuaaagggacuguuucuaccuuauauugauuauaacaaguuaacucacucaauauuguaugguaugcuuaugcuguauugaauggcaaaguuccucucacagucuuuuuuggggucacccuucacucuucacuuugugagguggcuaguucauuuguauaccugcucucuaaaugugggaauauauucuuuuaaaaguggcaacucaacuuaucucccccuucuaaaauauuuuagauguuuccaauuuuuuuuuuuguacgucagcccauggaaaccacacuaaauuuuucugugucaugaguaugcuugucucugcauuugaauuuaauugggaagugccucugaaauggcaggucuccuuuuuacacagugguuuacagaauguggugggaggaggcaccaaauagccuguuaggauagcauggcuccaaaacugauucuuuaacuugccuuuauacauugcauuaauucacaaguggaucaguccaucuugucuucaucuuggccaaauuccuucaaaauuaauaguaaaauaugccuaaauauauucuuguuccugcccuccccacucccaccuaggucacagggcuacaacuaaucauugucuccauugaaaugucacuagaugaucaacgauugaagaauauuucuuaccaauucaaauagaacagaaacuucagucaaguuuagcauuuauugcccuacauuucugcggcugucaaaaccaguugaucagagacgugaagauauguaaggaaauaggaagcugugauggguuaucgcuugucuaagagugguacaagugagacuugagggcauuaucacuuuuuaccuuauacauuuuuguauuuuaauuuuuuucaauaagcacauacuuaaaaauuaguuugaauguucuuaacgaaucuuuccauagguuacugauuaguucaacagggacaaauuauaaucauacauugcagaauuugcaugccacuuugaccaggugaucaaaauuggcauagcacaugaggggcagaccaacaugccaucaaggggcucuggaagugauguccugggaaggacaccagaccacuauuguaguauuauauccacuggaauauaaucaugaggaagcaucugauccucccaaauugagaaacauuuccauaaaauaacuggccuguauucuuccaaaauucuaauaucacagaaggaaaaggcugaggaauuaugucugauucaaauggauaaaagagauagacaauucagugcagugcaugauccuggacuuugucuucuaccggagagggaggaaguucccuauuggaauauggauuauggauuggaucuaaguacccacaguauauuuucugauuuugauaauaguacuguuuuuguucuuaggaagugcacacagaaguacuaaggugcaaaaggauauaauugaugcaacuuacacaugguucagaagcaacauauuauauaauuauaacugcacuguaauugaaaacuuuuaaaauuagccugguguggcagucccagcuacuugggaggcugaauugggaggaucuccuaagccuaggagguugcggcuguggugagcuguguuugugccacuggacuccagccugugugacagaacgagacccugucucaaaaacaaacaaacaaaacaaacaaaaaccccaaaacuuaaaaaaaauaaaaauguaaaauaugggaagaaugaaaaaauuauacauuuuccuugacuucaacccuugaucuuuucuugaucaguucccaggugggguuaggauaucuguguuuuuuaugagguuccuuggaguauuuggguggucagccaccauuuggagaucaccauguagugccuagauuauaaauuauccuuuuagaaagaguugcuggaaucauuucaagauuggucagguaccaauaaauaaguaauagaaacacccucaaaauuggaauugaaagaguggaaauuuauuuuauuuaguuuggggauaugaacaugguauaauauugucgcauuuuuucuggaguuuagaugaauaagagcagccuacaguugaccggaugacuuaauauuuuuuucguaccacaaaaauuaaaugcuuuacuaaaacuuucauucucuuacaauucugaugaacaagguuguacuguaugguuaaguaucacacuguaaauuuaggcaauacauguccuauugagcccauggaguaaaauagauuuucccgugauccaagcuauuacaauuucagauguguaaaguauuucaaauucauuuuaauagacugcuucccuucaaauacauguggagguagauuuauacaacuguaaacaguuuaugcauuuuuacagauuuucauuauauguguuugauacuaauuuaccucuuuuuaauuguaggagagauaaagaauuaguaguuuaaaacaguaggaacugcguguucugcugugaucaaggaauuagauaaucuggcuuguuugcuuaaggggucuguaucuugagacuuuuauagggcaguauuaaagcucugagccuccuuauuaugccaguacccagaagauugcuuuaaugagaaguaaagggccuuuuuccaauuacaagggaauaacugcauuaaguuccuguguuaugucaaccugcuuugauuugauuacuaugaaagaaauggauuuaucugucaguguuacuuaauuaagccuucucauugauguuuugcagaguaauauagugugguuugcacauuugagccuaaguacagagaaaauuggccuaaaacuaagacaugaccccugaagauaacaugcaagauugaucauuugucauugccaggucauaggcugcaguguuaaacauagguggaaggauugccauguugaaaggguaaaaugaaaaucaguuuaugggagugaguauuuuaagcaaaagggguugugguggaaaacuggauuuuagggaggaguuuugaauauguaaaacuauugacuucaccaauauuagucaagcaucuggaauaggaaaugacaauaaaacaaacaggagaaguagauuuuguuaaaguauaaaaggaaauagaagaaaaaggagaaagcaagaggaaagaaugccguuugggagaaguagaccauugugguuaggcagagcaauuacagccuacagauauuucaauuaagccagccuccccuucucagaaccucacaaauggcacccucgggagaaaagagguaucaggaaagaaaagaagaaaagaggaaacaguuccauguuucauguuggcuaaccucucccaagaauaaauucaauaaauuauuuaccaaauaggcauuuuaaauaccaguuuguauaucugaagucauuacaauauuauggauuuugcacuauaaauauuacauguaugguuugaaaaauacacacguaauuacauguagacauuaucagagguauauauucaguuuuauuaggaaaugaagcauauucuuaaauguauuccuuaguuguuuaacacuuuguuuucuaaaguaucuaccuuuuauuucuugcacucugugauauaucuuuagaaggugauaugucuuuaggaggugccaaacaccuacuuaaaaacuuccuugcaauauuuucacauuuauuuaaguacuuugaaacuuaucuguguaauguugaaguuagaugguacuuugauuuuuuuuucaaagucuucagauaugguaacuuacuuccaauuguuauucucacgcaauucacaauguuuacucuccaagaaaacugucuuaguuaagacugauuuuuaagugcuuuuagauuggucacauuucgaaaagucaaagaagguauauauaguucacguuauacucuugcuugaguuauucauggcucuuauuuguaggauauugcuuuaaaagguaggauccccaaacgacuaacuucucuucaagaggaagaccccagcuagccagucccauacacuugaaagguugcuaaauggcacucaucucucagcauuucacauuauauauucaagcuaggguauaauucaaguuagaugaucguugacaccuccaaauauauaaauuaauauaaaggcuucaauguacguuugguucaguugcauaauguaacuguuuaccaccuugagcuucaaaaagauuucugaguuucaauauaaggaacaccacugacauauuuguaacauaacaguuacccacuucauuuuguuacuuucucauuaucugaauuuuauguuauaggaagaugcuuucccuguuuaugacagcacacaauggaauuaacuccauaucuuaagcagcagaaauguaguguucauuuuugaaaaacagguuauuuugaacuuaaggaaaauaauacuguuuuaaaggacuuauuaauggaaguuuaaguuggauguuaauuaaggcuaaaauauugcaguaauugucugcgaacacuuuuuuccuacuauacuuucucaccagcauaucuacccuuuaacuuuucuuaucauaugaaaaauacucuaagaugaucucaugcuugaccuuugaguuucagauuuauuugguuaggaaauccauuagcucugagaaagccaggguugacagcagucaucugaaaauggaaagcccaggucuguauucuuuauauuugacuuaucuuuuuuuuuuuuuuuugagacagagucuugcucagucaccgaggcuggagugcaguggcacaaucuuggaucacugcagccuccaucuucuggguucaugugauucuagugccucagccucuugaguagcugggacuacaagugugcaccaccaugcccagcuaauuuuuguguuuuuaguagagauggguuuuaccauguugcccaggcugaucucgaacucuuggccucacuuuuucuagucugauaguuuugauugcuguccacauaagcaaaguagagcuuugaguaaucaaaucauaauccaccugccucggcuucccaaagugcugggauuauaggcgugagccaucgcaccuggccugacacaucuuaacauuugugugggaagcauugacacaacccucauccuuugcuuagucagauuugggaagugcuggaagcuucuugucgaguuucuuguuagugcccagaucacucauucugaagcaccauuucuuaugucuaauagaaaacagaaacaaucaugcuuguguggacaucaucugucaauauuugaaucuccucaacucuuccuaugucuguaauaguacucaaauuugacuucaaauuacucuacuuagagcucuuauuauacugggugcuaaugaaaaugugcacauccuuaacacgcucuuugcugaugaaauauuuugaacucuaaauucaucuggcacugacggagagcauaugccaucucaguuugugugagggcucagccaaggguucuuccuggacuaggaaauuaguaggagccacagauguacgcagucugugagucuccauaaugguguagaggauauuuaauagugucuguuguugcaggaagaagguuuugaggcaguguagacuucauuguguuucagaaugauuaucuuuccuggaagaacuugacauccuaucucugaacgcauucugaauguguugaaauuuuuauuaagaaaucaauauauuuccacaagagcaggaaucuguagacuuagagcaaugcaaaauaccauuucaggcauuuuucuaauuucauaaaacucuaggguccugggugauuggcauguuguaggcucagaguauagaaaggacaacuacacagcucuacgucaaaucaaucuagguaacuuucauacuuguuuauuucaaaucaagcugaaaguuacaugguauuuagucuguguucuuagcuugggacucugaucagcauacauaacuucugacaacaugucauuuguguauuacacauagaaguacacugagauauaaagagaauacucuaaugguaaacuaagccacugaauaaaucuaaugcuuacugaauucuuacucugauaguguuauacagggucacggagaagguaggauuguuuaaccuaaacguuuuggguguuucuaagauccaggagaguauuuaaaaaucacugaccuguuuagcagaacaaggagucauaaaaauguaaggcucagauuuucuuagauauuggaggguauuauuaaauuaggcacucaugauaaauacuggugacuaugguagauauuuacuacggaucaaguacuuuccuaaguguuuaacaaauguuaguuaauucauuuacuuuaacaauaacuccuuaaucuugcaaauacuaucauccccuuaucuucuguuagaauacugacuuugggguaugucuuggguuuucacuucuguucuccuugacucaagaggccauuacauuuucaaggcugacagauguccccagggcaaaaaauguguuuucuucuucccuggguuccagccuucacuuugauuuuggcucccugauuccuuguuaucuugucugcucaguauuuuaaaauuuuucaaaaaacuguuauccaucauuuuuaguuuucugugggagaguuguccaaauauacuagccugcccuauuuccaagaauggaaaucaaacuugcuuauuucguaguucacaaaaaugaguacggagaggccagugacuugcucagaccagagaacuggucacugcagagucccugcugaaauccagcucuuuaucccaacucccagugcuguguuuucuaaaguuugucuagucugucugauaguuuugaucuugcugaccacaagagcaaaguggagcuuugaguaaucggauuacaaguguaaugaauguggaugggaaaucgcagaagguaagaauuaugucugaacaucuuuccccuaaauagaguguuuggucauaguucugcccaaacuguuguguuuuggcacugaucugucaaauacuuuauuuauuauuuuuuuuuuugagacagucucgcucugucacccaggcuggaguacaguggcucgaucuuggcucgcggcaaccuccaccuccuggguucaagcaguucuccugccucagccuccugaguagcugggauuacaggcguccaccaccaggcccagcuaauuuuuguauguucaguagagauggggucucaccauuuuggccaggcuggcuucaaacuccugaccucagcugaucugcccgccucggcaucucaaagugcugggauuacaggcaugagccauugcacccgaccaaugugucagacacuguagaggggacucaugcagaaugaaucaaauaagaugaaaauuuguggauuuucagauugccuccuaaagcagccagcaaucccauggaagaguuacuaaaucuaucuugguuuaggguaaaauaagaaauuagaaaaaucuugaacugagcccauuucagucuuuuggaacaggaauuucuaucaucuacuugcuuucuuccuuucuuuuugcccgggguaauaucuuucucuuuauucucccaucuuggaaaaaggguggcaauagaacaaggggggggggggcgagaacuaaauagauucagcagcuucaucccaggcaguuuuucauuugucacuauguugccuuaauggauuucacacaucuauuuccuguauauuguuuagucucaccucuagauguaaacacuucucauaccacaauauuaucuuacuuuucacuuucugcuguuuuaacucauuucaauaaagaacuaaugagcccaccauuguacaguaccacacaagauguuauuugugucaaguauguuucuuuccuauaauaaacguacaucacaguuggguaugauauaaguauauagcucuauagcuguauauauauucacaugguuauuuggauaauaaauucuguguacuugcugaacuaucguauugagccagccauacaaguuuuaucauugugccuacuguugauacuaugggcugcuaugggauauucuguccucuguguugggagcucacagauauuuucugucuggcuuaauaccaggauuagguaugcuucuccuggacacuuuguguguuuuuaucugaugguuauugucaaucuuguuucccucucugcuuugucuacuuaauagcuucuaaaguuuugacccacuucuagcaaauagccaguccuucacugugugcauuuugauaaacucaucauaccucuggccuuacuguucugcuacuuuuauuuugcagucacuuggguccuucaaauauugauuucguauauuuuguguuguauguguuucuguaaucuuuuguggacacaagaguuggguauaaacucccaaauaaauauauucacucugcguggggagaagugacaggagggaacguucagcugguuagacagagaugugacauucuuacuggggagucuuuacagcagugggcagagcuucagccuccuuuuguguccaagcucugccauuuccugaucccuugggcaaguuuucuaacccaucugagccucaguucagauauauaaaaccagaauacuaguaaggcauuugagaguuuagcgcagugucugacauacauucaagcucaccacaugugagcuguuacucuuucuuugagaggugaggaacaguuuaggcagaaggaauagcaguuacaaaaacauggugguauaaaagaccgugcaguguccugguacccuagcaggaguaaggaauggccagguguaggcccugugcaagguuuacaugaaaaugagucuggacaagaacuucuuggaugcucaugugauggagguguauagugaaugcugcugaaaccagcaacccagacagcaauuuuaagauauggagugagagaggcugcuguuggugguguggggcaugcauuugucuuguguuacaguggaguaguccugugguucucaaacuccugugugcauaaaaguuaccuggggaccuguuaaaaacaguuuucucagccccacccccagaguuucagacugaguagauaugagacggacccuaauaagccaauuuaaaaaugggcauacaggugauucagguggcggauacacuuugaaaugcacuugguggugcacuggaauaguuauugaggaaaugcuaacuaaggggcaggccugacaaaguucaaggagagggaagauggaagaaaaugacuucaaaguaacauguuuacauucauuaugaauuaccauugcgcaugcuauggaaacacuaguuuauagugucuucuauggauauggauaaaugagcaccgguccuauagauuuuuuucaaagguaaaauauaauuagaauucauaugauuauucuauuuauuagguuugggagagcuagugauuuguccucauccuugagauccagcaggagaccaagggaaggggaagccuguucaacagagagcaaucaaagaaagaaaggugcagcagcgugaggucaggaagugggaaagauggaaaugggaaaggguggaaaaagagcagucagauccgauuggucaggaaucuauuugugaaggaacccagccaguauuuaaccugcuuugaaaaagcuagacuuccagcauuuuuaauuaguggauugcucgcuuuugaaauugcccaguugggaauacucaaguguugauguguuuuaucugccugcuaauuagcaggcugcuugguugaccauuacuuuuccuuuuuucuguggacagaagauguauaugaaggucucuugguacauuccagcucaagucuagcuuaaagugcauaagaaaaacuguguauuuaauaagaguucuuacuaaauuauaaaucaaauuuuaauacaucuuuucuccaacuugauuccuuuugcucuagcacagggcuucucaaucucaacacaauuuuuauuuggggucagaacaccaaaaauauauauauauauuuuuagggacagggucucacucaguugccuagguuggagugcaguggcacaaucguaguucacuguaaccuugaacuccugggcucaagggaucuuccugccucggccccuccaauuagcuaggacuacaggcaaguuccaccacacuuggcuaauuuuaaaaauuuuuguagcgacagaaucuugccguguuucccaggcuggucucaaacuccuggccucaagcaauccuucugcuucagccucccaacgugcugguaucacaggugugagcugcugugcccugcacaggguauuucuuacuguggagagcuguuuugugcaauuaugagauauuuaauagcaacucuuggccucugugugaucaaugccacuagcaacacccaaauugugacaaccaaaacugucuccuggguggcuuugccaaauguccuuugggaugcaaaagccccacugaccuggcaguagcguccucuuuccuccaagucucugccuacuuuucauguuuaaaauccucuuuuaaaauugaaaagauaaaaugaguccaaacaauuugaaaucuuaugguacuuauagggauucaaaucuguuccuccauuacuuuuuggccaaauucaagaggagaaaucucucaaaugaauccaagcuggcuguuauaggugaaaagaaagucaagaugcgccagacuuuuaaaagcuugcagugguugagagauuuuguuauuuauacacuuuuuauuuuggcugaaaauauuugguuuuuguuuaagaauuaagagaaccguguaggcuacaaaauuuauuuaugugcgaaucccagaggguuguaaguagcuucuuugugugcuucaguucaacauauacaggauaggccagcauguuggauuguuaaacagcagaucuggggaagguuuuacaccuuuucucuaggcuuggugcagucccgagagcuuucuugacaugccuugaagcucacagugcacugauuuaaacuguccauaggggacaucuguuugcaguuuguguuaucugcugaagcaccaacuaaaaggaagugaaauaauauuugucauuaaaaaaaaaaagagaaguuaauuuaaugguaauaacuuaguuguuguugcuuuucuaucucuuaagauauucugaaacaccauguacucuacuguaucccaaaauaaauaaauuaauuauacuaugauuacuucugcugauaauaaaauagcaguaauaauaaaaggaaugacaguagagcauuaagagaauaaacaguaucacugaaaugugaggaaacacaauaaaugggauugugucuccugaaccuuaguuucacacuuccuccuccacuucugucagaggguguuugugauggccgucuguuaucagccgugaucaaaauaauauaacagugaaacuuuuuauacuuaugaaggcccuuucaucaaaaaucucacagccauuucuaaauauagagcaacugaucuuuaaaacacuuuuauguuuuaagcaauuaauaugguaacuuagcuguuagacuuuccauccugcguauuugccauuuggagcguggauggaacauuucguaaucuacucagcauuaaaacuuugcugguauugaguuuagaauuccaacuuuucgaugguucauguaggucuuuucacugucaucuaucaaaacaaaacauugcuuuauaauggaauaaccacauucauuuccacauaucaaaacccagauuaaggauuauagaccaaaugguaugucuaguuuaaaaaaaaaaggaaagacagagacaguauugucuuaaccuaaaaaaaaguuuuguuucaguccuaauaucccuguaaugugcugguggaaauagacuacugaauacuuucucagucucauuuucuguugcaugucuggugucuucugugauaagccugggcuauggaacaaaaaggauccaagagcauuauggcgaggaugcuaaagguguuaguguggauauuuaccuuaauuuaacuuuuuuugcauuaaaguuauguuagugcauuuuuaaacuuauuuuauccaaaagauuguaauaaaacuuuaaguacaguuucacaucuauaaagacugaggcuaucaaacacugugaaggauggaaguaauuuuuauguuuauaccucugguuccugaggguccaguucauuucuacugugaauuuaaaugaguuaauuuaaguagaugggucagaagccacuaucaucaugguagcccggugccugguucuuaauuaaaggcaacaggagauuaauuugaaacauuaauuugaaagugcauauacaaaaagaaaaaauuacugcaagaaagccuaaagaacuuuucucuugucccuagauguagaagacagaaguagcucaggguccugggggaauggaggacauccaagcccguccaggguaaguauaucuaaucuuuucucccacaaccagacaucccacauauguaaauugacaaacagaagguguguuucucucucucucucucucucucucucacacacacacacacacacacacacacacagaggcaugggcaugcacacgcacacaaacacacacgcauauaugugcauacuaaguuuaaugaggaucagcuugacuuuggaauuuuuuucccccauucucuuauuggaugcuguuauucaauuugacaccuguuccacuucugcuaaccagaagaaaauuccuucguuacauguuuggucuuucuuuugucaguuauugauccauauuacauaaugcuguuuguuguagauggaaaaacuuaaaaaaauuccuaauaucccuauaagguauuggugugaauagacuacugaauaaucccaaagauacacuaugaaguucuauccuaccaguauaaucuacguacugaaucugaguugauuucgcuauguagacauguuaucauuccaccaguagggacuuugaucacuagauggaucauucauuuauuugcccucaacuuuuugcuauucuucuccacaguuuuccuacaugcauugguuguuucuuggggaagacccaaggaauauaauguaauaggaauguaauaggaagaccauggaauaagaguugggugggugguuaagcaauacguguuucuuguauguauaugaucuugggcaugucauuucaccucuuggguccucauuuucuuauuuugcaaaaugaggaaguagauccagaggaucaucuguguuucuuccaguuuaaauauucaugauuuuguaugaaauuucuuuaacugaaucauugcuaggcccucuaaaauccaugucaguuuuuaugauguacauacaaugccccagauuaaaaguacacuucguguacaugguaaaaccagcaugucuuccuuucccaaccagcuauauauauauagaugaagcauucugcagggaggguaacauuuuacuguaaguguucacacaaauuuggguugggggaagguuccauuuuggcauaagaggcagggaagguaaucaagcugucaaaaugagggcauuucagcaagucagagcuagacauuuccaccuguccuuggcauugugauccuuagucuaguguucaggguacagcaggaucucuaagcuuaccaguaacuuugugagcccuuacaccagcugucgagcuugacauucuaaugcuuuauauggauggguugaggaaaucuuuccuccuccucauguuacagucugcacuugcagaaauaaauccauuccccuugacagcaaguggagaucauagaacuccccucaauuguuuaguucauccagauuuucacaauuucuuaugauuuauccauucaguacacaugguacuuuuaauuguguuucagaaaacaaggucuguuuagaaucaucuuaauuuaggauuaaaacuaacuagcuuuugguuuuuguuagcuguccugccauuuuucucaaggaauauauuggugaauaauuucaaaccaauuuuguguaauuuauauuuucuaaauccagaaguuugcaugagacaaaucauuuguggcagauuuauacccaggcguacuuucaaggucucucuuuuuucaucuuaacauggggauagugucuaccuuacagcacugugcugaggauuaaauuagauaauauauauuaagcuuuuaguacacuaucuaggaugaggacacuuaauaagugauaauuagcauuaugcaaugccugguauagagugagugaguguacuaugauggguauuuaaaauguagccucuuuuuauagauggacauguuggcagaauuagauuacaguaucaggcaaguuaauuguuauacacgaggaaaggugauugagaacgggguaguuuuccuuaagguugaggggaugugucuuuuccuuguucaugcagcagcccucucuuuugugugggcagauuuugcccuuuggcucacaugcaaccgauaccucugaguaaauuugacuuagacuuucaugggcaguuccaccagcugagcagaaugacuuuuuccccccuuuuuggucacuuuaugcacuuuaguagacugaaaguugaaccauguaguauagaugauuuuaacucuuuccuauugcguuaucaaauuuccccauuaaaauuaaguaacuggacagcuuaagaacauuguuuuaauuuuaaauuccccuuaaaacaauaagcugauuguaauaaugaaauauuucugucaaaauuugucugccuuacaacugguuguuuuuugugacaugcuuuguccaacuccagaaaugcuaauuuaugcuaauguuuugauguucauauccuaguuaaacccuaauauucuuaacuuucuuauguguuaauuacuuaugugacaaucuaguucucuuacaaccacaauaccacaauaguaacuauaauaaaacauugaaacuucaguauccuaacaccaaauguuauuguuugaauggcucuaucuuggucuuugaaaagcaauucauugcaugcuaugccuaauuuucccuuguggcacaauuuugcuuuaauguggccuuauuaaaauaauaauuuuuaacauaagcaauauacuuuguaugugucuggugucuuacauacacuauuuuauuuaaucaugucaacaacuccaugcaguugauaccauuauuauuauuccuaagauuucucagcuauuaugaggaaaauuuggacuucguagacucuagagcuuucuuuuagccacuauaccugugaaagugcagauuccuucuagugaaguuccagggagggaauaguggacuccaauuucuuuggaggggagaaguuuugguaguggagcuauguuuguuuaugugcuguuuauuaauauaaaauaauaacuuacacugucauuuuauuuacagaacuauggagaugggacucccuaugaccacaugaccagcagggaccuugggucacaugacaaucucucuccaccuuuugucaauuccagaauacaaaguaagacccauuuuaaauuaacuuacacuuuuugaaugcucaaguuuuacuauagaagguaaaaccauguccuagacagagguucugcuuuuagaaacuuggauauuuagucaguucacuuguaauaaucuuaaauugcagagaggauuggcagucuguguuugguaauagugcauuaaggauuaaguuuuacaagcauauggaaugaaaugcuuuuagugauacugaaucuauguggaaauuuuguuuuccuuagaccuaaagcacggaccacaguuucaauguuguaucaguaguuuccuaaguuaagguagaugaagucaaaguggugaauauuuagaauaaaaauaucacugggcuuguugguuggcagugauauauagucaguguuaacugugauuucugcuaaagggguuaugaaaauaaaugguguuaaugggcuuagugugcuuaaaucagaguagugcauucaaguugaauuguaaaaucugauuguauauuuaucaaggcaugaacuuuagugcuaauggccuaggcagaccccauccugcuuuauuaaagcaaguuaccuguuaguuugaggcugucugugaaucuccggcaugccauucauccuggcauccucagcauguuuuucugcuuuuggcuacccuguagggauguuuguuuaacagcaguaacuugagcaaugaaaagaugauuccuaauggcuuaaaaggucccaauagcuggcuacuuuaguuuugauugaaaaaaaaaaagaucuuuguucuaguaaacaugaguucuuaacaauauuaguaaaucucucaaccuggccaaauucucuugagaaucugucaauaagugaaguuaaauuucuugguacaaucuguuggacaacacuccaaggaaacacacacagcgaugauuauauuuuucugagaccauaacugcaaaugcuucuaaagaaugucaugauuuuaagcuuuggaagcuauaccaguuacuucagguccuugaaucucaggcauucuuugaaaaaucaccaucaaauccaucuaaauggauuucagauauuuaacacaaaauagucaaagcagauaaauacuagcaacuuauuuuuaauggguaacaucauauguucgugccuuugaguaucuuaccaacuuugagaaccacaaaguugguuuuggucauagaauguucuuauuuuugugcuauuuuugccuucaaaguaguaaauuucauauuuacguuuuaacauuguaacucaagcaggaaucccaguucuuuaucaguuguugauagaaaggugcauuguuucuuguucucaggauauguagauacaggugaccagauauauuuaucaacuuagauuuuaaaaggcagcuuuugacucuucagugucaauaguuaugauuuuauuucuaacacccuugcuucucuauucaucuccacacaaccacuuagaauaaaagauucacuugaaaauguagucuugagaaguagcaccuaaauaauauacuaacuuccuuggauccuaaaaugauccuccaaugagcuacaguaagaaaaauagaauaaauaaauacucauagggagacgcuuauguuaucuaugugaaaaaaguuuuaacucuaaagaacaacuugauaaauuaauauuacagaauacaccaagcaguacaaacagauuaaaugauuguucuguucauguuuccucaugggcaacugcuuuacaaaucaaauuaguuuuucaacccaaauaguauuuaaaauauaaguggccugacagucuagagcggagagagcugauucuuuucacuuaguuguuguuuaggcugcaaauccaugucagcuuugcucuuuuauccugucugcccuccuucccauuaaacucuuaaauauggagaccaagacagucuccugcauugugauaggaaaugcuacuauguccacgaggcccccacccacuguucccagugaaaggacuucucuguuagauaagcugucugguuugaaacauggcucuuuauuguuuacaaacugcuacauuuuccaccucgagcagauuuuugcacagaaaagaauugugcuugggcuaaaugguuuaucugacauuaacggcgcagugucagacuggggucagggaagucacccucagagcgagaggguauugcgcgguaugcaaaaaaaauggaaaagggagaaaaagacauugaaacaaguaugaaauaccuuacauuuuuaguuuagagaagaauaauuuuuuuaagagaauugacucuuaugcugcauuaaaaacuucccaucgcuauaauuucucacacacccgaugccuucuugauuggcuugcguaucugaaggcuagauucggggaacaaagauucucauugauuuugcccaagcugcuguuuauuuaaaaugaaaccacuuuucagaugagccauauuugguguuauguuacagcuuuacaaagaaaagauagaucauuuucaagaaauuaacgacaauuaauuuacaaaugauaauaaaaacaaaguaagaucuauugguguaggggacaguuugaacucauagcauauaugcuguguucuaaaccgcacuuuguguccagacccagagcccauguugugaccuuuguggauauuuuccuucuaccaaaagaagguaguagacuuuagcauaaguguuugacaacacuccagucuccacuuucagaauguuuaacugguuuuuguuaaaacuacaaaguauuuguuucugucucaaaggcuuaauucugcugugaugucgcaucaggguaaaagcuauagcaucagaaauaaaucagccacuuuauuggagcagauucucuauugucaaaucaaucaagccugugacugaauuaggcgucugcuacagaaauaagugacacuaauuuuauaggaaagaguuauuaacugcagaugaccugauuuuuuuuuuuccuuuuuuuggugaacuguucauuuaguaagguuuuauuuuauugcaaagaaagaaaaaaguacuggacuacucuuuccuuuugagaguggauuaucauuaauuauguauuuuguucuuuauggcaguauacaauuuuagggaaaugauaacaggcauugcuaguauauuuguuuauaaccucuaugguaaugaaacccauuauuacaacucugaacuucuugauuucacaugaaugguuuugcauuuuacagauuuuuaaacauaauacuucuauuuggcacugaaauuccaaaacuuaguucauuugugucucuauuucacauuuaugcaaagugggauauaaauuauaagaguaauaaaguguuuuagccuaggcaacauggugaaaccucaucucuaccaaaaauacaaaaacuuagccaggcgugguggcacacuucuguggucccaacuacuugggaggccaaggagggaggaucucuugagcucagggggcggagguugcagugggcugacaucaugccauugcaccccaaccugggcaauaagugagaucccaucucaaaaaaaaguaauaaaauguuuguuuuaauuuauucuuuuagaaauaaucuuguguguguggaaaaaugcacuauuugauaguuugugaaucccuaaaguaaauaaaacacccaugugugguuauacaugcaugcacacacauguacacccauacacacaauguauguaucaugcuagaagacuuaaugacguuucuugguuuauaagauuguucuguauuccugucugugguuauaguugucauacaggguuuuagugguugauacuuguaaguguuuuaaagaagaaccuaacuaacagaaacaaaaagcaagcuccuaaauuuuuuuuaaauaggugugaauagccuuuguguuuguuuugauguuggcaggguugagagaugucaguacugacugccuacauugaccaauucauauacuuuuaccugacauuuacuaagaacucacucguugcuuucauuguguagauacaugccagguugcauuuugccuuaguugaaauuccaugcauuguuuuauaucuggagaaaauaaaucauuucuuccuugugacugccuaucauuauuaaugauuauaauguacacuggaccuauuggagacuucuucauugcaguuuuuaaacaauuugaugaaaccuuccuaggugguccauuggauaccuuucagaguaugcuaaugguagaaagggucgaugagucuaauuccucuguuuuuuuaagaggguuauuuauaugcuauggaauaguuugagaauccuggcaagaaguguauggaaagaauauggacauuaaaaaaaacuuuuuuuuccuuugucaagcacuaaacuuuugcagguaauuguccagauauuuuuacaaugguagacaauauauuuucuagcuaaaacuguuugcuccaaggaaggagcuaagcauuccauuuuccuuuuauuauuccagagcaucgauugaaagcuagauugaggauaagugagcaaguugccccauaaaauuacauacaugcauuugugacugaagggugugaaaagcgauacuuuuguacauuuggcuacagcuuaguucagcaucggggcuaugcuuucacauggcccauuuugaaugguucaguuuccuuacugugguauuugguucuaguccuacucaugguacucucccagagcauuaaauaauuuaccgccauaggguagcuggguucuaaccuagcucagcagaacauuuuucugcuggauuagauugagguuucaggcagaacugaagaaagcugcuggcuuacaggaugaccuuugaaucucaucuggguuagcgguugauauuuugauuugguuacuguggucauauugugacagcugcuagcucauuauaauucgguuccaccgcuccguuugccuagcaggaauauuuagguuuguauuacuucagaguguuuauggcuacccugaguuuagcccagcauaaaggugaaguguugugaguguuuucaaaucccaguggcagaagcaggugccacagucuucuuguaaaacagcaaaugugaguacaugcuaauacagggaguuuuacucuucauuguaaaacagagaauaaccaaugaaucagcuuuuacuaggaaaaguguuuuuggaagccuuaauguacaaaggaaaagcaugacuacaaagaaacauaauuuuucaaagcacgaaugagauguuaccugacuucaugguuagauauuuuguucuuugcagaagugugaguauuagaaaauaguaaaaccuguacaauaauggcaaucauuugauguuugaaaguuccaaaggucaaauaaucuuuaguaacuucauaagaacggaacugugaauauagaugucagcucuagaaauuuuaguucacuuuuuaaaugcagcgaaauuagguagugauacaagcaggccccuuugcuaguucauuaguuagggacaucuuggugugcuucuuuuuuuuuuuuuuuuuuccaauaacaccuuucagcuugauguuaucucgacaucaacucuuaaguguuggacuuauaauguggcacaaguaauuucugagaaaggaaauuauuaauuguggucuuauuugauuuuacuuugggaauuuucauuucuuuaauguuaaauuuaaaaugcccuccugaaauauuaacaaguaugacucguuugagccucaucgcugguguuuuuagcaaucuugauuguugagcuaaggcugguagucaggagucaggagaacucaguuuuucuuucuucuacuucuuccuuucuucuucuacuucuccuucuucuuuuucuuuucuuuuuuuuuuuuuuuuuuuuuuuugagacagagucucucucuguugcccagacuggaguucaguaggaugaucucugaagccucaacuuccugggcucaggugagccucccaccuuagccugcugagcagcugggacgacagguguacaccaccacaucuggcuaauuuuuauauuuuuaguagagaugggguuuuaccauguuagccaggcuggucuugaacuccugaccugaagugaucugccugcuucagucucccaaagcccugggauuacaggcgugagccaccacgcccagccaagaauugaguuuucuauucuguuuugcuacagcugccuguggguccucuggucaggucguuuucacaucuuuagguugagggaggaacagcucuuuaggugaucucugagauaauuuuauuaucuaaugguccauugaucuuucugauaugucauuuuauccuuauacuauauuuucucuuuggagauguuuuauuguucuuucuaauccauucaucucuauuuuaugaauaccuucaagugacuuugccagugauguguuuuccaaauguaauucuuuaaagccuaacuaaaauagauauuccuuuuauaucucagcugauuccagaucuauagcuaaggaauuggauugguuggggauaaauaaaauaauaacucauuaaguugagucaccaggagaaaaguucugugcauagaucaguauuuagcauagagguuguaggaccucaauaaaugacugucgagugaaucagggaauuagauagauaggguuuaaacguugaaugaaaagcccauacauuaaaguuaggccuauaccuuacuguaccaagaagaagacccuaaaccagagccagucauauagaaauucacauuuuguucuauaggacuauauccuugacugggcaaaauauucugccaagauaggaaacgggccauauuacaguguggccuguuucaguuuucaguacaccacagauuauuuuauauauaagcggaaauaaguaaaaucaauaauauuuugggucgggcauagugccucaugccuguaauccuagcacuuugggaggccaagguggaaggauugcucgagcccaaguguuugagaccagccugggcaacauagcgagauccuguuucuacagauaauaaaaaaauuagcugggugugguuuuaugcacuaguggucccagacauucaggaggcugagguggaaggacuacuggaggcugggagguugaggucacuacagugagcugugauugugccacugcacuugcacuccagccugggugacagagagagaccccauugcuaauaauaauaauacuuauuacuauauuuauauuuuuguaauuauauaauaauaauaauuacuauuauuauuauaaauaauuugaaaggccauugaaaaaaguugcguuucugguauugagcuaagauaacugauuuccuuuuguccagucagaggacauuuccauucuucucucauuggucuuguuuccuuuccggccuacucugugauauagcacagcuaaugcugugguccucaaacacuuuuagaguccaacuagguuuacuaauccaagucguauaacauuuagaagaauuucuaaacagaaaaauguuacuugaaaacuauggccaacagagauguauagaccuucuaaauaccaggggaagauuucucacauagaaaguuauugacccaaagagaagauaaaucauuuaagcuucacauaaaaguaaaaagcaauuuguaucagguaggaaugcuuuugcuucgaaguaauggaaaaugugacuaaugauggcuuaagaauaauuuuucucauucuagaaaucuggugguaggucccugcuggaagugguuugcagcucagugaugucagggcugguggcucugugauucuuuuguccuuccccucauugucuaaagaugggggucacagcuucuugugucaaguucagguuugaugcagaaagaaggggaagggugaguugaguggugucuccccaccacacugcuuccccauaacccaggccaucuccagcugcagagguuggggcagggcugggaaugcagccugggaaauagacaggagagaagcaaguuugggacucauacugggcuuacuaacuugcaguguucaauucacacuuuaauuuuuuaaagagaaaaauauauaauuuucuauuuaauaauuuugaaaauuaagaacaaggccuuaacuuucauguaauaaaaauauauaaaaagaugucucagcucuaauuucuggucagcaaauuagagaggaagauggaguaggaaaaaagauacuguaaagaggaagauggagaaaguacaggcaugagcgucuugcaugggaaggagcgugaggucugcuguuugcaucucaccuucaaggccugugucuucauuguccuaagcccuugagcaaggcagcaaccagccaaagccagcucuccuuaccuuugcuuuccccaggaccuucucuuuuaggucucuggcuugacuuucugccagccuguccagggcacccuugucacgcaacaggccuguagcuccagccaccaaccacucuuuucuccaguccccuggguggucuuuggcagagccaaaggccaggcuuuacucccagugucuccugcugcacccauccagagcaggccuggcacccuggagcacgucccugggacaugcugcuacaagugacagacaaagaucuuucuccuggaccauugcccaaacaguuuccagggaacuuaccuccagcaaccugccaugucaccaugaaacagucagacaagaaugccuacugccuaggggagaaaacccucuauuuucuuuuaauauguacacaauugcaguuguugauuuuuaauguggaggauuaggugcagccaaaagacauuuaguuuuagacaacaugccaagacuggaugaaauggugagagcuggauccaacuuuuguccagaaguuucccaacccuauugaacagucucaugucaugaaucagacccauuggaacagaggcagggggaaggaccaucuaucauuaaagguaaccaggaugugaaauaaacagugcugcuuuuauuuaguagaaaaaguuuuucucuagguuuuuacauuuuuauuuauuuucauguuuuuauuuacuuacuuucuuuuuagacacagaaucucacucugucacccaggcuggaguacagugacaugauuauagcucacugcaucuucaaacaccuaggcucaagugauccucccgcuuuagccucccaaaguucugggauuacaggugugagccacugugcccagccaauucucuaagucuuuccuugggaagaugguuucucugaauuuugcauaagcccuauacuuaaaaugugucugugacaguauuaaccaguacccuacuucuggacuggaucuuggguggcgggguugcgauuaaacacuuuguguuucucaaaccucucauuacuccauggcuucaggagaauaacaucaguauaguuagggaauccugaaccucacauccuugaaacuucuguguccaccuuaagugcuguauucauccucaauaaaaauaagacugcuuucuuuguucacauuauauauucuuagaaccaaagaagcaaaggagcuguuuugagcagugcacaucuuacagggugucaugggacaguggauucuaggucuucaggggucacuucagcauaauucuuggcuuuucacuuccuagugaugggugaugggacauugggcaaauuuccucagagcccccguuuucugguuucccaggugaggacagggaugccagccuggcccaccccucccaggcucacugagaaagauguggugaugugauacacuuuguaaucacugugcucugcuguguaacuguuagggcauugcaaggcuaaccacuggucaucugucauuuucgucuggguaaugaauggaaaaaucuauagacuuugggguuuugggugguagcaauuuuaaaauaccuauaccuucuaaagagauuggaacagaaggcaggagcagguggagguaguauagaauguucacuucuguaaacaucaagaccaaaaugaaaaggcuucuuuuuuagccaguccacaaaacaguaauccuauaaaauaaguaccucuuuggggacagcuguguuggauucagaugcucccuuuugugaaauauuugccuacagccauguuucucuccauuuuaaauguucucaaguuucaucuuuaaacacaaggccaagaacacccuggugugguguuugaguggugagacuagggagaacccacugacaaaugcagauuucuuugccuguguuguaggucaucugaauaauggagucacuacaagguaccaugguuuucaucaaggagauaguuuuacaaauaccuuccauauucuugggaauguuuuggagacaguccuauuccacuucauuucuuucuucuccacagaugcuugguauagaauguugccucuguauaugggauuauucucucauucccuuuacuccacagacgcuugguauagaauguugccucuguauuggauuauucucucauuccccuuacucuuaagaguuuuugaauccgaaggaaacauguuuuguuuugaguaaaaggagguguucaguggaucucauuuucuuuucuuuugcggaauaugaggccuaggaacuaacaauugcaaaauauauggagcauagguugagauuaaauuaaauuuauuucuaagugguuaauagacacagcucgaacauuuuucaucuucuugaugauugcuuauuaaucacuccuuaauuccuugacacauuuauuaauaggaaaaauugcaaggaagcaucauuugaaaguaguauaaaauacagcugguuauauuguuuauguuuaagauaaaacauuuaaagcuuucacguagguugaaaaugccacaagagaacuaacaugggggaagugguggaugguggaccuagcagagcacuguggucagcugggcauugcugugagcaccagcucaccacucuccaguucugugaccuugggcaaguuucuuuagcacugugaugaaauuucucaucuaaguaguugcccuguguuuaaaagaaauaacguaaagccaccuggcccuaaaauucaguuaaugcaaauuauuauuacaccuacuauuauguuaucuagucuguuuuucuguucauuggguccgaucagcuuggcaaaagugauaugcuaacuugagcaucauguagugaauucuggcagaacguggaagugauuaauuaaaugccacccccucgugggccauauuaaagcugaaugaaaauagaaaguguguaauaucugauaacauuugguggagaagggggagacagaaaaauugaaggauaagagaaaaggagacacauauaaagcuaauuuuagagcgauagaucacaaaguaagauuuucuagcuuuguauuaucagcauuggcuuggcuuucugagucucgaaauuacuagguuacugacuggccgugccuuuuccucaccuuggcuauucagaccaagcuguacucuuaacagcucaguagccaaaucugaaugcuucaaauauaagcauaaacucuuuauguguaacugauugcacuuaauugggcaauaccaaaucauggaagaaaauuuauuagugacccugucuccuucagaacuuucagaguaauuggaaaugagccuaauauccguguuuuugaaagcuuuaacaauuggucuacugacaggauuaaauucauacuuuauaugguguguauguuuuuucaugcuuaaguuuuuuuccuuauuuauugauggucuuacaaauauuauuuggaaauugagaugcagugagcacagaucuuaaauaucuuggcagaccgccucaguagcuguggaugaucccuguuagcuagagaaaaaccaggaaaaaaaaacccaaccugguacacaauaguuuacgaaaugaucuuugugugauuuugaacaagcuguuuuucauuuuaaucucaguuuccuugcuucuguuacugaccuaacucauggagauguggccaggagagggugggagagcucucugaauuuuuuuguuucuccugaaauaaaacaguucuaaauagacauacuuuugugugauuacauuuuccauuuuucgcaaagucguagguauaguuugaacaccaauugagaauaaaagaagcugccuucucccagucuuuucaagacauuuuaauaguuaaugagauuuugccccuuacccucaugaguuucauuugguucugaaauaaaaauuuacggcuguucucucagcugagcugauacuaguuuaagaguggaauugaguucacaccugcucuggcauaaaaagccucuaugugacuucuuugaaauauucacagagcagaauaagagagaguacucacuaucucuacaacuguaguaacuacacgguaauguugcuugcaagcacuuuagagaagcugcucuauaaacugacucuaaucugcugauauuguccacagauagaugccuccccuaagucaccuguguuccucaagguggaaugugguuguggaaaugcaguugguuuguguaggcagugggucuacauuaacacuguaaaguguacauaugggaaaaucuuugcauuugcuaggccauuuagccguucaagacaugguccguuagucaggcaacguacaauggauuuucugaguguucuaguuaaagagcaggauguguaaaguaguauacauuuaggcggauaauuaauaauugguguaggcuuguaaggcuguaauagaauauauaaauuucagcaccuguuaaaguuuuaucagagcagaucaccuuuccuuacugugagggaauauucccgccuguagaaaaauaaagugcucccacuacacgugaaaaaccuuuaugaugaaaggaggacugguuuuuauaacaaauauuauuuuccauggucacugugauuaggugacauuuuagcagucacauuuagagagcguuccuagacaauaguauuuuguauggguuugacuguagguggcaaaacacugcauagaaacaauauuuuagugcauucuaauauucagauacaguuuacuugucaaagaagccaccuccccccccauaucauccccccacaaaacaauaggguuguucauuuuauaaguucaucacaaguaaauauucagagcgaaagccuuuucuaguggcuacguuggaagggguagagaagaugaaacauagaucccaaguucaguuuuuggcuuugguuguaucauaagcaguuuuuacacuucauaucuuagcugucuucauuuucagacauagaggaagugcucccuuacagcagugagggaaagggcaaaugauauauuugugaaagcaaagcagacuaucuuacugcuuuaaaaguuucauuggcugcuugauaaauaaaauuaacauguuaucgauaugucugcaaucauaugguccucaguauauguauuuuuuaaagccauuuauauaaauuccauuuauucuagaagcugcccaaaaugauaaacuucaauacucaaaugagucuuugguucguacagucauucacccagcaaguacuuuugggaagcuggugaucugcaagcccuauguuagguacuagauaguggcaugcuacuuuucuugcuuucaacuuggcccacauccuaauaaaagaaucagguagauaucagauaauuacaauucagagaguuggggaaauaauccauguguucccaggguguuguugcauacauaucagggauacuccaccaucagcuuccucauaauaaugucuaauuuuuuuuuuuuuuuugagacggucucaccccguccuucaggcuggagugcaggggugcuuacugcagcuucaaacuucugggcuuaagaucuucccuccuuggccuccugguggcagggacugugggcacgugccaccacaccuggcuaauuuuuucuauuuuuauuuuuuguagagacaaggucucgcucuguugcacaggcuacucuggaaccucuagccucaagcagucauccugccuuagccucccaaagauuacaagugugagccacuguguccagcuuggcuaagauuuuuuuuucuuuuuuuccuuuuuuuuuuuuuuuugagacagagucucgcucuguccccaggcuagcaugcaguggcgcgaucuccgcucacugcuagcuccaccuccuggguucacgccauucuccugccuuagccuccugaguaucugggacuacaggcaucuaccaccacgcccagcuaauuuuuuguguguuuuuaguagagacaggguuucaccguguuagccaggauggucuccaucuccugaccuagugauccgccugccucggccucccaaaguacugggauuacaggcgugagucaccgcgccuggccuggcuaagauuuuuggguacucacuguguaccaggcacuugcuaaguacuuuacacauauuauccugcuugcuccuuauaauaaacuucuuuguuagacauugucauuaccauuuuacaaaggaggcaauugagaaucagagagauuagguuauuugcccaguguuguguagcugguaaguggcagaauccagauuugaagcaagaucugcugaacucuaaagccuuguccuuacccaccacugcauugccuccuuuguagagaauuuagaaagaauucccagagguggaauagcagcuaaacauggguucagcugcaacuaauagaauaccugauaacaaugguagguuaguaaaacaaagggguuuuuccccuucauuuuaggaggugucuggaggcaggagguugccugugugaguucagcaaaucaauguuucuuucuucccauucugcccuccuuagcaugcugauuuucauucuucagcuuuuuccucuccucuugcauuucuuucuugcaagcuggcucuugagccucacacagcacauuagaguccccuaaaggaggcaggggaggcagagguuaggguaacauuuauccuuacauauauccuauuccauccaggaagggggaaaaacauuaccagaaucugguggccuugagcaggauucugcuaacaacuuauuggcuaaaccucuagcagacaucuacucauagcugcaagggaagcuuggaaugugaacucuuagagccaugguugggucucugacucaagagacaggcaagggaggagggaguuaggaauggcuauuguauggaucaacaugaauuuucuuaauaauauacgugguaaugccugagcuucaucuuaaaggugaguugguuagaacuauccugauggaaagaaaauuaccaguugguagagaugcuugagcagagccuugggagcuggaagacguaauaggaauacuggaacugaagucauucugugagaugacuaugagauguaguaccacagaggaagggaugacagguugauauggcuuggcugugucccacccaaaucucaucuugaauuguagcucucauaauccccacauauugugggaaggaccuggugggaggcaauugaaucaugggggguggguuuuucccaugcuguucuugugauagugaauacaucucacgagaucugaugguuuuauaaaggccaguucgccugcacaugcuaucuugccucccaccauguaggacgugcuuuugcuucuucuucgccuuccaccaugauugugaggcuuccccagccaugugaaacuaugaguucauuaaacccccuuuucuuuauaaauuauaauuauuuauaaauuauaauuaaaaucuauaaauuguaccaucuccgguauuucuucauagcaguauaaaaaugcucuaauacacaggugaagcuggaauacaauccuggccccagagaaaugaagggucucuuguguuuaggaguggaagaugucagauuuucaaugaagcgugugguaaacuacucaaggauugauuuuaaauagugagauaccaugauaugauuuaugauuuaggacacucaagcaacugugaauaggaggcaacuugagggcaaggagauuacucaggaggugauuaaggcaauuccaagaggaaaugaugagauugagcugaacugggaacaaugaagaugaagaggaggauggauuugagugauauuaaaaugauggaaaugguuggacuugguaacugaugggcaaggcaggggucguccuuggcuucuuggugucuggcuugggccacuuggugguuggcagugccauuuguuaagauguagaauauaugaggagaaguaggucaugggggauuaagguggucaguucaguuuuggaaauaaugaauuuuugacaugucuguggguggacagauuugugauucuggguuugggauugcagauuuggcacacaauauuaauauuucauaguugaagucaugggaguagauaaguuccccagagagagacaugaaccaccaccaacaaggcaauuuguugcauugugacagcucuaacuuuuagaaaguucucaauucuguagcugucagccugaaauacucauuuuucccucugaagcuaacuaguauuguguauugucucucuuuccacauguuuugaaggaugcuaaucuuggcuuccuucaaaagcgcaacuggaaaacuuucaacacauuguagaacaugguuuaaucacaccuuguauucccggucaccauccucugcuguguucuaguucaucucuuuuucccuccaaguggugaauccaagucuuacccuaguauuccagaucugguuugaucaauaguggaucugcucucauuuuuaguguuaaugcagucuaagauuccauguauacauucauauuuuaacauugacugaaaauggagcuugugguccacuaaaaucauuaaguguuuuuaacauuaauugcuuuacauccagggcuuccacaucuuuguguagaaugggacuuaauacguauccucgucugauuucuucauguugguuuuggucugcaaaugugcaauaauucuguccuuucacucuguugauauaggaagugagauggugugaugcuuaggaaugcaaacucuuggauuuauauccuggcucugcccacccuuuacuaccugggugacaucuaaguugcuuucucugagucacaguuuccucaucucuguguugaagauauuauaaaauccaucuguugggauuguugggugaaguaaaugagguaaugcauguauaaugcauagaggaauccccagaacaucaucaacacucaguaauuuuucccuguuacuauuguagggcauauaaggaguuaauggcgcuauuuuugugauuguggauccuuucucucaguauucuuucuggaauacuuucaguaucucuuucuggagagaaaguuuaaggcaagugguucaucugugacgaauggaagaaggaaaugugguucuugauuuugaguugugugaugaacccaaauuuaccaggcaauagauaggauaugaugauuacuaaauuugccauugacugauaguuaacuggcuaccuuguugggucucuugagaaaagaacuaaaacaagaacaacaacaacaaaagcuuaaaauuaccugaaaauaugucucuuuaccuacaccuaauuuuaaggcagaaaauuccaaagugagccagcuacucaauacaggugcugaagguuaugugaaaauucggguuaacacuaaugauagauugagagguaacuguuugcuuuacaaaccgcuugccaaggaaugcccauauuagacuaugaaaauuagacucauggcaaauuuucaggaacaugauucuugugauaaacaagcuaucuggagggugaugugugagcucacaggggaguuuuaagaacagguuuccauuguuggacaguaaccugacagcuaggcauacucagaggaagggcauagauuaguauccaacaaccuguuuuaaaaccaagcaaugggaccccauacaagguccagguugacccgaaccaagguuagaugaaccugacuuguuuuuauaguaaacgucacaauggugacaagccagcagggucaucagcacacuuugcagcuacagacuucccacuggacaaaccauuuucagcuuccucuguuuggucacacccacaagaaguacgaaugguauauuuaaaaagcuaguccaucuugguucauuuauaccaguguguaggauuucuguagacucugggcugguuacaaccuagagcugcagaagggugcagagcuucauguguucauucuguacugugauaaaguucuuugcacguuuguggaaaugcaaaaguucuucuaugcaccuggcuucuguuccggucauuuccuuguauauggguuuugauccggugugacggaagagggaagcuaugcauucugagaucucagauuucauuguauccaauuauuuauaagaccugagaggugcuuuauuaguuaggaagcacugcagauuuucucuguagcuuuuaaaaaucauccugacuuccuauguguuauuuuuugcauuggcacccauugccaaugcuaugucucagaagagccgagacuuguggccaauaauccuuagaaacugauggggcuguagaauuuauuucucugucacccuuuuugaaaauaaaauaaaguuauauuuuucauuuacauggauggacaaauuggggucuuuaaaauaaaaccuacuuccccuuuucauucuuuuucugaucauuuguagcaaaagcuuagugguuuucuguagaacugcuuuguuuuaaaaaucaaauugaagaccaacuugauucugccugcagagcaaagcuaucugccuuuuuagaaaaucuggaugguuaaauuggaagcacauucugcacaugguuuagcaguuaguagccuggaaaaugacccaauagccaagauaguuuuuuuguuuguuuguuuuuuguuuuuuuaaucuucauuguaagugcuuguuuaaaguguaagcuuguaauggacuauuuugcacauuguucauuguuaauucuuuucaggcuauuauaguucuguaaauacauugccugcuaaguugugucaguggagaaacauuagugcuauaagaaaauccagugaaaugugcuuaaaagcauuaccaauuagcgcaugggacuggaucaccgcgauuucuuagugauccuagagaagucaguuucaguugacuucccauuuauuuaaaauggguaugacaacguucuuuuuggagaauagggcagcacacaaaugcacacuaugcuguggccugcugaagaguuuccacugauuugugacuauauuacucaauauugcuuuguagcacccuuagucuaauccacauugaaggagcaaaauccuucuguaucuuacuuauuauacgauuauguaauacauauguuacuuuauauauaauauguaguaguacuuauuuuacuauuuuuauucauuauaaugaaaauaacaaauuuacugggugguaucuaccaucuagcucaagcuguucuauuuuguauuguuuaaauuugagaaaagcuaauauugguuaauaauuaaagguuacaaaaauuguagugggaaaggaguuaaauucugucucucagauaguaaagacugccagaacauggacauaaucaugggaaauaauaggguggauagaaugugauuuaucugcguauguuaaagaaagaaaaauagugaucgugaauguacugaauauagcuuaaacuauuuaucauuauguacaaauggaaacuuacauaaaaccccuguugauuaaguuuuaucugaaacaaaggauaugauuggaaguggagaaugggagaguauuuuaagagcaugugauaauccagcuagaagcuucagcaagucuguggucaaacaagagaagagaaagaaagagcaaggaagcuugauuugguuaugcaaauuuggagcacacauaugaguugggaccuaauggauuguugcacuggauuuggucaucaaaugaugcuuuucauagcaaauauuaucugagccauuaauucaaacacugagaaaugcaggccauguguaggcagaaccacagccuuuuuaucccucaaaacaaaauguaaaaguuggccuugaugguuagaccuuauaaagaagaauaaggggggaagggggaaaggagcaaguagugaaggaaaaagcacccagaauggaaacaggcaugcguauucagacauaaauccaauaaacagacaccccaaaguuaugcuguguaagaauagacacacaguaagaaauuuccagcuaucaggcuaacaggauggaaaacuggagagcacagagcaauuacuuacgaagaaagaggcacaguugacaucaaguguuauagaggagacuggcaugauuacaggaagauguugagaauaucagaaaacauccccaaauuaagagugccaaaaagaagaaagauuaccgaugagaucaugauaaauaauaaugagcuguuucucaaaguaccugaagaaggggccugaaaagugguuugucaagccuggaagacagagaaaggguaauguauugacggacgauggagacacugcuaaaaaauaaaugaaauuuucaccccaguguucacaaaggaggaggugguuggggacagaugucagacacagacacaaauuucccaggggagaaugaagaaauacaaaagaaaucaggauccugcuaaaacaggugaucaaggggugagaagaagaaaaugaauaaaaccccaaaaaccccaaagcuuagcgguagucaccuaaaaaucuucaagaagugagaacaaagaagcuaacaagaagaggaaaaacauacccgcaucacuuagaaaggcuggaaauauuuucauguguguguguuuuuaucuaguuaauuuguuagacuagcccuuuugaaacuuguccuuaaaggaaguaagauagaauacuuaaagaaaaaugauuguggcugggcgugguggcucaccacccagaguggaaacaggcaugcguauucagacauaaauccaauaaacagacaccccaaaguuaugcuguguaagaauagacacacaguaagaaauuuccagcuaucaggcuaacaggccuguaaucucagcucuuugggaggccgaggagggcagaucauuugaagccaggaguucgagaccaaccuggccaacauggugaaaccccgugucuacuaaaaauacaaaaaauuagccaggcgugguggcacgugccuguagucccagcuagucgggaggcugaggcaggagaacugauugaacccaggaggcggcgguugcagugagcugagaucaugccguuauacucuugccucggugacagagugagacuccgucucaaaaaagaaaaaagaaaaaugaucguuuaaguggccuugaauaaccaagacaucuuuccugcuaaguucuuuucgaguuacccauuaugcccagcguugaauguuuacugugcuuauuaaggaugauuuuuguguccuaggugaucacugaguccuugauugggccaguauuuacuggauggaugcuucuuagugccagggagugcgcuagauccuggacuacugggauggaaaagcuagauacuuucugaggguuuuugaagucacuucuuccucacucauauaagcaaccccaccucuuuccaggcauugauuucaguguguucaucaucccuggucuugcuuuuaaccagcuacuugaugggcaaaggucuggagaggggcagccuccuuuguugcuggcucagugugcugugcuguccucagcguggugccugcuuuuugcccuuauccucagauguggaucccucucuucccaagcucuccuccauccccugugcugcaaacaaaacuccuuguuuguugcuccccaccaguggccacgaaggaauuugcaaaccccucaaccuccuacuguuuuggaauucaugaaguuuuugcccugagcaagaggcuauacuuucaaaaguacuuuuuccuuucuucauuuucccacccccugccuuucaaccacugccccgcccuggugcacacaccuccaucccaggcugauaacucccaucucuauuugaaccacccacucccuucucuuggccucugucaauuuuagggcucagcaaaacugggcuuacuaaaaacaccuuucaauuucuguucucagcauuaaucugucuuugcuuaguguucaaagaauacuuuaagauacucauuaaugcaaacacuguuaugaggagggagcuucacuucggucccuucuucucaccuucagauacuacuguaacagcugugugggacuggaguauggaauguuucagagaagcugcuucugaguguguaggagagggcugaagaaacuuucauccaguacacaguuuuguccuguaguccuuguucccauggccaaaagucuucugguaaaauuaaucuccagugcuaccuuuccuaccaggacugcagguggugucuuuuaguugaaacagacucccguggucccuugauucucauauguaauguuccauguucaggugucucugaaagcuguuagacuucauccaauggagaaggguccauugagcuacaucacuuucuuuuuucacauuugcguuucuuuauguagagugaguugcaguuugguuggcuuuuuuucugggaauagaucacucuucuggggacugucagacuuggucccugcccugggugaguuugccaucuuauugaggggguacuaacaugugcgagacaacuauaaucauagcaauaccaaccccaccucaauggcugagugacuaaugagaggagagagugaggggcugagcagaggccucuaggaagcagcuguggucaaucuuagccuacauuuacuuuuuuuuuuuuuuuuuuugagacgaagucucacuccgucacucaggcuggagugcagugguaugaucucugcucacugcaaccuccaccucccagguucaagcaauucuccugucucagccuccugaguagcugggauuacaggcaugcaccaccacacccaguuaauuuuuguauuuuuaguagagaugggguuucaccauguuggccaggcuggucucaaacuccugaccucaagugauccgcccaccuuggccuccgaaagugcugggauuagaggcgugagccgcugugccuggccuaaaccuauauuuacuuugaauuucacuauagucuaccauuuccugaugccuuauauaucugacauauaucugaugagugacauucuugagaugucugcccaggacuccugaaccccaugagaaauaagauugcacuuugcaguucuucaaccuugcugugcaucugaguaacauguggcccauucauacacugcagaugccugggcuccgucugugagauucuguguuuagaggccugggcugggaucuaggcuucuguuauuuaaacaggaauuucugaccuacacauugcuucaaaaaauugucaauuuuguuuucaaaauuguuauuuuuucuugaacucaauacuuauuuuuaaauccuuuuucacucaggaaaagugaaucaucaccuacuuagcaccuaauuauuuaccacuaagauauuugugugcaaaaaauuaauaauuuuuagaucaaagaaaauggauaacuucuaauauguuaaaaucgugcauauuuccauugagagagagaaugggcugaaauuaucccucuuuuauauuuuaauuguucaucaaauugauagauuuaaucuacuggcccuaaagauuugcuucuauaauaauguugugaaugaaaccuucauugcuguagauucacaauucaacaucauacguaugugguaggugugauuuuucuuguauuaaaggaaaaaggguuagcagauuuuuaccaauuuagaaaaaaggcaagccaaauuagagggaagucagcauuauaaauauuucgaaaagaacccccauucauuauuuuuuguaauguguagcuaagaccaagcaacagugaagugggaaucuuugccuuaugcaaaaugguuagggaaauagcuaaggaugcuaagaaauuagcuucaauauugguuguaggcaugaauguuuuucucagggacuugggugauuuuguuacacuuucuaauauuaucucugcuaucuucuaggacuuauuuugugcagucaaagacuuuuuaaggcugucuguucuguaaaagaaauacaaacuccaaguuguuugauuuuaugaguuuuguuguuguuguuguugcuguucagucuguaaaauagugacguggauaauaaagauauuuaguuguauguccagugaccuuuggaauaauaaaacuguuuuugucuguguggguuuuucacauacagguaauguuuuguucacauucuggauacagaccugaccucaggcugcucagcacugcaauuucauaggcuccuaugagguccccggcuaacauuuugacuguggugguagaccuucaccucuuagauuucauauaucuuucauuuugcuucuuuugugcuucuguugaauucuguauauuuaagaaaauuaagaugcagagagaaaauugguuaaugucuccucugugucuuguaauauguggcccaaacagaaagaaaauguauggaauuuagaaauuuuauuuacuuguuuucuuacaucauagaauaccauuuuaccauugaaauuauuaaaaccugcuuuuauugagaauuuuggggaaguugaaaauguaaccuuuacggggaauuaaagcuguuuuauuuuaaugaauaaaguaguuaaauuauuaaucauauaaaauuauuucucuggauguuaauaaccauuucuuuacccaggaacuuuuuucuaaucacagaaucuugauuggugguuuauuugaaggcauaucucacuauuaaugguucaagaauacccauaacuuuuggaaagacucaaaacauauugcauaauuggauuuuaaguuauguuguuuguaagcuuauuugacuuguaucauguagugauuacuaucaguuuuucuggauguagguaggugcuucuuaugauucuuucauagauaguauugagucauucauuaagucuauuccucagaugcuuauugagcaucagacuugugucacauacuugcacagcuugguguuggagauacacccuuuaucaccacauacuuggaguugcuuuuugucugcuguaagacacaggauguagugaacaggccaagagaaauauaggguccugugggagcuccuuacagggagggacauagcacagagaaacucaggguaguugacauuuaaguucagaucugagugaucaggaaaacagccagccagagggagcuggcaugggaauggauggaggcguguuugagucauggcagccagaucuaaagaaggcuacaaguagagagaggacugugcauuucuccuucccaucacuggaagaggaaggguaugaggaguaggcucuacaugaacaugagagccagcucaugaagggcuguacaagccauguuucaguguuuaucauucauucugcaaauacauacucagcacuaugugucagguacuuggcuucaggaaacaaggcagaaaauaaugccugcccuuguggagauuuuauucaaauggggaagagacaaacaguaaacauggcacuagugguuuugaaaaugggucagaaguauguguaguccaaaugguuacagacucagcauuugccaauaucauggagccaaaucuaagacuauuuaauaaaaauaaguuugcaaucauuuccaguccucagcugauaacuacagauagacuuauucuuaacucaacauauuuacagguaaaguugaagguuaccuaucauuuauauuuauugcucacucacauugcaucaggcauugggcuaagcaagcaagcaaaccacauuugagagaaggugcuacaguuuagugcaaucaguauuucaaguucaccagaguagaacuuaagaguagaagguuuauuuguuaaauaagaauacuugaccuuaauggcuaccaaaaaagaguuggaagaaugaauaagaucuaguauuugauggcacaacagggugauuauaaucaauaauaauuuaauaguacauuuaaaaauaacuggaagaguauaauuguauuguuuguaacauaaaggauaaaugcuugaguugauggguacuccauuuacccauauaugauuauuacacauuauaagccuauaugaaaauaucucauauaccucauauauacccacuauguaccuacaaaaauuaaaauacacacacacacacacacacacacacacacacacgaauacuugagaggugaucagaauguccuguauuccuggccgggcacgguggcucacgccuguaaucccagcacuuugggaggccaaggcgggcagaucaugaggucaggagacugagaccauccuggcuaacagggugaaaccccgucucuacuaaaaauacaaaaaaaaaaaaaauuagccgggcgugguggcgggugccuguagucccagcuacuugggaggcugaggcaggagaauggcgugaaccugggaggcggagcuugcagugagccgagaucgcgccacugcacucuagccucggcaacacagcgagacuccaucucaaaaaaaaaaaaaaaaaagaauguccuguauugcuguuugaaaacacauuaccagaaccagaauucuuccuugaaguuuugaacaauaucacaauaacagaaacaucucaagauuuuaucaugcagccagcaaacaaaaaaauucuacauagugauugaaguagacauuugcuugucacucaagaugaauuauuguaaauaaggaguuuuuauuacaaugaacacuuuuuuuggcagaauuaauaaagagcagaggauacuagaagucagugcauagaagcaaaaggagaaauguaguugagcauagugaauagagaagauuugcuuucguuuauuugcccuauacauuaagaccauugaaugagacuauuuuguguaugacaagcauuugaaaaaauuguuuuacucuggcaaucuuaggcugauuuguuuuauuuccuuuagaauaaaaguugcaaguggguaggaauuaugccuuaaaguguuagccuacaaaggacuggaaaacuacucaaggguaacagcugaagaggaaauggcucugucagugucgugcgcauggaugauugggcacauaagggacacaagcagggagaaaggugcagagagaagagcucauaaaaccaaggaggcuugcuuggaacuaaaauagaauagcaaaagugaaaagccuggggagccacuaaugugauauaguuucccucguaacauaaugcaaauauguaaaguugaaaacgugugccgccucuugcauagacauugcugucaucagcagcacacacaguuggguauauuuggcgaggcauuuaaucuccuggcucucuggucucucaguccauaucaccagaggcauguauuuucaaaacaguccagaucaaugucuggucuuuguaucugugguacaaauauaaagcuuacuuguccacauaacagcaaaguaaauccgugguccauuaacgcuaaauuguaaauagugauagucacuuuuguccaacagugucuguaauguuuauugcuaaagcccauacauguuuauugauauuauccuaaucugggaacaguagcugcuaguuaucuaugugccaaacacugugcugcuguuugcaaauuuuaucuaauagcaacuguuugugaggagcauuuguuaucugcauuuuacccauaaggaagguaggagggacagaaagguuaaaauaauccagauggaggacccacucuuggucacugguauguuuugggcuuagcacacaguucugccagacucugcaacauguguucuuaaccaucagacuuuauuucucuggugggcaacacagguagaugugacagguuagaaguauuagauauaaauauaaguuaucgagaugauaugacuaccgaauucacuacugcacuuuuuuuacuuuuuuaaaaacauguauuucagcacacugcuaaaccacagcaagaaucuuuuuaaaaagaccuuacaagaagcaugauuacaggucacaaaaucaagggaaaauauugucaucauuauuuuuuaauaagugauaagugaggcugaugaguguagaccuguugcuuuauuaauagaaauaugugcaucuggugaggacuuguauuugccaagcacacugcuggccuggaauuagacuccucuguggaauucaggucaguguuuacacccauaguaguuuacaaucuuucauaaauuugagcaaaauauuaggaaagcacuuagaagcaauuuagagaaucagaauuaaaguagaaucgguguagcauguauguucaguggagaggggcgaguagaggagugaguuucucugacagaugaugaaucuaguuuguuuacuuuuugggagacccuguuuccacacucacugacaugugaguuugcauccuggcucaagcacuuaaacuccccagucucccuuucugugugugugggauggagauaacaaggccaaccuuacaagguuguauaggguaaagugcccaguguaagauuugaagcacaguaagucuucaguggggcuagguuuucuccuuccucccugcuacuuacuucaugaagaggaugaauaaguacaaaucucuguucagcgcugcaaaggaagauuaucauauuuauuuauuuauuuauuuuugagacagagucucacucugucgcccaggcuggaaugcaguggcaugaucuuggcccacugcagccuccgccuccuggguucaagugauucugcugccucagccacccaaguggcugggacuacaggcgugugccaccaggcccagcuaauuuuuguauauuuuaguagagacaggguuucgccauguuuaccaggcuggucucgaacuccugacuucaagugauccauccaccuuggccucccaaagugcugggauuacaggcaugagccaccuugcccagcccagauuaucauuuuuaaaugcugaaaaccuaaauuucccauugcacugugcuauuacuuucacaguguugacuuucagagauauccgugcaccgccuuuugguagcucccuauguccucuugcuucucuaguugccauuucuuuggaagacccccccgacauuaguuaucucauuuuccaugagugauuuugaaacccaguuugugccacaguaaaauuuauugaaauagaagaaacacuggaucuugagagauaccaccagcaccugcagucuuaacgcuucaucuccucuccugaccuggguccaacucaucuuuuuuucucaucaccgccugcugccaucuuguuuacuccaagucuucaccguucagucagaaauacaaagcccugcaugggucagguaguccucagagaaggagagaaguaagaaagaaaguggaggccggccacggugguucacaacuguaaucccagcacuuuuggaggcugaggugggcggaucaccugaggucaggaguccaagaccagcuuggccaacguggugaaaccccgucucuacuaaaaauacaaaaauuagcugggcuugguggcaggugccuguaaucccagcuacucgggaggcugaggcgagagaauugcuugaacccggaaggcggagguugcagugagccgagaucgccccauugcacucuagccuggacaacaagagcaaaacuccgucugaaaaaacaaaaaacaagaaagaagguggaaucaaagggauguagggguuccacaaauuuagaugagaugucagguuucucagauguguuccuugauuugagguaggugaucuuagaagagcugcaacuaaacuccaacuggcuccuuuuucccccaugucuuagaagaaaaugugcuucguuuuuauucucuugacaacccucugcauuugcaucuuucagcuucuucuaacuugugucuccugggaccuuucuuuucauaacucuauuuucuuucaucaucugucuuuccccugacuccuuuucccuuugcuucaaaaugugcaaauggauccucucuucucuggcagugauuaucaaagugugguuucucggcgaaaugugaucacuuacuucaaaucuccugggaugaugugaaaguugggacccacuucaggccuaugugucaauaccucaguaugauauauuccagcaacuuucccaaaaaacuacuuaguuuccaaggcaguuuggcaucuccuagaguggcacagcaaauuccaugauuuuuuucuagcccuguucguuuugucuuuuaaaaccugucucccucaacauccacaauguuaaaaacgucuaacuugccuucuguuucgcucacuacucuuuuuuuuuuuccugcuuucugcuucugucuucauaagugcaggcaugggaagagcugggaauuuggagucccaguaggguuugauuccuuaaugucauugcucaguagcugcgugaucuugggucacccauguaucuucaguagggcaucugcuuuggagguuuguguggcuugcaagugucauuuuuaaauugggagcccaaaugcaauuguuugugcucuaaaaaucugccucuuccaguuugcuguuggaaaacuuggaaauuauuggcuuugccaggguuguggccucuggaugagagcuaaaaggugaacagccuuuuauccauucugcuuccccccacuuacucaggguccuuuccuguuacaaaucauaguuuguauggcauggcaaguacuggaagggagaaauucucuccagugagccagaaaaugcaacgggaucuguuugugauugauagagauaagagugccugaucuacuuuucccucugccagaaaaguauuuuucccugacagcuggagacaucaaaggucugaagcugugaauacagagagaugaauguucuaauauuaauauuauauuuaaaaauauaccacguaacauuuaacaucaacaugucuaguuuccucugucugguaacccccagucguccauaugcaaaaagaggaauuccaaucacagagguccucacuccaaggagacaggcaaccauuacgugucugugaauagcugaguaagccaaacugugauaguuucugauagaucaugucaagaccuaaauaguggaaucuucaggauuuggagguggggagcaagucaccuggauugaugaggacucacugaugaacugaccaaauuguuuuuuuuuuuuuuuuuuuuuuuuugagauggagucuugcucugucccccaagcuggagugagugcaguggugccaucuuggcucaucgcaagcuccgccucccggguucacgccauucuccugccucagccucccgaguagcugggaccacaggcgcccaccaccaugcccggcuaauuuuuuguauuuuuaguagagaugggguuucaccguguuagccagauggucuugaucuccugaccuugugauccgcuggucuuggccucccaaagugcugggauuacaggcgugagccaucgugcucggccccaaaugggcuuuuuaggaguucucauggaagagauggaaguuucuucuugagugagagcaaucccagagucugauauuucaccuaguacaugggaagggaacauguuuuguccuaagccaggugugaaguauagucauucauguugggcaaaaacguggcaggacuuggaacuucuguggggacccacaaaggagaauagaggagaagacuccaugaaauuucugguccugguguuguguggauggcccagggcccuggccagagagauucaacuacuaggugagguuuuuuucacuuuagacaacccugcuaaggcuucauuucacuuauaugccgucugugggccuuugaugguucuuuuuuccuauauuugcuauggauauauuuaugcauuuaaaaaauuugcaucauuguaacuuuucauugacaaaauauauuuaauaugcucgguuuuuacaguuuugcuuaauuaguuuuuuucccacuuauauuuauuuucuguaacuuuucucuuuuuuguugucuguuuugcucuauuaagauguuauauaucuucuccuccuucuccagaguagaccucucaucaguucaccaaaaucucucuccaguaagagucaggaagcuuaccgugugacaaccccuucaaggcaauaaggcuccaacuaagggauuaagauuguuuuuugacaccaaacauuguuuauccucuuaauuuugagcuauguagccugaaauccaugcucugugaugaaauggaggugguuuaucugagcuuuaauacucuuaaaaaugaagauaaugauagagcauaguaaugaaaauuaaauaagaugcaugcaucuagcagagaagcuaagaaauaggagauucuuaacaaauguaaccucauuucuucuuuaguuucuguaaaaccccaggaauguuagaaaauaucuaggucgaaaggagaagaucaugaguuugguguuaauuuugagguaccuuuaaccagucaagugaagacaugaaguagacaguugaauuuaagggugugcagaucagagaugucugaguggagagucugcaguugaagagcuguuuguagagaugccaguugaugguaugagauugcuuauggagucuugaguaacaggugggccuugagccuagcaguagaaggauuuucaagauuuaaagacauucaauugagaacaaaagagcaugccagggacugggagagaagggaaaugugauguuauagaagcuaugcuaagcauaguuuuuuaagaaggaggggaugggugugucuuuuuuggucaucaaggaagaugaguacucaacagugucucuuggcuuuaaccacuuuaguggucacuguugacauuuucagagaguuuucuugguggaaucauggaauaggaacugacuuuccaucccucagaguugaguugucuuucaucugacuuggcaaaguauuucuuuuauguacuucuaaugugauuuuucucuauuguuuauaguuguuugcacuuuucauucacguaauaaauuaucaguuuccugaagacagaggucaugcaaaaucccauguaaauuacaccuaguuaaguauuuagucuuagaaucauugguucucaugaugaacaaaacacauuucuuggucuguucauuuauucauucauucgcugaacaguuuuucauuuaccaauuccauacaaauagcagguacuauuuuagguuaugugaauauaguggugaacauaagauacucccuuuucuguaaacuuucauuguagguggagacagaugagaaggaaugaauacaaauguugagggcguucagugucuucacuuauuuguuccucacaacaauagcaugauguagauguuauuccuaguccuauuucauugaugagaagauggaggcaucaagauauuuaguaacuugccaggguucucaguucauuggaaacagggaugauguuuggagcuaggauucaaacccaggcgguuugacucucagauccacuuugcuaaucaucucacuacacugcaaaguguuuggcacggggaaaaucauuauucuuauuauuaauguaguuaauaguaacuauuucucaagggagcugaggaaucauuuacucuaauucagaugagaaaauggacacucauacagcuagcuauuggcagaacugaaauuuagaagccauauuuccaggcuccccuuccaauguuuuccccucauccaguaccucuucuuuaaggaauggaguauggaaaagggaaaagaagcuggaagaaugaaggaaugggcaaggagaaggaaggguguguagaagagauauaggaaauaauuaaaccuguuggauuugggguuuuugaugcuauugaacugucugguuuuuaaaguuuuuuucccccuuauauucucaagagguagauauccuugaaaugauaucuucaugcaaaauaguguuuuauuucaucuaugaccaaaaaauaauucaggagcuaggaaaccuuagcuccuuaaaaguaaaagacuguauuuugggaaagaacauuguuacuggaauuuauacugugaugacacugguugguagacacacuagaagcuuugaggagugugugugugugucuuugugugucuguguuugugucuuugugugucuguguuuguauauguuuguauauuaguaugauauauauagaaguacauauuuauuuuauaaaauacugguaguguuuaauuugugcauacucuuuaggggagaggguauugaaauauuuuucuggguuggaaaaguuuuuguacuuacaugcaaggcugcucuaaaaucaagcaccauauugaaacaucacaaauauacacuaagcaagggacagaugcacaaggaauuuaagcagaguuuuucuaaauggcaaauaauuagaggggaacagaugccuaugggcagcaaaggaugaaaugagguaccaggaauuuuaaaagggagauggaaauacaaauguagaaugcaguugcucucaaggauguuuaagccuagagggugugcuugcccaaaguucacucuuuuuguggguauugacuuaaauuugguucucucuucaccugucuuccccaaagaaguagaugaugcuaaucauucugaaguggaacagauuuucuguggaaccucaguuuuggaugaucuguggcugcaucucuuucuucugccucccuagggucuuguccuuuuauaggacugccaggauaugacauuucacaaccaugucaguucucacuuauuuauuauuuauaccccauauccuuccaaaaggguuuuuagguagccuaccaauaaaagacacguaugaaaauauauguguguguguguguguauauauauauauauauauaaaauuuuuugucuugguuuguguuuuaggauggacaugucccuucuuuagaaacaagucugcuguaaaauggguuguauccaucucagagcuauucugcguagucuugauguggaaaaggaaacaaaucuccaagaauaaaguagagcacuaggcauuucccaucuuccuguagagugguaguuuaaacagcaggggcacugagcagagcgauugagccacccagcaaagcugagcuguagcaccugaucauuaucccucagguuuaagauuuaccuguugugcucauuguaacaaaagaaaugaaaucucuguaauuauauuggaagggggaggagaucguguuuuaguuccuuugaucuugagcuagaauaggcucugcuuuuggaaauuuaauuugaaagagcccaacguacacaucugcuuuuuguacugcaauuucuauugagcuugaaaauagaaauuuauuaaugcaaauguguagagucuguuccuugaggaaaagauauacucauucaaaacacaaggugaucccuuccuacauagcuauggaagauguuaauauguuuucuguuuuuuuuuuuccuugacuucagauaugagguuccuugcuaacaaggacuaagcauaaaaauuauaggauccauuggggaauggaaagauucauucaauacuuaaaaguuuccaaaggacaaauucauuggugaagagcugggggaagcauacugaauccucaaaagaaaaaaaaaaagccaaaaacaagugcaucaucaaaccauucugaaaauauguuugaauugaugauagggcccaugcuaagagacaaagcuuucauuucaacgaauccaaucugccuaguguuguguaaaauugccuuugccuguaaauggaauggcaugcagauuuuagguaggacacuuucucacccaacuuagccuguacucuauuucauuuuuuccaccauuacaugaagcuucacauaaaugacaacuugacuuaauccuuaaaguggcuggauuguguggucuauuuugauuaaacuuuuucuuguucuuaguguaaauuuucaguaaugccuaaaaugucaugagcauuuugggacauaaauccuuuaagcuauuuugcagucauauaguuguucuuuggaggguuugagugcuuuccuaaacuccuucucaucucuaaauaggcaaaauaaauuauaaauugucgagaacauucaaucacucuucggaugagcaggcaucuccuaaagcuggggaaaguauccauuuucaauauuuugaguaaauauaguugauucuuuauaauauuuguacuguaucaaaagaucucaaaaacuguuauaaauuaccuagacuuaaggaagaagacaugauuaaauaauucauuggaucaauaaaaccaaucugcuuuuuucugauguggugugaugaaguuuuuuuucaaaugggguaggugggccucagugcuguguauuauccuuuugauucuauugguuacugucuuucucugcuccccccuuaguuguuguuugauauuuuugugcuuuuuguuuguuuuguuuuaaagaaaggaaagcugcaagccauagaaaguuaggcugugaguuaggaauucugaguuuaaagcagggagccugucccuaacuuuguguuuaaguugguguuucaguuauguugccaguguaagcuugugacccuuacaaauguacaauuucauuuggguucagugauuccuggaugaguuugugauauaggaugccaaaggcuguggaauuucuuuaagacacaaaaucuugagacagagcugauuccuuggaagcuuguggguaacuagagucucauguuaacuaaucuggagggggcuaagaaaagucuuccuacccacuuccaauuaauuaauuucuaacauuuccaucuaaucaugacuuugucgagugacacacaucuuuuuuccucacaggcaagaaacucacacacaaaauuucuauuucuaauggcagacaguuggggugccgcagccaagcagucacccuuaaaaauuaaugagcguaaugaugguuagaaaagcgauucugauggugguuggagagggaggggccauggggauggcagaaggaggaagaccggacuccucauaagugacaaugaugugagccccuguccucaucuccccucccauccccccuuccgcccagucaccaccccuuccauccuccucucuuuacaggagccaaagcagauagaaagacagggcgauuaugaagacgucaguuggaguguaggcaggcgagaggggcgcagcgccccagaugagguccggggggagcugaggagggucacucauggacgaccgugugugugugucugacagacugugaaauggugcguuguugcacggcugcgcugcaccugggcccuucaucugugauugauugguuuggucauguguaauggucccaucugcucuguguuguuuuucuuuuuuuacuuauaaacaccguucccagaggcugagagaggaugagcuauguuuugucaucuucacuuacacuuuagcucaaaaaaguggucaaguagguaagcucuaaagucuguccaaguaauguaguaggaaaguacgguuuuuccccuuugcuugauugugugugugugugugugugugugugugcgcgcgcgcgugugccucuccugcgcacgcgugugugcguggaguuuuaaugcugccuguuaauaucugaauaguucgugaaccacggaagaccaaaauaucgcagaaaugauuugcacaacucuguguauugugacucuuacugcagugaggauuuuuuuuuguaacggagccaauacuuaauuaaaaccgcugacaucaugguguuauaauuaagcguggcauuaauuaagcuggaauaacgauuuuuuuuuauuaagaacugcuucuauuguauaagaccauuaucgccuaaaaacaaaauaauuuuaaggcaaaaauaaauuugcuuuaaccuagcccuuuucaacuucccccaaaguccggccucaggacugucaucaucagggcuccgagucugugugugcgugugugugugagcaugugcguguguguguguguguuuggugguguuggguugggggagaguggaagugaaauuuguuuuuuuucacccaaaaaugcugaucggcuccuggcauucugauggcuaauuaugcaucggagagcuucgacagcugcauucaucaucauaaaauguaauaauuaaugacauuccaacaaagaaaaauaugcaaaugaggacucauuagcauuuucauauucagcuuugauaaugcuuuugcugacaagguuguaauuaaugaaaauucaugucgcagucaggagauuggaucgguuucauuccgcucacaauucccaaaugcuugcauuauggaaaaucggcggcucugccaacuuuucagggaagaaaaaaacacacacacacacuaaaagcaccagaugcaaauuaaugguagggagucuuuaacucuuuaaaccaccccccuaaauuuccaucauaggaaacaugugaugaguguuagccuaagaacuagauucucuuuuuuuuaauaauaggaaaguacuuuuauuugugacccaaguaugagaauuucuggcaaacuuuuuuuuuaauauuaaaaaaaaccccccaaacccuccaccuuuucccuucuuuccuuuucccuuucaagacuauuuaaauguacauaguaaaacauguuaggacagccaagccccagcauguuguguucuguccucuggcuggcagauucacgccacaacaguuuauucauccacaugcuuuuuggcgacucuucaucacguauuugggcuuagaucuucuggugccucccucggcgugcuacccauaaggucgaaagaaaagcaaguauucgauuucucuauucaggguggguuuuuuuuuuuuuuuuuuuuuuuggaugauagugguuuuuuuuuuuuugugcuuuuucuuuuuaaucuauucccuuugugguuuaguguaagaguuugagaaugugcccauaauucucucacucaacacuucugguuuaguguuguucuucaaauguaauuuuaggagacacucugcaaucaaaauggaaacccagaaaccccagagcagagauaucgacaaauauuuaacacagagagcuguuaauuuaugaaagccucuguguguugcuuucaaaauguggaacuuuagguuggcaaauguacacuugaugccaaccugguaccauguuugacagacaagccugaaguuaaacugaaaguucuaucuggcccucaagguuagaaagaaaaacuuaaacagagucugacuucauuuucuauuugaucuuuagguuaaaaaaugaugauuauuaaaacuggucuuuuugcugaggcagauguuuuaauaaaagguuuguauaaugauuaagaaaaagggaaaauagaaguguacuucuuuauaaauuauaacguuuauaagcauuuucacucucagaugaauaaaaugacuucugggaguuccuaagaugcaguuuccuguuuauuuaaaguuaaauuguaauucccaaaguugcuagcccagcauaaauaaagauuauaauacgccuuguuaagggaagagagaaacuuugauaugcggggccuuauuuuuuagaguauuucaguaaaacagaaagaaucaucaguuauuucacgaaaauuuuaaaauaaaucuuuuuucccuuguaugugauuaagaaugacuggguuucauuccuuguuaaacucuugggguuccaagaaacagaauuuuauuucaaucucuugcuucuuccaacuuuuauuuugucacaguuuguacaugaaccuguguguguguacacaggcauguguguaaauguguguguguccaugucuaaagauuaugguggcucuguccucucuccuguaaaaucuauugugguaaaauagcaggcaaaagaagguuuuacuuuuuuuuuuuccuuuuaguuuauuucuuuuuuugugugggcaaacugcccauccagaugguagaauuucaccuguaagcaaucugaaacgauagguuaauucugacauuuuauagagcuuuuuuuauuuucuuuucacacaguacaacuaagugcagaauaacugcucaagauaauguuucuuuuuuuuuuuuuuuucuuuuaaagcgcuuucugcugugauugguucuuuuuucccccaaaucugaauuuggggcucauuuaaaaaucuguggcuuuaggcacuuugcuguuauugucaaaaccacaucuaaugaaaucuuugaccagcuucuaauauguguaaaugaggaagugauggcagaagugaaaaagcagguuagucgccgagaagcagauccuuguaauuuuauaacgcugaacguuccacuggcuuugauaaauuuacuguuaguuuucuccucccaccaaauucacagauguauaccaacucauaacuucccaaguaaugccuagcaugguauuagcccccggaauccugggacuugcuuuuguugucagugugguuagccucugguggcuuaugugacugaguaaacuggagaaaaacuucagggugauucguugucccgugaucaaggaaucccauuauuuccaaaagcggguuagaagauguuuuuggaguagaguguggaagggaaagggaguauuggagauuguuuuuacacauaaucaugguaaucaugcuguguugacaaguuaguuuugaaugugccaccuucuuguuuuuauuucuagaaaaccuucauuuucaugaauuauuucuugagcugaugauaaagaugacuuuagagacaucuucuccccugguguauuccuuuagggaaacguuuuugaaaguguuucccuuuauuauaccuguaaggcuugggaccuuugucauggcauuguuuguuguuuuuuccguuuccuguuuugcacguguuaauuccugugggcauuuucuuuuuaaagugaugggauuuccacuguccagcagcaagccacauuuacuggaguuauugaacucuguaauaggaaaccugugggugaucaguuuuacccucccuagaagauacugcuucagucaaugagaauuacagccccaugacugagaauuuuaaagaagggguuccacuaagacacccagauguuuuguuucagguguugcaacaaaaucaacauuuguuugugggcagcgaagccaguguuccugccaguauucccguucagucgcuucucauauuucccuugcaaacuuucccauugguuggggucuguggagagauuucaguggcuggcugguggaaauguuugggagaacauuugcguaucaaagcaaccuaaauauuugcaaaaauguuugcuugagaaaaaagaauccacuuaggauuaggaaguaacugcuuaaacauuuuaaaagcauuugugauuucccuaaguauauuacucaugagccacugccuaaccugaauuucaggggucacucuggaaucuguauauuuaaaaacccuauaagauaauaaagguuuugcuuuaugauuaagaucugaauccauacauuaaaaugaaaaaacacuugacaagacaaaauauauuuuaagaauuguuuaucauuuagugaaccugcaaaacaaaagguguaaagaaagggccucaugaaaugguuggauguugaauaccucuaacgucauucuuucccucuacuguagauuuuuuguugguaaaacccaauuguauugcuaugauaugacauuccuucuguuggaguccauaagcuuucuuccagugguaaugauuugaaugucagaucuuuuucuugaguuuaauguaggcauuuucuguccacauuauuaaaguuucagcuacauuuuacugaugguuuggaaacaguauguguaaaacucaguguaggccaauuuuuccaauuuguuaacaagguaggaguugagcauugacaauuacuguacuuaaaagccccucggaucagguguuauuuuaccaucuggacauuuuaauuaguaauaaaaguguggaucuggauacacagaaauaggaucuacaguacacaauggcccaaugcacucuguuggugcugagguguauguggcuacauuuuauaaauauguauguaugugugugugugggcaaguguaauuaugugccagguguguccuuuuucaaacugggcacuaacacaacaccaaagaauuuggcuacuuuucuuagauaaaaaguaaaaauguauaaucuauaaacuugcacauaaguaaaacuguaucuuuuuaaugcuccuacuuccucaaguauggcaugacaaaauauaaugcugacauuuagguaggccugggcaaaagaugugacucuucucuuucauagcugugugcucuaaggcaaauaaauuaaccaccaaguaucccuuuuuucucauauucagaaugaaaguauaaaugauaauuguuaugguaucuaccuaacaggauuaugaggaagcucauuugagcauguauguugaaaagcacuuaaugaaauauaaggagucauaacaguucuuaacaauugauuguuaauacaggaugcagaugaccaauucauaccccacauaccaucuuuuauaauucaguaaaucaucucauauuuaaaaauaagggagaugcaaauauaauguuacauuagauuauuaacaaaugauaaguuuaagaccaccagaaaaaaauguguucauaaguuucaacauaaagcaaaaugacucauucuuauaaaguauauacaggcucauugacgcaauguuauccuuaauuaaggcaaaagcgaugcauuugagggaaauagugacccucuggagaaauagagaaugaaaauaguuuagggaaaugaaucuuaacaucuucucuuuuggaaaaauucaugcauguuucucuuaaucauuaugaauuucauguuugcaaaccagugugaauacuuaaacgauaaucauuauuguuuagaaucuaccuauuacuacacacacagauacacacacacacacacacacacacacacacacacacacacauuugcucaagaaaaucauccucaggaaguaaaggaguugauaaaauuaccauuggagcagaugaguuuggauacuucuacugaaagcuguuucaguuuuuauuauagguacaguucucccccgagaauucuuugggagaaauaaaaacauuuguuuuuaauuuaaaugagugguaacaugcuguagcauaauauuaacuauuucagugauuuuaucaauuuuaucuuccucugccuuaauguaauaaaugcauaucuugauuaaguacaaaucuuuacauuacguugucccuaaugacaaauauuauuuuaggcaacuuaguuuuaaucaucagagugucuuagggagcuuauaaaacuugucucugggacaugguauuagcaggauguacagaguuccuuuuuggugccaugcuaggaggagagacugacagagucaguccaguccauucauucauuugauagauaauaaguaaaccacagaagaaacgagaauaugucaguucugacuguacagguuuuaagauuuuuuagacuuaauauugaaaacuaguuuuacuuaauguucuaucaguuucauuuaaaugcccuaauccaaugaucacuuucauuuaaauauccuaaucuagugagcagauagggcuuacauagcauuugucuugaagacguuuuaaaaaugcagcugcagguccucaucuuugaaacuccauuugguaaaaauggccaugucuaccuuuaccuguagauuuaaguguccacagucgcgggaugagaaaagaaauugugacacuucuugaaaaauggucucaucaaagggauucaguugaaaaugugagggacugcauuuaaacuuugauaaaaaaaauaaguaauucuaaguaaagucuguagccaaacuccuuaauugugaugcauuugcugaguuccccucuuccgucgucgggccugcucugaugccauauggccuaccauggaacauuuaacuugucagauauaauggauuguccuggaagcagauuuuugcuuugagcacucggcuccuuucuugcauuucacucucagcuccaggcugcaggaugaaggauugugguagaagugcaaagaagagacacacaguugauuccccuuaagagagugaccuauaugccacaaaauuuuacccacguaaagaggcauuauccccgucacuggccuuagcaggcugcaugucaaagucauuuaaauuucccuggacuuaacagauuguguaaacauuucagaacugagagcuuaggaauaaugaaacaucgucauuuuaacuuaggcaaaaauggugcagccauauuggccaaaggaggcauauuauuuauugugaccuacauguaacguagaccaccugguuuuuagauucuauaaauuaaguucucucaaguuuaugaaggaugcuaaaaaauauauauauuaugauggaaauguuacuuggcuuuauuguuuuuguuucgugaauagagaggugagguugaaaugaucauuuaggaaucgcuucuuagccuuuuggcuaagaucaagugaaaugaucauuuagguggagggacaguggcagcuaauuauccuaccaggcuuucuagcuugaaacuuaggggcagaccuuccauucauucuaaccuauuugaaauuagagauuggauguguuauggacuauuuaauuuuuaucuguaaaaguaaauaauguagucuuuguucauuuuaauuuggugcuuuuaugaguuaauuuuuuuuucaauuugugcuauuguuucaacaagcuuggaaaacaguaggaacaauuugugacuuuugcaucuguaggaaaacuucuuuaaaagaauaaacagugcccuaccuauauguguguguacauacauagcugugagguacucuucugguauaaccuacuguaaaccccaaagcaaauauugugauauagagacacagaauagacaauuuacaaguaaucaaucaagcacaaaccagugggaaaauaaggaacuuauguaucucaauuuauucuuuaaaugcuacauauuugauugcuuuaggguugcaaaaguuaauuaauagauuuguauaagacacacagaaauauacauacacuaaaagagacuuugcuaaguguaauucaauauacucacaaaaauauguguuaauuauguuagaaauuuaauauuuaauuuaauuccauaaauccuugcauuacaaauaaguccucauacaggucagauagggcaauaaaaacuacuguggccuugaaaacugacagaagcucacuucuguacaaaucuuuuuaaugaacaacuuuccaucgagcagcuaagaaauaucuguuaaagucaguauuuaauacuaaaguguacuuauguauguuucuuacugauccuaaauugagcacguuaguuuuaucaaugccacucaucggcugacuguaccccuccucccccauacagauuuggugagacuuaguacuaaauaaguuuggggagugccuggccauagccggcucuuguuggggcaugugcgcccucugcuggcugcucacauaggaacugacuggugugugagguucuuucuuucuuuuacuuuucaagguuggguuuuuuuuguuuuuuguuuuguuucaauuuauuuuuauacaacugaucagauauuuaccaugauuauaaaguuguagcuuaauacugaguauggccguuaauuuguuuuuauuuggaaauaaaggugagguuuuguuuuggguguguuuuugguaaauagauaguccugauaguucaaauaacaugcaauguguguaauacucuugaguuuuuuaagugguugauuguauaucacgauuaaccauauuuucauugcuuucauauuccccuugccuugauuguauuugagaaguauucuuguuggacuaaguugggaauagaacuuaaaaggggauagauaagucauugaaauuuugaaauaugauuauuugucuguaauggaugugguagguaaucccuaguagaaaaauuccuguuaugguugguugauaguuuucacuugcuuugccaaggaaaaugaguauauuuacaucauaauacuuuauaaaagcauuuuugguuuccuugcaaaccaaauuaagcugugcucacuggcagacauugagaaugguaguuugaguaaaauauuuuuuguuuuguuuugcuuuugcaguugcuguuuauagaguaugagauguuaaaggaacaaaucacugauggucucuuuacucccaggacacaggacuaaacuauacaagggcaguuacagaggaagagugucagccucucuaccauugccuggguggagagcauccuuggguccugguagugaaggccagggcucuguguaaugagugugucuuuuaaaaauagcaacaauuuuuguugacaaggcuccaucaaagucuuuauaauaauuuaguuuguauaagugauuucuguguaucucugaaauuaaaugacuugauggagucaguuugguauuuguuguacagagaaggcaguuuagauuuuuauaguucuuuugucuuacauugcaaauuuuucuaauuuguaagcaaaagccauaaaaacuuccaaaccaaccguggagugaucaaagaacuuagagcuguggaagggcagaaaugucaucuacguuuuuuuuuucuuuucuuuucuuucaguuuuuccccuuugcaauuuuagguuccaguuaccuuaaaauuuguuuuggauaaaugauauaaauuuuuacuuaauagucuuuacuuacuuugauuuaacauugucaaauaacuaagaauugcauucuaacaaauauuaaguccuuauuaccucuguuagaaugucaucuugcaugaaaucucacauacaugucucuccuguuaccaccuugucuucaaugagguuguauugggugcucuuucuuggugcuucucuggguucccauuauaucccuuacugguggauagcauuguguuacuccugguauuuagucaucuaaacucuuaccuccuugagaauaaugugcauuguugacucucuugcauccagcacauguuacacagaaagcacccaacaaauauuaaauucccuauauuguguuuuuuaggccucauucaccacuauucagaugauaauuuuugcaaguuucaggauuaaaaauuguggucuguaaacauaguauauguaaugcauuuuauuuucuugcauacuuuuuauaggaugaggucauucuucuggcuacuccuugucugcuuucuuuuuucucuuuuuccucccucucauccuucccucugccucuccucuuccuuccugugcuccccaccuuccucucuugauugagucaugcuccuagauucagucauugagaggcuucucuuaaacacugcagcaugggaccauucaucuaccaaccuuccccuuccuugaacaauaacuagugcugcaggcugguuggacucuggggaguguggcccugcguaucuggcaguuugguuauuauuaugggcccauucucuugaaguugaucuugaagagcaggcuuggcuggaaaacaucauucuucuauaaauauaaugguuagcaaucuuccuacucuuugucuuccuuggaauguguuuucaauucugggcuguuccucccacuccccuccaguuucucucaguagugcauguuuaggggauauaggucaauuguauucagugcuaaggcuagagaaaugaucauuuaauauauuacagauacguauacaaauggcaguuggauuaucuucugucugggguuaaaaaugucacuuauauauguguguuuauguauguauuauacauaucuauauaccguauauaacauugucauguccccccccauucuuuugauguaguuuugaguaucauauccaauguguauaguuuaagagaugaacauuguuauauucuuguucacuguaaacuuagcuugaaaguuaaggccaucaccuguguaccauggugcuaaaauacauaauuuuucuauauagacaacuaagugccuauguagacuacucuauaacaaacaaaccuuuuccucucuuuuccaucucacuguggcuuauuuagaguuguaucauuuuuaucuuuuacauugacuguugcuaagacucugguggaacauucaguuaagugagcagcauauaauuuaugauuaaaagugauuuguguggugaaaugcggcugcugauuuccuucauauuuuccaauaaauuccaaaauauuuagccaggcaccaaagucuugcccagaugauguugucucuauuacauucagccagaaaugucacccaucuccuccaaugaaagggaaaggaccggauuuucucccucacuguggacuugucaugccuccacagaacguggacagagaagggguagaaggacccuuuuaaaugaacgaaccaggucagguucacuagaguuggauccuggauucuaaaggugacauccacucuugagauagaagagagaugcuuucagagcagcgggccagugggucugaucaaugaggagcaaccuuaacaaaacuccgggauucucauauuuugggauacuguuguuuauuaggggaaucgauuuggcaauguaaaaucgauuucuuaaaaaaaaaaaaaacagccuucauuauuggagaugagcacauuuaaaggccuagcacgcugccagagaaagguuucucuaacccaugaaauguaacugucugaaaugaccuuggggaucaacaaguccuugucuuuuaaaaaacucugcguaaauaggugagugcuaguaguaaucuacuuuuuguuaucuaccauguuaccaggucuauuggaguuuuagcuaauguaaccuauagagcugugccuaucacuuaaauugguugcuugucucccuagcuggucagaauaaccaguggaauuuuauuugcaagaaaaaaaaaucuguugggcaugguggcucaugccuguaauccuagcacuuugggaggcugaggcagguagaucacuugaggucgggaguucaagaccagccugaccaacauggugaaaccccaucucuacuaaaaauacaaaaauuagucggaugugguggcacaugcguguaaucccagcuacucgggaggcugaggcaggagaauugcuugaauccaagagauggagguugcagugagcugagacugcaugccacuguacuccagccugggcaacagagugagacucugucuuaaaaagaaaaaaauaaaaauaaaaagagagaaugccagacucuaccgaauucacguaccauggagaagagaacccaggaaucuguuuuuaggaaaagucuugcugauaauucuccugaucagcaagguuucuuagccaugaauugaauuugaggaaauugcuuuucuccacacucaccaucucaucacaagucuuccuucugccuaagaacauagugaaaauauuuuauuucugcgugcuuuugacaccuuuagcauguauugcaagaugagcuuuuuuucauuuuuauaugaaaaacuauuauguucuuuugaauaaaaaauaagcuuucaaaugcauaugcuguuuuuucuaagaccacacaaguccuuaauugccuugguuauauccaauuaucauagacucaaacugcaguaaaaauauaagauaggguaggcaucacugugaagauguuauucacauaaagccaaugguaaguuacucauuagaaguaaguugagugauuucaggguugcccuuaguccuucaggucucuaggggacccuuguacaaauugcugauucagaaaaucauuacuuuggugguucaagugguacuuuaguggccuuaaagaguuauuugacacaccuccccaaacagcuaaguuauccccaugauuauguugauuaauugcacacucuguggaauuaguguuauuuucaaugaaagauuuuccugcguucggaaaaucaagcauaaaacucaugugcuuuaauuugauaauguguguacuucuccuaagcaggaugccaagugaggggcugauuuugguuguuguugucugggccaugugaaaucaucuaggacaauauuuuuauucugcacugaaaagguaguuuuugauggacuguaggauguucacucaaaaugcuuaucgauucggacauuuucauccaucauggaacuugagaacucuuugacuuuaugaauugaguuuaaauuauuuggggagaggauuacgguagugagaaggcaaugguuguugcuacaguaggcacuaauaaugauacaucuagaaaacuccaaacggagguggcauauugugggaaagccuugguacuggaacuggaggucugugugcuaacuucaccacuucauaucugugcagccuuuuuaacuauaugagcugguuacccuuaauuuuagugacuucgucuauaaaaacauggacuaaaaugcccauuuaaugagcuuuuaggguguguugccuuaaauaauguaaguuaaauuugcaugcgagauagugcauuacaaauauaagugcucuauggagaauugaauauagaaucugaaauucuucacuuaggcagagcccugaagugaagacuuuugguggcaccuuaagauacuaucugggguuucaguacccacacuguguuaaaggcagcacaaugccuagaugagaugaggggaaucagugaugaaaugcagccaaaacuccccaauuuccagugggaucagagcuauaggccauuacugaguauucuauuuuuaggacuaaaagaacaucagcggaagagagaguuaaugccagucuuuuccagaaaaaaaugguuuacugcccauuuuucauuaucccuugauacauacaagcuaugugccuaguuaguuaccuuuucccccauuugucuuuauaggauuuccuagguuguuggaugacuaguuuauuugcuggaauggaguuguaauucuuuuagcacaaauuuauuuuacauuuagauuuuuaaaugacuguggaugaaggcagaguugucccuguaucguaagauucuguaggagagaaccaguacucuucucugaaauguuggaaauugaaagaauaaugucagcuucugcuuuuuuguaaacccagagucucaccuccaaacugggaucaggaguaaaguugacuagcuagucagaacaaugaagcuauaccugcauggccacagauuaccguaagacauauaagccaauagaaaccagcaaauuaaauagucaaaauguuuucauaucaauuuaaauaaaauaaaaauuuaauuuuugaaccuacaucauuuaucugauagaaaacuacaaauauauaguaaccugauauauucuuaguguuaaguuguaaauaauaguaguucugaaaggucaucagcucuuguauuaauagacacaaaaaagauggggacgggcauguaugcucaagucaguuuaggaaacauuguauaaaacuaaauugaaagccaaguacagugucucaugucugugaucccagcuccucuggagagcagugcagaagaauccuugagcauaggaguuagagagcaccuuggguaacauagugagaccccaucucauuaaaaaaaaagaaaacccugaauuaaaugucuuaacugcaguacuucucaagagucuuuaacaugcuagauacaauguaaaucuguuggggggcagggcaauagcuuguaacaguucguagauucuuuuaauuagucucccuuuugguuuuuggagcccguugugggaucacuauucuauagaugacacugagugaugcuggguuguccuguauuauaauuauauuuuuacuuuuacucuucuguacaucuuaauacaaagacauagucuucacauagagguguagaaaugcaguuuucugccauguuuuuguuaauuaguugcuuuguguuaaugugcggagaugguggcaguuuauuguaagaugucacagaauccauguguaucauuugugcagcuauaaaguaccuagagaccuuuuaggaauaaaacaccauguaaauguaaauuaucauugccuauaagacacuuucauuaauuucauaucaaauucaugaguguuuugagcucugggauuugagagucuucagugucgggccucuaguuuauuuauacuuuuuuuuuuuucccccagaguuuaaacaccagcagcauagcauagugcuaagagcacagucugggcaaacaaacugccaggguuugaauccuggcucugucacuuguaccuguguggcugugggcaauuuucuagaucucaguuuccucaucugcaaaaugguguuucuauuaccugccuuaugggguugugcagauugaaugaaucauuuuauguagagcuuugagcagugguuaauacaugauaaggacacagcuauucuuauuuggacagggaaggaaaaggcaggcauggaaacgaugaaggacuguaaauaauaaccucauguauguguucagaacuacuaaaaaguucaguuguuguuuaaugaacuaguccuuucuacauauauauagauucacaggguaaucagagauggaugggacuggggauggggacagaaauuuauucugagucaaacauguuuaugaugaguucccuagucugaugccagggaacaaaaggcucauucuucaguucccagaaugaggauuaacagugaaacagccuugcuugguguuguccugcagcaucagauaauuuuucaucaaggcguuucacgggaugauauauucucccauauagaugaaucuauuucagcggugggugaaacaccuaccauuuauauauaauuuuuaaaguggcauuuuacaaaugaaaggcuacacaaccaaacaugacccuguuauuauccuacuggucaaccacaagagggaucaucucuguuagagcuuaucucuagaaaucauuuuauugauaaguugcucgucugucucuagcucuuucuaggugguuuagaacugucauguguauccaggggcaguaaucuaccaaaggugauccuucuuagaaguaucccuaugaguggaauggauuuaugagaucauuuuuuucccuucauguaauauuuucauugucacccaguucccuuacaauaggauaccauggauguaucggaagaaaaauuggaagucaaauggcugauaauacaagaauauaaaaauauucaauuugaaauucuauagacauuuguuaaccauaucacccucaaauaaaaagcaaauuuuccugcuccuucuugggacagcaagauaaaagauuguugaauagaucagcaaaacauugacuuuuuuuuuuuuuuuuuuauauggaaguugcuugccuuuccugcucauauuaguuuuucugggccaggggaagcaagugaauccuuuauugauugccauuuggugccauuuuuaauaaucaaauuuaaauauaggcuuuagcagcggacggguucgauuuggacagaacacauguugacuuccuggacuguuugcucacuggagaugccgacuuguucuguagacggggcugcauguugaucuccuuugucuccagaaggauugauugacggauguugugucugcucauuuacagcguuuuccuuguuuaauuuaaaaaauugugacauaguauuacauguucccuuguauacaucauuuuugcagaagaaaguuguuuagccaauaugucgacuuaguuuaugaaauccucucuauagcuuucauucagcccuucguguacuccauuaggucauauucauuucaugcacggcaaaucgucaccagcagcaaaauuuaacauuugguccuuuuagguauaaaaaugaaucaaaugccugacaagauuuguuucugguauauauuucagaaucuccccccgccccccgcaccaaccccaucuuuaugggcauacaacaaauguuacuaacggguacuuuuaguuuuaaaaauauggacaacaguacuccaugcaguaaaagacuugagcgauuaaugcuacccuuaugccucuuuugaguaguuuuagccauggggcuuggcacugccaccauugucuuugugccaaaaaauauccgcagcggcugucgcauucuaguaccggaggguugucucgaaaauuccgcagugaacgcgccggguuuguucaucacugcuaucucuuuuaaauauuggaaaaauagaaucuuuagcucuuucaaagccccguugugguuguggggauggggggaggcggguggugaagaauggagaaaggaggaaagaggcuguccgcgccagccaguugguauaagugacaaaaauccaugccugacauagaguaaacacagauauuuaagagcuuuuguguucaugagcacagauaguuacuuaaggauccuacucaaacauguuaucagcgcucuugaaaauuuuauuaucugaaacaaauguuccaagugaauuuuaagcagaaaaucaacaucaagaccauagcuaauuuuuaauggauaauuuacacaaaagauaguuucuuuucuagaaacugagguguccuuuuaaaauggcugcuuuuagucuuuaaaaaaaaugauaggaaucgcgauuuuauguuugagaaggugcgugggcuuuauccacagugccugauuauuuugcucccaaacagggguucuggcucugagggcagauuuauaguugaauuggggaacaaaaagauguaauaaaguuaaaagcuuacacuaucagaaugaaauguguuuguucaugaucucuggaccgaucuauuugaugguaaaaguggaugcuacagaugaaaucuuuacaaggagcauaauccuuaaaaaaaaaaaaaaaaaaaaaaaguccaccucccagccuccugcuggcugugcugccucuuugguaccucgcagacuucgacagagcccuggacgggugcccauugaugucauggaaacacucaaauuacugagaaugauucaugucuaugcuggucucuuauccucccccacacaaacaggaguagauuuuuaacccugacaacuuguaauuugcaguggguuuauuuuuguaucuggauaaauauuuuuuaacaagcaaaauuaagauuaagcagucuguaucugauaugauaguaaagaaugcuggguuccauguagccaagaguacuuuggggacucugcagcgugaauucauauucuucuccuccuccucucccuccugccucuuucuuuuccuaccucuugcucuuugcauuccacucuuccucucuuuguuuuucuccuacuuauucucucucuccuuuuaaaauccugcccuuuuaucuuuaaaauaauggaaggaguagcccaacuuauaucuauaagugaggcaaauccuggcagaaagauuccucccuccuguucuguguguuggagucaaguugggaaauaaugcugaguggugaaauucuacaggggauagcuucaggaauuccuucuagagaaaaaaauagaugcuuuuucuuccuuaaacuguauuuuacaauuuggauuuuuagaaauuaccaaaacaggacacuagauguucaguuucuuaggaagucagagcagauucuacuuuauccaucuuucugucuuucugccugccuccuuaccugcccagcuuccugccugccuaucuaccuguuaaacaagugaauauuacaucaaaguaagugauguaauggugauauugaagcauucuuagaugcaagagcuuaaggaaggacacgcguccuuugauagcucaugaaggucgagccuuuucuguuaguaauauuuauagagagaaguuaaaggguauaaguagcuuaaauuugauguacacagaugaguaaauaugucuuugugaccauucacacugcugauacaaguauaaauuuaucuuuucuucagugcaaaauccucauacaauggaaguuauucuguuagaucuucuaagacugacagucugugcgauggugucuuguuucacugaaauugaaacugauauggggcauugauuuuauacuuugcgcugagcgcuagaccagaaauggggcggagguguuuucccaacuuuaagauucauuaaaaucaguagaaaaguuaauacugggaaacgggguuaauuuuaagacuuagguuuggcuuucuuugaaaaccaccauccauuuuauauauguaaugacuuggauacaggauacccuuuugaccacauagaaaaauuuauggauauaaauguaucaaagauacauucuuuguguggggucaggaaggcauacucuaauaacauugccauugccauugaccuaaaagauaaaaagacuacuguuacuuuuagcauucguguugaguugagaggggaaaacuuggggguuguaaacuucagaaggaaaucuauucagccucucaaaauacaaguuuagaguuuuccuguuggaaaaaggaauacuguaguccuauguaucaaguacaauuacuguaaagcuccagucuugacgaaagaaguauccuuuagacuugcgugggguggggucuuaggcaccugccugccucuuuuagccccuuuuaauguucugguauggacagauuucuacaaugauucuccacaugucacuaucuggacucuacugcuuagaucucuuguaaugugauuucauuauccucccuaaugauuauugggguuaaacuuuaaaaagaaacaaaugaacacccuugauuuuauucuuagauguggccgaauagcaucgaagggucuauagaucucuguagagcagucuacagauaaaaauuggguuguuagaauuggaacaagacauucacauuccaugaucccuuguccugcugggucuauugguggaaucugaacuuggguucagaguaggcaauuuuucaaaagcccuguuucccaaauguaaauuccaucaucaucuugaucaugaugggguucacuccugggaaagggaguuuuuaaaaaagagagagagagagagacucagaauuuugaauaguuucuuugcuaaauucaccaucuggagagccugugauugauuaguuuuggccucacuauuaagugucaauauaaucaaugggaauuacuaggcuagggucauuacauagauaauuugccugcuguguaaauaaaaaugaaauuguuuaaauuuugugcaagagaaagugaaaauaaggaguuacgauuuguuuguuagagaaaguggaggccauuggaaugacaguuuuuggaaguguggagcaguuuggcuaagaauaggaaugaaggauauuuuuuuccaguuuaucauagccagagugaggaaguguuauucccucucuugcuugcauacauugccaguagugccuacuuuacguauguaaacaucggggaagagcaguagaugucuguuaccuggaggagauuuuuuuuuaaggaaaaacacaauuuacacuuuuuugucguuucucuuggcagguaaaacagaaaggggcucauacucaucuuaugggagagaaucaaacuuacaggguugccaccagguaagugagaaucucuguugcggaaggguugagaggauuaaccugguaaaucaguuuguuuucuaaauuagaugaugcauuuuaaacugugacaccaaagaugcaccggcaagucagaugauggcucucucuuuaaguaaugaaauaacacagagcuuagaacuaauaaacaccucaucuuuagaucgcugcuguaucagaacuacauucaugggcuuguuuuuauuuuuuaauccaucagccgguaccaguggcacuguuugcaaaccagcaaugucggugaaagugguucuauuaaaagaguuuauuugcaauuaagaacuuaagaauuucuuacgcaggaaauacuucgcggagucaugugucagacccuggguuucggguggcuauugcccuaaauuauaguuuucauaggggcuguaugauguugugugaaaacaggguuguauugagggauaaaaaugucugugaaaauaugauuuguugucccuuuuuguuucugaauuguuuuuggcuggaagucaaggccagcaggcuaacagcaaagccgucucaagggaagcaugcgugagcuagaaaaauaagaguacuuuaauuaaauaauaaaaugccaguguaauacaaagguauagcauguguguguuugugucucugggcacuuugcauuuguauacuuuaaacucuccagagagagccuauuucuaaaaauacugucaauagcuaaaaguauaagcuuuguuucaagacaacugaguuuuuauagaugcuuucuuuuucaguucaguaucaguauuaaucauguauuuaaaaucuuuuuuaaaaauuuauacuuccuuuuuauaagugcauugguuucuuacuuuggaaaacucuugauggaauuuaauaauccucuuuaauauucagagcucucuacuguuuuuauuauucacgcaaacaaaauguacuuuuuuuuuuucaaaugcuggaaaggggaugcuuacucucuugaacucucucacccucugauguucuugaugggggaaaaaaaucuauuuuaauuuuauuuuaaacagcccauuuaauauaccccugaaaaauguaagcaaaguuuuguuuuuguaauuaaaucgagccuaugaggaaaguuuccuuuacguaccagacauaggaagguacgacuucugguggguugguguguuuguuuuuucccuguauauauuugcauuuuuaaaguuuacucccuuggcccagccaccaauucagucauauucggcaucugaaagauuuguugcauugaggugaacagugcuugguuaagagcuccugccggagugcaguucauggcaguuuguuuggaaagaauucugcaggaaagaaauuuacagccauuccagcgcaacggaaacaucuuuggaaugugagugcaaauguucgggcuagauagccugggcgacaagccucugagugcugugucucugguguaaagcucucaguuccugcagaagaccguguuccugugggucugguuucugagggucaaggcggaggucauuagaguuuuggggagaagaaaguugacaacauccuuccuuucugcagauggucauggcagaggucucuguuuucgcugggccccuuuuucuggucauugagagaauaggcuuccucaccccuguauccuuucuuacuaauaggaauuggcgugauuccucacagacacaaagauuuccucugcugaguaagcgugaggccccuuaacuugugaaagcaucauccagaccgugugagucugucuguguaugugcagaacacagacccuccuuucuccguuuguggggaauacuucccucgggugaaacugaaguuaauuuuuuuuuuuuuccaaacacaaggugagaaguggaaaggggcagaggguggaagagagguggauggauuggcaugugauggcugaauuucugggccuugggagguucguuuugaggcauuaauguccaggaaaauucuuuuguauauagcacuaugacugcauaugcuuuucuuaaaaagccuucguaauguagccguggaguguggagauuccuucauucuuaauuugugcuucaugguugugagucuugcaagagucuacuaucucugugcuuagcguggucgcagcaaucuccauaaacagugugauuacuuagggauaaauaaaagugaaauuuuggaaauuugcugacagagggaaaauagggacugaagaugaaaaauguacagaguaugaauuucugcuuucugugaaauuugagaauagaacagaccauagugugucuuccagugaaucaguuucucuugugccguauuguuauuugaaucccugucuacaacaucagcuaugcaaaccaaagagaaaggcaaaaucucaguaucuugggcuucaagucuaaauagcagaucacagcugaaaugauuccccacugugugacaaggugagugacucguggaggggaggcuuuuguuuucuucuguuuacuacaugauugagauacggaauaggaaaccuucagauggugugcccuaaggagcuccaaaagcugcuuuaucguauuauaacaguguauccuauggacuuaaaggggugagcagugcuauauggaaacaugcuucuuccagucucaauagccuuuuguuugguguagagacagaguggugguaagcaacagguagcaaagcgcuguccuggaggaauacauuauuauugugagacguguguuguuucagaaauauaucaaguuaaaaauagauauauauuuuagauuucuccuaaggauuuaacacuaauacugauggacauaugacgcuuuuuuaaauggauauauuuuagcagaagaaugaaagccggcagguucuuuauuagcaauuaaguuguuuucauuaaaaauaguaaugagauauuauuucauuaaugcauuuccaccugaaguuaucagaaauaaacauggugacuuuuugagacuuuuaaaauuguguugaaaaugaaucaauagauaagcaaaaguagccaaacgaacuuuuuugaguucuuacuaaauaugacaaaacuaauuuaaaucaaauugggguacagaaaucacacccagcuuaacauguucuugccaaaugguaaccucauacuccuuuuaacuggcagagaaaaugaaauuuauaauggaaagucugacagaaacgaaaaugagugggaauaaaguuuuuugcaagcuaguccaaccuuaauacuauaauagccaauaacuaaaacuuaaugggcaucauugcaaaugccagaagggaaaaaaugucauuuguuuugguuucuuuuugcugcuuugaauagaauguugggugauuugcaaacuuuuaaauuuugcuaaaaucuauuuuuuuaaugagaugaugauaucaaaacaaauacuuguuauuacuucuccccuuaaauggaaguuuagaguugauuaucaggaauuguuuguauuuucuuucugggauauagcccaggucuaaagccaugguuucauuuuuaguauugugugugugugugugugugugugugugugugugugugugugugugagagagagagagagagagagagagagauggggagagagagagagagagagaaagaaagcugccuaucugagaccaaucaaauuagaaucuugugagcugggccugugcuuuucugacaacuccccagguuauucuaaugugcagcuagguuuuaucauuuccuagaauguucuguagaaauauacccuguauuaaugacuuguguucaacauaugaccuugaaaaugcuuuuaggcuuuuugcauuaauuugauuauucaaggcauggaaauauauugcauaugaacuucauuuaaaaggcagugaaaauuagugauauagugaaaaucuucaaaucuuuauauagaauuccacaacugaaugucccagcccauaucuuguuuucucuagugaaguccaaggcuuuaaccucauccaaauucuuuuucuucuucagcaagugaucaaauaggacuuugcugauacaguuauuuaauguuuacaucuuaaaaugacuaauggaauuuaagaauuagaccuaaucuaggagguuguuguuaauuuccagaaacuuggagaccagggaggaaacauauuuucuuaguuugcccauaggcuugcucauuuuugguucaucgaaauuaagcauguaguugauuccaaaaugaauuucacauuucagaauugauuucuuugucuuguuauuuuuacuuuugauucaauagguauuacaaaugacuuaauucuaaacuuuuggccucuuuuaguuuuucuuaucuaaagucaaaauagaaaggauguaagugaaaaccguacaaaauuauuuuguuuauuacgaaauuggcaauugaggccaauuaggccuugcgcaagcagaaauacacaucgcuuuuuaauuuacuaagaugccuaaguguuuauccugaguguucagcacauccaucgaggucuuaugcauccuuccugggaagcucucccuugcagggccuuagcaccugucuucaucgugcuuuuuaaaauuugccaucauuuuuauguguuuguugcaugcugauuuccacaggauucuguaaacuccuggagggcagggaccaugucugcuuuauccugaauguguaccaugugccuagcagggcaaaaauugcaaugaccuaguguuucuuuccucagcaucacuuuuggaagccauuuugagggaguaaggucugaauagcaauguacaugaaccauauugugagcaucuuuuucaugccuacgaaaaccagaaaacugcacucucccaaaaaaguccuuuggaagcucuuccuucuaacaugcugugcaggcucuggaaggacaccaaagucauaccguggagagacacccacucugacuuuuugggggguugaaucgucucauucaccuggugacuucacuguucuaggccuguauaucuggaaaggccugaaugagggaauuauagaugaucugugguucuggcagagguguuguuggaaccaaaggucagcauccugguccgaacauugaaauguagcagugugaaugguaggacaggauauuuuaaauugugacaguuucagacaucacagggccugaguuugcaguauauaugucaucgcagcugugucccugagcgguauuuuucgggcagcggcuuauucauuuugggggauuguuauggguauauacccuucuuucaaaagucagccgguacuuaucaaaggggagaauggguccauucuuucauugcauugguuaagaaauacuuauugacccuguagugguguguuagauacucaggagaaaaaccaagggaucuuguauaccuucccuucuauccccaccagcagcuuccuggauguuaacggggaaaaucgagcucuauuuauuuauuuuuauuuuuaaccuuacauagcauaaauuuuugagcauccagaacaguugaaaaaauaauaaaaugaaugccacauaccugcuauuuagguuaaacaguuguuuguauuuguuauacaguauuuucuuguguguauguauaauauguauaagaauacauauuuuucagugaaccaaccauuuuaaguugcagauuuaauaagaaugcacccauagauuuuucaguacaugucucuuaaaaauaagacauuugccuaacuaacauacuguuauuaucccuaaagagauuaacaguaguuucuuaaucucaguccauauucagauuucuucaguuguccucaugcaaaugucuucaguagcuuucuuaaaaaaggcaacuaaaaugccauuuacgcgugucauuugauuucuaugucucuuuauaauuucuuuuaaacuagagcuguuccucuauuuguauucuuuuuuaaauuguguaauuuauuuuuuagggaugggguaucgcuauguugccaaggcuggacucaaacuucugggcuugggauuuucccaaguaauuuuuuuguugguuuguuugaaugauagugacuuuaaagagaccaggccaacuguccuauaaaacauuccccuuucuagaauuauuagauuucguuuccuuguggugcuguuuaauuuuguucaucacuuguuuugccuacaaauuuaaaauuaguucuaaagguuuaugcagguucagguuaaacauuuucggcuggaguacuucauugggggugcuguguauaucaaauuacauuccaacagaauauugagcuaugcugcuguugguaaugcuaacuuuaaucacuuggcaaaaguggugaccacuggauuguuccauuguaaaggaaucuuuccccaucugcaauuaacaaauagucuuuguauugauacuuuagcaauggacagauaccccuuuuucccaacaaccuuugaccuaauaguuuuagcacacauugaugacccuugccugaaucaguuauuucaacugaagacuucaaacuggugauucuuuuaaaauuccaucauuccuuccacauuuauagcuaguauucuucuauaaaagggcaguuucuuucaucauucauuuuaacacuaucaguuucauguuucauauuuuauauaagugucauaacaauuacuguuucuaauguuuccuuaccuggaggauguuggaagcauuaaaguauucuugaaaucucuuaagguauauugauaagaaaaguaguuauggcucaggcugauggucagagaggcuuuaauuguaagaggagggagguaauuguaggcauguuuccuuguaaacuaaacuucaguauucuuuuggugaaauuuggaaccuugcaacaaccucugugccccuagcuguguuucucugauucucauauugccacucuauaauugcuaguaaacaucucacaagguugaucaucaguaguugacuggccgacucgaggggguugcuguggugcucugugaagcugcgcuaucagggaucagcuaauaaucccugccucaguccuugcacaauccagacaugguugauagugaaugucaaaaugagugaauuucuaaaagauaguuugggcuuaaucuaaaggaagccugaguaacuaguauuaggugccaauauaaaucucugaguugguuaauauuauugucccuuaauaauuaagaaagggaugcucagagaaguaaagcaaguagaccucaaaucauuugcuucaaguaaguuucagagccagacucugaacucuaagauguuuuguuucaaagccagugcuuuccaacuuggguucccugcuacuuaagcccaugaaggaguuuuuaggcucagaaguccauauuaguucucaucuagaaaacccugucuggucgauuccaggcccacugggggaucugggccugacacaguaucuacaacagaguagcugcacucagcuccguucaggguuagcuagaacucugaacagucaguagggaaaggcauagcggagggcagaucgcaucguuccugacugcccagccuuaagggggggaaaaaaagauuauaugaauaaucuauucaguaacauccucagaauuagcaugugcaauuuccuuaaaaccaaugaggauuuccugugaaaaggcugggguggaauaugccaauucacauuuuagcaacagcgugaacacuuucuuaaaaauguauagauuauguuuuggcuuugcuuuuugugcaauguaggcagaauaugguuugcuauuauauaaauuuggauucauuauagaucacauuauuguuccaaaaacacaagagcuacauacagcgagauucugaaacaauaccuuuagcagguucuuaaauaugccccaauaauuuuucgauuauggcauuuagcccucaaguaaaauauaugaaacaacagaauaugugcuaggagcauaggcaaguuuuauacaacaacaguucaggcaguuagugcauaaaaagccauugaaauugcuuugagaugauuuaugagacaccgaagaaauggacuccuaguauccaaauugaaauuucaccagaaucaugggauuaacuucucuuuucuuaugaaaaccauuaagcguuuuuaaaauagcuucuagcaauuaggacuacaguucuucaucuuuauguuucugauagguguaaagacaaaggggaaaaaucaauuaaugacuaaagaaauaauugauuuaaugcugagguguaucugauauaauuuaauguugaaacguaucuacauaucauguagagaucaguguagcucuauagccuccuucuguaagaaaggcaguauacucaaaauucaacaucaggauaguguuucaaugugaaaugacagaaauauuuauugaacgucaugcuugauauuauuuuauuguugagagcuuuuuacugaaacucuuuaaaacugaacccccaaauuaaaauauuggcaacacugaaagauagcaacagaagccuguaaucugaaguaauggacuuauuaaggacuucagaaaaaaagacuuuagaaaagaagcauauaucguugagucugcugccgugccugauagugauaaccugcuuagaauugaagcaccccauucuuugaaaaauugugugcgcucuguggauauugacguggguuuguuuacaugugcuuucacucacagaucaacugagcuuccuaaagcauggaccuuucauguucagcguguuguuuucuaaucucauagaaguaguuucauagggaggagaaaacagaaaccgacaagaauauuucuuugcauuugccuuagcauuuccaacaugcaaauguugcuuuuuucauaguauggcacuuauuuuugucagacauuucuuguacuuaacaaagggcaaaguuacauuuuggcgggagagcgacuuucgcccggcacuucaccagaucucguugaauagaauauauuaucacuguuagcauucuuaggguucuuaaugaaagcuacauacccuuuaucuccauuuuccucuccuuuuagaagacaucuuccaaugaacaauuucuaugacuugaauaccagauauauguuauuuucaagcuaccucaaagccauguuuauaugcauuugcgacaauaacaauuccgugcuucggaauaauuauguaggaguaucauugagguuauuaggcaggacccacccucuagaguucuguacaugggggggucucuguguguugggguuuuacugugcaagcacacagaauauccugagcucauuuguaccaugauaaugaacagcagggcacugaaucuuuuuaguuuuauuggcauuguauacaguaaguuauuaaauuucaucucuguaauauaccugcaguaaaauaacaaaauauuggugcacuuaaagaacauguguguguggaacaaugcccuccccaucauuucagcccccugcaaacagcugcuuacagauuucaagauccauuguauguauucccucgagcccaccucuaauaaucgagacacaucugccauugcaguauuauaggcauauguaguuuuauugaaaacuauaccuguaaaaaaauuaaauaacuccugccucaauuaaauuggcaagcuaccuuuugcaaagaucauauugcagaccucuugagacccaagugaguucauuuuauucuuacauuacaaaucacuaaauauguuauuuuuauuuagcugaguagcuagcuuuccucguacuuugaugguaaguuacuuucauccauucucacuuuuguuuuccuucuccccucaucuuuacauauuaaaaaaauuaugcaaauugcaugaagcaaacauuuugagaaucugaacagaauaaaaucaaagggaaaggacccuaacaugcagcuuuaacucugaagugauuauuaaauaaauacaugcaaagguuacaaaauuggggucaaauuuauaacucacguuguggcuugugauuuuuacaaacuucuuugagauccauuugaucaucauaaugguagaauaggaaguaauaugaagaggaaaugaguuaguaggccauacaaagcauaugcagaugaauuccuauuggauuaaauaacuuaacacuuacucuuaagaaaauaauagauacgagaucucacucuaucacccaggcuggagugcaguggugcagucauagcucacugcaaccuugaacuccugggcucaagcaauccucccuccucagccuccugaguagcuaggacugcaggcauauaccaccauggcugguuaacuuuuuuauguuuuguagagccagggucucacguuguuguccaggcugucucaaauuccugacuucaagccauccuucuaccuagacuuuccaaaaugcugugauuauaggcaugagccacugcacccagccaacagucuuaauacuuguugaagauugagucaguaauagaugucugcaaaauaguuuuuuauccaaagaaggaauaagaguaaaauauuuaccgauauaaaaaugugagccuaaacuuauuuuaaguuauguaagguaucuguauaggucuucaugugaguuaaucaugccaauauauagugauuuaaccaagaagaauuuuuuugcuuuauauuuucauagaaaaaauccaaaaagacaaguugcccacuauaugggaaacauauauguguauauaucguauauaucugaauuauguaugucuauauauaugaaacacacacacacacuguuauaagacaguaagcagguuccuuaucuauaguuucuuaguuaaaaaaacaaaacaaaacaacauuuugugcuauucagaugaacuguguauaacuggaccgagggagugguuagaggugaauacugucccaaagugaacauagagucagaggaaagacucuguugaaagucagaaaguagaugauuucauaggaucaagucacggauaaauaugaggugaugacuguuauagagaagguagaaaaucgaaaaucaagcagugauauucuuuuuuuuuuuuuuuuuuugugggguuguuggggauugggucucuauguuguccaggugggacucaaaccccugggcugaaucagucuucccaccucagcccucugaguaguugggacuguagguacacaccaccaugccuggcuuguaguagcaguauugacaaccagucaggauagaaaauaguuacauguuuaaauaaagaauuuccuucuuugggccgggcaugauggcucaugccuguaaucccagcacuuugggaggccgagguggguggaucacuugaggacaggaguucgagaccagccugacgaacauggcgaaaugccaucucuacugaaaauacaaaaaguuagcuaggugugguggugcaugccuguaaucccagcuacucaggaggcugaggcacaagaauugcuugaaccugggaggcggagguugcagugagcccagaucacgccacugcacugcagccugggugacagagcgagacucugucucaaaaaaaaaaaaaaaaaaaaaaaaaagauuuuuuuuuuuucuuuuagaugaagucucacucugucgcccaggcugcagugcaguggcacaaucucugcucacugcaaccucugccuccuggguucaagcgaugcuccuguuucacccucccgaguaguugggauuacaggcgugugccaccugggcuggcuaaguuuuuuuuuaauauuuuuguagagacaggguuucaccauguuggccagacuggucucaaacuccugaccucaagugauccgcccaccucggccucccaaagugcugggauuacaggcaugaaccaccgcgccuggcagaauguucuucuuuuuugauaggaauguugauucaagucagugaguggucguuugguuccacuugggcuuaccugggcccaggagacucugcucacucuguguucucccaggguauuuugugccccacugcugguucacagagaugccagguuucacggaauggagggcugaguccuagagagggucaucacuuacaaguaagauaucaaacccuaagggaaucagaauuuaaagucuuagaaggguuucaguuuugucauauagaaaaauauugaaaauuaaaaaauauauauauuaugaauuguaaacaaacuuuuugaucaaaacucaugaaaguuggggaauacaccuuaacuugcacccugccacugcuuugaagucccaucccugggaugugguucacuccuguggaaauauauauuaucuauuacauuugaacugugaauuguguuugucacacugagcuaagcagcucagaacugucauguguagagugacugguacaauacaacaucaguggugguaaaagauuuguauggacaaugacauguggcaaagaagaaugucaacagcugccacugcuaugacaucgucccucaaggagucuuucugcaucucugccauguaacugucucagccaaagagaaggcacuaacaugaacuucuuccccagaaugcuacucccaacuagcgaccacguaagacucgcuugagucuuuuuugagggugcaaguccugggugccauuugucaccggaaagaacauuuaaguuuggaguuuuauguauagagggagggauuauucuuugauuuauuucgaaagaacauguucuuaauguccuuuugcagauaauacacacacccuaucaguuuuuggacuccagacugucuccauccauaugucauuaugaagcagguuuuuaucuuauuaugauuuagguaauuguacuagccucuaaaauuuuauaauguaccuuucagaagcucauagaugccaagaucagaggcuccuuuggaguuccaucuaauauaucuuccuuagccaacugguacagauaauuuuaucuuuccucuagauaguuacacauauagcucuagaaauaaaauguaguuauccuaaaucagcuguauagagccuuaaccagcaaucagaccauuuagaacauucaacaauaauacauucuaccaaacucugacuuucuguguucaguagauauuuauuaggaaacucacccugugucccacugaagauccucacaugcucucuagguagaugacuucagcuaauaguauaguaaccaugaggccuuaguauuuaugacuuuucuuuucuuucuuucuuuuuuuuuuuuuuuuuuuuuuuuaagagucaggguccugcuguguugcccaggcuggucuugaacucccggccagagugauccucccaccuuggccucccaaagugcugggauuauaggugugagccaccacaucuggaaguauuuaucacuuuccaaauucguauucuuacauguguuuggauuuauuuuucaagaagccagaguaaaauuuggcaauuaccaaauugugaguugagaaaaauagauaauucaccuuugguauugugcuuuugaauuugaauuccauugauuggauuucaguccgucgggauuaguucuuccaucugugucccuuggugugaugacugacucccagccaccaucugagacugcucggucucccucaucuccaaaaguccucaguuuccagaucucaucaauucugcuugcaagauaccaauaaaucugcugcugccuccuagacccccagucaccaccguggcugcccgugcugcucugaucccucuacccaccuucucccucacaugccuccuguccacugcugcuggagugacagucuccacaaaacauuguuccuuggcuuuggggccuguccuuagcauggugguauccuggccccuguuucugccugcagccucagccuucguacucaccauucacaucucauguuccagcccuacugagcugcuugcaguucccucaagaguucuuucacgguucucucugucuuuauaagaaccugaaauaccuuugccuugccuccccuucuucuugccuuacaucuguucuaccagcuaacucaccugcuuuguucaagauucagggacccuggauguuauaaccagggcagagcgagcugccucucuucugugcucaggaagccuuuggagcacuucuuuuuccucacagucaucacacugucuacagccagagaagggcaaaggcuaggggcaagggcuaggcuugccgucucuaucugcagugucuaacaggggcacccaggaagugcuuguuccagagucacaggauggaugagugaaugaaugaaugaacuagcaauaguaagaaauuguaugugagcauguaacuuacuauauuuaaauacuuccaugcaaauuucuugacuuaaauuaaccaugccaaugaccccugaggcuggauuuauuuauuuauuuauuuuuugagauggagucucgcucugucacccaggcugaagugcaguggugugaucucggcucacugcaaucccugccucccggguucaugccauucuucugccucagucucccgaguagcugggaccacaggcgcccaccaccaugcccggcuaauuuuuuuuuguauuuuuaguagagaugggguuucaccguguuagccaggauggucucaaucuccugaccucgugauccacccgccucggccucccaaagugcugagauuacagcugugagccacugugcccagccgaggcugggauuauuuuuaauccaguuuuauugauaaagaaacugagauuuagagagauuuguuuucacucugaaggcagagaugggacuggggaacaaacuccuuuggauccagauuuggcauuuucuuugucacuucuuuagcacuggauaaaguugguguagcuuugugucauagcaaguagcccacagagucuuuucauagaugguuccagcucucuauucauuauuaacuuagggaucauucauggaggcacuuaccuaguuaccaggcugagaccucugucugccaaugagaaaaaaugugcauuucuaaagaggauaugaagaaccuagcaaucuguauaucaggagcauugucuuuacauagacaaaaaagaauauuuugaauguuuccuguaaguaaguaccaguugcaauagcguggugcguaccgcccaugcuaucuauugcccaucagugguaccucuacucucugguuguggugaaaaggaccaugguccuccuggaaauuucuggcccugaagcucaggggagaagugcaacaccagccacaucucaucccccaaguuucauucuccuucacucucccugguacaacuuggcagaggauggggagaacugggaagaaguggaugcauugaguagaucaagcuuuuccucuucauguuuacuuuauaugauuuuaauuuuguaaccuuguuguaggacauaaaaaaugaaugacaguggacuuagcuuuuauuuauaacauugaaauccuuaaagauagaauguuagagucagaaaggaccuagacaucaucuggcauccagugccgcuuuguagcaaguggaaaacuaaagcucagagauguugagguuggucgucaucacacagcaagcagaccuugcucagacacagccacacaauacaaguaaaauuccuagccuguaacacggaaguuuuccuuugaugucuuuguacccgcuuucuuccaaagagcaaaaggucaccuagaccaugaaguaauagccagcagcagccggaaacacauccugaggaaauuucuagacgauugucccuuuguuaagcuaccauugaaucauacugucacagagccagagggugucguuugcuuguaaauacugaguuuuugaaaugucacuguaacacuggaaaaauguugucucugaagguugccaaagugacagaaucccgacauuguaaauaccagccaacacaagugcuuauaaaugacaggaauaaaauauacuugacuaaauccauaauaaucacugauaacacuguuuacccucagugaccaggagcugugaacuuggauaaaaagcacaugugugcagauaucauuaauaugucugagccucuagccauuccagaauauuuugauggaaaagcucccuaaauauguaaaagcuuugcaauaacuaagaagcuaguguguaagguagggugucagucgucccugaugaaacuagagagagccuugacuaucuucagcccccagaggacugauaaggccucccuuguucugguuagacccaaacucugagccaggcuacuagggcaggcaaugcuguauuuucaguagaugugauucucagaaggcccauuugccagaagcaugagcccacaccuauaucauguuccauggagaaaauguggaaugaacuuagagauuaaaaacuuuggagccauaagugggaggaucccaugaacuacccuuugacuuucaaaggguggauggguggucagaccuuuccacaguccuaauacucuauagcccaggcuuuuucuuaauaauaacuuccuccucucuagaaaugauucucucccucuuuuuucuguucuaguguaaaaauggugccuguguguauccgagucuuuaagaggaaauggacacauuggcaaaccagugccuccuuuggcucugugauguggcugcuguuacuacucaacuggagcaccccuuauauuccagucuccccagaaaugcucaggaacaguggagacucaaugacagaggguugagcccuccugguuuuucaacuggugaaagagaaauucagaugguuaaggagauagcagaguagccagcacuccgggagcugcucuuaucucugcuaugaggcugugcauggggaagaguagggcugcuuggaaugaccuccuuacuuuucauauauugaaacauauuucuuuuuccuugauaugcuccuguauuguuugaauuuuauuuuauuuuauuuuuugugguaagcauuguuuucuuaauuaacaaugaaagguuguagucaauaaacuaguacuugaugagauuugagaaaaacuacaaaacuguagauugcaaguuggcauuugaccaagaaauuaugauugugcuccuuggauuuuuaugcuuaggaaagagugcacaagagggaaaaagcuuucggucagaagauacccauucuaguacuagcuggaauggugguaaagaauacgaaauggucugaauguccauggcugugugauauuggcguauuuugcuguccaugggucuaaguggaugguauuauagcuuugaaagagucauggcaaaggagggaacaggugugucccaaacccuaaugaacucagcagauuggccuggcauucuggcaauguagucauucagcggagccguggggacucccuggguggggacccagcaugcuucuggagguaccugggaggcgcugggaguagggccugcuguacugguuugacuaaugugguguagguguugauguuggagaguugguggccagucucaggcucuguucuggcacuacuccagcuuguuggucaugaaugcagauugagauugaauggcuccuuacauuucccuugaagaaaggcagcuuugucuuccaggaaugagcugauggcaguggccguguggacauucugcagcuuuggcacccaguagcgauggccugauugccuugaaacugggagccucuagggcccugagaacuugagcagggcuggacaagccuuggagcagaacuuugcugugaauucuuucauugacucgcaaaagaugaaggacucuaaucccugauaucuaccuuuccacuugaccuuuuuagucuucaguggucuuuuagaaguaauuuuaccuggccgcgguggcucaugccuauaauccuagaacuuugggaggccuaggcgggcagaucaccugaggccaggaguucgagaccggccuggccagcauagugaaaccccaucucuacuaaaaauacaaaauuagcagggugugguggcucacgccuauaauccuaguuacucgggaugcugaggcaggagaaucacuugaaccugggaggcagaggcugaagugagccaagaucgugcauugcacuccagccugggugacaagagagaaaccaucuaacaaaaaaaguuauuuuaugaaaaacauuuggagguuuucuuuuggguauggcaggcagauuggccucuuauuuggcauaggugaagaagaagaguugaauaaaaguaguuggggcauagaauggccaugcaaguucccaacuaaaucagggucaaguuuaaauguauuuguauuuuguucaaauucaucuuuaucuaaaacaggcugaugcuguuuugucucugugcugcagguggauagccacaaauuugacucuauaguuaccaguuaucccccugccaccccuuguuuuucuuccugauuucucuacuuccaaucagcugcucuuuuagaaaccaauagagaagugagacggggugggggcagaggaagagagaaaggggguaagggggagggagaaagaggaaagagagguuguuuuuugucauuagugaguaaaaaucugucgggcucggguaguuucuuagugaauucagcauuuagugauuagauuagagggguauauuugagcugaagauuuugggaacucaccuuucugcucuacagaaucccuagguuucuccuuuagcucuacuuucugauucauuccauccccauccacugaccccaccgccaauauugagguacuugugaaagcucagaaucuccaguguccucaaggagcuagccccaaagugcccccugguggcuagaggagaaaaagacaagauggaggaugggaaaaaggucagguggauggauaacuuuggcucuucuuuuggcucuucuuuucugauaguauuuuuguuaacagcaucuaauggguugucuucuuucaguaucaaugugaaccagcucugaauagguuaguguaucaauguauuucccuuuuugggugauuuugcugcagggauuucuuucccuaugccaguuuuuguuggucugauuuuuguuucuaggcauauugcauugaccugagccuucucacaguacugaugacacuggggguagggagaacaggagcaguugaagacgacacaugcugucaccucaugugcuggugugaguggcgcagggaagggcugugauuuuuuauaggcacacugauuagccaagcacuugucaccuccacugccgcucauuggccuacugagugugagcgugccaucuaauugacagcugucuguugucagagggccaucuuuucuccuuuucaguuugagugaacacaacagagacaucugcagagcucucugcagcucugacaagguugcccugccugccaacccucagacuucuaggcagcauaauugaagagaucagaaaagaauauuaacccguugaccaucuugggcugagguguaaugaccaaaaagucacuuuuuaaggugacugugagucuuucuuaguagaggaagacaugagauucucugucagaagagucaggccaguaggaagugcuauuucuugguagugauuguucgugggguuucaguucaucugagcacuuggaagaggaugagaaguucauuuucaagguagacccaguguuucauggugggguuacacugaagccugaaugcugggucacaucauucaugucugauuuggcuuguguaaugacaguagugcuuuggauguguguaguuuggaugaggguuacucuuuuucuuuuaccgccaggccugacacugcccuuuuagcguaagauuccagaaucucuuaugcaguagcauggaauguauggccaaccccguaguaacguggacugccucuuugggacauuuccuguaagccagagauaucaagguggacuuugugauggguagauuguuuauuauacagauaucagcuugggaauuugaauguuuaauuauuugccuugucguagugucuucaaaugaagcucuauuugagcaucuacugggauugguacaauaugcagacaagcuggcuuugugugggucgagucaccugugcuugcaggaugggggugcuugcuauauuuggaagugauuuagugguauccuagguuuaucaggaggaaaauacaucuuugcauuuauuugaacauuugauuuagaaagggacaguguguggguauuggauaaauugcuuuuacucuuucuuugcuuugcauuguucuccccucugaugauuugcaacuuagcaagccuucaucauugaaccugggugaaaaagaagaucugagaagccuugaguaauuuguuucagacuguuuauacucuaguguuuuacagaugugggcuuauuugaggaauaguauuggcgaaagguagcgucauuaaacugguuggagaaauuucaggcaaguagauagagaaauuucaggcaacuccuuuuccaaguuguugcucacagauuauaauagaugaauucagcagaauguucugaccuccuagacuaggucagauaacugaguucuuguccuaacucaaauccuaaguagcuguuucuuaaagcucuguucugccucugcagaaugaaggcuuggccuauauaguguaugagauuccuucuagcuucaggguuuuguaacuaucagaauagguaaugaggaaggagacuaugcccugguagccuuuagccauaucacaaauauuuaacauacucccaaaauagcacauacaagacagaaauucuuuguacuugaagggaauaauaaauacagaaagcauuugagaaguacacauuuaauuucuguuaacucuuuuuuucuuauuuauguuuauuauuagaugauaaaugacuuccuuuuuuuuaguauuaaaacaaggugaucaggauagugagaggauugggucaggugaaacacaugacucaccugcgugcuuaugauuccccuuggaagaugguuuuggguaacauucugggaaaacuauggauaaagucauaggcuuccauauuuaauuaauucuaagacuuuuuuuucacauuucaacaucucagaaauuuaugguaugccaauucaauuggcaacuuuuuuccucucuugguaggaaauagauaaugauguuuuugacauucaguggcaucuuauaggugaugaaauacaauucugaggggaggaagcaagauuuuuuuuuuuuuaacugagaaaggcuacgugacuaagugacuucuuuguuucaaugcugacuaaagcugugauguccuuuuuaaucacuuugaaagauucaaauugcuuuaggaagacaauucaugcauggagcucacccucccagaacuccacacuuaaugcccacugaggaaggagagaaaugcaugcaaauauauaucccaauauagaaggaauauucuaguucaguaacuuccacuccugagcuuuuaucaaauuuuucucuauagaauuauuuuuguuuuauuguauccaaaaugucagauaucuuuuucaaggaaggucaagggacuuugccauuuucuaagccagaaguauucucaccuaguccaguacuagucaaaguuuuuaguaaaucacuuagaauuuccuuuuuuaaaaaaaaaaaaaaacccuucuagaguuuguugauaccuuaaagaucaucaaauccagcuccuuauuucacaaaugaguaaaaagaagacauaaguugcuuguucagaguucagcuaggaacuagauagaaccuggguagccugacgcucccauucuugcugcuaaauuccaugcaauguaaugaaagcgggauugaguauaaaaccgauacucuacacaucuuuuguugauauuucugagggagaaacuugaauuucuguaagugcacauagcugguuucccuuugcuuuguauuucugaaugcuacacuugucuucugccuacuacacuuaaauucauaggugauuucacaaggcacagaagcccaacuugucacaugugguuuaauauaugccacacuuuaugcugcaguagcaccauuuggucauauuuagugaacucugugguuguugagaaugccaaagcagcaggcucagcuauugcagcauaggccuguacuuaguuagcaagcuuagcuuaaaagcugucagugcagcuaauguuacaguggcuuacugagaccuuggccugguugugauaguucuccaaaccuggguguuuucaccuuugaaauaugaaucuggauuuagcuuuuucuuagaaaacagcaacaacaacaaaauggugaaaucuuuaagcucguuaaugugaaugcaguaagaauguaaauuuaauacauauucacuuauuauuaaaugcuguuguaaauaacauuuuuagauuuaauaaugauuucccaagacauuucgugcuauucuuuacuuugaaacugauggggugagaagagaguugaaucuuaauuauuauuuuuuaguuaauuaacaugugauuuaaaaaaaucgagauauauuuuguguuagacccuaauuagaaaagaugucaagaauaacauaaugcuaacuuaauuuuaaaauugauaaaugagggcaagaugauuggaaaguauccucuagaucacacaggaaacggguuaauauucaaaugaauagcucugaaacgcuacuuuccuaccagcuccugaagcaauuuaguuuuuaagaccuaaaacugacucacaaucugugguaugaaggauagauguuaauaguuuaaauauuuaggcauugcgugggcuguuuguuaaaccauugguagcuugagauugaccacagugggaguguuuucaccaugcgaaugagcaucccugcucacaguggggcaugagcauagcacugcaggauacggaacugacauuuauuacauaccugacauuuccguuacucuuuuauuuaucguuuugggcugcuuguuuguguccuauccccacuccccaaauucauauguugaaaccuuaauccccagugggaugguguuaggaggugaagccuuugggagaugauugggugaugaggguggaccuccgaugaaggaauuaauguccuuauaagaagaggaagacacacuggggccugucagcggugggggacgaggggaggguuagcauuaggagaaauaccggauguagaugacggguugaugggugcagcaaaacaccauggcacguguauacccauguaacaaaccugcacauucugcacauguaucccagaacuuuaaaguauaauuuaaaaaaaaaaagaaaaguaaaggaagagagcuagccagccuucucucuucuccaugugaggauaccacgagaagauggucaucuguaaaucagaaagaggacccucgugguggcucacaccuguaauccaagcacuuugggagguugagguaggaggaucaguugagcccaggaguuucgagaccagccugagcaacacgaugaaacccugucucuacugaaaaaaagaaaacaaaauuagccagauguggugacacauaccucuguaguccuagugacccaggagguuaaggugagaggaucagcugagcccggaaagucgaggcugcagugagccaugaucaugccacugcacuccagccugggcaauagacugagacccucucucuccccaaccccuccagaaagaggaucuugucuggaauccagccauucugguccugaucuuagaauucuagccuccggaacuguuagaaguaaaugcuuguuguuuaggcuacccagucuuucguauuuuguuauagcagcuaaauugacuuagacaucauuaauuauguauuuuaaguccuguguuuuagcauucuggaaugagagcauugaaaaugaucaucaagccgaguaaauuaacugaauuaacuauuccaccaaaaaaaaccccaaaaacugaaauguucguuguuccuggggaauggcuaugcacuuggaggcugguccccuuccucccuccucuucuuccuggugaauccccugacuuuucucaaucaggcuuucugauguggaggcuuccucugcuucccagggacacacucccuucccagggcuccuggagcugcugcaucucugcuacccugagauguaauucuugccugagauuucagcuccuccccuacacuucagaggcuucaguggacuauuucuuauucaucugugcaggcacauuguccaauguacaaccugcucaaugggcuuguugaguuaauaaacuacucuguguucuguauuauguggauuuagauguuuugcuucuuuuucagccuuccuuucgcacccuccaccuacccgaccccugcuaagaugcuaccuuuuaaagaaaagaaauaaguucuucacacuuuucuacauuuauaauucaauauaaauaacugcuacugguauacuuaaucacaauuagauuaaauauguucuuugaaacagggaggucaucuaaugaauagaagugaaauaugucagaaaaugucacauaacugagagugugacaucuuuaguaaauagaauguugagaugauuuuagugcuaggcuaguuuuguaagagacaucuuauuugacaccuuuguucaaacaacuuuugugguucucaaacuagccucuauugaaaagaccaaguucccuacgucuucucuuugaacacuuucuucuuugcauuaaccuguucuugcuagugcguccaaguguggaaagcaaagauuaguuuuaaaucuuccgggucaaaacuguuuuggcuuuuuucuagagcugauaauaaguaguauaguuuucuguguaccauguguaagagaagagaaaaggucugacuuuauguuagauaauccauaauucgguugcucugucccacuauauggagaccaaagucacacuaaauggaugccuuggguaggggagaaggauguagccuuucaaucagacuucuuagcugcacuagucacauggcuagccuggggcagguauuuaaacuugcuauaccuaagucuccucaucuauuaauugacauuaauaucagcaccuucuucauaggguuuguaaggauugaauaauuuaauguauguaagacacuuagaagagugucuuaaauaaugugagcaccuucuucauuaacauuagcacauauuucauaugauuuugugaggauuaaauaauuuaauguauguaagacacuuauaagaguguguuaaauuacagacugugcucaguaaauguugucuaauauuauuuuuaaacugaugguuauuagccaagcuauaccauaucuucaacuuugggugcacaagagugggcaguaucuuugaagaggucguuguuucucaaucugugggucaaguauucuuagggaaacuuuucauuuugguccaacucauaacuuuagugacauuagucuuugcaauuuccugcugagaagagaagguagccuuucuauuuuuuuuaaguuuucaaagccuaauuuuauauuaaaagaaaacaagguauuaaaaccacguauuucuuuuaacuuauuaaaaggaaauaacacaguaacauuaauaaaaaguuacaaaauggcacaguaacauuaauaaaauguuacauugucuuuuuauucuauagcgugaauggaagaaauaaaguaacuuuucuagagcuacaaaguaguuaaugguggcaaagauucacucucuggcaaugugucuuguuucacaaaguaauacaaguucaacacaguauagaauugccuuugauuucaaaugguaacagcauuuauuggauuauuuuuguagauguucaaugccacaaguaaaaugaaguuuucucuuuaaaaggaugauagauguggcagacccaucacugggucccuggacagugguaacaugaugggguuuaaaguccuuuuugaaauagccagguuaaucugcauaaaggcuauggugcuucauuaagcuuuuugaaaacuuucugggguaggccaaguggcuauuuguaucaguuaaacguaaguacaacuacuuaaaauaacauuucuucccacuugugcuugagucugggucuauauuuuuccugauaauaacaggauaaaaugaaucauuugauuccauauuccaagaaaaacguguccauuagguagaggaagcucuuagaaauuaucuccaagaguggcuuguuuuguaccugucauauuuauuauaagguaaagggagauguagacuggugggggugaugguaguaaauugaaaugaguugccagcuguguugcccaggcuggucuugaacuccugggcucaagccaucccaccagagaagguucuuaaaccuuuugcuuuccauugggcaucuuuaucuacauuuuaccucaucaagcucaucaagugaaucagacgcuuugacucagucauaacauguugauggagagucacuuaguuggaaaauauagacaagaagaugggcucugggaagaacugguagguaggcaauggcucugaaaguguggggcccugguuuacaguguaaugacacccaccauuuagugccucagccauuauucaagugugcugugccuuuccuacuggccacguuaaugagaggguggagauagcaaguuccugcugaaauuuucacaggaaagcuaagcccuuaaaugauguuuugaaggaaugguuucucuaccaucuguaaaaaaggcuugauuaauuauuuugguggcagaaacuauaugcugugcuucagguuaaacagcaggaacauauugagguucuugggaagaguuuuccuacagccaucaaauagguguccacacagguuaaccggacugugcaauaagaaugugggacauuggcaugccagugugaagucuggaaaagucggaugugauauaugcaaguggaagagaacugaaacuaugaagagucauuuggaaagccccaguugugaguuugugauaguugagaaauggcaccuccucuuugcauacuuagguuugagcaggaaacaaagaagugacuugaagucauguuaugaaaagaagaauuggguuggaggucagacucuggauucuagaccugauucugaguuaacuaacauuuuagccuaguuucaggcacuccccaguggcccaaugagccaccccuucuugcaggccucaaaaugcacugugauaaaacugcauaguauuuucuuuuccuuauuuucauguucuaagaaauauuauuguccgggcacgguggcuuacaccuguaaucccagcacuuuaggaggccgaggcaggcagaucucuucagcccaagaguucaagaccagccugggcaacauggugagacccugucucuaauaaaaauagaaaaagacaaaacccugguguggugaugcaugccuguggucugagcuacucaggaggcugaagugggaggaucccuugagcccuggggguggagguugcagugagcugagaucccgccgcugcauucaagacugagugacagagugaaacccugucuaaaaaaaaaaaaaaaaaaaaaaggagaagaaaauauaauaaaaauaauacauggauacuuucuuaaaauaucagacacuugagaauguugaguaaaauauaaaaggacuuaaucuggagaucauugccuuaguuauaacauagaaccuuucuacuuaggagaauuucccucucuccuacucccuauuuguaaaaauuuucuuuuguggcuucagucaaguuucauacuuuuaaauguuuuuguuaauuuuauucuuuguguuuuuuuccuaaacuguauuuuuguuccauuaugauuuuuucauugguuagcugagguauaggaaaguugucuuuuuuauugucuguuaaucuuauaacccguaacuccagaacuuucuuacuagccucugguaguuuuuuuuaguuguuuaagauuuuuuaggaagaaaaucauuggcaaauauugggaguguugucucuuaaagugucuuucuguuauauuuuccuugugcuaguacauuggcaaagacuuacaggagaguguuaagagaauaguggaauacaggucagcuucgcauuuuguugacuugagcaaagaaucuucuaguguuucauuauuaaauaaguuuucuguaggcaucuaguagauuaagaaaacuuucuuaugauccaccacuucuuaaaaugaauguguguguucaaacuaaagagauauauguauauaguagaaauauauguguaugcuugugugcauguguguguauaaacuuuaaaucauccucucaaaauuccugaaguaaaagucuauuuuguuguuuuauguggaauuuuauuuuauuuaaauuuuuauauuuauauauuuuauuuaaaauuuucaugaaauggccaagcaggguuuaauauaaaauggaaacaggguuuaucucagaaauuugguggcuaaauuccuuguaucccgucuuaucuagggauguuguuuguuucaagguucuaccuugagaggagccugucauuuucuuuuuugugugcugcuuugccuaguugacaucuuggcuuuaugugcuccuguugaaugcauugggaaauuuucuuucuucuuucuauguccugaaauagcuuauauaagaggggaauuuuugauauuugggggaaauugcaugggacuuuuuuuuuuuuuuuuuuuuuuuuagacagggccucacucuauccucaaaacuggaauggagugcaguggugugaucauggcucacugcagucucuaccaccugaguagcugagacuauaggcacaugccaccaaucccacuaauuuuuguauuuuuuuguggaggcggaguuucgccauguugcucaugcuggucuugaacuccuggacuuagccaucugccugccuuagccucccaaacugcugggauuacaaaugugagccaccgcgccuggcaagacuaguacuucagaacuggauuuuuuacuaauuuuuccauuucuguuucuuuguguuucaauugugauaguuuuuguuauccuagaaaacauccauuuuccagacuuuaaaauuugcuacauaaaauuauacauacuuucucuuguuuuaaaaaacuccuuaucuauuuagcaaauauauuuuguaauuauguugauuucuguuuucucucuucuuguuuuuccuuacacuugccagagguuuguguguuuucuuugguuuuuuuuuucaaguaccuucuuuugguuucauugauaaucuacauuuuguuuuaucuaaauuuaguaaauuuuaaauuuuauuaauucaucauauuuaaauauguugcacuuuuucuagcuuuuuauauuguauguuuuguucauuuaauuuuuauuuuuacaucuugcaauuuaaggccauuauuuuucauugguuacagcuuuggcugcaucccuuagauuuucuuauauacagcuaucacuaucauuuauuuguguauuguuuuaaauguuauuuugcauucuuguguaguucaagaguuacuuaaaacacuguuuucacagucccacuuuaauaaaauguuuuucauguuggcagugcuacuguuuuguuuuuacuauuuaauuuuauugcauucugaguggggaaauggcauggauauuuccuacuuuggggguaaucuaguaggauuuuuaaaaaugcuuaguuuuuuuuaagcauuucauaugcauuugaaaauaaugaauacuauuucccuauuuuauuauuauuauuauuauuuuugagauggagucucacucugucacucagguuggaguguaguggcacgaucucagcucagugcaaccuccggcucccgguuucaagcaaucuucccaccucagccucccaaguagcugggaucacaagcaugugccaccaaccuggcuacauuuuguuuuuuuuaguagagauggaguuucaucauuuuggccagccuggucuugaauuccugaccucaacugaucuucccaccucagccucccaaacugcugggauuacaggcgugagccacugcacccggccuauuuucccuauuuuaauauauuaaaccuuuuauuacuuauuguccuucuaauugauuuaaauuucugagagauauuuguucuagucuucuacuuugauuauggauuuaccaaccgcucaggguauuuauauuuuaaaaaauauaucucaaagcuguaucauaaaugauuagaaguucaggaauauuuuauauuuuugguggacuauagguuucaucaguaugaaauauccaacuuuuuucuuuuuuuacauuuuugccuuagauuggcuuucaauguauaguaauguucucuacaugcuuuauuuuuguagauuuuauauuacauauuuuuuauauauuuuuauuuuucauagucucuguguuuuauuuuugaugguuuguuauacacagcauuuagcuuuacauuuuucuagccuaaugugacagccacuguaacuuaguugaggaauauaauauccaaauaaacauaguuuaauuuucuuuuuuuccuuggcuugaucacauuuccuuuguuuuauauuuuuugcugcuuaaaaaaaggucuuuuuuuuucuaauggugcaggaauuauacaucuuauuucuugugaaaguuauucuugccuuucuaacucacauauuucaaauuauauaucucuauuaaagucuaaaucuguuuggugucuguaucuuuccuaaaaaagaugacggagaguguuagcacauuuuuaauuacugaguuucucccuuuguuccuccccuuuaccucucauguugagguugauauguuuccuuuuugacguuuuaaauugcaucaacagucacauagagucuacuagcguuuccuugccccaucuugcuaauuuuuguggaccauguuguucuggguuuuuuuggguugauuugucauuauacaguuauauauccuuauguaauuuuuuucagaaguguggggguauaaauuuucagagucuuugcauuuucuaaauugccuguaguuagcucaccuuuuugaaggcaaguuuggcuacauauaaaauuugaguuuuaaagucuuguauccccuuuuucugucacauuuuuguucuggcuugccuugcagcucuaaauguagcaccccaauuaaucacccgauuauugcaucacacuccacuccagcuccauguauguauugacccugggauuggagcauccuagauuuagcuguuucuuugcagucuucuugauuggcugcugcuuuuuggcuugugauuuauuuauuuuuccucuguagagcaaauccaucuacuuuuaucuuuaagaauaauucaaaauuguuauuccaccgaagcuacucuuccuuauuuucuggcacuauuuggcauguauaucucuucuaaauucacacacacacauacacacacacccaguaucauuuaugacauaugagguuagaggaaaaguagaagcuuauguuuaaucuaccaucccaagccaaccccuuuauauggaacuuuacacauucuaaaugcuuucaaauacaguaccuuauaaggaaggagaugcuauuauucuccuuuuauaaauuagaaaacugagagguuauaagucauuuuauuuauuuauucuuucauuuauuucuccauuaauccauuggcuaaauuugcaucaucugcuauguauaagcagcccucagugccagagacacaaaaccccagcuuccaggaccucacagcugagaguggaagcaaguggguaacaauagagacuugugacaauaauuucagcauaggguggauuucaguuccaugcauguuugagacacgugcuaggugcagaggaaccuggggagaggcgucucuaugucagacuucccaguggaaguguugaggaguguuucccagcggaaguguugucauugauuaaaauccaugcuguaaauguaggcaugaguugacugcugugcucuugguaucuaguaaaguuccuggucccugguuggcacuuaaaaaaaaauaagugaaugaacaaacaaagcuuccuuggcucucaccgaagcacuccuuuuguacuaacauaugugauagucuccacaggcaugauuucuuuauuucuccaagcaucucuuugaguagguacagugaaugucuccuguccacaaaugaaggggccaaggcuguggggaguuaagugucuugucuaaggaggcuuggaucccagguuccucugacucccgacaggcaagacuccuacuggcccuauggcccccucauccagauuauuuuagccucuuuuuucaaacucuuuccugcccucugaucauguuucuaccaagaccaaguaucacaaacuaaugaagagguauaacuggcugccuccuggaggagguauuaagaagcauacaguggccaaaguggaggaggaauaaaaauaccuccagagaccucaauaauaccaaaauagcuagucacaccauauaugucuaagcuuugauacagccuuucuacaugacauguucauuuggaauuauauuagacauucagguuugaaucagggcaggucacuugaaaugucucaauucaaugcaaaaguuauaagaaaaauaacauuuccccccacacaaguauauagcauaguauaaaacauucucaaaaacuuuguaaaggaaacacauuuuacaguuuaacucauaccuacuucacuuccuucucccucuccuguucucuguucauuauuucccuacuuacuaacuggcucuuaguuaauauuuucguggccucacccccacaccuuuuuaguuggucucuuuuuugugcaaauugauuuuauuccuaucuaaggagaugcuuucauccuuuuuuucaugcuuugaggccucauuagaucacugcacucuaauuuugggggggagaguugucauuugcacuauauguacagucugagcauccuaaaguucuuguucugagaaaaacaucgccauggugagcggcccauuuugaauuaggaggacuggcuaaggugcucacuuaagcucuuuguaguuuuguucagucaauugaguguuucuauguuacaucuaucugucuauaugucugucuaucuaucuaucuaucuaucuaucuaucuaucuaucuaucuaucuaucaucugucuaucuaucuacauaccuaccuaccuaccuauguacugagcccaggcuggagcaguggugcaaucagagcuuaccguccccuugaccucccagacucaagugauccucucaccucagccuccuaaguagcugggaccacaggugugcaccaccauaccuggcuaauuuuuuuucuauuuuauuuucuguagagacugagucuugcugugcugcuuaggcugcuuucaaacuccugggcucaagcgauccuccugccucagccccgcaaagugccgggauuacaggcaugagccauugcgcccggccuucucuuuuuaacguaauauugagauuggggucagacugugcugguuguggguaaagcuauugcagccuuccagcuaugaaggccugcccuccacgaugggauggccaggcugguaccugagacuaguguuggaggcaguggcagcuucccuuugaucuauugcagaaugcauuuucaaacacacacacacacacacacacaaauaaaacucugauguucacuuuuuaauugaaagcuaaaaaugcccagcuccuuucugcagauugacaagcugauauuucagcaguagcuaaagaacccgguuuaguaagcuacugaauuuugacguuuauaaacauuuaaugaauacauuuuuauuuaugucagcuuaaaaaauacagcugcugauaucugcgccccccaacaacuuuuuuugucuuaaugccaaaauuagaauauuuaaauauuuuaaaauuuccugaugagcaccugugcaggugugagggcagcaugaauucacagggagaguguaugaaguugguuaucuugaugugcuuguggggaauguguauuuccuugcaaggacugucaugugcuaccugauccucuuucauggaccucagccacuuucgccucuaacuugaaaaggaaacuggcauuguggcacaggggccaaagggacacauuuguagccuuguccucaaaucaagugggacuucugguucuuucucugaccaucugcuugaccuucagucuggugucuccaaggagugugucucuauggcaguuuaaaaaauucuguuacacugagaaagagacaaaauguaaaucuuaaaggaaucaguagauuuuuaaccccacugcugguguugagaagacaguuugagucuuaaucucuuuccuuaaguuucaaaacauguaggauuuauguuauugacaugucaaacuuuuuguacuuauucauuagggaagguuucaauacacacaaaaauagaguauuauaagaugcgcuacuauguauucauuauccaguuucaacagacgucaccauuuucccagucuuuuguuauauaguauccccuucacuuuauguuccugaaauauuuuaaggcaaagccuugacagcauauuauuucaccuauaaauauuucagaagcaucucuaacaaauaagcccccuccuuuguuuuacauagccauggugccauaucacagcuagcaagacuauuaggaauucuuaauagcauuaagaacugacguuccucaguugucucacaaaugccuuuuuacagcuggcauguuugaaucagaauccaaaccagguucacacguugcauuugauuaucaugacuuugaagucuucuuaaaaucuacaacauggccagucucccucuuuuuaaauauuuaaacuggguccauuuuccuguagaaagcccacauuauggauuuggcuuauugcuucuuuguggugucauacaccauguucaucuguucuccauacuuccuguaagcugauacuugcauuuagggcaagcuugucuaacccauggcccacaggacacaugcggcccaacacaaauuugaaaacuuucuuaaaacacuguguuuuuuguuuuuuuguuuuuuuuaagaagaccaaguuuguuugcaguguaugaaugucuaggugaggcuggguuaauggggagaaugagacuaacauaacaucuauaacucucaugacuuuuuguuauuguuguuguuuguuuuguuuuuggagacagagccucccucugucacccaggcuggagugcaguggcgcaaucucagcucacugcaaccuccgccuccuggguucaagugauucuccugucucagccucccaaguagcugggauuacaggcacgugccaccaugcuaauuuuuguauuuuuaguagagucgggguuucuccauguuggccaggcuggucucgaauuccugaccucaggugacccacccgccuuggccucccacagugcugggauuacaggcaugagccaccgcgcccggcugaaaacacuaugagguuuuuucauggguaaucuuggauauguuauuugcuucauucaagaaguaguauguggccauucauuucucaagaugcuuagauuguucagugaguucaugugcugcccaccagaucucccuaauacagaguuuuacauugucuuucaccuguuuguuuuaggaucuauugaugauuauuucauuggagguugcaaaauagccauaaguaaauugguuuaaugaagcuucuucucccuacuaaaucuuaucuagaguuuaacuaucuauuaaucauucauuuuugcacauuuuuacagcuuuugugggguauuuuacauucuuucuucuguuugaauauagagggugccuugcaaacuucacucauuucacuagaagaggcaacuguuuaaauccuacucuucuaauauauuuccugguucauguuuuccugcacauucauaaaugaggaggacguugauuugucaguuaucuucagugcuuagaauaguugcugaaaugugacaagaauguuuauggaagaaauuaccuuauagguuguacauguccucuaaagacaucauaggcacuccuacauugcauuggugaaggggccaccaaacagcagaauccugcaacuugguugaacuaugaaaauguucuugauacauuauaauuuccucaaccccuuuagccaguauuggccauucaggcaaaggaauagaauuuccaagacuuguacuguauguuugcagaaggagggaggauggcagauagguuuguguguguugggauggagaaaguaugcaaauaagcuaauuaauaucaauuguuuuuauaucuauauuacacauacacacacucgcauacacauaagcacacauaauuaaucacacccaugagcacauguacacagcuggucuacaccagauugcccugacaauuuuagagcugugugcugaaaaauuuuagaggaauuuggcuuugaaugugcaacacguauuacagagcaaagaucaccuuggguccuaagggagaugacuuucaucucuaccaugugaguaaaaccugggugauugaaccauaaauuauuuuggguauauagaacuuucuucaaauaacacuuaaaauuaaauguccagguaagugauuuucaaaucagaacaaccaaaauuguuaauaguuaugaucaugcuuauauacguauggaaauguauauguauauggaaauauggaaauuuguguauaagcaugcucugcaguaaaucaaaaaaugaccauggagcaaacauaugaaaaugcucaccagcaaugaaaaaaaugacccuauggcaaacaauaaaguaaaaugcuacacugucuuccuguagaggaccuacuagguuuggacaaacuggcugugcucaaauacaugugccaaaauugagcaggcugggugcaaauauucuaagggaauugaaagacacuuuuucgugaaauagguuuagguguugacauuaucucuaaaaguaauuaaaagaugauugauguaguaaauuuucuuuuaagccaugccuuuaagcacauuguaggaaaaggacuguuaaacaccacauuuucuuauuuagaacccuuggggccauagguauuucacaauuuaagaaucauuugcauuuuaugaaguuaauaugguguauauaacauguccuguguaacucuccagugaagucugaaacagccgcaauguauauauagauuauuauuucuauagcaaaacauaugaauagauacaccuaguaagacaaaaacaaaaauuauagauacguagauauucucacauuaguucagguuuugucacaaaguacagcuuucaaaccuucuggaauuuuucaauugagggaaagauugugaaccuucaaaugaacaaauaaauaaauaucuaccuuuucugaagaaaaacaaaagccaaauaacaaauaaaucaagaaucacuuuucaugguuuuuaaaccccucaaauaaaugucuuccuucuuucaguucauagaagauuuagaauuauaaaauaaagaaggccuauccacauggucuauauaugucuuauauaucuauaucuauaucuauaucuauaucuauaucuauaucuauaucuauaucuauaucuauaaacaauuuuagaauuagcucgucccacacaaaaauaguuuuuuuguuguuguuguuuuuuguuuugcuuuuuuugggauggaguuuugcucuuguuguccaggcuggagugcaauggcacuaucucagcucagugcaaccucugccuuccgaguucaagcgauucuccugccucacccuccucaguagcuggaauaacaggcgugcaucauuaauuuuuuuauauuuuuaguagagaugggguuucacuauguuggccaggcuggucuugaacuccugaccucaggugguccacucaccuuggccucccaaagugcugggaucauaggcaugagccacugugcccagccaaaacuuuagauuuuuauccuguuugugccucaaagccuauucaguugaaaggcugaugggcucgcucugagguccauuguuggcugggggagagcauuagggagcugacuuuuggcagaugaggaaaacagcaugaucacugcuuuugccacucugcuuuguggaauugacccacucugaaguuguucucacucgacagcaaugcaggcauuuauccagugcuucuacaagaaauaauuugggcaaaagcaguaaggaaguaagccuuaacagaaaagugggacccagcaauaggagaaucuacacaucugcuaagcccagccaucauauauauauguguguguguguguauauauauauauauauacacacacauauauauacacacacacacacacauauauauacacacacacacacacacauauauauauauauauauauauauauauauauauauuuuggagauggagucucacacuguugccuaggcugaagugcaguggcaugaucucggcucacugcaaccuccaccucccgaguucaagcaauucuccucccucagccucuugaguagguggcacuacaggugcaugccaccacaccguuaauuuuuuguauuuuuaguagagacagaguuucaccguauuaggauggucucgaucuccugaccuugugaucugccugccucaguucccaaagugcugggauuagaggcaugagccaccaugcccagcccuuauauauuuuuaaugugcauuaguaaauuauaaauaaugacagucuccauguggaaaaugaaaaucaacuuagcuuauacauuuuuaaaaaucagucaaguggucuugucucauauacauagaccuugaaagauuuguuuucaguacauucuguagaaggcucuugaauaucugauagacuccccuggcagcuuucaccuggugugugcaugcacagauauaaucaccuuagucuuuauccugcaguaaacaaaguucaagagagauuucugaaaugaagauaaucuucauucugccuuuugccgcuaccuaaaguucccuuggaggacucugugaaguuacucagguuauauuuuuuauaacaaauauaaaccacagaauuugccagaaugagaaauauucugaugaacaucaugauuugacugaggauggaggaauuguagggaaugguuaaacuugaagauacuuuuuagaaaaacaggucaugugcuacagaagcuacuuuuaaaaacaugcuuuuucauuaaauguaaauuuaccacauuauuuuauauaucuucauuaauuuaauaaaacuccugcuaggcuuuuguaaauuuucacagauauaauguuaccauaggcaucuaugcacauguauuuuuguacacuuguccaauauuauccauagaguuaaaauuuuuaacuugaaacuucuaagucagaaggcauaugcuuuuaauauucugcaguacauuuuaacuugccuuccagaaaguuuauaccagauuacauucccauuagcuauauaugaaagugaacuuccucacuggcaguugaaaauuugucuuauuuuaauuugccagauagcuugucauauauuuauugccaaauuucaaauucauuccuuuuauaaaggaaugguucauguucuuccccagucuauuuaguuuuauucuuauuacaauguaagagcuuuucauuuauuaggaguaucuucucauuaaauauuuguuaagaaagauuuuuguucaacuuuguaugguuuggauaauguuuucauuuauuuuuauuuauuuauuuauuuauuuagagacagagugucgcucuguuucccaggcuggagugcaguggcaagaucuugguucacugcaaacuucgccucccagguucaggcgauucuucugccucagccucucuaauagcugggauuacaggugugcacuaccacgccugguuaauuuuuguauuuuuaguagagacaugggguuucgccguguuggccaggauggucuucaacuccuaaccucaaaugauccaccugccucggccucccaaagugcugagauuacaggcaugagcuacuacgcccagcuggguaauguuuugaaaaacgaguauguagucugggucccaauauguucuaauuuuucuagcucuaaugucauagcuaacaaaggccaucucuacuuaauugcuuguacuuuauucucaggcuuuuauguuuuaaccuuugcauuuaaacauauuuuaguaugaagugugaagcaaaaacguaaauuuuuccccuuaaaugcuaaacaaacuuuaguuaccauuuauugaauaauuuaucauuuucucauugauuuuuuuuucaaugacagccucgccauaaaucuuucuguaauauuuccugaucuggcagcagccgcacauugcuuuaauuuacuuuguuuaaaauguauauauucucaacuuacaucuuuguaaaaauuuucuuaacuauuaucaugcauuaauauuccagauaagcuuuagaauuugugucuucucuacccuauccauuuuucucucuuuggaauuuguuugaauuugcauuaaagucuccuuuaauuuugagucauccaaucacauuuaugcaaauacuuuccugggaaauauuugugugaaaagauuuucuuuuaaaaauugauauacaagauuauuucggucuuuuagaaguguuuauacugcugaauccuuucaugauuuuuguuaaacuggcuugugaacuaguucagcaagucagugucguaugcugaauaucuaaauauauuuauaaugagaaauauaagaaaacauaauaagaauauuucugucuuacauccguggagagaaaauagaauauuuauaaaugcaaaugcucuacaauuacucuaaggaaacuuaaagaucacaguccuauucuaacucuguaaaguuauuugcuuguuuguuauuuuaacagcaucuuucucauaagcauuuaaggcugguuauaauguuuugugugugaauauugaguaaaccaaaugauuggaggcccguuauuuuuacaaagauuuuauggaauaagcaaguucggaauggauuucgaaaaagagacagucccuguuucaguguggaagggacauuggaguccaaaggucagggucagauacauguuuucuucuuuuuuuuuuuccuuccuuccuuccuuccuuccuuccuuccuuccuuccuucuuuccuuccuuccuuccuuccuuccuuccuuccuuccuuccuuccuuccuuccucuuuuuuuuuuguuuuuguuuuuggagacaaagucucauucuguugcccaggcuggagugcaguggugcgaucauaacucaccgcagccuccaacuccugaacucuugggcucaagugauucucccaccuuggccucugaaaaugcugggauuacaggcaugagccauuacaccuggccauuuucuuuugacuagagcugaaguucugaaacuagcagucauuggagauaagacaggagaagacaguugggaggcuccaagcaugugauuucaggaaaagcaugaguugauuauugagaauuucagaugugagauuuccaggaacagugugaguccagaagauguaagaaagaucaguggaauucacacaguuugguuauucaugcaucuucgaauauuuuucagauaaucucggguggauacuucaguuauuucugccucagcccaccuuauuuguaaagcaguauuaguagaauccccuccuugagggguucuucauauuaaauaaguugcauagccaacagccugaggcauaccaaacacuguauagauauuugcuguuauuuguaugauugcugccuuuuacugaguggcauccugggcuggugcuugggacucaacagugaggacauucccucccacaucugccuguaaugccaaggccuugugauagggaguggccugaagcccgggguagaggaguggaccuccccagcauagcuggggaaggagucucaaggagaugacauuugaccaguccucaugguuguuugcaaguggcuucucugcuguggaaugggaagaaagggucuuccaggaagagggguuagccuuuguaaaagugcagagaaacguuuguaugagcaagagaguaauuagggaaccgugagcaauuccaugugacucugacuauagguaggcugcagggaagggaagagacagaugaggacugucuuccuagugccuagaacaguggcuggcccauaguagguauucggugcaucuuaguggagaaaugugugaaagaggaaagagagggcugggagguagacuacuacuagauuggcuauggguggagcugggggcucagcauuuucaagcucugaaguuuggucuccuugaaggaacaggagcagcucuggauuuuagaaggccaauucuguccacagugcaccaguguucuaggugagguuggaugauggggagagggaagucugaagauagcauccauaaaucucaugacauuucuaucccagcagugcaaucaaauguugagaauauguccuguagcuuucuuuuagaaaagggguuagcaggccaggugugguggcucaggccuguaaucccagcacuuugggaggccagcgcggguggaucacgaggucaagagauugaaaucaucauggccaacauggugaaacccuaucucaacuaaaaauacaaaaauuagcugggcaugguggcaugcaccuguagcccagcuacucgggaggcugaggcaggagagucgcuugaaccugggaguuggagguugcagugagccaagauugcgccacugcacuccagccugguggcagagugagacuucucucaaaaaaaaaaaaaaaaggguggggggcgggcaaauuauggcuuaaggccaaauccaaccaacagcuucuuuuuauaaauaaaauuuuacuggaacacugucugaccuguuuauuuacauauuauguaugguugauuuagcguaacaauggcagaguuggguguuuucaacagagaccacauggccagcaaugacuaaaauauuuucuaucugguccuucaagaaaaauguuuggugaccucaguguuagaagauuguuuuuagguauuuaauggugccauucuggaaaaguuggcauuguuggaagaguucaaauugaugcauguguagccuaagaaaaauggggccauaucacuuccuaugaagaaacacaccaaaauuuuaauucaauucuuaaguuguugucuugauuaucuaaguucugucucuagucuccuauggcuauuuuuguggcuuugacccuagcugacccagccuauugucaguaguuaagaagguagauuccaagugcucaaugucauguuaagacuuccuugcuaccuacuaagggaagucauuuuuuuagccagcuguuuuaaguucuccuaaccuauuucauaugcuauguucccacaauaaccauucccuucucuugccauuucuuuguccucucuccugcaauguuucuucuacugaaagaauacggcacuacugaaucuguuucuccugggcagggcuugcauuaucccaccuguuccaaauucuuuuuagaaccgggcccuuugggugaaugaugaaccauuuaauagccccauguacuauagaaauuuaaccauuuucaaccaaaccugucauagauaagaacaaagguaagccaucaugugucuagaaaaacauacaacugauuuccucacagacauuacaaguucuuacucuucaaauguacuuuaaaggacugagaguguaauuaggaaucagcagaaguuuuguggaaaagaggcauugagccuuuugcauauuaaggaucaaauuuuauguuuuguaugaagcauucaugaggugauguucuuaaaaaccacuccagaggcacaggaggaacgcugaggacaagacugaauauagagauggaggaauuacgugucuacuggguagagauggagaaggcauauuuauacuagggaugguugaaaucaugcaagcaucuuccauagcuaauaaauuauuuuauccaguuggccuuuacugagggcauacuguguaccggggcccacccuguuggaugccaggaauacaaagaugaucagaguucacuuucugcgcuugaggaucccacagauuagaaaggaggaaaaagaguuacuuuccauacaaggcuauaaauguuacaacaguugaauuuuucagaugaaguggaaggaaacgucuagaaggaagaggacugaaaugaaagaagacugggggaaaagaaauaauaauaaacaaaaagaaaaauaauuugaaacuuuuuagagaagaugauugaccccauuguggagaucaagauuaaagaugaauggcaggcagcuguggagagcagagguggagauauugggaggaucagacuaaagaacugaaauuucaguuguccaagcgggcaugcuguucuacagccucacaugucuugggccuauuagaaauauauauaaucuaucuaugcaugacuuauauaccauacaucacaucauuucuuccaaacuuacauuauaauauaacacauucuguauuaguauauaguaagauuuuaaaauguacaacauauuuaaauauacuccuuacaauuaagccucaguaagugcuaggaacuuugcuaagcacuuuguauuaucuaacugaauucuuaccauggguaggcacucuuauacaacauuucccaggcaaggaguuuugcccaccaagguuagacagauuguccaggauuauccaggggguaaguggcacucacaccagggcuugucugacccuacuuaauuagaugggcuccuaugaaguaaauuuuaggauaagcucuugacuuaaaaaugagccuucuaaugguugugggagagggagaaaaaacaaguuuacagaagauagcgggugaguguggagcagagaacuagcauaggcuuugaagucaagccuaacugaauucccagcuuggcuccacugcuugccagccacauggcauuggucaggucacauaaccacucugaauguccccaucuguacauugggguuuguagcaucugccuuguuagcauguaaaggaucugcaccugugccuggcacuuagcagacacugugacuuguagcugcugcugcuccugcuauaccuaccguccuugccacucuucuuauauucacauccacccauccuccuccucauacuacuauuacuaccuaugcuaauacuauggugguuaugaugagcagcaguaguaguuggaaugccucaaagauaagauuuaugcuaaaaaacagaagcacaguaguuauuuaagaccucgauuugaucaauagcauuaguucugcauuuacuucaauauuuagugagcaugugccauggcaggucucugcgccaggcacuguagaaaguuaaaacaugaagaagucauuuccucuuuuagcugccauauccucuaguuugaccuuuacgccauauacucuuggucagauauucaagaaagaaucuugggagggaaagaguuagugcucaucgagugcagacuggcuugaagcugugcauagcuuuggaaggaaugucaggacuuaaauaauuucaggaugaguugaagauuacauugagcauuuacuacuucuccagauaaucucaauuuccgcccaucaugugauggaggugucaccuuauuuacagguucagauuguuagcgggacacuuuguuauagugauaucuuacagaguuggccauuaggcuauaauugagccuuuauguggggugcuggguaggccacaugacccugguuccuguuuccagggaggccaaccuacauaaaaauggcugucauauaucguugcucagaggggcagauauuuacaacaaccuugaaauggaacuuccacccaauaugaugaagacugacuugugacaguuugauaugccuuuauuuugcuaaaauagcaaccuggccaaauauauuuuucagcacauuuauuauagcuacuuguuuauauuuauagcaaaaguguugcuaauucccuaguauguuaacaggucauauucaaauuguucuauuuuuacuuuggcacaaaauugcugaaggaaacauuuuuaaggcaaguagugauuauagcauaucaacucacuacauagugaauuauauauuaaaugaacuuccugaacugagaaggagcuuaaacugacaaagaagauaguuuucuuaaauucuguauuguuuacauaagauuucuucaaauccauuuuuuauuauagguuacugauugucucaauguuuucuuuuugcuaaauuucuaccuucccgccaacaaauauaaucccccuuuuaauauauaauagaugaccugggauuccagaauggauuuucagaaaccaucaaaaaaccuccucgcuuuaguguauacaauaaauaauauauucuuuuuuaaaaauaugagagucaaauagguauaugcguaaaccuggccaacccuugggcaguuguaauuuccauaccaaaaugcaugagucuuuacuugacuguuacucuguuauacauuaaguacuaguuaccauggcaaccuuugcaucacauuaugacauuuaaauauaaggugguguguuuccuuauaaggaaagacaauguauuugaauuuuugaguguuuggugaaauacaaucacuacuaaaauaaauaauuuuguuuaaggcaauugauuucuuugggaauuacguacauuuccaaccaaaccuauggagugcauucauuuauuuuuauuuuuuugugaugucauggagaaguaaaagauuuuuuuuaaaacaacgcuugauaaguauaacauaauaauucauuaaaugccuauaauuacccucguaaguggcaaaacacaaaauugaaccauauuugagguuauuuaucagugaccaauacuguagcaagaguucgaauguaacaucacaagauuuaugaaauucuaucgcauauaacacauuucuuauuuuuguauaucuaguugguuaacuguaacuaguuuugaucuuaccuauaguugaauuaacaguagcaguuugcucaugcgugcaaaagcaaaauuaaaggagccacugaacucauccuuguggcauuuccaggaacauggccacuuaaauuuaauuaugaagauuguugggcaauuucuuuauuaaauauggaaaaaaccuagucauuucuuguugccaguguagcucuaggccauaaggcuaucaucuuuguuauguagacucccauauauaacucauuuuuaacuuuuuauaguaacuuuuccaaauuauuaucacagcuuguacuuuuuaaucugaaaauagagaaucuaaugaucacucauaacuuuuggugcaucuuuucaauaauaaucaguggauuguaauaugggacuguuuugugugggacauaagaaagagguaagcucugugcuggacccuggcucugcggaacauuuuacauauguuguuucaucuauuccugauaacccuaugauagagcucuuauuagucccuuuuuacacgggaagaaaguaugguuuagagcaguugcauaacucacccccaaauacauugucuguauuucuuugagcuaagguucaaccagauuggucugaccuuaaagcccucccucuuuccuuaauagauuugacuucuacuucugacuuguuacagacacaaugugcaugauauguuuaauguagaaauaaaaaacacugacaaaaaaccuuuaaaaauguuugcuaaauaauaauuucaguaauuuguauuucucugcagcacagcaguuuuuuaagucccugauuugcaagauaucuuggucuuuguaaguuacccaaguccucuuuuguugaaaccaagcauaggacagaaauaaaaauaaauuauaaagguguacucuuggaccuucaggaaucaggaaagaagacuguccaaagacugaccuucaauuuugagcuuugaaguucaaaaguggacagguggaaauacuguguucuucauugcccuuuggugcgagauauauucuagguugcagaguaagugccaacagcagcaaaauuaucgccccccuccugcuacuguaguaagucagcaauggcccuucuguggucagaauggcacauucagcagcaacuauucgacagggauuuacagaaacuuccccauggcuguuaggaaucuuauucagcagugucuuugaaaacccgauucugugcagaauuagcuauguagaaaugaccuagguugugauaaaagguauuuuaaacaaaucuaacuuguaauuucacucaauguguauuuugcauuuaaugccacaaagucugguagauaccuacacauauauuuugcauucauaaguuuuauagugguucagaauuuuuuuccauauuaacauuuuaaaaaauccuggcuuuauagagucaguucaccauacaaagccacuauacaucacuuagguuugugaugaaagaauggaauugcagcugugugaguacuagaauacccaaacaugaauuagacucacaagcauuuggcaauaguucagaaaaagagcuuaaucugguuucaucugagacugcuuuucucuguucugcaacauccccccaagauguugugucugauaccggaucacaacguaaugggagugacgcagaaucgagaaagcccugagaaaccaggggcacauuugcuuuucuccagagauuuucuuucuccuacuucuuuuuuccccucuuccaguuuccaacucugaaauucaaggucauucaccuauuagaugcauuaauuauaagccaaaaaagcaguauucaucguacucugaucucagucauaucuauaauuaaguguaaauauaaucuuccuuuuuagaaauguaccacccacccauuacauuuaaagugcugacugaaaugaaauaauaguucagagcaagaugauuuuaguuuaacuagaaaaaaguugauaauuuaagcuucaagcagugaguucuauuuuugauuaccauucaguuauaaaucuaauuugagauauaugcugcuuuucuguuacucaaguuuaauucaugguuugcuuucuugguuguauaagcaaaguucagugguugaucaaggcuguuaagaagcuccccugaaaaggaaugggggcaggguugagaauguguucgaaagacauucugagaccuauaucugauguaaaacaaacaaauccgauguaaaacaaacaacaaaauuuuaauugaaaaagacacucacagagugcuguauuuggggauuugaauggccaaguuaggaauggccauuugcaggggaauuggcugcagagggugaaccccaaaacauuccaaccugguugauaaagucaguguguuuuauucuuugguuacaguauuuuaggucuuuugggaaaaaaaauuaggagcgaguaaggggaagggcuugucucaucacacuguggacaguuaagcaaaaugcuaaacuauggguuuaagauuuacagguuagcucugccagaugccacaucugccuccaguguuuccuggcagauucgggcagccuacuacugggacccagcauaaccgcagaacaugagcuugcacaaugugaaaaaccuaaaaccauuauaauccuauuuaaggccaggaugaauuugcccauuuugaaaguagauguaguuuucaagcuuaacuuuuauuaagcagaaacuugucuucagagcuauaucuauauaugcagguaaauucauaauauaaacaaauaccuuauccauuuugugcaaaauuuaauuuacuuuaaaucaaacgccauucacuuuuuaaaauucauaaacucagguuuuucagccaguggaaaauuuaucuuucucauugcuacagagaguuaaguaucugacguaaaggccagacaauaguaaauggucauuguucgcuuuauaaguauacucuacaauaagaacacauauauuuuuaucuucauuuucccuaaggagguguuuagggcccccuuaaaugugaggaaauguuuauuuuuguugcuuuagaagaaugauucuauuguccaagugagaaagaaauaggaacaaacaggucuaaggagaaagaaacaggaaugugcuuugugaaaaaaauaaagauuaacaggaaccacuaaagguuuguaagugcuaucugguccuagugcuauguuacugcacauaguccuugcgccugcauauguaagaguuggaugcgugauuuauuaugacuggcccaugaaauuauuuucuuuuaaguuaacaacaauaaggucaaccacagccuguagcuguuuuguaguuauuuuauauuuuucacagcucuauugugaaugcugcuaaaagacaguauagcaaguguguguuuuuagguugaccccuugaaugcauuuaauuucuugagagugaaaaccuuugccaccaggaccaagaggaauuaaccaaugguuaaacucauuuaaaaacacaagcaagcauuucaacauauuugcuuagccguuuucugaauauuuaauauacuucuagagaaagaaaaaugaagaaauaggggugauuugugucuagaauacaaaguuauuuucaaacuccucuuuccaaugaaaugaagacucauucguagauuuaccaaacuguaaggagguugugauuucaaaucauucacagcuuuauugauggaaauuucaaagaaaacuuggacacagacuucacuguaacuuucuuuguuaauaagaaaugcgaagagugaaauuuagguugagauucaaaaacuuuugaaugccacuccuaaaugauaaauuauuuguuacuagauuucugauuuaugcaaaacuuuauuauaauaagccuuauguuuuaguuugucauuguguaguguuuuaauaugucucauaaguucaaaagaggcaauaguugagcaugcagaugucagauuuuuaucugauaaaucugguuuuaucagguauuuaugugguaaacauuaagauacuagcaaugaguuuauuacucaaaaugugcuuucaaucugaaaucucauccuugaaguuguauuuugaaguaauguuuauuacauaucucuugaaaaagucuuaaacuggaaucaguaaaggcgagcuugucaguagcugauuaguccuuuauauaugacucauccaacacucagaaaaaccccuuggaauagagagguucucuuuaugauauuuagcuauauggcgguggaaaggggagguuugaauuuuugauuuuccagcuuaugggucauauuugaccaacugcuuucacuagaagacaugccacuuuguugagcuauuuaggaaucaaaaagacugucuuaauuuaaaacaaggacccuuuguuuuaguuggugacugccuugugaaauuuuucaguucucagcggguuaaccagggaacaggggcagagucauaauuggccuauuuagaguauuuugcaugugaauaguguguuagugaagcaucccuaagucuguugugagugacauggugauuagaauuuagauuagggaaaacacauucuguacuuuaucaaggacaguaauuaguucagucaguaaaaguugauuacaaguaacgauaaaguuagauuuuuaguacuuaauuuuaaaauuucuuuauuaaauaguaaauuuguucuuaauauaaaugguacuaucuacucuuguuuuauugcauaucagaauaauuaaaagaacaauguguucaaugcagaguauaaucaagcgauuuauauauuauggguaaguuucuauguaguuuuuagaaaauguaauauuauauaaucuuucugaugucaucauuuuuagaaguuuaauaauugucacacugugauagguuauuguggaaguuuucuaguguucagguaaauguuuaaucugugggaugugucuuagcuuccgauagaccucaagagggcauucugaaguccuuuguggcuguuagcuuggaauaucugcuauuucuguaauuuugagaguuagugugaggauuugaauuuccucuugguucaguuggcauuuucucuucugugggugcuaugucaguucguggagaaucaugauaugcgguacagagaggcaggguucucagucgaguucauaggcuacacuuacccccaguguaugcagccaggggaaguugugugcguucacaaaaugagguucuucuuguuaaggaaggggaugaauaguucccagauaugagccucagucuagagaaaggaaacauuagucuuauauaaaugccauuuguuuugugaaaugaaaacgugagucaucuuaaaagacuuaaaaaaauauuguuuaaagggaaucaucuacuuuccuccuaaaaguaaagaauuaaaaauucacaaacuuugugauagcuucuuagacugccuuucuuuuggguuuuuguuuuguuuuaauugucucagcuuagcagaugcuguuugcuuuauugcauugguuuaaguacuaacaaucaguugggagguggugaaaguaaaaaauuaaccuuauauguuuguuuucccuuuuuaaccuuuuagcagagucuccuuggaggugacauggauaugggcaacccaggaacccuuucgcccaccaaaccugguucccaguacuaucaguauucuagcaauaauccccgaaggaggccucuucacaguagugccauggguaagguauuccuuuguuugaaugccugagggaugauuaugccuuuuucuuuuuuucuuucuuucuuuaaaauaucgcccccccauccuaccucccaccccaagaaaaccauaaaauuuggcucaguugucagccuggagacuuccccccuaguacacugaguagguacguuaacagcuuaugguagcagaacuuuuuuggugucugcuuaugucuaguuuucucuuagcugcacccauaaggaagcuauuaaaagaucaaaguagcaaaaaguuaaauaucuucauuuuuaugaacaaagcagaauuugauuucugcuagaaucgaaugugaucgugguaacuacaguuugcuaagguaaugauuuaaggaaaugugguaucaucuagaagucuuugugguuuaaccuaucuuaguuaggaaaaugggcauuugggagcugaaagcaucuucauuuucuuucagagguacagacaaagaaaguucgaaaaguuccuccagguuugccaucuucaguaaguacugcuuguuucugcuuuguauauugcuuauuuuguucuguuuuguauugaugggaaggagauagaaguaaaugaguuuccaugcgcccagagcagcacguuuaucuagaagguggaugagguagaaaugaccugcacauccagccaccugacccacauuggagugauuaauugcacauccuggaagacugggugguuauguugauauucagcagguuaagcucuaaagagagccuugaaaaggugccugaaguuugaggaguuuuaccuguacagggcuugcaagagaaugaguauuaguuucauguguugguuaaauucuuugucaguauuaugaugauuuauggauuugcaugcgaaaggagauuuguggagaggauuuaggaaaaauuuacauggguuucagcccagagugcaggaagaaugucucuauuuucuggagagguugcugaauaaaggcugcaaagguagcugcaucaguagccauuugugucuuuacuaccaggugacaacuagaaguagucagcuguaaccaagagcauucugggucuuuuuaacagcuggagcucuaugcagaaguugcugauaucccccacccacccccaggucccuaguacagcaaaaguugguugugaucacaacucaauacaugauaucauauuuugaauucuuacguuccuagauaauuguauuuaauuuuauuuaggacuaguccauuucuaguaauuuucuccucauauaaaaugaaaacauaguuuccucucuucuuucuuuguuucuuuauccuuccuccuuuuuuucauucuuccuugcugugauauaaaguuuugauuuaauucuguagaguacuaguauucuuugaaaagaaugcugagacuuauuguuuuuauacuuuaauauaaaaucauauuuagauuucuuaaaguauauuaccaaucaaugcuugcauauuaguuucauuucauuuuuaauguauuagaagaauaauaggucuugcaaaugugcuaagauuagauuaacccaaacaccuguguauuugacuugauuucaguucagcucauccaaacaauuauuaaaugaauauaucagaauaagucuuaucaggaaaaagaguaaauuuuguaugcugauuaucauagaguuggugauguugaagaagcaucacaaaauuauucauaaauauagaaaaauauuguguaaauaagauugccaaugguguauagucacuuucaacuagcaauaagucacuuaaaauuguacucaguuguuuauuguuugaauuucuguguuguauugaaauugacuaauaugcccaaaggauuuuauaagcauauuuuaagcuugaaguuagggguggauuuaauguugaugaaacuuuagcuuuuaauagguuuuaugacaacuucaaaugauacaguccuaacagcuguuuacauuuuaaacaugccugaacuuaauauggacaauauuaaaugcauuugguggaccuuugaauguucugaaacaauggaauaacuguccuauaaaagccauaaaaaacuuaaagcuaucauacccuccuuaugcuucauauucaaauuaacuuguuuuauccaaugcuaagauuaggcagaaaucuagacaauuucuaaggagugcauugguguggcauuggaugguauguaucugcuuaaucacugucaacaacaauuuucauaauucguuguaaauguuuaaguauuucccuauagcuaacuggccccuuuagaaaauuuuacugguacaguguuuucuuugcuguuaagacaauuuagguguugcugcuaugucgugauacauucagaaauauaaaaauaauuuuccuuucuuucccaauaaacaaaacuugggaauuaggaauuuaguuuuauucuauuuaauuuucuguuuuuaguggucaguuuaggauuuacucuucuuagaagauuuaucuugacuaaauguuuucaugguccuuaugaaacauuuugaugaauagccuuuuuucugaaauauaaggaggaagaaaauacaauucaaaaugaaauuuuuauugcaauuuuuugagcaagaagaacaaguuuagguaauuuuauaauuuaaucauccauuuacucauuaccuaaaaaaaucccagcucuauuuucauagcaauuuaacuuaguuuauguaagcuuuguuguaaauaucaauugcuuauuacuuacaacaagauccacauggcuuaccaccacacaaaauauuuauuuuaacuugauuccaaaaaaggucugcaguagacauggucacacuuuucuaguagcagaucuguauuucuauauuuuuagaccucugccaugcuuuuuuuaaagcucaaauaaaauuaugacuauuugauaagagauacuucuuaaauuguuucaguauguaugaguauuuguauaacagauacuaaaagauuggagauaauaaaagguuuccuuuggagugauuaugacuacauaagacacuuauauguuuucuuugauacauauuuaccaugacaaauaguaauaaaucugucacaaucuguuguggcaacucacuuuaccccccauuuugaagugggcccucucuuucccuuauaauaaaaggaagaaaacuuaaacggugacacugcaucaucagguauuauuugugacacgccugugguacagagacuggacuucugccgccauuaggcugggucuuccucccaggcaaucaggagagagaggggauugccuagcccuguuuugaaaacacugcagcaucugugggagagagaaaacguaggccuggccagacaucaugccauggaucuggcaggauccacgaauguguguuuguacugugugcugcaccuagagaccucacgucacuguggaaguaugacacgauggugggauaacagaagacccaccaggcagggucuacaggacaagcacagcgugucggggggaagccugucccucuagugcacauagaccaguacuugcuaaggugauuuuuuuuuuaaaggaaagccugugugaaagacagcuaucuaauugcccacgagagcucugcuuauuacugcaguacauuuuuaucuucucgguucguauuuuaguauguugcucuuuuuagucacgucccaauuucucguagcccucguuuuuugcgaagaccuuaguaauaaaguguugucuuuuguugaugucagaauuuauuuugcaugucuaagcucuugaaucuacaugagaacaucuuguuuugcuagauuucuacauuuugguuuuccauuucaaaccauauuucaucuuaaacucaauauuuugcaacuuuacugcucauuucaacaaauuuguuuuauauaaccuaauaaucauacacauugaaucaugaauucauacacagaaaaauguacuauaguaaauuaaaguuggaaaaaaaugauuuaugauucuuaacagaaauuaacaugaaaguacuaaaaucuagaaaguagcaaaaaauuuuauauugugcuguuuuaagauacuuucaucaaacacagaaacaaagcaaaggcauuaucuuuuggaaacuuuauucugcccaucaacauguaaacauguaaaacuuuuaucuuagaauuugaaauauuucaaaauuauauacguuuuaucagaaacuguuaacaacuacaaacuuucuacuucagacuuugguggaauuugucuccacuuguaauccgauuugcaucuuuaaugauggucucaccaugaccccaguuggaaucucuugaacaucagauuuuucuggaaauaggauauuuuauccuuagaaauaguuuaugaccucucaucuccagugaucuuuccuaaagcuguacuucucaguaaagucuuuuuucuacguuaaaguacagagggguuuugugugucuguuuuguuuuaaaacucaggaggaccuggcaaacuuuaaguggucagagauaauuugggacacauggaucccaagauaaacaauuucuacuacuauaaagauucuaaaauaagguuuggacgcuucaagaauauuugugacauuaguuaaucaguagguagguuugaaaaauaaaaacaauguguauuagauauuagguucaccaauuuucauaaggaaagaauucuuaaauaaaaugaaauauuuaaguauggauuagaguuuccuuuacagaagcaauuauuagggguaucaagaaaaaugaguaaugcuaauggccuuaaauguccuauguauuuuguguuauauaaaaacuuuccuauuugaagauuucaaacaugauguugaauccauaucuugagcuauuuagggaaaaccccuuuuaucccaggugcuugaagaaaucacaaacaauuuaaaagagauauugguaaacuguuuuuuccuuauuagugggcuggaaauuauguaugauuuaaaaaaucaguacugaacucagaaauauauaauuuccuacaucacuuuugaaauugaucauagggaaaucagaacgaugcuuuuucaugucaacaaauuuuaacaaguaauaauacaauuuucuuuaagaugaaaguuuuauugaaauaugauaucgaucacaagugaacgaaauaucagccaucugggcucuauccuuuuuaggaaagucuggaaguagccgauugugugguaagacguaaaaggaggaaacucuucaagguucaucccugcagggauagauacuuugugaagaaguauaauuguuaaguguuuaaaauauuaagauagcucucaguauucacuuuuaaacuuagugugcccauuuucuaauuaaagauauuggaauaugagguuuggauauuaaaauugugcuuauuaauguuuaggcaagaaggagguuaagaguggcacaauuaagucaucucaaauaggacaaaacuauucacacaauuuacacggcauauauaacaugacaauggggaacagugaaagcugagaaaauauucaugacagagaaaguauuuuugugugugugcaguuaaugcugaauuugcuaaaccagacuucuaguucagcaugugcguuuuuuuuuuuuugugaaaaccaaucuuaucuucucuauuacacauugagacuauagaguuuaugauuuuuaugaauugcugauauaugaaaaaauauaggagaaucuuuauauuuguuuugauuggaggcuuuuguuccauuaaaaauuuuucagaaagcacacaagaggcuugcacauacucaacauacauacuauuaggcauucuaauaucccagaaguuugcucaaggauuucugaauuuuuguuuggaauuuuggaauaaugagcuccuucauccacuauccuccucuucucugccuugaagcccaauccugcacccuuuaagaaagaaggcuucuggugugcauauuuuagauagaaagagagaagaaauauaaaggaaaagacaagcaugaagguuaacuguggaugaaagguuuguguauuuuugagcuauuccugcuuuaucuuuacaaacaaaaagguuguaugccccaaacacucaaacaaaacaccaccaguucauuccuucccccagaaagaagccuuccuggccagcagcaccccauuuuucuacucagugaucucuucuaaggaguggugccugauguaucuuccuacucuccaauguguuuuuauuuuuaaucaaguauucaaaauaguauuuugcaugcuaagauuuaucaggacuuucguuaagauguuagcagcugcuaacauaaacaauaauagcauuuaguguaaaacuggacuuguugagaaaagagaaauacauuucugggaacugcuauuuugaacuuuaucauuuucacugaagaguauauuuuggugugaaguuuuggacucgagagugguuuaaauuacugagaaguguaggaaaccacugcagggcugcuuuacccagagagaauuauaacagggcuugcauguauuuugaaaauaaaaccuuuuucuauggcauccagcuuaacugugaauuuauauuuacgaaauaauguagauaaaugccuugauaauuugauugaauaccauuuuuuaacuuuuaaaauuuaauugauugaaauaguuuuauuugcuaacauagcaaaauguucuccuuuuuuccagaucacugacaauuucugcauuuucuauguuuucuugguuuugaauaauucuaaagguuuucauugaaaguaaugaaucaggaauuggagggcuaaauaagauucucuuagaagauguggcaguaauccuaaaagaauaaggagucucuucaagaauugucaaaguuguauuuucuuaaggcagaauccauacuugucaggcuguugacagacacuugcuuugucuuggcuuuuguuugauuuuuuacauaacugcacuggauuauuaaacugaacauaaaauugcaccucaaagcaauagcacaggauuuucagccuugaucaauuucuacuauccccggaugugugugugcacgcgugugugugugcacccauguguaugagugugcuucuuuuaaaggaauaggagcuuuuauacaauguggugcaaaacuuauaguuuuaaauacuuaauuauuuuaucuggaaacagcagcaugugagugauucuuuuuuaaguugcagcugcugcauagguguagagcuauuugaggaguuugaugcuuuacuugagcauauacucccucuucagagaaguuaagguagugcagaaguuucugcauuuuguaaaauuucaggguugaaaauaaagaugcuuuaugauuuggugagauggauagauuucacuucugaaagaaugugcaaguuguauuuugaaaggaacauuuuaagaauucuacuuaagugguuuagugacacccacucuugucucuugucugacuuugucaucugaggaauuaaucauaaauaagccacuagggaugaaacuugauauauaagugcuuacuuccagaguaauaagaagaggaacuguguguguguuaaauuucacuaaauuuauuuugauuauuccguagagcaggaaauaggaacauuucguagugaagcucucuucauagcaaacuguaaagaaaauuucucaguguguugccauauguuggcagugauuaaagggcauuuccuuugugaaacauggagccauauuagaaagacuuauauuuucucauaaaaaugaccuuugcaaguacauuuaaucaugaaaacuggugucauucgucacauacacauacaaaaagugucacuguuaccauuagggauuuuaggaaaaugcuacuuuggaacaauuauuuugauggcaucugagaaagaauaccuaagugucuacaggagccuccucccuccauggcccauaucauucuaaauaugccuccugaauuacgcuuauaauaauauuguaaugucuuucauucuaccgauuggcacaguauaucauuauaucauuagcugcuaugagaaagcaguuucaaguagguggcagauucuuagcauuaauguuuucaaguaacccuguuuggagaauuggguuguuucacaggugcucagguacauuaacacaguacaauaauauuuucuggcuugcuuuuuaugaaacgaacuugaaguacaaaauaauuuaauaacaaguggaguauaaaaacuggagcucuagcuuaagaaaguuuaauaacucaagacguuaaaggauaagaaaaaaauugucuaaggaggcagcaguguuuagcucauuuugcguuacuacuaaagcugaaauuuauuaggagaauguuuauggccugauuauuuagacuuguugaguuaguuuaaauuuuuuaaacgauuuggucaaguagaaaagcacaguucuguaucuauuguacuauuugaaaguauuguuacauaaaauaaauucgaaauucugccauuuaauacucaggcauaugauucaggagugaaauugcauugccagaaccuuggggucccucauguaucuuaauaugaauuuuauuuuuagagguguauaagacauuggcacauauaaucuguggcuuaauugauaacagcaaagaaaauggaauuaaaaauauuuauuauuaacagauacaguugggauuacaaaauucaaacugcagucaguaauuauuuuacaaauaaaugcuauuucauuuucccuuuaguaaauauaucaguaacuucacccaauauugauguaagugaaacccgacaguaacaagcugggagugcccagguagaaggggaaaaaagcauguucauuuauucauucauuccuuucuccguuuauacuuauucaaagaguauuuuucauugcagcuaaaaacuagacacaccauguaacauggaacaugucuuuuucuucuauguauucuuauuuaaaucguggagcuuuucaacugagauucuucacguuuaaugaaauuugcagucuugugucacuugcgucacaauuuguaggaauaaccuuagcauuuuaaagaguauaccguguagccuuuugagaaagucaugcauuugaaaaauaaaauaacccacaaaguguaacacauggacuuuugucccuuaagcugauugcccuuacucacuugucaccaccuuuacgagagugagggauauguuuuagauacauuuuuuuuuguccuauagaaaccagacucacugcuuuacuuaugcguauuacucugaaauauauuuccagugaaugaauauaguaguaaaagugguguagcaagguagaaaaaacacugcacuagacauaaaaagaccuuucaaguauaacgucugacagccucuacuuacacacccaguggccuugguuaggucacaaaccugcuucucugucuacaaagcagguauaaaauagugccugcauaauaagguggugucaauauacugauaacaaaccuuuaucaaaguacuuauuccaugccagaguacuuauuccauguucuaagugguacacuauuacaucauuugcaucuauugaaucauuuauuccuauaaaaauccugugagauggguacuacuguuuauucaagagacuuaaaaaugagacacagagaggugaagaaacaugucugcggucacacauaguaaguggcagagcugggagugagaccugggcagccugucucuaaaguuucuguguucuuaaccauagugcugucuaugcugccuagcguuucagacacucuguagaccaaaaagcucucuacagcaagguugucauuaaguuagcaaguauuugacuaucuacaauaaauuaauauucagaaauuucauuucacuguagagugaucaucaguaucucuguauagucauguccuauaacuuuugcccaagcaaaucaguaugccaggcaguccaggggagcaucuguguaaacaaagacaguauaauauagugguuagaguaugaaaucugaucaacuggguuuuuagggggcuaugucacuuccuagcuacacaguuauuuguaaaauaaguacucauugggguuugaaugcauuuauguaauauccuugaauguuacauacuauuguuacacauaauaaaaagcacugucaugcuauuaucaguaacaagguaacuaccuuucauuuggcauuugagaaacaaaucuaacauggcagccuacuuaggaguaguuagcaguagaauagaaacuaagaccagggucucagcuauguucaaaagaauuuuaccuaacagaggucacuugcuuuuucugaaauuauguaauauugcuuuuuuuuuuuuuuuuuuuugagauggggucuugcucugucaccuagguuggaguacaguggugcaaucauaguucacugcagucucaaacucccaggcucaagcgguccucccaccucaggcuccugaguagcuggguacacagguucacaaccaccacaccuggcuaauuuuuuucuuuuuuuuugguagagacagggucucccuguguuucccaggcucugcaaacccaucucuaucaaaccaagacacguagucagcccuuuuaaucauuagaccuaguggucugcaaaguuuguguuggaaauacuuuaucuucucucuuuugaacugguacaucggcugugaugcccggagcugcuuauacugugguucccuuggccaauaauuuguuuaugccuaaaucagccuugccucuaagugauaaggagauacgugcuuuuucuuuuguuuugugucagugguauucucuaauaggccgggaacgggucugcccaagugaugcacagccccuugguggggcuggcuauagauccccccgcaaaacugaagguuaggccuaagauauuagcuuugccuggcaagaugaagauguguggacuagguagaccuguguggcagucuguuucuuuuauaaaguaaacagaguucaguuuguuuaggacugcuuagguagauuucuuacacugagcaggaauauuuguacagauguuuuaagguaaagucaaagaauggcuagauuguagccuuugacgcauuauaauguaucuuuucucagugccccuguugaauucacaaaagaaaagguauuuuugaucaucggcuaugagaaacuuaaaacacuuuuuuuuauauauaaaggcugauuuaguuaacucuucuugcauuuaaagaaaaaaacaucugcugaaaguagggaggggggaggugugagcggaagcguggucuccacauuccacaaugaaugucuuuucccagccaauuuuaauuugcagaaaaaccaggcacugaguuagauuccucgggaaaagucccuguuggcugaugagcccugaacuucuuccguguacacccugaacagggacugaugcuucaguucacagagauaauuuuucucuggaaagccgauagauccgauuuagccaccccucauuuguagucauugccaccuuguggauuacaaaggauauugguuuucaucaaacuuccauuucgauuuggcuuuuuauggcaaguacacguuggcaguggauugccguguuccucaccaaaaggauccugguuuguucagcaacaccucacuucuccacucacaguucauuuaugauucugaugagaguguuuuuucaggaaacacacauuucacuuuuugaccuaggagcaucuguuagaauuuuuuuuuaauacuacuuuggcauucugaaaguguuaaugucuuucauaucuguuuaaugcuauuuagggauauuuaugaucaccucuugguuacucaggguaaagugugucgcaauuuuuuuuaaacagacaggaaagcauucacaugaggaaacagauugcuuuaaacaugugcuuccugugacaguaaaaagaacaaauuagauuuaacacuguguaaugaaugcauaaauguguacauuuaagcuuuuaaaagcuuuauguucaguucuggucacaacaaaaauugagucaccuguaaaaauuaaagaugcccaggguacucucagacuuuugaaaugcccagcaauugcaguccucaccugacgaugccucguuggaauuauaaaaagcaugaucuauuagugcuggagagaacuagaacauuacaaggcacauucagagguuaaaccagguuacagucagauuccguacauuuagcaaauaaaucagaauuuguugugggggggagaauacuucacucucaucuuccucccuaagaaucaaugaaaaaaucaauuuucgggaaccccauauauuccucugucuuucaugaaagaaaaagaaggaaaccugauguuuacuuacuagcauuuacuacaauuuaauuauauaagaaaaugacucuuuuucuuauguaauucaguuuguguuuuguaugcuggcagggagugaauagaaucugaguuaauauuuccaguuagacuagaguguggaauuggagggccugaauccucuccccggaagaagaggcacucauggccauuucugucugagccugcggauagugccucuccguccccugugcuuucaaagcuaaggauuuguggcacgcuugccaucucucuggccaaggagggccaggagagagucccucgggggagggcacauaguuugaggacaucugacucucuucuaucacauacugagguacuaauaucaaaacagacugcuugucgucgcacgguggggcagugcuuuuuuuggcugccguggucgaaaugaaaugggcaagcuguaguccgcuuggcaucagaaugggcuaagggaagcagggaaaucagagucagacugugaaugcaagucacagccaaugguuaacuuccuuuuugugugucacuuggcagcagcgagacugauggugauuuuuuuuuuuaacaugggugagaguucagugcccuaggaagagccguagaugcuguuauugugcuuccucauacaguugacuuguguugauuucuugaggccaguacagcuguuccaagagccagcuccaggagcuuuguguguauguacauggccaucggacgucggaugaaaaagguaaacagaugagaggugauccauacaaaaucucacugcugaucacuaggcagucuuaggggaaucagguucuggcauaaggcaauaauaccaaagaauaauauauagugcacuugaagggauacucccuuguauacagacacccaaagauauuuuuaaauuaucaccacuccgcaccccucaucucacauacaggauucaaaucaauuuuggacugucuggaaaauguaggacuaaaauagccagauugaauucagauaaaauuaccuucugcuuuuuugggagguuguugcuuuuugguuagccacauuauuuucuuugaagauucauuuggaagagaguuugguagaauuucuagccucucucaagauuuuccucccauuucucuguuugcaaagagcuguuccccaaaggcaaaaagagcgaguugccaucuugagcgaauuguauguuuagugaacaccaaauggucucagaguuacccuaaauuuucauuauaucugguugcuuucaaauacuauuuauuccccucaaaacuccuaaccauuuauauaagauaucaguaagaugaccaacuucugacaacccaaaagcagggaaggaagcuuagaaauagaauaccauuugucugguaauuagaguguaucucuuaagaguucgagagaauucugauuaaccuuucuguucccacauucucacguaaaauuagcacaccuuuuaaauuauuaucuaguauuuaaacacauauuuuugagucuucuuaaugcaacagguucuggggacacuaaaaguguguuauaguuuucuaaaaaacuucauuuuucuuacauuuuaaauguucuguuugugcaaaauuucgagaaucaccauaagggcuucuuugcauuuuuaauuuaguaacuaacauaugaauaaauuugcauauuaauuaguugcagauuaaaucaugcauacauaauugccuccuuacuguguuuaauguuugucaaaaucuccagccugguuugauggaugucguaugaaagauuacaauuugauguacccuuggaaguauuuacaccaauaaugcaagauucuuaauagcagaauuuucuaguuauauacaguuacuaauaaacauguaagauagguacaugucccuuugacuaaaauuuuuuucuuugcaccaaaucauuuacuauucauaaucauuaaugcaucuccuaauuauacagcauaugucuguuaacccuuucauugcuggccuucaaaugguagcuucuuucuuuuucuugcccccuaaagaaagcaaaauuguuugauaauacucugaaauuacucgauugccuuuuauuuauuucucuccuaguauauggacaaaccucauuugccauuuauuuuaacauacaauagauaauuauaugaucauuuuguauuuucuaguuaaagaucauaaaaugacccacgugcacaugguuaguagcugaugggcuuuugccuuucuuuuaccaaugcugaaaaaaauugaaauauuucagauacuucauauaguaguaaaaaaaaauguauacacagacauacucucuauuuaggaggguaauuguagaauaaguaaaaguauuaaaauuauauuuaaauucauuuugaauauugaaaugcauuuaauguaucaugaucaaacauaggauggaaaugugauuuuuuuuauuagaauugagaucucugaaguagaaacugacaagagaauagaugcucuugauuugacauaauuuuaaaaugccaauaaauguuuucucaaauuucuucagguauuuaauuuuuuaaguuuuaucuuacucauauaaaaaguagaccaacuggcuuuuuuuuuuccuuuuuacuauuuugaugucuaagcugcuuaucacacuguauuacccugcauuaaugaguauuccuacugugcaaaauucuaucaaaaaugauggugugaaugucauuuuuaauuggaaguuuauacagucaaauuuauaguacacaacaaaaaauauguauguaguucugcuccaagccuuuuuuuaggcuuuugaucuuuuuaguuuaaguauacauuuuuauuaaucuaagugucauuugaaaaucuacacaaauaugacuacauuuuuuauuaauaccauuguauuauggaagagagggaaacuaaggcauagaguaauuauaaugucuguaaacuguaagaagaacaaauacaagaaugaccaagaauagauuuucaggggucuuuuuuagacaugaaaacuugcugaccgguucuguauguuucacauaagucagacuguaugauuucugucuucuuuauuuuugaaugccugcauuuauaugccuaguaaaaaggcaaagguuaaaaugaguugaaagcauaaacagcugauuucccuucuuugauucuuucauaggagaaauaaugucuccuggucaccuaccucaggagcauuuauuugcuuaucacaggacacaaugaacuauuuauugauuuaacacaacauucuuuuacaacacgcaauauuacauuaaauuauuuagcaaugugaaaaaugaaaugaaagcugcaaaacuuauaaaaggaagcaaacagucagaccugaaacauauuuauccacagccauugugccuagguaauucagggcauaugguauguaaaugauauuuggagauccuugccaaaucuacacacgacgggauaaauuaaggacagguuucccugggugugagucccaugauuguggccggcacacuuccugcuugaauguguguguucuguucuugucuuucagcaagagcgucacagagcauucaguggccaaaucugguccucagcugacuucuaagacauuauuugcaauucccaagaauugauuuuaugauuaaauuuaaaacauaguaccaauuugccaaacuuucccuuugcucucacauuugaaaaguaagaucugaauaauuugucaggauauguuuagauauuaagccauuuaaauggguaucuuugacauuagaaauugagugccucugagcuucuuagucacugaagaaagguguuccugagcagugacuuuucucuaagcuaggauuaagauguuuccuagaacagacuaugaauuauuuugaacgauugauaauuuugguuccagguuggcccaguaauaauuuauuaauucaacuugacaacccaaauuacugguaucacuuauuuuauuuuugaauuauuauuuugaagcauauacucucauuucuagaaaggugaaggcacugacuccuauuuagaauaaauuuuaaguagguaagagguuaugcuguuuucuuuuuuuuugaaaggaaugucuuuucuaagcugggggucuuagcucagaguuuuuaaugcuuuaaauuaagguucauuuuuaucuuggaauuaugcaauuggagauuuugauuagaaacuauggcagaauuuuuucuccuauaauuuauuggacuauaccuaaagagugcauuuacugugcacacuuaauuauaaauacaagacuuauauguuauuuauaaaaguuauuucgggguauuuuaagacauguagaguauggcuuaggauguuuuauuguuuuuacuauuaagaauaaugcuuuuacuaaauaaaacuguguuucuuuuauaaaagauaaugcucuuaauauuaugguuuuauuugaauuagcaguuuagucuguguccccacauuccauuucauuuauggaaugcaaauaacacuaguuacugcauagaaaaugaaauuaggcugaguccuuguucauugcuguguaaauuggguaaaaaucagagaaaaaaaaauacccuugagaucaauguaaaucaauacuacuugagacagauccagcuaaaaauucaugaaaggggucacaguucuggaggaguuuauauaauuaucauguagccuauaguuugugaacucagggcaaaguucugagcugguuguucugggaccauuccuugguucauugaaacuacuuugcacagcugugcuucaaacucaacaacagagagcaaaaacaauauucacuauaaaauaaaccucguccugccuuucaacuucacugugaacuugcagucuugaaaacaacaaaagggauaaucgcaauugagauuacagaauccagauuagauguaauacacaguagggugguauggcccaauuuuacuuacauggggcaaguggaagugcugugaaugccaacauguuaagcaucauagccacuuauuaagauguuagcuuuaaaugucagucuuuggaccccauuugaaaugaagcaccugcauuuuauucaaagaaauuaagauauauuggggaaugcggaggugaguugaggguuuuuuuuguuuguuuuucuguuuuguuuuguuuuuuuuuucuggugggagaaagugccauagacaauagagauaaaauaucucaaguauuaaaagucuauuuuuauacacuguaugauucaaaaugacugagcaguuuugaaauuuuguagaaagaaaggaauauaaggagaauaagaaaugauauuugcaucuuuacagacaacucuguauagcacauuuaagauucuggcaauuuccuuacaaguaucugaaaauuaggaauuaugaaggaaacccagacagauacuuaacuauagcauugcuaccaggugucucuuugauaucaaugaguuaggaaaccuuaagaaaaaaagguuaaaacauccagaaugauaacuuauuuuagaauaugcuuucagacaaaauauuucuuuguuaagaauguugaaagguuuuauuuaauuguucacauauauuuaguaaauuuuuugguagacuugaccgauuaggcuuguuucauaaaagaugugggcuucuguguauuuagaucuuaaguuuauuucaaauuggccuuuauaaaacuuuagugccuuucucuuagaauucuagucaacaaaauuauauucaucaaguguauacaucacagaaguaacuggugauacagaguauaauuccuaccauauugucaaauggagucuauaucuccucaaagggaaagaaacacugacgugagucagaaguuuucacucacuuggcacugaaucagcuuaaaguucgagguugaaaaauucacaaauauuuauagcacaccuacuaagugccacgccuccuggaagguggacagcaauggccaauguuucugccauuggaaagauuugcaccgaaguguguauggccacauguaguuguacaaaucagaguucauuuuguaaugcuuuauaagggucugguaccacugauucuccuugcagacuaauaaacacagagcuuauaugacucuuaaaaauacagugauagcaagugcauccuaaauuauguaaucaugugguccaugauaacaguguaauauaugauauacagauggaaucagccaccuggcuuacuguaauuguuguugagguccuuuguuaugaacauauauuucuguuaacaaugcaacaaaauaauuuuuuaagcuguuuuuuuuuuucuguacugccucaaaucuagauaaacggaauguguuggaaaggacaacaaauaagaaguuaaauauguggaaaugacauggaaagcaccuguuucuucccuuuguuuucuucuacgucaucaggaaauaauauuuaaccauagaauauggugucccucuaagaaaauguuuauaauugaauguucaaaguagaauauagauuaaauaaguaaagaugacuugccaaaaaaaauuaaagaacauuugaaacaaacagaagucugcaucacacauaauaaguggcauaacaguaucaccucucaaaagugacaauagauguguccaucuuuaugccuuuagcauguuguuggcauuauuaguuauuguauugagagaguagccacgcuauacaagagaaaggaagguaaauuagaucccucacgcccccuucuucugugaauuguauauguuuuugaauacacucucugccaggacagcaaauaaaauuugguucaucccugauccucagcagauuauaaucuagguaaaggacagaccagguucaugaaaucaaaaauaauaauuagaacauuuggaaacuaggggaacagguccucauauugugugcauguuuuaucagucuaaaguagauauagcucuauugaaaauuguuggcuaguaauaugcucauuuucccauuucaugaagacuuauucucaaauggaaguuacagcuggcuaucguguuuuuccgacaaacucucuucucuguggacaugaugauuucuguuguuguggaaaggaaggaaauaaaucucuuuuuguuccucauucacucaaugagcaaagugugauugagcuccuauugugugcagauuauauuguuggagcacaggacaaagaaagcuaaauuaucaucuuuguuuagaaauuuaagauauuugggagcagcaagguagaugccuaugccuaguuuauuuaacaaggcacugaacuuugcuggagaauccuauauucuagaauauaguccuuaucuggaagugacuacagaaccugauucuggaucacagagagcugcagaucuggugugauuaagacaguggccacagauacuccacugagcuucugucuugcagcuucugucugucucuucccugaaaaucacagggaccacagauacuccacugagcuucugucuagcagcuucugucugucucuucccugaaaaucucagggaccguguggaguuuugcuuggucaacuggagaaacaacuuuugauuguuuuuauguuuuucagagauuuauuugccagagauauuacauuauaauaaaaacauaaacacagaaguuagggauuggaacaaagguuauauggucacaauuuaacucauaguuauuugaaaauuauugguuuauaaggaaacagauuuagacaaagcuagaacuuaugcagguaaguuacaaagcuagaacuuacucaggcaguugcucacgucuguaauucuagcacuuugggaggccggggcgggcggaucacgaggucaggaguucaagaccauccuggccaacauggugaaacccugucucuacuaaaaauacaaaaauuagccaggcgugguaguggugcaugcugguaaucccagccacucaggaggcugaggcaagagaauugcuugaaccugggaggcagagguggcagugagccaagaucacaccacugcacuccagccuggugacagagcgagacuccgucucaaaaaaaaagaaaauguaguggacacaauacauuuagauuuuuaauaaaguagacauauguuuauugcagaacauaugagcaguugauuaguuaaagauauccaacaugccaggcgugguggcuaacacuuguaaucccagcacuuugggaggccgaggcaggcggaucacgaggucaagagaucgagaccauccuggccaacguagcgaaaccccaucucuacuaaaaauacaaaaacuaucugggcaugguggcacacaccuguacuccuagcuacucaggagcugaggcaggauaauugcuugaacccgggagguagagguugcagugagccgagaucgugccacugcacuccagccuggcaacagagugagacuacaucucaaaaaaaaaaaaaaaaaaaaaaauccaacauugcuggcaaguuugaaggucacagcccauguacaaaauugguauaucuugaggaacucuugucuuuaucauauguucuguaccauuuccuugcacacaacacaguuacuauaugaugguacuaaguagauacagguccagaccccauaaagaauguggcauucaguucuugaacagauguuagagaacacaacccacucggcaguaagggauaucuucaacuagagggaagggugagaguugaccuguuuguccuuuugacucauauuuagaaaugcuaaaguuguuuuauguucaaaaugcauuugauaaucaugccugaagaggucaaagugcugacauuguugaaaacaaauaccccugucaaacaaauagagacaauuuucaugucuuugguugguaagcaccauaauuuggccuuuggcauugcugucaguaaagcuaguugaugacuuuuacaucaauuuuuggcccaaccauaaaugaaggaaauaagaccaauacugccacaguacuuuuucucacucaucacccauaccugauucagcuggguuaauguuaaaagccaaaauuuaucaauaucaauuuuuuucccaaaucauucuuauuuuaguacuguuuaugcucaauaaaaguuuaugaauuucuuucacuguuauuuaaugaaaacccagaauuuuuuaaaauugcacauuaucucuuuaaaaaaagucuuuuagauuacucgugggauuuacucuaaguuguugucuuuuaauagaagaugaugcaaaacuugucucaccuguuccuuccuggucgugucuguguuuaugugugggguggguauauaagugcuuuugauuaacagaaugaagagagugcuuauuuugaaaacucagucguuaaaauucaaguuuauuuugaguuaaagaacaccauauuuagauuaggaauggaccaaugaccugcuuaagcuuuaggcuaucgauuggccuugagggaacuuagaucugcuaaacacgaacuugaaaaggcacuucagugauggauguacguuggaugcucucacuguauggucauucacuugcauuuuaaaauuuauguuuuguuuuuccuuuauaccuacucuuuucauuccguuugucagagguggccauuuaaaguauuugacaauuguuuguucucugccuagcaaguuguccuauugcuccaugaugugaaagaacaaagguaaucaacaguuagaaaccucaggaaauugcuagaaucuucacccccaaagaggguuaauaaacccuagauaauuaguucauuuagaaugaaaaccauuuucauuguaauaaucacauuuccccucugauuaucgagcaaugcauugggaagccugauauuuauucacaaauuuuuuaaaauugagaacauccugugcugagauuccagucagcuucauccauccauuuuuuguuaaaaguuucucaacuaucauccuucauccagacaaauaaacauaaccaggauuuccccucuaacuuuuugggaauucauuuacacguguaccauuuugagggaaaaaaacaauuguccucgaauuucauuugacucaggugauugugguaagcucgcuaaccagcuucaucuaggaagugcagcaaucugagucaacuuccuccaucucuguuuuuacauuguccagugugaugcuuccucauuguaccaaaauagaaaugguuuguuuuuguaucaaacuuggagacuggcuauggauuacacuggguuaggauaaggguuuguuauuuuuuuuuuuuuaagaacauuccacuuaucccaagggaaaaagauugacggccuggggaaaaauaagaggcauaaugaagucuuuucuccuuaaauaaaaaucacaucuagucuucagaugugucaauugcacuauguuugccuaauuucauuuaauauuugagagauuuaguaguaaauuuaugacuuuugcaguuacuuugcaaaaaauugaggaaggaagaagugaauuucacuuugagucaaauguguagguuccaguguaauuaaaccuaaaaaucuauauauucuggucuugcuacuugguauuacacuuugccauaucacauaaugcuauuagcuacauuuuaccuuguuugcagggugaugccauuuuguaucucugguuuguugaauuuccuagaagauguuauguucauguagauaauggcauacucauugaauucuuuaccucagacaugaaaauauguggaaaaguggggaaaugaaucugaucagauuucacuguauacugaaauuugagaaucugguuuuugcaucuauuuugcaugcugcugucucuccaaaccauauaugucugugugaguuuuuauaaugccacauaaagcaaaaugagaagucucuucuuucuucuaaagggaaauagugccacagaaagguagaagucaaauauuuacuuauggaucaaaaaucuaguuaaaaaacaacccauugcuuaccuuaguaaucaaugugaauuacuuuauaaucaauaugaauacaagcuaucugaccagucacucagaaaauaaauauuugaucaugugauaaaccauuugaaugucuacauaugaacccaggccauauaaaaauaaccaauucaagauaacauaggaagucacuaaaaaagacacaaauaaaauuagauuucacaguuuacgcugauauuuugauacuuuucugugauaaaagcaucuuccaaacuaaauguguccauauuugaaccauguaaauaguuaaaaguauuuuaccugagaauaucuaaaugaugccaagaaaauaaguucaugccacuaaaaagauugagaugauuugugcuuuaucugacuucuugguguaauauggauuuacuucagauaaguauauuuucuacuuauccgauaaguguguuuaucugagauaaauauuuucuccagauacguguguauauugaaaaaaaauuuaaaauaauuaggaucccaauugaaaaaguaaaaaucuuaauugcuuaauaagaaaacaguuauuucauagucuuaagauuucaauacaaagaaauaugggaauauacacguaagagguuuguugguguucauuauuaaauugcaaggcugucucaaguuauugucaucagaauaaauucugugugugugugucugucugucugcguccuccuguuaguaauuagaucuuuuaugaaguuguacucauaccuauuagggauuuuugucauugcaguuuuaaguugaauaugacacauggauccuuuguugggucuaagcuaucaccauuuauuacaauuuuuuauaacauuccauauauaugcaucuacuaacuaaacaucagccuuaauuuagcuuaugaauuaaauuuuuuguuaggagugacuccugcuggagagcaaaaaauaccaauuaguuuagcuucuaaauaaacuauacuccuuuuuucaauggacaaggguaaccuccuauuccuuggcuuggcaacauuuacuauuccucuaaguuuaaagaugagaacauagauuugaguacuaacacaucagcagaaauuauauuuuuaaguacauacauaauucucaggccagucguguuuggugcuccaaaaagauuugugauugaauaucuuugcuccauugggaagaguuuagcauggugcuguauuuuuauaauucuuuuuuccauuuuagcagacuucaccuaagucuauuuuagguggagauuuuuuuuuuuuuuuuuuuuuuuuuuuuuugcugcugcucuuuaaggcacucuugcauagaggaaacagcagaggagacacaaggaaaugcacucuccuuuauaacaugcugcugauucucugaacuagguguccucucauuuaagccucaaaagaagcuguguauuaacuagaugaaggaacuaacacucaaaccugugauacagcuuggccagagucacacugcuggggagcagcaagguuacucaucaagaugugucugacccucaaguuuaagugcucugauuuaauaacuuugcucacacccugauuccagugucuuaguagcuuuugaucuauaaaaugucaucuaaggaucuuugagccuuaauucuuugucuuuaaagugggaaugauaauaccugccacagaguacuaguuauggagauuaaauaagugaaggcaauuauuauauguucuuuaaauugugugucacuguacugugcauguauuaagugucguuuuauuagcaaauaucuuuuugauggguagauguuuaccugaggugguuauuuaauuuauaggcuggcuuguucacacuauguuauguaaucauuguauauuaaugaauaucacuauuuuccuuaggauaugauguuuagcuaauucagccaugcuaggcaaaagaggucagcauuguagaaauaagcaaugucuuauacugaaaaaaagaaagacaacaacaacaaaacaacaacaacaaaaaacaacuuuccguguucagugacuuaaacagaaacauggaguuguucaaauucuaccaaguuauauucgggaggagaaaaaugggaauuccuuccauaugaccauucuucauucauucauuuauucagcuucuauuuguugaguugccugccuuacacugcaauaugcagggcaguuuguguguguguagauguucauuagguuuauuugcacuuugcaguaaccauguaauauuaucauuauucagaaauaaagguagaaucuacucuaaugagcucuguggucgaguggauaguucagcucuuuacccuguaauaguuuguuaucuaauuguuuaauguaugugcgauugccuucacaauuaaagcauuauucuuuagucauauuuucucucuuuucucaauuuucucaggaagaaaauugacaugucugugaacccugugcauguccccaaauggagcuuaacccaaaguugggaaucacuaaauaauuguucaugaaaugguugaauauagcucuucauucaagugauguagauucugaauauuuacuuauucuuuaaugcaguuauucauucauucggcaaguuuuuauugaacaucuaccuuguagguaauacuaugccaaugcauuggggguuuuaggucaaauauuucccaguuucuuauaacaaauguauguguguguugucaguucugcuucaccucaaauauaucugucaaagacuuuuuggaaaauuacaaaagaacuguaaacuuuagauucuagaagaaaauaagaaucguguggguuucauuuaaguggucaacacuucuagacaguuugcugguaagaauuuuuuuccccaaaaguggcagaaaaagacaacuggguucauugccuacccccaguguccucaauagugcuuugucuaagcaccagagagggaugguggcuuucuguauaguguggcuaaccaucauuccccaucauuucagcgauaacaaggcugggcauggggggugggggugguaccaaguagguaaccaaguuaccuacugcuggcaagguaacuuguccaguuauacacuacugugaaaacugugucugugaaacaagcaguagacuaguucaggguccuguaaaaauuggcugcuuaagauuaagacuucuuuaaaauuauucugaaacacauggauuuaugcauauagcuucaguuguucuuauacuucuguucuaacuccccacgcaucacacuaaaaauuuaucauggaugauauuucugucacaaagaaaacuucaaaggcugagaucgcagaaaugucucaguugacaagccacugacuugaguucugugauugaaauguacuccaaggucagcaaaccaaaaccaaacaucacuggaugauaauacguucagugucucacuggcuauaauucguagaucaccuuucaaagcauuauaucuuuauuaaucauuguaaauuugugcuuuugaaaucuuagacucguuuccauuaggcaaugaagcccagaagcuuaauguucuagucucauuuuaauuuuuucagucuuaugugcugaauugucaggguuuaaaaaucgauuucaccucaucagauuaaaaauauuuauuuaugcacauguuaacaauauauuaaaagaaaugagagcuucaauuuuaaaaauaggaauuguagcucauuaagccaugacaauuugguuuauauuuacauaauuaauaggaaggcauuuauauguuugcaaaauagguaagaaaagguauuuaacguagaugaagcagaaugauuguuuaucaaaagaguuuagagaucuuucuagcagucuacccauggaaaguuaggaucuagaaaagccuucucaauaagggaagaaacaacaaagaaacaacaaccaggaaacuccccaacuuaucucuuuaaauuccagccucuuuucuaaguggugguuuuuacauacuguccucugguagguggguacccuggccuuguguauuaagcagugagggugguuuaaagguuacaaaugugauccugucagauugacaacuaacuguucuaaugaggaaaaaauccucaaagcaugaaauuugaaugaaaugugugauuauaauucaaguacuguuuacacaaaccucuggggaccuuccgaauaaaugcagagcaagugaguuagacaaaccucugggccuucgauacguguguguggaugugcgguguguguguguuuauuuuagagaguggggaaacuuuccaccauuagcccgggcuuugcuccucggaaccaacaccacuauuccuccuuguuuauuaauacuguauguguuuuguuagcauauugaguuguaaggaaauaggugcuuugaauuauuaaaguugauucuugagaauagauguaugcucggguggcauuugcuucggcauaugcaaaugauuuaguuucauuugggaucaauucccagaggcccuccuuuccugugaugcucugaauuuggcaagcucaagucagcccaucuccucuccccacaucccucccuuucuuucuuuccuuuuuuuguaccuccccccgccuuuuuguugauugguauaauauuuuuaaaagacaauaaauaaauauaucaacuugcuugugagaaaccuugccaucuauaaggauucuauuguucaguugugaucaauaaaggugaacaaagguuuucacguucuuaaaguuuagcaaaaucgaaguuuaguaaaaaugugcaugagauguuugcuaaaauauuuauacagauacugggcugcggggaugcugcaaaacucugaaaauguggucucaggggugccuuuggggaaacugacagcuguaagauauucgucgguucgaagguaccaauaaacuugcuuuagagcccagcaaauagcgugaaguugcaguagauugucuaaagcuacagugaaagcacccaacuccagaguggagaacgugcgcccuuggggcgcccagcgccagcgaggggagcagcgccccagccccuccguaggcucugggcccaugcggcugucugcggcggggcgaggugaaguucaugggcggccgcgcuucccaccagcuccggggaggccggggcccgcggagcccggggcgggccgcacugcuacucuguuucauuccgcaaccccguuuuguagguuguugaccaagcagucagaaaacacugcccccucucuccuuuugagcgaggucagagacgugguguuuuuuuuuuuuuuuuuuuuuuuuucuucccuccccuuucccuccccuuucuccgagucgaguucucaggcagcugcguacaaugcugggagcuagccagcagcagagacagauggcagaguuauuagaugugcaucauacgauucccuuccugccacucgcuuuuuaaucaaauuaaaacaaaaaagaaagagagggagagagagagagggggagucaauuaacugcauuuguauucugcucaauaauggacccuguuccacuuuuacccuaaggcaguugaguggaaauuuuagagaagaaaagggugccuagaacaaaacaaaacaaaaaaaaaaaaaaaaaggaaaaaaaaaaagaaaagaaaaagaaaaaagugaagacugcagaaauuuguaagaaucggcauuauucgaggaacuaauaaaaaccccucggaaaaguugaaucgaucucgcguaugcauuaggauuucgagcuccaucagggccgggcugccuuccagcuccgcugcgcaaaguugagcgucugacagcagcgccgcggccucccccgcccgccaggaauggucucuuccugcuuugcauauucaccacgcuuggcccggccauaugggaaaaugcaacugaaggaauuguugugaaaaaagggacagcgaguuugaaauaaaaguuguuagagugguacugaggagaaaaaagaauccgagaccauguacugcgcauacacaaucccgggcaugggcggcaacucuuugauguacuacuauaaugggaaagcgguaagcgaaugcgggcugcgagggggauuuuugacaaguuuuauugucgcagggaugagcauccuagguggugaucauuguuugcaaaguugugcaggacugccgcaccuuccugggugccaugaaauauuuaucauuugccaauccuaagaucuucuucuugccuacuucuucuccuucgucuuuuuuuccccccacuccucccccagaguagaaaaauagaugcuuucagagcuuuagagaguggauccuagagcgaaaguuugcagucagguaaaguugagaggugguaugauuuuuuuuuuuuaaagaguuuuggaaaauucuuauuccuuccaaaugacuguuagaaaggaaaagcagauaugagaagcagaauugagaaagcccaaguuaggcugagaggaaauuugggguaaguuucucccuggauugagguuuugugauaucuaaagucuuacuaaguuggaagcuugagugcaguggauagaguggagagaaccugaaagguuaaaauagagcaaacacauaaaacugagagaucaaauuaaggaguagauuauauaagcuuagauauauauuuaaagccaaaauggggaaggaaaaacaaacggguucauucaugcauauaacaguauugucauaaguuauuugugcuguguggcuucuucccucaauuucccccccuuccaacagaaacgcuuuauuuaagaaaaaaaugugucugguauuuugugcauaaccccagcagaagguuuauacuugccaucuggagguuuauuuuuuuuuuccuucgucugggcccacugaaggaaaaggauuucaauauuuucaaaucgguauguggggcucucgggaagaguuguugggugauagaggagcaaaaauuuauuguuuuaaaauagaaaagaagaaugagagaaaagugaaaagcagccauuuauaaacuguucucuuuguguacuuugaacuuccauuuggauugaucuuaaucagggauaguugggccaaaggggacagaucagagcuuucaggaaggcccaguucagcuguagcaauuggcgcaaacgaauuaaacauguguaugugcugcuauaugccugugaguguauauacauacagaugcaugcauaacgguuauuucuagaugagcauauucuguaauacauacauauacacaacuguuugaaggugcaguuucagaagauuaauaauuucauuuaagaagccaguuuuaugaaugggcaacuugaaauaauaucguuuacuuuuauuuugaaaaguacgaguaaaucaucaaaaguucauagcgcuauccuauuuuuaucuuuuuuaaaaaagagcacgguguaauuaaaauaguuaagugugguaagggaaauauaauuuuaaaacaaaugguuuucguugugauuugaucaaaguguuuaaaucuguaaacauaaauauugggauuauguaacaucuuuuuuuuuuuuuaacaaguacaugauuugcaauugguaguuacucauauauagauaagacuuuugccuauuaucuuuuagauguucucauacauaacuuauucagcaccuuucauuuuaaagcacuuuuaaugaaaauuuugugaaugaugccaucguagucaguaagcaaaagugucucugaagcagauucagggauuagauagcccuuauccguaaugaaagacuuacauuauaaaagaauauaaguuuccaugguuuuuaucuuucaggauuaccaaugaugugacuuuuacauguuaauuguuaauuuugcaucuuaaauaucugaacugacaaaauuuuaauuuaaguuuuguaccuuuuaacucccuuuuggccaaaaggaauuuucaaaaauauguauuccauucccacagcuugccaguugccuccaccguaagaaaaugcugaauaugacaucauaucacuaauaugcccucucaguugccaaauauuuugguuguuagauuuuuuuuuuuuuugagaggaugguacucauaaaaucaagaucgcucugucacaggaaauguauuuauaggaacuguuuuaaggcguuuauuaaaaacaaaucuggugauguguaucucuauugauucaaacacuagaaagaggcaaauuguacacacauuauaguuagaaaaaaaauagccauuuggaacaccagcagaaagcuuuugaaacugcggauggcuaccaguuguccaucuuagcuuuaugaaacagacagcaaaguccaguugugugugucccaaggaaggggccaauucuauaccauuuuuuaaaaugcccucaugcauacacugaggaagcagauuuuuguuuauucuacaguguguauucugcuggcucuaauucugcauugaguggcuuuugauuuggugccagacauguuguggagauuguauauaccaugcguuaauuguucaaaaugccuaucgaagagacuuuacauuucuugaguuuuacuuaucguuuggagguugaauaucuaugcuuuuuuguguguaugugcaugucuaaccaauguguguuugaaccugaauuguugaaguuaaguguggucagcuauuuguugcacaaguuuuccucugaagagaacacagcacugaauuccuucuuuuuucccagugacaagucaauuacuuguuuaaauucaguuugaacucccugaacugagagaggccagaggaagcagguuuucccugugaauaaacaaaagaagaaaaauggaaaaucauuccaaaacacagugauuuuagcuugugggaagaauauaauuaagcauuacaagaauuaugguuucuucuuuuaugaacuggcaacuauaggguuuguaaaaucaguuguccucuaacuuucuagcagaaauauaaucaaugauauuuuaggacaaacgaaaaaaacgugaauuuuuuuacuaccuuaaguuaugaaguguuuccauguccauaucccacaaaaaaauuuuuccuuguuucugugaacaacuguaccuguccagaaguguggacucugaaaaaaauacuuaacaaaaaaucguaacacaagagcuaucaaagaauaaauuuuggauauaaaccagaauguauuuuuaaaaaucaguuucuccucaggugagaguuucaugaacuugauaaaauaauuuuugugauuuuuuuuuccucuaugcauuagagguuuaaauacuaacggauccaaaucuaagcuuaaaaaaaauuaaagcaccacuucugaacuacgaaacagauuuuuuuuugcagagaaaaucaguagcuuauuuuguguuggaaauacaagcuuguaucaaagugugccaaugugucuguccuuauuaaggcuauaagaaguauuaggcauuaccugcucuccaauaaguguaguucuagcucuaaauuuugaucuuuauggcuucuugcauguucauugaagaagaauuuuaauaagugauuauuuggucaaauuucacauaucuaauauuauagcauauccacgaagauaaaauuauggcaaauaaaacugaaaacaaaaguggcgaaauguccucguaaugguaauugaagaucacaucaucagcucucgccagcaugugcauguguuaaaccguagagagaaaccuguaauuauuguaauugcucuuuuugcuuuauacuaacaagcuucaaaccauguuucaaaguaguuguuuugaaauaguuauuugucaaaucaucaaaucucggaaaguaaaugguaaugagcuuuuuauguuuauauucugacuguuggucauauuaugcagcuuuucaaguccauaaaguucagagaugaaacuggauguuaauuauuucugauaucaaggccaaagaauaaaauaauguuacgaguccugcuuaaggugaaaaauuaggaauauuugaauaucagaaucucucaauugggaaacucucuauucuuagaagaaaguuuuccuguaaauaagugacaauaucagucagcaaccuaaauuuuuuaaagcugaaaauugggguaugaagaguguagcuuuuucucauuuaucacaggaagugcuaagauaaaaagaucaauauuuaaaugacgccacuaauaacauuuuucaguacauuuuacauauggcucuuuuuuuuccccccaaaccucacaguugguuggaacagccacacauaggacauagguagccacuggguuuuaaaguuuccaguagagugucaacuaugcaaauuacauuuggcauuuuaaaaauauauuucuuauacuuacuauuuucagaaccaugauuauaaaugaaagcagccaguauaaaugcuuuuauuuuuuuuaauugcuguuuacuugcuauuacacagcaaaaauuugcuuaggccacaaaguaaucaaauuuuuaaauuccccacugguucaauaaaauaaaacauaucaaagagaaagcauguaggaaaaacugcuuuuuugugagcuuauuuuuuaaauauaguuggcacuuuaauuuacccauuuaaaaauaacaaugaaauuuuuuuuuaugcuucauuacuuuaaaacaaaauuauguugauuuuguucuuuauguuuaagcugauaaaaauucaccagacacuuaaucuugacauuguggcuacaucuugccuuccugccucugauuaaauuuucaaaaucccugcaugagauucacagauaccaguuugaacguuucugugaggcuaauuucucagggaaaaaauauggaucaguuacaucuuugguuaauuuuaucuaguuccuaauuucugcuaggucuaagcauuuuaaauauaguguugguaaagcauccuucugucgcugggugauggcauuauugcaggcagaauuaggagaaaggacauuggcauaggagaaagaggguuggggagaaaaguggucaggaaaaaagaucuaauaguugaugcagucuuuuaaauaccuuuccaacugaucuacaggaaauugugcugaagaaucauuuguuuccuguuccacuauaaaugugguuugcauuacauccccuguucggcuuuuuuuguuguuguuuuguuucuacuaaauuguaguaccacgauggaggcuugagaauaagugaugucuuccuuuauaacuuaucuuuuaauggcuugaucauaguuggauuuuagacacugucauauuucauuauaugaauuuuguauguguguguuuccaagccuacuugaaacuucuauuacugcucugccacuaagaaaaacaaugcugcagucuaaguucuuuagaaucacuauuguaggucaaauacauggucuacaugcugccaucagggaucuauuaaaugaaucucuuguuuacucauucagaaaauuuagagauuuuagaugugguucuggcaauuguaaaaguuguuagaauucagauuuacuuuugccuuaagaagaaaauacaguggagacauauauuugcucugcacagcugaccuaaaugcaugccuuguaccugugagaauuucaguaugcggacacauaaaagauuacugggccuuuuuucccccuccaauauuaucagaguuacaaaauaaauaaucuuucacagucaacauaguuuaaaaguaauuuuaguuuuaagcuuuuucaaguuuuuauauguuuaauugcacuuuauuagcccuuaauacuucaaacauaacucuaagaugacacaggcuaaaguuguauaugauaaacauuauugauuacuuaaaaaaaagggauaucuguauauucauaaaacauuuauaaucuauuuaggaaaucaucauaguccuaaaaaaaaagcaguuguuuguauaccaggaaaaagagaucaguagugacaaaaguggaaaagauacuuguauaaaauugucuccuuuagugugaagugaucuacugaaaguuauacuuggaauuuucagaaaauguccauaguuguaggcuuuauaacauuucaaauucuguaauaaacuauuuggcacauuaucauaucauuuuagguauauagauaccauggcauuuuauuaagcaaaacaauuuuuuucuucugaagaauacuuaaggugaaauuuacugguuuugagcuugaaagugguuugagaauuauacaugaacuccacuuaaacuuuggagacuuuccuuuuugcagugcuaaagauccaugacuugguuccaaacuacaaccuuuuauuugcagauguauuuauggcacaguaccacauucugauuagaauuuaagaguucacauuucugauauuucugucucuaaaugcuguguugcuucuguuuaccuaguuuucuuccuauucuuccuaauuucuuaaagaaaucugcacauauucauugagguauuuaauccaaaaagauuuaaaagagacacuacgccucuaacauucuguuuaggagaguauacuacuuuaaacuccguucuccccaccuaaaaaaggggggcuaaagaguggguuugaacaccugagaagucagaggugggaacaguguagaugauggucuaauuucaggcucaaccaaaaaaaaugcaggcuuuggcuggcauccuccagggaccuagcucugugcuuuccuagagaccaaauuacacucaucuugagagagggcauguugagguaauuggugggagagaguggggagaguugaauuccagcugcuuccauuguagcuguccugaaaaugaauaggggauguuaacaauggaggcuaacauuugacuuggcuuuuucaccuccacaaaccuaagggugagaauuauagaguacugaaugacugcaccaauaaugauccuguuuaagugggaauugcuauguugggaaaaacucacaccauuuuaaaaauaguugaugcauuuaccaaccacaguccuauuacuguagcccaauaaaguuuauccacaguauggaaacacuccuuuuuuuuauugucagccaucuaguguguguauuggaucuucaccucuuugguuaccauuuuaaaaugcuccuacugaaagacauuuggaaggcaccagaaucccaucuccaagaagggaagcaagauacaagugcccuguacucccuuucuccuagaauguguggucuuuuuuuuuuuuuaaggagaauaaauacuguaugacucaauagcuuuucuaacgaauaaaacaaauuaaauugauguuacaugcguauuuaaacccuauccaguuaaguacugaugugauuaaaauaaucaaauguauuacuuaaaaaauuaaaaaggauaaauucugcaccccauuauuuuauugacuuuuaaauauaaauugcagaaauguuuacauuccuaauggcauuauuaagcuaaacugacaaaucagaggaaaaaguugauuggccagcacauuauuauuucugcaccuguuauuacagaaguggaggcucagcauuaaaggagcuggauggaugcuguuuucuuaggcuuccuuugugugauguggggguugggauaaauguguaacaaguguaguuucacuuuguagugccuuuuuguguguugaugugauuaaaagacuacaguguuuuucaugucgcuuugaaauuaauaugcaaauaauaugggauauuagggcuucccucuaccugcugcacuaagcuucccuaagccaaaugggguggggauuggugucaacuuuuuucauacaaguuguuuaguugcaaauaucgccaacguuuuaucucuacucugugaauuuguaagggggggagggaaaugucaaacucauugaaguaggauugaagaucugggaugaaaauacuuuaaauuuuuauuuucuacuuauauaucagccaggauguuaggagaccuugaaaacauuuugaaaaaguuguguaacauuaccaaggcuuugguauaagauuauacuuuucuucugguugaguucuuccuuguauuaaucaugcaauaucauuucucagacacuugagcccggcucuccccuggagcauagguggcaauaauuguuuguuauuauaauucuagaauuucuuggguguucauuguccguaauucauuucacacagagaaaucuaaacuuucuucagccaguagaauaaauaaugccuucccuguccuuuccuuuucuuuuuuaaauuuugaguucuuuaggaaugucauuauagucuuugaaacguaaugacauuaaauuuggauugaaggggaagggagaggaacuuuuauuucaugccauccaguggcuaguuugaguuugcaaagaaauagauacaaugccauuauuuucugcaagauacuaguuaacacuauucucauaucaguuuagacuuuguccuguguaauaauuuaaauuccuagauuuuaauaacacuuaauauguagcauggaucccacuuaaucuccccccggcuucacaacaaaauguuuacauaaaugaacucucaauuuugauaucaacuauuuaacucacucuuuccugaguuaauacuuccauaauuaaacauguuccacaguugccauaggaguguaucuuaaaaaugauguucuucucuguucuuuugagccaucuguuugcuaggucaguaaagaaaugggagccugauuuuauuuuaaagccaauaaguuauuacucuacuauuguauuagacauucagcuucagagggaguaaaagauaaaauuccaucacauuuccacuuucuuacauuugcagcagaaacuuguaugcucaaauugguuauuuucaacucaugacagcugugauauuuaaaaugaucacagcuguugugacuuaaaauugauuuuucuauuaacaccugagaaaaagaccugugccguauuaaaaacuuaaauaagguaacuguaaaauuagauguguugaugugaaucugguaauccuacuucccagagguugcaaagugcagcacaccucuugcaugcuuccagggaaugagcuaaaacugcuagaaauagaugcaugauuguuaaaagcguuuacauuuuaaaggauuccuguaauagcagauccucuuggcccaacuuuacagugucacuuuugcugauaaaaucauuuaggauucaguuuccuuaauuaaccccaagaaagaugacuuacaugaaucauuaugauauccuaaccucuagacuagagaagcugcuuuaccuuucagauaugacauugaaaaaugcaaaaccauacggaauuguuucuuaugaaggaaguuuugguuuuauggugcuuuuccuccauuaucuuuagaugacgaaaaaggaaaaacagaugagaaaggacaaauagaucauggcuaaguagcuuuaggcuagcacuuguuuuuggaaucuuuaauacauuuuuaaucuucauguugaagauccauuuaaccuguuuuaaaguuagauggugauuccuggguucaguuggucuguuuaaauguuuaccuuuucaggauaauccguauuagaaucuugcaucucucaauagauuaccuauuuaacaaaguaaccaauuuaagaaaaccuaaacacauuuauacauuaagauauuuuccuguuucgaguuagaugauguaguauauaaaauauauggcuggccugauguggaauuauguauagacaacagugucuucacagaugcauugccaauagggagcuauguagauuaaacucuuuggccaguccuaggcuuuuuaccuguguaacucaaucagaauugaaagcaugacagguuuuaugaugaugaauguauggcuggauuggagaaaguaugguuggguggguagauagauggauagauuucauaacuagacaguaauagauaaugccaauuauuuauuacucaaacuuguuuauuccucagaaauuuuucugcagaguauuauuuugauuauugcauguaguucagaacauuuaguugaaaaugauaaaauauuugcugucacauaaucaagacugcuauagaguugguucuaaaaguuccagagugaacauacauuaccugugucaaaguuagaggcuaagacuauggagggccauaagaucacaaagucagacuaucacauacuaagugaucaugggugucaauggcuauuuccuuguuuaguugaaagaagauacuccucgagauggacauuguuuauaugaagauuuaagaaaaucaaaguggauauuuguugcugacagacuaagauuacaaacauauaucuuuagaacaggguguuccccaggggacauacggcaauaucuggaaacgcuuuugauugucacaacugugggggucaggcaggagcuugcuacuggcaucuagggcuggaggccagggaugcuacuaaacaucuuaacagcgugcaagacagacccucagaagugcugagguugggaaguccugcuugcaaagugauauaucuggaccuuaagaauuaaauaaugucauaauaaguuccauaauuaaaucuuggcauugugaggcauuuauagaggauaacauuuuuuuguuuuuuuucuuucccuuucuauuucccuuuuccuuuucuuuucuuuccuuuuuucuuuuguuuccaaaacauuguuuuuuguuuguuuguuuuggcauagcacacuauagcauugcccagguauuucuacguuuuaccaugaaaacgugagauuuuauaguguauuaaauauuguacauuauuugugaaccaacuggaauggcuucaaagcagcuguuagaauauguugagucaguaacacaacaugucugcauacccuaaacauauauuugucuuaccuuuuaaaauguuuagaacccucuaucaguguaacuauugguuugucuugaaucauccuaaaugaggaaguguauuaccauuuuuucccuacaggacauaaaguggaaagaagaaauuagcauaaagaaacuaauuaauaauuauguuuuaaguuuuuuggcauuacggacauuguuuacaucaucauuaacaucauaacaucauaucgucuguuaucaagaaaagauuaaaauuuaaagccaacauugaagauguucuuuccagcuuucccaauaaugcaacuccuuuaccuccucacaacuggggaccucucucccugccacugcugcgcuucuccucaauguggauaauucuuggccaugauacggaagugauuuugaaaccucaguugccuucuguagcacccuguggaggaagguggcaggaucugguggcugagucuuacaucugccaacuucuagaccucacuccuuaggugccacauuuuggagcuaguugccaagccucacaguaacuugagccacucuucaauuuccuccccaugauauacaaaguucuccaagguuuaaugagaguagauauggaggcugggcacgggaauggcagcucugauuugcaguauaucuuugguguacagauaugcuuucauuuauugcuuagcccauuagcuaauggaauuucaauuccuucccacaggcauucucagacccugcacuucacucuuccuguuucccuguccagcuugguacaacacauucuaguaaaaucacacugauguguuuagguuuacuuuguacaucacaucuguaaccaucuauaaguuugcccuaaacuggcauuuauuuugaacugucuuccaccuuuuauuguacagcguugucuguacucaaagugagcaacugaaaagaaaauuuuaacauucuuuuugugugccagacaaguaauaaagauuacuauuuuuaugguaauuuuuuuauuugaauauuucuguuucuggaagaugguaauuuuuuuaaaucaugaauuuccuguaagugaaacuauuugagggaguauugaccuuuuuuugaucaaucauugauuaucuguguugcacucucaguauuucucuuauaguccauaugucccucugaauaauuguagaacaauaacuugcuuacacaguguuuuuagaauaugcuucaggaagcuugccugugugguauuuaacucagacauuuauggaguauaaaaccaaucuuacugugacuuuuaauuauuaggaaaguggcuuacaguuaaaauaaagcuuacagaaaauauuguagcaauaauuaauauccaguaaaauacaguuguaagcuucgguucuuucagacauuuucucaacccaguucuaauuugaucguuacugcaccucaguaagauaggugaugcaggagucaucaucccauuucacaggcaaagccuggccuguucagugagguagccacuggccccauguggcuauuaacauucaaaugaaggccaggcacaguggcuuaugccuguaaucccagcacuuugggaagcugaagcgggaggauugccuaagcccaggaguucaagaucaacaugaucaacauugggacacccugucucuagaaaaaguuaaaaaaaaaaaaaaaauuagccaggcaugguagcgcucaucuauagucccagcuacuuaggagauugaggcaggaggaucauugagcccaggaagcugaggcugcagcaagcugugaucaugccacugugcuccagccugggcagcagagcaagacccugucucuaaaauuaaaaauaaugauaauaauaauaauaauaaauaaaugaugucagucaaugagaauuaaauaaaacuuuaaaaagaucacuuccuugguugcacuagccaaguuucaauuacugaguuuucauauaugaucaguggcuacuguauuagcacagauacagaauauuuguaucauuguagaaaguuccauggggaggugcuggccugggaaauggaagcauugagggauuaaaacuugcugaagaucaugugggucaugacagaauagagucauugcugcuauauauuccaauaggauauuuuuacauuuuucuuagcuuuauugucaaauaucugauguaagaauugacauuuuaaugcuaccuuguagcacuuuacugaaugcuuaucucaacugaauuuaaauuuagagcuugaguuacacaaacuuuucaaaggauacagcccuuugccugucugcacacaauggggaccuugaauuuccagccagugauacccuccagaagggaccaugucuuaaugcaucuuuguagaccuuuuggcauauuguagacaaccaagaaauguuuaugcagccuaaugaaugugucacauccaccauacgggcauauguccauacauacaguuagacaagaccuuuggguagaaugcucccgagagagcuggugucugccaaauuuuacagagcucaugccucugcucuugcuguuuuaguaaaaaguaguauuuuaucaaaaguuaaauuggguucaauauucaccauuuggguaauggguacauuagaagcccaguccccagcagcaugcaauauuccauguaacaacaagcacguauaccccuuggaucuaaaauuuuuuaaaaauauguauuuacucacauaauccaaauauuuuucauaguaaaugaaaacgucuguccaucuuguccuuagcagucauuuagucccuaaccugacuuuguguuguuauaaaguugugucacuuaaguaguacuuaaguaaguacauaccuacauccauacuaucuuuccauuuccugcaucacugaguuggacaaaugugcccaguuagcguugguagugcugaagaccauguucauucauacaugcacucaaaaucauauuaauuacuuuucagugauaaccauagguggcaacagaugaaugggcuagcccuaggcuauuauuaagcacugggaaugagauuguuggugccuuguaccugugcuacuuuaacaggugagacaauuccagagcuuuccccaucauccucucguugcuacagucuagacauugggagcacuggaagccuauggugacacagacuggcagaugccuugggcuucuaaugguguauauguaagccaucauuuuguuuguaauaauuaugguguugagaagcauuugugugcugugcacucuuucagcuugugccacguuuaguuccuguuaugcaaauaccacuuuaaacuuagaaauuccaauuugcauuaauauuuugguuucauagagcuaacuauugcauuucacaaacaagugcauuuuaaugaguaccggcagaaugauuuaaaaauguuauuuauuaaauacuauuguagaaaaugcagucuuugguugccagaaacuauuaagacgaaauauaauguguguugaggccacagaguacaccucuucaagaguauuugacccuuauggcuuucagugauacaacagccaaugcucuucaugcaggcuuggagggcagagguaauuaauauaaaauagaagccagcguaccauugacguuuggguuuacuuuuaaaauguaaacauauuuuuacuauuugacauuugucauaagaccauaggucauuuaccucugaguuaaggugaaggacuuuaccagucauaaacacccaaguuuuaaagcaguguuuucuuauaucuuacaucuugauguuaaauccugaaauggaguuuguugcugcuuuauaauuuuuuucccucuuccuaaaagccuuuuuuuaaaucagaauuguggauaaaaaaauuuugauguacaaugugugggaaaauaaaaauuuugcaacuggauuuucagaaaugaacuauuuuaacacauggacuuugaaugcugcugucaugguugucauagcuugugguuccuaauuauaaugagcuuuuuuggugguguuauugcaguuguuuuauucccccugcccccacccagucuucaacucacuuuucccagaaggagaguuccaagccuuugaaaauucucaugauuuugcaaauccacucuauuuuugucuagaauacaggaaaguuaaaacuguggcugguaugaugccauguuuugaauccaauuuuaaagcaacccuuugcaacccagggaguaaagcugacaucuuuguaucuguaaugaagauaauuauaccugcaaggugacaucacuagcaaaguaacaaauacccuugaaaacggaguuccuggucuucucugaauucuguagaccacauuuggcauuuaacaccagacaccucuuucaugccugucguuugagaaguugcuuucagaugaauuuacuaaagcugacugacacaggguuaaauuaauucuuuucuuuauuacucaaagugauacagaccuuucuuggacuaauguagcuuaauuaguggucaauuaaaacugaacauugcugaauugaaguucuuugaucaaacucccuggcaugggcuugcuuucuuuaacuagccaccaucuugaauucauuuggaaucaguaguauaaacaaguuaaaaacugguucuuuuauaagaaagucagcaggcuuguauagcugugguuucuuuuuuuacuucuguaggcggcaauucaaaggcaugcuaaaugaaaacaguacuacacccugaaaaaauuacauuuuuaaaaguaacacuaagcagucagaaaacagucaacacccuuaccuguuuauucuagauacauuuaucuucuauguagaacaaauaauuaauaauucacuucccaauuucagugguugauuuuguuguuacauggaaggugaaaacuccccacccucccuugcaaagucuauaguuauaacaaaaagugaagcaaacaaaauccaaccugguuguugggaguagagucggaaggggcacgguaaaugaaggugugcccaguugcuccuaaauucauucuuugucacucuugggaaaauaguucaccucuguaucuuuggagugggagugacacacuacuucauuuacuuauugauuucaucauuuauuuugaagggcauuauccuaucaguauggaaacugauaauagcauauauuucauaugaaucacuugauuaaaaauacacauugcuuuuguuagaauuugggugaaguuacaaaaaaagagaauuaggggagcugaaaacuggggcagaggaaaucguaagcauugguaauaagaucacccaccuccauuuauccaguuacaugucuuaauauuuaaaguguauauaccauucuugucuaaacauaaauugauaccauuccguaauccuaguuuuugaaagcuuaacaaccaaaaacauacauccuagcuggcauucaguuagugcugugcauucuggaguauuaauugaaacugguacuuuuguacuggaaauaaaaguaauagauuagguuuaaauagauaauuugcuuaguucauagugauuucuucugguuuuuggaaauuuucacagagaaagaguuaaaggaaauuuggaagugaccauguacaguguucccccuguaagugacagaauuuuugugguuuucauuacuuagaucgaaaaauuguaguuauaaucaauaauuaaaauuaaaaauuuuaccaguugacagaaagagaaauuguuuauagucaaugugccuuucagccuucucucuugccuucucccuaaaaggcugauuaggauguaauaauuggggaugauagcgggaggaagacgacaauuccauuuaauuaaagauaauuuauuuuacuucaaauuggugaugucccacaugaauaagaguagcuuuagcagauagauuuauuaauggguacugacaucucaguugacagaaaaagcaaacauuuucuuuccucauuguuuuuauugugucccgucaccugaaacugcugucaccaugcuuccuuugcugcuugacagagcuguagacuuuuccaccaaauaugcaauuauugguuuaucauugaaacaaaguugauccucuucugaguuaaaaacuaggccaggagcuugaaaggcgguucaggcuuucagagcuaaugcuacaaaugcucucuucuuaaaucacauuuucucaacugauccuucccauaucuaguucaugaguagauugaaccuuuugaauaaggaccaaagauuuccuuuggucuugggugaggugcuugcaugaauauuccuuuaauaccuugaaugucuuggauaaugaaaugugccccaaaaaacuaccauuugcauuacuuagguucauuccugacaaggaauucugcccucgugugauauguucguuguugucucaugcaaucguaaauggaucuuggaaguugggacaguuuuuuuuaauuaggaaguagauucaagaaaugcaugauauuguuuuucauauaaucuccucagucuauagugguuguaaaggugugcuguuuagcauaccuuuagcaaaacuguauuuauaauucuauguaucuuaaggcacuuuuuaaaugcuucugacaaacugcauucuguuuuuccaaugucuauuugaucucuguuacauuaggcuuauuugucuuacucucacaucgaauuccuauauuuuuguuuauguuuucugguguucagucauuucuguaugcuugccuaguauguuucuuucauaccgucuucuucacugaaugaaaugcagaccaccuuggccacuuccuuccuucugggcuucuuuuccuauucacaacuuccgccauucacacugacccucuagcuuuacuuauaucuauugcuccugcugcuuuguugcucuaauuuucauauauauuuccuuuaugcuaauauccuuuccuuaacucuuuggauuucacugguuugucuuuccagcuuuauuuagaaaauuaggccauauaacuaauguuuacaccguagaaaggaaaaugagauucuuucuuucuuuuuuggaagugaagaggugagaagguugugguagagguuuucuuuuauuuuaaaccagauggauuuauuuuguccugcuuugcuauuucacuauuucaaauugauuuuaaaucagugaugguguuuucaaggauuaauuuuuauuaaaucuugauuuucaugucguguuaaccuuuuccuuccccucagccaaagggucuucuuccuuuuuucuguccauuucacuuguuuguuuuaauaaccugaucucuccagccauuauuuuauccucaaauccugccacuuuuauccaucuuuuuuuauugcacuguuguccuuacuucaccuuauaucuuuucuucuucuguaauuauuacagaauccaugauaccuucuccaaaauucuaacaaagaauucuggaaaaggagaaauugggaaagagaaaaauugcaaguaauguucuuugcugagcccuaggaagucugcuuggauuuuuauauucgacugauauuccucccuagaguugcagucaugauucuauguaguagggacacgaaggcaaaaguuuaaauagacuaacacugacccuuaauuggaggugauaauccuacauauaaacuuucaggagggaaagcgauccugcauuuuacaucagguaaacucaguugcacccauugccaguagcugggucagguguguagggguguguguguguguguguguguguguguguguguguguguguacguacugggagccagguuggaaguaggaagagaaggagguucuucuuuccucucccacuugcaagcuauuuucuuucuuuucugucuguuuucauuauuucuauggcaaguuuacuugccacgucuuaaacaccuucaaccuuuuugucucuuccuuuacuuuuuugcuuuacugcuaucaaagaguuaaggaaguccauuaaauuggaggccauuccucaccauaagagaaaucuggaugggaugcuuuugacaacugggcucucuuuaguagcuucucucuacuugggaaaaugucagauauuuugagaaauaaaugcauugccccaaacugaaaacaccacuuuuauucuguaaaagaggcauucagggaaggagaccuccucuauucccaggaggucacaggaacugggaguggcaagaaggaagcugcuaaacgggcuccagaugcagcuuuauccaggggacgccucaugccuggucauuuggguggcugggcuugucccaccuccccuucuucaugcccuccucccggucucauccuaggcccucccaccccuaggccagccacaggccucacagcggacaucugcgggucugaguuucauauauccagcaugaaguucccucucucccucccauuaugaauucugggcugugguccugcuugcuccuugugugucagauugaaguucugaugcugucagccaugucugaccaaucagcaaacaacaccacaggaugaaauuuaaacaaugcagaugcucagauacagggcuauguugccuggaccacgaagggaaagcagagguaaggucagagucuccccaaaguggucuauccugagccugccugacuugacaccucuugggcugcacugugcugcuuugacuuguauguuacccauuugcuuugcacuacuucugucuucccuggcauucaccagaacuuucauuuuaauucgcucugcccggguuacuuuaccaccuucaucugcucacguccuuuucuuuuggauuggugcugacugucauuacgaauguuccuggauugccucguggccgaggguccuuggcaagugccaccuuguucaggucuuuuguggccagacuuuuaggaauagaggacugcugaggaucagggcaaacggacggaguuaauaggccuuauuaauuuucccucugcaggacaguggaauuuaucauucgguuacaaccacgguuuuguuucuuaccauugugauguauugaauuguaaauugagcuuaaaucaucuuuuuuucucagaaacgguuuacuuagaaaagauauaaauagauacaaccuaaacgaggaugaaucagcucaucuuccaagaguuuuggagggggagaaagggaauugauaacucucccccacccgaauccccccccacuuuuuuuuuuuuuuuuuuuuuuuuacaguuuuugguguuagcucacuagauuacuguuugcaaaagaagaaucucaucaucauccucuucuguuuuaaguguuuacuuggcccuuuuauaauuuaaaguguuuacacgguucugugcucccuaggcccaucuggaaaauauuuaaacuucauaagaucuauaagacuagaauaucacauauaaugggauagggggaaggaagaaaaauuagagccguugcguguguuuagaauaaguuaguuguuuguucagaagcggcugcuggaggaauuggaacaaauagcugugugcggugaacgauuggguccagagcuguacauuucaccacagaaugagccuugguuugugaaacugacauucuguugugacuucuaaauccaaacaaaucucugcaaauuucugcccgaucgaguuaauaagaaaauauauacaugcagaggcgagagccguaugcuacuuguacuucugucaguguugguggaaauaagagacggauuuuaccuacuguauuacauucaaccagcaauuggcagaacccccagcucagcggguuuucuugacuuuuuuuucugcugugagaacaaugggaugcaaaagggcuucagaaaaggagagcagcagauacgggauuggggucacuuuucuucuaauugccuuguaauuggggagugguuuccacuuucccacuaucucacuggugggaggggaggaagacagauguggcuuagcgguaacgagcuuucuccaggccggaugugcugagggaccaggggggucauucccugcucugggccugugaucugcuucacaccugugcucauuuucccccaugaucgaugaccuuguauuaacccagagugaccuuuugccuucgccuguucucugggacgagcucuuggcuaguggacccuccuuucucucugauuuacaggugguuacuggagccacauacacuuguuuuucauggugcacugugcacuuagcagcccggcaagaccugcaauuucaucccucucaaggggccaagcaggggauuggaaggugggagggaggagggugccgcgagagugguugcuguuugcaugugcuuuucuauuuuguggcucauaugguaucaauuaccauuugauggcaacgccaggccugaggcccuucgcauguuuguccugugagaaagaucuggaagaaccgacauaugguuuugauugcagcaauugcagguugauagaaugaacgcaggggugagguggguggguuuuccuuccggcccuuuccacucuggguugcuaaugugcuucgcuuguggaacuggucuuuucaucauccagccccucccccacuuaccccucccccacccccaacucccugccacuuugcauucccugccccugccuuccaaaugaccgccaggaacauguggcccacauuaaggaccuucaauuaaaacaaacaaaaaauuguccacucuucuguucagucccagagcaggucaguccaucaagaugguuggaaguguaccacaguuaagaaacaaaugguuggcauagggggcagauucccuccagaagcuugggacauguuuuaaaauggcuguuaguucagauuguuaaacaucgaaaugaugcugaaaaauagcagcaauagagauuaaugugggguguguguguguguguguguguguguauaucuguauguguguguauuucauuuaagacaccucuuggaaucugugcaucugcugcauagggacaggaagaugaugauaauggauaggaguucuuugggguuccaucuuucuguacaucccaggccauaagaugauggaaaagcaagugaggcaugugugucucuaugagcauuucccuucagaaggaagauguuggagacucaucucccaugcacagugacuucucucuuacuaaauuugugaugguaggggguacuccucauuacuguggcucagcagggauugcaucugugaauaugccaagggagggucuacuauuggggaauggugagaggcaaagaggagaaaagaacauuauaggcacuuugaauguuacccagcaacauuuuuuuuguuguuucaaaguaacaucuuucuauaaugcuuucaaauuuaccugucugguaaucuguucuaagaugggcagcccaugagguuuugacuuuuuucacuuuggcuauugcauuucaaaauauuacucacaauuaggaauuuauaccauuugaaacaauaaugugguaucucaugaguaaaugcugccauuaacaucuuccuucuuuuaaacugaaaacaagcaaaccagacccaaaaaaaaaaaaaaaaaagcagaaacaugcucccccaagaaagcuuguuuuuuucuuugagauggagucucgcucuguugcccagguuggagugcaauggugcgaucucgacucacugcaaccuccaccucccagguucaagcgauucuccugucucagccucccaaguagcuaggauuacagguguccaccaccacaccuggcuaauuuuuuguauuuuuaguagagaugagguuucaccauguuggccaggcugguuucaaacuccugaccucaagugauccgcccaccucggccucccaaagugcugggauuauaggcgugagccaccacaccuggccaagaaaguuuuuuaaaugugagaugaauuuuuaguuuugaaggccagcuauugaaaccuaaucacacugcuugacauacuucuucauauuuaucuuuauauuagagcugaucuuuaucaaaagguaguagaaacuaaaaaacuuaaguuauugaccuaaauuguagggaaaugucugucugaucgacucuagagagaaaauuggccguaucuuuauaaugguuacugaauguauaucuucaugaggcuacaguuuuuuuuucuuugcuccaacuuucuccuuaugauguagagauugguguauuaaauaaucacuuuuucaacagucuugaugacaauuuuauuuugcuauuucauaaucuucauacaaugggauaaguguuuucagagauacguuugaauucagagcaacuggcaauuaagugauuugcucuagucacauguuuuaguaguagcuauuugguuauuugccugauauuuaaugcacacauauguacccuuaaaucaucauucagugugauagcuuaagacaacauuucuguuugcugcucaugccacuauuagcuacguuugaagagugauauacugagaaguuuaauuugcugggguuuuuuucuaaaaacauugcuuuccugaaauauauaguauugggggcucauagcaaaaaaaccguaguauauggguugugagccugucuucgaacauggugggucacuuaacagcagcugugcuggagagauauuugauuugagaagacuguuuugaaucuucucagcccuaacaccauucugguuuugaaaugggaaaauggaaaagaguuuuagggaauagagauaucucagccuugaaaggaagcauagguagaaaucuuucaguucucacucagaugaaccagcauuccuaaucuggcuacccucacagaggacaaagagucugcugggaaauguggguuuauauuuguagagacacacuucagaggcaugagauaguguuagauaccgacuggaugcuucgugcccaacaucaauuugguuugcagauugaaauuuaggaaagcuugcagaggagccaaucuuuuuuauauacagcaccuuuaaaaaaaagacuguccacuacuauuaaaaucugauucagucuucuaaaauauuacuacauucaagacaacuuuuaaaaugaucaaauuuagauagacaucaaugauguuaaaagauaaaagcccuccuacauguaauauauagugucuuaaaccuuauuuuuuaaaaaagggauaccacuuuugccaaaaguuucaauguagggauacucaaacuguccuuggaaguccuaaaaauugcuaguuuuuuuuuuguuugcuucuuuuuuuguuguuuuuguuuuuuguuuguaguuauucacaaauggagaaauauuuauaaaauuauauuauaauuuguaaugcacgcaaacaaccaucagaccacacuugaaucagagaguuacaguuauaaauugaggaaagaggaugccagcacaaugccuaauggagugaaaaauugugcuuauuuucacaggacucucuuggagaggagcuaacuacuuuccucucucuuaauacccagacccucucccucagcccugacagcacguuacagaaugcauucacuuagugugugaagagcuagcucaccaccucccuuuaagaucuauucuuguuauucauacauugcaaauuuguacuuuuguauccacaaggaagacauuacuaacuucaagaaaggcagugucaaugaggagcaggaaaauacaguaugauacaagccugccaaugaaagaauuauacucagacucuaugcgcucuguuaaacaaaauuugaaccuuugaggaaaaaauauuggggauucugaugaguguuuuuacucuuucuuuccuuuuuuuuuuuuuuucuauuuggaaaucauggcuuccugauccuaagggauaaaaaaaaaaaaaaaaaaaaaaaccucaaagaaaagacucaacaggcuuucuggacaucaaauaguuccuacaaaacaacauucugaugacuugcauguaaagaaaucagaaacauaugaauuaagcuucucucgaaauacauauggguugaaaaauagagagaagugcugagaaaauguguuuuggguuuugcugagcccaugacguuugaaaaauaguaugagacauugaacaaacacaaagcauggcuuggcucacccauuccuaauauuagccuucuaguucaacggcaaaucaguuuaccaugugccuaaaugugagccaccuuggugcacucccccacacuuaauuauaugcaguuuaaauuuuuucaauuaggagcucaaaaauaacauugcauuucaaggaaaugcaaaucuuagcauuuucuuaccugguuuguucaccucagaccauuuuagaaaacaccacagauuauuucaccuuaggagcagucacacugauguggcccucuuugauguggcuggcauauaacagaagaaacguaucauuuuuaagaaacuggcuccaaagacaauauugcuauuaaauugaagccaaaaaccacugcagguaaaacaugaugaagaugaaggacgcccucucuuagccauauaguagaagcccgaucauagacucucacccuuacaccaugacuugaguuccugcucauuuuuaucccugagcucugcagacuucuaagcaguggaaguuuucauucucuuucccacauugcacucaagagagcuaacaugagagauucuaaauccugggauuccucugcaucuggcuuuaaguacaggagcagaacacagggaauuuaaggaacaaaaauagccagagcuucaggcuucuuccacugaugguaagucauugacaugcacuuggaugaaauccuguaucuguucuuuggacuagcacuaucgccugagauuaucaguuucagagaguuacagagaggcaguagauuucaucuuuccuauuucaggaggaguuauuuugguuguuuaaaaaaaaaaaaaacacuuuaauguacuuuuccuaacuccuucacucagaugguggcaagaaguuugacagaauaaaguaauucagcuaauauuuaucaaaugccuacuaugagugagcuguuagaauauaacccugaacaagacaagcaugagauaggcaaacagacuauuaaaaccuagacugauaaugcauugauugggguguacaggcuccuuaagguagauauacaaaggacaacuaguccacauuuggccuuagaggaagugaagugcaaggaugaaugggaauuaagcuggcaaaaugcaaggguuauaacuggaagcaggggugagcauggcauauccggugacccagaaguaguucagaaugccagaagcuuaugguacaaaaggauaacauaaaagaugagacugaaaagguaaacaguggccugaucaaaaagcgacuugugagcccuauuaaggaguugagauuuuaucaugaaugugacgaggagccuuucaaauggguaugccugagaaguaauugaauuuaaaagucaagacggauaggaggaccuggaaaacuuagagucagagaagccaagggaggcagaucugaccagaaggaggaaauugucaacagugucagauguugcugaaagauagaagugacauuuggcugcagcauccaggaggucuugagcaguuucauugaaguagugaguguggaaggaagguaaagaaguggagaacaggcauugcaagauaauuuuccaucaucgucaucaucaucguccucaucaccggaaaaugagcaucaauuaucuuaucuaccagacauagagagugaccagguaaggaaugacacaccugcagccugggagauuucagaaaacagaucauaaauauaaaacagaagacagcaacacaugguacaacacaugcaaagggcaaaaugagcaguguaggccaacgggaugaagaacagaaagaauuagggggcaggugaaaugggagaguuuuucaagcagucagugcgcuugagguuugcauucuggauugugccuccuuauaagucaguccaaccuguuuuugauucuccauccaguggaaauaggaaacaccaucaaagaugaugcauagucuuaacuugccugugacuucugauuauguuuccgaauuuugggaggaagauuaaagucauaaacugacucuugguuuguuauaauuucuugcaacuguuauuuuaaaaauccggacacaggccaaggcaggaggauucucugaggccaggaguuugagaccagccugggcaacauagugagacccugucccuacaauaauaaaaguaaaauaaaaagaaaaucuggaugcagaaacugagguguagauaaauauagcaagucagagauauucguaaauucuacaucgaugaguuucuugagaaauucugcacacccagugcuggacaacuguggaauugcagcgugauaccuuucacaucugggucaucuccauaugauaucuucuuccugguacaaggccagaaguucaccccacgcacaacaccuauggaagccacuuacgauucaaaggacaguuuuucugaaaaagggugcaugauguauacuucccuucaacacuaaaauucugcugcuuaaacuuuguaagugaaggaaaggacugguucucuucuacuuuggcugucuuccuuguuuccuauuuauugggugcuugcuuugggcaacccauuguauuggaugugcucuaaaccacaaucuuugcuccuaaggaguccguaguauuuaucgggggauacgaccuggauaauucauauaagauaugaauuucuuucuuuuucuuuuuuuucuuuuuuuuugagacagauucucacucugucgcccaggcuggagugcaguggcgcgaucacggcucacugcaaccuccgucuccuggguucaagcaauucucaugccucagccccccaaguagcugggauuacaggcacccaccaccauacucagcuaauuuuuguauuuuuaguagagauggaguuucaccguguuggccaggcuggucuugaauuccugaccucaagugauccgcccaccucggccucccaaaguccugggauuacaggcgugaaccacaaugccuggccaagauaugaauucuaaaaaaaaaaaaaaaaaaaaaaaaaaaaaaaaguccuuggaaaguuuagaagaugaaauacauuuaaugaaaauugagcucauucuuccccaauauuuguuccauauuccucuccauauuauacuauuaguacacaauccuguuuggacuuacuggaaaaaagagcugaauagcuuauccacaugucaagaaacuuucuguuuaagaacacugagguucaucaacaucaaaaaauauuuucagcaucauucaggcacuggacaugcucuacaaauuaaauaccuuagggccccuacuauuucaguguuuucucagugucuuguugcaguggcaaaugcuaugaacuacauuuuucaaaugaauauugaagauugagaaagagguuaagaaccucuaucuauuaacgauagaaccaaaucuagaaagaugucuccugcucuguagagcacauuagggaucauuauuuauagccauuuggcucucuuaagacauuuuggcaaugagggaaaaaucauagguugauuuucuugguggaaugaagaacauugaguuugcuaacaaagagagcaugagugacuuugguaagagagcaguuuuuauuucaguggaaaggcagccuccucuccuaauaauagcuacauuauuuaccuaaauguuccauguagcaacugauaacaaggcuuacugcuuaagaaauuuggccaucaucuuguccucucuacuagaauuccaucugccuacagaugggcccuugcuaauauuuuuuuucugaaggacaacauguaacuuaagggcccacuacuguguguuauuuuguuuuuuuaauugaggugaaagucacauaauguaaaauuaaccauuuugaaguaaaccauucaguaauauuuaguacauucacaauguugagcagucaccacaucugucuaguucuaaaacauuuuccccagcccagaaggaaacucuguauccauuaagcaguuccuuccuaucccccuacuucuaggcuuuauaaaccuuuaauuuuaauguuauauacacacacaggcauacacauacauauaugcuauacacacauauguauguauauauguauaauguguguaaauaauguguaaauauagacguauaaagauguauaauguggguaaauaaauggauguguguauguguauauacauauauguacauguauacauauauacguauauauguauacauauauguaucuacgcacauguauauacguguauacacacacacacacacauucaugucuauuuauagauuaggaaguuccaaacagaggaccuaauauuuccuaauuauguaaacaaagaacuaucuacuuuaaugaauguuucuccaccaggaaaaagaaaaauaggaaacauuccuugcuucuuuuaaccugucuguauauuucucuuaaauucucacuagaugcuaauuuaucaaggaagacaaaaaagacagaaauaauccugagccuuuuguuguguaaaacugcugcucuucuuguaaagacauuuucucauuaauuucaucaacacugagaauuuuaaacugcuucucaauuuuaagcaauuguauggguuuuacauuucuauuuuugaaaauccaaaauuauugaacaaaguaauuuaguuagcaaaguuuacauuucuuggaaagaaauaugaaagggucauucuuacuauaauuuuuauuguuaaagaaauugcuguuguucacauguauuuaugcccuccucauuccggaagaauauuugagguagccaguagcacauuuuuuugaauuaagaaaaaauuagaucaaaugaaaaaauaccuaaaauuuaaauauuuagagaaagccaacucaauuauauuuuaaauaugccugaagucgugaacuaacuaauguugaucauuuagucuucugguccuaucucaggaauauuauugcccuucuuaauucaucuuucaccuccuuuaagaaguauuucugaauaacccuauaggauaacuuccuuuacauuucuuuagcucauaugguuuauacaaaaggcuacucacuuuaucacauuuucuaguugcuuauuguacuucauaaaucucccaacuaguuccuagugaaaauucugcccuucuaauuuuuuguauguaauuuaccaaagcaccuagcuuugugcuagcuaaaagcucugcucugaguuaaauuagugaaauauugcugguugauuucaccuaaaaguuugccccgggcaggagggaagagggugggcauuugaauggguaacagacagagaagcagcugauuggacauagauguugacaacuugcauacuuauuuuuuucauuucaaucugugccacagagucauacauuugguaauuauuucaugcuuuuguuuucaguugaaaguaguuagggccauauguuuugacagaaaaaagauaauucguacuuuuuuucagcuuuaugaaagggaagaugggguaacaauuuuacaguguaccauggcagugauuccuguucaaaacuuuaccagauuggaaacucacuguucauaacaauucucuugguaagcagaagaugaaggcaucuguuuaaagcacccagaguuaaguuugaugcuucaaagcacagcagaguucauuuauaacucuacuuagcacuauuagauaucuuuaacaaauaugaaaaguuguccaccagauuccuuagacuguaggugauuuggaaggauauucuggucaagugcuaacuucugacugaggauuucaaaugaaaagaccuagguuauaaccccauuccugcccuuacucugucuugugacucauggaaaaggaaggcacuuaacccgcuccaagcuuauguuccugaauguauaagauggguagcaugguugaccacuuagacagauaauccaucucaaaaugaugauuaaagaagauaauggaugagaaaaguccuuuugauuuaaaauacuaugaagaugugaacuuuuaauaaugacuaaugauagaauuuugucaaauuugcuuuacguaauuaaguucaagaucaaagaauauaucuagagaaguaccuauguauuuugugaaauguuucuuugaguauuauuauuaucauuuuaugucuguuagaaucuuggccucacugucuuuucauucuugcuugaaugucgacucuucaaagugugacuuucugcuugugucugaugcaacuuucuuccugaucgcucuugcuuccugagaaggaauagguacuuaggaaugauggcuuuuuggcugucugugcuuauuagguacaaacacagcacuaaagacauuugggacuggagaaauaagaagagcgccuuuaggguuguaugcaaaaggucaaacuauaauguaguuagcauuuuucuuuguacugcuuucccuucuuguaacaaccucucaauacccucauaccuucucugcuuuccagaaaugcuuucuaaaaauugauuauugggaaaagaucugagaccucauugcccugaaguguaauuacugcugacaaacugugacagcauuucccaaagacagggagugauuggagaugugaugaaaaguggguuugugacuguggaaacucuuucagggauguaggcuuuuaccccucuugguaauguaccuugacaaaagucugcagcaaugaaauuaacuuguucacuccaaucgcaucuaaaguuauuugagcuuaaguccuuucuuaaggaugucagcuuuaggcuucaggcaucaaccuguggacuagaauucaaagggaaaaggguagggaauggugcucuuaaaaucuuuaggaccauuauagguaauuccauauccuaaagaaagcucagcccuaaacacauuagagaaguggaaugcacuaaaauauauuuuggcagaaccaaugaauguuuaucuuucucuguguuaugauguuauucuuaguuugacguguaucccaugugugguguguuuauucauucaugcaugcaugcacuuaguaaaguuuugagccuauucugugcccggcauuacaugcacacacacauauguccaagcacaccugcacauuuuuuuuuuuuugguaaugccuuuuuuaccuuauuguuucugcaacuggcuauccuuagcaggccuucuuaauguacaauaggguauagaagaaauaacaaucaacauuggaguaaaccuaaaauuaauuucugucuuuauuguagagucauagaauuuguuuuccucuggaagaugugcugcccucauuuaauugauaaaacagugcuuucagaggucacaaagcuauuuuuuggcagauauaaccaaaccuauuuugauguuccagcaccuccuaaugaagcaguagucgucaucuaaaacaaaaagcagucgguugcuaaaggaggagaaaguguugagaugugagaugaucuguuagacauaauugacaaucaugaauuugauaugauagguguaaacagagauagaaauaauuuaguuacaucuguuuaagauuuaagauaaccagaagcaauaauguuuaauugaaauaauauaucagguucuccuuaacauuaccuugaauuucuucacaugcacaucaaugcauuugguaaauaaaaguuuggaaacaacuuaguuaaguguuuagaacauauuagaguugugaugugcuuagcauccgcagucuuuuaucugugccaacccugagccugguaaugaagccaacucccacaugaauaaguaacauaaggaguguaaccaggaagaagucaggguuucaccuggaccaaauuuuaggcaauuaaguguuucaagagaucuuuagccagguguaacuuaaucaguuuaaggcacucucagcuagggccaagguacucauaauguuggcagugggcauucgucugauacaccacguugaaaguaauaggaaacauagagugucugcucaguuauugccaagagcaagagaaaugcagguguaaaaauauaaagaaguauuuggagccagaggcuaguacacauagacaagacuguauuuacacuuggcuuuaauaguucagauaauaacauggugguuuuuaaucaguuuagugugcugauauuuagucgugggucugguuucaccacuaaacccuaguguaacucucagccgguuacuuagccucucucugucucuaguaauauuaaacaaguguauuaauaccugcugcaucuuagcucaacuucaugucuggaagacagaugaaugguccugcuucuugcaguaacacacaagaaccuccuuugugcugcccugacugagaugaucuuguguucuucucuacgggcaaaacagcccuaggcugcuaaauggccaggcaguauaggggacuuaggacucuacaaagcuggguuuugguaggaguccaugagcaccgcggagagaauucuuaguuaucaggagauacgguuguaguacuuaaaaacucaaacuccaaaacaagacuacgugguuuugaaucucaguuuugccaguuuauuagcugugugacuuuaagcaaguugcuuaaccucucugugccucagaucccuuagccauaaaauugggaugaucaugcaacaauaggauuaguauguaagcaaaaugaguauauguacaguuuggcugcaauagagcugauagguguaaacagauauaaauaaugacuucuuuucugaaaaugacuucuuuucuguuuuucucguuggugaucccugcuuaugucacugggauggcugcgggaauucaguaggauaauauuggaaaauagcuuaaaucucaaauguucuauagcuaugauaacaucacuaugacgucauagcagagugaguccacucacaucucuccuggcaguuuugcugccucagaguuggaauaauaacucacugaaaauacuuccaaaauagugagccacucugcagauuuaauuuguaauauuauucuuucuaauuauuaguggcucugucuuaaguuccuuuguuuuaauugaagcaggguuuuuuuucccccuuguaaauuucuauacaugucaaaggcuaccaacucauuuuuauuuagaguuugaaauuugauuugaaaaauauacugcagccagcuauaugaaaaacauaagaggauauuguugacuuuugaugaagggaagaaagaacaagguagagcugccuagccaugaagaacgccaggguuuuuguaaccccuggugugcuuugcacgcagaaggcacacacuuaaauuggcauggcucacuuuuuuuacugugccuuugcugagcuugcugcaggcugagugcacugguagaggagugcagggcuguguucuggccaucccugccugcucaggccucuccugcuccuuuguggaucgcccaggucucugcugcuuccuggugccgucuccuggauccucuugacauuuuuccguucuguaauuugauugacaguuacagacaaggaaggggacugaaauucuuaccguuuugugacuuccuaaaacgggaaaggaaauuuggugaaugagaaggggaaaacgccucuuggcugaaauuauuuacaggauuuagccccagguuuaauguacucaugaaugaauaaugacucagcugauauuuagaagccgggaaaauuaugcgauuuuugugaugggguguauagauauggauguauacuugaagugguuuguguucuaaauauauuaacaugcucagggaauuucuuuuuggggaaauacauauauucuuuuucauagauuuuuguggugcauucugguagacggaagaugggucauugcucaguuaguaaaaaugaaauaugaauaucauacacauaagugguacauuuuacacuuuuugauaguugugaaauacucuuuuuuuuucagacuaccaauaaagagaauuugaggaguaaaacucuucuuaccaugaauuguuuuggggcacuuagaacuauuuaguuaauucuuuuaaauacuccaacugauuuagauagaauaaaagugucacaauuuuaacagcuuacaccagugaaauguuuccacuuauaagaaauacccucuuauuugucagcauacugaagacauauauguguuauuucuaagcacauuuccuauuuaugugauaauggagaucgcccuuuaaccaucacuuggacgugaaggaggauucuucuuccuccauuaguaaauauuccuugacuugauaauacugaaaauaugugaggugaaugagcuuuaauccugugguuugguuugguuuuugguuguuugcagucuuggacuguucaccugcacugucuugugccuuugaguaugauuaacugccuugacgccuuacagugcauuacacaacucuacuucuuccauuucuugacuaaucucucaugcuguuugacugcccauuggaaucuuuaaguuagcuacuuaggaaagacuuuaggaaggagaaugcuaagagaacuggcagagaagucaggagccugggcucuguccaggcccuggcguaaguccuuucaccucuuccuuugacuccuuuacaaaaugaaguugaacucauucgagcuuuaaaaagaugacgccaagaggcaagacagagggcaguagaugugaaaguaacaugaaagagaaaggaacaucugaaaaaaaaaaaaagguagaaaaagauuuugacaaauaguacuaaaaacaaagaauauagaauagagagacccaauuauacugauaauuacaauuaucaguauuguaaaaacuacagcaaaaaagcuaaaaacauauucagcuuuuauuguccauaaaaagugaucacaccaugucuaacuguaauucguuugucaaaaacacuagaggccaaggacuaaauugcggauuaagaguuucuuccuuuuauuuccugcauauccagaaaccuggggucauagauacucuuccaugguguguuguuuggcacaacuugcaaguauuuuggcagaugguuagaaaaaaagacuuuaagaaauaugcaauaguacucaggacucuaaauauaauaaauaaagcuaagauaccaguauccugccauucauuacaaucaacauuuauugaacagcaguuauaugccagguagcagggauaccuagaacuugccccucccacuagcacuccagaagaguuccugcuuucccagccuaaagcaacagcaagucuuacaugagcuaggcuuacugugauagcuguccugacggcgaguggcaaacauggcccagugccuuccucauggaugaacaugacucuacacugggacuccccgguagaccuuuuugugaugaugagaaaguccuguguuggugauguucaguaugguaacuagugacuguaugugcuguugagaacuugaaauauggcuacugugacugagggacagaacauuuaauuuuauuuaacuuugguugaguuuaauucaaauaacuacauauuacuaauggcuacugauuggacagcagcuuucuagacccauuguuaaaaauaauuauaagcaaugaguaccucuuaugagauagaauuaauaaucccauuuauugagggcccaugacagauuaagaauuauguuugacauauauuaucccuaauccucacaagaaugguucauuugacaaauaagauaacugaaguucugagagauaaauugcuuuguuauguccucgcaaggaauugugagagcuggaauuugaaccuaauuggucagacuccagagcugggugauuucuaguaaucugccaaaucuguguauguacuguccggaugcugugucuucugaguacaucuucuccuugcuuuauggauuaguuagcaaugucuuuaucuuggucacauaggacaguuacaggguccaucuuaucucuucugaauauggacguaucacugcacuggaaccauucauuuuucuuacugaggccuauguccuucaaaaaauauuaagaguugaggguccaacccagcuucuugaguaguaagcuaaucaccuacaaguauauuuccccaguagaugcugagagaagcaucaaaguacauggguaguucuguggacaucaguggcacucaguaaacucuuggcauuugaguguuuaacugucacaguugaggauaucugugaacucucccaaggccugagucacugaaugagcccagccaguacuugggcgucuguggcuccauucugcuuugcuguuuucugcuuuccauggaacauacaguaacucucuugaagggucugaaagccucaauuacaacguuucagugauucugaacugauuuuucuuuggaaaguauauaugcagaugguacuugcagaaucaccaggggguaguaacguggaggagugguaaaggucuacuggacaaucagguggcuaccacccaaccacacauggugaugugauaugaagccacuuuucuuuauuccuucagauuuaagguuuccccuucaggaagcagguuacuuaacaaguacuugauuucaccauaacaugcauuaugacauuaucuuuuuuucuuuuuucuuuuuuuuuuuugagacggaaucuugcccugucgcccaggcuggagugcaauggcacgaucucggcucacugcaaccuccuucucccagguucaagcaauucuccugccucagccuccugaguagcugggauuacaggugcaugccgccacaccuggcuaauuuuuuguaucuuugguggagaugggguuucaccauguuggccaggcuggucucgaacuccugacuucguuauccacccaccucaaccucccaaagugcugggauuacacgcaugagccaccguuccuggccgauauuuuauuuucuuaaaaggucauuaucagaugccacaagaguauuucuauaaacuaugacccaaguauagccuaauguuaauagcuuaaaauagguuuuauuuaccuuuuuugcccuuuaaaagcaaggaauuauuuuuuaauggaaagaacauagacuuugaugaucaguucacauccuugcuuuaccccuugaaaaaugugcaaccuggaaagacagcuuaacauuccugagucacauuuguccaaauaauacaaacaauggcaacaagacuucagcacuaaugucugauguuuuuuguaugauuaaucugugccagguuccauucuaguuucuuuacacacauuauaccaucuaauucucacaacaacuuugcauagcaggcauugucauuuccacuuuacaagcaggaaucugaggaccagaguuaaaaguaacugguccaagauugccuaguuaauaaaugguggaauuugcagucagacccaagcugguuugggccaauacacuugaccuucuuaugauacgucagccuugugaaauagggcagauacuauuaauaauauccaccuugugugaucauuaugaagguuagauauaauguauguggaacucuugccaccaaagugguuccacaagaggcccuaaacaaaugaguaaucauuauuauuuuaaaauguccguaagugaaaccgauaugccaagaccaguaaaaaugagagcuucuuaaggaaaagaguaggaggcauaccuuuguuucauuuuguuuguugguuucugugcuugcuuuuuguucuuuucuguuaggcacagguuuuauuuagaauaaauuaaauuuuuuuuucuuugaugagugcagaaauaauaguuggaaacauugaauggaacagcuaauguaccauaguaauacuucuuggauuaccaaaaaaaaaaaaaauuaaaucuguaaaaugaaaacauuuuuguuuacuuuggucaguucaagguucaguguuaucuagagauuuuuguuaaacucaggauuucuauauguaugauugucugcuaaauucagaauuagaagagaagagauaauggcgcuaacuuugcauguuaaauauacuguguuacuaguuuuccaugaaguuuuuacucaacaaauagguuacuaaaagagcugugaccuaugaguuucaccaagucuuuccauuuccaauucggcaacaaaaguuucacacuucucaauuacucuugugggaggaaucagaaugccaacagucaccuugaucuaagcguauuauuggagaaaaauucaaggauagauauuuguuucucauuagauuuuccucauauuuuaucauuggggucacucuaguacaugguacuagaauuugggauuuuuauuucauuuuagauuggacugauuuucugguguuagucauuaaaaauaauuccaacucuuugaagagaucugggauguuuguuauuauucuauugauuaaauaaagcuauuuuauuuaacaauuguguuguuaaacuuucuauauacuuagaauaauaauacuaaaaacugaauggguaugagcuuuucuuauugaauuuaaugucaguauuaaauaccuuauugaaacccauacuuugaaagcuugauugagaaauuggcaaaagaguugacugaaguaaaaguaaugaagcaguucacuggucauccagguuaugaaaaauuaaaccauuagagauaaacugaacugugaaaauuaugaucaugguguuuucauaaauaccaucuaugucuccgccaccauucuaaaaaaaaguacccuaucaaauggugaaaaauaagagugauguuucugugaccauuucauuauucaguuuucuuauauuugaaaugugggagguugaacuaaaauuuguugguucccuucuuuaaaaaaguauaguuauaugugauauuuauuuauuuauauaaacaaaaauauagagaucuuaccuugaaaauaacuuuugagguaagaaugauaaaguaucuaaauggaagaugaauaacauuguaucugauuuguaaauuaugauauaaagaaaauguauaaaauauguagaaauugucuguauaaaaaacuauaaacagugguccguugccuauuaacaaagaguuucauguuaucuaaaaagucuucaauuggcuaaaacagcagaaaaauagaaauuacauacuauaauauauccuaaaaacauuucaauuccauagauacucuucuccaugcagccaauauuuaugaauuuggaguaagugaccuacucuuagauauuugagcuugauuauaauucauagucaaaguagccuccuuguaaauaaccaaaauuaaccaaagauuuuuccuuaucuuccaaaagcaaugccaaguaauucuauccaaauuggaaaaaaaaaaagaaaaaggauaaaccuuauuaggugucaucaaaugguguugacauaaugauauauauguuuaaggauaauguaauagaauauguaauuaaaauuaaaguauauaugaaaagaauugauuuuaauuguuuuaaaacauaagaugauuuaauaauaugggucggagauucuuuuuaguuuuauaauaaauauauugauuucugaaauuuggguauauuccauaguacacuuagcuuauguuaauacugaggccagauugcugucaggcuaauagcguguagauauauuauagucacacuacaaucauuccgucaguuuucaguuucccuuuuuccugugauguuucuuucaucuuguuagauuauucucaagaccuucucuaaauaccuucaguaguaauucacaaacucuuuguuaguuaauaguucucaagaaaauucugagaugugguugacagaacuuagaucauugguuuguuuuuggauuccuagccaaaguuuuauucuuuguuucuuaaaaauacucaaaaaaguuuuuuuuccuuauuguaagcccucuggaaauagaagcaaaucacuguuuauacauuuaaaaugugaugaaaauuacaaaauaaaguccagugaaauauagggcuuguauccauuagugccuuaagaaaaaucccuguuuucugaagugcgagugggcuuuucugguuuguuuuuguuuuguuaaagcuccaggaccucccaauuuucaagggcacuuuggggcauguguagcauuuauuugauguauggauguagaugcauauuuucccacaucugucucuguggaccuauccuuugugaaauccuaaaccuuguauuaaugcuuaguuuaugauucaugguguucugagagcaauuauauaauuuuucugggguguuuauucgaugugcacuguaaaaaaaaaugagaguuauuuuuugguaacccugcacuugccuuuuuauuggugaauuucuuuuccuuuuacugugaccugugaauaucacuguaggcucacugccaauuuugugagccgcugccugcuucaaaauggaggcaggaagguauccauuuucaucaagaggaugacaguguuucagucuuucugaccaucuggagagaggaacuuugagagcaaaagaaaauggggauuaaaaaaaauuauauuuagcagaaaaggcaagggggaaaaccaauuaaaguuaaacuauaccuuaugaauuugugcuuuucuacuaugcuguccuguuuaaaaaaaacauaaacaagaaaauacacaggcuauuuguauaaagaauugguuucccaagucucaugaguauuaguaaaugaauguaaguaaauuagguuuuuggcacacuuuuuaaguuuauuguacacacaaauauaauaagcaugaaaaaggagggcucccuccucccgcuuccuaugcacacacugauuguugguggucuuauguagauccaggcuuuuaauggccuuuuucaugcaucucugcaaaaagcugacacuaugggaauuuaauauucuaagauauauuuaucacuuucugugguuuggauaguucauuuguguucucucugucuccccccucccuaccuccucucuguaaaagugaaaauuuuaauugaaagguagaguuuuuacucuaccauuugaaagagguuugaugcaugucuuucuguuuuuaccauuuucacaugcuuaugggccaucuguguuuagaagaaaaagaaagaagugcuuagacucacaggauuacccuaugggcauuauacaguguauuuacaacuagacaugguuuacaucaacuggaauauaacacaccugguuauuuucuguucgcacaaauacaccgagcuuuuguuucguuuuguuguguuuguuuuaguguguucggaaagggcacuguuucuaggguuuguucagauuuaaacuggaaaggguagaaauguagcacuuucugccuacuucuuauauaagaauggagcuugggcugcuguggucaaugcaaaaagcaaaacucaguugguucuuucuccucaggucuaugcuccaucagcaagcacugccgacuacaauagggacucgccaggcuauccuuccuccaaaccagcaaccagcacuuucccuagcuccuucuucaugcaagguaagaugcugcugcuucugagggaaaggccacuggauagcauuuuccugggucacuuaaugucacagauggggcagaagaaauggaauaguaggcaaguguagaauuuuugaagucaugcucuucuuaggaauugaauuccuuaaaaauugauguauuaauuaaaacuguacuaagucuuucuuuacaauuaaaccccuuuaagcaguaauggguuaagauuagauugaucugcuucacuuagagccgaugcuuaugauggucuuccacucaugaccaaccauuucagcaucuucaccauccccaagacgauguagcuguuuguuuagaagugguucagcuccauguauguuuugaacauccuggauuuagccaacugggaacaaguuggccuaauguauaaccuuauguaaaauuuucacccacuuacuaauuuguagguaagaacaaggguccaagaugaaguaaccuaccacagacuggaauauuacauggugaaagcucugucccaacauaguaacugguuuaggauaaaaggcccaacuuuugggggagaagacaaauauaggaaauuauggaauuguccaguauguuuaaauacauggaugugugcccccacccugagcuuguagucuugcuacugauagcguauaccuuucugcugcucaaaaaagaccaagauguggccgagugcgguggcucacgccuguaaucccaacacuugggaggccaaggcaggcaaaucacaaggucaggauaucaagaccauccuggccaauauggugaaacccugucuguacuaaaaauacaaaaaauuagccaggcgugguggugggcaccuguagucccagcuacucgggaggcugaggcagaagaauggcaugaaccugggaggcagagcuuacagugagcugagauugcaccacugcacuccagccugggcaacagagcgagacuccaucucaaaauaaauaaauaaauaaauaaacaaacaaauaaauaaaugaauuuuuuaaaaagaccaagauguuugaaaugauagcagcuacuucaagaaugaaccacuuggaggaugccccuaagggcuccauccugauauguguguggcacuuauuuucuaauguaauuaucuuguuaccaaguuaaugcccugaauuuagauguggaauuuaccaagaaccccugugugcaaaauguuaacucuuuuugcccaggugugaaaaccuuauuuguauaagccuugucuacgggccaugggguuuccuucuuuaugcaucucuaggaagggccaugucacaggaaggggagcacauuuggggcaaagaguaccagggaagcagccugauauaguggacacacucaaaaucauucucauuaaaagauacuaaucuuccuucccuucaguguguuagcucuuuuaguuuguuaguucacgugugaaauuccauggaaaucuauaaaauuggauggaauggcucuguuaggaauagagagaauuuguuccacgcauaauagagcccgugugucagaaguccuuuaacuuugugacccguccuagguguaacucaaagggacacagcaggcuaugucaccugggugcguuuugugccgugacaaaaagcuaaucaccuucaguuauaaacaguagcuaccucagcaucaguccccuguuuugugagcagugggagauauuguccuacaggagcuuacagagauuggcaacucaaggauccaucacucaaaacagauuucgauugaaaacauugacggaaggauauauuuuuucuaucugcccaggaaaguggcuuucuggaagggugcacauugcaggagaggccagguagauuauaucaguaggcuccuuucccuagcagaccacacaaaauauggggaacaaauuuguuuaucugcauaugcauacccgaaaagcaaaaaaaaaaaaaaaaaauugaguugacauuuuugaugagcacaauuaauuugcacacaucuaauucuauucuuucuuucaaaagaacauuaugccaagaucaugggaugugauaaauauuaauuuacugugaaaagcauaauuuauguaaaauauguauuuuuauaagucugcaucaagcagaguacucuguguuaacaguccuaaacgcauugccacccaggguaucacauugucaggagacucuuguuuagugauauauguuuucaauuuauuugucauaugugccaucuauuuaaaauguuagugaucuugaacuucauauuugaauuuaaggugacauuuaaaccucuguaaucuaaggacuaaagcucaaguacaugaaugauaacuuuaaaaaaaaucauguguuuucacaugauggccacagaaacaguugcaucaugguccugucccacaucagcuuccuuucaguagagggguacuuggugcccugagaauucaagacuugaaggaauaugcaauuaaggugaaagauguucagaaacugucuggggcauauuguaaacucacuacuguggccucuuauuuguaacuucaauuuccaucuucuaguuaaaacucugaaguugucaaaaucacagacaugauuuugcuugcaugguucuuaaagagaggaaucugcaaacuauuccucccaauaugaaaugaguccaguuacaaaauucuaacuuccggauuuaagaacucaaugaaaaagagcuucacgaaauacagugucagauuuaacuuuucuauugccuaacuuuuuaauaggccuuuacuauauaaaauguuauggugaaaauaaucuuauuuucaaggaagcaauaucugcuauacauuuaacagccagcugauggccuaguguauaccuaguacucaauacuuuuuguuaaacuauugaaacaaagaaaaaaugaaugaauuuagcaguaauguagaucaucuuuucccuuaggcuugggaaaccaaaccuaaacauuagcaaucauuaauaauaaccuguaggccaauaggcccagagaaugaaaaaauccguagggauguuuuuaauaagaauguuaacaaaagguuaaccuuauguugaaagauacuuuauauaauuuuaaaccucuauaauucauaaaucguuuuauaaaauccagagacucucaaaaauaucuguaauauaauagcuaccuagggcauguuuguacccuuuggauugcuacugaagguuuaagauagcuauauaccuauacaccaaaaaauaaaaauaaaauauccuaagaacuauauauuugagauucaucuucucugcaugccguaauauaauuauaauuccaacuuuaauucuauuuauuguauauguuaaaaaugaaauuaaacauuuucaaucugagauuuuuuaaaauuaauacuucuuuacaugcuuuuaaaacuugucaacuuuguaauuucucaaguacuuuucaccccaaaguuuaggaacaauuuaacuuuuuaguugguuuucauagaaaaaacaguuagaagacuucuaagaaauguuuccuuuagcaguaauuaccuugcgacuugacauaauucaugguagaaauauacucuguuguucuuuuacaguucaauuuuuaccaagaacacuuuaacuuuuuuaaguguuuauauuuguuugacaauauagagccacuugggaagaaaugaugacugucuucugauguaaucagcuaaccaacacaaagaugaauaacacaacaggcagucauuuucaaguauaugaaaaaacccuauucuauaaggcaaggcugaaugccucagaaagucaugguugucuuuguccuuuacagauggccaucacagcagugacccuuggagcuccuccagugggaugaaucagccuggcuaugcaggaauguugggcaacucuucucauauuccacaguccagcagcuacuguagccugcauccacaugaacguuugguaaggcagacauacacgguaacgggaaugucacagcuaguugauuaaaccucguccucugucuuuccaugcauauacacaaggacucugcaaauaagugcaaaaauggcacacacccauuauucuuaaguuguauuguuucugugaucaaagacauaacagguucaaaucaccuuuguaaauucuuccagauucucucuggcauuguucuuuuguuuauuguguuuugcucugugccuucuuuaucacaaugucagcuuccuuggguacauaaauagauaccuauuuaaguuguagaaucuuaacauggugguuccugguuuuuuuuuuuuuuuuuuuuuuucuaucuguaguuucaaaagauguacugcagagggcagagugacagucgguagauuauaugcaucacccaggagcauuucauuucccauugacuggccuaugucagcuuuggccuguugugauguauccaaaagaaggaguuuguauuuucuguagacuuccaucaguaagagaaaccaugagguuucuacauagaucagauucccauuuuucaguauuuuaacuuuaauucccaucccagccugccacucauacuguguuuugcgucacuccaggugaaaacuggugggcucuagaauguuaggucuuucauuacuaaacauuuccacucuguccaucaccuacauucaucuaucauaguaugucucuuuauccuggaggaaacaacucagcugacuuucuucuagccuuaaauaucaccacagcccagaauccacuguugaacuuaagucugucauuaaagagaggaaagagccuagaucuugagugagauuugggaugcagauaagaugaaacuugaaucccuugugcaagaacauagcuuaaacaauauguggaccucacauccuacaaaugcgaaagcauaugggaaauccagugaucccaggugauacuuacaucacuacuauucaucuugcauuugccccuuuuucuucuucucauaucuacacuuagguuucuuucucuguucugauaaaggaaaucauucuggauucauguggucuuugcucucuuuugcucaaccaguacagauaagaaacaggaucugaucuccuacuccaauaaucaaaaaaauuccagaaguuaagauuucugauauccuugaaaauccguauuuaguugguccuagugguagagaugcuaaguagucaauuagccuauacauuccugagaggcagacaguggaaaugguauuggccuuuuuguaucaccucccaagauugaauguguaaaucacaaacuaucucacauuucagcacauuuccaguaaauagcagaugacuuauuuucaaauuuucucuuuucccaccuccuauuuggagauauuagagugaaagcuuagagaaauaucaacuauaucaacuauuauuaugcuagaauccguuuuggcuaaaauuuucauuucugcaccaucauuuuccacuucugugggaacucauggucaaaacuguauguguccuaugagcaaggaaaguuuugauuacaaauaaaaguuuuaggcacuauaccgcauguuggaauuucaguucuuuuaagaguugcccauuugacauuaauuuuucuucccuucuguguuucuuucuuucuucuccuaucaugcucaagaguuuugaguuaggcgauuugauuuuauccuaguccaguucacugcaugggaaguagcuuuaaaaugugcuuccaugcacaaaaaguauaauuucaaaauggaaaccaacuauauuccuuuuagaaaaaauuuuacagaaccaaaacaauauuaugaacuagagagaaaauaucauuuugaaguaguaacccaguaggcuauaucagaagccauauuugcaaugccauuuaccuaucacgaaacacaggauuuucauuuuucaucugaacaguuaacagauuucagagaguagaguuuuuguuuuaaaggagacaugaauaagcuaucuugcaauguauacuaaugaauuuucccacuguuagugaaacuauugaauuauuauaucuaguugucauuguacuuucaguauuuaaccaugugaaaaucuuuuacugaagugacuuagaagaaucugacacugacaauacuuugaauauauaguagcaguugguguccuuucaguugaaaauaaugguaguuccuuauaauuuuauucuuagcaucuggcuagccccauacugaacaaagggauaguuuaagaaaaagcuaagcgcuguuccuggauuauuugggguauaauuuggccaaguugauauuaucuguaaagauaaaauauuuuaaaaacaucauugccuucaucacuuuaugccauguuauaacagaauguguaauuauaaagcuuaagauccacauauuucaguagcgacugucaaguuacugauguuuagucuuuaaauccccuuuacaguuuuagccuguccaacagaaucccacagcuaaucauuacuguguuacacauacccacacaaaaucacucagaugaauggaguuugcgguuaaaguuuggaauggguuguuguagaugauuuuauguuuggaaugacuuggcagaguucuuuuuaagaacaggauagaguccucacugucuggcaugauuuaggcauggucuuugcacuacagggcgaaacaguccuaggagucuggaauuuuccuuuaaaggaaguucuguuuucuuuuauuuuuuuguaacauaaacccuuacuucaguaauucucaacugauggcaguuuuucccuucagggaacguuuggugaugucuggggacauuuucauuguuacaacuaggggcuagaugcuacuggaauccagugcguagaggcuaggggugcugguaaacaugacgucauguaugggagagccuccacagcaaagaauugucuggcacaaaagaucaguagugcuaagguugugaaauccugcccaaacccaaagcaugauuuuauucuuauuuaugugcaccaguuauuauauuuuucuaauguuugaauuaucaaccaguauaucaguaauggaaacauuuccaacaauuacucuguuaauagacacgaaauacaggacucuugggcaucauaaguuaaaaugaacgaauagugggcauguaaagccucgcacuuugucacacuccucauguccuuuguagcaagcaggaaagacaguaauagcuggaguaagagacuaagaggaccucuuauaguuuaucccuaaauccucuaaaagagacauuauucucugugguguauuuauuacaucucugaaugacaguaguuuucaagauaguuuuuaauguaaaauaaucuaguuauaaaucucguuaguuuauuucaacaacuaauuuucuaugagucucuaaaaauaacugauuuacauggauuccauugguucacuccuuuauaaucuauggggauuaauuuuucuuuuuauucugugaacucagcguuaacccuuugucaaaucccaaauuacugcccauuuuacauaaaguuaaaagggcccaaagauucucaccgaugugauuaucuguuuuguuucaucuucugauuauuauaguuaguuaaauauuuauaauucuucuccucuuuuuuugauuuuugcacauuucaggcagauuuguaguucgucuguucuucagaaauuccacauggaauaggacuguguagaagugagguuaaaguuagucaucucuuuuuuuguucuuuuuuccacauucuguuucuuuuccuccauuuuguuauagugcuuaccucuauagcagaaauaccucuaucccugcuaagcuuucagaauagcuguacuauggaaugggcccacuauauuuuucauuggagaaaauuccauggacuaccuuggguguucauuagguggcaaguagaaaugaguuuaacagguggccuaaggaauuuuggggucaaggaaagaaagagguccauggaauuuaaaaauuugaaaggcauucucaggaacuuggaaagauuuaaaggcaucaucucaacuuuuuuacggaagucuuuuaaguugggcuauuuuggucauacagagguaauauuuucaaaaacauucaugcgucuuugaaaauccuaccucuaauacguagauucauuuccuuagacuaguuggcucucaaauaaguuauacuucaauccacuguuuauuaaauucugacugauaaccaauuguucauugagcguauaguauaauuauguguucaguaguuagccacaaguugugggaugcagaacuauaagcucuauuccuuuaaagaguuuacaauacaggugaaaauacauuagaaaaagcaagaaaugaaaggccaaauauaauuaaguguuaaagacaauagugcagaauguaagugcauuagggaccuagagagaagagaugguggaagaguuggagguagucagggacucuucaagaaagagguagaauucaagacggaucucacagaguaaacagggcaacacucaagagacuaugguuucauuccucgugagcaaaugcuuggguuuuaaauacccgugacuaucagcaucauauucaaucucuuauuuugaaauaaacaauuuuuaacagcauuuccaauaaugauauaauaaagacucauaauccauuaauauauugcauaugaagaaaaaguguauuuuagcuuuaauauauugccuuuacauaacacauucagaugccuaugagaauaacuuuugaagcugcuuuuuaucuugaaaauagcucagcacuuuuuuguaaauuacuauguccauuuuagugagcuguucauucccaagcagauggguggauugcaacuaauuugccaccuuacaggcacuguggcauacccaagaaacacagcuuauuuggaaaacuaauauaauaauuaaacucaaagcagagucuuaaaccaagugauucuguaaagauguuguucuuucauugccagcuaugugaggauugcuuguagguggggcauggaaagaaaguacucaaaccaaaauaagucaugugguccuaauuuaauucaguauagucaauaguuacauauugaugaguaagagagauauuuaaccauuagugcuuuuuaaauuuuuuauuuacuaaauuuuauuguugcugggguucaaaaaaauuuaauuugggaggaagaagauuugagacugguuagucuuugccauuuaguuucaagaagaucaggaugaaauguaauauaagcccuguggaucauaauguuguuuuauucauuauauaguggaaucuuuuucacuugaucaauaggccacacaaaaaaauuaauaguagaguggucuuuuauguugccgaaacccuggagaugauuuuaagcaguaaucuguagauuucgagauugugaucauuucucaaugucccucauugccauuauaucccuccacaguugaugcaaacccaagcuauguuucuguauaacuuauuauuugaaaaaugaaagcugucagaucuaaacaagauauauucuuggcuauuuugaaauucuaaaagcugucuccauuguaaaauagagaguugugagaaaaguauuugaaaauaacucacuaaauaccuuaugauuaaauauggccaccuuuuucugcuucuugcuauagagcuauccaucacacuccucagcagacaucaauuccagucuuccuccgauguccacuuuccaucguagugguacaaaccauuacagcaccucuuccuguacgccuccugccaacgggacagacaguauaaugggugagucacagaaaugccaauucugauaccaacaauuggugucagaguuuaaucaucaaggaccucuuuuucccuuucauaacugaauagcaauuaggcacuaaauauuagucacaugacagaaugaacacacaaauguaccaaacagaaguaaaaucacuggcuugagcauaaccauauuuuucgucacaagacacugaaauuuagcuacguucuacguugcaagucauuagauugaacaaggguucaaacagaccaaaacuaucuuguuccucacauucaaaaagagugaacaaagucauaagaugagccaucagugacuagugagcuacaaagcagaauagcucuuaaugguaguuauugaccacuucccaaaauuccagucauugugcuaggcucuuauccaugaugugccacugucuuccgaggacugguuaaugugaaauucucaggugacugcuaauaacuacaugagguuaaucuccuggagaaugugacacuguggagucccucagaggggaagaaguauuuguucacuuaugagagaggagaugcgugggcaucaguuggccagaaauuauuugcugcuuuuuuaaauuaauuaauuaauuaauuuuuaccaaggacauuuacuaaugaguuaagguccaagaagaaugcuguucccaugaacugagccaucauccucucauuucuugugauguucacuguagucuuuuccauaggugguuccccagucaguauucccacuuugaggaaugaacugggcuggauguccagcugccccuggagggaagagguggaguugguggggagauagcuaccugcuucugaaccagcuuugacaccuuguuguucagaugagcagcacagcuuagugccccagggucuuauuaaaaccucagacuucucagguagucacuuucugcgguuauagcucaaacuaacuccuugcuuggccugaaugucacugucagagcgucgguggggagaauacucaguguaugucuuugagagaagauggcgcaacagaauaaugcugcuguugaguccucuuagcucuuugcacuuguuuucuuuagagaguguguagaauuuggggaaguggcgugaaucacuuauguaggaaaguuuuugauguuggaggagagauguguuuugaaauguuggaaauauaauuucugccucaauaaugcccucccugcguauucaauaauauaucucacacuugagaugagcuaucucgcagccucuccacuccgcuauccugucuaagaagcaaauugaggagagaguuuccauuuuuuuuaacuuuuccuaaccaagcuucuacaaauauguugcaucaguuugaccuuggagagcuacagacagaggucacauggggaaguuuguuagcuaucaaugcaguuuuggcagauuugaaaaacaagaagaaagaaagcagugcagaacugaaagagugagaaaagcauauuucacuucagugugguuugacaaauggaaagccccuuucugcagucaugaggucugguuauaaagaaggaugaccggucauucauccuuuuacaagacagauuuccugucuacuugugguuugaguaauuuucuuuuuuaggaagguaugaagguggagcagaaccuugaguugaggaaaacauacuuaggcucuguuugaaaaaaaacuuuuucugauugauuugcaaaacaguccucuugagagagaggcacuaugacuuggaagggacauaucaggaaauagggugguuaucuccaugagcuguagacagcuuagccacagcucucagugggaaugaguuuugcuugguuuuagcuggucaucuucauuaguuuguggaugaacaggagaaucuacuuguuggucuagccagaguggagcaauaggugacuucuauaugcugagaauagacuuaacuuguuaaaaaccauagggccuuauuuaagggucuugacaauaauaaaggagcuauaauuuaaaaacaaaaguaugagauuuuuagaacccagaaaagggcuuuuuagaaauuuauuucauacauuauuuuacaauaauggaugcacuugucaaaauccacuagcggaaugagaaaaagaugcauaaucuuuaaggaaauagguagacaugguaauucagcauuuuggaggagcaaaccuuuauuauuaugcauagauacagauauuacuuuaagguuacuuuaagggagaacauucuagaauguuuuucuuuaaaauaauauguucaccaauugcguacgugaaaaugcagaggaaaauuuaagcauaauaagccuuaguauugcgugaugucugaguggcccauguuuuuucacacuuaaguucucuuaggcuuugguuugauuuuuugagugugguagaagucagugauggcagcgugucuguauaacaagaagagaagcuuucucuucugauguuagugauacuacccuaacaaacaguauggauuaauaggauacaucugcagacuuuugaaaauauuuggcauauacucacucauucugaaacgcaggaaguaaagaaauauuacguugccuguaucucaaagaacaaacagagcuaauuaaauaauuggcaaauagggaacacauagccugacacauguuugagauuacacacgauucuguagaaaaugacuguaagcaauacuaaugccuuaagaaugggguucgagcacuaacacauggacaucacauuuuucacguuuuccugguaaaaaguugcaagacagugcagucuuuucauacaugguguugaugucuuaggaagcugcuuuuucaguucagaagagggcugcugcccuucgucucagugucauguuauaauaugucuuucugguggucagcaguuguccugaacugacacuagaacaacgcagugcauguggggugagauacaagcucuagaacucucggaagggaaccucucuguaaccacauucccuuucuucuucuguucucugcaucucaaagguggaagaugcccacugagguuugcuguuuguuuggcuugggggagugaccagguguuucuuguuuuguuuucuuuugcccuauaauacccaauaucauuuuuugagaaauccauaagaaggauaaagcuuacuuggauuacauuaaugagagauuuuuuuuuuuucaugacacauucauccauggauuuucaagagaauuguagaacaagguauuuuacucauugcauacaguccacuacuuuucucaagccuugcuggcaaacucuggagaucauauuagaccuuucugaauugaaaaggucaucuaauuagcccuccaauuagaggaauauaauguaugggacacagcauggauucacaguaguucagcugguggcgcacccaguuaaggaaagaagcugucaggggucuuugggaguuaccagcaucagcaccuucuacucaguucuucaaacuuuuucaauguuaugccacuggguauucucagaagcagugcaguucagugccucugcaucugagcauacauacggaggaggaaguguaguaaguuauuagauaccagcuauagagaauaggaaugucugcaggauauuaaccauacacauuugguuagccacauacuuccuuccuauuugcaauaauauccaguagcccuuccugauggaaagaaguaagaggaccuccuaccauagcacagaccacugagacugcucaagggugagaaugcgucgucuccccauugggacauaccaucuguauacauucacagggugugacccuuugugguuugaggcuacacacacucccuugcccucagagagaacuggucauauaacuaacauaaugguuauaauaacuauuauuguuuuauuagucuuuaacuggccugcauucuaauacguggucuuuuccacguuuuuaaaccucaaaccaaacaggguugaaggaacagacuaccaagauugauuuaauacaccauaugcuaaagauuacccuggaauaucuaucugguucaugaauuaaucuggcuuagaacuuuaacuucgaaugacauguuaguauguggcuugucuaguagaaacauuauguccuuuucucuuugaggacuugguuucacaguaauuuuauuauuagaguagucacauaauguucacuuuauauuuuacaagaauauugagccuugaaguagucaggcgaugaacaagcacagagcauaagaguaauaagaauuguauccagcaaugugaaggcaucuuaguuaccaagaccaccagcagagaacaauaaacuaguuugauuuaaaucuccuccauuuccugugcacgaucaggaagcccaacuucccccugaauuccuaggaaucccuccuguuaaaaaauagugcauuguagucuauauacuugcguuuguauuuuaaaaugguuguaguaggagugcuggaaauguuccuucuuuuugucaucuuuauagauaagcacauggcauuguuaugcuguuucuaaugguuuaauaacacgagggucacucggacacaguuuagaaaaaccuacuuugaaagcagucaucuucucucaggcaaacacagugugaauugugcugcuuauucuuuugaugccuucaugauguucccagccuuagaugaugggugugcauuaaaggggcaacacauuuuccaaauucugauuuuuaguaguugaucccaaggcaccacucaucccaguguuuuguugaggguguguucuaaugggaaugaacauuuccccaaagcugaggcugagacagaggguggucuagcauguaacccaagauacaaaaccuuucuuucugcuucaucuucuagccagcaacaccaccuguguucaagccaucugaacaauacuuggguggcaggcagugucgaagccuccuacaaaaauuacaguuccucuuaauaacugcucaucuuccauucauauuuguauguuacagcucuacuuagggacugauuauauuucucuugggcaagauaaauugauuagagccaaaauuagaaaucgauaaagucuuuaccaagcaaaugcauuaguuuucaucuuucuguuacauggacauuuugaucaucucuaauaugaauugacaaaaaucuugggccucaaagaguaaucaaguccuguuacaucaaacccacauuuucagcuuuaauguaucuugcuaaacauggcccacuucucaaugcaaaaaaaaaaaaaaaauucugccacuugagaauuaaaauauauuucuuuuccaguuauacccuuuguuauaucugucacacaaauaaaaagagaaaucuguaagagaaagacucauguagcuuaacauguucaggcaaucuagaaaauguagcuucuccaguguuuccuggaccagaacaaaaggcauuccaagugaaagggcaaacuggccccaguaaacugcuuugaaauuuaagcccuuggguuuggcacuccagcuguugcaagguaaaaucgcuucauguuaaaaaauagucuguucuuaucagugguuuccauggguagccuuuguaguuuucugaaauauuuucaugacgcgaugagguaagaaguugauucuauuuuuaauucuauuuccugagucauaauaucucccugcauaaaacaggcacugauagaauguuuaguuagaaagguguaguucuaaagaaaucagauuggucauaauaucuugccucuucuaacgugugauuuuuggggcguauauauuuaguuuuuaaaugcuccuaaaauauuuguauugguuuucaauacuuuguuuaguuucauaaaaauauauauauuauuuguaaucuucauuuuaaaguuguuuaaaggaagaauuaaucuuuugaaagccacuacuguagcagauauuaucuguagugaagcaauaucuuguucuuuuuuggcuuagguucuuuguuagauaaugugauuuuuccaauguagcucugaacuuuuugugaaaaucuauauucaaaucaagcagauaucacagauuauuuugacugauagaucuaauuuuuagguauauaauaaugaaaagaaauaucgcuucuaggaaaaaaaaaaagauaaguacccccaaauaccaugguaauacauacugaaaaaagguuaguaucaucuauauuucacaucauuauuauuuucucuuuagaaugguuuuuagguuuguuuguuguucuuguuguuugaggcagaguuuugauccuguugcccaggcuagagugcaauggcgcaaucucaaucucggcucacugcaaccuccgccucccagguucaagcgauucuccugccuuagccaggcauaguggugcaugccugcaauccauguuuuuaguuuuuaaaggacuccuuaaugcagaaauucuucucauuuucacacuagauauaauuuguuguauuuuaucuuauauuaaauauuuuuaauacucuugauaucugagcugcucccagugguccaauuguaugaugucagacccucauuucaaagaacuugcuuauacaauaccuaucaugaguacuaaugacucauguauuuuaauaucauaacuuugugauauggaaguuuauuuugucacgagauaauuguguucuucuuaucaugugccagauuucuuucaguauuuuagcaauuaacaaauaaauauggguguggguuuuguaaaccaaauaaaguauauaucaaaacauuaucggcugggcaccgugacucaguccuguaaucccagcacuuugggaggccaaggugggugguucaugaagucaggaguucgagaccagccugaccaacauggugaaacccugucucuacuaaaaauacgaaaauuacuuggcgugguggcgugugccuguaauccuagcuacucaggaggcugaggcaggagaauugcuugaacccggaaggcagagguugcagugagccgagauugugccacugcacuccagccugggcaacagaacaagacuccaucucaaaacaaaaaagaaaacucaucugacaaacucaacauauaaauauaugaaaauaacaagcauaaauuagcuaugcuaagcagaggucaggagaauuaaauuaugaccuggaaaagccauagaauuggaccacugaagauccgaccccacuacugcauuuuacaaguguggaaggugaugacaacacauuuguaagaaagaaggcucucuuaguucaagaauggggcuggaaagucuuugaaauuauauaccuguuuaaugaaguuuugcuuggauucauugggugauuuaaccuuuccuuuucuuauuucacaaaauagugaaaaacaaucuucccucagaacuuuaauagguuuuauuuagauacuaugucuauuugcuaauguugaggcuuuaguaaauacaacauaccccaagugcuaggcauucuguuaauacugaagaccacaagaauccuggaaaucccauuuuaucacuuaguucuaaaggcaagauaccuuccaaugauacauguuaaagaaagcuggcuuugaauuguauacuguaauauaugucuuuuauuauucacaauacucuuuguucuucucuuuuguagauaaaaauaccaguguuuaaggcaguagagauaagcuucaugaauauguagacuuacuuuaucucuggaauucgaggccauauugacuuuuaguagcauaccaguucacuuuuuuuagugugaacacagacuuuuaaauauguggagaauauauguuauuuaaaacauuaaaaauauuuucucuccuuguuagccagaccuguuguggaaauuuuuguuuguuuguuugguguacuguaggacugugagacgaauaccccguuuugcuauguaucaaauuucuauuuauuugaaaacagauggaaguuauuugugaagauaauuccauuuacuauaaaauaauauaaagaaaagccagacucugaggacuccagagaccugaaaguagucuauacuugucagcaaugaccgucacauagcuugcuacauucaccagcucaucaacagcaaggggaaagucauagcaaggaaaccacuuuaucuuuaaaccaaggugucagguuuauauuuuaucuguaaaaaaguaacaugaauauauuugacaucuaccucagcaaacaaauuaaugcuaauuaaagauuaauguguuguaauuagcauuaaaaaugcaauuaaauugugaguaaauggaccaggaauagaaaauuguuagacgucucacugccugguuuucauauucugccuuuuguuuuugcagcaaauagaggaagcggggcagccggcagcucccagacuggagaugcucuggggaaagcacuugcuucggugaggaaauauugacuuuggacuccauauguaccauuguaaagggugaacuuuaaucagaaguggacauuuggaauuuuagaaaaugaauggcaaauagcuuugauuuuuggaaaaugcuagcuuucuugcauaacagucacuggaaaauuugagaaggcucugaagcuuccaguauauagucucuuucucucauccucaaaaugguacuaagcugcacucaauuauggaugugggaauauucuccuggucuuuggguuuauagguuuuuuauacugaugucuuauuuuucucuaaaguaauaugggugcacauugaccagcuaagacugucuuagcaaggaauaguucuaaaacacuuugaaagaggcauuugaaaaaaaaaaaaaaaaaaaaagacaauaacugagguccaugaagaacugucacauaauuggcaccugggggacucagcuucucugcuuugcccaccuacugccagaaagcuaaaauugaacauuucuugcauguucccugaugacaaaauggcauaccuucauugucucagagaguauaucugguauuuuagucaaaagcuaaacauggucauuuagaaauguaaguggagggccagguaguguggcucacacugguaaucucagcacuuugggaggccgaggugggaggaucacuugaggucaggaguucaagacuagccuggccaacacggugaagcccugucacuacuaaaaacaugaaaauuaacuaggcauggguggcacaugccuguaaucccagcuacuccggagacugaggcaggagaaucgcuugaaccugggagguagagguugcagugagcugagaucaugccacugcacuccaacuugggugacagagcaagacuccaucaaauaaauaaauaaauguaaguggagauuucuuucucuaagauuuugucucuucaguuggcuuuuaccauugagagcauuaaaaaaguucacacuguauuagcauugugcccuaaguaaaaguuuuuguuucaucugggccuucugaugcuaugcaaucaaacgccuagaucuggcaaaagaguggcaaaauaucuuaggaaugauccuguucaaccucucauuguguagaugaggaaaggaaaguucaaaguaucugcuuggcuugcccauagccacacagccaguaggaacgaagaguugguuugaagucugcugaccccagccuggcucuuuucccaccaucccauaccacaucaguaauucuuguuuugaaaaauuaaaauaauuguuaaguucuucauuugacaauuuugguacuguaguugauuauuacauguaugcuguaacuuguaaguucuaaaugaauugcguugacaacuucguaguuuagaaaagugugaauuauuuuaaugaaugaggguguuuuuuuuuucuccuuauuguuuuaagaucuauucuccagaucacacuaacaacagcuuuucaucaaacccuucaacuccuguuggcucuccuccaucucucucagguaguguauuucaaaucccauuucaucauauaacaguuuauaagaaugauuccccccuuguacuuccugauuuuguagguggaaacucacuuccccccaaaucccaaagcuuuaacauuccuauaacagacaaauacaaagggugggagagacaaauuaccagauaacaguauagucguuuacauccaaaccuuuucuuaaaaauuagauuaucuuuuuaaaauauacaggcauauggaaaauguauuucuuacacuuuucuuagcucugcagaagacacccaacggcagaauaauguauuccaauaaaacgucucagaugaaaaaaacucaguuaauauagucaugaauaugaauauagacuagauagucaucaaauauagacuauuuaaauggaucauuuccugcaggaauuucaggcuuuccaaauucccucuuuaaaguacaugccauugggauguuuagagaaaacuauaauuuuguaaauaaauugugaaauaauugugugggguagaagggauguuugacuucaaaguauaauacauucguaugaccuguggcuucaaauugaauaacuauaauuuguagaauuaugucaguaaauaauuucacuuuucagggguccguuuaagagacucauugucuuuccaauauaaaugcuuccagaaagccuuccuugguucaugucucugcucuuugguaaggagacagguggcuuauuaaaaaaacaaaacaacagcaacaaaaccuaaaucacaucuguaccugauggaaaccuuaccuuacuguaauuuauaguggaguuacuugcguuuguuauuuccugcaugcagcucucauggcccaguguaaacucagcuccuuggucgaggacaggagguuucacauugccacaaaacuuucagaaaugauggccauggcuuagcugggauuuaaugucaaccucuuccaagccuccgugguaugagaagaucacagaauagagagggcagugggauucugaagucucuauguccagagagaccgcguugaaacugggaagcgauugaggugauuuuaagaggauaaucaaacguucccccugguggaaauagaaacuagaguucaguauuguuguacuccucggguucuguaccagauucuuacacucugaaaaaugauuucaauugucaguaacccccuuucgagacaacaagagauacaacaagggauagaggaaucugagcagguggaacuccaguuuccacauuucaaacaaaguagcuuucauuuuauucauuuucuaauuuagaaaaagaaauguucuaugguaucauaauguuugagaacgacuaauguagucugauacccugauuuuacagaugagaauacugagucccaaaaagggaguugaguuguugaguuuauuaccagugguaauagcagagcuuggacaaaaaucuggugcucacaguucugccauccauuucuagauuaauggugggaaagaaaaauuaggaugcacagucauucuagaaaacaucacaaauucccucgaccugaguagcaugaucucagugaaaggcacagaaacaaggcuagagaugccacuuuuugggucuugguaaugcaucauggaagaccacauguuaggaagaaagaacuuuuaugaagaugcaaauauggggacagauugcuauuuucacaccgacggcucuguccaaauucugucaagaaaaguaauugaacaaaauauucuauuuuuauuuagcauaaaaauauacaugcacacccagaaaagacaggaagaguggauuuuaaaagugcuaacagugucggggcaugagauuucagugagaucauagcuauuauuuuuuccuuuuuugaauuauguauuuuccaaguuuucuacacugaauguguauuauuuuacauuuaaaguguuuuuuauuuuguagguuagacauguaauauguauucuaacagcaaucuuuuuuuaccuucaaguuuaaugaaucauaaaaaaauuauuuucuucagaagaaacuuuuagucauugcuguauauugacuuuaaauuucuggcuuaguggaucacugauaacuaaucuuauucccuuaaaaaguuuuucaagauuuaucuuuuucuaaagauuguuuuaaaaacaaguggcaaagcuguuuuccacuggugcgagaauuuugguuuaacauaaacuagccuugcaugaaggucuaacaaaaucccauuuuuguacccuuaaaaguaccuugauuccauggugauaguuuuucuuccacaggaacccuucuuaccaaaauucagaaucaauuaaauguucucuuuuaggagacagccagccugggggaauugugagucuauguaaagucuacauauuuuacauuuaaaauguuuuccuugucccaaaauucuuauaugggaaguuuacauguauuuacguuguuguuuaaaugaaaaucaucauugccauugccauuuccaaaaggacuguuuaaaauauuggcaagcgucuuuuuacaugugucuagaucugauuguaauucccacuuuaauaucagcaggcacagcuguuuggucuagaaauggaggacaggccucaucgucuccuaauuaugaaggacccuuacacucuuugguaugucucauuugcuaaucucugucccacccauuuucaggucauguucuuucuuguucagucuccuuuacucuccaagauuuugauuuucccuguuaguaacuuuaagucagcauuaagcacacagguuugcgggagccagagucauuagccuaugcuugcuccuauuuggagaugggaacccagauacuacuguaauggcagccccagggcucuaaauaucuaguagcagauaaaauccuggaagggcaauggccuucuccccaucucuaggaaagaucccugucaaugauuaaaucacuuuccugcuaucagagugcuggaacuccagccagguccuauaccuggaacauuugauucccucuaccucugcuuuacuuuccagaauaacagguuuacaggagcuuuccuucucguagaaacccagugguauccuucgugguagagaaaugccuacucuuccaggagugaauugcugaaaauuuccauggauguaguuaauuauuauaaauacucacaugaugauucagugucugacacuucagucuuucucuccucaugauggugggggccagaaauaugcaggaaacaaugcugguugugcagcauuuaggcuguacaugaauuuagcgggaaggaauagcaguaagggagaggagccuuuuaguuccucgggguugagguuuucuuuucucccuccuaucuugagaugacacauggaagaagacauagauuuaucuaucugcuuuaguguugucuuauauucuucccuuucagcuuaaucuuaaggaaaaucugaaaagaaaagcaaagguggauuucccuccuuugcuguguucuuccuugcuauaguguaugaaucauucagcuaugcauuuuaaccaguaaaggaaaccagacagugaaacauauaugcacuacccagcccaauuaaucugcggaccacauccacauaauuaguuguuuuaguguuuaccuucaucaguuauucucuggggccuauucaucaaaaccaggcuucguccaacuauagaacuguaaagacgggguguauaguuaugggccacagcuuccauucuguuugaauucugaacacugaagaagagauuuacaagcagaaacugcugucucuaccaggaagcugugagccagaaacugugauaggcacauguaugauuucuuuuccugcauacauuuacacucagaaguaaguauguauuaucauucccauauuuauaaauuagaaagcaugcacuccaagagguuuaguaacuuuuccaaggccaaauacguagcaaagcuagcagucuaggggagguaguuuaacucccaaacccaccaaaucagaauguucuguaccauagacuacuauauuagacacacauucuuccugucaguauaaaauagaaauguuuuuucucaugcaauagagcugguacacuuguuugcacagccgauucaaaaucaaagucaauuguagcaugaucuagugcaaagagucacuagauuuaaaauaaaaagaccuagauuccaacucugacuuuaccauuuccuagcagugugacacuacguaacuaauucacuuugugucuuugagccucauuuucaugucuguacggaaggaaucauaaugucuucccugccugcccauacacacgugaaacaaggaucaaugagaugguauauuuuaaaguguacacuggagagugguauuugauaucauuauugaucaguuuuuaaaaugaauacauaccuuuaaaaugaauacauacauuuucuucacuaaaaacuauacgcauugucuaguugugaaaaacuagaauccuaauggcaaggaugaacaaagguugguugguuuuuaaugguuuaaaguugcgaauucuaugcuauaguuggggcuuugaacucaguuagaugcccccagugaacaguugauucaaguguuugugauucuucagucuuaaaaucuuauacuacuuuaguugacagaauuuauauaauuuuuuucuguaaccauuuugaggcccuuacacgcauaccaccacacacccacugguuuugaugacaggaagccagaaacaccgguaaaaacucaacaagaaauuaucauccauuugcuuuucccugucucugauuugguacuuagcacugggucauauaccacagggaagaccaaagaaauauaccuucaggaaaagaauuuaauuaagaaacuauaaauaggucaucuuuccagugguaauuguuuaaaacucuuuaacuuaauaccugccagaaaguuccuuaaauucagugaauguuuuucucuucuaaaauaaauuuaaauugccuuucaaaaggcaguaccguauauagcacauguauguuauaauguccuggaauaauuauugaauuuaguuuguucaugaaaaauaacacuauaauuuuaacauuaacacguucuaccaguuuucuggaaacaacacuauuuguauuauuguuuuaaggaaauacauuuuauuggaaacauguauuuagaaacacaguguguuuuuugucgacuaaaauuuuacuuguauaauuuaggcaccccuuuugaacuaaaucaaauuuuacaucauuuguuaaccaacagcaaagccgaauugaagaucguuuagaaagacuggaugaugcuauucauguucuccggaaccaugcagugggcccauccacagcuaugccugguggucauggggacaugcauggaaucauuggaccuucucauaauggagccauggguggucugggcucaggguauggaaccggccuucuuucagccaacagacauucacucaugguaagugaugaaauuuauagacucuauaguuaucauauagaguuagaauuucagauauagauacuauuguugcuguuuuuuaaaaaaucagcuuuauugagauauaauucacuuaacauacgaugagcccauuucagguguacaauucaaguguuuuaguguauuuacaagguugugcaaccaucaccauagucuagguuuugaauauuuuugcccccugcaaaaagaaaagaauccccguugcccauuaagcagucauuccccaucccuccacuuccagcccuuggcaaccacuugucuacuuccuaugucuauagauuuaccuauucuggauauuuugaauauauggaaucauacaacaugugguggucuuuuuugacuggcaucuuuuacuuagcaugacuguugcaguuuuucuacaguuugccacguauuagagcuuuauucauuuuuauugucaaauaguauuucacuguauggacauaccacauuacacaguuggguuguuccaacuccuuggcuaugaugaauaaugcuucuauaaauauucauguuuaaguuuuugugcagacacauguuucccuugaggaugaauugcugggucauuguugguguuugaaauuauucauuuuggugacccuggccaaaguguacaauuugaguucauauuauaauaugacauugcuaguaauucaaauauuaguguuuuuuuuuuaauuaaagaagccaaaauagugucugucaauucugagucugggagauagaaauauaugguauguuuauuuguauaaauacauugcaugugacuguguaauuuaauagaguagcuuuacuacuaccuauuuagaauaagucuuuauuugaauuauauuuaagcagauuuguccauauuacaauugugauuuuuuuccucauuacuuuugaaaggauuuuggagauaauucuuuuugaggaugauuaugaagauucagagacucuucuuaauagaauauuaagugaugacaauuaaugaggugaccagagugguggagaauguaacuugaccagugauucucuguaguucugauccucacaagcucuaccucgucucuaagcaccuuaguguccuauuuugccccuuacaggcucgcuaaaaguugcuuggaugaagguauauuuuccauuaucacuguagcauuucucguuuaagcauggucccaaaaggaaaugcaaaauacauacaaauuauuaugagguucuuuuaaguucuugcucaguaguauucuccuguccaucuuucaguuucucuuaauaaaagucuaagauuaagaguaccauucugaacgguguaguauugaaaucugcaaccaauuugaaaccaaaaauacugguuuauaaauagaagcaacgaacucacaucuaaaauguggaaagauauuuuugaaugccaaagagaaaucuuuuuuucuuucccuugaccucugcccuaaaaauucaucauugaauaaaaauuguuuauauguucauggcaguugcuuagaguuuacaaaagaaaagucuagauuuuaauuuagcuuggccucagguaauguguuaaauacacuugggaugcauauaauaugagauuuucguuuguacagcucuuuuuuuucuaacuacaauguuuaaacauacugcuuuuaauuaagaaaucuggcuuuauuaaaagccagaucugugacuuauaaccauuucuguauaucugcucucaaucaacagaaaaauaguuuaauuucuguagcuguguucauuuugcauauguuaaacggauguaacaugcacccagggcauugcuucagagacuauuuuuuccauaaauauguaaaguuuuucuuaaauaccauauguagguuaagugguucuuuuaaauauuaaacuauacauaaauacuuuuggggacuauuugaccuuugaauugacuccuuuuugagucagauucagaggugggaugggaggaaaagacuagaauuauuuuuggagaugggaaguuggacugaccucaguagaaccgaaagugagacgacugaauagaacgguagaaaaaaggaaauaauuagccaauauuacauagaaaccccuuuaauuugaucuugauauacacacacacacacacacacacaaaagcaauaaagccgccaguuuugcugauaaggauaaguuccuguuuucuccucugaagacauuuaauauucaaucaaggacagccacagagccaagcagaucauagcguaacuccaaagauauggcaugucaucacccugcugcccuuugaaccaaaugggguuuugcagucucucuccuuucuuccugaaaaccauucaacguguccccagaaucugagcuccucagccugaaacacuaaugugugugaaaaggauugguuuggccuaucuuucccgugcaaacugguaugaauuuuaaaacaaaaacauaagaacaaaggaaauaguuuuugaauuuaaucagucugaaguuagccuuugaccauuugauacauuccacaauaaaaaggaaguuuaaggggaaggcaaaaaaaaaaaaaaaaaaaccucaucccccuuccccacaacaacaaaaaaauucaaggaggauacugguaauguuuuccacauuugaauuuuaauacaugaaacaggcuauaaaacuuuggccagcugcaguaaauaaaguagccgugggagguaugcaccggaaacuucagcagagagcacuggugagagucucauucccaacuacacaccuucguuuguuguucugggcggaagcgaguugcaguaacuugauacucaucccagucccgguuuuguauugagcacaucgccuuucuaacucuccucaguaauuccuucugauuaaagaguagacagcucugaauccucucgaccuccguacgcuucucauuuccuuucucccugccuuccaaaaaucaaaacaaaauggcuugauaacuuggaaggugauauaagcauuucuuucugcagcagcuugaaguugugguggggaaaacugugguucugccucggcuguuauguuaucucauuuaauugcuaacauauuguccuuagcuuuugauucauaaaauguuuuccuuggaguucugaaguaggucuucagugauuuacuaaguauuaguauaaugaaagggauuuuuuuuuuucacagcggcauggcucauaacacaagagcgaauguuuguauacuugcaagcucucuggaugauauuauugagcuaugcuuauuuccugcucaaaaaccuucccugccuuuccauuuucuacaagauaaagaccaauuccuuagcucagcauuugaagccuauuaccauuuaccgaaagccuuauguugagcucuuccaaucugcaacaagucuuccagcaagacaaggcugggcauauuaccagaauucacccuguauguucuccuucggaacuuuuguaucucuuugucuuguccagcccuaucugcuuaucucuguacaccuaauacccacccauucucaaagcacugacucaaaucauucuucuuccaggaagccuucccuugcuaccccacucaugcuagccauuuuuuucucuauucuuacagcccuaugaaucauaccauuucuagauauuuaucuuaaccagcuccgcauagcugugcaucuuuuauagauaugacucugccuuaccaacuguuguaaauuccucgagucucacauauuauauuuugucucucuccccccgaccccuguaaauagaucauccauagaaacgggagaaaagaaacgaggaaacuuaacauucugugagugugaguuggcagccccucugcuaggcgcucugcauguguugucuuaggcagucuucacaacagcccagugaggaugauaauaguggucauuucaggugucgguaaagugagccuuagaaguuugagcaguuagucucaaguccugcagcgggauuuaaacucaagcacaucaacuccaaauucaaugcucuuuuuuacuaccaggcauacucuccagagauuaucuaugagaacaccuuuucagaacuuauuuuaaaugcuaggagcuugugauuuucaaaacuugauaaguguugguuggcaaaagaaguuuccagguauuccauggcuggguucccagagcagcucucuucccaaauguauagacagagaacuuucccuccaaagugguggcaugcuuggauuaaaacccacauuaucuaugcacuuauucuuaaaccaacauguuugcgcugagugccuaagaggugugaacucucccuaccaggguccuugagguagcaaauuuuaaguuaucaaguuauuuuucuuacuauaaccacccacuuuucuuccaaaauuaaagcagaaaucucugaaugugggagaauaaggaaauagccaggucuucacuacccuaguuagaaacucuuaccaaguaugauucccucucugccucagagaccuccaugauuaauccugauauuaaaugauuagauuucuuauaaauuauggaaagggcaauuuuccagauagaauucucucuguuacucauucaguauucacauccacagaugaggccugaaaagaagcguuucaaaugaccuaaccgcuuuuuuaacugacuaagaacaaaacccacaucaaacuugucuuuaugugacucuauguguucccguuuauuuguugguagagucagcaacuacgugaucauugagcuaaaaauccccucuacuauucauauaucgcauuaguguagcucucagauccuucuuguuuaaagucuauuuauucauuucaauaacauuuauccgugguuaccaaguguagguucugugcucucaaggaauucacaggcuaguaggaaaagauguguacuuaagcagauugcucccugccagucugcuaugcccucuaaaagaccaggggccugacccuuauccaguagugaaagaucacaugguuguuuaguagaggaguggucaucuccaguugacuuagggaugggggagucaugugcaacucaccccacacaccuguccuccacagcaucccuucagaguccugcaggugggggauguggaacccauuucagaaaucaccaauaaaaguggaucuuugcccaguuuuccucuuuucaguaacaauuuuuguuuuacuuuggauuaaaugcagucuaucaaaagagcauuccuuaggaaaagugguaucuuuuuauuuaacugacauuauauacaugagaacuuuuaccucuuagggcuucauaggacaaacaacuucaguuaguuuuccuuguauaguuaagagcucagaccacugaauuuuagauucuaaaaguacccuggaaaucagcccauugcccuucuuugaagacuaaggccuaggaaggggaagugaccaaaccauggguacucacuaguagaauuagaaaccagacaaaagaggcuggacacgguggcucaccccuguaaucccagcaauuuaggaggccgaggcggguggaucacucgaggucaggaguucgaggccagccuggccaacauggugaaacccugucucuaccaaaaauacaaaaauuagccgggcaugguggugcacaccuguaaucccagcuacucaggaggcugaggcaggagaauugcuugaacucuggaggcacagguugcagugagccaagauugugccacugcacuccagccugggugacagagagacccugccacacacacaaaaaaggaaaccagacaaaacagcaagcagaccagcacuccuugugcuauauccuacacugcucagccgacuuccucuuuacccuaauaccauaaccauuucaaaacugugagugguagaaauuagaaaccauucuguuacucugacuuaacuaaugaaauccaagaaaacucuguaguuggcccuaggcugccugcaaugaguugcuauuuagcucuaccaguaauauuuggcaaaaagagaggguagugggcauugaugugauguggcaguuauugguacauagucaugggagcagcaggagucagaagauucuguuucuaugugggccucuucaacaaagauaugaucaacagaggcaucagcaucuucaguugauaaaguugauaaaauagaaaacuauuuucuaaauagccuguuacagaauuucagcgaagcuauugguggucagcaucaucuuuuaauagcuacuaucuuguuuuucuuuaaauuaggauauuugccuucucuaguguucugucaucucuccuaaucuccacaacuaucagguauuucggagagcagauuaguaaccucaacugaaaguuuugaucuuuaucaauuuaucaguugcuccucuugggcuuucacagguuuugauuccauaaaguucugugucuauuugagugcauacuucauuucuaagcaguuauucccauggacucucagggaauuuaagagauuaucucuacugaaaucucccuacagauuuccugccaagcagucaacaagucuugaucagccuccuuccuucaagggugacuagcuccaaaugcccacaaaguccauuuucaucaaauauuugaaaguucuuccuagguccagcccaaauuugcuuuuuucuacaguccuuauguuucugcccaauagaauugcccacaaaucaaguccaacaagcacuugagaaacucaguuauuugaagacagucugcugaguguuuuuucccucuagacgaaacaucacuaucuucaaauauuuaaccugaaaaaaaguuuggacucccugucaugaacuccauugcuucccagugcauucucccuaguuuagcaaggaugccuuuuucuccacaagaaccuuuuaguguguggaaccgcaaacugaacacagugcuuaagaaaggaucaaguggacuaggguggaucuaucuccucccccauucaguaccuuguaucuucauuaaggccaccuaacaauauccuguuuugcuauguuugaugcuuucauuguccugcugacauauauucaauuuguaaucaacugaaauccauaagccaccuaucuccccagucucauuguguacuuuuuguugugucuguacaaaacuucaugaaaccccauugaauguuauguuguagccucagucugauuccuguuuaaugguuucccugaagcccucauucagucacauacucugccaucucuguugcuggcaaaugugaugggugugacuaaugcccacaucaaagccaccaauacaauauuuucaggggaggggauugaccagaaggccaugaggcucaguguuacagacauucuuucuacacgagugcugucuucuauccuuugaguuuaaucucagcugguucugucucccuccuuauacaccguauggcccaccuuugcucauuuuguccguagcguugucacagaagccgggcaugcagcacucacugugaagcaggaaaugaggcuuguccagaaugccuugcucugguggaaccaaacugaguuugagaggccauuccuguguuucagagcacuuucaaaacuauuuucuaaauacccuguuacagaauuucacccaagcuauugguggucaacaucaucuuucaauagcuacuaucuuguuuuucuuuaaauuaggauauuugccuucucuaguguucugucaucucuccuaaucuccacaacuaucaaguauuucggagagcagauuagcaaccucaaccgaaaguuuugaacuuuaucaauaucauacuuuauuuuuuuaaaacugaaaaaaaaaaggacagaaagguaaaagaacuugaagaaauucuuuuagccauggaugagugauaacagcugagaauccuugagcuuaccauuugauauuucuauauuaauuuaaagaaaagucaaaagauuuugaaaacagcaauagaaguaagauccuuuaagcucuauucagcagccccuaagaaaagugaugaggacacugugcaugcccauaugugaacaugguuggccaccuuagguauuuccccuucucuccacaugaauacauauuuuacucaaauucagacucuaugauguugaaacagucuggcauuggauguuuaccucaaaacccugcucucucugcaccuaggacaaacaaauccuaguucucugguguuuagcaucuuggagccaugaauuuuaaauaaaucaaagacaaaaaccuugucuuucccaguuuuaaaauauaaaagauacacacacacacacacacacacacacacacguguauuuaaaauagacccuauaaccucaucauauucuuacauccuuacaugguuuucuucuuaaauuguggaggaaaaggcaggcagacacauuuaauagcacagugaucaucauuuuuuaaaugaacuguuacagggacauaaucuuaaacuauccauaauuuggaauaggcacaacugugcauuuaaaaaaaugcaauauuacccuuauuuucucaggaaagcagauuuucuggagggaaaaguauauauuguauauauuagaaaauauacauauguucauucacucuuucugcaucugcugugcuucagaugcuuuuggggaugcauaaacguguaaaagaaaguaucugaucuuacaggccuuuuauccugguagagugauaauacaaauaugggucuaacuauaaugcaagguagaauuaugaaaugaccuaaggagcaauucagaccgcuaggaaaagcuucccggagaagaugccauugagcucauauucgaguccacauagaauuucaacaauuagagacaggauagaaaaggcguuucagagccauauaauaaacaugauuuaaaaccaaaaacagaaaauaaaggcucaugcaccuaaauggaaguaagaaaacugccugaugauaccaguccuugcagcuugccagccagggcugcauugggugaaaagccccuccacagcacggcagcuccagcaguuggcucgaauauuucacaugagaguccacaggaagagcgagcuuucauguauauuuuuuacauccaaauuaaguuaacucauggaauuuuccacccuuaggaauuaaaguagcaacucaugaaguaauucaguuaugucauucauaccaaaacagaaaauacuggagcaacuuggcacuguuuaaaagccaagauuaggccuuggccauuuuauauuuuuucacauuccauggccguuguguuauuuuaacuuuuauuauggcuguaaauuuuucaaaucaaaaguaucuuaauugcuuagaaaacagaaguugaaaauggguucauaguaagaagaggguuuaggcaaagcagcuuuaggagugagaacugaaaaaaagcuguagcauuacauuuucuguaaugcgaggguucuaccuauuugguugacauucacaguugugcauaauuauagcuuccucuauauccauaaaucaucuuagaacuauaaaguugaguuuaaccaaaagaucuguccaauauuagugaaaugacaucuuuagggaagcauuguccugauacaauagccacauucauuuuaaagcaguuaauuggacacauugucaaaaaccacgguauugaguuuccacauuuuaauuucacauuugccuucucccuggcuucugcacacggacgggucucuuuuggagcugaaagugugugaaaguuauuggagaaugguagucucuggguaauguuucuguaagcugcccaaaauuuucccccuguagucuagaugggaaacagcugguauuuguuuaaaaagcuguuuugcaaaaugucuaaaccuugagauauagaacugaggucaccauuaaagcaggugcuuaagagcaagugagaaagacuucagaggccgacuggcucuggaaucuucugcagggcacuuccuauuagaagaaaaaguguugaaguuugcuccuuuauuuaggacacggcuauaaguauuaauaaguaagugcacuagcaauacuacuagaaauugaguauuuuugaacauagccagcccucaagugaauaauuagcucaguaugaaaggaacuaaaauggucauuuuucucacagggcuucaagauacaagagcccaaggcgcucuagucuccuuuggguguuugaauuuccucuuuaaacacaccaacaguaaaagaacuacuauuucaaauaagcaguaccauaacugacuauaucuuccaagguuuuggaugcaaucuaagggaaagggggaaaagagacccgacuuggcaagacccguaccgaagcagucuggaaaaaaagcaaagcaaaaaacauguggaaccacuaaaggccagugcacgucagguauccaccagucugaagaugaaaggaaguaagccuccuccccugggagcuggagguuauuagcagcuguuuauccagucgggaauagagauuaacauuguacuuuuuuuuuaagaacuagaagaaaauuuguuugggaaguuggcuuuucauaucaagucacugugcuuugccaaaaaaaacuuccuuucucagaacucauguacuagcauugagcaauguuaugauucucugagaaacucugaauuaccaaaaagucuuucuccauuaaauagaacagaaaaggacagagaaaugggugaacguuugccauugacacauugcaguuguacucuuuaccaugugaaauuugccguuuggucuauuaccuguucuccaaccugacucuaaaugggacacucugcccucuaccccucacacguacccucacaacuuaaucauugccacucuaaggugcacacaauggguucugcagauaccuacugcuugcaaaaagaccuuucaugagauauuggggaaacugccuaguacucugggugcuuuauucucaaaaaacaaacaaacaaacaaacaaaaaacgaguuggauauagguauuuuuccccugauuuaaugcuacucuuaaugucauuuucuuuuauuaaauccuuucuucugcuuuugaucuuauuuauagcagagccacuggucauauggaaacuauuacuguauagcugcgagaugaaagacuucauggcaauuaaauaagagugaaucauuugggccaauaauacacacauacagugagguaccauuuguguccaaaaugcccuguguuguucacuuuguagcaaagccauugagcuuuacaaagggcuuuacaaaaaucugcuuuuugucagaaauauguagucugacaauaugaaaacacauguuaacacacaguccuuagcugcuugcuucuucacacauacacaguaucuaaaucaugccacuuauugauauaaaaugaaauuuucacuuaaauuugggauauuauuuaguuguguuaagcgucagcucuuuaaaaauauauuuggauaaucuauaucaaaauucgacccaucacucaaaaccugccuaaaaugucauguucuucuuaaaguagucccugguuuccuaaacggguaugacuucaucauuuuuuaaaacccuacaugaccuuguacuccuuuaugacauucaucguauuuugccuuguauaguaauauuaucccaucauuaaaauaucagugccugggcuaggcgcggugguucaggccuguaaucccagcacuuugggaagccaaggcgggaggaucacaaguucaggaguucgagaccagccuagccaacauggugaaaccccgucucuacuaaaaauacaaaaauuagcugggcguaaaggugcacgccuguaaucccagcuacuggggaggcugaggcaggagaaucgcuugaacccgggaggcggagguugcagugagccaagaucaugccacugcacuccuuucugggcaacaaagcaacacuccaucuuaaaaaaaaaaaaaaaaaucagugccugcaaagucauagacguguuuauuuuuccuugcaaaugcccauguagugccuugcauauaguacacuuucauaaggcgcuugucaaauuaagugaaauguuuauuugauagaaacaugcuaaauguauauuuggcaauaucaaacaauuaaauuucagacauagucucacagauccauagcauuugugucaucauuugcuaagcaucuaacugcacauuguacuauuacacucccgugcagugaccugugcaguuccuguccuugggaugggaugcccacaaauggagacaaguauaggcuuuacgaauggcagcaaaacaaacuuauugaaguuuaugcccugcaccauucaacaaugaccuugaauguguuuuaaggguggugucuguaaugcauagugagcucgugaggugacaagaaaguggagauuucuggagauccacucagcccugaagggucagagagugaggggaucugugaggcuaauaaaagagaagcaguuggugaguuaggaggaaaaaacuagcccagcagacagagcagggagggcuuugcucaagccuuagugaugugggcguuaacccagcagaugagaggccaugcguagguaauugaacauugauagugaggaauuuaaaaauaggagggaacugcauugguccugggagucuaggugaaggaugcaucagcacaagguggaccucuuagacuggauccauacagcaagcaagagccaggcugaagccuuaauauugcaucaacugauggagagagaauauugcauuuaaaagaugaguauuuggaaagugauggggaagaaaugguucauucguuuaggugagcuucuuuauacuucuacucucuuuucaaauauauuacaguaagcauguguuacuugaauaacaagaaaagcauuuaagaaauaaaggccaauggguaaugguaaaucccuagggauccuuagggaugggccaccuggacuggcuaaaaacuguguggaggucagcagcaugacugugcacucucacagguaugcuugcacuucaggcauucagaauuccaaguguaaaucaaguguccaguugucuuuuccuuuaaacaaaagcuguuuacacauaauugcuagacuucaccauauucucugugcuagauauguuugguucacuaggauggauuaacuuuaguuccauaccaucuacuuacuagccugcuauguggagcaaggaagagauagaggaaugggcucuguuaaucugccaguguccccgcuaggugagcucucuccaguuaugguuuccacuguauaggaaaaugaugucgagaauugagggugugggacacagaagagagaaaugaaacaguuuuaauagauggaacguaugaguuaguacaagaaagaugaacugaggucggcucacauccguuugcauuucuugaacuauaucauagaaucauucauuuaaccauuuuggugaacauccaggggaguuucagcccagcugaucauaugauagacaagcacugccaaggucaggaucauuuagaucauguuuaaauccucuugaaaauuacuuuauuaucuggagaaucaauauuaaauaaaucuccaagaauugcacaauaaggaauuaccuuacauuucauacagaacauaagagaagcugugauguuucuggaaaacaauguagguguucucaagacaguuaugaaaucuucucccgacauacauguuaagaaucaaguaaaaauccaaacaaaagaauugaauccagaucugauguuaaugaaaagucucuuaaagguuuaaucacauguacuaaagaaaaaucaucugauaauuuuuuaaacugagaaauauggaaauuauguuugugguuggagugucccagauguuagcucuuucucccacaacaggugguuauuagagguaggucuuguuuucugcagagccucugugccucuaguguuguuccucacaguaucuaucuacugcugccauuccaugaacuuccuaauucccaucugugagccauuaaaaaaguuugcaugaccgcuucccaccucuuuaaaagaugcacuuuuguacuaaaugguguuuugcacauuugagaaaauaaguuugcuuuccucuaauaugacagaggucuggcaagauaauugaaacugaaaucuaguacucuacaacugucauguauaauugauauuucauggggagauuacaguucagacaccaaaacuguuuucuguaucaauggguuucuaauuacagugaaaacccaucagcuuuucuuuuguguuaauggaaaaacaacagagaaaaguaacaguaaguugcaguuaccaggacuucugucuuugucccauuuuguuguuguucuucuuucuaaaaaccaaaaaaaucuauguccaaaauuggaaaccagaugccauuaauagcaaacuuuaauuuugauguaccaaaauguuuauaauaguauauccaguuuugugucauuaucacuuggucuagaaacugaugacaaguuuccuaaaguucccauuguauacucuuuuagaaggauuaugguagaauagaagugacugaggucugaaagccuguuuugaagcaguuaucucuggagauaacauuaacuaggauugaauaacugccaaaugaaauuuaauacauuuucccauccaugaaauaggccucuuaaauacaacagaauaauuacuuucacaauacucccuggaaacaaagagagcaaaaauauugaaugucuuuuuuguuugugguguuuguuguuagcuagaggauaaggacaaggauauuuaccacaaugcugaaugcaucuccauauaaaaacagccuugccaacagccaccuaauuugaaucugcaugucuuuuaaaucuguuuauguuggagggaucguggcaaauauuaaauuuuauaauuuaguuagacaucuuggccuuggccugaguuaaugaacuaugauuuucccccugcaauaaagaaaaaggaaaugauuuuccucuaucuauauauguacguauauauauguauguuauaugcuuguaccuagguguguguauacauguauggacacacacacacacuguuuuaaaacaaaagcucugggaaauaaacgcaucuugcccccuaacucuccuccccucuccuauauaauuguucaguguuguaaguuuucugaguucaaaaucuguuuuagaucuccaacuaagcaucgaaaguuggaucuuaagucacuucaccauucuuggccuuagcuuucuuuguaaaaugaagaguuugaccuaacugauauauaaccaagguccuccaagcccucgacgucuaaguucugugauuuaaaaguguuucuaucaguuugucaagcccuuucuuggaaacuaagguuauuuaaaauuauauggugcuuacgugauucaaaauaauuauugcauaucuaaugacauuuaauuauuuccauugacaaauucacacaggagaauucaaauagcuguguuggaauuugaauauaauuugaccuaagauacaauguaacucagacauuuacaccuacauguaccagucaauauguggacgggacaggccaagccgccuguguuuggacuacaugaucuuauccccccuuccucguuuguagcucucuggaccgggaaaaugccugucauuaagguggcccauucauaguaugaccuaugucugcuucaaaaugagcugggccauccagugaucuuggcauucugagcuuagaaauacaaagacaaagaggaaauuagcaggagguacagaaccagaaagaaugcaccaagagguaucaugaagaaagaguccaaucugucaucaugagagggcagaagccagagagaagcagagguccccccagagagaggagagaggcugaauagcccagcagaggcgaggaguggcauucgguucccaagagcucucugaguccaaaaccuaagcuacagaaaacuauuuaugauaaaucuuuuauuugaacaaacucaaauagguuucucuuccuuacuauuaaaacuaccccacuaaauugaucagcauacaaaaauccccccaagaaucauuaugaguuccacaaaaaccaggaccacaucugaguuauuucucauucuauccccagugucucccaaagugacaggcaugagcuagauuagaaaauguuuguuaaauuaguaaaugcauucucugaucaaucaaugaauaaucauugaauaauuuuuaaauuucacuucuaucuucuauuuuuagcauagauaucacuaaaacugcauuauacgugacuaugggaagauucacauuuacaaugaguauuaauaaaauuuucauaagcuggcuuuuaacuuuagacuauuguuaucucuaugaaaagguuaucaaaauagagcuuuaacgaaguauggauuuucuaaaaauagggacgaaaugucaugcuuagaauugacuugugggaaucuccuuucuccuagucacauuaugacguauuuaaguucagaaugccaagaucauuggaugccccagcucauuuugaagcagacaugggucauucuaugaaugggccgccuuaaugccagugggcaaaucccugacccuuguauauacagagaacagugugaguuucuccaucuauuucuguguuauucuagcgauggauuugugccgacaguccacuguguuucuucccuugucucuuaugugaccagaaauaauguuucugaaagagaagaaaacaggguuagaauaugccaucuguggccaaggaaacaagcaaagccaagccaauuauucaaauuggaauacucuuccacagccacaggcaauggaguugauccuauccuggagaaucaagcucauuauuacauggcucuggaccuaucagagggcauucacaugaccuggaauagacacaaggggagucuuaaaacaucacgacaaauuagccggcgugguggugggcgccuguaauuccaguuacuugggaggcugaaacaggagaauugcuugaaccugggaggcagagguugcagugaacggagauugcaccccugcacuccagccugggugacagagcaagacucugucuccaaaaaaaaaaaaaaaaaaagucagaacaacuuugucucuaacauucuuuauggaaaaugauugauauuauuuaagaugaucuauagaaaauagauggaguuagguaacauaugggccuaaaauccaaacaaaaauguaguuggaacaacuauauccucagauauauuuauaauauuuaagaguuuacagucauuguauaggggaaagauuuaaaauuaaauggauuuuaacaaaauagagacaaagaucaccguaacugaagauagcuugaguuuugaggggguucuugaacuacacaggcuauuauuucuauauaacaugcaaguauuuucagucaaaacacaugauucugucugcaguuauuauguaccuauuacauaccaguugucauguacgauugcauggguucucuuuuucucuuuugagaacuuaccucaaugugaucuagagggaaaaaauuucaggagcaguaacugaauauauuuuaaguaaaaagcaaaacauuacucuuaaguuaugucacagaugcuugcaaagaaaucuugagaguguuaaugauucugaaauaggaguacacuucuccucuaugcucaaaucugugguuaccuucagugauuuugacuuagagucauccuuuguagaaauucaagaaauuagauccauugggaauacaaauaaauaugaaucagcacgaagaauuauuuagguuuauauugauugacagacauaaagagccaccauuugaucaaggccuguaaaaauucaugcuuacaaguugacaucuuagauugaaaggauaaucauugauugaauccguuuucuaaugcaugaauauaaaaauagcaaaucaaaaccucaauggaaaauagcuaucaugcuucugaauaaaaauuaaaauauauaagagagugaguuacaaaugguugcuggagcaggugggcguggucugccuauaagagagcagacuucagucacagaggaaaggagugguguggcaggcaacaggguugaauauguuuaaaaaaaaaaaaagguuuguacuuaacgccacagagcucuagaagcugaaacuagaaucagugagugaaaucuacaaagaggccaauuugugguaaaaauggaaugggcuucuuugggagauaucagucucaguacauuugaagcaccccacagaggccaaauaaccaccauucagaaaguucuguguugcgacacaggcaccggggagcagugcuggacuuccuacaucucucugcugaaacauucauuuauacuuccugaggcucauaagccucaaguguugucuuauucuugcuguauuuugaauccaaacaauuaauaugauuuaugugaucaucuccacccaaaauuuaaaaaaaaguuggagugcauacacacacacacacacacacacacaugcacacaugaauauaaaaauggcauacuucaggaucaauuacuuaaauauauuuucaguaaaaagcaaaauauuauaggugauacuuaauacauggcugccuuuaaauagcaugugcuuauuagguccugugaauuuguuguugguucagauacuuauuguugaugcauucuuuggaaauacccuuuuaaaauauauugguaacacaagagugaugauucuccuuucugguuucauauuuuugacuggaaaaaaaaauaaaccugauucauagcaguauaaauguaugguuaauuuuuuguguuuuagacccaccguccuguguaaaugcucacuuaaccauaggcuaagaaaauacuuggaaauagaaaagaaaaugugaacuacugauuguccucuuaguugacaaaugcuucauguuuucgcuugaaggcaugugcuaugaaguaggcaguugcugucucagugccacaaguucaaugucucuggaccccagagucgauaguaguaguuaauaaaaagcucagcaguauuuuuuuaaugaaguaaucaugcuguacucuauaauuuuauucuuggaagcauaaagaguauuuacaauauggugucuuucuagggucagaauagugaggaaaaaaauggaaaaauguccaaacauccuuccuugcauggcaaugauggcauuacugguguguuuaauaaaaccuuuauugguacauuuuccggugugguggcauuggcagaaaccaucccccuuuggauuuggaacucagcagcugaugaaauacaguaaacauuaauuuggaaugggcugccaguuuuggaaagccaggugacauuuuauuauauuuguaccaagcagaggcugugucccauacugcuguagcuuccgcugucagaggcuuagcuggcauuauggaaaaaaaaaaauggcaggccugagaaucuuauccccugaaaugaaagucgaaugccaaauugaaauuccuguaggauuuccgauagcaaugggggaauugagaagcucacaauuaagcauaugggcauuaagauaauugucagaucuguuggcggacaugauagaagacagauggguacgaaucagugcgcuccacugcagcacccugggaggcaauuugacguuuuaccugccugagcuacucugccauauuugucacugaauguacagcacggcaucuuacugaguguuaaguguuuucgccgggaacuauaggugcaugugcgguccuucagcgcccucuagugaaacgcguuugggaguaugguuuuugaaaagccagccuucaucagguccucuuggccucuggaaauagcugucgcaccuccgguuccugcucaccucucugguuccucucgcccuuucagguggggacccaucgugaagauggcguggcccugagaggcagccauucucuucugccaaaccagguuccgguuccacagcuuccuguccagucugcgacuuccccugaccugaacccaccccaggacccuuacagagguagguuggccucaccagggcacuucugaccucacuuucacaauaggaccaguguugauacccagccucuugguguucaucccucaagaagcacuggcagaaacccaggaaucaaauugggcacaaaaaugguaaggaaauggcaaaguauuuagaacuucgcccgcuaauuguguuucuccagggacuguuuuccucaaacauccucugaaauccugguccuauaucagcagggaaugaggccacagacugaugagaggaaauuuuauuuuagcuauuuccacauuuuucucauucagguccucuaaugugguuaguuguggccugaaaaugauauuuccaaaugaauaggaaggaaggaaauuguuuuuguuguuuaagauggaaggaaauauaggugcauuuaaaaaauggagcuugguugcaugauuuucgcucuugagucaucuagcccucuaaugauugccucauaccggugauuacgagcggcuuuucaugaccccaggaaguugggcuauugcuggccagcugacuaggagucgcuuagauaacaucuucucagucccuucacauuuaauauaaaaaugauaacauugccacaggaauacaugugggcauuuuuucagcuguucaacauuguacagaucugagugucaauuauauguauggguaugucugcccauuuuuuaugaauaauaaucauuuuauggacuuuuuuuuuuuuuuuuuuugacagagccucacucugucgcccaggcuggaguacaguggugcgaucucagcucacugcaaccuccaccucccagguucaagcgauucuccugccucagccucccaggggguagcuaggauuacagacaugcaucaccaugccuggcuauuuuucguauuuuuaguagagacaggguuucaccacauuagccaggcuggucuugaauuccugaccucaagugaugcacccgccucagccucccgaagugcugggauuacaggugugaaccaccacaacuggccaggaccuuucuuaucaggaggcuuuggauuuugcccucuuuguccuaaaccugugcuucucaaacugcacauaagcacaaccugagcaucuuguuaaaaugcagauuccacuucuguaggucugggauuguccauuucuaaugggcucacagaugaugaggccgcauggaccaaaguuugaguggcaagguucuagaauacacagauuacaaauaaagaggaauacuugacagauaugcuucuaccuuuaaaaaaauuacuacauuagggucguguuuuaaaaugcagugugacuuggaaaguugagcaaugauaaagcuagaaauuucuaaaaugaguagcaaacugccuuccauauguaccauuuuaaaaugcugauuacuucuugagaauaagagaagccuaauuucagaauaucauuaggguaccuauugaagucuugacugcacauauuuagcauacucccugggaauuauauuuuaaggacauuuuucuauuaaaucauugcauauggaagaaacucaauauaauagcugauauuuacuuggguucuuaaucagaacauuggcugugugauuuucaugauuaugauuuucauugcaauuaaguugauguuuuguagacagugaaauuaccaucuacuccaaaagauugcaaaauagaauuuaaccuuagagccaaugcagggaaaacuuguuucugcaggugcauuuuuugaaacuucaacagauagcagggggaaaaaaaagugacagaaggaucacaguucagcaguaugaauugucugcuggcagccuugcaaucuggugugcaggcagugagauugugguguacaugucaccugauuucucuuuuucggcaggcaugccaccaggacuacaggggcagagugucuccucuggcagcucugagaucaaauccgaugacgagggugaugagaaccugcaagacacgaaaucuucggaggacaagaaauuagaugacgacaagaaggauaucaaaucaauuacuaggucaagaucuagguaacaguauauaauacugucgcuucauuuaauuccuuuauuggacuuugaugaagugaacagaacgggaagaaacuauucaguuuuuuccuggcagguaaauuuacagcugaaaagaaaauuaaaggccuacucuagaaguacuaaaaguaucguuucagauaccuguacucuauuggagccuaaacuguuuuggcauuuaugaaucuggacccaaugcuaaugacacacagugaaaaaauuugucucugauucaaguacaguuuauuuguaaaacuauacuuauucuacaaauuuggucagaaauguugugucuauaauauuucuaaaaagagauuguagccauguuaaaaacucaacugauguaugugccaacuauaacucuuuucuuaccucuaaaguaagaaaauaauuuccuagauuuauccuaaacaugcugauguauauaagaguaauaccuuaauuguuuaugguuuuucuuccuggacacucuuuucuacagaaaacacaacugcaggaaaauagcuucugucugguuuucuuaaauaucugcuaucuuuaaauucaaaucuauaucuccuugaacuuuaaucugguaaucagaugguuuuugaauaccaacacccguguacuuugccucaauucccugagguuguuuuuauucacaaauucaaccaauuguccuaagacuacagcuuuccuucuaaaggcugugguucucaagguucuaucuggaaucuuuugugaauuaagaacaugcugccucuuuauguugcuguuguaauuauugagauaaauuccgugucuugccacaaguuuaaaaaugccgaauacuucuagauaaccccuuuccuuccuuguugucuuuuucugauucuuggccacuuuggcaagaaaucccaaggaggggauuucauaccuuuagcagcuucuguguuagaccagucaguucuugguaauuuaacuuauuguggccaaacuuaugcauguuaauggauucuuugaaguuuuggaacaacauuuucauucgcuguugagaaccuucuuauuuaaaaaggucacucuuaugacauuuacuuauguaugccuccaaaacuguauuauaaggcagugcuuuuucaaaucuaggcaguuuuauuugcauaacuaguuuauuuguaagugaauaaccaauucuaauuggucguuagccugaaaaucuuuggaagaaaaguuccuauuuuccagucuccuuuguguaagguguagcauuuguuggauguauaaaaauaucacccaaaugcucagcuuccggacaggccuggcagagacuguuuucauuugcuuuuuacagccuauuugcauaguagaauauaggagugaauuaaucauuacugauuuccuuggcacuggcagcaguugggggugagggcagaggagggauccgcagaaggcagagaaagagggccuuuuccaguggacucaguugacuuccauguuuaccauacacaccuguggcagacagugccaucuggaaaggcgcuuacgcuauggagagagaggagccuggucuuacagcauccuucuguggugucauccuccuugccccuaacuuuucuccuucacccaaguguucuugacuuacgugcauuaucuuuauguguaacguauacuugcaaccgaagaauaccacucccacuuuugauugauuggagcuucucaaguguaauugguccuuauugccacuuggaaguuacccagagauucuccaaaauggaacaucagagucauauauuuuaaaccagcauucauuaaauauacauuuaauugaguagauaauuucccacaucuuccaacuccgaaauguugugauuaaucaucuuuauucugugaacauuuccaaugugugaaauuacccuuuagguuaauuguuagucacuuccauggaguuucuugugauggggagucuacugauguucagugaaguuuguuucauuuucugugucucucauaagccccccaaaaguccucacucauguuuauucacaauagucauucagagcuuuauagcacgugcugcucugccuucuugagacaagacgucgugcacacuucucuuuuuuacaugacagcccuuggaauauuugaacccugcugcugugacgacuuccucauaugauaugcuuuccagguggcucaucauccucuuugccuuccauucaaaaguuucuaauuugucacuguaacacucagaaauggacagaaccgaucuuaucuuuucagacuauucugggcccggccaugcauuuguuaugaaucauggaauauuuugguuuucacaauuagaaauuaccuuuuggcuuuuuuuuuuuuuuuuuuuuguaagagacagagucuggcuguguugcccaggcuggagugcaguggccugaucacaucucacuguagccuccaccuccuagauucaagugagccucccaccucagccuccugaguagcugagaccgcaggugugcaucacugugcccagcuaauuuuuuuuuauuuuuuguagagacgaggucucacuauaucguccaggcugggguuauaggcaugagccacugcacccagcuuucuggcuucauuuuugacucacaaugaggucauggucauucauaagcugcagguguuugguuuguugaaucguuuugcaugacugauaucaguucagguuucccaaacuuguucuguggaucauaaacaucuauaagauuaaagaccauggaagucauguuuuuguaacuuuuuguuuaauacauagagaaaaugagacucacauaguggguugaccaggccuucaaagcaagguaauggggacaccugaauaaaagccucacugucuucacucccauugcucuggugucuuacauauaggccuuucuucuuacuccuguuaagcugccuuguauuuuuuugaccuaucaaaaucauuuuucaauuacuuguuuccccuagauuucagaugucacgguaugaaagguuuuauauauauuuaaaaaauaaaguauaaacauaaagucuuuuugaagcgugguuaugcaacauaugcuaggcguaaguuggugaaugccugcuuugcagaguguaaccccauugaauaaaaaaagcuuuguuuucccuuucugccccccuguaucaguaugggcacacccugcacucuaacuuuaaucuacgucacccucaccuguuugguuuggguuuaaugucugcgagaaaaccaaauaucuuguguauugugaacugucaaagccaucuaaaccaaucccaaggucaaguggauauaaaaauucugccaaaaacauggcauaagauggaaaaguucccugaaaacucuggaagaaaacaaaguaauguagacaccuucuuuuuccccacaccauuagaaaauguugcaucccuuuugucccacagcaauaaugacgaugaggaccugacaccagagcagaaggcagagcgugagaaggagcggaggauggccaacaaugcccgagagcgucugcggguccgugacaucaacgaggcuuucaaagagcucggccgcauggugcagcuccaccucaagagugacaagccccagaccaagcuccugauccuccaccaggcgguggccgucauccucagucuggagcagcaaguccgaggucagugcaggccagccuccuugcagagcucgugaggagcuuguggcaggcacaagcugagaugggcacgccagucuugagcaguggcagacaguagacuuucaagcaucauuccaaagaauuguuuccauugcagacugugucuaaauccauaaggcagcaucccuuucuccuguaauuaaguugugggauucucuuauaacuaagauuauauugcaacuuucccuauauccuuucaguaauuugagcuuaguuuauuugcuuuaccaaccuuugcuuacuguaaaguggcuguacacacucacaugcaguucaccuuuuacuagugacugaccaaauggauugccacaguacuuaguaacuguuccuuuuguucuguaauauaaacacugagaaaaaggucagacacgcaagaagagugcauugcugcccucugccagaagccucagcauuaaacaaagguucugugcuuuaauccuccacagaaaggaaucugaauccgaaagcugcgugucugaaaagaagggaggaagagaagguguccucagagccucccccucucuccuuggccggcccacacccuggaaugggagacgcaucgaaucacaugggacagauguaaaagggcaaguuuguuuucagccauuucugagaucgaucauucaaaacucucaucaguguaucagccauaaaagugaauuucacccaaauugacagauauuuucuuucauggaaaaagaauuuuuuuuaaaaaaagcauacuuuuucuguuacaaauauauuaaugaauuuuuucucucuuuuuuccuuucucagguccaaguugccacauugcuucauuaaaacaagagaccacuuccuuaacagcuguauuaucuuaaacccacauaaacacuucuccuuaacccccauuuuuguaauauaagacaagucugaguaguuaugaaucgcagacgcaagagguuucagcauucccaauuaucaaaaaacagaaaaacaaaaaaaagaaagaaaaaagugcaacuugagggacgacuuucuuuaacauaucauucagaaugugcaaagcaguauguacaggcugagacacagcccagagacugaacggcaaucuuuccacacuguggaacaaugcauuugugccuaaacuucuuuuggaaaaaaaaaauauaauuaauuuguaagucugaaaaaaaaauauuuaauuuaaaaaaaauuguaaacuugcaauaaugaaaaaguguacuucugaagaaaacuacaugaacguuuuuguugguauucaagucagcuaguguuuauaauuacuggauauugaauuaggggaagcucggcugcccuaguaacaaaaccagcaaacguccugaugacaacgaagugaugacauuagccauuccuuaggguaggaggaacagauggaucuuauagaccuaugacaaauauauauauaaauauauauauaaauauauauuaaaaauuuagugacuaugguaagcuuuuguucauuuguuucagacuuuuuucuccuguaaaaaaauaguacugauuaacuuuuuuaaaagaaagauuuuacuguaaauauggauuuuuuuuuuuuuggucuuauuucugucccuuucccugguuuguuaucguaaccuguagugccaacucugcuuccagagggguagugcaggaugaaaugcugacccugauguugcuucucauucauaaauaaguagaaaguuguuucuccagucuuuugggaacacaggacuuaaaagucacaucauguguagauauuacaagcagcauuaccaagacauggcaaaaagaguuugucugaauuguaauguugcguuugugaaccuauucugggauuuucagagguacaagguuagaaugcuacaauguuaccacugugccuuccaauguuuauaucaucggaaacauaacauaaucaaaguggcugugauuuaacaaaaugauuaaaguguuaccuaccuguguagccgaaguagugugcagugaggcguuucugaauacauggucagauuuuuggaaaaaaacaaaaacaaaaaaaacaaguaaaguucaaaaaccgucaaaugagaaaauugcaaguagugugacagagcugauugauuuuguugcuuucuugauuuuuuuuuucaaaauggguuuacuaaaauguagaugacuuaacugccuccuccuucgucugaaaaaugccaauauucaaucaucaugcagcauuauaacaagccuuauaaguccuaaagcauuaaguugcacuuuuuugaggagggguagugcaguauuucucuggccaguaugaaugaaguuuauacuuaccauauuugauagaaacauagaucaagcuauggcacagcgacucaucagauagcuagcuuugacgucugggcacaauugaaccaacuuccaucgugaaucuuuauaaugauugacuuugguguauagugcaguaaacaaauagugcuccuaguuaaguauuugucagcauccuuuugucucuaacuuguuucuauuuuuacagccacacaauucuuggcauguauuaagaaaaaaaaaaaucccuguucaaguaguuuuuccaccuaucagcacugaguaaaugccauaaauccauugaaauggucuaaauguuccaucuguucuccuguuuugccaguuauauaguaaugaaauacauuuguaaauuuuaugcaacaaauggcaaacguaucauuauuuugaaauuguguauguaaaaguuauauuuuuacauguagacucuuguuauuauguguuuuaauacauuguaucaguuuuuguuuuuuuuuaaaaacugugguuuaaaaagaagucucauuuaaaugaaauagcuacaagaaucagaauuuuauguucauuucugaaaauguaagaacaaauaagauaguuaccacguggucaucuuuuacaaacccauaaacauuuugauuagcuguguguguguugaaaaacuguaaauauguucaguagcgauaaaacuaaaauaacuuugauuuguugauaaguuccuaaaauguggagguggauuaaaaccuuaggagaauagcagaaaucaaacuucaugaaaaguuauuuuggggcuuuccugugaaauguaugaacaaagaggcucagagaaggacauggaagacaauaauguauacucucuccuccucccugaauaaugaaaaccauguguauuuguucccuccguauguuaaagauuuccuuuuagugguacauucugcacucauuuuguauagucuaccaaggcggguaucccuaggaacaauauuauauaggaagcagguauacucugaucacauucaggauaaguguacagaagaaaauacgguguuuacucuuuagggaacuggaaacacucccugcauugauguacauuuuaagaauggcacuuuugauacauguuaucauaaaggugcuuaauagagcugaauuaaaguuuuucaaaucuguaaacaaagcaaaaaaguaaauuguagucauuugauuauuuuuuaaauuggugcuuuauauuuuguucucacucagaguaaaagcugcaauuuauuguucaccagcuuugauguauucauuacucaguaaugcaauaccucuauuguugaauucccuuuggaaauaagugaaaauucuaacggccacugaaagcugcucgcuagguuuugcuugguggagaaacauaaucugcaccuauccauauuaauuggguuguauccccauuaaaaaagaaaaaaagggaauguggccuuuuuaguguguuuuuuauuguuguuguuuuguaauuaucaaacccagguaagauauugguauccugcacuggauuuucaaaugaaguucagcagaagacaguuaagauuaaaguacuauacaaaaauuucaaaaggguccauacuacgcuaucuguaugacgacacuuaggcuggggaucucuuucagaaacucggacuuuaaaagcaacuuggagcaguugauccaccuccacauucaaguaauuuaugaauaugcagaauagggaucuguucaucuagaaauuuuuaccauuugucuucuguguagcugcaaggaacacuaauguuuauacaacugucaguccacccaguggugcaacugguucugauucagucuuccgauuccuuuuuauuuuucacuuuuuccuauuucugaauuuuuuuuuuuauuugugaucuugauuuugaugagggguuggggaguggggagggagucgaaccaagacuuggaguuaagaggauuuucaucuuuugcauccaacaggcagaauaugaucuguguccaaaagugaacuugagucaggaaugaaucaauuucagcauaaacaagcacaaaaauuuagucugcuggcugacuggaagcaaaaaagucaagauggaauaugaugaauuccaacacaauggggcaccaaggccuuuaggccucucuuuuuauuuugcuuugguuuuguuuguuuuucuuuagagacaugcucuuucucaugggacuugaaguggacucaucuuugugcagugcugguuuugccauacucauuucaaguauuauagacauauguaauggugaaaauauaugaacuguggccuuuuucauucuuguuacuugugaugcaauuaagugaagauaagaaaaaaaaaaaaaaagcagagauuuaccauguaucagugccuggcuuuuuguuauaaagcuuuguuugucuagugcucuuuugcuauaaaauagacuguaguacacccuaguaggaaaaaaaaaaaacuaaauuuaaaaauaaaaaauauauuuggcuuauuuuucgcaggagcaauccuuuuauaccaugaauauuacaaaaaaauugucagauucugaauauuucuucuuuguagauuuuuggaaucauuaugaguaaaaguuuguuacuuuauuuuacuauuuaaaagauguuauuuuaccauguguuaccaagaugaaacuguauggguagcuuuuuuguuuguuuuuuguuuuguuuuuguuuuuguuuuuguuuuuaguuguaggucgcagcggggaaauuuuuugcgacuguacacauagcugcagcauuaaaaacuuaaaaaaauuguuaaaaaaaaaaaaagggaaaacauuucaaaaaaaaaaaaaaagauaaacaguuacaccuuguuuucaauguguggcugagugccucgauuuuuucauguuuuugguguauuucugauuuguagaaguguccaaacagguugugugcuggaguuccuucaagacaaaaacaaacccagcuuggucaaggccauuaccuguuucccaucuguaguuauucgaugaagucauguacaugaccguucuguagcaauaaaugugccauuuuuauaaacuguuucugacacuuguuucauuucauuuugcauuguccauauagcuaugauucucuucuguaaguaaaacgcaucuauauuucauuuuccaaguguuggagguauugacagcuuaacaaacaaaacauacaaaaaaaaucacaaaaacaaauugaaaagcaaagcacaugauugaucaaggaagagaugcccuuaaugaaaauggaacgggaugcaugcaaaacaaaaagaaaacugucuagaggauuaacuaauugaaggaauauaauuaauguguguguaacacugaagcuaugcauuugaagagcucugaacugcaccaguguuuucgguugugcugcagguugcuaagucaagucagccuuaaccuuuugcaccaguuggucggcuguuuggcagaacauucucagaucuuuucagucaaaaaucuaagaugauuuauuuuguaucacuuuguuaaaagcugaauauuguuaacuacaguuaauauuaacacuguauuuauacuuucucaaacuacauccgccccaccacuucugguugccucuguugacuauuaauccagauguaaacaaccagauguuuuuuucuaacuuguacaaacugacgugugucaacuaucauggaaggaaaaaaauguacagauuaaaauuauucaguguuauguacuguaaguuaauauuuuuguagaauggacaucaaucuacuuugcaaaauuuggaggcuauuucaacauugcacuguagaaauguaaaguaauguaugcaauguaaaggaaagcccgcgguagcugagcgcuucauaacagaauguucuaaucaaguacgugguauuuggggaugucuccaauauugcucuuguauucuuucuaauuggguuuagugacuaguugaaggaaaauguuauaacgccauuugguucacaugugaagugcccuccauagccaaauguugggauuuuuuuuuuuuucguuuuugguuggacuguuugcagauauuuaaauuuuaugaaauuuccaaagauuuugguugauaacccccuuuuaccuucuaaaugauuugagauguucuuauguucuuacuguguguuuuaaauauauauaaaagagccacaagcauuu

SEQ ID NO: 6322 - RNA, 363789 nt, Homo sapiens
cucuucuagaccuucuuuuggagaaauggcuuucggaaguuuugccaggaaacguagcccuaggcaggcagcuuugcagcccccuuucugcuuguugcacuuucuccauucguuccuuugcuuuuugcaggcucugacucagggaaggugugcauuauccacuagauacgucgaagaagagggaaaccaauuagggucgaaauaaaugcuggagagagagggagugaaagagagagugagagugagagagagagagagucuugcuucaaauugcucuccuguuagagacgaaaugagaauuuagugcagguggcacuuuuauuuuuauuuggguucacauaugacaggcaaauccuauacgagauggaaauggacauugccacguuuauggccaagguuuucaauauaaaacaaaacaacuuuuuucuucuccuuggugaaacuaguguuuuucuagagaggcugcuggccuccaaccugaaucuugauaacauuauggggacuguguuuguuccaaauguagcaguaguacugcuuggccaucuaaugaaccugaggaaaaagaaagaacagagugauaaugggggcuggggugggaucuguaauguuguuucucuuuuaguuuuaaguuggauggugauguauuuuacuaaauaaacccuuagcauaaacucuaagcuguuugguaacaguaugaaagaucuuugaggagcucugaaggcacaagugucuucuuuucaacuguaauauuucuuuguuucuuuuagauguuuucaccuccugugagcagugggaaaaauggaccaacuucuuuggcaaguggacauuuuacuggcucaaguauguaaauucuuuucuuaguguuaaguuaaauguucugggcuguuuauuuacucaauuguauguuuuuggcucuguugaagaguucugaaaaagucauugaauuuuagccuguaaucauacgguuauugcauuacccaucagugguauaacuuacacaaaauguuaucuugugcgauuaaaauuaggucuuuuuuuuuaagucaaggaaacucucucaaaauuccaucacuuaauuuaagagcaauuuucuaauacaguuguaaucaaacacaugaagauaagaccaguguuaacauggggaauaaauuaauguuuucuauuugaaaauaaggggaaaaaaucucuaacauucauaaaaugggaaaaucccuuguaaauaauaucauuuauuagguacuguauacaauuaacccuuuuaaagaaaugaacacuuaauucugcaaaugaaugcuauguaguaaaccauagcuguaaauagccucuugcuaaucuuagaggcuaaauaugaauucauuuauauuuaaaauacccuuuuugaugcuuuagcuguuuuuuuuucccuaacgauuuacuugugcaaugaauuuuuacuguauuuaaaguugcaaaucuggaaggacuuuuacguuuuauaaaugaaagaucuuugggugaugcuuaaaaaagaugcuagcacuauucacaaaggaaucugugugcacagugauuaucuggaaucuaaggagggguuuauuacagggcuauucgaauaucucuuauuaaaagugcagagugaaaauauucauuuaaaauguauuuuuuuuaauccaaugaauuucaaauaagaaaaaguuauacauuguugccugcuauccuuuaaguccguggcuuaaguccauuuaugcuuguuaaacagcugcaguauuuuaggaguucuggcaaugguauauaacaguacauuaggccaaguacuauucuuaagucagacugguaaauguugacaucuuuuaacugugagaugccaguggaauugucugucaacuaugaauauaauuuaacaucuuuuaauauucauuuggugcuauagcaaugaaagaaguuuguucacuuaugugauuuguauaauugguauauuuuuauaaaacuaauggcuuuaaaaguugcucauuuccaaauaaguuccuucuccuucuauugccugccuaaguuuagggaauuugugucucgauaacuuguuuuaaaaaaugugagaugcuucuuguauuuuuauuuuaguuuucuggugcacauugauuaaaaggaccauugacagacaauauguuuguguuuuacuauccuggaccugguuauguuuuccacuuagggauuugggauaguuuuuauauuaguauuauaucuuuaaauuucuguaugguauccucuaugcaacuuuuaagauggaaaauauuaauaugcauguuugauguaaagguaaggacaaguaucuuuugugggcaaauuaauuuuucauguuagacaagaucaaaacuaacuguuuuugacaguaauuuuuuuaugacuuaacuuaaaaauguguauucaguuucaaucuaaaaguagcuuaugucagacagacacagagauagacuacuuuuaaagucaaugcuaaaaaacuaguuugcaauguugugaaaauaugcauuuagaauaacuuaaguauauuacauuagauauuuaauaaaguaagguguuuagaaauaugagauuguguuacauuuaaaaagacaacuguaugucugauccauuuucuauguucacauuuaaauaaaguucuugcugugauguuuaaauguuuauagagaguacaggcuuaauaaguugaauauguauuaaugcauuuugguaagugaugauauaucaacacuuacacaguucugaagacaauaacacacacacauacacacauacacacauacacauacacacauauguucaugcaugcaaaccuggagagagacuucacucuuaauaagucauguuacacugcuucuaaugcauacacagugauuauuuugaagguguggaacuuuaaguuacguuguaccagaaaugguguuuucaggaccaaauguuuacuuguaaggguaaaaaguguaaugguccuuuuauucuggcagccugaaugagaaugcaggguauucauuucauguaguaugauggugauuauaauauguaggguacagauuggaguguucaguuuuccucuaucaagauaguauuugaacacagggcuguuaguuaagaaaacggguuguauuuccacuuaaaagaguuaaaucuuuuaaaaagcguaauacauuuuaaaaaucaugaauacugcauuuugcccuuuaauuggaaggaucaacuaggaaacuuuggagagagaaauaauuuucuaaauuuaccucaaguuaauauccauugucuugaguggacucagaugucccuuucauggauugcuuugaaacuuggauuuaggaaagaucuaaacuauaaguagacuguuccuauuugaaaaaucagcuaugguuuuucaaagugaggcaugguaauaauucaugcuuaaaguucccaauagcuuuugauuccauuaauauaggaugcuccauagugauuugcaaugugagaauaaaaauaaaguguggccauauucccuuuaaucuuucauuucacaaacaugguuuuuccuaccaccuuaagaaauggugaggcugcuagggagaauggaauguaaccugagcuacagccugacauucccagggagcauuuuucacaugaaaggcuuuugucaacccaggaaaggacuagcaguuuuuguuugauguuugcagguguucagcagaaagcacuaaaacaauucagccaugaugguucagagcuucgaugaccuuaacagggaaaauuggugggcucuggaauuauuuuuaagaaauaguuauaaccuauaugguaacuuaaacaaagggauuuaauauccguuauaucauugaucuuaaaacaaacuaaaagcauccacaugccuggaugauuggaaaauuauucucauugaaaaguaggauaccuaaguuaccaaaaaaagaaaaucaucuaaagagucuauaauuuauugaugaguauggacuuaauuuucugauauagcagaaggacaguuuauuugguuacuuuugacucuugugaggaaaagauaaacauccuagcuuugacaucuuuuuaaaaagucguuuuaaaguugggccacuaaaaugauacauucuaaagaacuuguuagaucaggucuggucacaucuguuacauguauuuacugcuggucuaugacagauacuacaucuuucucccuuaguuuaaaaguugagcuuuuuccccugugacuguuuaguuuuacugagguguucagguauuguuaaaagauugucaaaugaacgaguguuugaacaauuaagagcagcguuaaaacacaccacaucucuguugugggucauuuuuggaagaggaaaguauugccugaaauuuaccuaaguuagcuaaccuauauccacaugacaccaacauaauaugccaauuuagugaauucauugaggcggaaaaaaaucaguccgguggguaguuuuguaugauacagaaaauuaacguggucacauccugaauuaguuuugaguucauagugauggcaugaaaaaaaaauugguuuccccuuaaagauauuuguugaggagagcugcuuaauauuguguguguguguauaagugagugaaaacacccuuaaaaucguaaaugguauaauucauaaggguucuguggcuuuuuguaaagggcagaguaauuuaacagguuaaaagaaguacaguggcguuaaacccauuauguuagaaucacagaauuuuggguauagaaacccauuagaaauguugcccagugccuucauuauacaggcaaagaaaacugaggcccaagauaaggaguuccaaacugugcuuucuuauuuguuauuuuaaaaaacaaguuuuuauuugcuaauucucuauggcccugcaaauccuuuauuggaaauaaccuuggucucacugcugucuuucuguccuuuguacugcguaauggggcuugaggauuagugugcugauauuugugcauguaaaugcuucuguauaugcaugugccuucugaaaacuuuuuuagguuuggagcugaauuuuggauuauugaucauucucuuuugccuggucuucccugugacuguuuugcaugauguuggguaaaauaauagugugggugagcaugucacagugcuucucaguguguuagagaggugugcuguguaccuuauaccuguuguauuuuuuaaauccuaacaagaaccuaaugagaugcaaggauuacuacuauccuguauucauagcugaggaaacagagacagauguuaaacaacuggaucuuaaggcagccaauaaugaaauuagguuuuaaccucagguuugucuagcucaaaguccugaguucuauacacacacacacacacacacacacacacacacacacaucagacagcucauuuuugcaagauuauauaggcaaacagugugauauugaggcuucgcacgaaaugcuaucugugaucuuuaggguagauagcauuuuuaaaaaugugucuaauguuguaaugaugucaaccauauccauuauuuuucccgccuuuguauccaaauaaacuacccuuccaauuuaugacagauaucaaugugacuaaauaugucuuucucauaucuuuauuaguuuuacuaagaaaauacaguagauauuuuaaaaguugugcuuucauucuguuguaaguugauagucuacauggaugccaaugaaaacauguuuuuauguagcuaaucaauucagaauuugagguaaccaagccugauguauuaauauguaaaaaaauaaggaucuccugucuuuaaauauaaaaaaguuuugcaguucguuguuagaucuuugaaacuuaauauucaagaacaauacccucaauucuaucugcaucacuaaaauaagcaguuuugaagguuugauaugucuguuaccagacaugugcuuaaaauguuacauuuucuaaauucagaaggcagaagcaguacucuauuugacacugacuuaaguaaauaaaaugcauuaaacaagcguggggauccaagaacuguugaaacugaaaugcuuaacauuuuugacagcaucagcaaauuauccuuacccuacuauuguaaugaggaaaucacuuaaauaacagaugaacagccaagucacauaaacauauauaauagaacuauguaaugaaaguuuaugcuguuaauugcucgaaucugucuuaaaugcuuagaaucauggagcaguaaagacugucauauaaacaguuuuguuuugagcuuaaaauuauuccuuuuugcuuucaucugcuaugauaaacaaaguaauuuuguaagcuuuaaagaucaaacauuuacuccuaaugguaaacuacauuuuauauuggaaguuugcaaccucguccaagucauagaguugaguccugguggccccaggccugugauuuucaacguuuaguauuaugaugcuauuuagaucuguucccauaagccaagauaacagaucuuaaguugccuaauaaggaacaugguguguuuugaaauguucuucaguuuacaagucuuaaaccaaaauguucuuggccaaaccuuuagaaucuauauguaaguugaauaagucagauuuuauacagacauagcaugaaaaugaagcuaaguaggaacagaaaaaucugcccuuucuuuauuauuuuuuuuuuuguauuuuaugagcuauuuuuuauggccagguguuuguucuuccaaguuaauuagauagugcuaaguauuagaaaauguaaaauacauuacagauuuuuuaaaagguuauuuuuguuacugguuucuuauuacucuggguaaaauuuucacaacugaccaccagguuuauuagcuuauaugugagcuacccauuuuguacauucgugagccaauugacuaggaauaagguaugcacauggguuuuauguggauacuuuugacccauaucucucuuaauacuuaggagagagauauaagagaaauaauaauuuaaucuuuggagaagauuaacacuuuguuauaaguuauauauagguaaauauauauauauauauuuauauuagacuugcaggaauagugaaaauguugaaaagguugucauguuuacuuucauuucaaagauaaaggcccaguuaaucagcauaucaaauacccagguguguuuaaaaucaguuuaugugggugaauuucagggcuguaagaaaguauuuuauuuaaaggugcagccacacgauugauuguucaaaugggugcuuuuguacuuuugugugacaauuaacauuuaaugaaugacuuucuggacuggcauuggugguaauuacuauauguaguuuauuaacugcaauccauuguuggaugugccuuuauugauuuguuuugcaaacaccccuucacaugugcggcaguauuugugcagccguauuuguacguuacuuuuuaaagaaccuguuucacuugcugaugcugacauugccucuaaaaauguuaguuuauaaauucucaugugccagaaugucucuuugauccaaguaauuuuagcugaaauacaaaauccgucaacuuuucugcuauaaaaaguuugcauucaaauccucagggaaucccaaaguaaugacacaauauuguuuuucaaguaaauaauuuauggaaauuuacauuuauaagagacuuuagagaugcucuauuuuuuagguaaggagccaagguucgggaggguuaaaagucuuuugcccaaaucaugcaguugguuauuggcuguaauaggacacaaauacacauguccugacccucuggucaaagaccucaugcugcuuuuaauuaaggcuuggacucaauucgaugguaccaacuguauauuucuuaagaagggaaaaauguguauaaucuaccauuucugaaaaaauuauuaaaaauugagauugugaaagauggacguuguaauccagcccacuugucaucacguguucuaauuuggccaaggcaguugacaaauaacuguuaaaauguauuguguuauuaaaaauaacaaaguaagacccaugauuaaauaucagggcuguaauuuaaucuugggggaucuggugcuguucauaaaccauuuggcuuuuuucuguaacggaugacgucaaaauccagcuugauugaauuaugacccuggguuacagcagcaccugcuggugccuuuuuacuucauggccugucagcauuuccauuacaaacuuuuuucucugacauuuuaaacuucaaauaguuaaacuggacugaugguuggcauauaaacuuucugcuccuugggaaaagaccacuugcucaauaaaaacagagaagguggugacaaagccccauuacaggauaccccuuagaauguucugcuuugcuuuaaucuuccauucauuuaaacauucuuuugggggguacuuagcugaauugcaaggcauccaaauggaagguuuuuaaucucaaauuucccaugugaagacuuaaguaugggguguuuacaggacugguaaagugcaaaaagaccuagcaucuaugcagguuauugaaacucuggacaauccaguuuucauacaguguguaaaaugcugaggagcaagccaugaaaaacaugcaaauuggcauaccuugucaguaauugcuuuuauauucacuuaagaugaguaaaaauugauaaugauuaugguuagaaaaguaucuuuauuuauauuuauaucuggagacugguagcauagcuucaguuuguccccuuggguuuuaauauguugggaauggagaugggauguuguuugcaucuagcuagucagcuuuucaucuaucuagucuaauucugauugauggaucaucauauauauauauguauauauacacauauauguauaaauauguauauacauauauaaauauauaaacguauauauacauuuauauaaauauauaaauguauauauacauuuauaaauauauaaauguauauauacauauauaaauauauaaauguauauauaaauauauaaauguauauauacauauauaaauauauaaauguauauauaauauauauauauauuuaguaccugcuauucucauaucuccauguuagcaauuagaggacauagagggcuuuauggaagagagaaccuucucucagagggcauauauucuaacacagggguguccaauauuuuggcuucccugggcuacacuggaagaagaagaaucaucuugggccacacauaaaauacacuaacgauaguugaugagcugaaaaacuuuugcaaaaaaaccucauguuuuaagaaaguucacgaguuuguguuaggcuguagguuggacaagcuucuucuaacaggagaaaauagaaaaguaaaaaugugauuaacaucuagcauugggaagacacaauaaugugggaguuuagagaaaugaaaacuuauuucuuucauggggaaauuaauaaugaaggguucauggaaaacucaauucuaauccuugaaggaaugguagaauuuugacaaguagguagugagacugagcgugcauaucaggaucacugugaaccaagcacagaugaaagaaacuggaaaggguagauuaaagagagcucccagaaagagaaguuucuuggcucuaaaguggagucaacucuggucuagacacaugggaugauuuccaggcaaaaaccccugucuugguugccguuuauuuucuugacugaguuugcguuucacucggggguguuaccgauuauaauccaguuccauccaaaaguauauguuuuuaaugguagugucgggauggaaauugaagauuuugugucccuacuucccaaaauucuuccuauaauaucacucagcaguggaaacuuucuugagccaaaugaagcugcuuuggagaaaauuguucauguagccaaauucuggaaaucuagguucuuuugcaauguuugcugguaaguagcuguuucauauugaggaagugguagaaucuuaaaggcugcaccucaaaacuaaacaaaaucgaaacucaccaguacaauucaagagggguuuucacauuuuuuaaaaaggaauacugcuguauuuaaaacauuuuaagauugcaaaaauucaucauuauaauuuuuauuaucaucacuggcaucaccaugaccagugucacauuguuuggucaaaagcuggaauggaaaugugauaguuaucuuugccauauuauauauugagaaaugcguuuaaaacuuuuccggagauaccgugaucuuagcaaaaacuaauguaauauuuguaaaaacauugugaaguggccagauauaccuuuuaaugaaacugaccagaaguacaucacaaauagaaaaauacacguguguguguauguguauaccaucccuucccccaaauauuguucagauuaaagugucuuucucucugugaccugcaaguaucuuaacuuagcauguguguccaauuuccauagugaagccaaaaauucaaaugaugguugauauuggcuuaggaagaauuuauuaaugaaugacugugcuugguauagaguaaaaaaaaaaauuuaugacaaagaggauauucuagacucauguaaaagauuucaguuaagaaccuaugaauuccucaaccuuuuucuucacuuuucaaaaaguaaaggauuuauauuggaaauauuuugcaacccuacaaccugaaacucaaagcuuuggucagcaggugguaauaauauuuccagguugaauauccaauuucauacauaacccaauuuguaaguuugaaaagaaauauuaaacgaugucaguuuuaaugcuuguuugaauaauuguucuuuguuaugugcccucuuggacauuauuguccacuagugccccaaaccauugaaugcuuuucuguucucuuauggccacugugauucuucaaucuaguuacuucuaacugcaagauuaauuuucuucugacaucuaauuuuccccugauuuuauuaacaucuuauuauucuuuuucuggcucauuuugaacaauuucucuuuuauaugggguguauauuuguagugucccacuuguaagggaauucuacacuuuaauccuuaguaauuuugguagaauugggauaagaugagagauaguccauaauuguuuaaggcuugauuguuuaaagaagguugaaagcuucagaaaaguggaaguggaugaaugcaugccauguucuuauuauuuuuucagugugaguguguuucacuggaguaacgauagaguuauuaggaauuauuaccuuuaauuuacuuaugugcacauucauucguccacucauucauucauucauucauucagugaaaguuuuuuuuuuuuugagagccaagauacaaguuauagugcuagaaauuauggugcuacaaagaacaacaaauuucaacuucagcacugggacauuauguugcaguuguuaaauaaaaguucuacaguaauucaaagaagguacuuuugaaauaaaugauguuggccaggcuggguggcucaugccuauaaucccggcacuuugggaggccaaggcaggcggaucauuugaagucaggaguuugagaccagccuggccaacaugauuuaauuauuuuguagaaaucccguuucuacuaaaaauacaaaaauuagcugggcgugguggcaggugccuguaaucucagcuacucgggaggcugaggcaggagaauggcuugaauccaggagguggaguuuguggugagcugaaauugcgccacugcccuccaguauuggcgacagagcaagacucugucucaaaaauaaaauaaaauaaaauauguugaaauaugcaaguauacuuuuucaaaggacacuuuucaaauauaaccaaguacagacuucacauuucuaacugaaacggaaauccuaaaaucucuguauauguguacauguucuaugugaauauaaaggaaggcgaauggauuugaaugcuuauggaaauuggcccuugaaguguaguguuaggaauguacucugaaauuuagugucagagguugucugggaggcaaugagaauuaaguuccauucguccuuuuugagcagaaauuaaaauuuuggauguguagaugguacucauuuacuucuaggacacuagauauacaugcuuaucuuuuuuauccccacacuugaauuauguuaauauuuguguuuaaauugauacacaguaaaauauucuuuuaaaauuaaguagaugauuauugagcaucuaccaugugucagguaauacuuuggcagcucuauauaaaaugaugagcaagacaggcauguuucugauguugccuacauggaggacacagacauuaauggauaaucagccaaagaaggucaaguacuacauuugagagguguguggccugagaagaguuugcaauagggauaucugaucaaggggagcagucaggaagggcucagagaucagcccaggugaacuguggucuuacagaugaggaggaguuaaguggauggagguugcuuggcugacagguagggcaugauuccagccgcuguggcugguggggguugguaggugucagaucccgcaagacugagccacagggagccuugacagugugcugcuaaucagauuugugucugggacauggacccaaaggggagucacuguggguggcccacaccaguugugaaguuuuugcagaaguuuaggugagagacaggguugcugguucuacagugugggugguaaaguuggagaauuaacuuuguagacuuuauuugaaaucuguaccuuuaggucauuggggagcauucauaguggcuacuuguuuuuuuuuuuuuuuuuggugaaacuuccuauaacuuucuaauacuugaaaaucuaccauacuuuauacauuccgacaguaauuaugagaccuaauucagcugugugauagccacugccuuuuuagcaaccaagcacuaacuagagaagugcucuuuuauuuucugagaaaaguuagauugaguuugcaauucugcgaggguacagggguggaagugggucuuauugaauggucuucaguaccauuuuggcuuuuuuuuuuugagacggaguuaagcucucauugcccaggcuggagugcaauggcgcggucucagcucacugcaaccucugccucccgaguucaagugauucuccugccucagcuuccccaguaguugaaauuacaagcaugugccaccacaccuggcuaauuuuguauuuuuaguagagacaggguuucuccguguuggucagacuggucucgaacucccgaccucaggugaucugcccaccucggccucccaaagugcugggauuacaggcgugagccaccgagccuagcccuguuuaggcuuuuuauagccuauguucuuaugagcaguaaacauuaugaugguuuaguuagaccuguugaauugaauucacuucuccugccuguggucagguaucagguagcacagccacagaaguuacugaaugucuuuguugguggacuuuaggagagugguuuaauuuaugugguauucuaucugggauugcagcaguauuguuagauugcauuuugucacagggaggaaauuaccugguaacuccugauuaggaacaaaaugaagcuuccccuuuuuacaaauccuggcuaacauuccauuuggcucucuucuguugaccaccucucucucuccccucccuccucacuccauuuucucaguuauuuuauuguuuacuauuggaagucaccucccaacucaggauacuuguuaguccauuuuaggaaaaauaucaccauucuuucacuauuauucucuguugaaguugaagaacagaauauuacuuuuuuucuuuccauuauugguuacaccagcuaguuagagacuugggguaauacugugggcauggguuggauccugauaucugugucaguuagugagaguugguucuaugacccuagagcucuuuguguccuucaaacgagggugcugaaacaagacgaacauagaacugucuauaccaagcaaaaaacuccugaaagcacaugcccacugcaggugaauugguagcauaguguggagauaagugggcagugcuugguccuguuucugccuccuagagaguaccucucagcauccagggaugcuuuaguaacucuuaguuaaaacgaaaugaacuauaauuaauuaccuuucuuuugggagggacacagagaguuucaacagcaucuacaaugcuuuuuuuuuuuuuuugaaaagaaaauaugauagaauauuaagauugacagagcuggggauggguuggaggcugaauuaugauguguguuuucuuuaugcuugaauuauuucauaauuaaaaacaaaacauauaauaacaaaaaaaaaaacacccucuaccucucauucacauuccccucuggccauagccucuuucuugacuuccuuccuagcaagacuuuuguuaaguguuuucuacacaggcugcuacugcaugcuucaaaauuuaaccccaagcaaauauuagaaaacauauuuuaucuuauaauacuugauaccuacagaauaaucuguguaacaaauguaaguugugaagcuuaauaauggagugaacaucuaugaacccaccaccaacauaaguacuggagcaaugucagauccauuggccggccuguggguuuguucccuguccaccuuccccuaucuuuccugccagagagaaacauucucaugcccuuuuuaaaguaguauugugacuggcauauguaucccuaaacaauacuguauguuguuugguuuugcuuguuuuggaggauuauaaaacugauagauuguuuugugcuacuugcuuuuucacuugguauguuauuguccauguuguugcaugugguguauguuaauuuucucugcugaugaauagguuguaguuuauuuaugcauguuccaguugaugaaccuuuguguuccucuuuuuuggaacuacaaacuuucuuguauguuucucuugaugcacauguguaagacuuucucugugggguauaugaguggauaucuaugaguagaauuguugguuuguagaguuacaugaaaguccagcauggcaggauaguguccaguuguuuuuuaaagauucuuacugaucugcacucccaccuguagcauaaaggauuacuauuggugcagucuacugguauaaaauagaaaauguaucccauuauagucuuuuuuuuuuuuuuuuuuugaggcagggucucacaucucacucuguugcucaggcuuggagggcaguuuugcaaccucggcucacugucuggucucgacuuucugggcucaaguuauccucuugccucagccucccggguagcaggaccacaggcacacacaucucacccagcuaauuuuuguauuuuuuguagagaagggguuucaccauguugcccgggcuggucucgaacuucugagcucaagcaauuugccuuccuuggcuucccaaagugcugagauuauaggcaugagccaccacacagggccgcauuguggucuuaauuugcauuuccuugauaauucgguuaaacaacuuuguauauauuuauuucagaucauucauguccacucuguggaaucuaccccgcccccauuuucuauuggguuauuuguuuuuucuuauugauuucuagguguucuugauauauuuuuggaugauaauuauuagucauacaugcugcaaauaccuucucuuauuuugugacuuuuacucucucuaugguagcucuugauaaaguccuuaaauuuaagauagucacguaauuauuuugaaggguuggaaaagccuucuuaccccaagguuguacauauauucucuuguauguuuccucugaaaaggauuugauaauuuugccuaucacauuuaaguuuuccaugcaguugggauugauuuuguguggaaauccauucacacguacugaaaaguccauccuuucuccagucauucacaauacuauuucugugauauuuuuaguuccuguauuuguggggucuuuccuucugggccuuuuauucuacuugguuaguuuggcuaccuugccucgguaucacauuauaauaaauguuauaacuguauuuuguuguuuguuagguaaagcccuuccuccccacuuuucgugucccauauguacacauuugacuuugggcuauuguggagccugaguucuucuacgugaauuuaaaauucagcuugucaaggucuuugagaacccuuugaggcauuuuuauugaaguugcauggaaacuaaagaucaauuuugggagaauuauuaugcauuuaaugauuaucucuacucauuuauaucuccauuguuuuaggugucugauaucucaaaacaauucuuuauaauuuuuuagcuguaauuucguaauuauaguuuuauaauuuucuccaugaaguuuuacauuuucugaugauuuauucuucaguaccuuauuuuucuguuucuauuauuaccaguauauuuuuuuaauuauucaaauuauuuguuacuuguauauagaaagucuuuuuuaaaauuuuuauuuauuuuuuauuuuuagagauggaaucucacucuguugcccgggcuggagugcaguggcgugaucuuagcucacugcaaccucugccuccuggguucaagugauucucuugccucagccucccaaguagcugggacuacaguugcccggcaccacaccuggcauucaauugauuuuuguauaucaauuuucauauucagccauguugcugagcucucuuauuaguucuaaaaaugucuuuguguuuuccuuagaguuuuuucuguagaucugucacaucaugugugacucaagacaauuuuauuguuuuuuccuuucaaaccccaauacuuggccuuuuuuuuuuuuugucuuuacugugcuauauaugaccuuaaguacacuguuaaauaggaauggcaauacugauuaucuugucuuauuccugauuuucaccaugaauagugauguugauguugauagauacuugauuaagaaaguuucauucuauucauauuucaugaagaguuuuuaucaugaacagguauugaauuuuaucaaauacuuuuucuacauaaaauuaaaugaugacuucuuuauuuccuuuaaucuguuaaugucgugagugacauccguauauuuuccugugguaagccaccuuugcauuuuguggaugaaauuaaugauguagcuucauuacucuuuuaaaaauauuguccuggacucaauuucaaauauuuucuucaguauuuuuacaucuaugcuuacaaguaagauuggcauauaauauuuuuuuccuccuacuuucuaagucuaguuuugucuacaaaguuagaauaaggaaguguucucacucuguauucucuggaauagucuuaaauaaggaugaaacaaucuguucuuugaaauuaggucaaacuuaucuguaaaauugguccuaguauaagaagauuuuaagccacugauauaauuuuuaaauauaauaauauugagagugagagcuuuacuuuuucugcagauacuuuaacaauuaaauauauauauaaacuuauauggauguguguguguauagauguguguguuguauacauauauauguaauauaugucaguuuucucucuauuucauuuacauuuuaaaauuuauuaccauaaaguuauacaaagguauucucuuagcuuuuuaaucucugcugacuccauaauuuucauuuuucauucauaacuuuauuuauguauuccuucuuuuuuucaugaucaagcuaauuugaaguuuuucuuauuuauuacucuuuucaaaccaacuuuuggcuuuguggauuauuuuucuuguguguuuucuacuucauuaauuuuuaaucuuuguuauuuccugcuuucuauguacuuaggcuuauuauucuguuuuuuuuuuuuucuaaauagaguugacuacuuagugcacuaauuuaucauaauuucuuuuuauaauauaagaauuuaaggcaauauaauacccucugaugacuguggugacuguauuacauagguuuuaauuuauuacauuuucaucaucuuauaaguauuuuaauauuuacaguaugauuucuucuuugauacuugcaauauuuuuuggugccuucaaaauuuuacaaaugaauguauuacuuaucuuuuuauuauugaccucuauuacaauuuaauuguugucagagaacuauucuguauggcaacaguucuuugauauuuguugaggcuugcuuuguugccaauuuugugaaucaguuuuaaaaguuccauugugugcuucagaagaauguguacucuaugaauucagggaucuauauguguccagaaauuaaagcuuguugauuguguccuuuuuuuuuuuugagauggagucucgcucugucucccaggcuggagugcaguggcgcgaucucggcucacugcaaccucagccuccuggguucaugcaauucuccuuccucagccucccaaguagcugggauuacaggcgugugccaacacacccagcuaauuuuuguauuuucaguagagacuggguuucaccauguuggccaggcuggucuugaacuccugaccucaagugauccacccaccucuguugauugugucuuaaagucaucucuacauuugcuaauauucgaaaucugccugacauauuuguuauugagaaaaguagauugaaauaauuugcuaugaugaugaauuuauaaauuuuucccuguauuucuauuuugacuuuauacauauugaaauuauauuauuacaugcauucauuuuaagaauuacuauauuuuccugguuaauuaaacccuuuauucaguuuguauguggcuauucucuuucugcccuuuuaucuuaaacucuguuuugucugauauugguauaauuauugcacuucccuuuuguguaguauuugucuauauaucuguuuuuuaauuuuuuguuuucaguuauuccauguugcuauguuuuaaauaugcagaguggcauuuuauuuuucuuaguauucugaugguuuuauucuacuguuuucugaauuucccuguggcucauaagaaguucaguaucuuucugauugccauucuuuucuaguagaucuacccuuuucccugacuguuuuuuggcauuuagcaguuuuacuguaauguaucuauuugugaauuuuaaaauucuauuuggucuacauuguucuucaugcaucuguggcuucaugucucccuccaauucagaaaaauuaucagcuuuuauuuccuuaaauauucugacuccuuuauucauucuguucucuucuuuggggauuccgauuacaugugugcuugaccuucuuuucuguccuucauucucuuaacuuuucucucauauuuucaguccccuuguaucugcugcauucuggguaauuucuuuagacccaucuuccaguuuacaaauucucccuucagguuucucuaacguguuaucuaaugcaaugauuaauuuuuuuuauuucauugcuuacuuuuucauuucuaaaaguuccauuugguucucucuaaauuaugccuacuaauuuuuaaauacuuucuuauuucuuguucauuuuugugauucugucuuuaaguucuucuuguauuuaugacaguuuuuguauuauauguauuuauuuauguguauaaauuuauaggguacaaguacaaaacgugacaugcauagauugugcaguggucaagucaggacuacauuguacccauuaaguaauuucuuagccacccgccuccugccccucuaccuuuccggaucuccguugucucucugcccacugauagacuacauccaugucuauacauuuuuauuuuuauuuuauuuuuauuuauuuuuuaguuuuugaggcagaaucucgcucugucgcccaggcuggagugcaguggcaugaucuuggcucacugcaugcuccgccucccugguucacaccauucuccugccucagccucccgaguagcugggacuacaggcacccgucaccacgccgggcuaauuuuuuuuuuuuuuuuuuuguauuuuuaguagagaugggguuucacuguguuagccaggauggucucgaucuccugaccucgugaucgccugccucagccucccaaacugcugugauuacaggcgugagccaccguaucuggccauccaugucuauacauuuuuuagcacccacuuaugagugagaacauguaauauuugccuuucuaugucugguuuguuucaccuaagauagugaccuccaguuucauccauguuacuacaaaagacaucauuuuauucugguuuuuuuuuuggcuucauaguauuccauuguguauauaugcuacauuuucuuuaauaauuguaaaauagacuaugcaauuuuauagauauuuucuaacaaauccaaugcuuaaauuccaugggcuugagguagucuuguuauuucuacuaacccucacuuaagcuucuuuguuuugcuuuugugagaugcuuaugaauucacaucugguggguauugaaucuaugaaaaucugggagucuaaagugagaauacuuucuccagagaggaauugcuuuugcuucauagucucuuuccuacucugggaguccuagucuucuuaucacagugcugauacuggcauuugcucucagagcaucccugcuucuugugccuaccuuucaguauugaaaacucaaguuuuguuuuauuuuuuggugcuuucaagauuuccuuauuucuugcauuuauacuuuuggagaauuuuuuuuuuuuuuaauguugaacauugguuguuuuguagugugagaggccuuggguguauugucauacuuuuggaagcagaauucugauuuacucuuuaacccuuuucagucugacuucugucaccauuuauuccaaugaaacuaguugugcuaagauuaccuauaacucccauucuucccagcaacuuuagagaaaauguucuuuuuaaaaaaauggaaacucugugcuucuagauucugcacaacacaguuuccucuccuaguguucuuucugccucucuuuuguuggaagaggaaauguuggggaucuuaccugggcuuucuuuuucucuucuauugagaggcaguuuggugcagugccucaaucuggaaucagacugaguuguuaucaucugguuauuagcaauaugaccuuguuuucucacuguaaaauggauagaaauaggguuguugggagaauucauuaacauaacacuugccaugcacucagcccauuucuaacacauaguaggcauccaguacaugucuacuuuuauucucugguacauuaucuucuuaagucaucucuuguuuccaagaugacagcucacguauauauugcuccaguaugaucugugcaucucagagucaguuuguagagccaucuguauguuauauuugauuuucuucugucuccuuaauguauaccuucccuaggcuucugcauauaggaaaugacacugccaugcaccuagaugauuaaaccaguuccggacacuuugaccuuaucauuuguguuaccaucucacaugauaauugugaguugugcucuccacaucugcuuucaccaguugaguucaagacaccaucauuucuugccuggucuacucuaguagccuccuaaguacuuucugcacuuugacuucuucccuguugaauccauauuucacagcaaccagagugauuuuuuaaauaagaaagucaaacagagcaugcuuucucccagcuucaauguuuuucucauagugccuagaauaacuucuguucuccuuaauauggacuugagguaccucuacaaccucauuugguuuccuucugcugcuguauacuguuuggcuacauugggauucuucuaggcuuuggacuuugucaagcuuuuucuugauucagggccuuugcacaugcaguagaacacaucuucucucacucugcguggcugauuccauucagagcucaucugaaaugccacuuucucacggcgacuuucuuuuauuuccuaguuuaaucaagacucuuugguucagugcgugcugaauuugcuuaauaaaugauuccauaaacauacauauuuugaauagaaucugcugauuaauaggaaugauaguucugugagaucaugcucauuuuaaauuuagucauagugucauuggaaaccacuacaugucuuuucuauucauuuaaugaauuuucaaggucauaaaaauuucugaugauauuauaauuuuugcauuugcaaauacacuuugcauaguauuuauugcuggauaaaauauuggcccaaaucagggguuggagaacugacauucacugagcaccauaugucacguucucuuaccuuaauaucguauguuaggcccugaaaucuaguuauccccgagucacugaagaggagcugagauucagagauuccccuaggcuggccaaggccauaccuuguggagggcacagccuaaguuuaguccaggaguuugaacucuaaggagagaacucuuuccauaucugcugccuuauuucuucucuaagcaaacuccuuaaguucacaaaguucuuucauguguauuacucauaauauguaugucaaguucuagagagugcagggcauuuuugacauuuuauuuuggaucaagcuuucauucacuaauuuuuuauuuuucugagcaucccuuugagguccuugaauucacggaugagaaaaauuaaacaaucagugauuaaguggacucucugugaaguuacacaauggaauauuaaauuguugauggauauuuuuuauuagccagagaaagaaaaaacgcagacuuuuuuuuuuuuuuuuuuuuugagacagggucucacucuguugccugggauggagugcaguggugugaucacggcucacugaggccucaaucuccuggucucaggugauccucccaccucaaccucccaacuagcuggaaccacaggagugcaccaccacagcuggcugauuuuuguauuauuguaaagacaggguuucagcauguugcccaggcugguccguaacucguaggcucaagugaucugccugccucggccucccaaaguguuggaauuacaggugugagcuacugugucuggcccaaagcauuuuuuauuccaguaguugugucagucuguuuucuuucuauguauguauguauaauuuauguaucuauguaucugccugucuaucuaccuaucucugguuaaauauguuuuagaaaaaauguaacuagcacaacuaggccuggacuuauagauauuauuuaugguagaaggcuaaguuguuuauuuuuuuaaguuaauuauuuauaaagaaaaauauuaaccauauacaaguacauuuaguacuuaguuauggcaaaaaucaagaaggugaaauagauauggaaaaugugauugggugaguugguuuuauuggacugguagggugugcccuuggccaaaccaaaggccagaggguacaaggaagucagggggacacacugcuggggagauagagagggggcugcccaguugugaggggaacuaacuucuuguccagaacuucccuagggccuucccuggcucuugccuucuuugcuguauauuuugguuacuggcaggacacugguucaaauauacauuuccgugguuugauuuuauaaagcuaaaaaagccucaugcuaauauucagucucuuauguuaugaauguuaccauuuuaccucuuagcuauauagguaucuauaaaggacauuuuuuaaaaaugaaaaucauccuuccucaguaaagaacuagagaauaaacauguuucugaaaguagaaugauguggacuagagcaggggucggcaaacuuucucugagaggggccaaaugguaaaucuuucuggcuuuguaaccacagacucucuguugcaaauacuaaauucugcuguuguagcaugaagccaguuauagacagcaaagaaaccaaugagcauuacuguauuuuaauaaaacuuuauuugcaaaacagacaguaguuguauuuugcccaggggacuguaguuuguagaccccuagaugaaagaaauguaucuuagggccuccccucuuagcccuuuccaucaucagcaaugugaucuuggacaauauacuuuaagucuuaaugaauuuauucauuugaaaaacugacauuuuauuuuagaucaggcuuuucauucacuaauuuuuuauugcucuggacaucacuuugagguccuggaauuuacagaugagaaaaauuaaacaaugaaugaggacaguuuucuuguaugagggauuuuuguuuucuucauauuuuuaauguguuuaauauacuggagugagcaugucuuauucuuguuaacagacaagcuaucuaaaaauuaaaacacaaacuaaaaguagaggaagauuguuaugagaaacaugucauguaugugaaauacauuuuauaaggaauagauuagauucuuuauggaaccaggauggguauaaauacaucacuagauaaauauuaaguaggaagaucauuauggacaaagauuguuucuuaggaauuuugcaucguauagcacuguguuagacagaguccuuaacugauuauuuuuguagcauuuguuuacacauucacuuauuaauuaauuuugccaauguauugagccaucuauggagauguguggaggucuguguugaaagcuugagauagaaaaaaugagaaauaaaauaguuuuggaucucgaggcacucacauugaaggagauaaacauguauauaaaauauuauccuauuguaugauaaguucucaauuagaagcauguauguauagggcaccacuaggaaaucuguaucauuggaguagagggaagcuaggcaagagaccugcacagaguuugagcaguugggucuugaaggaugaguagggauucuuagacaaaagaagauugaaaggcagcuugagcugagggaaaugucugugcaauugugaacuuuacaaaucauagguaguucuguaagauuauaacuggagucaugaagacaggugaaggaugggauacucaaaguuuggcuagggccaugcaaugaaagccagggaauuugaacauauucagaaccauggaaugcuuugggaaucuaaugaaagauaugauacauuucuauaggaaaaucaucuuacauaaaaauuucaauauuuugcuacaguuuuaggaauaaggauguagugaucacuuuaugaacaguacagacuuuuuauaugguucccuucugaaaaaaaaaaggaguucacagauagacacauacuucaucauccugcuugaugguggcagcaaaugcucuggaugcacuuaugugaaguuuaucaugacuuuauuacuuaagagccugggaguauaugagauugugccauacuguuauuuauaauuuccucaaagagauggcuaggcaugaucagagaagccuucuuacugguagauguccacauaugucaguugccuaggcaugaucagagaagccuucuuacugguagauguccacauaugucaguugccuaaaugcuggagaagucacguggcuucggauagaauuuccucauuuguaagauggugcuccucaaaggaccuaccugccauuagagugguaaggauugaauuaacucuucugaugacagcacugagcccuaaauuuagcacauacuaagagcucaauaaauguuagcaguuaauacccuuauuagaauuaugaaaagucgguaauuucauucauguauguucauauauggagugcucacaaauacuugaauucuuuuauugaacaugugaguuagucuugcauuacgcacugcauauauguccauguauuucuggaucaucaugggucauuuguuuggaauaaaacuucauuuacggaaaucgucuguacagcccugguuaauuuuuucucugugauggguugcauuacauauuuucuauauaaaacagcaauggugaagauaaguuaacuaaugaauauauauuauuaugugcuuuuauuuuacagcuucuaauauucaguggggaaauuuuucuuguuaagagacaauggcaaggccaguuggccuaaaauuagauccagcagcuguguuuugaaucaaggccccacaugugcacuuuauacuccccacccccugcgcugggcuugucugcuucuuuuucuugcuucaggaggcagcauuuuugggugaauguuaacauucauguuuuuccuaguacaaccagaaaggugcuucuguuuaauuguaaggcagguuuauuuacauuuacggaauggaaaaaaagauuuauuuaauuauuaauuuuacaaaaccacccuuuagcaccaagcauaaaacuuuggagcccaaaucaaggcacuaggucacuuauaauuugauuucuaccaaaauaaguuuuuuuuuuuuuaaagaaaaaacccuaugauaauuuuuaacauuuuugacagcuacaaguaauuuaaguuguguuuuaucaguuuauauucagaagccaauguuaacugguguuaauuuuauagguccuaguuucuuuguauuucuugcccuacuguuugguuaauaaaccuuuuuuaaagaauauauucauguacacacaacauuaucaugauucgguuuaaguauccguguuuauaagugcacuucauuucaccuaauuauguuauuuauucauuuacacauuagcaacguacuacauauuccacuuuuacaggaacuuauuuuaauuauaccuacaguucuguucugcuccauuauaucauagaucaagcugaauaauagcagucuuaaaaggcauaugcuaaaagugauuaugggucauuaaggccaaauuaagguaacauuucugauagccacaagcagaagucuaacuuacaauuacuuuuuuuuuuuuuuuuuugcuuuggggaacguguucuaguuggcuuugauguugacggucucaugguugaaugccuaguggguguauggauugauccuugaucagacugauuuuuuuuuuuuuuuuuaggggggagauauauacaaaccauacuuuuuauuuauccagaaaucuguauuuauccagaaauagucuauucaaugacuuuacugccauauuucucaaaauguaugcuuuuucuuuagcccucucucuuccugccugccauuaagagucacacaggcaaccaaucuccccaucuaggaaagugaguacuagaaugcauuaaagucacuuuuuuauugaucauuagcauaaagccucauugugccauuggagagugaccuaaauaaguauaucacauccuuucaaagagaaaugccccauggaaaccauaccuaaaaacgauaacaauaacuaacagaaucugcguuuuaaugaguugauuuuuaauucuuguuucgauuggcccaauguaaucuauuaagaaauuaaagggcaucuuucaagcuuauccauauacuuuuauaaucaggaugugugacucuaguguuguuaauuuuauuuuugagaaauacuuagauuuuguaugggcauaaguaauucaaaauuauuuuguugauuuuauagacauuuuacuagggagauccauuguuguuacuuauuuucuaguuucauaauugcugauuaaaauuaauaagauucaaaugggaaaaugacaguagaaauauuccaauuuagaguucuuaguagguuggcuuacuuuuugcuggauuuaugaugauuuuccuacauacucagauuuggaagauacagcaucauaaaauaaacuguaguuuauauggaaccucuacauuuugguuggagauacaaguuucuacuggcucagaaauuuuuucuuuuaguuuuugauuuuuuuuagagacagucucacccuguugccagacuggaguacaguaguaggauccuagcucacugcagccucgaacuccugggcucaagugauccuccuaccgccgccugcugaguaucugggaauacagguguaugccaccaugcccagcuaguuuuucauuuuuaaacuuuuuguagaaauugaaucaaacuauguugcccaggcuggucuggaacuccuggccucaagugauccucccaccuuggucuccccaaguucuggcauuuaaagaacucagcccagcucauguaauuuuuaaauauucccacuccaugugauuacuucagucuggacaugucagacugaacugucauuucaguuuacaugucaauuugucuuucauguaaaaagggggaaaauaggaauauaugcuuauauuuuguuguaucugcauuuaaaaaaacacaagaaaccaaagugguuaccugaguagggguggggaaggcaguaaagaauagugugauggggaugagacuuccaaauagauaacuuuuuguauuauuuugacccuugaaccaugugaauguauuuucucuaaauauauuuagauuuguuuuugaacaagaaaaaaauugauagcagcuaugaacauuuuuuucuuuuuuucauuuuccuccuugauauaaguuacauuuuaauugucuuuuggauuguuuucuucagaauuuuaaucauaaaauaaaugaaauaaauaaaugcaaucaucauuccauuccuaucaguaauuucuauuaguguggcuuuuucuguguuuguuuuugucauuuagagauggcaucucccuauauuacccaggcuggacuccagcuccagggcuccagugauccucuugugucagcuuccugaguagcugagacuacagguguacacuacugcucccuacuuugugugugugugucugugucugugucugugugucugugugucuguguguuugcauuaguuuaugggcaacuagaacacguuagaugcuuuuaagcaucgauuuggauaaagaagcaguauuaaaaauccaacugaugccauacuucauggaagaaaaucauugcauuaaacaggaauuacacauaccgauaugaauuaguugauccaaugguccuuugaaauggaaguuacauuuuuaggagauggguauagcaaaagcagagguguuuuuggaugaugagcaauaaauaggggguuguuccuagauucccagagacuuacauaaaguugggaaugggagaaguaagugauggggacaagcuaaauuuuaaauuacucuuaaaguacuuuguuuagauuauauuaaccugucaaugugacuaaaaugucaacagaauucucuuaaguuuuacagauuuguagaugcuaaaugcucaugaacugaacugaauaacaguaaugagguaugaugauuugguaauuuuauuuuaauuagcaacaugaguaacuuuaaccuuuauuuaagaaaauaaagguaauauacacauguguauuuauuauacaaugggaaaaguucccuuugaaauucuccaugugguuugguguauuggcuuaugccuguaauuccaguacuuugggaggccaaggcagguggauagcuugagcccaggaguuugagaccagccugggugacauggugaaaccccaucucuauuuuaaaaagaaagaaagaaagaaauucucagugcaacagucuuuaaaucaugaaacuguucaguuggagaauuugcauuugcuuauugauagcugcauaucuacuauugugaauuuaauaucuuauuuauuuacauuuaugaauauaauacuauugagaaauuaggcucuauucuuuuuacaguggcauuuuuacugauugaucuagucucaucaaauauaacugagauguggaagccauuaucauaguucuuaaacacuauugcucuugagcaggggaugugagauacagagcauuguggaaaaaaaugcuauucuggaaaaccacucacuccuuugaaagucaaagagaauaaacaauguggaauuugaaaaaaaaaucacacugaaagauaaagguauauaagcucacuuaacuauuaaugauacaaauuaaucugcaaagaauuaaaagcagcuuuguuaauggcagaagacacaugcaguuaauaaggacauuacuucucauuugggguuagauuggcuucuccuuuauuaauaucuguuuaaacuacaaauagaaagaacuccauucuuaccagacuucuugucacaagacccagucucuaaagagaaauaucauugauaggaaaccagaaagacuaaauagauguauuuggucucacaggcaguccauuaauuugcucaaauuaaauauuaucuuuaaauauugaaagguuaaauguacaccgauaauggauuuagacagcuauuaagcuguaauugcuuucuaaugcaguuacuaaaagacauuugauauaacauauugagaaggaaggauuagagacuucucuaccucaguuuuaacugagaguuuuauggcuuuaauucuggcaguuguaggaauuggauaacaacaguuuuuaugagaacgcacacaauaugcauaaaauauucagugggcagauuguugagggaaugcauuauguacaguguauuuauguucauaguuuuugcaaaucuguaccagcaguacuaucagaucaacuauucacccuaaauauuuuucuauuagaucuaaaagucguauuucugaaaauguuaccauuuuaugguuucgaccccucuaagcugaauuaauguguuuugugcccuggauauaugguuacaguagugaccaaauuaauuugaaaacuucucagucuguuggagagucacaucuaguucagguagucaaacugauggcuuucccugccuggguaggcagcuuucuuuuuaguauucgcauuguuugaauuuguaguaugagauuuucacauuuuuacagguugcauuuugugaguugagugucuagcugugacaaauuauuguuaaccuaagaacauaugcugauugauacagucagccacuugccuccagaguucaauggaaggacaaaaaauuuuuggaaaagaaauaugaaugagagcuaggcucuucaaaacauauuuuccuggugaauuauuuaaacauaaucuaaguaugaguaugggucaggaaaaaaaauuaccugcaguuaagauaucaagccaaaguauuuuuugaauugaauaaagaaagggaaggaaaaagccugcuguugaucccugucacucauguuuuuguauuaauaggcagcaucugcuauuuguucuauuaauguuuuauauuaacauuuucauuuaguuuccuuuuuaaaauggugaaguuacagaauucacuuugguuucacaaaccuuuauggagaaauaaaugcauaugaagaucuguucuggggccuggggaagauguuuaaauuccaggugaugccagggccacugcauggcacccccugggguuguacaugcacauuguauauggcagccgcuugcuuccuucaaagaagagugugauaauaucugugcuuucuguugaacuuucagaguacuuccacagauauguuuuuaauacuuuuaaauccucagaaauaauuugauuauuucaguuuuauacaugagaagucauguucagaggaguacacacgaauauaaggcagaaaauaaaaaauauaagaauuucauggauuacaaagaaauaaaccacuacuuccauucacuguaaaccagagaagaauauauagggaaguuagaauucaguguguacccuuauuaauaaaacuaguguuuuauuaauaaacuauaauaaacuaguguuuauuaauaaauuaaauuuuuucaaauuuuuucugcuuucucaauagaugcucuauuuucuccccuccuccuauuccacccuaaaauuaaaagagaaaauacauuucuaaauuuuacugagauaguuaagcacagaauggaauggcauuacccauaagagucuaauauauaauguuuauaauccuuuaaaaguagaauuaggguucugucaucucaauauacuaugcugacuuugagauuucuuuuagucauuaaaucuguucugcaaaucuuuuuuaaaaaaauuaugagugacuuuauguuuuguuuuagauaauuuuaucacuaccaucuaacuaauuuuucuuuauguauuuucaaaaauuuaauaaugaauaugauugcaauaugcuuugagaccaggauagaugcuugcuuguuuuuuucuuuuccuuuagacuaucaucuuuuacauaccuuucucuuucucuuaaaguaaguggaaaaauuggauucauugaauuggucuugauacuaucuaggguuauaacauccuaauauucugugagucuuauuuuaggacuugcauauuuaauacaguuuuuaagucuuugaucuccuaaauaugcuuauagcagccgcuaccuucaccacacccaaauccuugaauguuaugauacaucauacuacucaugcuggauauuuacugaucugcuguguucaagacagacugcugagcuucguaaacuuuaccacccaaacuaaagacagagaguaaauacauaaacacagggaguuggggacuuggcugaaaauugccacccaaagcuugaaauuuauuugcaugcuggaacaaagaauauccaugaacuugaaacucaggaugacguauguuugauguuuauccuguaucauuauguauucuagggcaccacuucuguauacccagauggaaaucccaauuuuaaagcaaugcucuuggguauugagggguauauuugcgaagucacagucaucauuuauuccauguucccuugccuucuuuucugucaaguacucugagagucuugauguugaggauuuauuggaagcaaacguuguuaccuaaaugaagucuagugaacaaaaccaccaaaagaggacaugaagugacugcuauguauguauauaugauauauuuuuccucagaauuaucuaagugcuuugguugguugcaaauguggaauuuugcuguuugucucuaagucacucuuauagaaaugaucugugugugugauaccauaggaugugcuuccacugggcuccugagcagugggaauauauaccugaaacaguaugugacacuucugugcuuuuucucccucugugguuucuguucuuccuauaauguacgcaagugcaaauaugagcagugagcgaguagagagaaaacccuguaaguuuugugcucuacuuuagguguaugugauugcuucucuugcugugccauucauuucugauuuaaaugucuaaugacucucaucaaacaacauuuaaacuuucuaugagauccuguaaauguuccuuuagaucauauuaugaguaacaauggaugaaacgagcuuuaauggggaggcugcgguucaguccggggguucugcagcuguuggugauggcagaacacgucaauugaacugcagccaugcguucaguggcauuuugcccauuaagcgauguauaaaaacaguauuccugguacaguuacauuucauuucugcagcguuuucacagucagcacuggugugucccguggccuggccuuuucuccucuuggcgacugaaaaaauaaaagcccagugcuuuaaggugguguugcuuaagcaugaaugaaaucacucaaaaaaugucuucuuagcauugaaaaaauuggucacaagucaguaauuaauucauuuuagaguaaguucaucuuggggcugacaaagagguguaguagcuaauuuuaaaagaugaguguaacaucuuucccaugucauacaugucaagauuaaacuuaaauuauguauuauauauuaaugaccuuaauuuuauucauaaacuacuguaaguacaacagaaaucaauuuaguucuauuucagccaucauuucugggugugaacuucuaguuucuauaaggaauaaagagauaggcaugaacuaguaccugaccucaugaagcauacacuguaguuggagacguauagaccaaaagcaauccuagauggaaugggauauuugaaugagcuaaauagaggauugcuuugcacuuagagaaccuucaguaaaugaguguugaaagaaaguguguucaagaguuaccuuugaauuuuagauauuuauaugucacuguggacuuccugggagcugacugaaaauggugauugucauugucauuugacauuuuuuagucuaccagucuggggccuaauucagcauugaaaauaguuuuuccuguuuuaccagaaaaaguagaagccaggaguuuguuuuucucucuuuuccuugugcucuuuuaaaucuuauuucccucacaguugagcaggaggaggaaaaaaaaaguccuauuuccuucaucuuauuuuccacuaggcuuuugaggaggacgagauauucugaagcauauuugaaauaaauugaggaccguaacuuggcaaguaugaggugcaggaauaauccaugugcaggagagacggugaaagauuacucagagguacagagccauggagagucggaaggaacacuggaaguuucucguggagauggaaaccugagaacuugacugugguuaggacagguuggaggaguccuggguggugcugaagaggcucgguuccggagucaggccguugagguugaagccuggcucugccauucgcuaacauugugaccuuggaaaagcuuaccuaccucucugagucucaguuugcucaucuguaaaauggcaagaguguccacuucauggauuugcgaggaguaaauaagcuaguccguguaaagugaugcauacagaaagcaccagaaguauuagcugugauugauugcaggagccacagcaugcagcaggagaaugauuuuugagguguuugaagaauaauauguaaagagggcugggugauaugacucacgccuguaaucccagcacuuugggaggcugaggugggcagaucacuugaggccaggaguuggagaccagucuggauaacauggcgaaaaugccaucucuacuaaaaguacaaaaauuagccaggcuuggugcugggugccuguaaucccagcuacucgggaggcugaggcaggagaauugcuugaaccugggagacggagguugcagugagccaagaucgcgccacugcacuccagccugggcuacagagugagacuucgugucauagaaaaaaaaaaagaauaacaugaggauguguuugguguuggcauuuuggucacauugaagcagggagggaauggacauuucuuucagaaccaugcagcccuaaacguuaaacagagagguuuuuggggauaaguguuaagauuuugauguggauauuuuagaagguugggcguaacagcugauucaacccuuuuuuaucaccaucaaugaaaagggcuacauaaagauuuaagaagaggaggacauucuuuucuccacagcuggucaugcgcccaguguaguuggcaggaaaacggauuguuuggaaugugucccuaaaauccuguaauuuaauuuucauuauuuauauaacgcaguccguauauguggcgcuguacuacaugcacacaagaccaaauuucuggccaguguaauuuuaccaaagaagagacuguaacugaaauauuuguaccuacuaaauuaucugcagcuugguaacucaccguuagggaguccaugugaucccaaucagcaacagggauuggaggaacgcauuguuggcagugaaauaaggggucaggaacuagaauaaauagugcugggaugguaaacgggcccauguuauacuaaauguaauauaaagucacugacuuugaggaguccagaaaaauaaguuuguaaauauugacauuaaaguagcaaccaguuugcaugcuacuauguaaaaggaaacuauuaaaauaauuauuauacguaguuuuuugcuugcagcacuuguuucauucuguucacuuuuagaaacacaaauuagaaaggagugagucucuugaugugugucuaagagaaguuagaguaagauuucuagaaaucacgagauauauaacuuggauaguuuauaguuuucuacaaguguuucauguuaaaaguuccuacauuaaugguccuucaaugaauaguauuuaccucuggaauccaggagauauauccacaguuaccguauuggucaugcuaggcaagggcaugauuuauuggacuugauauuaucuguauauaguucuugcuuuucaaaacagucaucuggaccgggaguaagcuaauaaggccaugcacugcauaauggcguuucggucagugguggacugcauguaccacuuuggucccauaagacuauaauggagcugaaaaauuccuaucuauauuucuuaucauuauuuagaguguacucauucuacuuccaggaaaaaaaaaaaguuaacuguaaacagccucaggcagguccuucaggagggauuccagaagaaggcuuuguuaucauaggagaugacagcaccaugcuguuguugccccugacagcgccaugcuguuguuguccagugagacaagguguggaagacugauauugaugacccagacccuauguaggccuagacuaauguaugcauuugcaucuuuguuugugacaagaaguuuaaaaaauaguaaaaaaagcuuauaaaauaaggauguaaagaaaaauguuuugugcagcuauauaguauguuuuguuuucagcuaaguguuauuacaaaagagucaaaaaguuuuacaagaguuaagaagcuuauaagguaaaaaaguuagaguaagcuaaggucaauuuuuuuuuuuuuauuaaagcaagaaaaaucuuuuuucuguuuuugagacagggucacucugucacccaggcuggagugcaguggugcgaucuuggcuuacugcagccuccgccuccugggcucaggugaucuuccucccucagccuucugaguagcuggaaccacaggugcgugccaucacgugcagcuaauuuuugcauuuuuuguggugacgggguuuugccguguuacucaagcuggucuuagacuccugagcucaagugauccaccugccuugaccuccuaaagugcugagauuacaggugugaaccaccaugccuguccaaagaaagaaaaauaagaaaaaaaaaauucaauguauccuuaauguacaauguugauaaagucuacgguaguguacaagaauguccuaggccuuugcauucacucaccauucacucaugacucaccuaaagcaacuucuuguccugcaagcuccauucauggcaagugcccuauauagguguacaaucuuuuaucuuuuauacuauauuuuaaauguaccuuuuuguauguuuggauaugcucagauacacaaauaccauugugauacccuugccuguggcuauuuaguacaauaacaugcugugcagguuuguagccuuggagcaauaggcuaugccauauagccuagguguauagcaggcuacaccaucuagguuuguguagguacacucuauaauguucucacaaugacgaaaucaccuaauguauuucucagaauguauccacaucaguaaguaacacauaacuaauuuauugcaaggggcagaauguaaaccauugguuuaguaguuuuagauugaguuaaaaaaaaaagauauccuugagguuagugagaggaaucaaaaucaggggacaguguaggcauuuggggucaaaauuuauucagcauaugcuagcaugccaccaggaaccagaaggaauaaauuauucugacuccauucuuggcaagaucuguguggcuacagaacguaauuauuuugcaaaucauuuaaguugcugaccacagcuaggagauuaccaccuaagugaagauuaccaccuagauggagugugauuccucccugggauucccuuucagaauugucagaaaacaaagcaguaaauccacauguuaaucauuaaaauaaacgaagugcaauaugcccagcaaaucauuucacacauuuucuauuucaaggaauugggauucaaaucuuaaccuaaauuuuacauauucacauuuuaaagcaucacucagacuuguucagauuacugagcggaguaaggguuucaucugaacacauagaagcuggcugcguucuugaaauggggaggaugggguuggugaggucacaaaacuucuuuucagcucccugguugcaaagaauaugagugcuaugacauuagaugggaauucaaguucuggucuaaauugauaaaauagaguuguuauuuuauggccucaucuuuguuuuuauauaucacagaaucacugcgaaaauggcaguuuguuuucuaaagaggccugagaccagagcagcaggucacaaagcgagcauuuuacagcguugucagucagccuauuuggcugaacugaauuucccagggcaaaaguuuucuuacaacguuucaaacaauucaucaaaaagauggccuaggaaguauuaaaugucuuacaauguaaauauagacaaggcuuuauuaggaaagugugcaccuguuuauuuauugacuuauuuauuauaauagccuuucaaguaguuuucuugauccuuacacucuucacacaaugaguguaaauagacaccagucauaguuguagguggugagcuacagagcucuguauugauuagaucuucaggcugucaaaacaacuagaaauuuuaauaaauguuuucaaacaagugaccaguuccaucuaacccaucagaauguuuuauuguaaauauaacauggcugucaguuugacagaaauugucuucccagaauaauuuauagugugauuucaaaaugcauccagucacaggcuuuuaggaauccugucauagaauauuauuuuaugccaucauguuuuaaaaagacacagugauaacauugaauaggaauagugcaaugacacugaagugcaguuuuagaugggaggggaagucuuccuugcuucagcaaaucagguguuugaaguuuaaaaacugcuuaaguggauuuguaguaaagcucugucuguuuuaaaguacuggugacucaacagcuguggggaaucugucuggaaucggcgcggaacuuuggagaauguuuucuccucaggagcuggaacucaacucuuccucagcccacacaaugcaggaucugugguuuucugucccuguuucuuuuucuccauuuuucuccccuucacuuacucugauugauggaaacacgugcugggagcuuucccugacauucuuuccaaagacugaaaguaagaaauguuaugguggugcuaugucuauuuuugaaaguaagucuguuaacguaaagccuguguugauauauugggaugaauuauaauggugauauuauuacagccuucaaagcugaaaauuuauuauuuuucucaccuacuuuugguugcugauacuugaucauaggaacaugcugugcaucugguuaauuuuggggaacccauuuguagauuuucaaaaguuaaacuuuauccuucuuuauaucuucuccaggcccucuuuuguuauugaaaaacaaauagaaauacaauccacuacaacuucggugcuucugcuuuucuggucacucucauuauuaaugcuuauaaugaagauauuuuuggaaacacugacuuaucauugguuuugcaaauacaguaaaaauaauauuguuuguuggaacucuucauuaugauucuuuuacuuuuaaauauuuaauucauaauuauucuuguuucuacaucuguauuuuaauuuuuauuuguuuuuauuuaguuuuaaagacagggucucucucuguugcccaggcuggagugcagaggcaucaucauagcucacugcagccugaaauuuccagguucaagccauccucccaccucagccuccugagucgcugggacuacaggcccgugccaccaagacuggcugauuuaaaaaauuuuuuuuguggagacgaggucucacuuuguuacggaggcuggucucuuacuccugggcucaaaucauucuccugccucggccucccaaagugcugagauuuacaggcaugagccacuggacccugcacuuacgucucuauuuucaaauguuaaaugucuuuauguauaggaggucauguuggauuuuaaaagucaacagaaauugauaggaagcagugugcagcccugaaugaaacucuuaaguuaugggggaaaaaaauaccagaaccuaugagugaaauuauuuuuuaaaaucucgucuugcugguagacagguuuuuuagagacagggaccgcaucuucuuuaaucuuugcuguaucccuuguucccagcauauugucuggcacagaguauuuaauacauuaagugggugaauaaaaaagugaauggcgccgggcguggugucucacgccuguaaucccagcacuuugggaggccgaggcaggcagauuaccugaggucaggaguucaagaccagccuggccaacauggcaaaacccugucucuacugaaaaauacaaaaauuagccaggugugguggugggcaccuguaaucccagcuacuugggaggcugagguaggagaauugcuugaacccgggaggcagagguugcagugagcugagaucccgccacugcacuccagccugaguaacauggugagacagugucucaaaaaaacaaaaacaaaacaaaacaaaaaaaaccccagaccaaacaauaacaaccaaaacaagugaaugggauaacuuggugcugaguuuaagagccaagguucauuuccuugguaccuguugcuugacuagaagacaaaucugucguaaaugaucaaaaaaauguuuacauagacggauguggaggagaauuuuauguaugcauacacacagaauacuaaguggcauuuuuuaugugacagauucauuuccaugcauauuccauauuguaagucagucuucacaacuguuuugugaaguagcagaucccuguuuugcagaugaggcaacugaugcauacauagguuagguucacuuuuccaaaguccuagaguuuuuauuuggcugagccaggauuugaaugucagcacuuuagucucuuucuagaguuucugugugcaaucacuacugucuauuaccucuagcaguuuaucacaugcacaauuguucguaacaccuggcugugcaugauguacaucuacagguagacacuucauguacuugcugugguaguacucuagaaacacugguaaguucacauguuaucaaagaaacuccuguauccgcucuccgagugcugaucuggucauuuucugcuugaugacgccagucuuuugaguuaacucguaggugugcauguugguuucuuuaaaguguuagauuaugaaccauagggcagcaggugauuaauuucugcaucauaagaauucagcuacuguuuuuaggaauuugcuuacaaaccaucaaguuugcuuauucuuacagaguuuugucuuuauuugugguauuguaauauauaauaguuaguaucugaccccaagagccuuacaaugaggccacgaagacaaacagaauuucgagaagucagaaugaagaaugguccucaaaagagaaaggauagaaucuugggguuuuauucuugugagggauguuagaaaugaucuuaucucuaaguaauggggagagaacuuagcaaaauccuuaaagagcaggggaguccacuuuagugugaguuauuuaacuucucugugauuuguuuaccuuucuucaaaaauggaaugauaaugauacucagcccccuaguauguugugaggauugaaugagggaauaaacauacauggaguacuuaaaacagcucuugcacacaggaagugcauaacaaauauuaucauugaaauuaucauuuuacaauugaggaaauugaaucccagagaaauuaaauuacuuacucaaggcuaauccagcuagcuaaugacugagccagggcuggaaucuugacauacaugucgucagcacucuuguaauauucaacagaauuacuguaaagcaauccucuauuugacaaguaauaauacauaaucucugcauuuacuugggaugcugaauauauacugaacuucuugcuguucuuuauuuuuucuucugggaacuauauauugggugauucuuuuaaaaaaugugguuauaugccaacauuaugggaaaggaaaaaaaaacuuaccagacuuuucuuccauacauaauccaaauuucaaauguauuaauuuugccgaaugccauggcaacauacauaucuguuuuucaguucaugaaagguauuuugggaauuauuggcucaugcaugcuugagcguuuucgucuuucagcuauagaaauacacuauguauccucuucauuuuguguuugugcuucuauucaagaugagaauaaaagcaguuaguuucuggguuguaauauucuucagugaacgguggcuuucuaaaacaguuacaccuugacugaaaugaaaacucugcuguaucauaaaagauauucuaauuacugcaucuaguuaaaaggagaauaaaucacugggagauuauuuuaagugccuuaaauauaauaaaaaagaauaauggacguugaacagcuugacagguuugaugaaugcagacuauggcugauuucugcugcuuucuaauggaaaaggagagcauuuuacuuucuagguguauugucaaagcaaauuuuuguuagggaagauaaggagaagccuuaucuuuguugagcacuugccuuguaccaggcauuagccaaggcaguguauuaucucauuuaauuucauuuaauccuccccaaccuuguagauaauguuauccccauuuugcaucuaagaaaaaugaggcucagagaauuugaauaacuugccucaggguauauagcugcaaaguaggauccagacuagguucuuucucuuuauuucauuaccccaguaggguugugaugaugauguaaauauaaauguaaauauaauugucuccacuguuacaaagauacuaauuucaucccauuuaauuuagaaugguuguguccaaacaauuuuaacuucuuugagccucuguaaaaugggaacagucaggucacugugaucuaaaaggagaauauaugugcaaaccucuuugcuuagugcuugacaguaaauggggagugccugggagauuuguuuuccauaucaucaacagacaaauggguguucccaacugauucuaaguuaagaguuuuagauguuuaauuaauagacucauaaauugugccuguaaauuuaaaacgguaucuguugaguuuuucuaaauguauuuuacagauuagauggugauagacuuucuuaaaauguuguguuuuccauuggauuuugccuucauaaauguaugaaaauauauuuaguuaguguggacaugauugcagugcuaauacauggcagauuguguguacauauauguguguguguguuggcuauuguucuaucuguaggaggguaaaaaucuaaauggugggcaaauaaaaucagaagaaaauguugguuaauuuuuggauuauguugucucuauaagagaauguuauuacugguaaguauuuugcaaaguuuuucauccauguagugaauaugaaacaugucuucuugguugacucauuuguaucuuuuacaguacauuuugggugccaguuuauagauucuuuuccuaaaaucugcaaaguaauagaagaguuagaauucaguaccuaagauacagagauucuauuacuccaacccccuugccauaugaagaucuguguuuaaaugagucaagaaaauuaacuuuuaagauucuauguggauguaugaauuuauucauauuccaacauucaguugauggcauuuaugggaacuauacucauggaaacucagaaacaaagaaacuuuuauuugccacuauauucacacacuuuaguaguucuuuccuaaaucucuuuugaaguaaagaauacuauaacaucauauaguuuuguguucacaguuuuacaccuaauuuuacacauucacauuuauagauaugcacaauuacuggacuuacucuuugcuuguguucaaauauaaaagcuuauagaaucuuguaccagcuaucaacacauucauccaaauguauuccggguuucuccauugcugcugugguaguaaauauaaaucuacauucucagugguauuaguuguucuuagucaagcaugagaggaacuguauaugagugucauuaucuaauaauuuuucuaacuguguuaaauaacgucguauucucccuuccuuugccaugcugaaucagcugaagagacaaauaaguacagaagggaugaguguggcuucauaaucagggaugaauguguuaugauccaucuugauccaauaagcagaugaauauuucacaacugcauuauuuuguaagugaggauacugucaguuuuguagcaaagguucugguagauaagauugucuuucuugaucuuuuauaaguaaauuuuuauuguaaauuauuuaacugcauucucugaaaaauguacuuuuguaucagagaaauaugcuuaggauauauauguguaagaauuuaaaggacagguuuaguuaugggccaaaaucuaauguuguagcaucaacaugauuuuuauuaagaaaagagaauuugauguugagaguuuucaguucacauacagaauaaguaaaccuuauccuauaaacuacacuuauuauugguauccguguuuuuaaauguuuuauguguaccucaucaaaaugagaucaugaucuccuaauuuauagugauugugauuauuuaaaacuagcugaacuaggauaacauaaauaguguaaaaagggaauccuacaauugugauuacuacauuaaaaaugcaauuugcaguauaaaaugccaugugaagguuaaaugauguuaaagauaauaauguguauaaugaaaucaagaauagagcauuuaacaggaauguaucacuuuaugggcauagaaggcaagagagaucuuuacacugucauuauuacguacaugguaguauuuucuaauucaguggucuucaaauuguauacuauggaacucacuauaugaaagagauaauuuuuuuacaugggcacaaacacacaauuaccuuagcaauggcugaagucuuauucuuaaaauauauucuuuguuuuguuguauauuuuucucuaaaauaaaauaauuugaacaaaauaaauauaggacuauccuuuucaaaguaauagucagcgauugaauuuuugaaguggaaagacugaaugaaggccuguggauaaagacgaaauccugaaauaucaaaaaacaauaguuuauucacaaaauagauguuugugaaauaaaaguuaugcccuuugcuuucucaauugugugauauuuauaugucuuaguguuaaugcuuguggaguagggacuuaauauuuguuaacugaauaaaacugccuaauucuaugaagaauacuaaguuuauaugccaggaauuucucuuauuuuuugcaaauauguaauaauaauguuuuuuauaacuccucagauauuaugauuuacucuugauuaggcaaacugugggaggaguaucagauuauacaacaugccaaaaaacauuaauuauauuucucuguaaugaagaccugcaaauaaguaaagauguuuguaagcagucaaaguagaugucaucaaguucauguguuaaauuuguuuugggcagauagugaacagucauuuacucuauuagacaaaauaucauaauuagugaaaacaauauucuguuuuuuuuguuuugagauauucccuuuguuuuggggguucugcagauuuccugugauaugucugcaucugauuuuguuuauuuagucugcuucuucaaugugcugacuucauaccuugcaaaaauucugaaaucuucucaacuaguauuuguguauugccucuuccuuacuccuccucuguuuuuuuaaugaaacuccucuaagaagguuuuggacaauucucauucuauauuaugucuauuuaugucuauuuaauauagucuacuuuuuuuuuugcaucucuguuucauucacuagaauauaagcucucugaggaccauagucuguuuuguucaauaacguauauugagcauuugaaagagugacucagaauggauguccggugcgcaaguggaagcauuuuuugaauaaaugaacgauuucuguguaauuuauucugaucuguuuuucacuuuaccuagcuuucauuggucucguguauuguauaauucaagcucuguuucaauggcuguauuuuuaauuuauugguguucuauuugauucccauucaaacuuaucuuuucauuaugauguacauuauuuuugucuguauuaacacuuuaaauaugaucauuuaaaaaaucucuuucaaauuacucuauuugucaagaucuugggggcacuaauccuccuuugugugucuacugacuuguccacaguggauaaguuuguguguguuucuaauuuuugauugugagcucaucuucaucugggauguuugucuccuuuggaaguuugugcucuggguuaugggacaguucuuacaaagugguuuucuguuaguuucugccaauuucucaggaauuucauugguuuggcauuaguuuuuacauuaauuuuauggcuugugguucccaaacuaagcaaauaguauaaauuuagauucugcaacugcauauggaaaaguuuucaggguuggauuacucauaggcaacucuuucuuugcccaccaaagcccuugccagacauguuuucuggccauuucccugaaucagugacauaagaaucaguagccuuuccaaaucucuggcuuugugcaggggucuuaggaccugugccucuguggguuuaaaaacuccagccccuaucccuuagggcccauagaucugcuaauguuuccaguucuguguuuuuuguucuggcuguaaauucccucucagaauuccauuucuuuugaguuuggguauguauuuaacuuuuuucucaucauguuuuauccaggcuuuuuuuuuuuaaauggagugugugugcgcgcacgugugugagaguguguuuggaggaguguauuauuugaaccaucauauugcugagacuagaaauccccucucauuucuaagaucaauuauuauguggauauuugcuuucuuuuucugaguguaauauuaaauacgaaauggacucgugaaccuggagaaugucugucagaaauaccgaaccuuccuucuuucauuuucgccuguaaaaucuuacaauuuuuuuaaagauagauauacagccaucuagagaauacacagaagagugauuugguguucaucuuuguguuugcuguuugcugaaggaucacucgcuaagauacgucuaacauugcuauaauuguucuguuucccuuugaauugaauauuuaggguaaggcacugauaugucaguaggaugaccaacacuaaaaguccaguauccugggaaaccucugucuuugguagaccuggauugucaccuuagucuuggauuccuuccggagacugaagaaauccuuuaaaaacuuuccugcuguggagucuucuggcucaggccccaacuacaguguuacauucagacuucuuuguuagaacaaaguuuuacauauauucaaauaguaaggauaaauauuaaucuguuuagaaagagagccuugaaaggauccuagucuuuuugcauaggaaaaauguccccaaucaaugagaaagucuaggagcaugaucaagacuuauuuuauauaguuugucuuuuaggggguacugguggauuauacuuuuagaguuacauucaguauuauuguggcuggacuaaaaaccccucaagaauacauuucacauugauuuuauuauagacaucugucaagcaaagcagaggcaaaugauagcauacucauuuaccaguaaugcaaaucaaaugagcuaguggcaacaaaaucacuccugacaccuuugcccuuuuucucuugauuugaacuaaugacgugugugugugugugugugugugugugugugugugugugugcgcgcgcgcagacuagcaaaauccagacuagcaaacaaaggccaaugacaggauaacuuucauaccuucaugccugggucacucaccauguacgauaggagcagugcauucucuugugaauuaaaaaucuauuuauccuuccugggugcauaagucccauagaaggcugggaggggaaguggaacucuuuauauaggaggggcuuagaccucaauagccugucccuuugaaugacaaaaugcccaccagccuugccacaaauagcuucugaaauaugagaaccuuuuuuaauucuuaagauccuugaccacugcaacuaauguaaagacacacuccgcaacaaacuuauacacacacacguacacacacauuuuauucuguuuuauaggaauggcagucuuuagcagugcauaauuuuuuuauuauuauuuuguuugagacugggucucacucucacucaggcuggagugcaguggcaugaucauggcucacugcagccuugacccccuccugggcucaagugauccucccacuucagcguuuugaguaguugggaucacaggcacgugccaccacgccuugguaguuuuuguguuuuuuguagagaugguguuucgccauguugcccaggcuguucuugaacuccugagcucaagcaaucugcccaccuuggucugggauuacaggcgugagccacugugcccggccaacauuccaucauuuuaaaagcugggcaaaaagggaaggaacuaguugagaaaggaagguucuauggccagaacaucagaaugcuuguuuuuaguuuuugcaaacauuggugaaauaauaguuggcuuuuuuguaaagccuuuccaguuggaaacugcaaguacuuuuuuuuuuuuuuuuuuuccgagacggagucucgcucuguugcccaggcuggagugcaguggugugaucuuugcucacugccagcucugccucccagguucaugccauucuccugccucagccucuccaguagcugggacuacaggcgcccgccaccacacccggcuaauuuucuguauuuuuaguagagaugggguuucaccauguuagccaggauguucucgaucuccugaccucgugaucugcccuccucggccucccaaagugcugggauuacaggcgugagccaccacacccggccagaaacuggaaguacuuuuaaaaguaugauggaagauacauacuuuguaauauacauacauacaaaauuuguucuuugagcaaauuuauucaguuuuacuggcaaugaaacucauaauguuuacuccucagaaauuuuaaaacauuuguuuguugaauguauuuauuguuucuaucggcagucuuuggaaaucugucuugugauaguucuaauaauaugguuugaauacagcauugucauaugucuuauauguuggggcaacauucuaauaacuauacauuuuuuaucuuccgauacguuuuucugaauaacucuuuguguugacugcaaguauguuuuugcagagucaccaaguucugaaaguaugcuuuuaggauggcacuagguuacuguguuuguauuaaguauaauuguguucuuuuguagauuuguuccuauagagcuaugguuucauggucugaagcugaaagagguuuaaagaggucaucacaguuccuccucccacccuuacuguuguuaaauaugaauguacguuugacuauuggaggaauuuuguuucuagaacuuucaagaguaauuguuuucuguaauuuauaguaggaaaauauugauuuauuaauaguuaaaauguucuuugggaugcuugaagaccaugaugugaaaaacuuaaaaaaauuagcauugauguuguuucuauauauuugccaaugggaguacuauaacuuugaaauguaggggauuguuugaaacaugaauugugaaaaauaacgcaacuuuaguuauuuuauauuggguccaggcuaguccgcugaagaguaugaaguacaguuuuauguaaaauauaucucagauugagaauguggaaacacuguucuuuaaaaaaauaaaaucuucaguaagauccuuuuaugaauuuacugguuuguucucauuugucaucggacuguuuccagauguaaaauauuacuuucuugaaauugcuguugagucuacuaucaagaccaggugcauguuguuuuacagcuauuuuacuucugauuuuuaaugcugaaacucauagaaugccuugaacugauaauuuguuuaacucucuaccuacuaauuggaccaagaaauaacuuuguaucuuuaucucuuuuccauuucauguuuuauuucuguuucaauuagugugugccuuuggcaaaaaggagaugauuuugcuuucuguuuuaggauuugccuccaagaaaaaauauauuuuauugccacauuuucucaauugauccaguagaguucacagacaaugaaaagaguaagaaaacuaauuuuuaaagcuugguaguguuauaauuuucuuccuuauaauaaucagaaaaagaauuuguauaacuuuuguuucuaauauagcaguucugaaaaucuaggcuuacacauuuuccuucccauuacugcuguuuauacuuaaguaaaacaaaaauggucgcugcagguuuuuuucucauuuuagugcagaguuugaauucuucaaagacugcuaagguuuucccaccuuaacaauuuaugacagacccuuauaucuucauaggcugaguccgcugcuaagaguuugcuaacucaugacuuuaauacaccaguagagaucacacuggaguuaaaacaaagagagcacgaacccugaaaugauuuaagacuguucuuagcugacuacuggaacacagugucucacgugguguuauugguaaccuuaaugcagauuauaauucuguaguuuaaccaggauguguuggcuaugguaaagugccuuuauaaggaauugugaaagggcacaaggaauggaaacagaaccucaguuuucucaguguaaaugaugaugacaagaauucccugugcacauuuguuguugugagaaagggugagauagaauagauuggacacauaguaggugcucacuguuaguuuuucucauucauucauuacugugucauucuauuggcaugcucacagucauguaguggaauaugaaguuacaucgugauauuuuucauucauucaccacugugucauucuguugacauguucacaggcauguaguggaauauaaaguuacaucaugauauuuuaaaagcuaccgaugugguagauuucacagucuugaaaagggguuuuuuuuaagcugaauuuucaguuucacuugagaagaguccugauuugcuuguacaaagagcaguaggguugcagagaaggaaagaaggcaacucuuuuaagucccagccgcuacucugcugugucuuauucucuaaaacagugaagaagucuggguggacauucuaguggucagaagccuaagcuuugucuuuugaugagugcagacaggggagggagcaacugacgagggaguagaggggcuuggagccccuucccaagucuaccaucccucacuuaugugucucuuccucaguaaagcacccccagugcccuuauuugcuguauuuuucuucauggaacuuacugucuaugggaccuauuugugcauucauuuauggugugucucugcauugcuuucccuuucacuacccauguaaguuccaugaaggcccagucuuaagcauuacagguugagcgucccuaaucugaaaugcuccaaauuccaaaaccuuugaacacugacaugagauagugacaccuuugcuuuuucuguuguuccaaaguacgcaaacuguuuuaugcacaaaauuaucaaaaauauuuuguaaaauuaccuuuagcccauguguguaagguauacaugaagcugcauaugaaacauaaaauacauuucauguugaaacuugguucucaccccaaaguugccucauguauaugcaaauauucaaaaaucccaaaaaauuagacauccaaaacacuucugauccuaagccuuugagauaagggauacuuaaccuguacuggguccucagugccuggcacaggguggaugcucaguaaguauuuucuuaaaagaaagaacaagggaaagguagaugagacgauaagagguggagguacagggaagaagaacacagaaacauggugaugaaaagaacagucugauaccuuauuugggccccagaaaaugauugguacugaagggauuuuauuaguggucauuuaagaaacuuguguuguacuguuuuuguguauuggaaggaggcuagacauuguuacauggaaauucacaguuacauuuucacuaaauguuucauugugaaaaacgucaagaaagguuggagaaggucuaggaaaacuuaucuuugaagauacugucuuaugaauuuccagcucagacuugcagcuuuugggagcugaggcuaugaggugaucuugagagcagcugaggaggcucuaauggguuccagcugugugcccagagaacccacccucucaggauaacauuaaccagguagacccugcccugacugacuuccucugggcuuuauggguccccguggucuguugcauugaucuugcauuuucagguuuuauagcaauucuaaacaugugaggguacauauuugcucuuugaugugcccuuugauagaagccagagugcuuuaccugagccugccuguaauaaugggggaagguggguugcaugcccugcagccauacgcucccugggaggcugguuuuauugcgguuguugauuggcagacuuuaaucagggguguuucuuguuguauuuuugaacaugaaguauauuaaggauaguuaaacauguaguccugcugguguuuuguuuuguuuugaaccacauuuuguuccauugugccacuugauagaaaggagggcagaauggaaacauauggggagcagaaauaguaacacuuaugucauauaacuacacuguguuggugauuuuuuguuuuuuuccauguuuuauaauaccuuuauguacaucccuauuaagaaggcagcuauugugucuccauuucacagagagguaaguuaaggaauguggaauuuggaaacaugcuugccgguuaguguggauggaaccuaaauuagaauucagagcucuuauuacuagauaggagaccaaucccaggcagucauggcauuucugugaacucuuucgaagaguaaagggacaggaauugccuuuucagaguagaacucagugcauaucaguggaauuauagaacuuuaggguuagaagggccuuugaugggaccauccuuuaagcuagaacugccucuugaaguuugcagugugcaugaccugcagcuccauuguuuauauuccaaaucuaugaaacuagugagagaauaggacacaucuuuguauguuuagguuugacaguacuuaucagaaguggucauauuacgguuuucuaucuuccuuugguggcuuuucagcuuuccuugguaccagccuuccaaaagaaauuagcucccuugugcccucacuuuaauuuggaagagauugguuuggaagagccaccaagggcccacuagacagcuccuuagaaguugcugugacuuggcagauggcaccugagguuuaaggauuggggaucuagccauggcguguugaugaugaugaugaugaggauggcaaugacuauuaacuccuuaauccauauuuaaucauaucaccagaacugaugguuguucauugaagauucacuucaugaaguacaagcuaggugauuccuuuuugaaaauaacacugugggccuaagauauauggaccuuauguggcuuaaaaugacccacuucucugugcuuacuccuaauuaccuucuuauuucuuugaauuuaguaaugggaguaaauccgacuuuaaagccauuugugguggcaaacccuaacuauucaaugaaauacaaauuugguacauuugcauccuaugcaaguuuuauauuuuugacagcuauuuuuguauuuaagcaagaagccgaaauaaaaauuucuaaacagauaugccagauuauauucaccauguuugaguauaguauugauuggucauggcugauguuuaucagacuaagcaaagugugucuguauuaguugucucaagagggucuuuauucuuaaaugcuuaugaauuccauaauaagucuuggaaaguggaacauacccaagcacaauuuauaacuuuucuaggcuuuauugguauucugagccauccagugaggacuggagucauucacaugauagaauaacacagauaccauuuauuaaucugcugaauauugaucacauuuagcaaauugcugaauauuaguagugaaauacuauuccucuacaaaauaguaguagccauaguaguagcaaaauuauccucauguguccaugcaugauuuauauguauguguguguuuauauauauacaguguauacauccauaucucuauauuucuauuuugcuaucuuuguugggauuuauaagguaacuuuuaauuauuuuccuucccccauucucuacuuagcgauccuuucuuuauaccaaucaucaugguaaacacugggaauauaaagauuaauaagucacaguaccuauccuuagagcuggaagcaaauacuuuuuauccagcauaaugaguguuacgagagaugguauagaaaaugcucugguaggccuggugugguggcucaugacuguaaucccagcaguuugggaggcugaggcagguggaucacuugaggucaggaguuggagaccagccucgccaacauggugaaaccccaucucuacuaaaaauacaaaaaaauuagcugggugugguggugggcaccuguacucccagcuacucgagaggcugaggcaggagaaucgcuugaacccgggaggcggaaguugcacugagccgagauuacaccacugcacucccgccuggaugacagaacaagacuccgucucaauuaaaaaaaaaaaaugcaaaaagaaaaugcucugguaucccagaaaaugccuacucuguuucaggaaugcaauucagaaagguguaccagagugucauuugcagucuagugguaguuucauagaaugucuguuucaagaggacccuucucuauagaucuguaguuuuuauuaguuauaauuucuucacacuucugucagaaauguuugcuguuaauuuugaacacuguuuuucaugugaauauauuuuuuaaguggauaucuuuuucauuuuguuuuuuuccuccuggcuuuuaaauauauauuuaaaauauuuuuauccauaucuaauuuuugcaacuuucaaaaaaacuuucuaagcagucaccuccugacccucuuuuucccccuuagcuguuucccccccccuuuucagggccaccuccccuccuucagagcccccgcauaaugcuauuccuuuaccguccagccaucugccuguuuuagccucuucuucacucucucuguuucuucuauauagauuuccccauaugucugcuucuuccuuuauccacaaguccagacacuccuccauagcuuucuuaccaccccauccuggugucccgucuguucauaaauaacucuuucauccgccuugaaucccaacccccuacucuuucuaaaaagagugugcaaauaaaccuaaagugcacggagccaagaugcauagcauaguuuugauucagaauagacuuucuccuuccaaucaccuguuuuaguccccauuuuuuguugcuuggcuucuuuguacagauccacaauugccguucaauuuuuguaugaaaguggaugcaaaguuauuuaaugucuucaugacaaaguuuuugccucuuacuggcagguuauuuugcccuaaucaguuacacagucuugugcagccuagugguugcuauuuuggaguagucagguuugaaccuuuuguucuucagaaauuaacguauuaucucagaaacagcagucucugcuugcgugcuuggcaacacaaaacugcguuagguccuuuucuaagucugaguucuaggacaugugccaugaaaggaguguuaacugaaucaccugcagaaauggccacaaggagggcuuuguaauguucuagauauuuaaaauguugguguccuccuccuagcauggugugcuagugacaggcuccuuucucccuggucaagaguaaacauuggcaauuuacuucccuuuagaaauguguuacuguagccaucgcggaguugccaguguuuuuccuuccuaaugucagugauaauuuuacucacagauucccugcagagauuuuagcucagcaggaaguaaaucuagguaagauugccuugaaaacugaucuaaaacaauaaaugcuaacuguaucauuccuuuuuauuuaaaaaaaauuggaggcauaacuaacuugauuauuuguaacuggugagaucuaauaaucgugguuaagaccccauucguucauacauucucucguucucucucucacugcuucuuugccuauagaaaaauaaaagucagagauugaaaugauucacacuauauuuuuuaaggaugaaauaucauaguagaaaugaaagguagaacuguuuacucaugagaugcugagaaaaucuaaacuguagcuuuccuagaguuuaggaagcuaaauauuuuauugguaucaaaaucagaaauaucuaaagaauaagauauuuaguuuuaaauguuucauacuuucuaaaaagaguuuuugcuuuguuuuguuuuguuuuuguuuuuugagacgagucuggcuguuaccacccgggcugaagugcaauggcacgaucuuggcucacugcaaccuccaccuccuggguucuaguaauucuccugcuucgaccuccugaguagcugagauuacaggcaccugccaccaugcccggcuaauuuuuguauauuuaguggagaugggguuucaccauauuggccaggcuggucuugaaguacugaccucaggugacccacgcaccuuggccucccgaaguacugggauuauaggcaugagccacuguguccagccaaggucuuuuguuguuguuguuguugauagucaagaaugagauuuuacugaaacaaggacaucagaauaaaaagaaauguaaaaaaugggaaagacacugaaaauuacaacaacccauauuacucauucagauucuuuuuggaauuucaaauagucaauaaugaagagacauaaauuccuuggagaaacguagcuuagggucagcuuuccuuuaaugacacuagugcuauagucacuuauauguaguauuuuugguguuguccaauuucuguggauucugaacauuagcuguacacagauccaagucuguggcuuuagcauauuuuugcuuuuacaucuugucaaaaauauacuguuagaauaucuuagacucgagaagauuuuagaaaucacuaauaauguaacaacuguuauugguuaugaaugaacaaagguucaguuaaagaguauuuccagguaaggcuguacauauccacaguauauuauagagacuucuggguuaugcacuggauauuaaugguuuggauuauggugauguuucugaaugugugaagggugaaguucuagacuucauuuuuauuaaaugaaauugauuuucuuacccccaccaaauuacuuaccaaacauuagauaccuaagaucuuaaacauagccauccucuaaauuauuuguucuuuaaguguccagagaauaucgugcagcuuccagaucauggagaaaccaguucugugcucuugaaguugcagugguaggagaaauagcagucuucuaugacagauuuuucaacuuuaacccucucacucucugcuaauuagaaucauacggucauacacuuuugguuuuuuuuguguguaacaaauuuuuucuaaagauucaacaaaagaguuucaagguuaccuucaaguagguacaaauaucuuagcucuggcuucuuuuucucccaaauuggcuguggacuguaggagcuuaauuaguucaggcucagugcaauugguuugcuccuagggugugucuauacuuaaaacauuuuuuuauaacagaaaauacguuuuugaccacuuuucauaacuuccucuuguuguuuaccaguuuuaauuuuaucuuggcaauugaaaaucuugggggaggccaaucuaaaaaaaauucuuggauuuucaaguuggauauacaucgguuuccuaaaaagaacucucuuuuucaauaacuuugauaucucauucauucagccuguauuuauugagagcuuaucaugcacgugguguuaugcuuuuuaauugcugguaccuugaauauuuagagaaaaaauaccucgugcauuuugucucuguguguuugacaugucaccuuguugaaucugcaccaagaaaaugaugaauuccaaugaucuaugguaguuacaaggccuuagaagaaccagggaugugaauuuuuggucugcuuccuccguauuuccuauucauugagaaacgugcuuguaugcauauaaacaauuccuuacuauuuuucuuucuggagaggaaacaguaauggguggauuuuaucacaggacaaagacucuuccagauagcuguuacagucccucccucugcucaccugauuuagaugaaccucucuuugacccaccacgauggugguaagucugccguugcaguuuuguagacauguaugugaaggcgauguuuguuauggggucaguguugccuuaaggaugcgggcuagagugaggggaccuuuguggugggcuuugcagacuucuuggcagagggaagcacagaugcgugagguuacuauuuucaccuaucuccuccuuucuuuauuguuuacaggaacacuugucuaaguggugcacaauuuugccuugcuuacgcuucuagagugaaaaauaucuguccagacucccugggauagguugguucuaacaucuugguggauugagccuggaccaggaguuuugacuuagaauucauggagagaggugucuguaaauguauauauaccccuuuauguuugggagaaagcaucuguggagcuuaucuggguagcaagaggauuuugugacccagcaaagguuaaggcacacugccuggaaaaaucaauuaggauccaguugaggguuagaucuggccauagacuuugccugguguugguaaauaaucugaaagccuuaaagcaucucagaguaaugaaaggggcccaaggguucacagugccuuuucucaggauugcugcaaggauucuggauuaaaaauccuucugcugucuguggaacagaacauuuccugggaucaauccuugagccuuccauagacaaagaauuucccaaaacuaaucuugccccauguggugucagagguaaaauaagugccaagcaugagaagccagaguaaccuuuacuggaguaaccucugcuagaucucuuguuaucuauguacucuuagaauaucuuagacucgagaagauguuagaaaucaccaauaauguaagaacuguuauugguuaugaaugaacaaagguucaauuaaagaguauuuccagauaaggcuauacauauccauaguauauuauagagaccucuggguuaugcacuggauauuaaugguuuggauuauggugauguuucugaaugugugaagggugaaguucuaaacccuuuuuagauaggcaagugugaugugagcaguagaguacauuuuuuguuuuuguuuccugaaguggggcacauuucucuccccuuugugguucuguaaauacauuguugaguccaguggaacuucaaagauggcacauagcuacugaugacacacacaaauauuguaaguugauaaggaugucugaaauguuauaaguggcuaccugaugccugaugucaaugcugguaucuguaaagcacacacacuaagaauagagacuggcagcucaaggguguugaugguaauuuuauuguaucuucaagaaaguguguuuccagagaauuauuaucaguaauaaugacuaccaccuuguuuucuuuugccucauuucucuuucuucuuccaugaaacugggguaagccuuauuguagagagaagcccacauggauauccagcaccuagguuccgccgagggcaaggcggaaaugaacugaguuauuccauuucuguguaaaucggcgucauuugcuacaugugcaaguuuugggccagagguguggaaauuggguucacuguuaaucuaacuagugauagccuuuuuaaucauguauuuuaauaggaagguagcacaguugagggaccucuuuugccucuugugccuaagacagcuggguuugaaacucaguuuuuaaugaauuauuuaacuuuacugugucucauuuucaaaucuauaaaaugggguuaauuguauuuugcaggauuauacuggagaagaugauaguacauuucagauuucuaccacaaauauggcccucgaauuuacuuuucucuacuacuaagcaacaaaauaaaauugaggaaaugggagucucucuaccuggucuuugauuuagagugugguauuucuucauuauggguagaagaguauuuuucuuuauagagagucauuaaccuucaggaaaaaaaaaucaaucaaagguuacguggaaugaagaagcgaugucauguaauugagauuuuuuuuuuuuugauucaaaauguaaacucacuugauuuagaauugauuggaacauggcaugugaaaaaaacacaggagacauuuaaaacuguaccuaaaucugauauaguaguuaagaaagcuagcuuuauaggaaauuaaagggggcugauuagaguaagauaggagagagagggggaaaggggauaugguggguagcuagaagaaaggcauacacaugcuuagaaguaggaagccagagauggaggaagaccuaggaugggcuuggaaaacuucugaagccuuaaugaacugaucuugucacacacagcuguucauuugaguugugggccucagaguauuauuccuuuuuaucacugucuuuugaaaugcuaauuagauaauugaccauuguucccaguucuuugguuacuuuuuauucuuaaacuucuagagacuaggccuugaaugggauacucagagcagcacaccagaugggaaauuauucucuggccuucaguugccaaaugaccaccacaguagugcuugggauguauaaaauccagcugagaggcagaacuagccuaaggggugguuagcauacuucuugggauaguccuucaucaauagauuuuuauuuuguaaugaugaaggggacugccuuuguauuuuuauacagauuuaucagauuuacuuaaucaauaacuuaaucaauauugauuacuuaaucaauaaucauggucuucuugaccaugaaaggcucauuuaaagaaaagaacacuugaagaauaucugaaaaugauuagcaagauaccuuugguuuuucaugaaacaccauuauaagucuaauguuugaagaauguuuuuauucuacuucugaccuaguuaacucauaguuuuuuuuuuaaauugaauuagauaauguguaugaaagcaucuugaagaauauacacucagcacaaauguaagauuugauuaauaaggugguuauuaaugaauaccauauaguaacaauauaucugagucuugcagaaaaacauucuugaccaacaggacgugaucuaguagaagagcugccuguucuacauauuuuauaaagagaacuaaucauuuuucuucuguauacucaauccgauaucaggaaaccucauuuaggucuauucacacuguagaggcagcaaaauaacaugccugaccuuuucuauguaaauauuaaaaauuauuaaaucugcauguuggaaagauugauuucggcaauaccuucuaaauuuucagugaauauuuaaguguaaguuugcagauaguuucaugaaaauaauugacuuuuaguuuugguacuagaacaauuggaauauuggugguauuuuucauuuuaaaucugugugaacuaaaauuuucuuauuugucuggcaugaacaucacagaaaaauccuuucccuucaagcuauuuuuuuaaaaaaauuguaaaggagauacuauguauugcagaacauuuagcaaauagugaaaaaauaaaaagggaaagucaaaaauucccucuuauuaguucaguacuguaacagucgauuguauugccugggcuauuuuuuuaaaaaaauuguaaaagagauacuauguauugcagaacauuuagcaaauagugaaaaaauaaaaagggaaagucaaaaauucccucuuauuaguuaaguacuguaacaguugauuguauugccuggugguagucuuuauaucuguacacauauacauacaauuuaaaauauguaugcaauuuuagauuauuuaaauaaauucauacuuauuguuauauauuuuucuuuuucuuuuuuuguauuugcauuuuuaaaaaacugauaagaccugccaggguuaugugugcuguaguguuuccugaauuuauuuaacuacuaugguuuuucuguuuucuaauuuauuaauucauuaaacauuuguuauuccuuuguuuucuugggucaguuuuauagaagucauuuuccuuaaauugacuguugaguuaaauuauuucacucuuauguuccagaucaugaauuuguauuguguaaaaauuuggcugcauuccauaaguuuuguugauaauguaauauucucuguguuacuaguuucugaaguuauuuuggcaguuuuuuccuuuuaauacaauagcuaacuugaacucucauuuaaauuucaaagagauuaucaaguuuagcuuuuaaaauuuucauaacuguuuucuaguuuuauuaaaguguggccaguaaagaaacaguguauuuucugugucuuaaaauuucuuauacucuuagugucccaacaaaugauauuuuaggaauuucucaguauuucagaugagauuuauuuuuauauuuguaauaguuggaaauguggcuuauuuucuguaguguacauuuuaauuugcuuuucaguuuuuaaaguuuuuucuuaacuagaucucuuuugaaccuagaaagauguguuaaacacucccacaaaauaauacauguuucucaugcauaagcgauucaugaugacuguguguuuaugguagauauuuucaucuuugaucuucaguacucccucuuuuauuauuaucucuuuuuuuccauguauuauuguaagagaacuuuucaaguuugucgucuacaucagugacaauuuuucuacaauuuuaugcaaauuuuaauuuuguuaaugcauuuuuaguuuucuuacaauauuuccuauuacauccaucugcuuuuacaucucuucacaaaucuuuuguguugacaccuauuuuauagaaauauucuauuuuauauaacugucaaaugugauguuuucuagacuccacuuguauuuuuuauagggugaaaauguuuuucaaaguauaauuucccucugaauuaugaguacauauuucccuauauuuuauugugcagauuuuuuucucacuacacaguuuuuaacauguuaaacuuuaggacgcugcaaaucugccuuucuuaauauauucugugauguugaggcuaacuacauauauuuuguaaagagguaugcuggucuccaugucagccucuaccaauaggaggcgcuggagggagaguagaaggcuagaggaggaagaacuuggccuuuccuguucuuguuaucaucacucugguaacaucagucuuuuccaguuuuuaguuuugucuacauuccuaaaauuaaccuccuuggagauaacagccccagucugcuggugucucuuccucaucacgucucucugagcuuacaggcucuggaaacccaaccgcuucccuguuuccccagccguggggaugguagcuguuuccauccgacuguucaugggugcuucuucucaagucuaaagccagaggacuguaaauguauguuguuuaagccacacauccaaccauacugguucaggaaggcagcggucuuccaguaguuaguuagcuuucuaaaaacucccuuuaaaaaugagacuuuagaaagaggaugacaaauccugaggacucgugucuuaagcaaauuuucugucuagauauuuauuauaaaccuaauugcaucugauaagugcuguguaugucauacucuaucaaagguaaaaggguuauuaaaguaaccugcacuuuuuagagcaaugguggauggccuugcagaaggcacauggccuuuaucagucaacucacuguggggaagcuggagaaauaaaguucaggugagaguaagccgacaguucuggugugauuuucuugggaggauaacguauaauguagguagcaaacacaugggagaaagaagguuuugcauuaugagauuugacuuaauguguacaguuugcuuuugguguuguaaagcaguaaagaggcuuauugacaucucuauugaaggucauugcagugcaugaaauguaaaucaaaguguuauucuuuauuagaagcuagaagauaacauuuacauaacaugcuuuuaagguaaugaguuaaguucauuauuuuuuauuacuauaacuguuugaagaaaguuauuuucaugcuaaaaauacuccuacuugaauccgauuugucauaauuuuugcaugauguauaaucuauuguuaggaaacgauaauuccauuuauuuuuguuucugggggaaaauuguuagacagcuguuucagucuuuccaaauaaacucgcuuccagaauuccuaguaaguagcaaugcugguugauaggaaugucaccauuuuucugaccccccucagccuuaucacaaagacauagugcagaagccauauaagaaauuugagaaaaggaaaagauaccaaggccuagguauuucacaaacuggauaauuagacucugaauugcgacgaauaggcugaaagaaaaaaaugucacaagccuauaguggcuuaaggaacacugauuucacagugaaaucuuucuacauaaauuuuaugguuaacugguaauaggaauaaaacuguggagcaaugucagacaauucuguuaugauuccugccuaaugaauggcaggcuuucccuugguauuuucuccuuaaccugcccauugcccuuucuguaugaucacauuuucuuuaaccaguucuuugcucauaaauaaagccguguguuccgguucaaaaguugcaucuucauuuauaaauucacagaauauguuuuucagggaaaaauguaacucaaucagcuuugcaugguuuacauaaugugauagucucauauuuacuaugugguuaacaagaaauaacuguuaccaacaaaaaucagagaauuuaaaaacaacgaacauuuugcuugggagccuauguauaucucuauauaaauacauauagacaucuauaaacaucaucgauccuucccaugugcacaugccauauauauguggaugugggaugauacuuguuuuuauauauacauaucuauauuuauauagcugaagaagugaaacauauugcuuuuuauuuaagugacucaaugcguuuauagacaagcuuuauuuuacaguacuuuaucaaugccgagaugauaagauacugcuuugauuuggucuucuaaaggucaaaauuugaaagaauaaauugauuccuagagacauucuuaugcuaucauuggccuuauauugaacagagaauuucuaggaaaauuauuauuccucaauggaaauaaaaauucauuuuagguagcuuaaucaauuugaauuauucauuuauggcauugcuuucaauuguugaugaguguauuuguguacuggguguggggaggucuucaggggaugggaagguggagggaugagaagauucuuauagcacuaaacugaauuuucaauucccugcuaaagugugaagaaagaagugaagugcuucauuuucuucuuuuuagaaucauuuagcaaccacaguucguacuuuauauuuuuuauggaguacuuucaacaacuugcuuuugcaguugggaaaugacacuuaccuggauuuucuuggguucuuuauucaugacaucaaugaagacuacugcuaaugaaccauagaugaaguuacacauaugcuaagcagggaaaugcaggaagaaugugaagguccuagaguaucucaauucagcauguaagugaguugugugcacaguagcacaguucugucuuauggcuggucaaugcuccauauuaugaauuuacauaggcuuuauuuuaggcucugaaauaauuauuuuuauuauauuucucaaauuugccaaaguaucucugagagagauucagaucccaucuguuugacagcugaggaaauggggacaguugguacaaugguuucucaacauuagaacacaucuuuuuuuuuuuuuuucuuuuuuugagacggggucucacucuguugcccaugcugaagugcagugguaccaucagggcacacugcagccuugaccugccuggcuuaagcaauccuccuaccucagccuccugaguagcugggaauacaggugugggccaccaugcauggcuaauuuuuguauuuuuuuguagagacaugguuucacaauguugcccaggcuggucucgaacucccaggcucaagugaucugcaugccuugggccucccaaaguuuugggauuaaggcaugagccagcacgccuggccagaacaugucuuaacuuuuuaagauucaugauccuguugggagucuuauguuguugcuaauguugcuuauguaauuuacuuucauaauguccuguuuccaccuauuuuucccucuuugugcugaagacuauugaagagcauugacuagugacauucagauaauagucuggugaguuuggguugaauguucuuuuuuguguggcaugcuuggauauguguaaauauguaagaauauagggaacuaaaucuuacuuuucaagaugcuaucgugacaccucugcuuguuaaaauguuggauaauugugagaaaacacacaaaaaaauacaaggaccccgucacacuucuuuauucucuuucagauuuuauacacuuaaacagauuuacagcaaaaaauccuccaaugacuuuuuaaaaacacuguuauguuacugauaaacugauuuuugucugugucccuucguauauauucacacaauuuucauauuucuggguuauucauccuugcuucacauguguuaucucacgguuaaaaaaauuuuuguuggaugaucaaaagcaauuaaaacauucuuauucagugcuuacauacuuuuguguucuuuuucugugucauuuuuucauauacagaauauguuuuccaauaguuuacauucugaauuuuuuaaugaccaguguuaaacuguuagacuuaccaucauuuacuuaagucucuccuacauauuuggugauuuugguuauuucuguaucuuugcacacguuuuuucauuuuuguuucuauuuucuaauaugcaguuuuuauagcuucuugauagagucuuugaaauuuuguuucugugaaauuguguaguuucauagaacuaaauuugcucuacuuaacuguaccugaugaauucauauuagcuauaaauauuuaaacauuuuauauaacagacagcaaaucaucauauugcugggaauguaaggaagauaaacuccaugcauucuagaagucauuagagauuuugcauauaaagaccacagcuaguuucaagaucuaaaucuugaagcaggcauucaagguguuucaauaaguacuuaacgguaggccauuaauucauguaaucauuuaggauaaaugaugggcagaaaaguuacugugcaaaaaguauuauuuggagaauaauggauauaugaaaacuuacauaaaugauuauuuauuguaauuuuuguuacuuucaauuucuuggucauggcaaaaauugaaaugcaaggucaaacagaagagagauggagaaagcucuaaccagcaagggccuggacucucacacuucccugauuggagcugcugugugugucugaggagucaccauugcuuuacugcuuauaccuaaacagaaguauauguagcuuugcuugcacugaggauguuuauaaauccucuggguuuuacauuugauuuacuuucuuccucagccuucccaucucauuugaagacaccuuuaguuuuuucauuucucagacuuaaccucuagggaauuauucauaucuccauuuucucuuauauuguacauuuaaagucuuccuaaauguuguuagcuuauauuuauuaucuaucgcugcauagcaaacauuccccaaacuuagugauuuaaaacaauaaccauuuuauuggcacacaaaucuguauguaguuuaccugcuuggacugagcucagccaguugguucucuuguugaugucaaugguggucacucaugaggauacagucugauggcggguggacaggagggccugguugguuuagggagccaucaacugaauuggcucacuucuguuccaugugguuuaggccuccagaggauagcucaggguucuucacaucaugguagaaaaucacccagccgcacaaaagagcaagaucaaaugaguaagcacuuuuuaagucucugcuuacaucaugcuugcagauacuccauuggucaaagcgugucauguggcauaguccaguaucagggugcuaagaaacuccacaaaaucaugggugaaggaugguguuauucauuaggagcucuuauuauaaccguuucccacaagguucugacuuuuaagaauucaaccacuuuuccuaaccucuguugcuaggacuuuguagcacucugguaauagucugcuaacuggacugccugcuuuagcccuugaccuuagucuguuuuuuaauggagcagugaucuuuaaaacauaauucagauguuauuccuccucuucucagaacacuucauugaccuuacaccuuauuuaguuaaagccaaagaccuuaaaaugguauguggcuucccugguaccucugugauaucauuugcuuucucucccacucuacaccagccacacucuuucuuaguguucugcaaaugcaccaugcaagcucccaccucagggucuucacauuuguuauccuuucuguuaggaacacuugacucagguucuccauaguuggguccuucaucucucucuucacucaaaugucauaucagaaagccuucccugaccacacucuugaagauuacagucauuuccucuucuaaugcucaccaucguguuuccuacuuaguuuuucuccauccaggccuccggaucacucuccauccugcucugugucucaagaggcuaaccuucuacaguugcauaaucagacugccuuucucucguucucucagucuucugguuggguucaccuaaugggaagcuguagcuuucccuucauuuugcuuauaaaccuuuaaaaaaaaacccaaaaaaccagacaguauauuauuuuagauuuagauaagaccaaacuaagauuuagugagcauuuuccaugaaccaauuucugugcuuucagauaugucauagaaaaaguuaagugaacugucaucccuguuuaagagucagggauacugagguugagguuaaaugacuuguucaagguaacaguuagaaaauaaacaaacaagacuuccaaacucacguccagucaucuuuuccaucuacagcccugucuccguaagucaucacugaaugaucgcuguuacacacaccuuuggaauuugucuuuuaucacauacacaccaccaccaccauuuucuggaaacuucuuuuaaacccaaucugacuuuuuaaucaagucuauauuugcuagucucaauagcuguuaccuucauccucuuacaucuaagggcauguucaccaggagucuuucuccggaaucaccaaccuccucuucucuccugacucuucagcauuuuaauaugcucauuucuccuaucuuaaaauuaaagauggauuuuuaaauuuaaagaugaauuuaaauacgcccaccccccuccaaauuuugagacuaacuuuucucuucauuuuguucuguccuuuucaagccaaguuuucucacacgacauucuguauauaaugugccaugaucuggcuucuuuccacaacacucucugaagauuccaccucaaaacgucaucaguagcaugugugauuggcuuugaccuuucuacugcuuuaccucuuugaagcguuggacuuuggaacacagccuucuucuauaccuccuacucucuuucaaaacucagcucaugucuaccucuucaugggaguuuuucuuaacacagaagacugaucugauugucccuccagcuuguccucuuguaugcuggggcauaugccagcaaucacagcugcugagaugcuuagucuuccugacggaacuguaguuuuuggaguggucaggaucaugucuucagaacuugcaccccagccaugugucugcacguaguucagugaccagaacauagucaacacucaguacaugccugaugaaugaacaaaugagugugaccauacuuaacuuggugaggccauuuuuuuccgugaguuuuauacucuggguuguuuuccuaccuuggauucucugacuuuuuucucucucaucuacuugccugacuuucuuaggucuuuuaacuuuguuucuccaucuuuacauuaaguguugggauacagggcugaacaagaacagguaacugucuuauggcuuuacguuuauguguuuuccucugaaauuaggcaaauuuccuaaucuugcugaaguuauuuucauccuuaagaaaguaauauuauaggucuuuauagaguggggcaggaucaaaugagcauguuuauuaauugcuuagcauuaugccuggcacaaauucaauuaccauuauaugguaauaauuuuaauaguaauaaaccauauauuacacauguauuauucauaaucagaugauguaugcauuauauaaaaauuguacuauucuauaaauauuguaaaaaaagaguaaauaauauacaucaauugcuuugugcauccauauauuuuuacgugugcuccuuuuauuaaaucauauguuuuuccucaguuuauugguugcuuuuuacuuaccaaaagcuucuguccaaaaaaaaucaaaugcugcggcugcccugagcagaguucaccuuggaagaggcuuuaauugugaugaaccuguaagaacaaaguuuaagaauugagauaaucagcagcuguguauuucuuuaaauuuuuauauuuaaugauuuauuugaauuaacuguuaccacguuuacaucuucuagauuaguuuuuaggccuuuacuuuuccuuggcuguggguacugaccagcauggugguagguaugauuggggugugugugugugugugugugugugugugugugugugugugcauggauagauguguguguaugcucauggaugugcaugugcaugcaugaaugcauaauauuucaaacacaugcucagugauugagucacugucaggaaguaaacuuggagaccauguugcucgaugccacaauaguccuguuauugcauugucaccacaggaugccauuaaaauagguaugaagaaugucaguguucauuaauuugguucucuucagagaacauuagccauggggaaaagauacaguagaaaucugagaagagauggaagauaggagagaaaccuggcuuuugaagaaugaucuuugaucuuucagaagaggaauacaugucaagagcuuaucuaugugaaagaauuuacaugcaaagcaaaucaagaacauagauuuugcuuaucuuuauagauuauaguuucaucuuagauggcaaagaaaagccaggcuucucuauacaaagggauuugcauguuuaugauaacucaauuagccuuaacagagacuaccaguauaugcuggcugucuggccucaaacuuuaaugcauauguauuuucaaagagaacuaaaagauuuugggauuguaacacagagaaagaagagauagagaauuaucaaacauuggggaucagcuuuaaaauuauaaaacaaauuauauauguucugaaaaauuacuucaggaauaagcagcuuuuuuuuaaauaugagaaagcaaaaucauauccuguaugccauuaaagguuauugcguuuuccaaauuuauaguugcaagugauggaaauuuucuuuaacaaacugaaggaugcauuuguagucuaaaugguagcuuugagaguaguuagauauuuauggaaaaauuauaagaagcaaugugcuuuuaaaauuuuuuuuucaaaaauagauauugguuaggaaaacuacacucuuucacuauuugguaaugcauauucugacucauucacacagucauuguggcaccuaaaguguugcaaaauuagacauuuauauggagaugggcuauugauguaaaaaaaaaaaaaaaagcugagggcuaggaaugauaagacaugaguagaggguuuuaaaaaugagcucuuuguuuuccacucuucaucaugccuagaucucagagagguuuuguccagugagaauaaagaacccaugggaauuaugcagaaaucacuguccaguaaaaggaauaguuuuccuucagugaccaagggugggaccugaagucagcacuagucagugacgcuguuuuaucgucuucaugccaggugaagauuugcauaggugaaaugcccacuuauuaggagaauuacacccugacagaaauccaaaagauggugccccuuuaucuucuaucaggggauuucaucuaauacuagaaggagcaguaagauaccaugaguuuguuaccaguuauucacuggccugauccugaaggucauugccuuucuucaguguuauuugcucaguauccugccugcuacccuuaagcacuuacuuugccuauugaaaucuuacuagcuauucauucagaaguaccaguauuucuuucaagguugaucuuaugaugcuacuguauuuuuucuugccuuuuaauuauuuuuuuaacuuuuuauuuugaaaaauuuuuaaacacaugcaauguauacacaguaguagaauaaucuucugugucaccaucauacaguuucaauauuuaccagcauucugccuucuuggcucaucuauauauaccacucccacucgauuuugauaaauucuuaauaauagacuaugagauccuugaaauuugaaacuauaauuaaauaucugucuauagacaccauacacauauauauacagcuauauaugcacauacacacauauaugcauagacacacacaccuaccccuuuauuuuauuuuuuauuaaaauguaacguauccucauuguggagauagccaauguuaauauuuugauuacuguguagauucuaucuuccauugguuuuuaaaaacauaacaugaaauuuguuuauugcuuuuaaacuucauauuuuaccaugaauauuuuccaauguccuugaauguuuugaaagugugauuuuuaaaggcagcguaauauuccaucacauggaucuuccauaauuuauuuuaagaguuugcaacuguugaccacaucuuaaacuccuugcacauaaacacuugucugcauuugcaaggauguuauuaggauaguuuccuagggaauuauuaggugaaaggcucuuuauguaucuugccaaguugcuaucuaggaaggcugugccaauuuguauuauuuuuaucuuauuaacgugguagucgacauaguaucugguuguguucuuuuagaaauuggcauuuucuggauuaaugacacugaacguuuuucauguucaugauucuuauuacauguguaaaauaagguguuaucuggaauuguagugaaugguacaugccauuuaguuuagcuccaaaucuagugcuuugcagcaaugauuaauuauuuuuaguauuucacaaaucaguuuuugcugucuuuggaccagaaugucugccuaagugcaaguuacauuaguugagaguuggucuuauuuuacuuuuugaguauuauuuuaaaaaauugucacuguguauaauuuucucccuuuaugucauguaacuuuauugagaaaugcaauucaaucaggaauaauuuaguuuagguaaaacuucuuuguccaagaaauauacugucagguccaaauacauuuuaaguuuugaaaaaaauauuuauuuagauaaaaauuuguaaucacucaggguauuugacuggauuugaagcauaauuuacuuccagaaugaauuuagaacucuguuguuaaaguacuugguacaauuuguauauccaguaaaauaaaaguugccauuuuugcaagucaguguuuuaaugcugauuugguacuuuugcuaugugaaauuccccauacuccaguauaggaacugaaugaaaacauauaccuuauuaaaauaguagagguaaguauuuucagcuuccuaaacagcagagaaugcuuuuuuuuuuuuuuuuuuuaaacuuuuggaauuacucuauuaccuacaucuaaguugcaaauccaaaaauaaaacuaggauuuuauuaacauauucugcccuucauugcuuccgguuauacuuugcugaacuguguucgaguauguugaaaaauaauuccguguauuguguguugaaaaugauauuaaaaguauauguguuauguggaagaaacaaucaaaacagaccuacucagacaucaacaggauauuauuaccccaaagaaaugacgacaguuugccagcuugaugcguaaaggaaggaaauuuacaaacaucuccaagagaggcauguugaacgguugaaggaaaugaggcacguccugcuuuuauugugcuuauugcagugggauucccagaagacugaacaaggcuguccugagaccucuguuuggcagagaucuuguugauucauauuuuauuuuuguuucagaaaaggucugcuauuguucaaauuucuaauguagcucauaaacacacagccaguaucauuuccccuucuacugacugauauauacaaauaaauuaaaaucuacggucaucauuaacucauguucuguuuccauggagcacaggagaguaacaaggaaggccccuuaaaagaaaggccuuuuaaaguggaggucucaguucacaaacuuuaaaaguuuacgaaguaguauuuuagaauuuuaaucaccagauauauugggggaauuuauuacuuccuauucauauggaagaggacagcagagguaaauauuuauguaacuuguauuuuaaaagcuuacucuugauuaaaauguuugaucuaucgacuucuguauccuuagaaguuugaauugcuggacauauuugacugggguuuuuacaaaggcuucuagguugaaaugcaugguucaggauuuugguuucaaauuucugucagguuggacacauauaaaugagaaaguaauguggaauauuauaaacauuucugcuuuuuuaagcucuaacuuuuuuuugcuaucucuaccaaaaugccugaaaaugucaugacucuuuagacggagaaauagaggaauggaaaccauucuggauccucugcugugacucagucagucuaaggggcagacugagcgcuauaucuggaguuuuacuuuaugaaugugcaccuuuaaccuugagucagaaaaugugguuacugucagucuuacucaguaaguggugcugcauagaacaucagggggagacuuggccuugguuuaguagaaacuugaaggagacaaacaugaaaagcagugucagaaaauggaagaccaguguuaaaaaucuuugguuuugcuuucauuucucuugguuauuucuuaggauuauugcuuuagaucauuuucccaggcauuuucauggaugaagaauuccaaagaaaguuauuauuucaacucuugaaagcuacgcuucagggugaagguagggcuugauuaucaaaggaauuucccuggcugcaguccuaacaguuuaacuuccugugauuuccccccgccccuuucccuuuauuuuuggcucagaacuucaguaaugucuggauugauggaauuccucugggaggcagauuugagggucuaaaggugcuucucaauaaagauuuugaggaaugauauuaacuuauuagaggcaacccucuauuguuuuaguauaaaggggaugagauuugggggaaucauuuuggaugucacauuaagccacuagccauuuuacucuugaugaccuuaguugccuuuaaacuguauuuuuaguggggaucauucuuucaacaguccauucuuuuuuaaacgcaauuugguuuauaauucugggggcugccucuacaugcuguacugucaagagagacaucaaauauuuucugaguaguuuucaacacagugaauuaaagcugaaaaaacaaguagcgauacuaccagcaucuuaacugaguaugugguggugguguuugaguguuugugugugugugugugugugucugucugugugaguguuuuauguugcuguaccuacuugcuuuuagguagcuacaguuuuaccagagaagagaauaacuuagauuauaucaaaguuuuuuuuuauauaaugguuuaaaaaccugcccugugucuaguacuccuuuacgaaguccgcaagacuuggggauaacaguggacaauaauguuccuuaaggacuuacagaaauaagacacacacagauauauuuaaauuccaauuaaucugauuuuuaguguggauuauugaagggcuaggaacuuagacucagaaauggaguauuuuuccuguuuaaaauguaaagagauuuaauaacauacaggagucuugcuaugauuuuugagaggagauuuacucuaauguuucagauaaucuguuuaacaguuaauaaaaauacgauuuacauuuuguuuggauuuuuuaaagucagcacauaauuucuaaaaguaagcaaauuucuugcagggauggugaaaugaaaccuuguagcauuuagcguguauugcgguuuuguuauuugcaguuuguuauuaaguguuccuaggaauaaaaggaggugcacagcaacaauguuuacugugccgauuucugguauuuuauaauuaaagagcaagugugagcugggaagggugggcuggaaagcauggauucuggcucuaaaucucagcucgaccacuuacuaccuguaaccuggggcaacacaguuauuuaauuucucuguaaaaugaggauaauacaagucccugcuucauugggcuaugggaauuaaaugagugaaugcaucuaacauugagaacaguguucagcccauaguaacugcucagugaguauuuuuaagcuauuagcaugaucaaauuuagagaggagaaauauaauggagcaguuucucaguucuuguuagaaauaaucauuacauuugaaaauccaacaaaauauuaacauucaaaacccauuuucagaagugguggugguagaauugcuauaacggaggaaaauuuaggaauggcagccugguuaaaagaaagggcggguagaccuggaguagguuauagaucaauuuaaagcagcaaaguuuucuaaaggugcuucuaguuuuacuuuaaaugaguuugcaguugcacauaucaaauaauaagguguuauuugccagaggcauuuuguugguggggggugggagaaaguuuugggguauauuguguguguuggggguacauuuccccggcugccuuuuuccacugcugcugguccucuggucaggaagccucccugucccgcacugguucuguuauuuguucuuggauagcaucaacuugaggaugagacuuuauaggcaacacauuagccucagugucuccuccugguuguagucauuucccgguuacaugggucaguuucuccaccuuacuugagugaaugccuagaaaggcuauuucagccuagagaauuuuuaggggaauggagaagcugaggguaacuccucagcaccaacacuugaacccaaucaauacuugauagauuacucccagcacacacaauacacccagaaaucuucuccccaauccacacccaauuaaguuucagccaagguuagaauucagugguucccucuguguguguccccuuagcuguugcuguucaggugcaaagguguucauuucuuugucuacccauguguaguugccugauauccaacuaaacugcaucaaaauauggaaccccuagguaggcaaaaaagauaauuagaauacaguaguccccccgccccccuuaucuguaguuucauuuucucuaguuuuaguuacuguccaucagcugugguccaaaaauauuaaauggaaaauuccagaaauaacuccuaaguucuaaauugcucgccauuugaugaaaucugcacuguccuuugccaucucauccgggacaugaauccuuacuuuguccagcagauucacacuccagacacucccugccuauaagucaccucuagguuuucagauugacuguuacuauggcagugcucagguucuagucacccuuuuuugacuuaacuauggccccaaagcacaaaaguagugaaucuggcaauucagauaugccaaaagaaagccaugaagugcauccuauaaguuacaagggcaaaguuccccacuuaagaaaaggccaggccugguggcucaugccuguaaucccagcacuuugggaggccaaggcgggcggaucaccugaggucaagagaucgagaccagccuggccaacauggugaaaccccaucucuacuaaaaauacaaaaauuagccagacguggugguggacgccuguaaucccagcuacuugggaggcugaggcaggagaauugcuugagucugagaggcggagguugcagugagccaagauugugccacugcacuccagccucagugacagagcaagccuccaucucaaaaaaaaaaaaagaaaaaaaaaagaaagaucauaugcugagguugcaguauauuauaauuguucuauguuacucuuaguuauuguugucagucucucacugugccugauuuaugaacuaacuuuaucauagguauauaugcauaggaaaaaucauagcguauauagaauuuugugcuaucugagguuucaggcaucugcuggagaucuuaaaaccuaucccucucuuagagugaguacugugauuauguuuaaauaaaugaaugcaugcuugcuuguggaaauauuuuugugugugggguauguauauguguguguguguguguugcauguggacauuuuaauguguguguauuauccuagcugaugguuuuccuuuggacauuuggguucauuuuguagaaagaaaaugcaguuuuagaaucaggaagcugauuggaugauuccaucugaauauauguguguguauaaauaaaauauauuaucaaaagccugacuugacuugggaacugggaaguagcagccucagguccuccuagguuuauuggaguuacacuuauuaguaaguagccuaauccucucugcaaagagaggaaguacaguuuuaugauagaaucacgugggaugaggaucauugaaccagagagaaacugcugcuguuugauuuccacugcaggucaucaguauuucuugaucuagaacaaugauaaaaaguguucuggucuuuaagcaaaacucagauuuaggcuuuauccuuagaaucugaucuuuaaaacuggaagcacaagcuuuccagcuuugaauucacuccauuucagagaugaagaaaccauuucucaaagaggugucucuguugagguuucacagugaacaagucaggucagcugaauccaggucuaguguuauuuccugcaaauacauuuuauuuuucauuuuugcaguaaucuuuagauuaaacccacuccuauacuguuggauuaguuaggcacauggacuggguguauguuucccagauuugaagguugguucuccaugucauaguuauuuguucugguugcuuuuuuuuuuuuuuuuuuuugagacggagucucgcucuguggcccaggcuggagugcaguggcgggaucucggcucacugcaagcuccgccucccggguucacgccauucuccugccucagccccccaaguagcugggacuacaggcgcccgccacuacgcccggcuaauuuuuuguauuuuuaguagagacgggguuucaccguuuuagccgggauggucucgaucuccugaccucgugauccgcccgccucggccuuccaaagugcugggauuacaggcgugagccaccgcgcccggcccgguugcuauuuuuucucaguuuucuuaucuguacaguggcgguaguuauuucauagaaucauacugaggacuaaauaaguuauuucuuguaaauuacuuacaugaguacccagcauaaguguuagcuauaauaauuauuauguuauuaaugauuaugucauuauuauguauuguugauaguaauauaauaauauauugcuuuuuagacacuuuaguuagcuauccagcauaugacaauaaaaagguggcucuauugaagagaaggauuccauaauuuucuugugaaauuagcgccauaaaucauugaacaucuugcuucaguuuugugugaauuauuuggauugacuaaguacucuugguacugggcugaguuaccaucugcuguguuuugcuuccauaggucaggcuuauucuccuagggaauggugagguggaaaaaaaugccaauaaccuaaccccaaaauguauccuaacugucuuguucacauuuauaggacaguuuuauugcuguagguaagacggauaacugggcacuauuccagcaucuuggcaguuuuccuuuuuucaagguacuaauauuaggauuagcauguuguuuuaaagccauugccuuucugcaccuuauaauugcuuguucuugggggaggcuuggaacauuugaauuacgguuuuucugccaaauaugggagagguugucuguuuuguuuuaauacuucgauugguuuuuaaaguugguacuacaguccauuuugccaacagacaacacaaauuagaggcagugugggcacacuguguauggggcagaugcagagaggggcagcgaauaugcaugagcgagaauguuauagcucugucaguuuuuguaugugugccucaguuuauuuuugguauugauaccaauguucggcaauacagugauuugccuccucuauuuuguuucuaaaucaaagccuuggcagauuaaaaugacuaggaaaagauuaaauuguuaaugguauaaucauauuuuucucuaaagcauugaagaauuacagugucuauacuuauuagcaugugauaacuuuagugauugaaauguuuagcuaguuuuacucaaauauuaguaggauuucuaauuuucauaggagagccuagugccacaaaaguuacugguaacuagcacucuucaguuuucaucuucauguaacuguugugagcauucaaggaaggagcugggaaaugguuuagucuucauagaugcucaacagaugugaguucucuuuucucccauguauacguuucuuaucuuuuuguagaguucaugggagcagcauuuauggauucagacuuauauuguugacaauguccuugcuaccugauagaugaucaguaaguguugcagaacgaauacauaugagagcagcagagauaggaguacauuagggcaauuagaauagauuccuuuuuuuguuuguuuuuugagacagagucuguugcccaggcuggagugagguggaucggucucacugcaacuucugccuccuggguucaagcgauucuugugccucagccuccucaguagcgggacuacaggcaugugccaccacaccuggcuaauuuuuauauuuuuaguagagauggaguuucaucacguuggccaggcuggucucgaauuccuggccucaagugauccguccaccucggccucccaaagugcugggauuacagguaugagccacagugcccggccauuagaauagauuucaaagaaaaguugacugugccaaucucugcucccuccuguauguuguuaagucuacagggccauauugccuaaagaaacggaguuccccaagaauguguuaggaauaacaaaaauucuguacuuugaccugaaaauugcgguucuugagcugguuauuuuucuagguauuguuggaaguuaugagucagaguuagguacuuauucguggauaacacaaggacuucugucagagaucuggaugcugucaguagaaucucuguuuacccucuugggcucaguuuauucaucuauucuaugaggaggaguaugccuguuuggccuuccucuuagguugcuuuugagaaugaaugaaauaauaugugaaaauucuguucauaaguguagaagauggcuagugaugaugaugaugaugaugaugaaauugaugaugcccaaaauauggagaaucuagacugaauuuauggcuuucuaacuucgaauuuucggcuuucuaacuucgaauuuucaggaaugcaugaugauagaauguuuuuauuucugauauccacugcauuguuucuauagaccuucaaaguuugacacaaauaacuaaauuauuuuguuuuguuggugaggaucacuuuuauuuuagcgguguauccuguuaaaauaaccuugcaugaggauucucaaaguuauacuaauguugcacuaguaacuaaggcaguuccaaaaagagacauuuagaaugaauaaggauaaaucaaaaguaauucauauccauugguaaggagguggcacauaccaagugucaacuguagauauuuuagaaauugaaguguuaccauggaaucaaaguauuccacuguaagguugaauaucucaggauaccuacuuuaagucgucgauuaagaugaaguuaauauucauuuuacauauccugcuugaaaccucuuaugcugugaaauuuuccugucuauuaagaauaguuuuagaaaaaugaauuagcuaauuccuuaacuuguauguaacuugaauauaaguuccuuuccuuaacuugugugaaaaucaguucuccuuugugaagagcaugagagauaccucaauaaaauaguaauuuuauauugacaucgguugcaguuucaaagucagaguuuuacacuuaugugccccuauauugucuagcuuuguaauccccacuuuaaaaggcaucccaaaauagcaacagaagaauaaauugugacuuggguguauuagauuuguaugaucuuguuuauugagcugcuuuguuauguaguuaccaaggaugauguaagcuucucauccaaguuuuccuuuacuaugcugcauuguccuuuaaaugucaugagaauacaaauauuuucaagguagcagugaggaacaaucuagaugagaugaccaaaaggaccucucauaugaaacugcagugagcaaagguuuauuggucuuuggaucucuaaauagagugacuuuagauaucuaaauuuagugaaaaccagaauucagugacuuuagauuucagaccauaagggguuguaacaccuacuccuuuucucuguaaugaagaaaaaugaccacaacaaugugguggauaucagaaauagaaacuuuucaucgucaugcauuccuggaaauuccagguuagaaaggcauaaaagagagagaaaaccugucauaguuaguauaucuaccuugguuaguguuuuucacuuaggggauugcaaauucauaugagaauugcugagagaaacaauuaauuuagaacaaauauucuccuuccauuguuacagccuguaaaauguuacuucugaguugcuacuuaucuaucaccauuucucuuucuccacuucauuguuaguguuuguaugauuagggugggcgggggucuucuggaugggguugcucacacuccacaaagccuuuucccucuucuguugaaagaagacacagcugaaaucagucucuuugccuuuucaugauauggggaugcgguggaaucaaagcaggcaggaugaaagcccaaaagcuuccuguuuccagcuguuuucuucagcgaagguuuuuuuuuuuucucccaaagaugaugcuuccuuucaagggguuuuuaaucugcuaacuguuuccucaguuuauuucacuacaguaaaauguguucccuuuaggucauaucugucucuuuuaaaacccaaccuguccuuuucagccguguuaguugcuacucaaaagaacaaacgugauuuauaaaaguccuuuuaaugagguacaaagaccaauaaaccuuugccacuagaguuucaucuuuucaguugcuuuauuuucauuuaugaaaaauuugagaugucaaaaagccauugagaacacuauugauuugaccauuuaauauuuguaaacaaagccguuaaaaauaaaauauauuguuauggccuuaagguugguugugguuuuuuuuucccuuccgaaugcaguauaaucauauguaauuuguuuaauguaaauucuuuaaaauuaaggcacuggaaacugcauaaaugcuaaaaugaauacuaagaguggcuugauuuauuaagugauaaugugcaugaaaauauggcuuuuuugcacugauguuuauugcuucacuuuuugcauugauguuguuuuggaauuuacauuucuaaauucugcauccucuagggauaaaugaaauauaaaaaugaauucuuuuaaucacucauuaaacauuaacuagaccuuucacccauuuccuagaucuuccaggguucucaguaauaaucaucaucauuauacauugauuuauaaaggaauaucagagugagucagaauuuuucuguuucuuuaucacuugucuuuccccaaauauccauacugaccuaaacguaggagaauuuaucagcaagaagguucacauugcugcccuguuauuugagcucauucuuugugauauaaugaagccaguggcauaugggggagaaccaccucauuucauuuucacuuuaaugcuaacucuaacauaugcuuuugaauugaaguggggucccaaaugccaauauauguuaaaagaauuaaacacuuugaaaaaagagaaaguuuucccuuauuuacuccuguugcccacucucuugagggugagaggcugauagcgcuuaaaaacaugagcaugccuauuuuaucuguacuguuuaauagagagcuaugaaaaaaauggcaauuaacauauucagacagaaaaucauccuggcugaaugacucauuaaauagucguauaaacaggaugugccgaaaugaacugguucagaauuuaguuccauuggucuuuucagcacacacugcucauuaucagcacuuuaagaagcagacuugugggugcuuagaggacacuuaaauuucuuuucucuuuauuuuuuucuuaaauacuucuccccuccuccacuccuuuccccugcuauuccuaauucuuugcaggcuaagauuacucgucuaaacaugaaacauucuguuggcaaucgaguuagggguaagagcuucugacuuucauccaggucggugguccuaaccccagaugacaaucaaaauguauuugaagauuuuuuuuuuuggagacaaagucucccucugucgcccaggcuggagugcaauggcacaaucuuggcucacuguagccucagccucccagguucaagcaauucuccugccucagccuccgaguagcugggauuacaggcguauaccaccaugccuggcuaauuuuuguauuuuuaguagagaugggguuucaccauguuggccaggcuggucucaaacuccugaccuugugugauccgccugccucagccucccaaagugcugggauuacaggcgugagccacugugccuggccauguuuuuaaaauaugcagacauugcugaaccucauuuuuuugggcuucccauucaguaggucuagaggcaaggccugguaguccguauuuuaauaaaagcucccaguaggauucagauagccagccgggcuuggaaacuauucacugauuuguguccccucacaguaaaaaugcucuuuccccagguacaggauauauggccaucuggccuggauaucagugguuugcagaccuggcugcaaauuagaaucacuuggggagcuuggagaauaaauacugauguuugaccccacccccaauuaaauuguugguggggggaguaguuaaaaccuccccaguugauucuaauguacagucaaguuagaguacuucuguccuacauaaacagauggagcuagguuuagcugaaaaagucuaguuuucuuuuagaauaugcuuuacccugugcuaaaacuccucuguuacugugccucccuagccacacacacagagcuuaaacguauugccucuacuaaggcuuucacauuuauugguacccuguucucaggugggaguagaaugcuaggcucucacguuguaucagauuccuguuucuuccuaccugaguaucacaucugugaugugcagauguguugguauagcaugagcaccccacaaaggcuaaguaauaaggaugaagaacaaaauugcaguuuagcaaaggaaggagcauccaucuuuugagucccuguauacuccaagaaaaauucugaguaaacaaguuucuucuuuagcaaguugugauauuaaaugggugccuuucauuacauuggcuaacauuugcauuucuuggaccuguucuggaaaagggucugagaugaacccaucguugaagaucuaaaaaacaaaaacuuucaccaugucaagggaaagaggaaagauuuccauaaguguaaucuuguauucuggaugguacaugaaaacucuacuuccuaacugcccacagggauuuaagggguauuuuaagggguacuuacaaauaaaaggaagaagauacauuacaucacauucucauuaccaaggagaaacucauccucucuaggaaagguuucucuccugucuuacgugugacuuuccaccugcuaaguccccuugaaguuacugagcaaagacacucuuacaacacuaagccauuggugcuagaaguggaaguagacggagccccugagguucaggugccagguccuuguaucucugauggcgugggaaacaaaagucagcagccauuucucuucacuagagacucagaggagguaaaaaggggggauucacgaagucaucuugauuuuuccguaucuuauggcgaagucuugugguagaccccagaacccugaugguuggucucacgcucguaaguuuacauaaggcuuucucaagaaacugacauccagagcgcuugccuuagagaagacagcugaccauggucaugacacuggcagguguuaggacuggcuggucuacucugguauggcagaaacccugggccccugaauaagggaggugauuaugcuuuaaagucuaggcuuaccauguguagggcugugggacucacugucaggguuguguaaggcgagggccaucgcuugcagaagucugagugugugagcacccccuuaaauauugcccccaggugcuguacuugcuuaaccccggacccagcccuggcagggagcaacagcaggagggaaaaccauugguaauuuaggucuucacaucuuaugcuucauuuaaugugguugauaaagagccuccuuguaaaaauaucuugguguagacucccagggaaggaaacacuugugugacugacaagcuggcagugcccauggccacgugugucacccugguggaggauaaucguccuauuauuuuuugucaguagguauaacaaguggguagugcuuuguguauuccacugugaugaauuaauuuuguguucauuguaguagcacugaucauaaugaauuaauuugguauucauguggaugucagagguuuuuuuuuccccuuccaauuucauguagcuuuaguuaauggauacuuuaaaguacaguacaucugaucugauuucuguucucucauucacuucucauaauuuuccccccgcuggauauugugaggucuucuguuuuuaaaacauuuaacuugaucuuuaaauaauuaauguuuuaauagcuuuacaugaacucaaacauuccuccugcuuuuaauuuauaaaauaaggaaaauaagguaaauaguuauaacaaauauaacugcuagguugaaugauauacuuaauaacuuguauauuuuaguuugguuuaaaaagaucugaacuaaucauuuguaauuuguagccuuauugaagacaaauauuguauccccuuaugcaaauaugaaauaaugaaaacugcaugccguauauaauaguuugcucuucuuuuaauuucuucucucuuucccucauagacaagauugauaaauguaugugcauauauuauuuaucuguucauauaaggacauguaauugacuauuagauaugguaauugcauaaauauaucuuauucaagcucauuuccuuuucuguuuauaaaauaaauguuuuuguuaaauuggaauauguacugaaauagaagugccuaauuuaggauucagaaacuagguacacaaacaaaaaucaaacaaaauucugggaaccuuugacaaacuuguucuuuaaccuauauguguuuaaaaaauuuguucaucauguuugcugauuauugaagauauuuauaauagaauaaggguuuccuucaucacuaacacaccugcucggcugauuugcucccaguggaaauaugguugaaccuuuagaaagaacgauguuuuuuugccuuacgaguaucaggaugccauuuuuggucuuucuuuaaauuuaaacuuggaaaugguauccuccauauauucucuuguggcuuuaaacuuuuuuuuuuuuuuuuuuuguaauuuuacagcucuuguucaguuugauucucagcagcagcuguauuccauuguagacugcuguguuucagcaauugauggauccuguauauauucuacuauuuagaguauauaaagaaguugggacucuugcaaguggcaaggacuauauaacuggguuacuauggcuuucauuauuuuuguuauuauugugacagauuguacaguaauaugcuaacaaagauuuauggcaucaugcagcaguaggaaauguugggauggaggagaaaacucauguuaaaacaaaugucuauaauaauaagaggaaaacaaaacuucaaaaaagcugagaauuguuucuaguauaaauauuuuuauuaacauuuguuaugguugaagaucuugagaggaacuguucaugcauuucugcaguuuagauuaugcuguaugccuauuugugcaucaucguucuuaggagauuguucuuucuucugguuuuuuuuuuuuuuaguuuuuuuguuuuacuggaacacauagguauugaauaugcaaugaacagaaaauuuauggagggcagaguuaugaguaucugaggaaaguuuaauuacuuuuauaauuuagauaagcuucauaauuuauuguaacacgcuguacuuuggcacaauuuguaacaauuauaaagcacuugaauuuagguucuuuacuuggcagcuaucaacagaguuagcuguaugaaaacuuuaagcauuuacuuuccuuccuccgccuugcauuacaggcuuacgcuguaguaguuuuguugcucccacuuucauuugccacaucucuggguuuuauguaucacaguauaguaggcuuguggcuauacacuaggaagcagacgaagagagaaccugaagauaccuccugaugcccaaaccuaggaaagggaaaaaugcagaagaacucagacgacucuuggaaaugauucuugccucaauuaaaaagaccucaccacucaccuccauguaaaggacaggucgugaauuauucaaaugauucagaaaucaacauuuaaaaaaaugaacauaaauuccuuuucauaauuaaagagcgguggaaaauggcucuuuucuuaggucuagauuauauugcuguuaaaggaauugcugccuaguauacaauuuuuugacauuguuuucuacaacaucaaucuuauuuguuguccuuuuuugucacgccuguuaaauguguauuuuucuguguugauauugaaacuaauguacaaagugugacaucuccaaaaacugauuugguuguuccuaaaaacauugguccuuaaaaguauauuuauuugcagcccaggaauuuuuagcuucacauuuuucuuuuaauaacuaaacuguagaacagaauuagcucucauaaaaccuuguacuugcugaacaacucucauaauuaaaugaauauaaugauuuuaugugacacuuugaacuucuaaaguucuuucacaucuauguauguuuaggacaagauuuaaaaguuaaauuauucuacaguuggaguagaaauaaguggccaaguauccaacuuuuguaucucaaauaccuucuuuuuuuuuuuuuuucccaaauaccuucuuauauucuccaccgacuuuuugggcuggcuaagugugacagaaaugggaacuuuaguucuggcuuuugauucucucauguuaauguagguuuuugauaagucacuuggugcaaaacacugaaacaacuuaucuauuggcuuaaaugagucaacagucugaaucaaacagguugugaauugguuaaaauaauaaaccaguaacccugugguugagcucuugaugauuaaagaaccagaccuaagaaugcauuuauagucuuuuaaaagagaguaaagacucccacuucuuugagcuguguuucuuuguguagauuucuuuuuuuuuuuuuuuaaagaaaggcuucauuaucuguuucagaucuuuauagauguugcaauaagguacuccuuucuauuaguauaggauugaaaggaucaaaguuaauaacuugaacugagaugcuuuaaaauaacaaaauaguuuauuaucucuuuccuuuucaagauuuauguucuuacaaggguacaauguucaugauugaaugugguccuacugguaaggcuuccauguaauagaagaguaauucccuugucuagcauucucuggguuguuuuaauguugcaggugaauguguucugcugugcaaauaaauguaguucucuuauucacauuccugaugacuugcauccuuaaacccuuuuggucaggguauuauuguccuuuauccugaaaaaugucugugauuguagugcccuaauacuauaaaucaauggggacugaauucagcgccugcuaaguagagugaggcaacccuuuaaaugcaaaugcaucagggcuaguuuuaauguaauuuuaauaaggcugaaaccauuuugaaguagacuuaaaucauaauacuaaucuuaaaagacucucuauuuagcugagaagucccuuuauucucacuggccauuuuuccucugugugcauccaaaccaccuuucaugugauuccacaguuuuucauuucuuuuuuuuuuuuucucaaauagaauauauguacaguuugugguuacuuuauuaguuggagaagagcuuguauugacuaaaauugcuucacuucuuuuucuuccugguuguacaugccugacuaaucuguguguguguguguguguguguguccauaauauuucaaucacauugcuguguuuuggucagagaaguaaaaaucuagcugucaaugccaacuggaguaguuauuuaagaauauaauauuuaaguaggggaguauaugcaaaguaauauaaaaaugaggaaaacauuuacaaaaucaaaugugaccucaaguccaauauuuuucaaucuucuaagucuguugguuucaccaccucacauuauuucaauguaugugaaauauaucuugcuguuuauauuuggguugaugggacaggugcaggaucuuugaccuggggaaauaaauuggauuaaggacuagcuuaacuagucuacagaaacuguagacuacaaaaacugaaggcaagaaccuacugucacaucuuuugcagagagacaaaggcauuuugguauuuggauauuuuacuugggauauguauuuuguguauuuguguaauuuuguauuaauuuacacaaacuuaaguaaacaauauauuaauaagauucaucaaguaauuuauaaauuaacuuucccacauuuuucuguguucaagaauuaucaaggagauguguaaauauugaagccuauacuauauuccauuauuugcuuuuaauguauuucauauaauucagaaaacaguaauuuaucauuuacauuacuucccuuuuccuauugagccuucugaaagaauaauguagaccagcauuuuaaaaaaaagcuuguuucaagacauguuaauagaaauuuuauuuucaguccauucugcauuaaauauuguaaaacaccccuagagagugauauuauuuguaaugauucccaaauugcuuugaccagagaacuccuuuuuucaugaaauaccucccauguggaacauucugcagaagaguuuugugaaaugcuaacucagcccaaaagguuuuuuaaauuaaggccuuucaaguugguaaugguauuuaguuucuuguuuuuuaaaauagacuuuguuuaggacaguuuucuagggucacugugccacucaugcugacuguccugucgucuugaaaaauacuacugguaacaugugaacagauauggagguccucuacccgaguauuuuaauaccaaauaauagcuauaucuucucagauauugguagcuaugucaauggagaugugaaauuggcucuaucgauggcuuuuguccauucuccaagagaggccugucuuuguggguggagguguugguggauauguguaugugucuccuucucuuacccucuuaacaguuuggucacaguggugaccagugaguauagagcagagccuugacaaugcaccugacuuugggcuuuagccagauaguaugaaugagugaagcagauguuaaggagaggugaguuuagggcaacuggggcauucgugcccccucauucauucaguuaacauuuccaagaauccugugcagggcaaauaagaucuaucucaggaccagcaauaucucauccuugguaugaagauaagaagucaggagacuugagcuguagguuugguugucuccuugccuggcaggcuugccuaauuuacagcaaguagaaaauaaucugugucuuguucaaaucuaaauaacaaugcuuuaaagguaguguagaauauuuguuaaaaagaacauauuaauuauguuuuuagaagcuucuguaaggaagaaagaaguuugaccccccaacuuuucucuuuucuagaacugcaaauuacugcuauuuuaaauagacuuuguuguuuaacuguacauccaggaaaaucuaggaaauuaaagaagcaugcauauaaaugauuguguagcagaacaugaacauuaaauucauacagugaagaaauuaaaguuagaaauacucucaaacauaagaagguucuagaaucaauccuuuaagcacagucugagacaugguauaucuuugcacuuacuuggaccuugguuucuauuccugugaugauuauuggauuugaugccaucugauguccuguuccucagauucuaugaagcugagucugagauuaacuuaggucugagauugacauaaaggggaaccggucccuagauuuccucagggcugagaaguuauugauuucucaaguauaauaggacugcacagacgcacaauuugcaccaaucggaacaaaauguuuaacaaguucugaguauagaaaacacuuugcaauuugaauuucuaugauuccaaaauucaaaaaagcuccuuuuugauuaaaugcacugcccucaaccacacaugcucauuuucucugucuacugcuuugucauucuguuuauuuaacuuuacuuggcauaccagaguuuuaacgcugagauuuuaaaguacauaugcaaaauuggaaugugucagagaaccuaggaacagauucaucaaaggagucaugaggcacauugcacaugcuuuaacaucaagguguaaacggagcccauuaaacuauuaguuaaguggugaucaggagcaagagccugauuagauuacaaaaucuucugugugugagcgcgguaugugaaaacauaacacuugauccucaccauagugccaggaagauucaauuagagaacugguaugugcccagauuuggggacauaaagggcaacuggauuuugaaggaaagaugguaaggaaacaccugcaaaaaucugcuucucugugcaacagacuggguaauugcauaugcagauggauaguuagggauauaauugcuugauuugugaacauaaaugcccuuucgauugugucaguguugaauuuugcagugacaggugccugcggauugcuguguguguauccuuugcaccccuguuuaaauauuuggccuggaguaugucuuccauucauugugaauggaaccaccgccgucccgcccccaugauggucuggggguauuguuauagcucuuaaugucucuccaacuuuuucucauaaauaauaaccuuaauuugaaaccuuaacuaaaagaaggacugcauagaggcauguggugaagggcuuacgaauuaugcacagaauucauuuuuuaaagcugcuggauguaacucauuaguuuucauuguuuucucaaaauaaggaaaacuauuaaccaacacugcagacuaauagccuggauuuuuuuucccccauaaucaacugaaguuuaauggaaaaucaucuuuugaaagacuuccuuuuuucuccuugcuuuuucuuaaccuuuccauuaauacuguuccaauaucuucucuaaucucucucaacuaaauagcauucucagucauuccuuuucuaugucaacauuucuauaccgcacugaagauguuuguaaaaauacuggugcaguccaaaugggauuuauuuuuaaauugaagaauuuguuaagcacuuacuuauguggaauggucaggucaucuccguauuccuuucucuggccuuauggagaaaguggaggaaauggugucugccuuuaaugagguugcuaacgugccugaacuacacaauaaguuauuaagucauauuuuaugugauuauucaguuucuuuuuuuuuuugcuccauucuaaaucaaacuaucuaaauuauuuuugucaaauaaagguuaauuucagcaguuguugauaauaaacacuugcauguacuauucauaucaacguguaugauacucugcuaaguauaguacaucaguaaucucauuuaaucugucaaacaguauauauuauucccauuucacagaugagcaaacugagcuauaagauuaaguauauuacuccugccauauaguuaauaaauagaaagggauuggaguucagaaauaugugccucucuagcccacguuuguugcuguuuuggcaucuaauuugcaaauauaaauaaauauaucuaaauaaauaaaaaauaucuugaaucugccuuuuuaaaggagccugccaaagagaggcaaaauaaccgcagaaaucccauuuugacuggcuuugauaugaagacuucacacaacucuuauuuuaauuucuugguauuuccuuaugcuuugcugcucuucugaggcacauuuucucaguaagauauucuuuaugcuuuuuaacuaaaaauguggggauuaaauuuuacccacaaaaagguuugaaaccguucuuucuaauucuucaugugucauuaaaaaaguauccgcauguauuuuggugcguguggagaaggagcuggcacugugugcucaaauaaugcucagaaccaccugcuuugaauguggucugauugaaucaaaugacgacugcuuuucaucaccgagccgggauugggaugugggggaaguguuuuguuuugauauuucacaugugcuuagguguucgugguuucagguuguuuaagaacagacucucauugaguguuggugaguccugugggggagauuugaaagcaacguugaggauuucuaggucuguuucaaaauuacauccucuuguguggugcauuuauuuguguucaggaugcagauugccuuguggaaaauggcaaaucauuuucccucauaaaagguuucuuuuguuuuuuuguuuguuuggucuucagcuauuuuuuuugguaguuuccccuccugaguucagauuaucaguacuuucaucauuuauaccacucgguucucuggaguucuuggugcacuguggguccacuuuucuuguuuggggugaugacuaacaucugcccugauacucgccugguacuugaggcucugaacuuuauuaucuucucuucaacugcagcucguggcacuuguaggcaacgugccucccaaagagccugaaagagauuacagcucacuuccugccaucagacaguauguggggaggucaaggggugggcagaggagaggcuuggugaaauucagacuuuugggccccaucuagaagaaucugcuucaguaucucuuggagcuacccaggaauauguauuuucaacagugcuccagaucugagggacaguuggaauuaggaaaacuguggcucuaacugaugccccaguacuucucaaagugggugcccccacauccugauaugcuggauguguuuuguaacugcagauuccugggcuccacugggagugguggcccuggaccagccucugucauguguccccaaccacacucuugggauucguauuuguaugaacuuuagagaaugaacugccacagagauucuaggugacaggaaauugugggguaaauuggaggauuacagaucaugcuucuaauaucagcacagguacacacaaucgucaaaauaggggacagguguguuuggaaagcuuguuuuguaaagaaagucuuuucucccuuugacuucucuucuuuacguggaagcuacacuucugaauuacaaagagacagagaaaaaagagaacaauaacaacaaaagguuccugaggcauaccuaagcugcaggagccaagggagugucccuuguuuuacuuggugauggcuguuugaacagccguuugcuuucuccuuccuguccucugaugugaggaugcaggauuggaaucauuagaaacccuagguuaguagcaucaggcucccugcccuguguagucucugggaggacagagcugcagcuuaaguugugcuuuugucuuggcaagcaccuuucaauuuuuauccuagcucaguugcuuuguuuggcauuuuacuggccaauacuccuuuuuuuuucccucucuucuccaucuccuaauucucaaccucuucuggggccaaaaacuuggaggaaagacuuuaaaaaaaccaauuucacuccuguuuauguaaucguuucuauauuacagaaggcuaugguauguuuuaaaauguauacaucucuuugcuuuucucccuugugacugaauuuuugaaaaaugcuugaaauacggacaccaaaacggaauguaugugugucacauuuaaacggaaaacccuguuuguuuuguauauuagacuauagccaaugaaaacccagggaguaaggauuuucaugaccacaacugaauauagaaccucauagguuucuguuauaaguauaaauauugagaauaguuuuguuuguuuaugccagugcaguuuuauagcaaauccuuucaaauggggugcaaagccauccauggauauuuguaaaggcuuugcaaaaucauacauaaaauaaauuguccauuugauuugaacaaguuuugcaauuauuuguggcuuuaacaggggcuuuugaagggcacuguauauaucuaccagcugguucuacuuuuuuuuuuuuaagaaaauggagagcuuuguauacaaucccuuggguaaaccaguaauaaacuauauaucagguagucaagucaugccauuucaaaucuguuuuacauuuuaaagggguaauaauuugugaauuucaucucauagaaauuuuuaugcuucaaaucaaguuguuaucccauccuugucuauuuuuuuuuuaucgauccccucacucaguguuuuagagaaauaaagcauacaauggaaucucuugcugggaaaaaauacuuucuuacuuauuauauuguaucuuguaauaauauauuucuaucaccauuuaaaaaacauucuuuuaguuauugaugauuauuuugucaaauuauaugaauuugguucuguuuucuuuuugugacaaagauucugaauuuucauguuuaauaaaugcacuucuucacaugacaaauguucauugagcccuuagccaggcauuggugucaacccugguucauaggugcccagaguuccuguccuucugaagcuugcauccugguggggaucaauaaacaaagauaccaaccaacaaauauaaauauauguauguauguaauugauugauugauaucugugugugaguguuuccucaauggcauuaugcauuuauuuauucauucuucaugcauuuguugugugggaaagaauguuuuccagguugaggaaagacacgagacucgacagccagggauauauuagguaacggugaggagucuggugugauugaggcacagaaggaagugccaguguaaaguaacaugagaagaaaguacacacagauccugagcaccuuaaaugcuagccuaaggaauuuuaaguuuauacccaaagcaauagggagccacugaagauuuuuguauggagaagugacaguugucaguggcucauaguagauuggagugggcaccuuugcugaaguuagggaaccuguuuucagguccuuauuaugagacgugcuaguuaaaagaggaaaggaggggaggggguuggcaaaggcugcaguuaguuacauugagugaggucaaguaaaauguuuugaagcauuucuauggagaagucccagaucuucuuaccuuucaugacuuuguuagacucacucuucagugaaauaagacuggucuugauuuuuccaugcgucuugaguuaaagcguuacccuuugcuaccugggcucuacgauuucaccuguucucuggccacaccuuggaauucacuucuuugugcucuccaauauuugauuuccuucuugucuucuuuucuuuguuguuguuuuuuguuuuugauacaagagucucacucugucacccacgcuggagugcaguggugugauguuggcucauugcaaccuucgccucccggguucaagcgauuuuccugccucagccuccugaguggcugggauuacaggugugcgccaccacgcccggcuaauuuuuguauuuuuaguagagauggaauuucaccauguuggccaggcaggucuccaacuucuggccccaagccaucugcccaccucagccucccaaagugcugggauuacaggcagcauggccaccaugcccggcuuuccuucuugccuuuucuuaagaguccugcuucaaggaaacuuccgucuccuuuucaaaaacuauuucaguaacaaucccuugguguuuauuuaccauuuguagcuuaaacuuaaaacuuuuucccuguauuaguuauuuuucaaauauacuuuuugucucuucaacuaaauuuugagcucaggauucauaauuuauuugaagagguacaaacagaaagguucugucccauauuucuaaguaguaggauuuauuuuuccuucuauugaaaugaaaauauaaauggccuuugaggcuccaggagagcccacaaaauuuuauuuaguccaaaauaccguaaaacuucaguauuauuaauacuuaaagaugguuugccucaagcaagaaauaugaagcucuggggaacacauucugugugugugacacauccagacagugugguuugccaaaugguagcugauccagagugagguucuuaaccuucaucaagucagggacugcuuugaaaauccaaugcaagcuguagacugucuucccagaaaaaugcguauagcuaaauacaugaggaaaauucugcaguccuuagucuguguauguagcauguguguagguaugauauugguaaauccaaaagaaaaaaugcuuuuuaguuaccuuuuguagccauuaacguuaccugugcuaagugcucauuaggcauuugcuggcugauucuauucaugugagggccacagggaccaggagaggugagagcaaagaugcaugcacagaucagagaaggguuaaauggggaauuaugcagcauguaacuuauacauuuccugaaaaugaugcuucuguggacuuagacaaaaaugaguggccaggagaggauugccguuggauagaugaagucuagauuuauccagaguugguauuucuuguuaaagaaccucagugagcaguaaguucauaaaccuacuggggugcugguggagggggagaucuacuguuuauuuuaggauguuuucagcugcaacaaaagaaaacccugacucaaauggacuuaaacauagggaaaugucuuacauuacguuaccuauuccaaaaucucuggugguuuccuuccuccguguacugccuucauccuaggaaugauaaggaaauuccugcuuugguucugggcaucacauccaaacagaaaaaucaucaaagaggauaaguggucgucuacugaugugucucuuuccuuggaguagggagauauuuccaagaacccaguagaggcugcaccuuugugucuuagugcucauuuugaaaccaguaucuggccuggggaaggcaaggggugugauuggcuguaggacuuggggguuucccucuggaacuggaaaugaggucaccuguuccugauccacuaggaggagugguggcuaugugaacaaauagcaauuauaccaaaaacugcugcacguucuacuaagaaggaagaagagaaaaauagauauuggaccaacagaacuaacagugucauuguaucuucugauaaacucacauucugaauaaaaaaggaagucauguuuguauuuuuaaaauuuaucuaaaucuguuguuauuuucucuaccacaacacaugggguacagucauaugcuuaaguccaugugagugagcuuuuauaauagauguucuguccacacaaggacugguuuccaaggcccgcacucaguuuacuuaugggccccacugccaugcacaauuaagaaaaagacgagauuuuagcaacuuggacugaacuauagacuuugccuaaacucauuauuuacagcagcacuuuucuucauaggugaauuguuaauagguuugauuacuuauucuugccuuggagaauuuucagguauggcuuacaaagugauaugaauugucaucucucaaaugcaucuuuaauuuaaacauauucucuauguuucuggguagaggaagaggaaaaaagucuaugaaaaugaauuuaaaaugcuucucagagucaguauuaauuuaaaccguugcgguuuucuguggggcauauuuaacccaaaagaaaagcccuuauaauuaggaaauugggauucugaauaauuaauuugaaagaggaaauauaacuuuuucuacagagaacaucuuucauccaaauuuggaguuccaguuucugcagaugucacuucucucucauaacauaagaaaauagguaagaggcaguuuggaaagagguugaaaggagaaauuauagguucuccucccagcuuuuccaauaacuugccuugaggacuuggaccaagcccugacuuucucugauguauaaaguuguaaaggaagaugaaauacugugcacgaaagugcuuugaaaaauugaaagcaguaaacugcucuaggauauuuauuguuaguguggugguucugguuauuauaaaugaagcagaacuuuaaauauuaaugguacucuuguucaucaauggggaaguuauaggggaaagguuuuccaaaaaaugcugagcuauaacugccauccaaguaagugacgcagaaugccuaacccaauuuguaucuugcuaucaccugaucacagaaagcuguuucacuguagagguaacaguuguuuucuccucuguccugaggccaaugauuauauaauauguaucaaaucacuagggugcauaucaaagugagcauaaagaggcaaauauuucccuuuacaaugaccauauaagagauuauuucugucaggggauaaggcauacaugaagucugacuguuucacugcauuuuuacuauagaaaucacugagcuugagacuuguacauuaacuccaucuggucaugugacuggcaagugaaguguuucaauguguuaagaggacugaucugcauauuucuugcugaaucuuaaucuguacuugcauauuugugaaacgaaugaguauuuaaauuauggagaaaagauguauugugccaaacuaaccuuuauagcauaccugugguuguaguuucucuagcuaacaguggacaagaugaaaacucauuauacauuuucaucauguuagguauucuucucaaagucacaggagcacugcagaaugguucguaacuuuaugaauucagcuggcauuuuggauauauggacggccccuuugaggggcuaaagacacagccauccauuucaccaagagucgccgagggugccuuauugccccuaccccgugcuggguacugagggugggauagaaggcaaaccagacacaucccuuguguuuaugcagcuuuuucuucagugggcaagacauuacuugagaauccuaaaaauauaaaauuacgucuaugacaaguccaaugaaggagaaggacaagacacuugauugaggaggacauuuauugcuagucaggggggacaaggaaagcugacccaaggaaaugaugauucagcugaguugauagaggagugaaauagucauaguaggaaaguggaguggugggaguugggaggaaaguacuguauuugaagaaccacguguucaaguucugcagcagaagggccaaugaaguacuugaguguugucaaaggcaaucaagguaacuggaagagagaacacgagggcgugaggguauguuaucaggaugaccuugauguucacaauuaagaaaguugcucuaauccugacaucaauaggaagacugaaguaucugaaggagggaguuugcaugucuguucacaaagaccucuuaagcaauacacuguacacuauuaauaugccagugguucuuggggcgcugucuccaaccugugguugucucacuacuguauacucuacuccuuccccagugugugcuaucugugugauuugugugggaucacuacaucccugguggacuacugugacuggacuaaaacaaucaagguaauccuaucccucucaucacggugauuaauucgggucauccaggccuaagcaaauccaugcaugguauuuuuuggcuuuagggauuguuccaugauggucccaaucaggacaaaguucagcaggaauuuugcucuuuuauagacugaacuugcugccauugaaagucaaugaggaagcaaguagaucuggaauccuaugaccaugagagaagccugcuuuagggugaaguugacauggaagugucagaggugagggguacaaagaaccauuuuguccuugcuaauauaguagauccacuguaucucagauugcaccugauaccuguugaaguuuucaggcuuuucucaccccuaggcccuucuccaauccugaugcuagcuguugacaacagucauuauuaaauaaauaucagaaaccucaucugaauucaaggaaucucccagcucuuucuaaacccauacuugcucauuguaacuguagcucaggccaagauggaauagacuaccuuggugaggacagguguaugaagaaucacugauuuaaagauuguucauaacguaucgcagucauuaggcauaagucuauuucuugagacauuguaagggauuauucuuggaaggacauagguccaaaauguugaauuggacgucuaggagucagggugguaaaaaugaaguauauauugauuaaguggagaguuacaugaguagagaagcaaaaugaagccgaguagaaaauuaaagguuuugggaggaguacugccugaauuuagauguuuuuaaaguacagcuuucugucuucaugggaauaucuuuucgauauacugagaaaaagaaauccagguguucuucacuuuuguaagcauccugguuuuucgugcagggagcacagacaacaggauuucuugccaaucaguuaccauugugaggccugauuuuucaucuguaaaaugaggauaauacagucuaccugaguaauggcugugaaaguuaaaugaagcaauuugaguacaaauaccucacaaugaaugauuguuuucauugauguggugguaaauguuuaauaaccucuuuuucaaagaauaaaagccguuauuggucauuuuugccaauuuccaugguguaaauacuuccaacauugugccaguuccgaguuaccaguguguuacaaaauugaaauggaguuagagaaauacacauauaaugccggagagcucaccaggaugccacugcuuucuuuccuucuuuccaaauuacauacaucccagauuuuuuuuuuuuuuuuuuuuuuuuuugagauggagucuugcucuguugcccagguuggagugcaguggcacagucuuggcucacugcagccuccgccuuccauguucaagugauucuccugccucagccucccaaguagcuaggauuacaggugccugccaccacgcccagcaauuuuuuguauuuuuaguagagacagaguuuuaccauauugccuaggcuggucucaaacuccuggccucaagugauacacccuccucagccucccgaaguguugggauuacaggcgugagccacugcacccggcccauaagccaccacgccuggccuaugccagauuuuguacaaaguaaaaucaauccuugucccccaccacugugauacuaggguuuguuugauuuuagugacaucuguauuaggguugacacagaauuaauaacugaaucaauaaagagaccgggaacagggccacgccuuacacaaggugacaugaaaaauguugagguguagcaguuuauucccuuagguuaaucaugaaccuuucuguuaggccccuuugaaauuuaguaucacucuguccuaaaucaccaguaccuugcaaguguugauucuagcccauauaacucaccuuucucaaaaauucugcuauguuuguuuuaguaaccaaauacuguauuuuauuuucguaagauuuucuucccaaucuagauuauauauuucagagagaaagcguccuauuuuauguacauuuuguauccuuuuggugucaaauaucaugcuaugaccauaacaguaaguguaauacacauaauauccuccccccgcccccccgcuuuuuuuuuuuuuuuuuuuuggaguuccuacuguguuccagguuccaugguaacauuuuccuuguuaucuguaaucaucacaacaguacuggaggguaaauacggucauucccauuuuacagaugaggauacauucaaugugagauguuaaagauguucuucagaauuucccagguagcaggcagcucaugguauucaaaagguaaugguuaagagaaagaauggauaaugaauaucuugugucuauuuucuugagacagacgagacugagcagccugagaacauuuggugcucagagggaggaaaugcuaagaggggaaaacaagucugaaagggaaagaaggauaguucaaagaccaguuuccccugcuucagaauucugacuggugccagcucuaacugcguauguuugcuuuacuuggaagauagaaucauagugccagaauucacggaagucuguuuuggaagaugcauuagucaggguaugcuaauugcuggaacaaacaauccccaaacuucaguagcuuaacacugcagaggguuauuacccuccggugucacagagcaacgugggugggcucugguccuagccuggcuucuuccauggcucaggucugcuauccccuaggaccuuggaguucacuagauauuggcaucaggcugaucaaagaggaaaaggagaguggugcauagacgauuacaugggaaauuuuaagggccaggucuggacaaggcaaguauuacuucugcucacauuuuauuggccaaauccuagucauaugaucccaugacugcaaaggaagauggggaauuucagauuccuagguggucacgggcagaaagagauggggauuggugaaaacauagccuggcuuuagccacagaggguuacaccagaggccugcaaguuuggugaccacuaguuuucagagguauuggguauuugauaaaauccagugucuuccagagguugagcaugagccacauauaaauaacuuucccagugacgggccaucagcaguccaaugaagacauugggucuucaugucuucauuggacugcugauggccugucauuggggaaguuauuuaccuucucugaggagaaaauaauaacuugcauuucagagugguuugggacacuaaaggaaaucagaagauggaacugauuuguuaacuagaaauggacauaaguauugguuacagguuuaaaaugaaacuugcaauguuugaggaagaaagggaaaauguuaaugcaaaaacaaaaaagguaaagaaauggugggaaguagauuauuggcacuuuuucuuuggaaacccauugccauauuucauguaauuaaacuucauuccuuuuaaugaaacaauucuucuaaauaauacagagauuucccaccaauauaauauuuaacauuuauaauuuucaccuuaaaguuugaacauuuuuaauuuuaaaacuguuuguugcaguuuaaaucuccuuaugccacagaacuguggacuuucucugguugcaaaauucuuuacagugucuugaauugaaaagggcuuaaguaaaaaaagcugggggaagugggggccuuuuacaaacaaauuacaacucauuugguacaauaaggauaauucauuuugucuuguuuugcauggcuguauauuguuuugaauucauucugcauuucggaagcuugcaguauuucuuuucuguagguuucuuacuuguaacugcagauuucgcgguuucuuuuguguaccacuugccucccagaauuuggcccaacaguuuugaguagcugaacaauuuaucggggacagaucagcugaaauguggcucaacuugaguaaagcagaaggaaugacauaagguuaggugacugaugugugaguuuuugaauuugauuugguuuuacauggaaagguugaagcaaugauccauguauucuaauaaaaaucaucaguacaaaucaaauaaaaucuggcuuaguggcuauuuucccacuguaucacucauggcuagccugugcuguuacagaccacauuuggcaggcacggcuuuuuccuacaacaaaucuuaaaguaacauugcaaucuuugcuguguuaaaaaggcaucuuuucuaaucaaacugucugcuaaucucaucagauaaaucauuauucucuacugacagcuccggcuuucccggaaccccuucccugcuucuuguuuucucucaagaugucugguuaucgucauucuucaggucuuugccucuaucuccuuucacacuaaugacauaucuuccauuccugaggaagaguuacagcuuuuuaccauuccacuuacugaauugguaagaccaguaccucagagcagcucaucucuuucugaccgguauuccacuaguuaucagaugggcaaaaggcaggaugcauccaaguugcagaccuacuagaaccaaaaaugccuauucccaggaauuugaugugauuaaaccuaagaaaucaucaguugaugcguucucaucucuuucagcuggacuaguaaaguaaggcagauguauuuucacuacuucaguagugaacauguuuuauagaaccugaaagugaaaguaagggaagcagcaugguuuagaggaaaccuugguccauuuuuccgucauagaccuguccugcuagcaaaguccugggcguuucuuaaacugauggcaacugcgugugcccugguggugaaaugguguugcaguaugccugggcacugcccugugaaaaaggacacacagaggggagacucacaguuuuguuuucauugcugacaugguuuaaaaauguacguugcuagcugugaaaacucagucauuauaacaccguacaccuuucuucuuucagcaaguauuccuugugaacauuagcaaguauucuauucucuguuagaauuaaacagguaaucguaauagcaugaaagggugaaaguaugucuuaugcaaaauagccucuuuuauauagggcaucuaccaauuuucuugugauuuuuguuuuuuccucuuuugaaaaaugauuuuagucugcucguguuuagguagguaacuucucuugaucccaauuuuauacuuuaaaugaucccagauauugcauuuuaaaugagaugaguauauaaaaaauaggaagcagaaagcauaauuaaaaauugugguuacauuaucgugagaccaaaugaccagucagacuccucugaccaauuucauagaaaauaaggagguaucauuugaacaaguuguaacauaugggaacuguuuuaaacaccaucauugauaucaagaaacuauuaggaaaugcaaguuuguguaucguguguguguguaugcugauuuuacacacacaggcacaugcacacacaugcacacacacauuuauaagcccaaguaagagaaaccuuugccaaugucugccaggcauuuggcugaaguggaauugugaggaacauuuucucagccuuuauaaaucacaguugaaauaugucagcacuguucaguuuauaaaaugacaagggcuguaggcugggcaugguggcucacgccuauaaucccagcauuuugggaggcugaggugggaggauugccugagcccaggagucggagaucaaccugagcaacauagugagacccugucucuacaaaaaauucacugggugugguggugugugccuguggucccagcuacucaggagggugaggugggaggauugcuugagucugggagguugagguugcagcgagcccugaucgcaccacugcacuacauauacccuagaugaagagcaggaccccaucucaaaaaaaaacaaaaacaaaaaacaaaaaacaaaaaaacaacgagggcuucaucuaaagguuaaagggacuguuucuaccuuauauugauuauaacaaguuaacucacucaauauuguaugguaugcuuaugcuguauugaauggcaaaguuccucucacagucuuuuuuggggucacccuucacucuucacuuugugagguggcuaguucauuuguauaccugcucucuaaaugugggaauauauucuuuuaaaaguggcaacucaacuuaucucccccuucuaaaauauuuuagauguuuccaauuuuuuuuuuuguacgucagcccauggaaaccacacuaaauuuuucugugucaugaguaugcuugucucugcauuugaauuuaauugggaagugccucugaaauggcaggucuccuuuuuacacagugguuuacagaauguggugggaggaggcaccaaauagccuguuaggauagcauggcuccaaaacugauucuuuaacuugccuuuauacauugcauuaauucacaaguggaucaguccaucuugucuucaucuuggccaaauuccuucaaaauuaauaguaaaauaugccuaaauauauucuuguuccugcccuccccacucccaccuaggucacagggcuacaacuaaucauugucuccauugaaaugucacuagaugaucaacgauugaagaauauuucuuaccaauucaaauagaacagaaacuucagucaaguuuagcauuuauugcccuacauuucugcggcugucaaaaccaguugaucagagacgugaagauauguaaggaaauaggaagcugugauggguuaucgcuugucuaagagugguacaagugagacuugagggcauuaucacuuuuuaccuuauacauuuuuguauuuuaauuuuuuucaauaagcacauacuuaaaaauuaguuugaauguucuuaacgaaucuuuccauagguuacugauuaguucaacagggacaaauuauaaucauacauugcagaauuugcaugccacuuugaccaggugaucaaaauuggcauagcacaugaggggcagaccaacaugccaucaaggggcucuggaagugauguccugggaaggacaccagaccacuauuguaguauuauauccacuggaauauaaucaugaggaagcaucugauccucccaaauugagaaacauuuccauaaaauaacuggccuguauucuuccaaaauucuaauaucacagaaggaaaaggcugaggaauuaugucugauucaaauggauaaaagagauagacaauucagugcagugcaugauccuggacuuugucuucuaccggagagggaggaaguucccuauuggaauauggauuauggauuggaucuaaguacccacaguauauuuucugauuuugauaauaguacuguuuuuguucuuaggaagugcacacagaaguacuaaggugcaaaaggauauaauugaugcaacuuacacaugguucagaagcaacauauuauauaauuauaacugcacuguaauugaaaacuuuuaaaauuagccugguguggcagucccagcuacuugggaggcugaauugggaggaucuccuaagccuaggagguugcggcuguggugagcuguguuugugccacuggacuccagccugugugacagaacgagacccugucucaaaaacaaacaaacaaaacaaacaaaaaccccaaaacuuaaaaaaaauaaaaauguaaaauaugggaagaaugaaaaaauuauacauuuuccuugacuucaacccuugaucuuuucuugaucaguucccaggugggguuaggauaucuguguuuuuuaugagguuccuuggaguauuuggguggucagccaccauuuggagaucaccauguagugccuagauuauaaauuauccuuuuagaaagaguugcuggaaucauuucaagauuggucagguaccaauaaauaaguaauagaaacacccucaaaauuggaauugaaagaguggaaauuuauuuuauuuaguuuggggauaugaacaugguauaauauugucgcauuuuuucuggaguuuagaugaauaagagcagccuacaguugaccggaugacuuaauauuuuuuucguaccacaaaaauuaaaugcuuuacuaaaacuuucauucucuuacaauucugaugaacaagguuguacuguaugguuaaguaucacacuguaaauuuaggcaauacauguccuauugagcccauggaguaaaauagauuuucccgugauccaagcuauuacaauuucagauguguaaaguauuucaaauucauuuuaauagacugcuucccuucaaauacauguggagguagauuuauacaacuguaaacaguuuaugcauuuuuacagauuuucauuauauguguuugauacuaauuuaccucuuuuuaauuguaggagagauaaagaauuaguaguuuaaaacaguaggaacugcguguucugcugugaucaaggaauuagauaaucuggcuuguuugcuuaaggggucuguaucuugagacuuuuauagggcaguauuaaagcucugagccuccuuauuaugccaguacccagaagauugcuuuaaugagaaguaaagggccuuuuuccaauuacaagggaauaacugcauuaaguuccuguguuaugucaaccugcuuugauuugauuacuaugaaagaaauggauuuaucugucaguguuacuuaauuaagccuucucauugauguuuugcagaguaauauagugugguuugcacauuugagccuaaguacagagaaaauuggccuaaaacuaagacaugaccccugaagauaacaugcaagauugaucauuugucauugccaggucauaggcugcaguguuaaacauagguggaaggauugccauguugaaaggguaaaaugaaaaucaguuuaugggagugaguauuuuaagcaaaagggguugugguggaaaacuggauuuuagggaggaguuuugaauauguaaaacuauugacuucaccaauauuagucaagcaucuggaauaggaaaugacaauaaaacaaacaggagaaguagauuuuguuaaaguauaaaaggaaauagaagaaaaaggagaaagcaagaggaaagaaugccguuugggagaaguagaccauugugguuaggcagagcaauuacagccuacagauauuucaauuaagccagccuccccuucucagaaccucacaaauggcacccucgggagaaaagagguaucaggaaagaaaagaagaaaagaggaaacaguuccauguuucauguuggcuaaccucucccaagaauaaauucaauaaauuauuuaccaaauaggcauuuuaaauaccaguuuguauaucugaagucauuacaauauuauggauuuugcacuauaaauauuacauguaugguuugaaaaauacacacguaauuacauguagacauuaucagagguauauauucaguuuuauuaggaaaugaagcauauucuuaaauguauuccuuaguuguuuaacacuuuguuuucuaaaguaucuaccuuuuauuucuugcacucugugauauaucuuuagaaggugauaugucuuuaggaggugccaaacaccuacuuaaaaacuuccuugcaauauuuucacauuuauuuaaguacuuugaaacuuaucuguguaauguugaaguuagaugguacuuugauuuuuuuuucaaagucuucagauaugguaacuuacuuccaauuguuauucucacgcaauucacaauguuuacucuccaagaaaacugucuuaguuaagacugauuuuuaagugcuuuuagauuggucacauuucgaaaagucaaagaagguauauauaguucacguuauacucuugcuugaguuauucauggcucuuauuuguaggauauugcuuuaaaagguaggauccccaaacgacuaacuucucuucaagaggaagaccccagcuagccagucccauacacuugaaagguugcuaaauggcacucaucucucagcauuucacauuauauauucaagcuaggguauaauucaaguuagaugaucguugacaccuccaaauauauaaauuaauauaaaggcuucaauguacguuugguucaguugcauaauguaacuguuuaccaccuugagcuucaaaaagauuucugaguuucaauauaaggaacaccacugacauauuuguaacauaacaguuacccacuucauuuuguuacuuucucauuaucugaauuuuauguuauaggaagaugcuuucccuguuuaugacagcacacaauggaauuaacuccauaucuuaagcagcagaaauguaguguucauuuuugaaaaacagguuauuuugaacuuaaggaaaauaauacuguuuuaaaggacuuauuaauggaaguuuaaguuggauguuaauuaaggcuaaaauauugcaguaauugucugcgaacacuuuuuuccuacuauacuuucucaccagcauaucuacccuuuaacuuuucuuaucauaugaaaaauacucuaagaugaucucaugcuugaccuuugaguuucagauuuauuugguuaggaaauccauuagcucugagaaagccaggguugacagcagucaucugaaaauggaaagcccaggucuguauucuuuauauuugacuuaucuuuuuuuuuuuuuuuugagacagagucuugcucagucaccgaggcuggagugcaguggcacaaucuuggaucacugcagccuccaucuucuggguucaugugauucuagugccucagccucuugaguagcugggacuacaagugugcaccaccaugcccagcuaauuuuuguguuuuuaguagagauggguuuuaccauguugcccaggcugaucucgaacucuuggccucacuuuuucuagucugauaguuuugauugcuguccacauaagcaaaguagagcuuugaguaaucaaaucauaauccaccugccucggcuucccaaagugcugggauuauaggcgugagccaucgcaccuggccugacacaucuuaacauuugugugggaagcauugacacaacccucauccuuugcuuagucagauuugggaagugcuggaagcuucuugucgaguuucuuguuagugcccagaucacucauucugaagcaccauuucuuaugucuaauagaaaacagaaacaaucaugcuuguguggacaucaucugucaauauuugaaucuccucaacucuuccuaugucuguaauaguacucaaauuugacuucaaauuacucuacuuagagcucuuauuauacugggugcuaaugaaaaugugcacauccuuaacacgcucuuugcugaugaaauauuuugaacucuaaauucaucuggcacugacggagagcauaugccaucucaguuugugugagggcucagccaaggguucuuccuggacuaggaaauuaguaggagccacagauguacgcagucugugagucuccauaaugguguagaggauauuuaauagugucuguuguugcaggaagaagguuuugaggcaguguagacuucauuguguuucagaaugauuaucuuuccuggaagaacuugacauccuaucucugaacgcauucugaauguguugaaauuuuuauuaagaaaucaauauauuuccacaagagcaggaaucuguagacuuagagcaaugcaaaauaccauuucaggcauuuuucuaauuucauaaaacucuaggguccugggugauuggcauguuguaggcucagaguauagaaaggacaacuacacagcucuacgucaaaucaaucuagguaacuuucauacuuguuuauuucaaaucaagcugaaaguuacaugguauuuagucuguguucuuagcuugggacucugaucagcauacauaacuucugacaacaugucauuuguguauuacacauagaaguacacugagauauaaagagaauacucuaaugguaaacuaagccacugaauaaaucuaaugcuuacugaauucuuacucugauaguguuauacagggucacggagaagguaggauuguuuaaccuaaacguuuuggguguuucuaagauccaggagaguauuuaaaaaucacugaccuguuuagcagaacaaggagucauaaaaauguaaggcucagauuuucuuagauauuggaggguauuauuaaauuaggcacucaugauaaauacuggugacuaugguagauauuuacuacggaucaaguacuuuccuaaguguuuaacaaauguuaguuaauucauuuacuuuaacaauaacuccuuaaucuugcaaauacuaucauccccuuaucuucuguuagaauacugacuuugggguaugucuuggguuuucacuucuguucuccuugacucaagaggccauuacauuuucaaggcugacagauguccccagggcaaaaaauguguuuucuucuucccuggguuccagccuucacuuugauuuuggcucccugauuccuuguuaucuugucugcucaguauuuuaaaauuuuucaaaaaacuguuauccaucauuuuuaguuuucugugggagaguuguccaaauauacuagccugcccuauuuccaagaauggaaaucaaacuugcuuauuucguaguucacaaaaaugaguacggagaggccagugacuugcucagaccagagaacuggucacugcagagucccugcugaaauccagcucuuuaucccaacucccagugcuguguuuucuaaaguuugucuagucugucugauaguuuugaucuugcugaccacaagagcaaaguggagcuuugaguaaucggauuacaaguguaaugaauguggaugggaaaucgcagaagguaagaauuaugucugaacaucuuuccccuaaauagaguguuuggucauaguucugcccaaacuguuguguuuuggcacugaucugucaaauacuuuauuuauuauuuuuuuuuuugagacagucucgcucugucacccaggcuggaguacaguggcucgaucuuggcucgcggcaaccuccaccuccuggguucaagcaguucuccugccucagccuccugaguagcugggauuacaggcguccaccaccaggcccagcuaauuuuuguauguucaguagagauggggucucaccauuuuggccaggcuggcuucaaacuccugaccucagcugaucugcccgccucggcaucucaaagugcugggauuacaggcaugagccauugcacccgaccaaugugucagacacuguagaggggacucaugcagaaugaaucaaauaagaugaaaauuuguggauuuucagauugccuccuaaagcagccagcaaucccauggaagaguuacuaaaucuaucuugguuuaggguaaaauaagaaauuagaaaaaucuugaacugagcccauuucagucuuuuggaacaggaauuucuaucaucuacuugcuuucuuccuuucuuuuugcccgggguaauaucuuucucuuuauucucccaucuuggaaaaaggguggcaauagaacaaggggggggggggcgagaacuaaauagauucagcagcuucaucccaggcaguuuuucauuugucacuauguugccuuaauggauuucacacaucuauuuccuguauauuguuuagucucaccucuagauguaaacacuucucauaccacaauauuaucuuacuuuucacuuucugcuguuuuaacucauuucaauaaagaacuaaugagcccaccauuguacaguaccacacaagauguuauuugugucaaguauguuucuuuccuauaauaaacguacaucacaguuggguaugauauaaguauauagcucuauagcuguauauauauucacaugguuauuuggauaauaaauucuguguacuugcugaacuaucguauugagccagccauacaaguuuuaucauugugccuacuguugauacuaugggcugcuaugggauauucuguccucuguguugggagcucacagauauuuucugucuggcuuaauaccaggauuagguaugcuucuccuggacacuuuguguguuuuuaucugaugguuauugucaaucuuguuucccucucugcuuugucuacuuaauagcuucuaaaguuuugacccacuucuagcaaauagccaguccuucacugugugcauuuugauaaacucaucauaccucuggccuuacuguucugcuacuuuuauuuugcagucacuuggguccuucaaauauugauuucguauauuuuguguuguauguguuucuguaaucuuuuguggacacaagaguuggguauaaacucccaaauaaauauauucacucugcguggggagaagugacaggagggaacguucagcugguuagacagagaugugacauucuuacuggggagucuuuacagcagugggcagagcuucagccuccuuuuguguccaagcucugccauuuccugaucccuugggcaaguuuucuaacccaucugagccucaguucagauauauaaaaccagaauacuaguaaggcauuugagaguuuagcgcagugucugacauacauucaagcucaccacaugugagcuguuacucuuucuuugagaggugaggaacaguuuaggcagaaggaauagcaguuacaaaaacauggugguauaaaagaccgugcaguguccugguacccuagcaggaguaaggaauggccagguguaggcccugugcaagguuuacaugaaaaugagucuggacaagaacuucuuggaugcucaugugauggagguguauagugaaugcugcugaaaccagcaacccagacagcaauuuuaagauauggagugagagaggcugcuguuggugguguggggcaugcauuugucuuguguuacaguggaguaguccugugguucucaaacuccugugugcauaaaaguuaccuggggaccuguuaaaaacaguuuucucagccccacccccagaguuucagacugaguagauaugagacggacccuaauaagccaauuuaaaaaugggcauacaggugauucagguggcggauacacuuugaaaugcacuugguggugcacuggaauaguuauugaggaaaugcuaacuaaggggcaggccugacaaaguucaaggagagggaagauggaagaaaaugacuucaaaguaacauguuuacauucauuaugaauuaccauugcgcaugcuauggaaacacuaguuuauagugucuucuauggauauggauaaaugagcaccgguccuauagauuuuuuucaaagguaaaauauaauuagaauucauaugauuauucuauuuauuagguuugggagagcuagugauuuguccucauccuugagauccagcaggagaccaagggaaggggaagccuguucaacagagagcaaucaaagaaagaaaggugcagcagcgugaggucaggaagugggaaagauggaaaugggaaaggguggaaaaagagcagucagauccgauuggucaggaaucuauuugugaaggaacccagccaguauuuaaccugcuuugaaaaagcuagacuuccagcauuuuuaauuaguggauugcucgcuuuugaaauugcccaguugggaauacucaaguguugauguguuuuaucugccugcuaauuagcaggcugcuugguugaccauuacuuuuccuuuuuucuguggacagaagauguauaugaaggucucuugguacauuccagcucaagucuagcuuaaagugcauaagaaaaacuguguauuuaauaagaguucuuacuaaauuauaaaucaaauuuuaauacaucuuuucuccaacuugauuccuuuugcucuagcacagggcuucucaaucucaacacaauuuuuauuuggggucagaacaccaaaaauauauauauauauuuuuagggacagggucucacucaguugccuagguuggagugcaguggcacaaucguaguucacuguaaccuugaacuccugggcucaagggaucuuccugccucggccccuccaauuagcuaggacuacaggcaaguuccaccacacuuggcuaauuuuaaaaauuuuuguagcgacagaaucuugccguguuucccaggcuggucucaaacuccuggccucaagcaauccuucugcuucagccucccaacgugcugguaucacaggugugagcugcugugcccugcacaggguauuucuuacuguggagagcuguuuugugcaauuaugagauauuuaauagcaacucuuggccucugugugaucaaugccacuagcaacacccaaauugugacaaccaaaacugucuccuggguggcuuugccaaauguccuuugggaugcaaaagccccacugaccuggcaguagcguccucuuuccuccaagucucugccuacuuuucauguuuaaaauccucuuuuaaaauugaaaagauaaaaugaguccaaacaauuugaaaucuuaugguacuuauagggauucaaaucuguuccuccauuacuuuuuggccaaauucaagaggagaaaucucucaaaugaauccaagcuggcuguuauaggugaaaagaaagucaagaugcgccagacuuuuaaaagcuugcagugguugagagauuuuguuauuuauacacuuuuuauuuuggcugaaaauauuugguuuuuguuuaagaauuaagagaaccguguaggcuacaaaauuuauuuaugugcgaaucccagaggguuguaaguagcuucuuugugugcuucaguucaacauauacaggauaggccagcauguuggauuguuaaacagcagaucuggggaagguuuuacaccuuuucucuaggcuuggugcagucccgagagcuuucuugacaugccuugaagcucacagugcacugauuuaaacuguccauaggggacaucuguuugcaguuuguguuaucugcugaagcaccaacuaaaaggaagugaaauaauauuugucauuaaaaaaaaaaagagaaguuaauuuaaugguaauaacuuaguuguuguugcuuuucuaucucuuaagauauucugaaacaccauguacucuacuguaucccaaaauaaauaaauuaauuauacuaugauuacuucugcugauaauaaaauagcaguaauaauaaaaggaaugacaguagagcauuaagagaauaaacaguaucacugaaaugugaggaaacacaauaaaugggauugugucuccugaaccuuaguuucacacuuccuccuccacuucugucagaggguguuugugauggccgucuguuaucagccgugaucaaaauaauauaacagugaaacuuuuuauacuuaugaaggcccuuucaucaaaaaucucacagccauuucuaaauauagagcaacugaucuuuaaaacacuuuuauguuuuaagcaauuaauaugguaacuuagcuguuagacuuuccauccugcguauuugccauuuggagcguggauggaacauuucguaaucuacucagcauuaaaacuuugcugguauugaguuuagaauuccaacuuuucgaugguucauguaggucuuuucacugucaucuaucaaaacaaaacauugcuuuauaauggaauaaccacauucauuuccacauaucaaaacccagauuaaggauuauagaccaaaugguaugucuaguuuaaaaaaaaaaggaaagacagagacaguauugucuuaaccuaaaaaaaaguuuuguuucaguccuaauaucccuguaaugugcugguggaaauagacuacugaauacuuucucagucucauuuucuguugcaugucuggugucuucugugauaagccugggcuauggaacaaaaaggauccaagagcauuauggcgaggaugcuaaagguguuaguguggauauuuaccuuaauuuaacuuuuuuugcauuaaaguuauguuagugcauuuuuaaacuuauuuuauccaaaagauuguaauaaaacuuuaaguacaguuucacaucuauaaagacugaggcuaucaaacacugugaaggauggaaguaauuuuuauguuuauaccucugguuccugaggguccaguucauuucuacugugaauuuaaaugaguuaauuuaaguagaugggucagaagccacuaucaucaugguagcccggugccugguucuuaauuaaaggcaacaggagauuaauuugaaacauuaauuugaaagugcauauacaaaaagaaaaaauuacugcaagaaagccuaaagaacuuuucucuugucccuagauguagaagacagaaguagcucaggguccugggggaauggaggacauccaagcccguccaggguaaguauaucuaaucuuuucucccacaaccagacaucccacauauguaaauugacaaacagaagguguguuucucucucucucucucucucucucucacacacacacacacacacacacacacacagaggcaugggcaugcacacgcacacaaacacacacgcauauaugugcauacuaaguuuaaugaggaucagcuugacuuuggaauuuuuuucccccauucucuuauuggaugcuguuauucaauuugacaccuguuccacuucugcuaaccagaagaaaauuccuucguuacauguuuggucuuucuuuugucaguuauugauccauauuacauaaugcuguuuguuguagauggaaaaacuuaaaaaaauuccuaauaucccuauaagguauuggugugaauagacuacugaauaaucccaaagauacacuaugaaguucuauccuaccaguauaaucuacguacugaaucugaguugauuucgcuauguagacauguuaucauuccaccaguagggacuuugaucacuagauggaucauucauuuauuugcccucaacuuuuugcuauucuucuccacaguuuuccuacaugcauugguuguuucuuggggaagacccaaggaauauaauguaauaggaauguaauaggaagaccauggaauaagaguugggugggugguuaagcaauacguguuucuuguauguauaugaucuugggcaugucauuucaccucuuggguccucauuuucuuauuuugcaaaaugaggaaguagauccagaggaucaucuguguuucuuccaguuuaaauauucaugauuuuguaugaaauuucuuuaacugaaucauugcuaggcccucuaaaauccaugucaguuuuuaugauguacauacaaugccccagauuaaaaguacacuucguguacaugguaaaaccagcaugucuuccuuucccaaccagcuauauauauauagaugaagcauucugcagggaggguaacauuuuacuguaaguguucacacaaauuuggguugggggaagguuccauuuuggcauaagaggcagggaagguaaucaagcugucaaaaugagggcauuucagcaagucagagcuagacauuuccaccuguccuuggcauugugauccuuagucuaguguucaggguacagcaggaucucuaagcuuaccaguaacuuugugagcccuuacaccagcugucgagcuugacauucuaaugcuuuauauggauggguugaggaaaucuuuccuccuccucauguuacagucugcacuugcagaaauaaauccauuccccuugacagcaaguggagaucauagaacuccccucaauuguuuaguucauccagauuuucacaauuucuuaugauuuauccauucaguacacaugguacuuuuaauuguguuucagaaaacaaggucuguuuagaaucaucuuaauuuaggauuaaaacuaacuagcuuuugguuuuuguuagcuguccugccauuuuucucaaggaauauauuggugaauaauuucaaaccaauuuuguguaauuuauauuuucuaaauccagaaguuugcaugagacaaaucauuuguggcagauuuauacccaggcguacuuucaaggucucucuuuuuucaucuuaacauggggauagugucuaccuuacagcacugugcugaggauuaaauuagauaauauauauuaagcuuuuaguacacuaucuaggaugaggacacuuaauaagugauaauuagcauuaugcaaugccugguauagagugagugaguguacuaugauggguauuuaaaauguagccucuuuuuauagauggacauguuggcagaauuagauuacaguaucaggcaaguuaauuguuauacacgaggaaaggugauugagaacgggguaguuuuccuuaagguugaggggaugugucuuuuccuuguucaugcagcagcccucucuuuugugugggcagauuuugcccuuuggcucacaugcaaccgauaccucugaguaaauuugacuuagacuuucaugggcaguuccaccagcugagcagaaugacuuuuuccccccuuuuuggucacuuuaugcacuuuaguagacugaaaguugaaccauguaguauagaugauuuuaacucuuuccuauugcguuaucaaauuuccccauuaaaauuaaguaacuggacagcuuaagaacauuguuuuaauuuuaaauuccccuuaaaacaauaagcugauuguaauaaugaaauauuucugucaaaauuugucugccuuacaacugguuguuuuuugugacaugcuuuguccaacuccagaaaugcuaauuuaugcuaauguuuugauguucauauccuaguuaaacccuaauauucuuaacuuucuuauguguuaauuacuuaugugacaaucuaguucucuuacaaccacaauaccacaauaguaacuauaauaaaacauugaaacuucaguauccuaacaccaaauguuauuguuugaauggcucuaucuuggucuuugaaaagcaauucauugcaugcuaugccuaauuuucccuuguggcacaauuuugcuuuaauguggccuuauuaaaauaauaauuuuuaacauaagcaauauacuuuguaugugucuggugucuuacauacacuauuuuauuuaaucaugucaacaacuccaugcaguugauaccauuauuauuauuccuaagauuucucagcuauuaugaggaaaauuuggacuucguagacucuagagcuuucuuuuagccacuauaccugugaaagugcagauuccuucuagugaaguuccagggagggaauaguggacuccaauuucuuuggaggggagaaguuuugguaguggagcuauguuuguuuaugugcuguuuauuaauauaaaauaauaacuuacacugucauuuuauuuacagaacuauggagaugggacucccuaugaccacaugaccagcagggaccuugggucacaugacaaucucucuccaccuuuugucaauuccagaauacaaaguaagacccauuuuaaauuaacuuacacuuuuugaaugcucaaguuuuacuauagaagguaaaaccauguccuagacagagguucugcuuuuagaaacuuggauauuuagucaguucacuuguaauaaucuuaaauugcagagaggauuggcagucuguguuugguaauagugcauuaaggauuaaguuuuacaagcauauggaaugaaaugcuuuuagugauacugaaucuauguggaaauuuuguuuuccuuagaccuaaagcacggaccacaguuucaauguuguaucaguaguuuccuaaguuaagguagaugaagucaaaguggugaauauuuagaauaaaaauaucacugggcuuguugguuggcagugauauauagucaguguuaacugugauuucugcuaaagggguuaugaaaauaaaugguguuaaugggcuuagugugcuuaaaucagaguagugcauucaaguugaauuguaaaaucugauuguauauuuaucaaggcaugaacuuuagugcuaauggccuaggcagaccccauccugcuuuauuaaagcaaguuaccuguuaguuugaggcugucugugaaucuccggcaugccauucauccuggcauccucagcauguuuuucugcuuuuggcuacccuguagggauguuuguuuaacagcaguaacuugagcaaugaaaagaugauuccuaauggcuuaaaaggucccaauagcuggcuacuuuaguuuugauugaaaaaaaaaaagaucuuuguucuaguaaacaugaguucuuaacaauauuaguaaaucucucaaccuggccaaauucucuugagaaucugucaauaagugaaguuaaauuucuugguacaaucuguuggacaacacuccaaggaaacacacacagcgaugauuauauuuuucugagaccauaacugcaaaugcuucuaaagaaugucaugauuuuaagcuuuggaagcuauaccaguuacuucagguccuugaaucucaggcauucuuugaaaaaucaccaucaaauccaucuaaauggauuucagauauuuaacacaaaauagucaaagcagauaaauacuagcaacuuauuuuuaauggguaacaucauauguucgugccuuugaguaucuuaccaacuuugagaaccacaaaguugguuuuggucauagaauguucuuauuuuugugcuauuuuugccuucaaaguaguaaauuucauauuuacguuuuaacauuguaacucaagcaggaaucccaguucuuuaucaguuguugauagaaaggugcauuguuucuuguucucaggauauguagauacaggugaccagauauauuuaucaacuuagauuuuaaaaggcagcuuuugacucuucagugucaauaguuaugauuuuauuucuaacacccuugcuucucuauucaucuccacacaaccacuuagaauaaaagauucacuugaaaauguagucuugagaaguagcaccuaaauaauauacuaacuuccuuggauccuaaaaugauccuccaaugagcuacaguaagaaaaauagaauaaauaaauacucauagggagacgcuuauguuaucuaugugaaaaaaguuuuaacucuaaagaacaacuugauaaauuaauauuacagaauacaccaagcaguacaaacagauuaaaugauuguucuguucauguuuccucaugggcaacugcuuuacaaaucaaauuaguuuuucaacccaaauaguauuuaaaauauaaguggccugacagucuagagcggagagagcugauucuuuucacuuaguuguuguuuaggcugcaaauccaugucagcuuugcucuuuuauccugucugcccuccuucccauuaaacucuuaaauauggagaccaagacagucuccugcauugugauaggaaaugcuacuauguccacgaggcccccacccacuguucccagugaaaggacuucucuguuagauaagcugucugguuugaaacauggcucuuuauuguuuacaaacugcuacauuuuccaccucgagcagauuuuugcacagaaaagaauugugcuugggcuaaaugguuuaucugacauuaacggcgcagugucagacuggggucagggaagucacccucagagcgagaggguauugcgcgguaugcaaaaaaaauggaaaagggagaaaaagacauugaaacaaguaugaaauaccuuacauuuuuaguuuagagaagaauaauuuuuuuaagagaauugacucuuaugcugcauuaaaaacuucccaucgcuauaauuucucacacacccgaugccuucuugauuggcuugcguaucugaaggcuagauucggggaacaaagauucucauugauuuugcccaagcugcuguuuauuuaaaaugaaaccacuuuucagaugagccauauuugguguuauguuacagcuuuacaaagaaaagauagaucauuuucaagaaauuaacgacaauuaauuuacaaaugauaauaaaaacaaaguaagaucuauugguguaggggacaguuugaacucauagcauauaugcuguguucuaaaccgcacuuuguguccagacccagagcccauguugugaccuuuguggauauuuuccuucuaccaaaagaagguaguagacuuuagcauaaguguuugacaacacuccagucuccacuuucagaauguuuaacugguuuuuguuaaaacuacaaaguauuuguuucugucucaaaggcuuaauucugcugugaugucgcaucaggguaaaagcuauagcaucagaaauaaaucagccacuuuauuggagcagauucucuauugucaaaucaaucaagccugugacugaauuaggcgucugcuacagaaauaagugacacuaauuuuauaggaaagaguuauuaacugcagaugaccugauuuuuuuuuuuccuuuuuuuggugaacuguucauuuaguaagguuuuauuuuauugcaaagaaagaaaaaaguacuggacuacucuuuccuuuugagaguggauuaucauuaauuauguauuuuguucuuuauggcaguauacaauuuuagggaaaugauaacaggcauugcuaguauauuuguuuauaaccucuaugguaaugaaacccauuauuacaacucugaacuucuugauuucacaugaaugguuuugcauuuuacagauuuuuaaacauaauacuucuauuuggcacugaaauuccaaaacuuaguucauuugugucucuauuucacauuuaugcaaagugggauauaaauuauaagaguaauaaaguguuuuagccuaggcaacauggugaaaccucaucucuaccaaaaauacaaaaacuuagccaggcgugguggcacacuucuguggucccaacuacuugggaggccaaggagggaggaucucuugagcucagggggcggagguugcagugggcugacaucaugccauugcaccccaaccugggcaauaagugagaucccaucucaaaaaaaaguaauaaaauguuuguuuuaauuuauucuuuuagaaauaaucuuguguguguggaaaaaugcacuauuugauaguuugugaaucccuaaaguaaauaaaacacccaugugugguuauacaugcaugcacacacauguacacccauacacacaauguauguaucaugcuagaagacuuaaugacguuucuugguuuauaagauuguucuguauuccugucugugguuauaguugucauacaggguuuuagugguugauacuuguaaguguuuuaaagaagaaccuaacuaacagaaacaaaaagcaagcuccuaaauuuuuuuuaaauaggugugaauagccuuuguguuuguuuugauguuggcaggguugagagaugucaguacugacugccuacauugaccaauucauauacuuuuaccugacauuuacuaagaacucacucguugcuuucauuguguagauacaugccagguugcauuuugccuuaguugaaauuccaugcauuguuuuauaucuggagaaaauaaaucauuucuuccuugugacugccuaucauuauuaaugauuauaauguacacuggaccuauuggagacuucuucauugcaguuuuuaaacaauuugaugaaaccuuccuaggugguccauuggauaccuuucagaguaugcuaaugguagaaagggucgaugagucuaauuccucuguuuuuuuaagaggguuauuuauaugcuauggaauaguuugagaauccuggcaagaaguguauggaaagaauauggacauuaaaaaaaacuuuuuuuuccuuugucaagcacuaaacuuuugcagguaauuguccagauauuuuuacaaugguagacaauauauuuucuagcuaaaacuguuugcuccaaggaaggagcuaagcauuccauuuuccuuuuauuauuccagagcaucgauugaaagcuagauugaggauaagugagcaaguugccccauaaaauuacauacaugcauuugugacugaagggugugaaaagcgauacuuuuguacauuuggcuacagcuuaguucagcaucggggcuaugcuuucacauggcccauuuugaaugguucaguuuccuuacugugguauuugguucuaguccuacucaugguacucucccagagcauuaaauaauuuaccgccauaggguagcuggguucuaaccuagcucagcagaacauuuuucugcuggauuagauugagguuucaggcagaacugaagaaagcugcuggcuuacaggaugaccuuugaaucucaucuggguuagcgguugauauuuugauuugguuacuguggucauauugugacagcugcuagcucauuauaauucgguuccaccgcuccguuugccuagcaggaauauuuagguuuguauuacuucagaguguuuauggcuacccugaguuuagcccagcauaaaggugaaguguugugaguguuuucaaaucccaguggcagaagcaggugccacagucuucuuguaaaacagcaaaugugaguacaugcuaauacagggaguuuuacucuucauuguaaaacagagaauaaccaaugaaucagcuuuuacuaggaaaaguguuuuuggaagccuuaauguacaaaggaaaagcaugacuacaaagaaacauaauuuuucaaagcacgaaugagauguuaccugacuucaugguuagauauuuuguucuuugcagaagugugaguauuagaaaauaguaaaaccuguacaauaauggcaaucauuugauguuugaaaguuccaaaggucaaauaaucuuuaguaacuucauaagaacggaacugugaauauagaugucagcucuagaaauuuuaguucacuuuuuaaaugcagcgaaauuagguagugauacaagcaggccccuuugcuaguucauuaguuagggacaucuuggugugcuucuuuuuuuuuuuuuuuuuuccaauaacaccuuucagcuugauguuaucucgacaucaacucuuaaguguuggacuuauaauguggcacaaguaauuucugagaaaggaaauuauuaauuguggucuuauuugauuuuacuuugggaauuuucauuucuuuaauguuaaauuuaaaaugcccuccugaaauauuaacaaguaugacucguuugagccucaucgcugguguuuuuagcaaucuugauuguugagcuaaggcugguagucaggagucaggagaacucaguuuuucuuucuucuacuucuuccuuucuucuucuacuucuccuucuucuuuuucuuuucuuuuuuuuuuuuuuuuuuuuuuuugagacagagucucucucuguugcccagacuggaguucaguaggaugaucucugaagccucaacuuccugggcucaggugagccucccaccuuagccugcugagcagcugggacgacagguguacaccaccacaucuggcuaauuuuuauauuuuuaguagagaugggguuuuaccauguuagccaggcuggucuugaacuccugaccugaagugaucugccugcuucagucucccaaagcccugggauuacaggcgugagccaccacgcccagccaagaauugaguuuucuauucuguuuugcuacagcugccuguggguccucuggucaggucguuuucacaucuuuagguugagggaggaacagcucuuuaggugaucucugagauaauuuuauuaucuaaugguccauugaucuuucugauaugucauuuuauccuuauacuauauuuucucuuuggagauguuuuauuguucuuucuaauccauucaucucuauuuuaugaauaccuucaagugacuuugccagugauguguuuuccaaauguaauucuuuaaagccuaacuaaaauagauauuccuuuuauaucucagcugauuccagaucuauagcuaaggaauuggauugguuggggauaaauaaaauaauaacucauuaaguugagucaccaggagaaaaguucugugcauagaucaguauuuagcauagagguuguaggaccucaauaaaugacugucgagugaaucagggaauuagauagauaggguuuaaacguugaaugaaaagcccauacauuaaaguuaggccuauaccuuacuguaccaagaagaagacccuaaaccagagccagucauauagaaauucacauuuuguucuauaggacuauauccuugacugggcaaaauauucugccaagauaggaaacgggccauauuacaguguggccuguuucaguuuucaguacaccacagauuauuuuauauauaagcggaaauaaguaaaaucaauaauauuuugggucgggcauagugccucaugccuguaauccuagcacuuugggaggccaagguggaaggauugcucgagcccaaguguuugagaccagccugggcaacauagcgagauccuguuucuacagauaauaaaaaaauuagcugggugugguuuuaugcacuaguggucccagacauucaggaggcugagguggaaggacuacuggaggcugggagguugaggucacuacagugagcugugauugugccacugcacuugcacuccagccugggugacagagagagaccccauugcuaauaauaauaauacuuauuacuauauuuauauuuuuguaauuauauaauaauaauaauuacuauuauuauuauaaauaauuugaaaggccauugaaaaaaguugcguuucugguauugagcuaagauaacugauuuccuuuuguccagucagaggacauuuccauucuucucucauuggucuuguuuccuuuccggccuacucugugauauagcacagcuaaugcugugguccucaaacacuuuuagaguccaacuagguuuacuaauccaagucguauaacauuuagaagaauuucuaaacagaaaaauguuacuugaaaacuauggccaacagagauguauagaccuucuaaauaccaggggaagauuucucacauagaaaguuauugacccaaagagaagauaaaucauuuaagcuucacauaaaaguaaaaagcaauuuguaucagguaggaaugcuuuugcuucgaaguaauggaaaaugugacuaaugauggcuuaagaauaauuuuucucauucuagaaaucuggugguaggucccugcuggaagugguuugcagcucagugaugucagggcugguggcucugugauucuuuuguccuuccccucauugucuaaagaugggggucacagcuucuugugucaaguucagguuugaugcagaaagaaggggaagggugaguugaguggugucuccccaccacacugcuuccccauaacccaggccaucuccagcugcagagguuggggcagggcugggaaugcagccugggaaauagacaggagagaagcaaguuugggacucauacugggcuuacuaacuugcaguguucaauucacacuuuaauuuuuuaaagagaaaaauauauaauuuucuauuuaauaauuuugaaaauuaagaacaaggccuuaacuuucauguaauaaaaauauauaaaaagaugucucagcucuaauuucuggucagcaaauuagagaggaagauggaguaggaaaaaagauacuguaaagaggaagauggagaaaguacaggcaugagcgucuugcaugggaaggagcgugaggucugcuguuugcaucucaccuucaaggccugugucuucauuguccuaagcccuugagcaaggcagcaaccagccaaagccagcucuccuuaccuuugcuuuccccaggaccuucucuuuuaggucucuggcuugacuuucugccagccuguccagggcacccuugucacgcaacaggccuguagcuccagccaccaaccacucuuuucuccaguccccuggguggucuuuggcagagccaaaggccaggcuuuacucccagugucuccugcugcacccauccagagcaggccuggcacccuggagcacgucccugggacaugcugcuacaagugacagacaaagaucuuucuccuggaccauugcccaaacaguuuccagggaacuuaccuccagcaaccugccaugucaccaugaaacagucagacaagaaugccuacugccuaggggagaaaacccucuauuuucuuuuaauauguacacaauugcaguuguugauuuuuaauguggaggauuaggugcagccaaaagacauuuaguuuuagacaacaugccaagacuggaugaaauggugagagcuggauccaacuuuuguccagaaguuucccaacccuauugaacagucucaugucaugaaucagacccauuggaacagaggcagggggaaggaccaucuaucauuaaagguaaccaggaugugaaauaaacagugcugcuuuuauuuaguagaaaaaguuuuucucuagguuuuuacauuuuuauuuauuuucauguuuuuauuuacuuacuuucuuuuuagacacagaaucucacucugucacccaggcuggaguacagugacaugauuauagcucacugcaucuucaaacaccuaggcucaagugauccucccgcuuuagccucccaaaguucugggauuacaggugugagccacugugcccagccaauucucuaagucuuuccuugggaagaugguuucucugaauuuugcauaagcccuauacuuaaaaugugucugugacaguauuaaccaguacccuacuucuggacuggaucuuggguggcgggguugcgauuaaacacuuuguguuucucaaaccucucauuacuccauggcuucaggagaauaacaucaguauaguuagggaauccugaaccucacauccuugaaacuucuguguccaccuuaagugcuguauucauccucaauaaaaauaagacugcuuucuuuguucacauuauauauucuuagaaccaaagaagcaaaggagcuguuuugagcagugcacaucuuacagggugucaugggacaguggauucuaggucuucaggggucacuucagcauaauucuuggcuuuucacuuccuagugaugggugaugggacauugggcaaauuuccucagagcccccguuuucugguuucccaggugaggacagggaugccagccuggcccaccccucccaggcucacugagaaagauguggugaugugauacacuuuguaaucacugugcucugcuguguaacuguuagggcauugcaaggcuaaccacuggucaucugucauuuucgucuggguaaugaauggaaaaaucuauagacuuugggguuuugggugguagcaauuuuaaaauaccuauaccuucuaaagagauuggaacagaaggcaggagcagguggagguaguauagaauguucacuucuguaaacaucaagaccaaaaugaaaaggcuucuuuuuuagccaguccacaaaacaguaauccuauaaaauaaguaccucuuuggggacagcuguguuggauucagaugcucccuuuugugaaauauuugccuacagccauguuucucuccauuuuaaauguucucaaguuucaucuuuaaacacaaggccaagaacacccuggugugguguuugaguggugagacuagggagaacccacugacaaaugcagauuucuuugccuguguuguaggucaucugaauaauggagucacuacaagguaccaugguuuucaucaaggagauaguuuuacaaauaccuuccauauucuugggaauguuuuggagacaguccuauuccacuucauuucuuucuucuccacagaugcuugguauagaauguugccucuguauaugggauuauucucucauucccuuuacuccacagacgcuugguauagaauguugccucuguauuggauuauucucucauuccccuuacucuuaagaguuuuugaauccgaaggaaacauguuuuguuuugaguaaaaggagguguucaguggaucucauuuucuuuucuuuugcggaauaugaggccuaggaacuaacaauugcaaaauauauggagcauagguugagauuaaauuaaauuuauuucuaagugguuaauagacacagcucgaacauuuuucaucuucuugaugauugcuuauuaaucacuccuuaauuccuugacacauuuauuaauaggaaaaauugcaaggaagcaucauuugaaaguaguauaaaauacagcugguuauauuguuuauguuuaagauaaaacauuuaaagcuuucacguagguugaaaaugccacaagagaacuaacaugggggaagugguggaugguggaccuagcagagcacuguggucagcugggcauugcugugagcaccagcucaccacucuccaguucugugaccuugggcaaguuucuuuagcacugugaugaaauuucucaucuaaguaguugcccuguguuuaaaagaaauaacguaaagccaccuggcccuaaaauucaguuaaugcaaauuauuauuacaccuacuauuauguuaucuagucuguuuuucuguucauuggguccgaucagcuuggcaaaagugauaugcuaacuugagcaucauguagugaauucuggcagaacguggaagugauuaauuaaaugccacccccucgugggccauauuaaagcugaaugaaaauagaaaguguguaauaucugauaacauuugguggagaagggggagacagaaaaauugaaggauaagagaaaaggagacacauauaaagcuaauuuuagagcgauagaucacaaaguaagauuuucuagcuuuguauuaucagcauuggcuuggcuuucugagucucgaaauuacuagguuacugacuggccgugccuuuuccucaccuuggcuauucagaccaagcuguacucuuaacagcucaguagccaaaucugaaugcuucaaauauaagcauaaacucuuuauguguaacugauugcacuuaauugggcaauaccaaaucauggaagaaaauuuauuagugacccugucuccuucagaacuuucagaguaauuggaaaugagccuaauauccguguuuuugaaagcuuuaacaauuggucuacugacaggauuaaauucauacuuuauaugguguguauguuuuuucaugcuuaaguuuuuuuccuuauuuauugauggucuuacaaauauuauuuggaaauugagaugcagugagcacagaucuuaaauaucuuggcagaccgccucaguagcuguggaugaucccuguuagcuagagaaaaaccaggaaaaaaaaacccaaccugguacacaauaguuuacgaaaugaucuuugugugauuuugaacaagcuguuuuucauuuuaaucucaguuuccuugcuucuguuacugaccuaacucauggagauguggccaggagagggugggagagcucucugaauuuuuuuguuucuccugaaauaaaacaguucuaaauagacauacuuuugugugauuacauuuuccauuuuucgcaaagucguagguauaguuugaacaccaauugagaauaaaagaagcugccuucucccagucuuuucaagacauuuuaauaguuaaugagauuuugccccuuacccucaugaguuucauuugguucugaaauaaaaauuuacggcuguucucucagcugagcugauacuaguuuaagaguggaauugaguucacaccugcucuggcauaaaaagccucuaugugacuucuuugaaauauucacagagcagaauaagagagaguacucacuaucucuacaacuguaguaacuacacgguaauguugcuugcaagcacuuuagagaagcugcucuauaaacugacucuaaucugcugauauuguccacagauagaugccuccccuaagucaccuguguuccucaagguggaaugugguuguggaaaugcaguugguuuguguaggcagugggucuacauuaacacuguaaaguguacauaugggaaaaucuuugcauuugcuaggccauuuagccguucaagacaugguccguuagucaggcaacguacaauggauuuucugaguguucuaguuaaagagcaggauguguaaaguaguauacauuuaggcggauaauuaauaauugguguaggcuuguaaggcuguaauagaauauauaaauuucagcaccuguuaaaguuuuaucagagcagaucaccuuuccuuacugugagggaauauucccgccuguagaaaaauaaagugcucccacuacacgugaaaaaccuuuaugaugaaaggaggacugguuuuuauaacaaauauuauuuuccauggucacugugauuaggugacauuuuagcagucacauuuagagagcguuccuagacaauaguauuuuguauggguuugacuguagguggcaaaacacugcauagaaacaauauuuuagugcauucuaauauucagauacaguuuacuugucaaagaagccaccuccccccccauaucauccccccacaaaacaauaggguuguucauuuuauaaguucaucacaaguaaauauucagagcgaaagccuuuucuaguggcuacguuggaagggguagagaagaugaaacauagaucccaaguucaguuuuuggcuuugguuguaucauaagcaguuuuuacacuucauaucuuagcugucuucauuuucagacauagaggaagugcucccuuacagcagugagggaaagggcaaaugauauauuugugaaagcaaagcagacuaucuuacugcuuuaaaaguuucauuggcugcuugauaaauaaaauuaacauguuaucgauaugucugcaaucauaugguccucaguauauguauuuuuuaaagccauuuauauaaauuccauuuauucuagaagcugcccaaaaugauaaacuucaauacucaaaugagucuuugguucguacagucauucacccagcaaguacuuuugggaagcuggugaucugcaagcccuauguuagguacuagauaguggcaugcuacuuuucuugcuuucaacuuggcccacauccuaauaaaagaaucagguagauaucagauaauuacaauucagagaguuggggaaauaauccauguguucccaggguguuguugcauacauaucagggauacuccaccaucagcuuccucauaauaaugucuaauuuuuuuuuuuuuuuugagacggucucaccccguccuucaggcuggagugcaggggugcuuacugcagcuucaaacuucugggcuuaagaucuucccuccuuggccuccugguggcagggacugugggcacgugccaccacaccuggcuaauuuuuucuauuuuuauuuuuuguagagacaaggucucgcucuguugcacaggcuacucuggaaccucuagccucaagcagucauccugccuuagccucccaaagauuacaagugugagccacuguguccagcuuggcuaagauuuuuuuuucuuuuuuuccuuuuuuuuuuuuuuuugagacagagucucgcucuguccccaggcuagcaugcaguggcgcgaucuccgcucacugcuagcuccaccuccuggguucacgccauucuccugccuuagccuccugaguaucugggacuacaggcaucuaccaccacgcccagcuaauuuuuuguguguuuuuaguagagacaggguuucaccguguuagccaggauggucuccaucuccugaccuagugauccgccugccucggccucccaaaguacugggauuacaggcgugagucaccgcgccuggccuggcuaagauuuuuggguacucacuguguaccaggcacuugcuaaguacuuuacacauauuauccugcuugcuccuuauaauaaacuucuuuguuagacauugucauuaccauuuuacaaaggaggcaauugagaaucagagagauuagguuauuugcccaguguuguguagcugguaaguggcagaauccagauuugaagcaagaucugcugaacucuaaagccuuguccuuacccaccacugcauugccuccuuuguagagaauuuagaaagaauucccagagguggaauagcagcuaaacauggguucagcugcaacuaauagaauaccugauaacaaugguagguuaguaaaacaaagggguuuuuccccuucauuuuaggaggugucuggaggcaggagguugccugugugaguucagcaaaucaauguuucuuucuucccauucugcccuccuuagcaugcugauuuucauucuucagcuuuuuccucuccucuugcauuucuuucuugcaagcuggcucuugagccucacacagcacauuagaguccccuaaaggaggcaggggaggcagagguuaggguaacauuuauccuuacauauauccuauuccauccaggaagggggaaaaacauuaccagaaucugguggccuugagcaggauucugcuaacaacuuauuggcuaaaccucuagcagacaucuacucauagcugcaagggaagcuuggaaugugaacucuuagagccaugguugggucucugacucaagagacaggcaagggaggagggaguuaggaauggcuauuguauggaucaacaugaauuuucuuaauaauauacgugguaaugccugagcuucaucuuaaaggugaguugguuagaacuauccugauggaaagaaaauuaccaguugguagagaugcuugagcagagccuugggagcuggaagacguaauaggaauacuggaacugaagucauucugugagaugacuaugagauguaguaccacagaggaagggaugacagguugauauggcuuggcugugucccacccaaaucucaucuugaauuguagcucucauaauccccacauauugugggaaggaccuggugggaggcaauugaaucaugggggguggguuuuucccaugcuguucuugugauagugaauacaucucacgagaucugaugguuuuauaaaggccaguucgccugcacaugcuaucuugccucccaccauguaggacgugcuuuugcuucuucuucgccuuccaccaugauugugaggcuuccccagccaugugaaacuaugaguucauuaaacccccuuuucuuuauaaauuauaauuauuuauaaauuauaauuaaaaucuauaaauuguaccaucuccgguauuucuucauagcaguauaaaaaugcucuaauacacaggugaagcuggaauacaauccuggccccagagaaaugaagggucucuuguguuuaggaguggaagaugucagauuuucaaugaagcgugugguaaacuacucaaggauugauuuuaaauagugagauaccaugauaugauuuaugauuuaggacacucaagcaacugugaauaggaggcaacuugagggcaaggagauuacucaggaggugauuaaggcaauuccaagaggaaaugaugagauugagcugaacugggaacaaugaagaugaagaggaggauggauuugagugauauuaaaaugauggaaaugguuggacuugguaacugaugggcaaggcaggggucguccuuggcuucuuggugucuggcuugggccacuuggugguuggcagugccauuuguuaagauguagaauauaugaggagaaguaggucaugggggauuaagguggucaguucaguuuuggaaauaaugaauuuuugacaugucuguggguggacagauuugugauucuggguuugggauugcagauuuggcacacaauauuaauauuucauaguugaagucaugggaguagauaaguuccccagagagagacaugaaccaccaccaacaaggcaauuuguugcauugugacagcucuaacuuuuagaaaguucucaauucuguagcugucagccugaaauacucauuuuucccucugaagcuaacuaguauuguguauugucucucuuuccacauguuuugaaggaugcuaaucuuggcuuccuucaaaagcgcaacuggaaaacuuucaacacauuguagaacaugguuuaaucacaccuuguauucccggucaccauccucugcuguguucuaguucaucucuuuuucccuccaaguggugaauccaagucuuacccuaguauuccagaucugguuugaucaauaguggaucugcucucauuuuuaguguuaaugcagucuaagauuccauguauacauucauauuuuaacauugacugaaaauggagcuugugguccacuaaaaucauuaaguguuuuuaacauuaauugcuuuacauccagggcuuccacaucuuuguguagaaugggacuuaauacguauccucgucugauuucuucauguugguuuuggucugcaaaugugcaauaauucuguccuuucacucuguugauauaggaagugagauggugugaugcuuaggaaugcaaacucuuggauuuauauccuggcucugcccacccuuuacuaccugggugacaucuaaguugcuuucucugagucacaguuuccucaucucuguguugaagauauuauaaaauccaucuguugggauuguugggugaaguaaaugagguaaugcauguauaaugcauagaggaauccccagaacaucaucaacacucaguaauuuuucccuguuacuauuguagggcauauaaggaguuaauggcgcuauuuuugugauuguggauccuuucucucaguauucuuucuggaauacuuucaguaucucuuucuggagagaaaguuuaaggcaagugguucaucugugacgaauggaagaaggaaaugugguucuugauuuugaguugugugaugaacccaaauuuaccaggcaauagauaggauaugaugauuacuaaauuugccauugacugauaguuaacuggcuaccuuguugggucucuugagaaaagaacuaaaacaagaacaacaacaacaaaagcuuaaaauuaccugaaaauaugucucuuuaccuacaccuaauuuuaaggcagaaaauuccaaagugagccagcuacucaauacaggugcugaagguuaugugaaaauucggguuaacacuaaugauagauugagagguaacuguuugcuuuacaaaccgcuugccaaggaaugcccauauuagacuaugaaaauuagacucauggcaaauuuucaggaacaugauucuugugauaaacaagcuaucuggagggugaugugugagcucacaggggaguuuuaagaacagguuuccauuguuggacaguaaccugacagcuaggcauacucagaggaagggcauagauuaguauccaacaaccuguuuuaaaaccaagcaaugggaccccauacaagguccagguugacccgaaccaagguuagaugaaccugacuuguuuuuauaguaaacgucacaauggugacaagccagcagggucaucagcacacuuugcagcuacagacuucccacuggacaaaccauuuucagcuuccucuguuuggucacacccacaagaaguacgaaugguauauuuaaaaagcuaguccaucuugguucauuuauaccaguguguaggauuucuguagacucugggcugguuacaaccuagagcugcagaagggugcagagcuucauguguucauucuguacugugauaaaguucuuugcacguuuguggaaaugcaaaaguucuucuaugcaccuggcuucuguuccggucauuuccuuguauauggguuuugauccggugugacggaagagggaagcuaugcauucugagaucucagauuucauuguauccaauuauuuauaagaccugagaggugcuuuauuaguuaggaagcacugcagauuuucucuguagcuuuuaaaaaucauccugacuuccuauguguuauuuuuugcauuggcacccauugccaaugcuaugucucagaagagccgagacuuguggccaauaauccuuagaaacugauggggcuguagaauuuauuucucugucacccuuuuugaaaauaaaauaaaguuauauuuuucauuuacauggauggacaaauuggggucuuuaaaauaaaaccuacuuccccuuuucauucuuuuucugaucauuuguagcaaaagcuuagugguuuucuguagaacugcuuuguuuuaaaaaucaaauugaagaccaacuugauucugccugcagagcaaagcuaucugccuuuuuagaaaaucuggaugguuaaauuggaagcacauucugcacaugguuuagcaguuaguagccuggaaaaugacccaauagccaagauaguuuuuuuguuuguuuguuuuuuguuuuuuuaaucuucauuguaagugcuuguuuaaaguguaagcuuguaauggacuauuuugcacauuguucauuguuaauucuuuucaggcuauuauaguucuguaaauacauugccugcuaaguugugucaguggagaaacauuagugcuauaagaaaauccagugaaaugugcuuaaaagcauuaccaauuagcgcaugggacuggaucaccgcgauuucuuagugauccuagagaagucaguuucaguugacuucccauuuauuuaaaauggguaugacaacguucuuuuuggagaauagggcagcacacaaaugcacacuaugcuguggccugcugaagaguuuccacugauuugugacuauauuacucaauauugcuuuguagcacccuuagucuaauccacauugaaggagcaaaauccuucuguaucuuacuuauuauacgauuauguaauacauauguuacuuuauauauaauauguaguaguacuuauuuuacuauuuuuauucauuauaaugaaaauaacaaauuuacugggugguaucuaccaucuagcucaagcuguucuauuuuguauuguuuaaauuugagaaaagcuaauauugguuaauaauuaaagguuacaaaaauuguagugggaaaggaguuaaauucugucucucagauaguaaagacugccagaacauggacauaaucaugggaaauaauaggguggauagaaugugauuuaucugcguauguuaaagaaagaaaaauagugaucgugaauguacugaauauagcuuaaacuauuuaucauuauguacaaauggaaacuuacauaaaaccccuguugauuaaguuuuaucugaaacaaaggauaugauuggaaguggagaaugggagaguauuuuaagagcaugugauaauccagcuagaagcuucagcaagucuguggucaaacaagagaagagaaagaaagagcaaggaagcuugauuugguuaugcaaauuuggagcacacauaugaguugggaccuaauggauuguugcacuggauuuggucaucaaaugaugcuuuucauagcaaauauuaucugagccauuaauucaaacacugagaaaugcaggccauguguaggcagaaccacagccuuuuuaucccucaaaacaaaauguaaaaguuggccuugaugguuagaccuuauaaagaagaauaaggggggaagggggaaaggagcaaguagugaaggaaaaagcacccagaauggaaacaggcaugcguauucagacauaaauccaauaaacagacaccccaaaguuaugcuguguaagaauagacacacaguaagaaauuuccagcuaucaggcuaacaggauggaaaacuggagagcacagagcaauuacuuacgaagaaagaggcacaguugacaucaaguguuauagaggagacuggcaugauuacaggaagauguugagaauaucagaaaacauccccaaauuaagagugccaaaaagaagaaagauuaccgaugagaucaugauaaauaauaaugagcuguuucucaaaguaccugaagaaggggccugaaaagugguuugucaagccuggaagacagagaaaggguaauguauugacggacgauggagacacugcuaaaaaauaaaugaaauuuucaccccaguguucacaaaggaggaggugguuggggacagaugucagacacagacacaaauuucccaggggagaaugaagaaauacaaaagaaaucaggauccugcuaaaacaggugaucaaggggugagaagaagaaaaugaauaaaaccccaaaaaccccaaagcuuagcgguagucaccuaaaaaucuucaagaagugagaacaaagaagcuaacaagaagaggaaaaacauacccgcaucacuuagaaaggcuggaaauauuuucauguguguguguuuuuaucuaguuaauuuguuagacuagcccuuuugaaacuuguccuuaaaggaaguaagauagaauacuuaaagaaaaaugauuguggcugggcgugguggcucaccacccagaguggaaacaggcaugcguauucagacauaaauccaauaaacagacaccccaaaguuaugcuguguaagaauagacacacaguaagaaauuuccagcuaucaggcuaacaggccuguaaucucagcucuuugggaggccgaggagggcagaucauuugaagccaggaguucgagaccaaccuggccaacauggugaaaccccgugucuacuaaaaauacaaaaaauuagccaggcgugguggcacgugccuguagucccagcuagucgggaggcugaggcaggagaacugauugaacccaggaggcggcgguugcagugagcugagaucaugccguuauacucuugccucggugacagagugagacuccgucucaaaaaagaaaaaagaaaaaugaucguuuaaguggccuugaauaaccaagacaucuuuccugcuaaguucuuuucgaguuacccauuaugcccagcguugaauguuuacugugcuuauuaaggaugauuuuuguguccuaggugaucacugaguccuugauugggccaguauuuacuggauggaugcuucuuagugccagggagugcgcuagauccuggacuacugggauggaaaagcuagauacuuucugaggguuuuugaagucacuucuuccucacucauauaagcaaccccaccucuuuccaggcauugauuucaguguguucaucaucccuggucuugcuuuuaaccagcuacuugaugggcaaaggucuggagaggggcagccuccuuuguugcuggcucagugugcugugcuguccucagcguggugccugcuuuuugcccuuauccucagauguggaucccucucuucccaagcucuccuccauccccugugcugcaaacaaaacuccuuguuuguugcuccccaccaguggccacgaaggaauuugcaaaccccucaaccuccuacuguuuuggaauucaugaaguuuuugcccugagcaagaggcuauacuuucaaaaguacuuuuuccuuucuucauuuucccacccccugccuuucaaccacugccccgcccuggugcacacaccuccaucccaggcugauaacucccaucucuauuugaaccacccacucccuucucuuggccucugucaauuuuagggcucagcaaaacugggcuuacuaaaaacaccuuucaauuucuguucucagcauuaaucugucuuugcuuaguguucaaagaauacuuuaagauacucauuaaugcaaacacuguuaugaggagggagcuucacuucggucccuucuucucaccuucagauacuacuguaacagcugugugggacuggaguauggaauguuucagagaagcugcuucugaguguguaggagagggcugaagaaacuuucauccaguacacaguuuuguccuguaguccuuguucccauggccaaaagucuucugguaaaauuaaucuccagugcuaccuuuccuaccaggacugcagguggugucuuuuaguugaaacagacucccguggucccuugauucucauauguaauguuccauguucaggugucucugaaagcuguuagacuucauccaauggagaaggguccauugagcuacaucacuuucuuuuuucacauuugcguuucuuuauguagagugaguugcaguuugguuggcuuuuuuucugggaauagaucacucuucuggggacugucagacuuggucccugcccugggugaguuugccaucuuauugaggggguacuaacaugugcgagacaacuauaaucauagcaauaccaaccccaccucaauggcugagugacuaaugagaggagagagugaggggcugagcagaggccucuaggaagcagcuguggucaaucuuagccuacauuuacuuuuuuuuuuuuuuuuuuugagacgaagucucacuccgucacucaggcuggagugcagugguaugaucucugcucacugcaaccuccaccucccagguucaagcaauucuccugucucagccuccugaguagcugggauuacaggcaugcaccaccacacccaguuaauuuuuguauuuuuaguagagaugggguuucaccauguuggccaggcuggucucaaacuccugaccucaagugauccgcccaccuuggccuccgaaagugcugggauuagaggcgugagccgcugugccuggccuaaaccuauauuuacuuugaauuucacuauagucuaccauuuccugaugccuuauauaucugacauauaucugaugagugacauucuugagaugucugcccaggacuccugaaccccaugagaaauaagauugcacuuugcaguucuucaaccuugcugugcaucugaguaacauguggcccauucauacacugcagaugccugggcuccgucugugagauucuguguuuagaggccugggcugggaucuaggcuucuguuauuuaaacaggaauuucugaccuacacauugcuucaaaaaauugucaauuuuguuuucaaaauuguuauuuuuucuugaacucaauacuuauuuuuaaauccuuuuucacucaggaaaagugaaucaucaccuacuuagcaccuaauuauuuaccacuaagauauuugugugcaaaaaauuaauaauuuuuagaucaaagaaaauggauaacuucuaauauguuaaaaucgugcauauuuccauugagagagagaaugggcugaaauuaucccucuuuuauauuuuaauuguucaucaaauugauagauuuaaucuacuggcccuaaagauuugcuucuauaauaauguugugaaugaaaccuucauugcuguagauucacaauucaacaucauacguaugugguaggugugauuuuucuuguauuaaaggaaaaaggguuagcagauuuuuaccaauuuagaaaaaaggcaagccaaauuagagggaagucagcauuauaaauauuucgaaaagaacccccauucauuauuuuuuguaauguguagcuaagaccaagcaacagugaagugggaaucuuugccuuaugcaaaaugguuagggaaauagcuaaggaugcuaagaaauuagcuucaauauugguuguaggcaugaauguuuuucucagggacuugggugauuuuguuacacuuucuaauauuaucucugcuaucuucuaggacuuauuuugugcagucaaagacuuuuuaaggcugucuguucuguaaaagaaauacaaacuccaaguuguuugauuuuaugaguuuuguuguuguuguuguugcuguucagucuguaaaauagugacguggauaauaaagauauuuaguuguauguccagugaccuuuggaauaauaaaacuguuuuugucuguguggguuuuucacauacagguaauguuuuguucacauucuggauacagaccugaccucaggcugcucagcacugcaauuucauaggcuccuaugagguccccggcuaacauuuugacuguggugguagaccuucaccucuuagauuucauauaucuuucauuuugcuucuuuugugcuucuguugaauucuguauauuuaagaaaauuaagaugcagagagaaaauugguuaaugucuccucugugucuuguaauauguggcccaaacagaaagaaaauguauggaauuuagaaauuuuauuuacuuguuuucuuacaucauagaauaccauuuuaccauugaaauuauuaaaaccugcuuuuauugagaauuuuggggaaguugaaaauguaaccuuuacggggaauuaaagcuguuuuauuuuaaugaauaaaguaguuaaauuauuaaucauauaaaauuauuucucuggauguuaauaaccauuucuuuacccaggaacuuuuuucuaaucacagaaucuugauuggugguuuauuugaaggcauaucucacuauuaaugguucaagaauacccauaacuuuuggaaagacucaaaacauauugcauaauuggauuuuaaguuauguuguuuguaagcuuauuugacuuguaucauguagugauuacuaucaguuuuucuggauguagguaggugcuucuuaugauucuuucauagauaguauugagucauucauuaagucuauuccucagaugcuuauugagcaucagacuugugucacauacuugcacagcuugguguuggagauacacccuuuaucaccacauacuuggaguugcuuuuugucugcuguaagacacaggauguagugaacaggccaagagaaauauaggguccugugggagcuccuuacagggagggacauagcacagagaaacucaggguaguugacauuuaaguucagaucugagugaucaggaaaacagccagccagagggagcuggcaugggaauggauggaggcguguuugagucauggcagccagaucuaaagaaggcuacaaguagagagaggacugugcauuucuccuucccaucacuggaagaggaaggguaugaggaguaggcucuacaugaacaugagagccagcucaugaagggcuguacaagccauguuucaguguuuaucauucauucugcaaauacauacucagcacuaugugucagguacuuggcuucaggaaacaaggcagaaaauaaugccugcccuuguggagauuuuauucaaauggggaagagacaaacaguaaacauggcacuagugguuuugaaaaugggucagaaguauguguaguccaaaugguuacagacucagcauuugccaauaucauggagccaaaucuaagacuauuuaauaaaaauaaguuugcaaucauuuccaguccucagcugauaacuacagauagacuuauucuuaacucaacauauuuacagguaaaguugaagguuaccuaucauuuauauuuauugcucacucacauugcaucaggcauugggcuaagcaagcaagcaaaccacauuugagagaaggugcuacaguuuagugcaaucaguauuucaaguucaccagaguagaacuuaagaguagaagguuuauuuguuaaauaagaauacuugaccuuaauggcuaccaaaaaagaguuggaagaaugaauaagaucuaguauuugauggcacaacagggugauuauaaucaauaauaauuuaauaguacauuuaaaaauaacuggaagaguauaauuguauuguuuguaacauaaaggauaaaugcuugaguugauggguacuccauuuacccauauaugauuauuacacauuauaagccuauaugaaaauaucucauauaccucauauauacccacuauguaccuacaaaaauuaaaauacacacacacacacacacacacacacacacacacgaauacuugagaggugaucagaauguccuguauuccuggccgggcacgguggcucacgccuguaaucccagcacuuugggaggccaaggcgggcagaucaugaggucaggagacugagaccauccuggcuaacagggugaaaccccgucucuacuaaaaauacaaaaaaaaaaaaaauuagccgggcgugguggcgggugccuguagucccagcuacuugggaggcugaggcaggagaauggcgugaaccugggaggcggagcuugcagugagccgagaucgcgccacugcacucuagccucggcaacacagcgagacuccaucucaaaaaaaaaaaaaaaaaagaauguccuguauugcuguuugaaaacacauuaccagaaccagaauucuuccuugaaguuuugaacaauaucacaauaacagaaacaucucaagauuuuaucaugcagccagcaaacaaaaaaauucuacauagugauugaaguagacauuugcuugucacucaagaugaauuauuguaaauaaggaguuuuuauuacaaugaacacuuuuuuuggcagaauuaauaaagagcagaggauacuagaagucagugcauagaagcaaaaggagaaauguaguugagcauagugaauagagaagauuugcuuucguuuauuugcccuauacauuaagaccauugaaugagacuauuuuguguaugacaagcauuugaaaaaauuguuuuacucuggcaaucuuaggcugauuuguuuuauuuccuuuagaauaaaaguugcaaguggguaggaauuaugccuuaaaguguuagccuacaaaggacuggaaaacuacucaaggguaacagcugaagaggaaauggcucugucagugucgugcgcauggaugauugggcacauaagggacacaagcagggagaaaggugcagagagaagagcucauaaaaccaaggaggcuugcuuggaacuaaaauagaauagcaaaagugaaaagccuggggagccacuaaugugauauaguuucccucguaacauaaugcaaauauguaaaguugaaaacgugugccgccucuugcauagacauugcugucaucagcagcacacacaguuggguauauuuggcgaggcauuuaaucuccuggcucucuggucucucaguccauaucaccagaggcauguauuuucaaaacaguccagaucaaugucuggucuuuguaucugugguacaaauauaaagcuuacuuguccacauaacagcaaaguaaauccgugguccauuaacgcuaaauuguaaauagugauagucacuuuuguccaacagugucuguaauguuuauugcuaaagcccauacauguuuauugauauuauccuaaucugggaacaguagcugcuaguuaucuaugugccaaacacugugcugcuguuugcaaauuuuaucuaauagcaacuguuugugaggagcauuuguuaucugcauuuuacccauaaggaagguaggagggacagaaagguuaaaauaauccagauggaggacccacucuuggucacugguauguuuugggcuuagcacacaguucugccagacucugcaacauguguucuuaaccaucagacuuuauuucucuggugggcaacacagguagaugugacagguuagaaguauuagauauaaauauaaguuaucgagaugauaugacuaccgaauucacuacugcacuuuuuuuacuuuuuuaaaaacauguauuucagcacacugcuaaaccacagcaagaaucuuuuuaaaaagaccuuacaagaagcaugauuacaggucacaaaaucaagggaaaauauugucaucauuauuuuuuaauaagugauaagugaggcugaugaguguagaccuguugcuuuauuaauagaaauaugugcaucuggugaggacuuguauuugccaagcacacugcuggccuggaauuagacuccucuguggaauucaggucaguguuuacacccauaguaguuuacaaucuuucauaaauuugagcaaaauauuaggaaagcacuuagaagcaauuuagagaaucagaauuaaaguagaaucgguguagcauguauguucaguggagaggggcgaguagaggagugaguuucucugacagaugaugaaucuaguuuguuuacuuuuugggagacccuguuuccacacucacugacaugugaguuugcauccuggcucaagcacuuaaacuccccagucucccuuucugugugugugggauggagauaacaaggccaaccuuacaagguuguauaggguaaagugcccaguguaagauuugaagcacaguaagucuucaguggggcuagguuuucuccuuccucccugcuacuuacuucaugaagaggaugaauaaguacaaaucucuguucagcgcugcaaaggaagauuaucauauuuauuuauuuauuuauuuuugagacagagucucacucugucgcccaggcuggaaugcaguggcaugaucuuggcccacugcagccuccgccuccuggguucaagugauucugcugccucagccacccaaguggcugggacuacaggcgugugccaccaggcccagcuaauuuuuguauauuuuaguagagacaggguuucgccauguuuaccaggcuggucucgaacuccugacuucaagugauccauccaccuuggccucccaaagugcugggauuacaggcaugagccaccuugcccagcccagauuaucauuuuuaaaugcugaaaaccuaaauuucccauugcacugugcuauuacuuucacaguguugacuuucagagauauccgugcaccgccuuuugguagcucccuauguccucuugcuucucuaguugccauuucuuuggaagacccccccgacauuaguuaucucauuuuccaugagugauuuugaaacccaguuugugccacaguaaaauuuauugaaauagaagaaacacuggaucuugagagauaccaccagcaccugcagucuuaacgcuucaucuccucuccugaccuggguccaacucaucuuuuuuucucaucaccgccugcugccaucuuguuuacuccaagucuucaccguucagucagaaauacaaagcccugcaugggucagguaguccucagagaaggagagaaguaagaaagaaaguggaggccggccacggugguucacaacuguaaucccagcacuuuuggaggcugaggugggcggaucaccugaggucaggaguccaagaccagcuuggccaacguggugaaaccccgucucuacuaaaaauacaaaaauuagcugggcuugguggcaggugccuguaaucccagcuacucgggaggcugaggcgagagaauugcuugaacccggaaggcggagguugcagugagccgagaucgccccauugcacucuagccuggacaacaagagcaaaacuccgucugaaaaaacaaaaaacaagaaagaagguggaaucaaagggauguagggguuccacaaauuuagaugagaugucagguuucucagauguguuccuugauuugagguaggugaucuuagaagagcugcaacuaaacuccaacuggcuccuuuuucccccaugucuuagaagaaaaugugcuucguuuuuauucucuugacaacccucugcauuugcaucuuucagcuucuucuaacuugugucuccugggaccuuucuuuucauaacucuauuuucuuucaucaucugucuuuccccugacuccuuuucccuuugcuucaaaaugugcaaauggauccucucuucucuggcagugauuaucaaagugugguuucucggcgaaaugugaucacuuacuucaaaucuccugggaugaugugaaaguugggacccacuucaggccuaugugucaauaccucaguaugauauauuccagcaacuuucccaaaaaacuacuuaguuuccaaggcaguuuggcaucuccuagaguggcacagcaaauuccaugauuuuuuucuagcccuguucguuuugucuuuuaaaaccugucucccucaacauccacaauguuaaaaacgucuaacuugccuucuguuucgcucacuacucuuuuuuuuuuuccugcuuucugcuucugucuucauaagugcaggcaugggaagagcugggaauuuggagucccaguaggguuugauuccuuaaugucauugcucaguagcugcgugaucuugggucacccauguaucuucaguagggcaucugcuuuggagguuuguguggcuugcaagugucauuuuuaaauugggagcccaaaugcaauuguuugugcucuaaaaaucugccucuuccaguuugcuguuggaaaacuuggaaauuauuggcuuugccaggguuguggccucuggaugagagcuaaaaggugaacagccuuuuauccauucugcuuccccccacuuacucaggguccuuuccuguuacaaaucauaguuuguauggcauggcaaguacuggaagggagaaauucucuccagugagccagaaaaugcaacgggaucuguuugugauugauagagauaagagugccugaucuacuuuucccucugccagaaaaguauuuuucccugacagcuggagacaucaaaggucugaagcugugaauacagagagaugaauguucuaauauuaauauuauauuuaaaaauauaccacguaacauuuaacaucaacaugucuaguuuccucugucugguaacccccagucguccauaugcaaaaagaggaauuccaaucacagagguccucacuccaaggagacaggcaaccauuacgugucugugaauagcugaguaagccaaacugugauaguuucugauagaucaugucaagaccuaaauaguggaaucuucaggauuuggagguggggagcaagucaccuggauugaugaggacucacugaugaacugaccaaauuguuuuuuuuuuuuuuuuuuuuuuuuugagauggagucuugcucugucccccaagcuggagugagugcaguggugccaucuuggcucaucgcaagcuccgccucccggguucacgccauucuccugccucagccucccgaguagcugggaccacaggcgcccaccaccaugcccggcuaauuuuuuguauuuuuaguagagaugggguuucaccguguuagccagauggucuugaucuccugaccuugugauccgcuggucuuggccucccaaagugcugggauuacaggcgugagccaucgugcucggccccaaaugggcuuuuuaggaguucucauggaagagauggaaguuucuucuugagugagagcaaucccagagucugauauuucaccuaguacaugggaagggaacauguuuuguccuaagccaggugugaaguauagucauucauguugggcaaaaacguggcaggacuuggaacuucuguggggacccacaaaggagaauagaggagaagacuccaugaaauuucugguccugguguuguguggauggcccagggcccuggccagagagauucaacuacuaggugagguuuuuuucacuuuagacaacccugcuaaggcuucauuucacuuauaugccgucugugggccuuugaugguucuuuuuuccuauauuugcuauggauauauuuaugcauuuaaaaaauuugcaucauuguaacuuuucauugacaaaauauauuuaauaugcucgguuuuuacaguuuugcuuaauuaguuuuuuucccacuuauauuuauuuucuguaacuuuucucuuuuuuguugucuguuuugcucuauuaagauguuauauaucuucuccuccuucuccagaguagaccucucaucaguucaccaaaaucucucuccaguaagagucaggaagcuuaccgugugacaaccccuucaaggcaauaaggcuccaacuaagggauuaagauuguuuuuugacaccaaacauuguuuauccucuuaauuuugagcuauguagccugaaauccaugcucugugaugaaauggaggugguuuaucugagcuuuaauacucuuaaaaaugaagauaaugauagagcauaguaaugaaaauuaaauaagaugcaugcaucuagcagagaagcuaagaaauaggagauucuuaacaaauguaaccucauuucuucuuuaguuucuguaaaaccccaggaauguuagaaaauaucuaggucgaaaggagaagaucaugaguuugguguuaauuuugagguaccuuuaaccagucaagugaagacaugaaguagacaguugaauuuaagggugugcagaucagagaugucugaguggagagucugcaguugaagagcuguuuguagagaugccaguugaugguaugagauugcuuauggagucuugaguaacaggugggccuugagccuagcaguagaaggauuuucaagauuuaaagacauucaauugagaacaaaagagcaugccagggacugggagagaagggaaaugugauguuauagaagcuaugcuaagcauaguuuuuuaagaaggaggggaugggugugucuuuuuuggucaucaaggaagaugaguacucaacagugucucuuggcuuuaaccacuuuaguggucacuguugacauuuucagagaguuuucuugguggaaucauggaauaggaacugacuuuccaucccucagaguugaguugucuuucaucugacuuggcaaaguauuucuuuuauguacuucuaaugugauuuuucucuauuguuuauaguuguuugcacuuuucauucacguaauaaauuaucaguuuccugaagacagaggucaugcaaaaucccauguaaauuacaccuaguuaaguauuuagucuuagaaucauugguucucaugaugaacaaaacacauuucuuggucuguucauuuauucauucauucgcugaacaguuuuucauuuaccaauuccauacaaauagcagguacuauuuuagguuaugugaauauaguggugaacauaagauacucccuuuucuguaaacuuucauuguagguggagacagaugagaaggaaugaauacaaauguugagggcguucagugucuucacuuauuuguuccucacaacaauagcaugauguagauguuauuccuaguccuauuucauugaugagaagauggaggcaucaagauauuuaguaacuugccaggguucucaguucauuggaaacagggaugauguuuggagcuaggauucaaacccaggcgguuugacucucagauccacuuugcuaaucaucucacuacacugcaaaguguuuggcacggggaaaaucauuauucuuauuauuaauguaguuaauaguaacuauuucucaagggagcugaggaaucauuuacucuaauucagaugagaaaauggacacucauacagcuagcuauuggcagaacugaaauuuagaagccauauuuccaggcuccccuuccaauguuuuccccucauccaguaccucuucuuuaaggaauggaguauggaaaagggaaaagaagcuggaagaaugaaggaaugggcaaggagaaggaaggguguguagaagagauauaggaaauaauuaaaccuguuggauuugggguuuuugaugcuauugaacugucugguuuuuaaaguuuuuuucccccuuauauucucaagagguagauauccuugaaaugauaucuucaugcaaaauaguguuuuauuucaucuaugaccaaaaaauaauucaggagcuaggaaaccuuagcuccuuaaaaguaaaagacuguauuuugggaaagaacauuguuacuggaauuuauacugugaugacacugguugguagacacacuagaagcuuugaggagugugugugugugucuuugugugucuguguuugugucuuugugugucuguguuuguauauguuuguauauuaguaugauauauauagaaguacauauuuauuuuauaaaauacugguaguguuuaauuugugcauacucuuuaggggagaggguauugaaauauuuuucuggguuggaaaaguuuuuguacuuacaugcaaggcugcucuaaaaucaagcaccauauugaaacaucacaaauauacacuaagcaagggacagaugcacaaggaauuuaagcagaguuuuucuaaauggcaaauaauuagaggggaacagaugccuaugggcagcaaaggaugaaaugagguaccaggaauuuuaaaagggagauggaaauacaaauguagaaugcaguugcucucaaggauguuuaagccuagagggugugcuugcccaaaguucacucuuuuuguggguauugacuuaaauuugguucucucuucaccugucuuccccaaagaaguagaugaugcuaaucauucugaaguggaacagauuuucuguggaaccucaguuuuggaugaucuguggcugcaucucuuucuucugccucccuagggucuuguccuuuuauaggacugccaggauaugacauuucacaaccaugucaguucucacuuauuuauuauuuauaccccauauccuuccaaaaggguuuuuagguagccuaccaauaaaagacacguaugaaaauauauguguguguguguguguauauauauauauauauauaaaauuuuuugucuugguuuguguuuuaggauggacaugucccuucuuuagaaacaagucugcuguaaaauggguuguauccaucucagagcuauucugcguagucuugauguggaaaaggaaacaaaucuccaagaauaaaguagagcacuaggcauuucccaucuuccuguagagugguaguuuaaacagcaggggcacugagcagagcgauugagccacccagcaaagcugagcuguagcaccugaucauuaucccucagguuuaagauuuaccuguugugcucauuguaacaaaagaaaugaaaucucuguaauuauauuggaagggggaggagaucguguuuuaguuccuuugaucuugagcuagaauaggcucugcuuuuggaaauuuaauuugaaagagcccaacguacacaucugcuuuuuguacugcaauuucuauugagcuugaaaauagaaauuuauuaaugcaaauguguagagucuguuccuugaggaaaagauauacucauucaaaacacaaggugaucccuuccuacauagcuauggaagauguuaauauguuuucuguuuuuuuuuuuccuugacuucagauaugagguuccuugcuaacaaggacuaagcauaaaaauuauaggauccauuggggaauggaaagauucauucaauacuuaaaaguuuccaaaggacaaauucauuggugaagagcugggggaagcauacugaauccucaaaagaaaaaaaaaaagccaaaaacaagugcaucaucaaaccauucugaaaauauguuugaauugaugauagggcccaugcuaagagacaaagcuuucauuucaacgaauccaaucugccuaguguuguguaaaauugccuuugccuguaaauggaauggcaugcagauuuuagguaggacacuuucucacccaacuuagccuguacucuauuucauuuuuuccaccauuacaugaagcuucacauaaaugacaacuugacuuaauccuuaaaguggcuggauuguguggucuauuuugauuaaacuuuuucuuguucuuaguguaaauuuucaguaaugccuaaaaugucaugagcauuuugggacauaaauccuuuaagcuauuuugcagucauauaguuguucuuuggaggguuugagugcuuuccuaaacuccuucucaucucuaaauaggcaaaauaaauuauaaauugucgagaacauucaaucacucuucggaugagcaggcaucuccuaaagcuggggaaaguauccauuuucaauauuuugaguaaauauaguugauucuuuauaauauuuguacuguaucaaaagaucucaaaaacuguuauaaauuaccuagacuuaaggaagaagacaugauuaaauaauucauuggaucaauaaaaccaaucugcuuuuuucugauguggugugaugaaguuuuuuuucaaaugggguaggugggccucagugcuguguauuauccuuuugauucuauugguuacugucuuucucugcuccccccuuaguuguuguuugauauuuuugugcuuuuuguuuguuuuguuuuaaagaaaggaaagcugcaagccauagaaaguuaggcugugaguuaggaauucugaguuuaaagcagggagccugucccuaacuuuguguuuaaguugguguuucaguuauguugccaguguaagcuugugacccuuacaaauguacaauuucauuuggguucagugauuccuggaugaguuugugauauaggaugccaaaggcuguggaauuucuuuaagacacaaaaucuugagacagagcugauuccuuggaagcuuguggguaacuagagucucauguuaacuaaucuggagggggcuaagaaaagucuuccuacccacuuccaauuaauuaauuucuaacauuuccaucuaaucaugacuuugucgagugacacacaucuuuuuuccucacaggcaagaaacucacacacaaaauuucuauuucuaauggcagacaguuggggugccgcagccaagcagucacccuuaaaaauuaaugagcguaaugaugguuagaaaagcgauucugauggugguuggagagggaggggccauggggauggcagaaggaggaagaccggacuccucauaagugacaaugaugugagccccuguccucaucuccccucccauccccccuuccgcccagucaccaccccuuccauccuccucucuuuacaggagccaaagcagauagaaagacagggcgauuaugaagacgucaguuggaguguaggcaggcgagaggggcgcagcgccccagaugagguccggggggagcugaggagggucacucauggacgaccgugugugugugucugacagacugugaaauggugcguuguugcacggcugcgcugcaccugggcccuucaucugugauugauugguuuggucauguguaauggucccaucugcucuguguuguuuuucuuuuuuuacuuauaaacaccguucccagaggcugagagaggaugagcuauguuuugucaucuucacuuacacuuuagcucaaaaaaguggucaaguagguaagcucuaaagucuguccaaguaauguaguaggaaaguacgguuuuuccccuuugcuugauugugugugugugugugugugugugugugcgcgcgcgcgugugccucuccugcgcacgcgugugugcguggaguuuuaaugcugccuguuaauaucugaauaguucgugaaccacggaagaccaaaauaucgcagaaaugauuugcacaacucuguguauugugacucuuacugcagugaggauuuuuuuuuguaacggagccaauacuuaauuaaaaccgcugacaucaugguguuauaauuaagcguggcauuaauuaagcuggaauaacgauuuuuuuuuauuaagaacugcuucuauuguauaagaccauuaucgccuaaaaacaaaauaauuuuaaggcaaaaauaaauuugcuuuaaccuagcccuuuucaacuucccccaaaguccggccucaggacugucaucaucagggcuccgagucugugugugcgugugugugugagcaugugcguguguguguguguguuuggugguguuggguugggggagaguggaagugaaauuuguuuuuuuucacccaaaaaugcugaucggcuccuggcauucugauggcuaauuaugcaucggagagcuucgacagcugcauucaucaucauaaaauguaauaauuaaugacauuccaacaaagaaaaauaugcaaaugaggacucauuagcauuuucauauucagcuuugauaaugcuuuugcugacaagguuguaauuaaugaaaauucaugucgcagucaggagauuggaucgguuucauuccgcucacaauucccaaaugcuugcauuauggaaaaucggcggcucugccaacuuuucagggaagaaaaaaacacacacacacacuaaaagcaccagaugcaaauuaaugguagggagucuuuaacucuuuaaaccaccccccuaaauuuccaucauaggaaacaugugaugaguguuagccuaagaacuagauucucuuuuuuuuaauaauaggaaaguacuuuuauuugugacccaaguaugagaauuucuggcaaacuuuuuuuuuaauauuaaaaaaaaccccccaaacccuccaccuuuucccuucuuuccuuuucccuuucaagacuauuuaaauguacauaguaaaacauguuaggacagccaagccccagcauguuguguucuguccucuggcuggcagauucacgccacaacaguuuauucauccacaugcuuuuuggcgacucuucaucacguauuugggcuuagaucuucuggugccucccucggcgugcuacccauaaggucgaaagaaaagcaaguauucgauuucucuauucaggguggguuuuuuuuuuuuuuuuuuuuuuuggaugauagugguuuuuuuuuuuuugugcuuuuucuuuuuaaucuauucccuuugugguuuaguguaagaguuugagaaugugcccauaauucucucacucaacacuucugguuuaguguuguucuucaaauguaauuuuaggagacacucugcaaucaaaauggaaacccagaaaccccagagcagagauaucgacaaauauuuaacacagagagcuguuaauuuaugaaagccucuguguguugcuuucaaaauguggaacuuuagguuggcaaauguacacuugaugccaaccugguaccauguuugacagacaagccugaaguuaaacugaaaguucuaucuggcccucaagguuagaaagaaaaacuuaaacagagucugacuucauuuucuauuugaucuuuagguuaaaaaaugaugauuauuaaaacuggucuuuuugcugaggcagauguuuuaauaaaagguuuguauaaugauuaagaaaaagggaaaauagaaguguacuucuuuauaaauuauaacguuuauaagcauuuucacucucagaugaauaaaaugacuucugggaguuccuaagaugcaguuuccuguuuauuuaaaguuaaauuguaauucccaaaguugcuagcccagcauaaauaaagauuauaauacgccuuguuaagggaagagagaaacuuugauaugcggggccuuauuuuuuagaguauuucaguaaaacagaaagaaucaucaguuauuucacgaaaauuuuaaaauaaaucuuuuuucccuuguaugugauuaagaaugacuggguuucauuccuuguuaaacucuugggguuccaagaaacagaauuuuauuucaaucucuugcuucuuccaacuuuuauuuugucacaguuuguacaugaaccuguguguguguacacaggcauguguguaaauguguguguguccaugucuaaagauuaugguggcucuguccucucuccuguaaaaucuauugugguaaaauagcaggcaaaagaagguuuuacuuuuuuuuuuuccuuuuaguuuauuucuuuuuuugugugggcaaacugcccauccagaugguagaauuucaccuguaagcaaucugaaacgauagguuaauucugacauuuuauagagcuuuuuuuauuuucuuuucacacaguacaacuaagugcagaauaacugcucaagauaauguuucuuuuuuuuuuuuuuuucuuuuaaagcgcuuucugcugugauugguucuuuuuucccccaaaucugaauuuggggcucauuuaaaaaucuguggcuuuaggcacuuugcuguuauugucaaaaccacaucuaaugaaaucuuugaccagcuucuaauauguguaaaugaggaagugauggcagaagugaaaaagcagguuagucgccgagaagcagauccuuguaauuuuauaacgcugaacguuccacuggcuuugauaaauuuacuguuaguuuucuccucccaccaaauucacagauguauaccaacucauaacuucccaaguaaugccuagcaugguauuagcccccggaauccugggacuugcuuuuguugucagugugguuagccucugguggcuuaugugacugaguaaacuggagaaaaacuucagggugauucguugucccgugaucaaggaaucccauuauuuccaaaagcggguuagaagauguuuuuggaguagaguguggaagggaaagggaguauuggagauuguuuuuacacauaaucaugguaaucaugcuguguugacaaguuaguuuugaaugugccaccuucuuguuuuuauuucuagaaaaccuucauuuucaugaauuauuucuugagcugaugauaaagaugacuuuagagacaucuucuccccugguguauuccuuuagggaaacguuuuugaaaguguuucccuuuauuauaccuguaaggcuugggaccuuugucauggcauuguuuguuguuuuuuccguuuccuguuuugcacguguuaauuccugugggcauuuucuuuuuaaagugaugggauuuccacuguccagcagcaagccacauuuacuggaguuauugaacucuguaauaggaaaccugugggugaucaguuuuacccucccuagaagauacugcuucagucaaugagaauuacagccccaugacugagaauuuuaaagaagggguuccacuaagacacccagauguuuuguuucagguguugcaacaaaaucaacauuuguuugugggcagcgaagccaguguuccugccaguauucccguucagucgcuucucauauuucccuugcaaacuuucccauugguuggggucuguggagagauuucaguggcuggcugguggaaauguuugggagaacauuugcguaucaaagcaaccuaaauauuugcaaaaauguuugcuugagaaaaaagaauccacuuaggauuaggaaguaacugcuuaaacauuuuaaaagcauuugugauuucccuaaguauauuacucaugagccacugccuaaccugaauuucaggggucacucuggaaucuguauauuuaaaaacccuauaagauaauaaagguuuugcuuuaugauuaagaucugaauccauacauuaaaaugaaaaaacacuugacaagacaaaauauauuuuaagaauuguuuaucauuuagugaaccugcaaaacaaaagguguaaagaaagggccucaugaaaugguuggauguugaauaccucuaacgucauucuuucccucuacuguagauuuuuuguugguaaaacccaauuguauugcuaugauaugacauuccuucuguuggaguccauaagcuuucuuccagugguaaugauuugaaugucagaucuuuuucuugaguuuaauguaggcauuuucuguccacauuauuaaaguuucagcuacauuuuacugaugguuuggaaacaguauguguaaaacucaguguaggccaauuuuuccaauuuguuaacaagguaggaguugagcauugacaauuacuguacuuaaaagccccucggaucagguguuauuuuaccaucuggacauuuuaauuaguaauaaaaguguggaucuggauacacagaaauaggaucuacaguacacaauggcccaaugcacucuguuggugcugagguguauguggcuacauuuuauaaauauguauguaugugugugugugggcaaguguaauuaugugccagguguguccuuuuucaaacugggcacuaacacaacaccaaagaauuuggcuacuuuucuuagauaaaaaguaaaaauguauaaucuauaaacuugcacauaaguaaaacuguaucuuuuuaaugcuccuacuuccucaaguauggcaugacaaaauauaaugcugacauuuagguaggccugggcaaaagaugugacucuucucuuucauagcugugugcucuaaggcaaauaaauuaaccaccaaguaucccuuuuuucucauauucagaaugaaaguauaaaugauaauuguuaugguaucuaccuaacaggauuaugaggaagcucauuugagcauguauguugaaaagcacuuaaugaaauauaaggagucauaacaguucuuaacaauugauuguuaauacaggaugcagaugaccaauucauaccccacauaccaucuuuuauaauucaguaaaucaucucauauuuaaaaauaagggagaugcaaauauaauguuacauuagauuauuaacaaaugauaaguuuaagaccaccagaaaaaaauguguucauaaguuucaacauaaagcaaaaugacucauucuuauaaaguauauacaggcucauugacgcaauguuauccuuaauuaaggcaaaagcgaugcauuugagggaaauagugacccucuggagaaauagagaaugaaaauaguuuagggaaaugaaucuuaacaucuucucuuuuggaaaaauucaugcauguuucucuuaaucauuaugaauuucauguuugcaaaccagugugaauacuuaaacgauaaucauuauuguuuagaaucuaccuauuacuacacacacagauacacacacacacacacacacacacacacacacacacacacauuugcucaagaaaaucauccucaggaaguaaaggaguugauaaaauuaccauuggagcagaugaguuuggauacuucuacugaaagcuguuucaguuuuuauuauagguacaguucucccccgagaauucuuugggagaaauaaaaacauuuguuuuuaauuuaaaugagugguaacaugcuguagcauaauauuaacuauuucagugauuuuaucaauuuuaucuuccucugccuuaauguaauaaaugcauaucuugauuaaguacaaaucuuuacauuacguugucccuaaugacaaauauuauuuuaggcaacuuaguuuuaaucaucagagugucuuagggagcuuauaaaacuugucucugggacaugguauuagcaggauguacagaguuccuuuuuggugccaugcuaggaggagagacugacagagucaguccaguccauucauucauuugauagauaauaaguaaaccacagaagaaacgagaauaugucaguucugacuguacagguuuuaagauuuuuuagacuuaauauugaaaacuaguuuuacuuaauguucuaucaguuucauuuaaaugcccuaauccaaugaucacuuucauuuaaauauccuaaucuagugagcagauagggcuuacauagcauuugucuugaagacguuuuaaaaaugcagcugcagguccucaucuuugaaacuccauuugguaaaaauggccaugucuaccuuuaccuguagauuuaaguguccacagucgcgggaugagaaaagaaauugugacacuucuugaaaaauggucucaucaaagggauucaguugaaaaugugagggacugcauuuaaacuuugauaaaaaaaauaaguaauucuaaguaaagucuguagccaaacuccuuaauugugaugcauuugcugaguuccccucuuccgucgucgggccugcucugaugccauauggccuaccauggaacauuuaacuugucagauauaauggauuguccuggaagcagauuuuugcuuugagcacucggcuccuuucuugcauuucacucucagcuccaggcugcaggaugaaggauugugguagaagugcaaagaagagacacacaguugauuccccuuaagagagugaccuauaugccacaaaauuuuacccacguaaagaggcauuauccccgucacuggccuuagcaggcugcaugucaaagucauuuaaauuucccuggacuuaacagauuguguaaacauuucagaacugagagcuuaggaauaaugaaacaucgucauuuuaacuuaggcaaaaauggugcagccauauuggccaaaggaggcauauuauuuauugugaccuacauguaacguagaccaccugguuuuuagauucuauaaauuaaguucucucaaguuuaugaaggaugcuaaaaaauauauauauuaugauggaaauguuacuuggcuuuauuguuuuuguuucgugaauagagaggugagguugaaaugaucauuuaggaaucgcuucuuagccuuuuggcuaagaucaagugaaaugaucauuuagguggagggacaguggcagcuaauuauccuaccaggcuuucuagcuugaaacuuaggggcagaccuuccauucauucuaaccuauuugaaauuagagauuggauguguuauggacuauuuaauuuuuaucuguaaaaguaaauaauguagucuuuguucauuuuaauuuggugcuuuuaugaguuaauuuuuuuuucaauuugugcuauuguuucaacaagcuuggaaaacaguaggaacaauuugugacuuuugcaucuguaggaaaacuucuuuaaaagaauaaacagugcccuaccuauauguguguguacauacauagcugugagguacucuucugguauaaccuacuguaaaccccaaagcaaauauugugauauagagacacagaauagacaauuuacaaguaaucaaucaagcacaaaccagugggaaaauaaggaacuuauguaucucaauuuauucuuuaaaugcuacauauuugauugcuuuaggguugcaaaaguuaauuaauagauuuguauaagacacacagaaauauacauacacuaaaagagacuuugcuaaguguaauucaauauacucacaaaaauauguguuaauuauguuagaaauuuaauauuuaauuuaauuccauaaauccuugcauuacaaauaaguccucauacaggucagauagggcaauaaaaacuacuguggccuugaaaacugacagaagcucacuucuguacaaaucuuuuuaaugaacaacuuuccaucgagcagcuaagaaauaucuguuaaagucaguauuuaauacuaaaguguacuuauguauguuucuuacugauccuaaauugagcacguuaguuuuaucaaugccacucaucggcugacuguaccccuccucccccauacagauuuggugagacuuaguacuaaauaaguuuggggagugccuggccauagccggcucuuguuggggcaugugcgcccucugcuggcugcucacauaggaacugacuggugugugagguucuuucuuucuuuuacuuuucaagguuggguuuuuuuuguuuuuuguuuuguuucaauuuauuuuuauacaacugaucagauauuuaccaugauuauaaaguuguagcuuaauacugaguauggccguuaauuuguuuuuauuuggaaauaaaggugagguuuuguuuuggguguguuuuugguaaauagauaguccugauaguucaaauaacaugcaauguguguaauacucuugaguuuuuuaagugguugauuguauaucacgauuaaccauauuuucauugcuuucauauuccccuugccuugauuguauuugagaaguauucuuguuggacuaaguugggaauagaacuuaaaaggggauagauaagucauugaaauuuugaaauaugauuauuugucuguaauggaugugguagguaaucccuaguagaaaaauuccuguuaugguugguugauaguuuucacuugcuuugccaaggaaaaugaguauauuuacaucauaauacuuuauaaaagcauuuuugguuuccuugcaaaccaaauuaagcugugcucacuggcagacauugagaaugguaguuugaguaaaauauuuuuuguuuuguuuugcuuuugcaguugcuguuuauagaguaugagauguuaaaggaacaaaucacugauggucucuuuacucccaggacacaggacuaaacuauacaagggcaguuacagaggaagagugucagccucucuaccauugccuggguggagagcauccuuggguccugguagugaaggccagggcucuguguaaugagugugucuuuuaaaaauagcaacaauuuuuguugacaaggcuccaucaaagucuuuauaauaauuuaguuuguauaagugauuucuguguaucucugaaauuaaaugacuugauggagucaguuugguauuuguuguacagagaaggcaguuuagauuuuuauaguucuuuugucuuacauugcaaauuuuucuaauuuguaagcaaaagccauaaaaacuuccaaaccaaccguggagugaucaaagaacuuagagcuguggaagggcagaaaugucaucuacguuuuuuuuuucuuuucuuuucuuucaguuuuuccccuuugcaauuuuagguuccaguuaccuuaaaauuuguuuuggauaaaugauauaaauuuuuacuuaauagucuuuacuuacuuugauuuaacauugucaaauaacuaagaauugcauucuaacaaauauuaaguccuuauuaccucuguuagaaugucaucuugcaugaaaucucacauacaugucucuccuguuaccaccuugucuucaaugagguuguauugggugcucuuucuuggugcuucucuggguucccauuauaucccuuacugguggauagcauuguguuacuccugguauuuagucaucuaaacucuuaccuccuugagaauaaugugcauuguugacucucuugcauccagcacauguuacacagaaagcacccaacaaauauuaaauucccuauauuguguuuuuuaggccucauucaccacuauucagaugauaauuuuugcaaguuucaggauuaaaaauuguggucuguaaacauaguauauguaaugcauuuuauuuucuugcauacuuuuuauaggaugaggucauucuucuggcuacuccuugucugcuuucuuuuuucucuuuuuccucccucucauccuucccucugccucuccucuuccuuccugugcuccccaccuuccucucuugauugagucaugcuccuagauucagucauugagaggcuucucuuaaacacugcagcaugggaccauucaucuaccaaccuuccccuuccuugaacaauaacuagugcugcaggcugguuggacucuggggaguguggcccugcguaucuggcaguuugguuauuauuaugggcccauucucuugaaguugaucuugaagagcaggcuuggcuggaaaacaucauucuucuauaaauauaaugguuagcaaucuuccuacucuuugucuuccuuggaauguguuuucaauucugggcuguuccucccacuccccuccaguuucucucaguagugcauguuuaggggauauaggucaauuguauucagugcuaaggcuagagaaaugaucauuuaauauauuacagauacguauacaaauggcaguuggauuaucuucugucugggguuaaaaaugucacuuauauauguguguuuauguauguauuauacauaucuauauaccguauauaacauugucauguccccccccauucuuuugauguaguuuugaguaucauauccaauguguauaguuuaagagaugaacauuguuauauucuuguucacuguaaacuuagcuugaaaguuaaggccaucaccuguguaccauggugcuaaaauacauaauuuuucuauauagacaacuaagugccuauguagacuacucuauaacaaacaaaccuuuuccucucuuuuccaucucacuguggcuuauuuagaguuguaucauuuuuaucuuuuacauugacuguugcuaagacucugguggaacauucaguuaagugagcagcauauaauuuaugauuaaaagugauuuguguggugaaaugcggcugcugauuuccuucauauuuuccaauaaauuccaaaauauuuagccaggcaccaaagucuugcccagaugauguugucucuauuacauucagccagaaaugucacccaucuccuccaaugaaagggaaaggaccggauuuucucccucacuguggacuugucaugccuccacagaacguggacagagaagggguagaaggacccuuuuaaaugaacgaaccaggucagguucacuagaguuggauccuggauucuaaaggugacauccacucuugagauagaagagagaugcuuucagagcagcgggccagugggucugaucaaugaggagcaaccuuaacaaaacuccgggauucucauauuuugggauacuguuguuuauuaggggaaucgauuuggcaauguaaaaucgauuucuuaaaaaaaaaaaaaacagccuucauuauuggagaugagcacauuuaaaggccuagcacgcugccagagaaagguuucucuaacccaugaaauguaacugucugaaaugaccuuggggaucaacaaguccuugucuuuuaaaaaacucugcguaaauaggugagugcuaguaguaaucuacuuuuuguuaucuaccauguuaccaggucuauuggaguuuuagcuaauguaaccuauagagcugugccuaucacuuaaauugguugcuugucucccuagcuggucagaauaaccaguggaauuuuauuugcaagaaaaaaaaaucuguugggcaugguggcucaugccuguaauccuagcacuuugggaggcugaggcagguagaucacuugaggucgggaguucaagaccagccugaccaacauggugaaaccccaucucuacuaaaaauacaaaaauuagucggaugugguggcacaugcguguaaucccagcuacucgggaggcugaggcaggagaauugcuugaauccaagagauggagguugcagugagcugagacugcaugccacuguacuccagccugggcaacagagugagacucugucuuaaaaagaaaaaaauaaaaauaaaaagagagaaugccagacucuaccgaauucacguaccauggagaagagaacccaggaaucuguuuuuaggaaaagucuugcugauaauucuccugaucagcaagguuucuuagccaugaauugaauuugaggaaauugcuuuucuccacacucaccaucucaucacaagucuuccuucugccuaagaacauagugaaaauauuuuauuucugcgugcuuuugacaccuuuagcauguauugcaagaugagcuuuuuuucauuuuuauaugaaaaacuauuauguucuuuugaauaaaaaauaagcuuucaaaugcauaugcuguuuuuucuaagaccacacaaguccuuaauugccuugguuauauccaauuaucauagacucaaacugcaguaaaaauauaagauaggguaggcaucacugugaagauguuauucacauaaagccaaugguaaguuacucauuagaaguaaguugagugauuucaggguugcccuuaguccuucaggucucuaggggacccuuguacaaauugcugauucagaaaaucauuacuuuggugguucaagugguacuuuaguggccuuaaagaguuauuugacacaccuccccaaacagcuaaguuauccccaugauuauguugauuaauugcacacucuguggaauuaguguuauuuucaaugaaagauuuuccugcguucggaaaaucaagcauaaaacucaugugcuuuaauuugauaauguguguacuucuccuaagcaggaugccaagugaggggcugauuuugguuguuguugucugggccaugugaaaucaucuaggacaauauuuuuauucugcacugaaaagguaguuuuugauggacuguaggauguucacucaaaaugcuuaucgauucggacauuuucauccaucauggaacuugagaacucuuugacuuuaugaauugaguuuaaauuauuuggggagaggauuacgguagugagaaggcaaugguuguugcuacaguaggcacuaauaaugauacaucuagaaaacuccaaacggagguggcauauugugggaaagccuugguacuggaacuggaggucugugugcuaacuucaccacuucauaucugugcagccuuuuuaacuauaugagcugguuacccuuaauuuuagugacuucgucuauaaaaacauggacuaaaaugcccauuuaaugagcuuuuaggguguguugccuuaaauaauguaaguuaaauuugcaugcgagauagugcauuacaaauauaagugcucuauggagaauugaauauagaaucugaaauucuucacuuaggcagagcccugaagugaagacuuuugguggcaccuuaagauacuaucugggguuucaguacccacacuguguuaaaggcagcacaaugccuagaugagaugaggggaaucagugaugaaaugcagccaaaacuccccaauuuccagugggaucagagcuauaggccauuacugaguauucuauuuuuaggacuaaaagaacaucagcggaagagagaguuaaugccagucuuuuccagaaaaaaaugguuuacugcccauuuuucauuaucccuugauacauacaagcuaugugccuaguuaguuaccuuuucccccauuugucuuuauaggauuuccuagguuguuggaugacuaguuuauuugcuggaauggaguuguaauucuuuuagcacaaauuuauuuuacauuuagauuuuuaaaugacuguggaugaaggcagaguugucccuguaucguaagauucuguaggagagaaccaguacucuucucugaaauguuggaaauugaaagaauaaugucagcuucugcuuuuuuguaaacccagagucucaccuccaaacugggaucaggaguaaaguugacuagcuagucagaacaaugaagcuauaccugcauggccacagauuaccguaagacauauaagccaauagaaaccagcaaauuaaauagucaaaauguuuucauaucaauuuaaauaaaauaaaaauuuaauuuuugaaccuacaucauuuaucugauagaaaacuacaaauauauaguaaccugauauauucuuaguguuaaguuguaaauaauaguaguucugaaaggucaucagcucuuguauuaauagacacaaaaaagauggggacgggcauguaugcucaagucaguuuaggaaacauuguauaaaacuaaauugaaagccaaguacagugucucaugucugugaucccagcuccucuggagagcagugcagaagaauccuugagcauaggaguuagagagcaccuuggguaacauagugagaccccaucucauuaaaaaaaaagaaaacccugaauuaaaugucuuaacugcaguacuucucaagagucuuuaacaugcuagauacaauguaaaucuguuggggggcagggcaauagcuuguaacaguucguagauucuuuuaauuagucucccuuuugguuuuuggagcccguugugggaucacuauucuauagaugacacugagugaugcuggguuguccuguauuauaauuauauuuuuacuuuuacucuucuguacaucuuaauacaaagacauagucuucacauagagguguagaaaugcaguuuucugccauguuuuuguuaauuaguugcuuuguguuaaugugcggagaugguggcaguuuauuguaagaugucacagaauccauguguaucauuugugcagcuauaaaguaccuagagaccuuuuaggaauaaaacaccauguaaauguaaauuaucauugccuauaagacacuuucauuaauuucauaucaaauucaugaguguuuugagcucugggauuugagagucuucagugucgggccucuaguuuauuuauacuuuuuuuuuuuucccccagaguuuaaacaccagcagcauagcauagugcuaagagcacagucugggcaaacaaacugccaggguuugaauccuggcucugucacuuguaccuguguggcugugggcaauuuucuagaucucaguuuccucaucugcaaaaugguguuucuauuaccugccuuaugggguugugcagauugaaugaaucauuuuauguagagcuuugagcagugguuaauacaugauaaggacacagcuauucuuauuuggacagggaaggaaaaggcaggcauggaaacgaugaaggacuguaaauaauaaccucauguauguguucagaacuacuaaaaaguucaguuguuguuuaaugaacuaguccuuucuacauauauauagauucacaggguaaucagagauggaugggacuggggauggggacagaaauuuauucugagucaaacauguuuaugaugaguucccuagucugaugccagggaacaaaaggcucauucuucaguucccagaaugaggauuaacagugaaacagccuugcuugguguuguccugcagcaucagauaauuuuucaucaaggcguuucacgggaugauauauucucccauauagaugaaucuauuucagcggugggugaaacaccuaccauuuauauauaauuuuuaaaguggcauuuuacaaaugaaaggcuacacaaccaaacaugacccuguuauuauccuacuggucaaccacaagagggaucaucucuguuagagcuuaucucuagaaaucauuuuauugauaaguugcucgucugucucuagcucuuucuaggugguuuagaacugucauguguauccaggggcaguaaucuaccaaaggugauccuucuuagaaguaucccuaugaguggaauggauuuaugagaucauuuuuuucccuucauguaauauuuucauugucacccaguucccuuacaauaggauaccauggauguaucggaagaaaaauuggaagucaaauggcugauaauacaagaauauaaaaauauucaauuugaaauucuauagacauuuguuaaccauaucacccucaaauaaaaagcaaauuuuccugcuccuucuugggacagcaagauaaaagauuguugaauagaucagcaaaacauugacuuuuuuuuuuuuuuuuuuauauggaaguugcuugccuuuccugcucauauuaguuuuucugggccaggggaagcaagugaauccuuuauugauugccauuuggugccauuuuuaauaaucaaauuuaaauauaggcuuuagcagcggacggguucgauuuggacagaacacauguugacuuccuggacuguuugcucacuggagaugccgacuuguucuguagacggggcugcauguugaucuccuuugucuccagaaggauugauugacggauguugugucugcucauuuacagcguuuuccuuguuuaauuuaaaaaauugugacauaguauuacauguucccuuguauacaucauuuuugcagaagaaaguuguuuagccaauaugucgacuuaguuuaugaaauccucucuauagcuuucauucagcccuucguguacuccauuaggucauauucauuucaugcacggcaaaucgucaccagcagcaaaauuuaacauuugguccuuuuagguauaaaaaugaaucaaaugccugacaagauuuguuucugguauauauuucagaaucuccccccgccccccgcaccaaccccaucuuuaugggcauacaacaaauguuacuaacggguacuuuuaguuuuaaaaauauggacaacaguacuccaugcaguaaaagacuugagcgauuaaugcuacccuuaugccucuuuugaguaguuuuagccauggggcuuggcacugccaccauugucuuugugccaaaaaauauccgcagcggcugucgcauucuaguaccggaggguugucucgaaaauuccgcagugaacgcgccggguuuguucaucacugcuaucucuuuuaaauauuggaaaaauagaaucuuuagcucuuucaaagccccguugugguuguggggauggggggaggcggguggugaagaauggagaaaggaggaaagaggcuguccgcgccagccaguugguauaagugacaaaaauccaugccugacauagaguaaacacagauauuuaagagcuuuuguguucaugagcacagauaguuacuuaaggauccuacucaaacauguuaucagcgcucuugaaaauuuuauuaucugaaacaaauguuccaagugaauuuuaagcagaaaaucaacaucaagaccauagcuaauuuuuaauggauaauuuacacaaaagauaguuucuuuucuagaaacugagguguccuuuuaaaauggcugcuuuuagucuuuaaaaaaaaugauaggaaucgcgauuuuauguuugagaaggugcgugggcuuuauccacagugccugauuauuuugcucccaaacagggguucuggcucugagggcagauuuauaguugaauuggggaacaaaaagauguaauaaaguuaaaagcuuacacuaucagaaugaaauguguuuguucaugaucucuggaccgaucuauuugaugguaaaaguggaugcuacagaugaaaucuuuacaaggagcauaauccuuaaaaaaaaaaaaaaaaaaaaaaaguccaccucccagccuccugcuggcugugcugccucuuugguaccucgcagacuucgacagagcccuggacgggugcccauugaugucauggaaacacucaaauuacugagaaugauucaugucuaugcuggucucuuauccucccccacacaaacaggaguagauuuuuaacccugacaacuuguaauuugcaguggguuuauuuuuguaucuggauaaauauuuuuuaacaagcaaaauuaagauuaagcagucuguaucugauaugauaguaaagaaugcuggguuccauguagccaagaguacuuuggggacucugcagcgugaauucauauucuucuccuccuccucucccuccugccucuuucuuuuccuaccucuugcucuuugcauuccacucuuccucucuuuguuuuucuccuacuuauucucucucuccuuuuaaaauccugcccuuuuaucuuuaaaauaauggaaggaguagcccaacuuauaucuauaagugaggcaaauccuggcagaaagauuccucccuccuguucuguguguuggagucaaguugggaaauaaugcugaguggugaaauucuacaggggauagcuucaggaauuccuucuagagaaaaaaauagaugcuuuuucuuccuuaaacuguauuuuacaauuuggauuuuuagaaauuaccaaaacaggacacuagauguucaguuucuuaggaagucagagcagauucuacuuuauccaucuuucugucuuucugccugccuccuuaccugcccagcuuccugccugccuaucuaccuguuaaacaagugaauauuacaucaaaguaagugauguaauggugauauugaagcauucuuagaugcaagagcuuaaggaaggacacgcguccuuugauagcucaugaaggucgagccuuuucuguuaguaauauuuauagagagaaguuaaaggguauaaguagcuuaaauuugauguacacagaugaguaaauaugucuuugugaccauucacacugcugauacaaguauaaauuuaucuuuucuucagugcaaaauccucauacaauggaaguuauucuguuagaucuucuaagacugacagucugugcgauggugucuuguuucacugaaauugaaacugauauggggcauugauuuuauacuuugcgcugagcgcuagaccagaaauggggcggagguguuuucccaacuuuaagauucauuaaaaucaguagaaaaguuaauacugggaaacgggguuaauuuuaagacuuagguuuggcuuucuuugaaaaccaccauccauuuuauauauguaaugacuuggauacaggauacccuuuugaccacauagaaaaauuuauggauauaaauguaucaaagauacauucuuuguguggggucaggaaggcauacucuaauaacauugccauugccauugaccuaaaagauaaaaagacuacuguuacuuuuagcauucguguugaguugagaggggaaaacuuggggguuguaaacuucagaaggaaaucuauucagccucucaaaauacaaguuuagaguuuuccuguuggaaaaaggaauacuguaguccuauguaucaaguacaauuacuguaaagcuccagucuugacgaaagaaguauccuuuagacuugcgugggguggggucuuaggcaccugccugccucuuuuagccccuuuuaauguucugguauggacagauuucuacaaugauucuccacaugucacuaucuggacucuacugcuuagaucucuuguaaugugauuucauuauccucccuaaugauuauugggguuaaacuuuaaaaagaaacaaaugaacacccuugauuuuauucuuagauguggccgaauagcaucgaagggucuauagaucucuguagagcagucuacagauaaaaauuggguuguuagaauuggaacaagacauucacauuccaugaucccuuguccugcugggucuauugguggaaucugaacuuggguucagaguaggcaauuuuucaaaagcccuguuucccaaauguaaauuccaucaucaucuugaucaugaugggguucacuccugggaaagggaguuuuuaaaaaagagagagagagagagacucagaauuuugaauaguuucuuugcuaaauucaccaucuggagagccugugauugauuaguuuuggccucacuauuaagugucaauauaaucaaugggaauuacuaggcuagggucauuacauagauaauuugccugcuguguaaauaaaaaugaaauuguuuaaauuuugugcaagagaaagugaaaauaaggaguuacgauuuguuuguuagagaaaguggaggccauuggaaugacaguuuuuggaaguguggagcaguuuggcuaagaauaggaaugaaggauauuuuuuuccaguuuaucauagccagagugaggaaguguuauucccucucuugcuugcauacauugccaguagugccuacuuuacguauguaaacaucggggaagagcaguagaugucuguuaccuggaggagauuuuuuuuuaaggaaaaacacaauuuacacuuuuuugucguuucucuuggcagguaaaacagaaaggggcucauacucaucuuaugggagagaaucaaacuuacaggguugccaccagguaagugagaaucucuguugcggaaggguugagaggauuaaccugguaaaucaguuuguuuucuaaauuagaugaugcauuuuaaacugugacaccaaagaugcaccggcaagucagaugauggcucucucuuuaaguaaugaaauaacacagagcuuagaacuaauaaacaccucaucuuuagaucgcugcuguaucagaacuacauucaugggcuuguuuuuauuuuuuaauccaucagccgguaccaguggcacuguuugcaaaccagcaaugucggugaaagugguucuauuaaaagaguuuauuugcaauuaagaacuuaagaauuucuuacgcaggaaauacuucgcggagucaugugucagacccuggguuucggguggcuauugcccuaaauuauaguuuucauaggggcuguaugauguugugugaaaacaggguuguauugagggauaaaaaugucugugaaaauaugauuuguugucccuuuuuguuucugaauuguuuuuggcuggaagucaaggccagcaggcuaacagcaaagccgucucaagggaagcaugcgugagcuagaaaaauaagaguacuuuaauuaaauaauaaaaugccaguguaauacaaagguauagcauguguguguuugugucucugggcacuuugcauuuguauacuuuaaacucuccagagagagccuauuucuaaaaauacugucaauagcuaaaaguauaagcuuuguuucaagacaacugaguuuuuauagaugcuuucuuuuucaguucaguaucaguauuaaucauguauuuaaaaucuuuuuuaaaaauuuauacuuccuuuuuauaagugcauugguuucuuacuuuggaaaacucuugauggaauuuaauaauccucuuuaauauucagagcucucuacuguuuuuauuauucacgcaaacaaaauguacuuuuuuuuuuucaaaugcuggaaaggggaugcuuacucucuugaacucucucacccucugauguucuugaugggggaaaaaaaucuauuuuaauuuuauuuuaaacagcccauuuaauauaccccugaaaaauguaagcaaaguuuuguuuuuguaauuaaaucgagccuaugaggaaaguuuccuuuacguaccagacauaggaagguacgacuucugguggguugguguguuuguuuuuucccuguauauauuugcauuuuuaaaguuuacucccuuggcccagccaccaauucagucauauucggcaucugaaagauuuguugcauugaggugaacagugcuugguuaagagcuccugccggagugcaguucauggcaguuuguuuggaaagaauucugcaggaaagaaauuuacagccauuccagcgcaacggaaacaucuuuggaaugugagugcaaauguucgggcuagauagccugggcgacaagccucugagugcugugucucugguguaaagcucucaguuccugcagaagaccguguuccugugggucugguuucugagggucaaggcggaggucauuagaguuuuggggagaagaaaguugacaacauccuuccuuucugcagauggucauggcagaggucucuguuuucgcugggccccuuuuucuggucauugagagaauaggcuuccucaccccuguauccuuucuuacuaauaggaauuggcgugauuccucacagacacaaagauuuccucugcugaguaagcgugaggccccuuaacuugugaaagcaucauccagaccgugugagucugucuguguaugugcagaacacagacccuccuuucuccguuuguggggaauacuucccucgggugaaacugaaguuaauuuuuuuuuuuuuccaaacacaaggugagaaguggaaaggggcagaggguggaagagagguggauggauuggcaugugauggcugaauuucugggccuugggagguucguuuugaggcauuaauguccaggaaaauucuuuuguauauagcacuaugacugcauaugcuuuucuuaaaaagccuucguaauguagccguggaguguggagauuccuucauucuuaauuugugcuucaugguugugagucuugcaagagucuacuaucucugugcuuagcguggucgcagcaaucuccauaaacagugugauuacuuagggauaaauaaaagugaaauuuuggaaauuugcugacagagggaaaauagggacugaagaugaaaaauguacagaguaugaauuucugcuuucugugaaauuugagaauagaacagaccauagugugucuuccagugaaucaguuucucuugugccguauuguuauuugaaucccugucuacaacaucagcuaugcaaaccaaagagaaaggcaaaaucucaguaucuugggcuucaagucuaaauagcagaucacagcugaaaugauuccccacugugugacaaggugagugacucguggaggggaggcuuuuguuuucuucuguuuacuacaugauugagauacggaauaggaaaccuucagauggugugcccuaaggagcuccaaaagcugcuuuaucguauuauaacaguguauccuauggacuuaaaggggugagcagugcuauauggaaacaugcuucuuccagucucaauagccuuuuguuugguguagagacagaguggugguaagcaacagguagcaaagcgcuguccuggaggaauacauuauuauugugagacguguguuguuucagaaauauaucaaguuaaaaauagauauauauuuuagauuucuccuaaggauuuaacacuaauacugauggacauaugacgcuuuuuuaaauggauauauuuuagcagaagaaugaaagccggcagguucuuuauuagcaauuaaguuguuuucauuaaaaauaguaaugagauauuauuucauuaaugcauuuccaccugaaguuaucagaaauaaacauggugacuuuuugagacuuuuaaaauuguguugaaaaugaaucaauagauaagcaaaaguagccaaacgaacuuuuuugaguucuuacuaaauaugacaaaacuaauuuaaaucaaauugggguacagaaaucacacccagcuuaacauguucuugccaaaugguaaccucauacuccuuuuaacuggcagagaaaaugaaauuuauaauggaaagucugacagaaacgaaaaugagugggaauaaaguuuuuugcaagcuaguccaaccuuaauacuauaauagccaauaacuaaaacuuaaugggcaucauugcaaaugccagaagggaaaaaaugucauuuguuuugguuucuuuuugcugcuuugaauagaauguugggugauuugcaaacuuuuaaauuuugcuaaaaucuauuuuuuuaaugagaugaugauaucaaaacaaauacuuguuauuacuucuccccuuaaauggaaguuuagaguugauuaucaggaauuguuuguauuuucuuucugggauauagcccaggucuaaagccaugguuucauuuuuaguauugugugugugugugugugugugugugugugugugugugugugugugagagagagagagagagagagagagagauggggagagagagagagagagagaaagaaagcugccuaucugagaccaaucaaauuagaaucuugugagcugggccugugcuuuucugacaacuccccagguuauucuaaugugcagcuagguuuuaucauuuccuagaauguucuguagaaauauacccuguauuaaugacuuguguucaacauaugaccuugaaaaugcuuuuaggcuuuuugcauuaauuugauuauucaaggcauggaaauauauugcauaugaacuucauuuaaaaggcagugaaaauuagugauauagugaaaaucuucaaaucuuuauauagaauuccacaacugaaugucccagcccauaucuuguuuucucuagugaaguccaaggcuuuaaccucauccaaauucuuuuucuucuucagcaagugaucaaauaggacuuugcugauacaguuauuuaauguuuacaucuuaaaaugacuaauggaauuuaagaauuagaccuaaucuaggagguuguuguuaauuuccagaaacuuggagaccagggaggaaacauauuuucuuaguuugcccauaggcuugcucauuuuugguucaucgaaauuaagcauguaguugauuccaaaaugaauuucacauuucagaauugauuucuuugucuuguuauuuuuacuuuugauucaauagguauuacaaaugacuuaauucuaaacuuuuggccucuuuuaguuuuucuuaucuaaagucaaaauagaaaggauguaagugaaaaccguacaaaauuauuuuguuuauuacgaaauuggcaauugaggccaauuaggccuugcgcaagcagaaauacacaucgcuuuuuaauuuacuaagaugccuaaguguuuauccugaguguucagcacauccaucgaggucuuaugcauccuuccugggaagcucucccuugcagggccuuagcaccugucuucaucgugcuuuuuaaaauuugccaucauuuuuauguguuuguugcaugcugauuuccacaggauucuguaaacuccuggagggcagggaccaugucugcuuuauccugaauguguaccaugugccuagcagggcaaaaauugcaaugaccuaguguuucuuuccucagcaucacuuuuggaagccauuuugagggaguaaggucugaauagcaauguacaugaaccauauugugagcaucuuuuucaugccuacgaaaaccagaaaacugcacucucccaaaaaaguccuuuggaagcucuuccuucuaacaugcugugcaggcucuggaaggacaccaaagucauaccguggagagacacccacucugacuuuuugggggguugaaucgucucauucaccuggugacuucacuguucuaggccuguauaucuggaaaggccugaaugagggaauuauagaugaucugugguucuggcagagguguuguuggaaccaaaggucagcauccugguccgaacauugaaauguagcagugugaaugguaggacaggauauuuuaaauugugacaguuucagacaucacagggccugaguuugcaguauauaugucaucgcagcugugucccugagcgguauuuuucgggcagcggcuuauucauuuugggggauuguuauggguauauacccuucuuucaaaagucagccgguacuuaucaaaggggagaauggguccauucuuucauugcauugguuaagaaauacuuauugacccuguagugguguguuagauacucaggagaaaaaccaagggaucuuguauaccuucccuucuauccccaccagcagcuuccuggauguuaacggggaaaaucgagcucuauuuauuuauuuuuauuuuuaaccuuacauagcauaaauuuuugagcauccagaacaguugaaaaaauaauaaaaugaaugccacauaccugcuauuuagguuaaacaguuguuuguauuuguuauacaguauuuucuuguguguauguauaauauguauaagaauacauauuuuucagugaaccaaccauuuuaaguugcagauuuaauaagaaugcacccauagauuuuucaguacaugucucuuaaaaauaagacauuugccuaacuaacauacuguuauuaucccuaaagagauuaacaguaguuucuuaaucucaguccauauucagauuucuucaguuguccucaugcaaaugucuucaguagcuuucuuaaaaaaggcaacuaaaaugccauuuacgcgugucauuugauuucuaugucucuuuauaauuucuuuuaaacuagagcuguuccucuauuuguauucuuuuuuaaauuguguaauuuauuuuuuagggaugggguaucgcuauguugccaaggcuggacucaaacuucugggcuugggauuuucccaaguaauuuuuuuguugguuuguuugaaugauagugacuuuaaagagaccaggccaacuguccuauaaaacauuccccuuucuagaauuauuagauuucguuuccuuguggugcuguuuaauuuuguucaucacuuguuuugccuacaaauuuaaaauuaguucuaaagguuuaugcagguucagguuaaacauuuucggcuggaguacuucauugggggugcuguguauaucaaauuacauuccaacagaauauugagcuaugcugcuguugguaaugcuaacuuuaaucacuuggcaaaaguggugaccacuggauuguuccauuguaaaggaaucuuuccccaucugcaauuaacaaauagucuuuguauugauacuuuagcaauggacagauaccccuuuuucccaacaaccuuugaccuaauaguuuuagcacacauugaugacccuugccugaaucaguuauuucaacugaagacuucaaacuggugauucuuuuaaaauuccaucauuccuuccacauuuauagcuaguauucuucuauaaaagggcaguuucuuucaucauucauuuuaacacuaucaguuucauguuucauauuuuauauaagugucauaacaauuacuguuucuaauguuuccuuaccuggaggauguuggaagcauuaaaguauucuugaaaucucuuaagguauauugauaagaaaaguaguuauggcucaggcugauggucagagaggcuuuaauuguaagaggagggagguaauuguaggcauguuuccuuguaaacuaaacuucaguauucuuuuggugaaauuuggaaccuugcaacaaccucugugccccuagcuguguuucucugauucucauauugccacucuauaauugcuaguaaacaucucacaagguugaucaucaguaguugacuggccgacucgaggggguugcuguggugcucugugaagcugcgcuaucagggaucagcuaauaaucccugccucaguccuugcacaauccagacaugguugauagugaaugucaaaaugagugaauuucuaaaagauaguuugggcuuaaucuaaaggaagccugaguaacuaguauuaggugccaauauaaaucucugaguugguuaauauuauugucccuuaauaauuaagaaagggaugcucagagaaguaaagcaaguagaccucaaaucauuugcuucaaguaaguuucagagccagacucugaacucuaagauguuuuguuucaaagccagugcuuuccaacuuggguucccugcuacuuaagcccaugaaggaguuuuuaggcucagaaguccauauuaguucucaucuagaaaacccugucuggucgauuccaggcccacugggggaucugggccugacacaguaucuacaacagaguagcugcacucagcuccguucaggguuagcuagaacucugaacagucaguagggaaaggcauagcggagggcagaucgcaucguuccugacugcccagccuuaagggggggaaaaaaagauuauaugaauaaucuauucaguaacauccucagaauuagcaugugcaauuuccuuaaaaccaaugaggauuuccugugaaaaggcugggguggaauaugccaauucacauuuuagcaacagcgugaacacuuucuuaaaaauguauagauuauguuuuggcuuugcuuuuugugcaauguaggcagaauaugguuugcuauuauauaaauuuggauucauuauagaucacauuauuguuccaaaaacacaagagcuacauacagcgagauucugaaacaauaccuuuagcagguucuuaaauaugccccaauaauuuuucgauuauggcauuuagcccucaaguaaaauauaugaaacaacagaauaugugcuaggagcauaggcaaguuuuauacaacaacaguucaggcaguuagugcauaaaaagccauugaaauugcuuugagaugauuuaugagacaccgaagaaauggacuccuaguauccaaauugaaauuucaccagaaucaugggauuaacuucucuuuucuuaugaaaaccauuaagcguuuuuaaaauagcuucuagcaauuaggacuacaguucuucaucuuuauguuucugauagguguaaagacaaaggggaaaaaucaauuaaugacuaaagaaauaauugauuuaaugcugagguguaucugauauaauuuaauguugaaacguaucuacauaucauguagagaucaguguagcucuauagccuccuucuguaagaaaggcaguauacucaaaauucaacaucaggauaguguuucaaugugaaaugacagaaauauuuauugaacgucaugcuugauauuauuuuauuguugagagcuuuuuacugaaacucuuuaaaacugaacccccaaauuaaaauauuggcaacacugaaagauagcaacagaagccuguaaucugaaguaauggacuuauuaaggacuucagaaaaaaagacuuuagaaaagaagcauauaucguugagucugcugccgugccugauagugauaaccugcuuagaauugaagcaccccauucuuugaaaaauugugugcgcucuguggauauugacguggguuuguuuacaugugcuuucacucacagaucaacugagcuuccuaaagcauggaccuuucauguucagcguguuguuuucuaaucucauagaaguaguuucauagggaggagaaaacagaaaccgacaagaauauuucuuugcauuugccuuagcauuuccaacaugcaaauguugcuuuuuucauaguauggcacuuauuuuugucagacauuucuuguacuuaacaaagggcaaaguuacauuuuggcgggagagcgacuuucgcccggcacuucaccagaucucguugaauagaauauauuaucacuguuagcauucuuaggguucuuaaugaaagcuacauacccuuuaucuccauuuuccucuccuuuuagaagacaucuuccaaugaacaauuucuaugacuugaauaccagauauauguuauuuucaagcuaccucaaagccauguuuauaugcauuugcgacaauaacaauuccgugcuucggaauaauuauguaggaguaucauugagguuauuaggcaggacccacccucuagaguucuguacaugggggggucucuguguguugggguuuuacugugcaagcacacagaauauccugagcucauuuguaccaugauaaugaacagcagggcacugaaucuuuuuaguuuuauuggcauuguauacaguaaguuauuaaauuucaucucuguaauauaccugcaguaaaauaacaaaauauuggugcacuuaaagaacauguguguguggaacaaugcccuccccaucauuucagcccccugcaaacagcugcuuacagauuucaagauccauuguauguauucccucgagcccaccucuaauaaucgagacacaucugccauugcaguauuauaggcauauguaguuuuauugaaaacuauaccuguaaaaaaauuaaauaacuccugccucaauuaaauuggcaagcuaccuuuugcaaagaucauauugcagaccucuugagacccaagugaguucauuuuauucuuacauuacaaaucacuaaauauguuauuuuuauuuagcugaguagcuagcuuuccucguacuuugaugguaaguuacuuucauccauucucacuuuuguuuuccuucuccccucaucuuuacauauuaaaaaaauuaugcaaauugcaugaagcaaacauuuugagaaucugaacagaauaaaaucaaagggaaaggacccuaacaugcagcuuuaacucugaagugauuauuaaauaaauacaugcaaagguuacaaaauuggggucaaauuuauaacucacguuguggcuugugauuuuuacaaacuucuuugagauccauuugaucaucauaaugguagaauaggaaguaauaugaagaggaaaugaguuaguaggccauacaaagcauaugcagaugaauuccuauuggauuaaauaacuuaacacuuacucuuaagaaaauaauagauacgagaucucacucuaucacccaggcuggagugcaguggugcagucauagcucacugcaaccuugaacuccugggcucaagcaauccucccuccucagccuccugaguagcuaggacugcaggcauauaccaccauggcugguuaacuuuuuuauguuuuguagagccagggucucacguuguuguccaggcugucucaaauuccugacuucaagccauccuucuaccuagacuuuccaaaaugcugugauuauaggcaugagccacugcacccagccaacagucuuaauacuuguugaagauugagucaguaauagaugucugcaaaauaguuuuuuauccaaagaaggaauaagaguaaaauauuuaccgauauaaaaaugugagccuaaacuuauuuuaaguuauguaagguaucuguauaggucuucaugugaguuaaucaugccaauauauagugauuuaaccaagaagaauuuuuuugcuuuauauuuucauagaaaaaauccaaaaagacaaguugcccacuauaugggaaacauauauguguauauaucguauauaucugaauuauguaugucuauauauaugaaacacacacacacacuguuauaagacaguaagcagguuccuuaucuauaguuucuuaguuaaaaaaacaaaacaaaacaacauuuugugcuauucagaugaacuguguauaacuggaccgagggagugguuagaggugaauacugucccaaagugaacauagagucagaggaaagacucuguugaaagucagaaaguagaugauuucauaggaucaagucacggauaaauaugaggugaugacuguuauagagaagguagaaaaucgaaaaucaagcagugauauucuuuuuuuuuuuuuuuuuuugugggguuguuggggauugggucucuauguuguccaggugggacucaaaccccugggcugaaucagucuucccaccucagcccucugaguaguugggacuguagguacacaccaccaugccuggcuuguaguagcaguauugacaaccagucaggauagaaaauaguuacauguuuaaauaaagaauuuccuucuuugggccgggcaugauggcucaugccuguaaucccagcacuuugggaggccgagguggguggaucacuugaggacaggaguucgagaccagccugacgaacauggcgaaaugccaucucuacugaaaauacaaaaaguuagcuaggugugguggugcaugccuguaaucccagcuacucaggaggcugaggcacaagaauugcuugaaccugggaggcggagguugcagugagcccagaucacgccacugcacugcagccugggugacagagcgagacucugucucaaaaaaaaaaaaaaaaaaaaaaaaaagauuuuuuuuuuuucuuuuagaugaagucucacucugucgcccaggcugcagugcaguggcacaaucucugcucacugcaaccucugccuccuggguucaagcgaugcuccuguuucacccucccgaguaguugggauuacaggcgugugccaccugggcuggcuaaguuuuuuuuuaauauuuuuguagagacaggguuucaccauguuggccagacuggucucaaacuccugaccucaagugauccgcccaccucggccucccaaagugcugggauuacaggcaugaaccaccgcgccuggcagaauguucuucuuuuuugauaggaauguugauucaagucagugaguggucguuugguuccacuugggcuuaccugggcccaggagacucugcucacucuguguucucccaggguauuuugugccccacugcugguucacagagaugccagguuucacggaauggagggcugaguccuagagagggucaucacuuacaaguaagauaucaaacccuaagggaaucagaauuuaaagucuuagaaggguuucaguuuugucauauagaaaaauauugaaaauuaaaaaauauauauauuaugaauuguaaacaaacuuuuugaucaaaacucaugaaaguuggggaauacaccuuaacuugcacccugccacugcuuugaagucccaucccugggaugugguucacuccuguggaaauauauauuaucuauuacauuugaacugugaauuguguuugucacacugagcuaagcagcucagaacugucauguguagagugacugguacaauacaacaucaguggugguaaaagauuuguauggacaaugacauguggcaaagaagaaugucaacagcugccacugcuaugacaucgucccucaaggagucuuucugcaucucugccauguaacugucucagccaaagagaaggcacuaacaugaacuucuuccccagaaugcuacucccaacuagcgaccacguaagacucgcuugagucuuuuuugagggugcaaguccugggugccauuugucaccggaaagaacauuuaaguuuggaguuuuauguauagagggagggauuauucuuugauuuauuucgaaagaacauguucuuaauguccuuuugcagauaauacacacacccuaucaguuuuuggacuccagacugucuccauccauaugucauuaugaagcagguuuuuaucuuauuaugauuuagguaauuguacuagccucuaaaauuuuauaauguaccuuucagaagcucauagaugccaagaucagaggcuccuuuggaguuccaucuaauauaucuuccuuagccaacugguacagauaauuuuaucuuuccucuagauaguuacacauauagcucuagaaauaaaauguaguuauccuaaaucagcuguauagagccuuaaccagcaaucagaccauuuagaacauucaacaauaauacauucuaccaaacucugacuuucuguguucaguagauauuuauuaggaaacucacccugugucccacugaagauccucacaugcucucuagguagaugacuucagcuaauaguauaguaaccaugaggccuuaguauuuaugacuuuucuuuucuuucuuucuuuuuuuuuuuuuuuuuuuuuuuuaagagucaggguccugcuguguugcccaggcuggucuugaacucccggccagagugauccucccaccuuggccucccaaagugcugggauuauaggugugagccaccacaucuggaaguauuuaucacuuuccaaauucguauucuuacauguguuuggauuuauuuuucaagaagccagaguaaaauuuggcaauuaccaaauugugaguugagaaaaauagauaauucaccuuugguauugugcuuuugaauuugaauuccauugauuggauuucaguccgucgggauuaguucuuccaucugugucccuuggugugaugacugacucccagccaccaucugagacugcucggucucccucaucuccaaaaguccucaguuuccagaucucaucaauucugcuugcaagauaccaauaaaucugcugcugccuccuagacccccagucaccaccguggcugcccgugcugcucugaucccucuacccaccuucucccucacaugccuccuguccacugcugcuggagugacagucuccacaaaacauuguuccuuggcuuuggggccuguccuuagcauggugguauccuggccccuguuucugccugcagccucagccuucguacucaccauucacaucucauguuccagcccuacugagcugcuugcaguucccucaagaguucuuucacgguucucucugucuuuauaagaaccugaaauaccuuugccuugccuccccuucuucuugccuuacaucuguucuaccagcuaacucaccugcuuuguucaagauucagggacccuggauguuauaaccagggcagagcgagcugccucucuucugugcucaggaagccuuuggagcacuucuuuuuccucacagucaucacacugucuacagccagagaagggcaaaggcuaggggcaagggcuaggcuugccgucucuaucugcagugucuaacaggggcacccaggaagugcuuguuccagagucacaggauggaugagugaaugaaugaaugaacuagcaauaguaagaaauuguaugugagcauguaacuuacuauauuuaaauacuuccaugcaaauuucuugacuuaaauuaaccaugccaaugaccccugaggcuggauuuauuuauuuauuuauuuuuugagauggagucucgcucugucacccaggcugaagugcaguggugugaucucggcucacugcaaucccugccucccggguucaugccauucuucugccucagucucccgaguagcugggaccacaggcgcccaccaccaugcccggcuaauuuuuuuuuguauuuuuaguagagaugggguuucaccguguuagccaggauggucucaaucuccugaccucgugauccacccgccucggccucccaaagugcugagauuacagcugugagccacugugcccagccgaggcugggauuauuuuuaauccaguuuuauugauaaagaaacugagauuuagagagauuuguuuucacucugaaggcagagaugggacuggggaacaaacuccuuuggauccagauuuggcauuuucuuugucacuucuuuagcacuggauaaaguugguguagcuuugugucauagcaaguagcccacagagucuuuucauagaugguuccagcucucuauucauuauuaacuuagggaucauucauggaggcacuuaccuaguuaccaggcugagaccucugucugccaaugagaaaaaaugugcauuucuaaagaggauaugaagaaccuagcaaucuguauaucaggagcauugucuuuacauagacaaaaaagaauauuuugaauguuuccuguaaguaaguaccaguugcaauagcguggugcguaccgcccaugcuaucuauugcccaucagugguaccucuacucucugguuguggugaaaaggaccaugguccuccuggaaauuucuggcccugaagcucaggggagaagugcaacaccagccacaucucaucccccaaguuucauucuccuucacucucccugguacaacuuggcagaggauggggagaacugggaagaaguggaugcauugaguagaucaagcuuuuccucuucauguuuacuuuauaugauuuuaauuuuguaaccuuguuguaggacauaaaaaaugaaugacaguggacuuagcuuuuauuuauaacauugaaauccuuaaagauagaauguuagagucagaaaggaccuagacaucaucuggcauccagugccgcuuuguagcaaguggaaaacuaaagcucagagauguugagguuggucgucaucacacagcaagcagaccuugcucagacacagccacacaauacaaguaaaauuccuagccuguaacacggaaguuuuccuuugaugucuuuguacccgcuuucuuccaaagagcaaaaggucaccuagaccaugaaguaauagccagcagcagccggaaacacauccugaggaaauuucuagacgauugucccuuuguuaagcuaccauugaaucauacugucacagagccagagggugucguuugcuuguaaauacugaguuuuugaaaugucacuguaacacuggaaaaauguugucucugaagguugccaaagugacagaaucccgacauuguaaauaccagccaacacaagugcuuauaaaugacaggaauaaaauauacuugacuaaauccauaauaaucacugauaacacuguuuacccucagugaccaggagcugugaacuuggauaaaaagcacaugugugcagauaucauuaauaugucugagccucuagccauuccagaauauuuugauggaaaagcucccuaaauauguaaaagcuuugcaauaacuaagaagcuaguguguaagguagggugucagucgucccugaugaaacuagagagagccuugacuaucuucagcccccagaggacugauaaggccucccuuguucugguuagacccaaacucugagccaggcuacuagggcaggcaaugcuguauuuucaguagaugugauucucagaaggcccauuugccagaagcaugagcccacaccuauaucauguuccauggagaaaauguggaaugaacuuagagauuaaaaacuuuggagccauaagugggaggaucccaugaacuacccuuugacuuucaaaggguggauggguggucagaccuuuccacaguccuaauacucuauagcccaggcuuuuucuuaauaauaacuuccuccucucuagaaaugauucucucccucuuuuuucuguucuaguguaaaaauggugccuguguguauccgagucuuuaagaggaaauggacacauuggcaaaccagugccuccuuuggcucugugauguggcugcuguuacuacucaacuggagcaccccuuauauuccagucuccccagaaaugcucaggaacaguggagacucaaugacagaggguugagcccuccugguuuuucaacuggugaaagagaaauucagaugguuaaggagauagcagaguagccagcacuccgggagcugcucuuaucucugcuaugaggcugugcauggggaagaguagggcugcuuggaaugaccuccuuacuuuucauauauugaaacauauuucuuuuuccuugauaugcuccuguauuguuugaauuuuauuuuauuuuauuuuuugugguaagcauuguuuucuuaauuaacaaugaaagguuguagucaauaaacuaguacuugaugagauuugagaaaaacuacaaaacuguagauugcaaguuggcauuugaccaagaaauuaugauugugcuccuuggauuuuuaugcuuaggaaagagugcacaagagggaaaaagcuuucggucagaagauacccauucuaguacuagcuggaauggugguaaagaauacgaaauggucugaauguccauggcugugugauauuggcguauuuugcuguccaugggucuaaguggaugguauuauagcuuugaaagagucauggcaaaggagggaacaggugugucccaaacccuaaugaacucagcagauuggccuggcauucuggcaauguagucauucagcggagccguggggacucccuggguggggacccagcaugcuucuggagguaccugggaggcgcugggaguagggccugcuguacugguuugacuaaugugguguagguguugauguuggagaguugguggccagucucaggcucuguucuggcacuacuccagcuuguuggucaugaaugcagauugagauugaauggcuccuuacauuucccuugaagaaaggcagcuuugucuuccaggaaugagcugauggcaguggccguguggacauucugcagcuuuggcacccaguagcgauggccugauugccuugaaacugggagccucuagggcccugagaacuugagcagggcuggacaagccuuggagcagaacuuugcugugaauucuuucauugacucgcaaaagaugaaggacucuaaucccugauaucuaccuuuccacuugaccuuuuuagucuucaguggucuuuuagaaguaauuuuaccuggccgcgguggcucaugccuauaauccuagaacuuugggaggccuaggcgggcagaucaccugaggccaggaguucgagaccggccuggccagcauagugaaaccccaucucuacuaaaaauacaaaauuagcagggugugguggcucacgccuauaauccuaguuacucgggaugcugaggcaggagaaucacuugaaccugggaggcagaggcugaagugagccaagaucgugcauugcacuccagccugggugacaagagagaaaccaucuaacaaaaaaaguuauuuuaugaaaaacauuuggagguuuucuuuuggguauggcaggcagauuggccucuuauuuggcauaggugaagaagaagaguugaauaaaaguaguuggggcauagaauggccaugcaaguucccaacuaaaucagggucaaguuuaaauguauuuguauuuuguucaaauucaucuuuaucuaaaacaggcugaugcuguuuugucucugugcugcagguggauagccacaaauuugacucuauaguuaccaguuaucccccugccaccccuuguuuuucuuccugauuucucuacuuccaaucagcugcucuuuuagaaaccaauagagaagugagacggggugggggcagaggaagagagaaaggggguaagggggagggagaaagaggaaagagagguuguuuuuugucauuagugaguaaaaaucugucgggcucggguaguuucuuagugaauucagcauuuagugauuagauuagagggguauauuugagcugaagauuuugggaacucaccuuucugcucuacagaaucccuagguuucuccuuuagcucuacuuucugauucauuccauccccauccacugaccccaccgccaauauugagguacuugugaaagcucagaaucuccaguguccucaaggagcuagccccaaagugcccccugguggcuagaggagaaaaagacaagauggaggaugggaaaaaggucagguggauggauaacuuuggcucuucuuuuggcucuucuuuucugauaguauuuuuguuaacagcaucuaauggguugucuucuuucaguaucaaugugaaccagcucugaauagguuaguguaucaauguauuucccuuuuugggugauuuugcugcagggauuucuuucccuaugccaguuuuuguuggucugauuuuuguuucuaggcauauugcauugaccugagccuucucacaguacugaugacacuggggguagggagaacaggagcaguugaagacgacacaugcugucaccucaugugcuggugugaguggcgcagggaagggcugugauuuuuuauaggcacacugauuagccaagcacuugucaccuccacugccgcucauuggccuacugagugugagcgugccaucuaauugacagcugucuguugucagagggccaucuuuucuccuuuucaguuugagugaacacaacagagacaucugcagagcucucugcagcucugacaagguugcccugccugccaacccucagacuucuaggcagcauaauugaagagaucagaaaagaauauuaacccguugaccaucuugggcugagguguaaugaccaaaaagucacuuuuuaaggugacugugagucuuucuuaguagaggaagacaugagauucucugucagaagagucaggccaguaggaagugcuauuucuugguagugauuguucgugggguuucaguucaucugagcacuuggaagaggaugagaaguucauuuucaagguagacccaguguuucauggugggguuacacugaagccugaaugcugggucacaucauucaugucugauuuggcuuguguaaugacaguagugcuuuggauguguguaguuuggaugaggguuacucuuuuucuuuuaccgccaggccugacacugcccuuuuagcguaagauuccagaaucucuuaugcaguagcauggaauguauggccaaccccguaguaacguggacugccucuuugggacauuuccuguaagccagagauaucaagguggacuuugugauggguagauuguuuauuauacagauaucagcuugggaauuugaauguuuaauuauuugccuugucguagugucuucaaaugaagcucuauuugagcaucuacugggauugguacaauaugcagacaagcuggcuuugugugggucgagucaccugugcuugcaggaugggggugcuugcuauauuuggaagugauuuagugguauccuagguuuaucaggaggaaaauacaucuuugcauuuauuugaacauuugauuuagaaagggacaguguguggguauuggauaaauugcuuuuacucuuucuuugcuuugcauuguucuccccucugaugauuugcaacuuagcaagccuucaucauugaaccugggugaaaaagaagaucugagaagccuugaguaauuuguuucagacuguuuauacucuaguguuuuacagaugugggcuuauuugaggaauaguauuggcgaaagguagcgucauuaaacugguuggagaaauuucaggcaaguagauagagaaauuucaggcaacuccuuuuccaaguuguugcucacagauuauaauagaugaauucagcagaauguucugaccuccuagacuaggucagauaacugaguucuuguccuaacucaaauccuaaguagcuguuucuuaaagcucuguucugccucugcagaaugaaggcuuggccuauauaguguaugagauuccuucuagcuucaggguuuuguaacuaucagaauagguaaugaggaaggagacuaugcccugguagccuuuagccauaucacaaauauuuaacauacucccaaaauagcacauacaagacagaaauucuuuguacuugaagggaauaauaaauacagaaagcauuugagaaguacacauuuaauuucuguuaacucuuuuuuucuuauuuauguuuauuauuagaugauaaaugacuuccuuuuuuuuaguauuaaaacaaggugaucaggauagugagaggauugggucaggugaaacacaugacucaccugcgugcuuaugauuccccuuggaagaugguuuuggguaacauucugggaaaacuauggauaaagucauaggcuuccauauuuaauuaauucuaagacuuuuuuuucacauuucaacaucucagaaauuuaugguaugccaauucaauuggcaacuuuuuuccucucuugguaggaaauagauaaugauguuuuugacauucaguggcaucuuauaggugaugaaauacaauucugaggggaggaagcaagauuuuuuuuuuuuuaacugagaaaggcuacgugacuaagugacuucuuuguuucaaugcugacuaaagcugugauguccuuuuuaaucacuuugaaagauucaaauugcuuuaggaagacaauucaugcauggagcucacccucccagaacuccacacuuaaugcccacugaggaaggagagaaaugcaugcaaauauauaucccaauauagaaggaauauucuaguucaguaacuuccacuccugagcuuuuaucaaauuuuucucuauagaauuauuuuuguuuuauuguauccaaaaugucagauaucuuuuucaaggaaggucaagggacuuugccauuuucuaagccagaaguauucucaccuaguccaguacuagucaaaguuuuuaguaaaucacuuagaauuuccuuuuuuaaaaaaaaaaaaaaacccuucuagaguuuguugauaccuuaaagaucaucaaauccagcuccuuauuucacaaaugaguaaaaagaagacauaaguugcuuguucagaguucagcuaggaacuagauagaaccuggguagccugacgcucccauucuugcugcuaaauuccaugcaauguaaugaaagcgggauugaguauaaaaccgauacucuacacaucuuuuguugauauuucugagggagaaacuugaauuucuguaagugcacauagcugguuucccuuugcuuuguauuucugaaugcuacacuugucuucugccuacuacacuuaaauucauaggugauuucacaaggcacagaagcccaacuugucacaugugguuuaauauaugccacacuuuaugcugcaguagcaccauuuggucauauuuagugaacucugugguuguugagaaugccaaagcagcaggcucagcuauugcagcauaggccuguacuuaguuagcaagcuuagcuuaaaagcugucagugcagcuaauguuacaguggcuuacugagaccuuggccugguugugauaguucuccaaaccuggguguuuucaccuuugaaauaugaaucuggauuuagcuuuuucuuagaaaacagcaacaacaacaaaauggugaaaucuuuaagcucguuaaugugaaugcaguaagaauguaaauuuaauacauauucacuuauuauuaaaugcuguuguaaauaacauuuuuagauuuaauaaugauuucccaagacauuucgugcuauucuuuacuuugaaacugauggggugagaagagaguugaaucuuaauuauuauuuuuuaguuaauuaacaugugauuuaaaaaaaucgagauauauuuuguguuagacccuaauuagaaaagaugucaagaauaacauaaugcuaacuuaauuuuaaaauugauaaaugagggcaagaugauuggaaaguauccucuagaucacacaggaaacggguuaauauucaaaugaauagcucugaaacgcuacuuuccuaccagcuccugaagcaauuuaguuuuuaagaccuaaaacugacucacaaucugugguaugaaggauagauguuaauaguuuaaauauuuaggcauugcgugggcuguuuguuaaaccauugguagcuugagauugaccacagugggaguguuuucaccaugcgaaugagcaucccugcucacaguggggcaugagcauagcacugcaggauacggaacugacauuuauuacauaccugacauuuccguuacucuuuuauuuaucguuuugggcugcuuguuuguguccuauccccacuccccaaauucauauguugaaaccuuaauccccagugggaugguguuaggaggugaagccuuugggagaugauugggugaugaggguggaccuccgaugaaggaauuaauguccuuauaagaagaggaagacacacuggggccugucagcggugggggacgaggggaggguuagcauuaggagaaauaccggauguagaugacggguugaugggugcagcaaaacaccauggcacguguauacccauguaacaaaccugcacauucugcacauguaucccagaacuuuaaaguauaauuuaaaaaaaaaaagaaaaguaaaggaagagagcuagccagccuucucucuucuccaugugaggauaccacgagaagauggucaucuguaaaucagaaagaggacccucgugguggcucacaccuguaauccaagcacuuugggagguugagguaggaggaucaguugagcccaggaguuucgagaccagccugagcaacacgaugaaacccugucucuacugaaaaaaagaaaacaaaauuagccagauguggugacacauaccucuguaguccuagugacccaggagguuaaggugagaggaucagcugagcccggaaagucgaggcugcagugagccaugaucaugccacugcacuccagccugggcaauagacugagacccucucucuccccaaccccuccagaaagaggaucuugucuggaauccagccauucugguccugaucuuagaauucuagccuccggaacuguuagaaguaaaugcuuguuguuuaggcuacccagucuuucguauuuuguuauagcagcuaaauugacuuagacaucauuaauuauguauuuuaaguccuguguuuuagcauucuggaaugagagcauugaaaaugaucaucaagccgaguaaauuaacugaauuaacuauuccaccaaaaaaaaccccaaaaacugaaauguucguuguuccuggggaauggcuaugcacuuggaggcugguccccuuccucccuccucuucuuccuggugaauccccugacuuuucucaaucaggcuuucugauguggaggcuuccucugcuucccagggacacacucccuucccagggcuccuggagcugcugcaucucugcuacccugagauguaauucuugccugagauuucagcuccuccccuacacuucagaggcuucaguggacuauuucuuauucaucugugcaggcacauuguccaauguacaaccugcucaaugggcuuguugaguuaauaaacuacucuguguucuguauuauguggauuuagauguuuugcuucuuuuucagccuuccuuucgcacccuccaccuacccgaccccugcuaagaugcuaccuuuuaaagaaaagaaauaaguucuucacacuuuucuacauuuauaauucaauauaaauaacugcuacugguauacuuaaucacaauuagauuaaauauguucuuugaaacagggaggucaucuaaugaauagaagugaaauaugucagaaaaugucacauaacugagagugugacaucuuuaguaaauagaauguugagaugauuuuagugcuaggcuaguuuuguaagagacaucuuauuugacaccuuuguucaaacaacuuuugugguucucaaacuagccucuauugaaaagaccaaguucccuacgucuucucuuugaacacuuucuucuuugcauuaaccuguucuugcuagugcguccaaguguggaaagcaaagauuaguuuuaaaucuuccgggucaaaacuguuuuggcuuuuuucuagagcugauaauaaguaguauaguuuucuguguaccauguguaagagaagagaaaaggucugacuuuauguuagauaauccauaauucgguugcucugucccacuauauggagaccaaagucacacuaaauggaugccuuggguaggggagaaggauguagccuuucaaucagacuucuuagcugcacuagucacauggcuagccuggggcagguauuuaaacuugcuauaccuaagucuccucaucuauuaauugacauuaauaucagcaccuucuucauaggguuuguaaggauugaauaauuuaauguauguaagacacuuagaagagugucuuaaauaaugugagcaccuucuucauuaacauuagcacauauuucauaugauuuugugaggauuaaauaauuuaauguauguaagacacuuauaagaguguguuaaauuacagacugugcucaguaaauguugucuaauauuauuuuuaaacugaugguuauuagccaagcuauaccauaucuucaacuuugggugcacaagagugggcaguaucuuugaagaggucguuguuucucaaucugugggucaaguauucuuagggaaacuuuucauuuugguccaacucauaacuuuagugacauuagucuuugcaauuuccugcugagaagagaagguagccuuucuauuuuuuuuaaguuuucaaagccuaauuuuauauuaaaagaaaacaagguauuaaaaccacguauuucuuuuaacuuauuaaaaggaaauaacacaguaacauuaauaaaaaguuacaaaauggcacaguaacauuaauaaaauguuacauugucuuuuuauucuauagcgugaauggaagaaauaaaguaacuuuucuagagcuacaaaguaguuaaugguggcaaagauucacucucuggcaaugugucuuguuucacaaaguaauacaaguucaacacaguauagaauugccuuugauuucaaaugguaacagcauuuauuggauuauuuuuguagauguucaaugccacaaguaaaaugaaguuuucucuuuaaaaggaugauagauguggcagacccaucacugggucccuggacagugguaacaugaugggguuuaaaguccuuuuugaaauagccagguuaaucugcauaaaggcuauggugcuucauuaagcuuuuugaaaacuuucugggguaggccaaguggcuauuuguaucaguuaaacguaaguacaacuacuuaaaauaacauuucuucccacuugugcuugagucugggucuauauuuuuccugauaauaacaggauaaaaugaaucauuugauuccauauuccaagaaaaacguguccauuagguagaggaagcucuuagaaauuaucuccaagaguggcuuguuuuguaccugucauauuuauuauaagguaaagggagauguagacuggugggggugaugguaguaaauugaaaugaguugccagcuguguugcccaggcuggucuugaacuccugggcucaagccaucccaccagagaagguucuuaaaccuuuugcuuuccauugggcaucuuuaucuacauuuuaccucaucaagcucaucaagugaaucagacgcuuugacucagucauaacauguugauggagagucacuuaguuggaaaauauagacaagaagaugggcucugggaagaacugguagguaggcaauggcucugaaaguguggggcccugguuuacaguguaaugacacccaccauuuagugccucagccauuauucaagugugcugugccuuuccuacuggccacguuaaugagaggguggagauagcaaguuccugcugaaauuuucacaggaaagcuaagcccuuaaaugauguuuugaaggaaugguuucucuaccaucuguaaaaaaggcuugauuaauuauuuugguggcagaaacuauaugcugugcuucagguuaaacagcaggaacauauugagguucuugggaagaguuuuccuacagccaucaaauagguguccacacagguuaaccggacugugcaauaagaaugugggacauuggcaugccagugugaagucuggaaaagucggaugugauauaugcaaguggaagagaacugaaacuaugaagagucauuuggaaagccccaguugugaguuugugauaguugagaaauggcaccuccucuuugcauacuuagguuugagcaggaaacaaagaagugacuugaagucauguuaugaaaagaagaauuggguuggaggucagacucuggauucuagaccugauucugaguuaacuaacauuuuagccuaguuucaggcacuccccaguggcccaaugagccaccccuucuugcaggccucaaaaugcacugugauaaaacugcauaguauuuucuuuuccuuauuuucauguucuaagaaauauuauuguccgggcacgguggcuuacaccuguaaucccagcacuuuaggaggccgaggcaggcagaucucuucagcccaagaguucaagaccagccugggcaacauggugagacccugucucuaauaaaaauagaaaaagacaaaacccugguguggugaugcaugccuguggucugagcuacucaggaggcugaagugggaggaucccuugagcccuggggguggagguugcagugagcugagaucccgccgcugcauucaagacugagugacagagugaaacccugucuaaaaaaaaaaaaaaaaaaaaaaggagaagaaaauauaauaaaaauaauacauggauacuuucuuaaaauaucagacacuugagaauguugaguaaaauauaaaaggacuuaaucuggagaucauugccuuaguuauaacauagaaccuuucuacuuaggagaauuucccucucuccuacucccuauuuguaaaaauuuucuuuuguggcuucagucaaguuucauacuuuuaaauguuuuuguuaauuuuauucuuuguguuuuuuuccuaaacuguauuuuuguuccauuaugauuuuuucauugguuagcugagguauaggaaaguugucuuuuuuauugucuguuaaucuuauaacccguaacuccagaacuuucuuacuagccucugguaguuuuuuuuaguuguuuaagauuuuuuaggaagaaaaucauuggcaaauauugggaguguugucucuuaaagugucuuucuguuauauuuuccuugugcuaguacauuggcaaagacuuacaggagaguguuaagagaauaguggaauacaggucagcuucgcauuuuguugacuugagcaaagaaucuucuaguguuucauuauuaaauaaguuuucuguaggcaucuaguagauuaagaaaacuuucuuaugauccaccacuucuuaaaaugaauguguguguucaaacuaaagagauauauguauauaguagaaauauauguguaugcuugugugcauguguguguauaaacuuuaaaucauccucucaaaauuccugaaguaaaagucuauuuuguuguuuuauguggaauuuuauuuuauuuaaauuuuuauauuuauauauuuuauuuaaaauuuucaugaaauggccaagcaggguuuaauauaaaauggaaacaggguuuaucucagaaauuugguggcuaaauuccuuguaucccgucuuaucuagggauguuguuuguuucaagguucuaccuugagaggagccugucauuuucuuuuuugugugcugcuuugccuaguugacaucuuggcuuuaugugcuccuguugaaugcauugggaaauuuucuuucuucuuucuauguccugaaauagcuuauauaagaggggaauuuuugauauuugggggaaauugcaugggacuuuuuuuuuuuuuuuuuuuuuuuuagacagggccucacucuauccucaaaacuggaauggagugcaguggugugaucauggcucacugcagucucuaccaccugaguagcugagacuauaggcacaugccaccaaucccacuaauuuuuguauuuuuuuguggaggcggaguuucgccauguugcucaugcuggucuugaacuccuggacuuagccaucugccugccuuagccucccaaacugcugggauuacaaaugugagccaccgcgccuggcaagacuaguacuucagaacuggauuuuuuacuaauuuuuccauuucuguuucuuuguguuucaauugugauaguuuuuguuauccuagaaaacauccauuuuccagacuuuaaaauuugcuacauaaaauuauacauacuuucucuuguuuuaaaaaacuccuuaucuauuuagcaaauauauuuuguaauuauguugauuucuguuuucucucuucuuguuuuuccuuacacuugccagagguuuguguguuuucuuugguuuuuuuuuucaaguaccuucuuuugguuucauugauaaucuacauuuuguuuuaucuaaauuuaguaaauuuuaaauuuuauuaauucaucauauuuaaauauguugcacuuuuucuagcuuuuuauauuguauguuuuguucauuuaauuuuuauuuuuacaucuugcaauuuaaggccauuauuuuucauugguuacagcuuuggcugcaucccuuagauuuucuuauauacagcuaucacuaucauuuauuuguguauuguuuuaaauguuauuuugcauucuuguguaguucaagaguuacuuaaaacacuguuuucacagucccacuuuaauaaaauguuuuucauguuggcagugcuacuguuuuguuuuuacuauuuaauuuuauugcauucugaguggggaaauggcauggauauuuccuacuuuggggguaaucuaguaggauuuuuaaaaaugcuuaguuuuuuuuaagcauuucauaugcauuugaaaauaaugaauacuauuucccuauuuuauuauuauuauuauuauuuuugagauggagucucacucugucacucagguuggaguguaguggcacgaucucagcucagugcaaccuccggcucccgguuucaagcaaucuucccaccucagccucccaaguagcugggaucacaagcaugugccaccaaccuggcuacauuuuguuuuuuuuaguagagauggaguuucaucauuuuggccagccuggucuugaauuccugaccucaacugaucuucccaccucagccucccaaacugcugggauuacaggcgugagccacugcacccggccuauuuucccuauuuuaauauauuaaaccuuuuauuacuuauuguccuucuaauugauuuaaauuucugagagauauuuguucuagucuucuacuuugauuauggauuuaccaaccgcucaggguauuuauauuuuaaaaaauauaucucaaagcuguaucauaaaugauuagaaguucaggaauauuuuauauuuuugguggacuauagguuucaucaguaugaaauauccaacuuuuuucuuuuuuuacauuuuugccuuagauuggcuuucaauguauaguaauguucucuacaugcuuuauuuuuguagauuuuauauuacauauuuuuuauauauuuuuauuuuucauagucucuguguuuuauuuuugaugguuuguuauacacagcauuuagcuuuacauuuuucuagccuaaugugacagccacuguaacuuaguugaggaauauaauauccaaauaaacauaguuuaauuuucuuuuuuuccuuggcuugaucacauuuccuuuguuuuauauuuuuugcugcuuaaaaaaaggucuuuuuuuuucuaauggugcaggaauuauacaucuuauuucuugugaaaguuauucuugccuuucuaacucacauauuucaaauuauauaucucuauuaaagucuaaaucuguuuggugucuguaucuuuccuaaaaaagaugacggagaguguuagcacauuuuuaauuacugaguuucucccuuuguuccuccccuuuaccucucauguugagguugauauguuuccuuuuugacguuuuaaauugcaucaacagucacauagagucuacuagcguuuccuugccccaucuugcuaauuuuuguggaccauguuguucuggguuuuuuuggguugauuugucauuauacaguuauauauccuuauguaauuuuuuucagaaguguggggguauaaauuuucagagucuuugcauuuucuaaauugccuguaguuagcucaccuuuuugaaggcaaguuuggcuacauauaaaauuugaguuuuaaagucuuguauccccuuuuucugucacauuuuuguucuggcuugccuugcagcucuaaauguagcaccccaauuaaucacccgauuauugcaucacacuccacuccagcuccauguauguauugacccugggauuggagcauccuagauuuagcuguuucuuugcagucuucuugauuggcugcugcuuuuuggcuugugauuuauuuauuuuuccucuguagagcaaauccaucuacuuuuaucuuuaagaauaauucaaaauuguuauuccaccgaagcuacucuuccuuauuuucuggcacuauuuggcauguauaucucuucuaaauucacacacacacauacacacacacccaguaucauuuaugacauaugagguuagaggaaaaguagaagcuuauguuuaaucuaccaucccaagccaaccccuuuauauggaacuuuacacauucuaaaugcuuucaaauacaguaccuuauaaggaaggagaugcuauuauucuccuuuuauaaauuagaaaacugagagguuauaagucauuuuauuuauuuauucuuucauuuauuucuccauuaauccauuggcuaaauuugcaucaucugcuauguauaagcagcccucagugccagagacacaaaaccccagcuuccaggaccucacagcugagaguggaagcaaguggguaacaauagagacuugugacaauaauuucagcauaggguggauuucaguuccaugcauguuugagacacgugcuaggugcagaggaaccuggggagaggcgucucuaugucagacuucccaguggaaguguugaggaguguuucccagcggaaguguugucauugauuaaaauccaugcuguaaauguaggcaugaguugacugcugugcucuugguaucuaguaaaguuccuggucccugguuggcacuuaaaaaaaaauaagugaaugaacaaacaaagcuuccuuggcucucaccgaagcacuccuuuuguacuaacauaugugauagucuccacaggcaugauuucuuuauuucuccaagcaucucuuugaguagguacagugaaugucuccuguccacaaaugaaggggccaaggcuguggggaguuaagugucuugucuaaggaggcuuggaucccagguuccucugacucccgacaggcaagacuccuacuggcccuauggcccccucauccagauuauuuuagccucuuuuuucaaacucuuuccugcccucugaucauguuucuaccaagaccaaguaucacaaacuaaugaagagguauaacuggcugccuccuggaggagguauuaagaagcauacaguggccaaaguggaggaggaauaaaaauaccuccagagaccucaauaauaccaaaauagcuagucacaccauauaugucuaagcuuugauacagccuuucuacaugacauguucauuuggaauuauauuagacauucagguuugaaucagggcaggucacuugaaaugucucaauucaaugcaaaaguuauaagaaaaauaacauuuccccccacacaaguauauagcauaguauaaaacauucucaaaaacuuuguaaaggaaacacauuuuacaguuuaacucauaccuacuucacuuccuucucccucuccuguucucuguucauuauuucccuacuuacuaacuggcucuuaguuaauauuuucguggccucacccccacaccuuuuuaguuggucucuuuuuugugcaaauugauuuuauuccuaucuaaggagaugcuuucauccuuuuuuucaugcuuugaggccucauuagaucacugcacucuaauuuugggggggagaguugucauuugcacuauauguacagucugagcauccuaaaguucuuguucugagaaaaacaucgccauggugagcggcccauuuugaauuaggaggacuggcuaaggugcucacuuaagcucuuuguaguuuuguucagucaauugaguguuucuauguuacaucuaucugucuauaugucugucuaucuaucuaucuaucuaucuaucuaucuaucuaucuaucuaucuaucaucugucuaucuaucuacauaccuaccuaccuaccuauguacugagcccaggcuggagcaguggugcaaucagagcuuaccguccccuugaccucccagacucaagugauccucucaccucagccuccuaaguagcugggaccacaggugugcaccaccauaccuggcuaauuuuuuuucuauuuuauuuucuguagagacugagucuugcugugcugcuuaggcugcuuucaaacuccugggcucaagcgauccuccugccucagccccgcaaagugccgggauuacaggcaugagccauugcgcccggccuucucuuuuuaacguaauauugagauuggggucagacugugcugguuguggguaaagcuauugcagccuuccagcuaugaaggccugcccuccacgaugggauggccaggcugguaccugagacuaguguuggaggcaguggcagcuucccuuugaucuauugcagaaugcauuuucaaacacacacacacacacacacacaaauaaaacucugauguucacuuuuuaauugaaagcuaaaaaugcccagcuccuuucugcagauugacaagcugauauuucagcaguagcuaaagaacccgguuuaguaagcuacugaauuuugacguuuauaaacauuuaaugaauacauuuuuauuuaugucagcuuaaaaaauacagcugcugauaucugcgccccccaacaacuuuuuuugucuuaaugccaaaauuagaauauuuaaauauuuuaaaauuuccugaugagcaccugugcaggugugagggcagcaugaauucacagggagaguguaugaaguugguuaucuugaugugcuuguggggaauguguauuuccuugcaaggacugucaugugcuaccugauccucuuucauggaccucagccacuuucgccucuaacuugaaaaggaaacuggcauuguggcacaggggccaaagggacacauuuguagccuuguccucaaaucaagugggacuucugguucuuucucugaccaucugcuugaccuucagucuggugucuccaaggagugugucucuauggcaguuuaaaaaauucuguuacacugagaaagagacaaaauguaaaucuuaaaggaaucaguagauuuuuaaccccacugcugguguugagaagacaguuugagucuuaaucucuuuccuuaaguuucaaaacauguaggauuuauguuauugacaugucaaacuuuuuguacuuauucauuagggaagguuucaauacacacaaaaauagaguauuauaagaugcgcuacuauguauucauuauccaguuucaacagacgucaccauuuucccagucuuuuguuauauaguauccccuucacuuuauguuccugaaauauuuuaaggcaaagccuugacagcauauuauuucaccuauaaauauuucagaagcaucucuaacaaauaagcccccuccuuuguuuuacauagccauggugccauaucacagcuagcaagacuauuaggaauucuuaauagcauuaagaacugacguuccucaguugucucacaaaugccuuuuuacagcuggcauguuugaaucagaauccaaaccagguucacacguugcauuugauuaucaugacuuugaagucuucuuaaaaucuacaacauggccagucucccucuuuuuaaauauuuaaacuggguccauuuuccuguagaaagcccacauuauggauuuggcuuauugcuucuuuguggugucauacaccauguucaucuguucuccauacuuccuguaagcugauacuugcauuuagggcaagcuugucuaacccauggcccacaggacacaugcggcccaacacaaauuugaaaacuuucuuaaaacacuguguuuuuuguuuuuuuguuuuuuuuaagaagaccaaguuuguuugcaguguaugaaugucuaggugaggcuggguuaauggggagaaugagacuaacauaacaucuauaacucucaugacuuuuuguuauuguuguuguuuguuuuguuuuuggagacagagccucccucugucacccaggcuggagugcaguggcgcaaucucagcucacugcaaccuccgccuccuggguucaagugauucuccugucucagccucccaaguagcugggauuacaggcacgugccaccaugcuaauuuuuguauuuuuaguagagucgggguuucuccauguuggccaggcuggucucgaauuccugaccucaggugacccacccgccuuggccucccacagugcugggauuacaggcaugagccaccgcgcccggcugaaaacacuaugagguuuuuucauggguaaucuuggauauguuauuugcuucauucaagaaguaguauguggccauucauuucucaagaugcuuagauuguucagugaguucaugugcugcccaccagaucucccuaauacagaguuuuacauugucuuucaccuguuuguuuuaggaucuauugaugauuauuucauuggagguugcaaaauagccauaaguaaauugguuuaaugaagcuucuucucccuacuaaaucuuaucuagaguuuaacuaucuauuaaucauucauuuuugcacauuuuuacagcuuuugugggguauuuuacauucuuucuucuguuugaauauagagggugccuugcaaacuucacucauuucacuagaagaggcaacuguuuaaauccuacucuucuaauauauuuccugguucauguuuuccugcacauucauaaaugaggaggacguugauuugucaguuaucuucagugcuuagaauaguugcugaaaugugacaagaauguuuauggaagaaauuaccuuauagguuguacauguccucuaaagacaucauaggcacuccuacauugcauuggugaaggggccaccaaacagcagaauccugcaacuugguugaacuaugaaaauguucuugauacauuauaauuuccucaaccccuuuagccaguauuggccauucaggcaaaggaauagaauuuccaagacuuguacuguauguuugcagaaggagggaggauggcagauagguuuguguguguugggauggagaaaguaugcaaauaagcuaauuaauaucaauuguuuuuauaucuauauuacacauacacacacucgcauacacauaagcacacauaauuaaucacacccaugagcacauguacacagcuggucuacaccagauugcccugacaauuuuagagcugugugcugaaaaauuuuagaggaauuuggcuuugaaugugcaacacguauuacagagcaaagaucaccuuggguccuaagggagaugacuuucaucucuaccaugugaguaaaaccugggugauugaaccauaaauuauuuuggguauauagaacuuucuucaaauaacacuuaaaauuaaauguccagguaagugauuuucaaaucagaacaaccaaaauuguuaauaguuaugaucaugcuuauauacguauggaaauguauauguauauggaaauauggaaauuuguguauaagcaugcucugcaguaaaucaaaaaaugaccauggagcaaacauaugaaaaugcucaccagcaaugaaaaaaaugacccuauggcaaacaauaaaguaaaaugcuacacugucuuccuguagaggaccuacuagguuuggacaaacuggcugugcucaaauacaugugccaaaauugagcaggcugggugcaaauauucuaagggaauugaaagacacuuuuucgugaaauagguuuagguguugacauuaucucuaaaaguaauuaaaagaugauugauguaguaaauuuucuuuuaagccaugccuuuaagcacauuguaggaaaaggacuguuaaacaccacauuuucuuauuuagaacccuuggggccauagguauuucacaauuuaagaaucauuugcauuuuaugaaguuaauaugguguauauaacauguccuguguaacucuccagugaagucugaaacagccgcaauguauauauagauuauuauuucuauagcaaaacauaugaauagauacaccuaguaagacaaaaacaaaaauuauagauacguagauauucucacauuaguucagguuuugucacaaaguacagcuuucaaaccuucuggaauuuuucaauugagggaaagauugugaaccuucaaaugaacaaauaaauaaauaucuaccuuuucugaagaaaaacaaaagccaaauaacaaauaaaucaagaaucacuuuucaugguuuuuaaaccccucaaauaaaugucuuccuucuuucaguucauagaagauuuagaauuauaaaauaaagaaggccuauccacauggucuauauaugucuuauauaucuauaucuauaucuauaucuauaucuauaucuauaucuauaucuauaucuauaucuauaaacaauuuuagaauuagcucgucccacacaaaaauaguuuuuuuguuguuguuguuuuuuguuuugcuuuuuuugggauggaguuuugcucuuguuguccaggcuggagugcaauggcacuaucucagcucagugcaaccucugccuuccgaguucaagcgauucuccugccucacccuccucaguagcuggaauaacaggcgugcaucauuaauuuuuuuauauuuuuaguagagaugggguuucacuauguuggccaggcuggucuugaacuccugaccucaggugguccacucaccuuggccucccaaagugcugggaucauaggcaugagccacugugcccagccaaaacuuuagauuuuuauccuguuugugccucaaagccuauucaguugaaaggcugaugggcucgcucugagguccauuguuggcugggggagagcauuagggagcugacuuuuggcagaugaggaaaacagcaugaucacugcuuuugccacucugcuuuguggaauugacccacucugaaguuguucucacucgacagcaaugcaggcauuuauccagugcuucuacaagaaauaauuugggcaaaagcaguaaggaaguaagccuuaacagaaaagugggacccagcaauaggagaaucuacacaucugcuaagcccagccaucauauauauauguguguguguguguauauauauauauauauacacacacauauauauacacacacacacacacauauauauacacacacacacacacacauauauauauauauauauauauauauauauauauauuuuggagauggagucucacacuguugccuaggcugaagugcaguggcaugaucucggcucacugcaaccuccaccucccgaguucaagcaauucuccucccucagccucuugaguagguggcacuacaggugcaugccaccacaccguuaauuuuuuguauuuuuaguagagacagaguuucaccguauuaggauggucucgaucuccugaccuugugaucugccugccucaguucccaaagugcugggauuagaggcaugagccaccaugcccagcccuuauauauuuuuaaugugcauuaguaaauuauaaauaaugacagucuccauguggaaaaugaaaaucaacuuagcuuauacauuuuuaaaaaucagucaaguggucuugucucauauacauagaccuugaaagauuuguuuucaguacauucuguagaaggcucuugaauaucugauagacuccccuggcagcuuucaccuggugugugcaugcacagauauaaucaccuuagucuuuauccugcaguaaacaaaguucaagagagauuucugaaaugaagauaaucuucauucugccuuuugccgcuaccuaaaguucccuuggaggacucugugaaguuacucagguuauauuuuuuauaacaaauauaaaccacagaauuugccagaaugagaaauauucugaugaacaucaugauuugacugaggauggaggaauuguagggaaugguuaaacuugaagauacuuuuuagaaaaacaggucaugugcuacagaagcuacuuuuaaaaacaugcuuuuucauuaaauguaaauuuaccacauuauuuuauauaucuucauuaauuuaauaaaacuccugcuaggcuuuuguaaauuuucacagauauaauguuaccauaggcaucuaugcacauguauuuuuguacacuuguccaauauuauccauagaguuaaaauuuuuaacuugaaacuucuaagucagaaggcauaugcuuuuaauauucugcaguacauuuuaacuugccuuccagaaaguuuauaccagauuacauucccauuagcuauauaugaaagugaacuuccucacuggcaguugaaaauuugucuuauuuuaauuugccagauagcuugucauauauuuauugccaaauuucaaauucauuccuuuuauaaaggaaugguucauguucuuccccagucuauuuaguuuuauucuuauuacaauguaagagcuuuucauuuauuaggaguaucuucucauuaaauauuuguuaagaaagauuuuuguucaacuuuguaugguuuggauaauguuuucauuuauuuuuauuuauuuauuuauuuauuuagagacagagugucgcucuguuucccaggcuggagugcaguggcaagaucuugguucacugcaaacuucgccucccagguucaggcgauucuucugccucagccucucuaauagcugggauuacaggugugcacuaccacgccugguuaauuuuuguauuuuuaguagagacaugggguuucgccguguuggccaggauggucuucaacuccuaaccucaaaugauccaccugccucggccucccaaagugcugagauuacaggcaugagcuacuacgcccagcuggguaauguuuugaaaaacgaguauguagucugggucccaauauguucuaauuuuucuagcucuaaugucauagcuaacaaaggccaucucuacuuaauugcuuguacuuuauucucaggcuuuuauguuuuaaccuuugcauuuaaacauauuuuaguaugaagugugaagcaaaaacguaaauuuuuccccuuaaaugcuaaacaaacuuuaguuaccauuuauugaauaauuuaucauuuucucauugauuuuuuuuucaaugacagccucgccauaaaucuuucuguaauauuuccugaucuggcagcagccgcacauugcuuuaauuuacuuuguuuaaaauguauauauucucaacuuacaucuuuguaaaaauuuucuuaacuauuaucaugcauuaauauuccagauaagcuuuagaauuugugucuucucuacccuauccauuuuucucucuuuggaauuuguuugaauuugcauuaaagucuccuuuaauuuugagucauccaaucacauuuaugcaaauacuuuccugggaaauauuugugugaaaagauuuucuuuuaaaaauugauauacaagauuauuucggucuuuuagaaguguuuauacugcugaauccuuucaugauuuuuguuaaacuggcuugugaacuaguucagcaagucagugucguaugcugaauaucuaaauauauuuauaaugagaaauauaagaaaacauaauaagaauauuucugucuuacauccguggagagaaaauagaauauuuauaaaugcaaaugcucuacaauuacucuaaggaaacuuaaagaucacaguccuauucuaacucuguaaaguuauuugcuuguuuguuauuuuaacagcaucuuucucauaagcauuuaaggcugguuauaauguuuugugugugaauauugaguaaaccaaaugauuggaggcccguuauuuuuacaaagauuuuauggaauaagcaaguucggaauggauuucgaaaaagagacagucccuguuucaguguggaagggacauuggaguccaaaggucagggucagauacauguuuucuucuuuuuuuuuuuccuuccuuccuuccuuccuuccuuccuuccuuccuuccuucuuuccuuccuuccuuccuuccuuccuuccuuccuuccuuccuuccuuccuuccucuuuuuuuuuuguuuuuguuuuuggagacaaagucucauucuguugcccaggcuggagugcaguggugcgaucauaacucaccgcagccuccaacuccugaacucuugggcucaagugauucucccaccuuggccucugaaaaugcugggauuacaggcaugagccauuacaccuggccauuuucuuuugacuagagcugaaguucugaaacuagcagucauuggagauaagacaggagaagacaguugggaggcuccaagcaugugauuucaggaaaagcaugaguugauuauugagaauuucagaugugagauuuccaggaacagugugaguccagaagauguaagaaagaucaguggaauucacacaguuugguuauucaugcaucuucgaauauuuuucagauaaucucggguggauacuucaguuauuucugccucagcccaccuuauuuguaaagcaguauuaguagaauccccuccuugagggguucuucauauuaaauaaguugcauagccaacagccugaggcauaccaaacacuguauagauauuugcuguuauuuguaugauugcugccuuuuacugaguggcauccugggcuggugcuugggacucaacagugaggacauucccucccacaucugccuguaaugccaaggccuugugauagggaguggccugaagcccgggguagaggaguggaccuccccagcauagcuggggaaggagucucaaggagaugacauuugaccaguccucaugguuguuugcaaguggcuucucugcuguggaaugggaagaaagggucuuccaggaagagggguuagccuuuguaaaagugcagagaaacguuuguaugagcaagagaguaauuagggaaccgugagcaauuccaugugacucugacuauagguaggcugcagggaagggaagagacagaugaggacugucuuccuagugccuagaacaguggcuggcccauaguagguauucggugcaucuuaguggagaaaugugugaaagaggaaagagagggcugggagguagacuacuacuagauuggcuauggguggagcugggggcucagcauuuucaagcucugaaguuuggucuccuugaaggaacaggagcagcucuggauuuuagaaggccaauucuguccacagugcaccaguguucuaggugagguuggaugauggggagagggaagucugaagauagcauccauaaaucucaugacauuucuaucccagcagugcaaucaaauguugagaauauguccuguagcuuucuuuuagaaaagggguuagcaggccaggugugguggcucaggccuguaaucccagcacuuugggaggccagcgcggguggaucacgaggucaagagauugaaaucaucauggccaacauggugaaacccuaucucaacuaaaaauacaaaaauuagcugggcaugguggcaugcaccuguagcccagcuacucgggaggcugaggcaggagagucgcuugaaccugggaguuggagguugcagugagccaagauugcgccacugcacuccagccugguggcagagugagacuucucucaaaaaaaaaaaaaaaaggguggggggcgggcaaauuauggcuuaaggccaaauccaaccaacagcuucuuuuuauaaauaaaauuuuacuggaacacugucugaccuguuuauuuacauauuauguaugguugauuuagcguaacaauggcagaguuggguguuuucaacagagaccacauggccagcaaugacuaaaauauuuucuaucugguccuucaagaaaaauguuuggugaccucaguguuagaagauuguuuuuagguauuuaauggugccauucuggaaaaguuggcauuguuggaagaguucaaauugaugcauguguagccuaagaaaaauggggccauaucacuuccuaugaagaaacacaccaaaauuuuaauucaauucuuaaguuguugucuugauuaucuaaguucugucucuagucuccuauggcuauuuuuguggcuuugacccuagcugacccagccuauugucaguaguuaagaagguagauuccaagugcucaaugucauguuaagacuuccuugcuaccuacuaagggaagucauuuuuuuagccagcuguuuuaaguucuccuaaccuauuucauaugcuauguucccacaauaaccauucccuucucuugccauuucuuuguccucucuccugcaauguuucuucuacugaaagaauacggcacuacugaaucuguuucuccugggcagggcuugcauuaucccaccuguuccaaauucuuuuuagaaccgggcccuuugggugaaugaugaaccauuuaauagccccauguacuauagaaauuuaaccauuuucaaccaaaccugucauagauaagaacaaagguaagccaucaugugucuagaaaaacauacaacugauuuccucacagacauuacaaguucuuacucuucaaauguacuuuaaaggacugagaguguaauuaggaaucagcagaaguuuuguggaaaagaggcauugagccuuuugcauauuaaggaucaaauuuuauguuuuguaugaagcauucaugaggugauguucuuaaaaaccacuccagaggcacaggaggaacgcugaggacaagacugaauauagagauggaggaauuacgugucuacuggguagagauggagaaggcauauuuauacuagggaugguugaaaucaugcaagcaucuuccauagcuaauaaauuauuuuauccaguuggccuuuacugagggcauacuguguaccggggcccacccuguuggaugccaggaauacaaagaugaucagaguucacuuucugcgcuugaggaucccacagauuagaaaggaggaaaaagaguuacuuuccauacaaggcuauaaauguuacaacaguugaauuuuucagaugaaguggaaggaaacgucuagaaggaagaggacugaaaugaaagaagacugggggaaaagaaauaauaauaaacaaaaagaaaaauaauuugaaacuuuuuagagaagaugauugaccccauuguggagaucaagauuaaagaugaauggcaggcagcuguggagagcagagguggagauauugggaggaucagacuaaagaacugaaauuucaguuguccaagcgggcaugcuguucuacagccucacaugucuugggccuauuagaaauauauauaaucuaucuaugcaugacuuauauaccauacaucacaucauuucuuccaaacuuacauuauaauauaacacauucuguauuaguauauaguaagauuuuaaaauguacaacauauuuaaauauacuccuuacaauuaagccucaguaagugcuaggaacuuugcuaagcacuuuguauuaucuaacugaauucuuaccauggguaggcacucuuauacaacauuucccaggcaaggaguuuugcccaccaagguuagacagauuguccaggauuauccaggggguaaguggcacucacaccagggcuugucugacccuacuuaauuagaugggcuccuaugaaguaaauuuuaggauaagcucuugacuuaaaaaugagccuucuaaugguugugggagagggagaaaaaacaaguuuacagaagauagcgggugaguguggagcagagaacuagcauaggcuuugaagucaagccuaacugaauucccagcuuggcuccacugcuugccagccacauggcauuggucaggucacauaaccacucugaauguccccaucuguacauugggguuuguagcaucugccuuguuagcauguaaaggaucugcaccugugccuggcacuuagcagacacugugacuuguagcugcugcugcuccugcuauaccuaccguccuugccacucuucuuauauucacauccacccauccuccuccucauacuacuauuacuaccuaugcuaauacuauggugguuaugaugagcagcaguaguaguuggaaugccucaaagauaagauuuaugcuaaaaaacagaagcacaguaguuauuuaagaccucgauuugaucaauagcauuaguucugcauuuacuucaauauuuagugagcaugugccauggcaggucucugcgccaggcacuguagaaaguuaaaacaugaagaagucauuuccucuuuuagcugccauauccucuaguuugaccuuuacgccauauacucuuggucagauauucaagaaagaaucuugggagggaaagaguuagugcucaucgagugcagacuggcuugaagcugugcauagcuuuggaaggaaugucaggacuuaaauaauuucaggaugaguugaagauuacauugagcauuuacuacuucuccagauaaucucaauuuccgcccaucaugugauggaggugucaccuuauuuacagguucagauuguuagcgggacacuuuguuauagugauaucuuacagaguuggccauuaggcuauaauugagccuuuauguggggugcuggguaggccacaugacccugguuccuguuuccagggaggccaaccuacauaaaaauggcugucauauaucguugcucagaggggcagauauuuacaacaaccuugaaauggaacuuccacccaauaugaugaagacugacuugugacaguuugauaugccuuuauuuugcuaaaauagcaaccuggccaaauauauuuuucagcacauuuauuauagcuacuuguuuauauuuauagcaaaaguguugcuaauucccuaguauguuaacaggucauauucaaauuguucuauuuuuacuuuggcacaaaauugcugaaggaaacauuuuuaaggcaaguagugauuauagcauaucaacucacuacauagugaauuauauauuaaaugaacuuccugaacugagaaggagcuuaaacugacaaagaagauaguuuucuuaaauucuguauuguuuacauaagauuucuucaaauccauuuuuuauuauagguuacugauugucucaauguuuucuuuuugcuaaauuucuaccuucccgccaacaaauauaaucccccuuuuaauauauaauagaugaccugggauuccagaauggauuuucagaaaccaucaaaaaaccuccucgcuuuaguguauacaauaaauaauauauucuuuuuuaaaaauaugagagucaaauagguauaugcguaaaccuggccaacccuugggcaguuguaauuuccauaccaaaaugcaugagucuuuacuugacuguuacucuguuauacauuaaguacuaguuaccauggcaaccuuugcaucacauuaugacauuuaaauauaaggugguguguuuccuuauaaggaaagacaauguauuugaauuuuugaguguuuggugaaauacaaucacuacuaaaauaaauaauuuuguuuaaggcaauugauuucuuugggaauuacguacauuuccaaccaaaccuauggagugcauucauuuauuuuuauuuuuuugugaugucauggagaaguaaaagauuuuuuuuaaaacaacgcuugauaaguauaacauaauaauucauuaaaugccuauaauuacccucguaaguggcaaaacacaaaauugaaccauauuugagguuauuuaucagugaccaauacuguagcaagaguucgaauguaacaucacaagauuuaugaaauucuaucgcauauaacacauuucuuauuuuuguauaucuaguugguuaacuguaacuaguuuugaucuuaccuauaguugaauuaacaguagcaguuugcucaugcgugcaaaagcaaaauuaaaggagccacugaacucauccuuguggcauuuccaggaacauggccacuuaaauuuaauuaugaagauuguugggcaauuucuuuauuaaauauggaaaaaaccuagucauuucuuguugccaguguagcucuaggccauaaggcuaucaucuuuguuauguagacucccauauauaacucauuuuuaacuuuuuauaguaacuuuuccaaauuauuaucacagcuuguacuuuuuaaucugaaaauagagaaucuaaugaucacucauaacuuuuggugcaucuuuucaauaauaaucaguggauuguaauaugggacuguuuugugugggacauaagaaagagguaagcucugugcuggacccuggcucugcggaacauuuuacauauguuguuucaucuauuccugauaacccuaugauagagcucuuauuagucccuuuuuacacgggaagaaaguaugguuuagagcaguugcauaacucacccccaaauacauugucuguauuucuuugagcuaagguucaaccagauuggucugaccuuaaagcccucccucuuuccuuaauagauuugacuucuacuucugacuuguuacagacacaaugugcaugauauguuuaauguagaaauaaaaaacacugacaaaaaaccuuuaaaaauguuugcuaaauaauaauuucaguaauuuguauuucucugcagcacagcaguuuuuuaagucccugauuugcaagauaucuuggucuuuguaaguuacccaaguccucuuuuguugaaaccaagcauaggacagaaauaaaaauaaauuauaaagguguacucuuggaccuucaggaaucaggaaagaagacuguccaaagacugaccuucaauuuugagcuuugaaguucaaaaguggacagguggaaauacuguguucuucauugcccuuuggugcgagauauauucuagguugcagaguaagugccaacagcagcaaaauuaucgccccccuccugcuacuguaguaagucagcaauggcccuucuguggucagaauggcacauucagcagcaacuauucgacagggauuuacagaaacuuccccauggcuguuaggaaucuuauucagcagugucuuugaaaacccgauucugugcagaauuagcuauguagaaaugaccuagguugugauaaaagguauuuuaaacaaaucuaacuuguaauuucacucaauguguauuuugcauuuaaugccacaaagucugguagauaccuacacauauauuuugcauucauaaguuuuauagugguucagaauuuuuuuccauauuaacauuuuaaaaaauccuggcuuuauagagucaguucaccauacaaagccacuauacaucacuuagguuugugaugaaagaauggaauugcagcugugugaguacuagaauacccaaacaugaauuagacucacaagcauuuggcaauaguucagaaaaagagcuuaaucugguuucaucugagacugcuuuucucuguucugcaacauccccccaagauguugugucugauaccggaucacaacguaaugggagugacgcagaaucgagaaagcccugagaaaccaggggcacauuugcuuuucuccagagauuuucuuucuccuacuucuuuuuuccccucuuccaguuuccaacucugaaauucaaggucauucaccuauuagaugcauuaauuauaagccaaaaaagcaguauucaucguacucugaucucagucauaucuauaauuaaguguaaauauaaucuuccuuuuuagaaauguaccacccacccauuacauuuaaagugcugacugaaaugaaauaauaguucagagcaagaugauuuuaguuuaacuagaaaaaaguugauaauuuaagcuucaagcagugaguucuauuuuugauuaccauucaguuauaaaucuaauuugagauauaugcugcuuuucuguuacucaaguuuaauucaugguuugcuuucuugguuguauaagcaaaguucagugguugaucaaggcuguuaagaagcuccccugaaaaggaaugggggcaggguugagaauguguucgaaagacauucugagaccuauaucugauguaaaacaaacaaauccgauguaaaacaaacaacaaaauuuuaauugaaaaagacacucacagagugcuguauuuggggauuugaauggccaaguuaggaauggccauuugcaggggaauuggcugcagagggugaaccccaaaacauuccaaccugguugauaaagucaguguguuuuauucuuugguuacaguauuuuaggucuuuugggaaaaaaaauuaggagcgaguaaggggaagggcuugucucaucacacuguggacaguuaagcaaaaugcuaaacuauggguuuaagauuuacagguuagcucugccagaugccacaucugccuccaguguuuccuggcagauucgggcagccuacuacugggacccagcauaaccgcagaacaugagcuugcacaaugugaaaaaccuaaaaccauuauaauccuauuuaaggccaggaugaauuugcccauuuugaaaguagauguaguuuucaagcuuaacuuuuauuaagcagaaacuugucuucagagcuauaucuauauaugcagguaaauucauaauauaaacaaauaccuuauccauuuugugcaaaauuuaauuuacuuuaaaucaaacgccauucacuuuuuaaaauucauaaacucagguuuuucagccaguggaaaauuuaucuuucucauugcuacagagaguuaaguaucugacguaaaggccagacaauaguaaauggucauuguucgcuuuauaaguauacucuacaauaagaacacauauauuuuuaucuucauuuucccuaaggagguguuuagggcccccuuaaaugugaggaaauguuuauuuuuguugcuuuagaagaaugauucuauuguccaagugagaaagaaauaggaacaaacaggucuaaggagaaagaaacaggaaugugcuuugugaaaaaaauaaagauuaacaggaaccacuaaagguuuguaagugcuaucugguccuagugcuauguuacugcacauaguccuugcgccugcauauguaagaguuggaugcgugauuuauuaugacuggcccaugaaauuauuuucuuuuaaguuaacaacaauaaggucaaccacagccuguagcuguuuuguaguuauuuuauauuuuucacagcucuauugugaaugcugcuaaaagacaguauagcaaguguguguuuuuagguugaccccuugaaugcauuuaauuucuugagagugaaaaccuuugccaccaggaccaagaggaauuaaccaaugguuaaacucauuuaaaaacacaagcaagcauuucaacauauuugcuuagccguuuucugaauauuuaauauacuucuagagaaagaaaaaugaagaaauaggggugauuugugucuagaauacaaaguuauuuucaaacuccucuuuccaaugaaaugaagacucauucguagauuuaccaaacuguaaggagguugugauuucaaaucauucacagcuuuauugauggaaauuucaaagaaaacuuggacacagacuucacuguaacuuucuuuguuaauaagaaaugcgaagagugaaauuuagguugagauucaaaaacuuuugaaugccacuccuaaaugauaaauuauuuguuacuagauuucugauuuaugcaaaacuuuauuauaauaagccuuauguuuuaguuugucauuguguaguguuuuaauaugucucauaaguucaaaagaggcaauaguugagcaugcagaugucagauuuuuaucugauaaaucugguuuuaucagguauuuaugugguaaacauuaagauacuagcaaugaguuuauuacucaaaaugugcuuucaaucugaaaucucauccuugaaguuguauuuugaaguaauguuuauuacauaucucuugaaaaagucuuaaacuggaaucaguaaaggcgagcuugucaguagcugauuaguccuuuauauaugacucauccaacacucagaaaaaccccuuggaauagagagguucucuuuaugauauuuagcuauauggcgguggaaaggggagguuugaauuuuugauuuuccagcuuaugggucauauuugaccaacugcuuucacuagaagacaugccacuuuguugagcuauuuaggaaucaaaaagacugucuuaauuuaaaacaaggacccuuuguuuuaguuggugacugccuugugaaauuuuucaguucucagcggguuaaccagggaacaggggcagagucauaauuggccuauuuagaguauuuugcaugugaauaguguguuagugaagcaucccuaagucuguugugagugacauggugauuagaauuuagauuagggaaaacacauucuguacuuuaucaaggacaguaauuaguucagucaguaaaaguugauuacaaguaacgauaaaguuagauuuuuaguacuuaauuuuaaaauuucuuuauuaaauaguaaauuuguucuuaauauaaaugguacuaucuacucuuguuuuauugcauaucagaauaauuaaaagaacaauguguucaaugcagaguauaaucaagcgauuuauauauuauggguaaguuucuauguaguuuuuagaaaauguaauauuauauaaucuuucugaugucaucauuuuuagaaguuuaauaauugucacacugugauagguuauuguggaaguuuucuaguguucagguaaauguuuaaucugugggaugugucuuagcuuccgauagaccucaagagggcauucugaaguccuuuguggcuguuagcuuggaauaucugcuauuucuguaauuuugagaguuagugugaggauuugaauuuccucuugguucaguuggcauuuucucuucugugggugcuaugucaguucguggagaaucaugauaugcgguacagagaggcaggguucucagucgaguucauaggcuacacuuacccccaguguaugcagccaggggaaguugugugcguucacaaaaugagguucuucuuguuaaggaaggggaugaauaguucccagauaugagccucagucuagagaaaggaaacauuagucuuauauaaaugccauuuguuuugugaaaugaaaacgugagucaucuuaaaagacuuaaaaaaauauuguuuaaagggaaucaucuacuuuccuccuaaaaguaaagaauuaaaaauucacaaacuuugugauagcuucuuagacugccuuucuuuuggguuuuuguuuuguuuuaauugucucagcuuagcagaugcuguuugcuuuauugcauugguuuaaguacuaacaaucaguugggagguggugaaaguaaaaaauuaaccuuauauguuuguuuucccuuuuuaaccuuuuagcagagucuccuuggaggugacauggauaugggcaacccaggaacccuuucgcccaccaaaccugguucccaguacuaucaguauucuagcaauaauccccgaaggaggccucuucacaguagugccauggguaagguauuccuuuguuugaaugccugagggaugauuaugccuuuuucuuuuuuucuuucuuucuuuaaaauaucgcccccccauccuaccucccaccccaagaaaaccauaaaauuuggcucaguugucagccuggagacuuccccccuaguacacugaguagguacguuaacagcuuaugguagcagaacuuuuuuggugucugcuuaugucuaguuuucucuuagcugcacccauaaggaagcuauuaaaagaucaaaguagcaaaaaguuaaauaucuucauuuuuaugaacaaagcagaauuugauuucugcuagaaucgaaugugaucgugguaacuacaguuugcuaagguaaugauuuaaggaaaugugguaucaucuagaagucuuugugguuuaaccuaucuuaguuaggaaaaugggcauuugggagcugaaagcaucuucauuuucuuucagagguacagacaaagaaaguucgaaaaguuccuccagguuugccaucuucaguaaguacugcuuguuucugcuuuguauauugcuuauuuuguucuguuuuguauugaugggaaggagauagaaguaaaugaguuuccaugcgcccagagcagcacguuuaucuagaagguggaugagguagaaaugaccugcacauccagccaccugacccacauuggagugauuaauugcacauccuggaagacugggugguuauguugauauucagcagguuaagcucuaaagagagccuugaaaaggugccugaaguuugaggaguuuuaccuguacagggcuugcaagagaaugaguauuaguuucauguguugguuaaauucuuugucaguauuaugaugauuuauggauuugcaugcgaaaggagauuuguggagaggauuuaggaaaaauuuacauggguuucagcccagagugcaggaagaaugucucuauuuucuggagagguugcugaauaaaggcugcaaagguagcugcaucaguagccauuugugucuuuacuaccaggugacaacuagaaguagucagcuguaaccaagagcauucugggucuuuuuaacagcuggagcucuaugcagaaguugcugauaucccccacccacccccaggucccuaguacagcaaaaguugguugugaucacaacucaauacaugauaucauauuuugaauucuuacguuccuagauaauuguauuuaauuuuauuuaggacuaguccauuucuaguaauuuucuccucauauaaaaugaaaacauaguuuccucucuucuuucuuuguuucuuuauccuuccuccuuuuuuucauucuuccuugcugugauauaaaguuuugauuuaauucuguagaguacuaguauucuuugaaaagaaugcugagacuuauuguuuuuauacuuuaauauaaaaucauauuuagauuucuuaaaguauauuaccaaucaaugcuugcauauuaguuucauuucauuuuuaauguauuagaagaauaauaggucuugcaaaugugcuaagauuagauuaacccaaacaccuguguauuugacuugauuucaguucagcucauccaaacaauuauuaaaugaauauaucagaauaagucuuaucaggaaaaagaguaaauuuuguaugcugauuaucauagaguuggugauguugaagaagcaucacaaaauuauucauaaauauagaaaaauauuguguaaauaagauugccaaugguguauagucacuuucaacuagcaauaagucacuuaaaauuguacucaguuguuuauuguuugaauuucuguguuguauugaaauugacuaauaugcccaaaggauuuuauaagcauauuuuaagcuugaaguuagggguggauuuaauguugaugaaacuuuagcuuuuaauagguuuuaugacaacuucaaaugauacaguccuaacagcuguuuacauuuuaaacaugccugaacuuaauauggacaauauuaaaugcauuugguggaccuuugaauguucugaaacaauggaauaacuguccuauaaaagccauaaaaaacuuaaagcuaucauacccuccuuaugcuucauauucaaauuaacuuguuuuauccaaugcuaagauuaggcagaaaucuagacaauuucuaaggagugcauugguguggcauuggaugguauguaucugcuuaaucacugucaacaacaauuuucauaauucguuguaaauguuuaaguauuucccuauagcuaacuggccccuuuagaaaauuuuacugguacaguguuuucuuugcuguuaagacaauuuagguguugcugcuaugucgugauacauucagaaauauaaaaauaauuuuccuuucuuucccaauaaacaaaacuugggaauuaggaauuuaguuuuauucuauuuaauuuucuguuuuuaguggucaguuuaggauuuacucuucuuagaagauuuaucuugacuaaauguuuucaugguccuuaugaaacauuuugaugaauagccuuuuuucugaaauauaaggaggaagaaaauacaauucaaaaugaaauuuuuauugcaauuuuuugagcaagaagaacaaguuuagguaauuuuauaauuuaaucauccauuuacucauuaccuaaaaaaaucccagcucuauuuucauagcaauuuaacuuaguuuauguaagcuuuguuguaaauaucaauugcuuauuacuuacaacaagauccacauggcuuaccaccacacaaaauauuuauuuuaacuugauuccaaaaaaggucugcaguagacauggucacacuuuucuaguagcagaucuguauuucuauauuuuuagaccucugccaugcuuuuuuuaaagcucaaauaaaauuaugacuauuugauaagagauacuucuuaaauuguuucaguauguaugaguauuuguauaacagauacuaaaagauuggagauaauaaaagguuuccuuuggagugauuaugacuacauaagacacuuauauguuuucuuugauacauauuuaccaugacaaauaguaauaaaucugucacaaucuguuguggcaacucacuuuaccccccauuuugaagugggcccucucuuucccuuauaauaaaaggaagaaaacuuaaacggugacacugcaucaucagguauuauuugugacacgccugugguacagagacuggacuucugccgccauuaggcugggucuuccucccaggcaaucaggagagagaggggauugccuagcccuguuuugaaaacacugcagcaucugugggagagagaaaacguaggccuggccagacaucaugccauggaucuggcaggauccacgaauguguguuuguacugugugcugcaccuagagaccucacgucacuguggaaguaugacacgauggugggauaacagaagacccaccaggcagggucuacaggacaagcacagcgugucggggggaagccugucccucuagugcacauagaccaguacuugcuaaggugauuuuuuuuuuaaaggaaagccugugugaaagacagcuaucuaauugcccacgagagcucugcuuauuacugcaguacauuuuuaucuucucgguucguauuuuaguauguugcucuuuuuagucacgucccaauuucucguagcccucguuuuuugcgaagaccuuaguaauaaaguguugucuuuuguugaugucagaauuuauuuugcaugucuaagcucuugaaucuacaugagaacaucuuguuuugcuagauuucuacauuuugguuuuccauuucaaaccauauuucaucuuaaacucaauauuuugcaacuuuacugcucauuucaacaaauuuguuuuauauaaccuaauaaucauacacauugaaucaugaauucauacacagaaaaauguacuauaguaaauuaaaguuggaaaaaaaugauuuaugauucuuaacagaaauuaacaugaaaguacuaaaaucuagaaaguagcaaaaaauuuuauauugugcuguuuuaagauacuuucaucaaacacagaaacaaagcaaaggcauuaucuuuuggaaacuuuauucugcccaucaacauguaaacauguaaaacuuuuaucuuagaauuugaaauauuucaaaauuauauacguuuuaucagaaacuguuaacaacuacaaacuuucuacuucagacuuugguggaauuugucuccacuuguaauccgauuugcaucuuuaaugauggucucaccaugaccccaguuggaaucucuugaacaucagauuuuucuggaaauaggauauuuuauccuuagaaauaguuuaugaccucucaucuccagugaucuuuccuaaagcuguacuucucaguaaagucuuuuuucuacguuaaaguacagagggguuuugugugucuguuuuguuuuaaaacucaggaggaccuggcaaacuuuaaguggucagagauaauuugggacacauggaucccaagauaaacaauuucuacuacuauaaagauucuaaaauaagguuuggacgcuucaagaauauuugugacauuaguuaaucaguagguagguuugaaaaauaaaaacaauguguauuagauauuagguucaccaauuuucauaaggaaagaauucuuaaauaaaaugaaauauuuaaguauggauuagaguuuccuuuacagaagcaauuauuagggguaucaagaaaaaugaguaaugcuaauggccuuaaauguccuauguauuuuguguuauauaaaaacuuuccuauuugaagauuucaaacaugauguugaauccauaucuugagcuauuuagggaaaaccccuuuuaucccaggugcuugaagaaaucacaaacaauuuaaaagagauauugguaaacuguuuuuuccuuauuagugggcuggaaauuauguaugauuuaaaaaaucaguacugaacucagaaauauauaauuuccuacaucacuuuugaaauugaucauagggaaaucagaacgaugcuuuuucaugucaacaaauuuuaacaaguaauaauacaauuuucuuuaagaugaaaguuuuauugaaauaugauaucgaucacaagugaacgaaauaucagccaucugggcucuauccuuuuuaggaaagucuggaaguagccgauugugugguaagacguaaaaggaggaaacucuucaagguucaucccugcagggauagauacuuugugaagaaguauaauuguuaaguguuuaaaauauuaagauagcucucaguauucacuuuuaaacuuagugugcccauuuucuaauuaaagauauuggaauaugagguuuggauauuaaaauugugcuuauuaauguuuaggcaagaaggagguuaagaguggcacaauuaagucaucucaaauaggacaaaacuauucacacaauuuacacggcauauauaacaugacaauggggaacagugaaagcugagaaaauauucaugacagagaaaguauuuuugugugugugcaguuaaugcugaauuugcuaaaccagacuucuaguucagcaugugcguuuuuuuuuuuuugugaaaaccaaucuuaucuucucuauuacacauugagacuauagaguuuaugauuuuuaugaauugcugauauaugaaaaaauauaggagaaucuuuauauuuguuuugauuggaggcuuuuguuccauuaaaaauuuuucagaaagcacacaagaggcuugcacauacucaacauacauacuauuaggcauucuaauaucccagaaguuugcucaaggauuucugaauuuuuguuuggaauuuuggaauaaugagcuccuucauccacuauccuccucuucucugccuugaagcccaauccugcacccuuuaagaaagaaggcuucuggugugcauauuuuagauagaaagagagaagaaauauaaaggaaaagacaagcaugaagguuaacuguggaugaaagguuuguguauuuuugagcuauuccugcuuuaucuuuacaaacaaaaagguuguaugccccaaacacucaaacaaaacaccaccaguucauuccuucccccagaaagaagccuuccuggccagcagcaccccauuuuucuacucagugaucucuucuaaggaguggugccugauguaucuuccuacucuccaauguguuuuuauuuuuaaucaaguauucaaaauaguauuuugcaugcuaagauuuaucaggacuuucguuaagauguuagcagcugcuaacauaaacaauaauagcauuuaguguaaaacuggacuuguugagaaaagagaaauacauuucugggaacugcuauuuugaacuuuaucauuuucacugaagaguauauuuuggugugaaguuuuggacucgagagugguuuaaauuacugagaaguguaggaaaccacugcagggcugcuuuacccagagagaauuauaacagggcuugcauguauuuugaaaauaaaaccuuuuucuauggcauccagcuuaacugugaauuuauauuuacgaaauaauguagauaaaugccuugauaauuugauugaauaccauuuuuuaacuuuuaaaauuuaauugauugaaauaguuuuauuugcuaacauagcaaaauguucuccuuuuuuccagaucacugacaauuucugcauuuucuauguuuucuugguuuugaauaauucuaaagguuuucauugaaaguaaugaaucaggaauuggagggcuaaauaagauucucuuagaagauguggcaguaauccuaaaagaauaaggagucucuucaagaauugucaaaguuguauuuucuuaaggcagaauccauacuugucaggcuguugacagacacuugcuuugucuuggcuuuuguuugauuuuuuacauaacugcacuggauuauuaaacugaacauaaaauugcaccucaaagcaauagcacaggauuuucagccuugaucaauuucuacuauccccggaugugugugugcacgcgugugugugugcacccauguguaugagugugcuucuuuuaaaggaauaggagcuuuuauacaauguggugcaaaacuuauaguuuuaaauacuuaauuauuuuaucuggaaacagcagcaugugagugauucuuuuuuaaguugcagcugcugcauagguguagagcuauuugaggaguuugaugcuuuacuugagcauauacucccucuucagagaaguuaagguagugcagaaguuucugcauuuuguaaaauuucaggguugaaaauaaagaugcuuuaugauuuggugagauggauagauuucacuucugaaagaaugugcaaguuguauuuugaaaggaacauuuuaagaauucuacuuaagugguuuagugacacccacucuugucucuugucugacuuugucaucugaggaauuaaucauaaauaagccacuagggaugaaacuugauauauaagugcuuacuuccagaguaauaagaagaggaacuguguguguguuaaauuucacuaaauuuauuuugauuauuccguagagcaggaaauaggaacauuucguagugaagcucucuucauagcaaacuguaaagaaaauuucucaguguguugccauauguuggcagugauuaaagggcauuuccuuugugaaacauggagccauauuagaaagacuuauauuuucucauaaaaaugaccuuugcaaguacauuuaaucaugaaaacuggugucauucgucacauacacauacaaaaagugucacuguuaccauuagggauuuuaggaaaaugcuacuuuggaacaauuauuuugauggcaucugagaaagaauaccuaagugucuacaggagccuccucccuccauggcccauaucauucuaaauaugccuccugaauuacgcuuauaauaauauuguaaugucuuucauucuaccgauuggcacaguauaucauuauaucauuagcugcuaugagaaagcaguuucaaguagguggcagauucuuagcauuaauguuuucaaguaacccuguuuggagaauuggguuguuucacaggugcucagguacauuaacacaguacaauaauauuuucuggcuugcuuuuuaugaaacgaacuugaaguacaaaauaauuuaauaacaaguggaguauaaaaacuggagcucuagcuuaagaaaguuuaauaacucaagacguuaaaggauaagaaaaaaauugucuaaggaggcagcaguguuuagcucauuuugcguuacuacuaaagcugaaauuuauuaggagaauguuuauggccugauuauuuagacuuguugaguuaguuuaaauuuuuuaaacgauuuggucaaguagaaaagcacaguucuguaucuauuguacuauuugaaaguauuguuacauaaaauaaauucgaaauucugccauuuaauacucaggcauaugauucaggagugaaauugcauugccagaaccuuggggucccucauguaucuuaauaugaauuuuauuuuuagagguguauaagacauuggcacauauaaucuguggcuuaauugauaacagcaaagaaaauggaauuaaaaauauuuauuauuaacagauacaguugggauuacaaaauucaaacugcagucaguaauuauuuuacaaauaaaugcuauuucauuuucccuuuaguaaauauaucaguaacuucacccaauauugauguaagugaaacccgacaguaacaagcugggagugcccagguagaaggggaaaaaagcauguucauuuauucauucauuccuuucuccguuuauacuuauucaaagaguauuuuucauugcagcuaaaaacuagacacaccauguaacauggaacaugucuuuuucuucuauguauucuuauuuaaaucguggagcuuuucaacugagauucuucacguuuaaugaaauuugcagucuugugucacuugcgucacaauuuguaggaauaaccuuagcauuuuaaagaguauaccguguagccuuuugagaaagucaugcauuugaaaaauaaaauaacccacaaaguguaacacauggacuuuugucccuuaagcugauugcccuuacucacuugucaccaccuuuacgagagugagggauauguuuuagauacauuuuuuuuuguccuauagaaaccagacucacugcuuuacuuaugcguauuacucugaaauauauuuccagugaaugaauauaguaguaaaagugguguagcaagguagaaaaaacacugcacuagacauaaaaagaccuuucaaguauaacgucugacagccucuacuuacacacccaguggccuugguuaggucacaaaccugcuucucugucuacaaagcagguauaaaauagugccugcauaauaagguggugucaauauacugauaacaaaccuuuaucaaaguacuuauuccaugccagaguacuuauuccauguucuaagugguacacuauuacaucauuugcaucuauugaaucauuuauuccuauaaaaauccugugagauggguacuacuguuuauucaagagacuuaaaaaugagacacagagaggugaagaaacaugucugcggucacacauaguaaguggcagagcugggagugagaccugggcagccugucucuaaaguuucuguguucuuaaccauagugcugucuaugcugccuagcguuucagacacucuguagaccaaaaagcucucuacagcaagguugucauuaaguuagcaaguauuugacuaucuacaauaaauuaauauucagaaauuucauuucacuguagagugaucaucaguaucucuguauagucauguccuauaacuuuugcccaagcaaaucaguaugccaggcaguccaggggagcaucuguguaaacaaagacaguauaauauagugguuagaguaugaaaucugaucaacuggguuuuuagggggcuaugucacuuccuagcuacacaguuauuuguaaaauaaguacucauugggguuugaaugcauuuauguaauauccuugaauguuacauacuauuguuacacauaauaaaaagcacugucaugcuauuaucaguaacaagguaacuaccuuucauuuggcauuugagaaacaaaucuaacauggcagccuacuuaggaguaguuagcaguagaauagaaacuaagaccagggucucagcuauguucaaaagaauuuuaccuaacagaggucacuugcuuuuucugaaauuauguaauauugcuuuuuuuuuuuuuuuuuuuugagauggggucuugcucugucaccuagguuggaguacaguggugcaaucauaguucacugcagucucaaacucccaggcucaagcgguccucccaccucaggcuccugaguagcuggguacacagguucacaaccaccacaccuggcuaauuuuuuucuuuuuuuuugguagagacagggucucccuguguuucccaggcucugcaaacccaucucuaucaaaccaagacacguagucagcccuuuuaaucauuagaccuaguggucugcaaaguuuguguuggaaauacuuuaucuucucucuuuugaacugguacaucggcugugaugcccggagcugcuuauacugugguucccuuggccaauaauuuguuuaugccuaaaucagccuugccucuaagugauaaggagauacgugcuuuuucuuuuguuuugugucagugguauucucuaauaggccgggaacgggucugcccaagugaugcacagccccuugguggggcuggcuauagauccccccgcaaaacugaagguuaggccuaagauauuagcuuugccuggcaagaugaagauguguggacuagguagaccuguguggcagucuguuucuuuuauaaaguaaacagaguucaguuuguuuaggacugcuuagguagauuucuuacacugagcaggaauauuuguacagauguuuuaagguaaagucaaagaauggcuagauuguagccuuugacgcauuauaauguaucuuuucucagugccccuguugaauucacaaaagaaaagguauuuuugaucaucggcuaugagaaacuuaaaacacuuuuuuuuauauauaaaggcugauuuaguuaacucuucuugcauuuaaagaaaaaaacaucugcugaaaguagggaggggggaggugugagcggaagcguggucuccacauuccacaaugaaugucuuuucccagccaauuuuaauuugcagaaaaaccaggcacugaguuagauuccucgggaaaagucccuguuggcugaugagcccugaacuucuuccguguacacccugaacagggacugaugcuucaguucacagagauaauuuuucucuggaaagccgauagauccgauuuagccaccccucauuuguagucauugccaccuuguggauuacaaaggauauugguuuucaucaaacuuccauuucgauuuggcuuuuuauggcaaguacacguuggcaguggauugccguguuccucaccaaaaggauccugguuuguucagcaacaccucacuucuccacucacaguucauuuaugauucugaugagaguguuuuuucaggaaacacacauuucacuuuuugaccuaggagcaucuguuagaauuuuuuuuuaauacuacuuuggcauucugaaaguguuaaugucuuucauaucuguuuaaugcuauuuagggauauuuaugaucaccucuugguuacucaggguaaagugugucgcaauuuuuuuuaaacagacaggaaagcauucacaugaggaaacagauugcuuuaaacaugugcuuccugugacaguaaaaagaacaaauuagauuuaacacuguguaaugaaugcauaaauguguacauuuaagcuuuuaaaagcuuuauguucaguucuggucacaacaaaaauugagucaccuguaaaaauuaaagaugcccaggguacucucagacuuuugaaaugcccagcaauugcaguccucaccugacgaugccucguuggaauuauaaaaagcaugaucuauuagugcuggagagaacuagaacauuacaaggcacauucagagguuaaaccagguuacagucagauuccguacauuuagcaaauaaaucagaauuuguugugggggggagaauacuucacucucaucuuccucccuaagaaucaaugaaaaaaucaauuuucgggaaccccauauauuccucugucuuucaugaaagaaaaagaaggaaaccugauguuuacuuacuagcauuuacuacaauuuaauuauauaagaaaaugacucuuuuucuuauguaauucaguuuguguuuuguaugcuggcagggagugaauagaaucugaguuaauauuuccaguuagacuagaguguggaauuggagggccugaauccucuccccggaagaagaggcacucauggccauuucugucugagccugcggauagugccucuccguccccugugcuuucaaagcuaaggauuuguggcacgcuugccaucucucuggccaaggagggccaggagagagucccucgggggagggcacauaguuugaggacaucugacucucuucuaucacauacugagguacuaauaucaaaacagacugcuugucgucgcacgguggggcagugcuuuuuuuggcugccguggucgaaaugaaaugggcaagcuguaguccgcuuggcaucagaaugggcuaagggaagcagggaaaucagagucagacugugaaugcaagucacagccaaugguuaacuuccuuuuugugugucacuuggcagcagcgagacugauggugauuuuuuuuuuuaacaugggugagaguucagugcccuaggaagagccguagaugcuguuauugugcuuccucauacaguugacuuguguugauuucuugaggccaguacagcuguuccaagagccagcuccaggagcuuuguguguauguacauggccaucggacgucggaugaaaaagguaaacagaugagaggugauccauacaaaaucucacugcugaucacuaggcagucuuaggggaaucagguucuggcauaaggcaauaauaccaaagaauaauauauagugcacuugaagggauacucccuuguauacagacacccaaagauauuuuuaaauuaucaccacuccgcaccccucaucucacauacaggauucaaaucaauuuuggacugucuggaaaauguaggacuaaaauagccagauugaauucagauaaaauuaccuucugcuuuuuugggagguuguugcuuuuugguuagccacauuauuuucuuugaagauucauuuggaagagaguuugguagaauuucuagccucucucaagauuuuccucccauuucucuguuugcaaagagcuguuccccaaaggcaaaaagagcgaguugccaucuugagcgaauuguauguuuagugaacaccaaauggucucagaguuacccuaaauuuucauuauaucugguugcuuucaaauacuauuuauuccccucaaaacuccuaaccauuuauauaagauaucaguaagaugaccaacuucugacaacccaaaagcagggaaggaagcuuagaaauagaauaccauuugucugguaauuagaguguaucucuuaagaguucgagagaauucugauuaaccuuucuguucccacauucucacguaaaauuagcacaccuuuuaaauuauuaucuaguauuuaaacacauauuuuugagucuucuuaaugcaacagguucuggggacacuaaaaguguguuauaguuuucuaaaaaacuucauuuuucuuacauuuuaaauguucuguuugugcaaaauuucgagaaucaccauaagggcuucuuugcauuuuuaauuuaguaacuaacauaugaauaaauuugcauauuaauuaguugcagauuaaaucaugcauacauaauugccuccuuacuguguuuaauguuugucaaaaucuccagccugguuugauggaugucguaugaaagauuacaauuugauguacccuuggaaguauuuacaccaauaaugcaagauucuuaauagcagaauuuucuaguuauauacaguuacuaauaaacauguaagauagguacaugucccuuugacuaaaauuuuuuucuuugcaccaaaucauuuacuauucauaaucauuaaugcaucuccuaauuauacagcauaugucuguuaacccuuucauugcuggccuucaaaugguagcuucuuucuuuuucuugcccccuaaagaaagcaaaauuguuugauaauacucugaaauuacucgauugccuuuuauuuauuucucuccuaguauauggacaaaccucauuugccauuuauuuuaacauacaauagauaauuauaugaucauuuuguauuuucuaguuaaagaucauaaaaugacccacgugcacaugguuaguagcugaugggcuuuugccuuucuuuuaccaaugcugaaaaaaauugaaauauuucagauacuucauauaguaguaaaaaaaaauguauacacagacauacucucuauuuaggaggguaauuguagaauaaguaaaaguauuaaaauuauauuuaaauucauuuugaauauugaaaugcauuuaauguaucaugaucaaacauaggauggaaaugugauuuuuuuuauuagaauugagaucucugaaguagaaacugacaagagaauagaugcucuugauuugacauaauuuuaaaaugccaauaaauguuuucucaaauuucuucagguauuuaauuuuuuaaguuuuaucuuacucauauaaaaaguagaccaacuggcuuuuuuuuuuccuuuuuacuauuuugaugucuaagcugcuuaucacacuguauuacccugcauuaaugaguauuccuacugugcaaaauucuaucaaaaaugauggugugaaugucauuuuuaauuggaaguuuauacagucaaauuuauaguacacaacaaaaaauauguauguaguucugcuccaagccuuuuuuuaggcuuuugaucuuuuuaguuuaaguauacauuuuuauuaaucuaagugucauuugaaaaucuacacaaauaugacuacauuuuuuauuaauaccauuguauuauggaagagagggaaacuaaggcauagaguaauuauaaugucuguaaacuguaagaagaacaaauacaagaaugaccaagaauagauuuucaggggucuuuuuuagacaugaaaacuugcugaccgguucuguauguuucacauaagucagacuguaugauuucugucuucuuuauuuuugaaugccugcauuuauaugccuaguaaaaaggcaaagguuaaaaugaguugaaagcauaaacagcugauuucccuucuuugauucuuucauaggagaaauaaugucuccuggucaccuaccucaggagcauuuauuugcuuaucacaggacacaaugaacuauuuauugauuuaacacaacauucuuuuacaacacgcaauauuacauuaaauuauuuagcaaugugaaaaaugaaaugaaagcugcaaaacuuauaaaaggaagcaaacagucagaccugaaacauauuuauccacagccauugugccuagguaauucagggcauaugguauguaaaugauauuuggagauccuugccaaaucuacacacgacgggauaaauuaaggacagguuucccugggugugagucccaugauuguggccggcacacuuccugcuugaauguguguguucuguucuugucuuucagcaagagcgucacagagcauucaguggccaaaucugguccucagcugacuucuaagacauuauuugcaauucccaagaauugauuuuaugauuaaauuuaaaacauaguaccaauuugccaaacuuucccuuugcucucacauuugaaaaguaagaucugaauaauuugucaggauauguuuagauauuaagccauuuaaauggguaucuuugacauuagaaauugagugccucugagcuucuuagucacugaagaaagguguuccugagcagugacuuuucucuaagcuaggauuaagauguuuccuagaacagacuaugaauuauuuugaacgauugauaauuuugguuccagguuggcccaguaauaauuuauuaauucaacuugacaacccaaauuacugguaucacuuauuuuauuuuugaauuauuauuuugaagcauauacucucauuucuagaaaggugaaggcacugacuccuauuuagaauaaauuuuaaguagguaagagguuaugcuguuuucuuuuuuuuugaaaggaaugucuuuucuaagcugggggucuuagcucagaguuuuuaaugcuuuaaauuaagguucauuuuuaucuuggaauuaugcaauuggagauuuugauuagaaacuauggcagaauuuuuucuccuauaauuuauuggacuauaccuaaagagugcauuuacugugcacacuuaauuauaaauacaagacuuauauguuauuuauaaaaguuauuucgggguauuuuaagacauguagaguauggcuuaggauguuuuauuguuuuuacuauuaagaauaaugcuuuuacuaaauaaaacuguguuucuuuuauaaaagauaaugcucuuaauauuaugguuuuauuugaauuagcaguuuagucuguguccccacauuccauuucauuuauggaaugcaaauaacacuaguuacugcauagaaaaugaaauuaggcugaguccuuguucauugcuguguaaauuggguaaaaaucagagaaaaaaaaauacccuugagaucaauguaaaucaauacuacuugagacagauccagcuaaaaauucaugaaaggggucacaguucuggaggaguuuauauaauuaucauguagccuauaguuugugaacucagggcaaaguucugagcugguuguucugggaccauuccuugguucauugaaacuacuuugcacagcugugcuucaaacucaacaacagagagcaaaaacaauauucacuauaaaauaaaccucguccugccuuucaacuucacugugaacuugcagucuugaaaacaacaaaagggauaaucgcaauugagauuacagaauccagauuagauguaauacacaguagggugguauggcccaauuuuacuuacauggggcaaguggaagugcugugaaugccaacauguuaagcaucauagccacuuauuaagauguuagcuuuaaaugucagucuuuggaccccauuugaaaugaagcaccugcauuuuauucaaagaaauuaagauauauuggggaaugcggaggugaguugaggguuuuuuuuguuuguuuuucuguuuuguuuuguuuuuuuuuucuggugggagaaagugccauagacaauagagauaaaauaucucaaguauuaaaagucuauuuuuauacacuguaugauucaaaaugacugagcaguuuugaaauuuuguagaaagaaaggaauauaaggagaauaagaaaugauauuugcaucuuuacagacaacucuguauagcacauuuaagauucuggcaauuuccuuacaaguaucugaaaauuaggaauuaugaaggaaacccagacagauacuuaacuauagcauugcuaccaggugucucuuugauaucaaugaguuaggaaaccuuaagaaaaaaagguuaaaacauccagaaugauaacuuauuuuagaauaugcuuucagacaaaauauuucuuuguuaagaauguugaaagguuuuauuuaauuguucacauauauuuaguaaauuuuuugguagacuugaccgauuaggcuuguuucauaaaagaugugggcuucuguguauuuagaucuuaaguuuauuucaaauuggccuuuauaaaacuuuagugccuuucucuuagaauucuagucaacaaaauuauauucaucaaguguauacaucacagaaguaacuggugauacagaguauaauuccuaccauauugucaaauggagucuauaucuccucaaagggaaagaaacacugacgugagucagaaguuuucacucacuuggcacugaaucagcuuaaaguucgagguugaaaaauucacaaauauuuauagcacaccuacuaagugccacgccuccuggaagguggacagcaauggccaauguuucugccauuggaaagauuugcaccgaaguguguauggccacauguaguuguacaaaucagaguucauuuuguaaugcuuuauaagggucugguaccacugauucuccuugcagacuaauaaacacagagcuuauaugacucuuaaaaauacagugauagcaagugcauccuaaauuauguaaucaugugguccaugauaacaguguaauauaugauauacagauggaaucagccaccuggcuuacuguaauuguuguugagguccuuuguuaugaacauauauuucuguuaacaaugcaacaaaauaauuuuuuaagcuguuuuuuuuuuucuguacugccucaaaucuagauaaacggaauguguuggaaaggacaacaaauaagaaguuaaauauguggaaaugacauggaaagcaccuguuucuucccuuuguuuucuucuacgucaucaggaaauaauauuuaaccauagaauauggugucccucuaagaaaauguuuauaauugaauguucaaaguagaauauagauuaaauaaguaaagaugacuugccaaaaaaaauuaaagaacauuugaaacaaacagaagucugcaucacacauaauaaguggcauaacaguaucaccucucaaaagugacaauagauguguccaucuuuaugccuuuagcauguuguuggcauuauuaguuauuguauugagagaguagccacgcuauacaagagaaaggaagguaaauuagaucccucacgcccccuucuucugugaauuguauauguuuuugaauacacucucugccaggacagcaaauaaaauuugguucaucccugauccucagcagauuauaaucuagguaaaggacagaccagguucaugaaaucaaaaauaauaauuagaacauuuggaaacuaggggaacagguccucauauugugugcauguuuuaucagucuaaaguagauauagcucuauugaaaauuguuggcuaguaauaugcucauuuucccauuucaugaagacuuauucucaaauggaaguuacagcuggcuaucguguuuuuccgacaaacucucuucucuguggacaugaugauuucuguuguuguggaaaggaaggaaauaaaucucuuuuuguuccucauucacucaaugagcaaagugugauugagcuccuauugugugcagauuauauuguuggagcacaggacaaagaaagcuaaauuaucaucuuuguuuagaaauuuaagauauuugggagcagcaagguagaugccuaugccuaguuuauuuaacaaggcacugaacuuugcuggagaauccuauauucuagaauauaguccuuaucuggaagugacuacagaaccugauucuggaucacagagagcugcagaucuggugugauuaagacaguggccacagauacuccacugagcuucugucuugcagcuucugucugucucuucccugaaaaucacagggaccacagauacuccacugagcuucugucuagcagcuucugucugucucuucccugaaaaucucagggaccguguggaguuuugcuuggucaacuggagaaacaacuuuugauuguuuuuauguuuuucagagauuuauuugccagagauauuacauuauaauaaaaacauaaacacagaaguuagggauuggaacaaagguuauauggucacaauuuaacucauaguuauuugaaaauuauugguuuauaaggaaacagauuuagacaaagcuagaacuuaugcagguaaguuacaaagcuagaacuuacucaggcaguugcucacgucuguaauucuagcacuuugggaggccggggcgggcggaucacgaggucaggaguucaagaccauccuggccaacauggugaaacccugucucuacuaaaaauacaaaaauuagccaggcgugguaguggugcaugcugguaaucccagccacucaggaggcugaggcaagagaauugcuugaaccugggaggcagagguggcagugagccaagaucacaccacugcacuccagccuggugacagagcgagacuccgucucaaaaaaaaagaaaauguaguggacacaauacauuuagauuuuuaauaaaguagacauauguuuauugcagaacauaugagcaguugauuaguuaaagauauccaacaugccaggcgugguggcuaacacuuguaaucccagcacuuugggaggccgaggcaggcggaucacgaggucaagagaucgagaccauccuggccaacguagcgaaaccccaucucuacuaaaaauacaaaaacuaucugggcaugguggcacacaccuguacuccuagcuacucaggagcugaggcaggauaauugcuugaacccgggagguagagguugcagugagccgagaucgugccacugcacuccagccuggcaacagagugagacuacaucucaaaaaaaaaaaaaaaaaaaaaaauccaacauugcuggcaaguuugaaggucacagcccauguacaaaauugguauaucuugaggaacucuugucuuuaucauauguucuguaccauuuccuugcacacaacacaguuacuauaugaugguacuaaguagauacagguccagaccccauaaagaauguggcauucaguucuugaacagauguuagagaacacaacccacucggcaguaagggauaucuucaacuagagggaagggugagaguugaccuguuuguccuuuugacucauauuuagaaaugcuaaaguuguuuuauguucaaaaugcauuugauaaucaugccugaagaggucaaagugcugacauuguugaaaacaaauaccccugucaaacaaauagagacaauuuucaugucuuugguugguaagcaccauaauuuggccuuuggcauugcugucaguaaagcuaguugaugacuuuuacaucaauuuuuggcccaaccauaaaugaaggaaauaagaccaauacugccacaguacuuuuucucacucaucacccauaccugauucagcuggguuaauguuaaaagccaaaauuuaucaauaucaauuuuuuucccaaaucauucuuauuuuaguacuguuuaugcucaauaaaaguuuaugaauuucuuucacuguuauuuaaugaaaacccagaauuuuuuaaaauugcacauuaucucuuuaaaaaaagucuuuuagauuacucgugggauuuacucuaaguuguugucuuuuaauagaagaugaugcaaaacuugucucaccuguuccuuccuggucgugucuguguuuaugugugggguggguauauaagugcuuuugauuaacagaaugaagagagugcuuauuuugaaaacucagucguuaaaauucaaguuuauuuugaguuaaagaacaccauauuuagauuaggaauggaccaaugaccugcuuaagcuuuaggcuaucgauuggccuugagggaacuuagaucugcuaaacacgaacuugaaaaggcacuucagugauggauguacguuggaugcucucacuguauggucauucacuugcauuuuaaaauuuauguuuuguuuuuccuuuauaccuacucuuuucauuccguuugucagagguggccauuuaaaguauuugacaauuguuuguucucugccuagcaaguuguccuauugcuccaugaugugaaagaacaaagguaaucaacaguuagaaaccucaggaaauugcuagaaucuucacccccaaagaggguuaauaaacccuagauaauuaguucauuuagaaugaaaaccauuuucauuguaauaaucacauuuccccucugauuaucgagcaaugcauugggaagccugauauuuauucacaaauuuuuuaaaauugagaacauccugugcugagauuccagucagcuucauccauccauuuuuuguuaaaaguuucucaacuaucauccuucauccagacaaauaaacauaaccaggauuuccccucuaacuuuuugggaauucauuuacacguguaccauuuugagggaaaaaaacaauuguccucgaauuucauuugacucaggugauugugguaagcucgcuaaccagcuucaucuaggaagugcagcaaucugagucaacuuccuccaucucuguuuuuacauuguccagugugaugcuuccucauuguaccaaaauagaaaugguuuguuuuuguaucaaacuuggagacuggcuauggauuacacuggguuaggauaaggguuuguuauuuuuuuuuuuuuaagaacauuccacuuaucccaagggaaaaagauugacggccuggggaaaaauaagaggcauaaugaagucuuuucuccuuaaauaaaaaucacaucuagucuucagaugugucaauugcacuauguuugccuaauuucauuuaauauuugagagauuuaguaguaaauuuaugacuuuugcaguuacuuugcaaaaaauugaggaaggaagaagugaauuucacuuugagucaaauguguagguuccaguguaauuaaaccuaaaaaucuauauauucuggucuugcuacuugguauuacacuuugccauaucacauaaugcuauuagcuacauuuuaccuuguuugcagggugaugccauuuuguaucucugguuuguugaauuuccuagaagauguuauguucauguagauaauggcauacucauugaauucuuuaccucagacaugaaaauauguggaaaaguggggaaaugaaucugaucagauuucacuguauacugaaauuugagaaucugguuuuugcaucuauuuugcaugcugcugucucuccaaaccauauaugucugugugaguuuuuauaaugccacauaaagcaaaaugagaagucucuucuuucuucuaaagggaaauagugccacagaaagguagaagucaaauauuuacuuauggaucaaaaaucuaguuaaaaaacaacccauugcuuaccuuaguaaucaaugugaauuacuuuauaaucaauaugaauacaagcuaucugaccagucacucagaaaauaaauauuugaucaugugauaaaccauuugaaugucuacauaugaacccaggccauauaaaaauaaccaauucaagauaacauaggaagucacuaaaaaagacacaaauaaaauuagauuucacaguuuacgcugauauuuugauacuuuucugugauaaaagcaucuuccaaacuaaauguguccauauuugaaccauguaaauaguuaaaaguauuuuaccugagaauaucuaaaugaugccaagaaaauaaguucaugccacuaaaaagauugagaugauuugugcuuuaucugacuucuugguguaauauggauuuacuucagauaaguauauuuucuacuuauccgauaaguguguuuaucugagauaaauauuuucuccagauacguguguauauugaaaaaaaauuuaaaauaauuaggaucccaauugaaaaaguaaaaaucuuaauugcuuaauaagaaaacaguuauuucauagucuuaagauuucaauacaaagaaauaugggaauauacacguaagagguuuguugguguucauuauuaaauugcaaggcugucucaaguuauugucaucagaauaaauucugugugugugugucugucugucugcguccuccuguuaguaauuagaucuuuuaugaaguuguacucauaccuauuagggauuuuugucauugcaguuuuaaguugaauaugacacauggauccuuuguugggucuaagcuaucaccauuuauuacaauuuuuuauaacauuccauauauaugcaucuacuaacuaaacaucagccuuaauuuagcuuaugaauuaaauuuuuuguuaggagugacuccugcuggagagcaaaaaauaccaauuaguuuagcuucuaaauaaacuauacuccuuuuuucaauggacaaggguaaccuccuauuccuuggcuuggcaacauuuacuauuccucuaaguuuaaagaugagaacauagauuugaguacuaacacaucagcagaaauuauauuuuuaaguacauacauaauucucaggccagucguguuuggugcuccaaaaagauuugugauugaauaucuuugcuccauugggaagaguuuagcauggugcuguauuuuuauaauucuuuuuuccauuuuagcagacuucaccuaagucuauuuuagguggagauuuuuuuuuuuuuuuuuuuuuuuuuuuuuugcugcugcucuuuaaggcacucuugcauagaggaaacagcagaggagacacaaggaaaugcacucuccuuuauaacaugcugcugauucucugaacuagguguccucucauuuaagccucaaaagaagcuguguauuaacuagaugaaggaacuaacacucaaaccugugauacagcuuggccagagucacacugcuggggagcagcaagguuacucaucaagaugugucugacccucaaguuuaagugcucugauuuaauaacuuugcucacacccugauuccagugucuuaguagcuuuugaucuauaaaaugucaucuaaggaucuuugagccuuaauucuuugucuuuaaagugggaaugauaauaccugccacagaguacuaguuauggagauuaaauaagugaaggcaauuauuauauguucuuuaaauugugugucacuguacugugcauguauuaagugucguuuuauuagcaaauaucuuuuugauggguagauguuuaccugaggugguuauuuaauuuauaggcuggcuuguucacacuauguuauguaaucauuguauauuaaugaauaucacuauuuuccuuaggauaugauguuuagcuaauucagccaugcuaggcaaaagaggucagcauuguagaaauaagcaaugucuuauacugaaaaaaagaaagacaacaacaacaaaacaacaacaacaaaaaacaacuuuccguguucagugacuuaaacagaaacauggaguuguucaaauucuaccaaguuauauucgggaggagaaaaaugggaauuccuuccauaugaccauucuucauucauucauuuauucagcuucuauuuguugaguugccugccuuacacugcaauaugcagggcaguuuguguguguguagauguucauuagguuuauuugcacuuugcaguaaccauguaauauuaucauuauucagaaauaaagguagaaucuacucuaaugagcucuguggucgaguggauaguucagcucuuuacccuguaauaguuuguuaucuaauuguuuaauguaugugcgauugccuucacaauuaaagcauuauucuuuagucauauuuucucucuuuucucaauuuucucaggaagaaaauugacaugucugugaacccugugcauguccccaaauggagcuuaacccaaaguugggaaucacuaaauaauuguucaugaaaugguugaauauagcucuucauucaagugauguagauucugaauauuuacuuauucuuuaaugcaguuauucauucauucggcaaguuuuuauugaacaucuaccuuguagguaauacuaugccaaugcauuggggguuuuaggucaaauauuucccaguuucuuauaacaaauguauguguguguugucaguucugcuucaccucaaauauaucugucaaagacuuuuuggaaaauuacaaaagaacuguaaacuuuagauucuagaagaaaauaagaaucguguggguuucauuuaaguggucaacacuucuagacaguuugcugguaagaauuuuuuuccccaaaaguggcagaaaaagacaacuggguucauugccuacccccaguguccucaauagugcuuugucuaagcaccagagagggaugguggcuuucuguauaguguggcuaaccaucauuccccaucauuucagcgauaacaaggcugggcauggggggugggggugguaccaaguagguaaccaaguuaccuacugcuggcaagguaacuuguccaguuauacacuacugugaaaacugugucugugaaacaagcaguagacuaguucaggguccuguaaaaauuggcugcuuaagauuaagacuucuuuaaaauuauucugaaacacauggauuuaugcauauagcuucaguuguucuuauacuucuguucuaacuccccacgcaucacacuaaaaauuuaucauggaugauauuucugucacaaagaaaacuucaaaggcugagaucgcagaaaugucucaguugacaagccacugacuugaguucugugauugaaauguacuccaaggucagcaaaccaaaaccaaacaucacuggaugauaauacguucagugucucacuggcuauaauucguagaucaccuuucaaagcauuauaucuuuauuaaucauuguaaauuugugcuuuugaaaucuuagacucguuuccauuaggcaaugaagcccagaagcuuaauguucuagucucauuuuaauuuuuucagucuuaugugcugaauugucaggguuuaaaaaucgauuucaccucaucagauuaaaaauauuuauuuaugcacauguuaacaauauauuaaaagaaaugagagcuucaauuuuaaaaauaggaauuguagcucauuaagccaugacaauuugguuuauauuuacauaauuaauaggaaggcauuuauauguuugcaaaauagguaagaaaagguauuuaacguagaugaagcagaaugauuguuuaucaaaagaguuuagagaucuuucuagcagucuacccauggaaaguuaggaucuagaaaagccuucucaauaagggaagaaacaacaaagaaacaacaaccaggaaacuccccaacuuaucucuuuaaauuccagccucuuuucuaaguggugguuuuuacauacuguccucugguagguggguacccuggccuuguguauuaagcagugagggugguuuaaagguuacaaaugugauccugucagauugacaacuaacuguucuaaugaggaaaaaauccucaaagcaugaaauuugaaugaaaugugugauuauaauucaaguacuguuuacacaaaccucuggggaccuuccgaauaaaugcagagcaagugaguuagacaaaccucugggccuucgauacguguguguggaugugcgguguguguguguuuauuuuagagaguggggaaacuuuccaccauuagcccgggcuuugcuccucggaaccaacaccacuauuccuccuuguuuauuaauacuguauguguuuuguuagcauauugaguuguaaggaaauaggugcuuugaauuauuaaaguugauucuugagaauagauguaugcucggguggcauuugcuucggcauaugcaaaugauuuaguuucauuugggaucaauucccagaggcccuccuuuccugugaugcucugaauuuggcaagcucaagucagcccaucuccucuccccacaucccucccuuucuuucuuuccuuuuuuuguaccuccccccgccuuuuuguugauugguauaauauuuuuaaaagacaauaaauaaauauaucaacuugcuugugagaaaccuugccaucuauaaggauucuauuguucaguugugaucaauaaaggugaacaaagguuuucacguucuuaaaguuuagcaaaaucgaaguuuaguaaaaaugugcaugagauguuugcuaaaauauuuauacagauacugggcugcggggaugcugcaaaacucugaaaauguggucucaggggugccuuuggggaaacugacagcuguaagauauucgucgguucgaagguaccaauaaacuugcuuuagagcccagcaaauagcgugaaguugcaguagauugucuaaagcuacagugaaagcacccaacuccagaguggagaacgugcgcccuuggggcgcccagcgccagcgaggggagcagcgccccagccccuccguaggcucugggcccaugcggcugucugcggcggggcgaggugaaguucaugggcggccgcgcuucccaccagcuccggggaggccggggcccgcggagcccggggcgggccgcacugcuacucuguuucauuccgcaaccccguuuuguagguuguugaccaagcagucagaaaacacugcccccucucuccuuuugagcgaggucagagacgugguguuuuuuuuuuuuuuuuuuuuuuuuucuucccuccccuuucccuccccuuucuccgagucgaguucucaggcagcugcguacaaugcugggagcuagccagcagcagagacagauggcagaguuauuagaugugcaucauacgauucccuuccugccacucgcuuuuuaaucaaauuaaaacaaaaaagaaagagagggagagagagagagggggagucaauuaacugcauuuguauucugcucaauaauggacccuguuccacuuuuacccuaaggcaguugaguggaaauuuuagagaagaaaagggugccuagaacaaaacaaaacaaaaaaaaaaaaaaaaaggaaaaaaaaaaagaaaagaaaaagaaaaaagugaagacugcagaaauuuguaagaaucggcauuauucgaggaacuaauaaaaaccccucggaaaaguugaaucgaucucgcguaugcauuaggauuucgagcuccaucagggccgggcugccuuccagcuccgcugcgcaaaguugagcgucugacagcagcgccgcggccucccccgcccgccaggaauggucucuuccugcuuugcauauucaccacgcuuggcccggccauaugggaaaaugcaacugaaggaauuguugugaaaaaagggacagcgaguuugaaauaaaaguuguuagagugguacugaggagaaaaaagaauccgagaccauguacugcgcauacacaaucccgggcaugggcggcaacucuuugauguacuacuauaaugggaaagcgguaagcgaaugcgggcugcgagggggauuuuugacaaguuuuauugucgcagggaugagcauccuagguggugaucauuguuugcaaaguugugcaggacugccgcaccuuccugggugccaugaaauauuuaucauuugccaauccuaagaucuucuucuugccuacuucuucuccuucgucuuuuuuuccccccacuccucccccagaguagaaaaauagaugcuuucagagcuuuagagaguggauccuagagcgaaaguuugcagucagguaaaguugagaggugguaugauuuuuuuuuuuuaaagaguuuuggaaaauucuuauuccuuccaaaugacuguuagaaaggaaaagcagauaugagaagcagaauugagaaagcccaaguuaggcugagaggaaauuugggguaaguuucucccuggauugagguuuugugauaucuaaagucuuacuaaguuggaagcuugagugcaguggauagaguggagagaaccugaaagguuaaaauagagcaaacacauaaaacugagagaucaaauuaaggaguagauuauauaagcuuagauauauauuuaaagccaaaauggggaaggaaaaacaaacggguucauucaugcauauaacaguauugucauaaguuauuugugcuguguggcuucuucccucaauuucccccccuuccaacagaaacgcuuuauuuaagaaaaaaaugugucugguauuuugugcauaaccccagcagaagguuuauacuugccaucuggagguuuauuuuuuuuuuccuucgucugggcccacugaaggaaaaggauuucaauauuuucaaaucgguauguggggcucucgggaagaguuguugggugauagaggagcaaaaauuuauuguuuuaaaauagaaaagaagaaugagagaaaagugaaaagcagccauuuauaaacuguucucuuuguguacuuugaacuuccauuuggauugaucuuaaucagggauaguugggccaaaggggacagaucagagcuuucaggaaggcccaguucagcuguagcaauuggcgcaaacgaauuaaacauguguaugugcugcuauaugccugugaguguauauacauacagaugcaugcauaacgguuauuucuagaugagcauauucuguaauacauacauauacacaacuguuugaaggugcaguuucagaagauuaauaauuucauuuaagaagccaguuuuaugaaugggcaacuugaaauaauaucguuuacuuuuauuuugaaaaguacgaguaaaucaucaaaaguucauagcgcuauccuauuuuuaucuuuuuuaaaaaagagcacgguguaauuaaaauaguuaagugugguaagggaaauauaauuuuaaaacaaaugguuuucguugugauuugaucaaaguguuuaaaucuguaaacauaaauauugggauuauguaacaucuuuuuuuuuuuuuaacaaguacaugauuugcaauugguaguuacucauauauagauaagacuuuugccuauuaucuuuuagauguucucauacauaacuuauucagcaccuuucauuuuaaagcacuuuuaaugaaaauuuugugaaugaugccaucguagucaguaagcaaaagugucucugaagcagauucagggauuagauagcccuuauccguaaugaaagacuuacauuauaaaagaauauaaguuuccaugguuuuuaucuuucaggauuaccaaugaugugacuuuuacauguuaauuguuaauuuugcaucuuaaauaucugaacugacaaaauuuuaauuuaaguuuuguaccuuuuaacucccuuuuggccaaaaggaauuuucaaaaauauguauuccauucccacagcuugccaguugccuccaccguaagaaaaugcugaauaugacaucauaucacuaauaugcccucucaguugccaaauauuuugguuguuagauuuuuuuuuuuuuugagaggaugguacucauaaaaucaagaucgcucugucacaggaaauguauuuauaggaacuguuuuaaggcguuuauuaaaaacaaaucuggugauguguaucucuauugauucaaacacuagaaagaggcaaauuguacacacauuauaguuagaaaaaaaauagccauuuggaacaccagcagaaagcuuuugaaacugcggauggcuaccaguuguccaucuuagcuuuaugaaacagacagcaaaguccaguugugugugucccaaggaaggggccaauucuauaccauuuuuuaaaaugcccucaugcauacacugaggaagcagauuuuuguuuauucuacaguguguauucugcuggcucuaauucugcauugaguggcuuuugauuuggugccagacauguuguggagauuguauauaccaugcguuaauuguucaaaaugccuaucgaagagacuuuacauuucuugaguuuuacuuaucguuuggagguugaauaucuaugcuuuuuuguguguaugugcaugucuaaccaauguguguuugaaccugaauuguugaaguuaaguguggucagcuauuuguugcacaaguuuuccucugaagagaacacagcacugaauuccuucuuuuuucccagugacaagucaauuacuuguuuaaauucaguuugaacucccugaacugagagaggccagaggaagcagguuuucccugugaauaaacaaaagaagaaaaauggaaaaucauuccaaaacacagugauuuuagcuugugggaagaauauaauuaagcauuacaagaauuaugguuucuucuuuuaugaacuggcaacuauaggguuuguaaaaucaguuguccucuaacuuucuagcagaaauauaaucaaugauauuuuaggacaaacgaaaaaaacgugaauuuuuuuacuaccuuaaguuaugaaguguuuccauguccauaucccacaaaaaaauuuuuccuuguuucugugaacaacuguaccuguccagaaguguggacucugaaaaaaauacuuaacaaaaaaucguaacacaagagcuaucaaagaauaaauuuuggauauaaaccagaauguauuuuuaaaaaucaguuucuccucaggugagaguuucaugaacuugauaaaauaauuuuugugauuuuuuuuuccucuaugcauuagagguuuaaauacuaacggauccaaaucuaagcuuaaaaaaaauuaaagcaccacuucugaacuacgaaacagauuuuuuuuugcagagaaaaucaguagcuuauuuuguguuggaaauacaagcuuguaucaaagugugccaaugugucuguccuuauuaaggcuauaagaaguauuaggcauuaccugcucuccaauaaguguaguucuagcucuaaauuuugaucuuuauggcuucuugcauguucauugaagaagaauuuuaauaagugauuauuuggucaaauuucacauaucuaauauuauagcauauccacgaagauaaaauuauggcaaauaaaacugaaaacaaaaguggcgaaauguccucguaaugguaauugaagaucacaucaucagcucucgccagcaugugcauguguuaaaccguagagagaaaccuguaauuauuguaauugcucuuuuugcuuuauacuaacaagcuucaaaccauguuucaaaguaguuguuuugaaauaguuauuugucaaaucaucaaaucucggaaaguaaaugguaaugagcuuuuuauguuuauauucugacuguuggucauauuaugcagcuuuucaaguccauaaaguucagagaugaaacuggauguuaauuauuucugauaucaaggccaaagaauaaaauaauguuacgaguccugcuuaaggugaaaaauuaggaauauuugaauaucagaaucucucaauugggaaacucucuauucuuagaagaaaguuuuccuguaaauaagugacaauaucagucagcaaccuaaauuuuuuaaagcugaaaauugggguaugaagaguguagcuuuuucucauuuaucacaggaagugcuaagauaaaaagaucaauauuuaaaugacgccacuaauaacauuuuucaguacauuuuacauauggcucuuuuuuuuccccccaaaccucacaguugguuggaacagccacacauaggacauagguagccacuggguuuuaaaguuuccaguagagugucaacuaugcaaauuacauuuggcauuuuaaaaauauauuucuuauacuuacuauuuucagaaccaugauuauaaaugaaagcagccaguauaaaugcuuuuauuuuuuuuaauugcuguuuacuugcuauuacacagcaaaaauuugcuuaggccacaaaguaaucaaauuuuuaaauuccccacugguucaauaaaauaaaacauaucaaagagaaagcauguaggaaaaacugcuuuuuugugagcuuauuuuuuaaauauaguuggcacuuuaauuuacccauuuaaaaauaacaaugaaauuuuuuuuuaugcuucauuacuuuaaaacaaaauuauguugauuuuguucuuuauguuuaagcugauaaaaauucaccagacacuuaaucuugacauuguggcuacaucuugccuuccugccucugauuaaauuuucaaaaucccugcaugagauucacagauaccaguuugaacguuucugugaggcuaauuucucagggaaaaaauauggaucaguuacaucuuugguuaauuuuaucuaguuccuaauuucugcuaggucuaagcauuuuaaauauaguguugguaaagcauccuucugucgcugggugauggcauuauugcaggcagaauuaggagaaaggacauuggcauaggagaaagaggguuggggagaaaaguggucaggaaaaaagaucuaauaguugaugcagucuuuuaaauaccuuuccaacugaucuacaggaaauugugcugaagaaucauuuguuuccuguuccacuauaaaugugguuugcauuacauccccuguucggcuuuuuuuguuguuguuuuguuucuacuaaauuguaguaccacgauggaggcuugagaauaagugaugucuuccuuuauaacuuaucuuuuaauggcuugaucauaguuggauuuuagacacugucauauuucauuauaugaauuuuguauguguguguuuccaagccuacuugaaacuucuauuacugcucugccacuaagaaaaacaaugcugcagucuaaguucuuuagaaucacuauuguaggucaaauacauggucuacaugcugccaucagggaucuauuaaaugaaucucuuguuuacucauucagaaaauuuagagauuuuagaugugguucuggcaauuguaaaaguuguuagaauucagauuuacuuuugccuuaagaagaaaauacaguggagacauauauuugcucugcacagcugaccuaaaugcaugccuuguaccugugagaauuucaguaugcggacacauaaaagauuacugggccuuuuuucccccuccaauauuaucagaguuacaaaauaaauaaucuuucacagucaacauaguuuaaaaguaauuuuaguuuuaagcuuuuucaaguuuuuauauguuuaauugcacuuuauuagcccuuaauacuucaaacauaacucuaagaugacacaggcuaaaguuguauaugauaaacauuauugauuacuuaaaaaaaagggauaucuguauauucauaaaacauuuauaaucuauuuaggaaaucaucauaguccuaaaaaaaaagcaguuguuuguauaccaggaaaaagagaucaguagugacaaaaguggaaaagauacuuguauaaaauugucuccuuuagugugaagugaucuacugaaaguuauacuuggaauuuucagaaaauguccauaguuguaggcuuuauaacauuucaaauucuguaauaaacuauuuggcacauuaucauaucauuuuagguauauagauaccauggcauuuuauuaagcaaaacaauuuuuuucuucugaagaauacuuaaggugaaauuuacugguuuugagcuugaaagugguuugagaauuauacaugaacuccacuuaaacuuuggagacuuuccuuuuugcagugcuaaagauccaugacuugguuccaaacuacaaccuuuuauuugcagauguauuuauggcacaguaccacauucugauuagaauuuaagaguucacauuucugauauuucugucucuaaaugcuguguugcuucuguuuaccuaguuuucuuccuauucuuccuaauuucuuaaagaaaucugcacauauucauugagguauuuaauccaaaaagauuuaaaagagacacuacgccucuaacauucuguuuaggagaguauacuacuuuaaacuccguucuccccaccuaaaaaaggggggcuaaagaguggguuugaacaccugagaagucagaggugggaacaguguagaugauggucuaauuucaggcucaaccaaaaaaaaugcaggcuuuggcuggcauccuccagggaccuagcucugugcuuuccuagagaccaaauuacacucaucuugagagagggcauguugagguaauuggugggagagaguggggagaguugaauuccagcugcuuccauuguagcuguccugaaaaugaauaggggauguuaacaauggaggcuaacauuugacuuggcuuuuucaccuccacaaaccuaagggugagaauuauagaguacugaaugacugcaccaauaaugauccuguuuaagugggaauugcuauguugggaaaaacucacaccauuuuaaaaauaguugaugcauuuaccaaccacaguccuauuacuguagcccaauaaaguuuauccacaguauggaaacacuccuuuuuuuuauugucagccaucuaguguguguauuggaucuucaccucuuugguuaccauuuuaaaaugcuccuacugaaagacauuuggaaggcaccagaaucccaucuccaagaagggaagcaagauacaagugcccuguacucccuuucuccuagaauguguggucuuuuuuuuuuuuuaaggagaauaaauacuguaugacucaauagcuuuucuaacgaauaaaacaaauuaaauugauguuacaugcguauuuaaacccuauccaguuaaguacugaugugauuaaaauaaucaaauguauuacuuaaaaaauuaaaaaggauaaauucugcaccccauuauuuuauugacuuuuaaauauaaauugcagaaauguuuacauuccuaauggcauuauuaagcuaaacugacaaaucagaggaaaaaguugauuggccagcacauuauuauuucugcaccuguuauuacagaaguggaggcucagcauuaaaggagcuggauggaugcuguuuucuuaggcuuccuuugugugauguggggguugggauaaauguguaacaaguguaguuucacuuuguagugccuuuuuguguguugaugugauuaaaagacuacaguguuuuucaugucgcuuugaaauuaauaugcaaauaauaugggauauuagggcuucccucuaccugcugcacuaagcuucccuaagccaaaugggguggggauuggugucaacuuuuuucauacaaguuguuuaguugcaaauaucgccaacguuuuaucucuacucugugaauuuguaagggggggagggaaaugucaaacucauugaaguaggauugaagaucugggaugaaaauacuuuaaauuuuuauuuucuacuuauauaucagccaggauguuaggagaccuugaaaacauuuugaaaaaguuguguaacauuaccaaggcuuugguauaagauuauacuuuucuucugguugaguucuuccuuguauuaaucaugcaauaucauuucucagacacuugagcccggcucuccccuggagcauagguggcaauaauuguuuguuauuauaauucuagaauuucuuggguguucauuguccguaauucauuucacacagagaaaucuaaacuuucuucagccaguagaauaaauaaugccuucccuguccuuuccuuuucuuuuuuaaauuuugaguucuuuaggaaugucauuauagucuuugaaacguaaugacauuaaauuuggauugaaggggaagggagaggaacuuuuauuucaugccauccaguggcuaguuugaguuugcaaagaaauagauacaaugccauuauuuucugcaagauacuaguuaacacuauucucauaucaguuuagacuuuguccuguguaauaauuuaaauuccuagauuuuaauaacacuuaauauguagcauggaucccacuuaaucuccccccggcuucacaacaaaauguuuacauaaaugaacucucaauuuugauaucaacuauuuaacucacucuuuccugaguuaauacuuccauaauuaaacauguuccacaguugccauaggaguguaucuuaaaaaugauguucuucucuguucuuuugagccaucuguuugcuaggucaguaaagaaaugggagccugauuuuauuuuaaagccaauaaguuauuacucuacuauuguauuagacauucagcuucagagggaguaaaagauaaaauuccaucacauuuccacuuucuuacauuugcagcagaaacuuguaugcucaaauugguuauuuucaacucaugacagcugugauauuuaaaaugaucacagcuguugugacuuaaaauugauuuuucuauuaacaccugagaaaaagaccugugccguauuaaaaacuuaaauaagguaacuguaaaauuagauguguugaugugaaucugguaauccuacuucccagagguugcaaagugcagcacaccucuugcaugcuuccagggaaugagcuaaaacugcuagaaauagaugcaugauuguuaaaagcguuuacauuuuaaaggauuccuguaauagcagauccucuuggcccaacuuuacagugucacuuuugcugauaaaaucauuuaggauucaguuuccuuaauuaaccccaagaaagaugacuuacaugaaucauuaugauauccuaaccucuagacuagagaagcugcuuuaccuuucagauaugacauugaaaaaugcaaaaccauacggaauuguuucuuaugaaggaaguuuugguuuuauggugcuuuuccuccauuaucuuuagaugacgaaaaaggaaaaacagaugagaaaggacaaauagaucauggcuaaguagcuuuaggcuagcacuuguuuuuggaaucuuuaauacauuuuuaaucuucauguugaagauccauuuaaccuguuuuaaaguuagauggugauuccuggguucaguuggucuguuuaaauguuuaccuuuucaggauaauccguauuagaaucuugcaucucucaauagauuaccuauuuaacaaaguaaccaauuuaagaaaaccuaaacacauuuauacauuaagauauuuuccuguuucgaguuagaugauguaguauauaaaauauauggcuggccugauguggaauuauguauagacaacagugucuucacagaugcauugccaauagggagcuauguagauuaaacucuuuggccaguccuaggcuuuuuaccuguguaacucaaucagaauugaaagcaugacagguuuuaugaugaugaauguauggcuggauuggagaaaguaugguuggguggguagauagauggauagauuucauaacuagacaguaauagauaaugccaauuauuuauuacucaaacuuguuuauuccucagaaauuuuucugcagaguauuauuuugauuauugcauguaguucagaacauuuaguugaaaaugauaaaauauuugcugucacauaaucaagacugcuauagaguugguucuaaaaguuccagagugaacauacauuaccugugucaaaguuagaggcuaagacuauggagggccauaagaucacaaagucagacuaucacauacuaagugaucaugggugucaauggcuauuuccuuguuuaguugaaagaagauacuccucgagauggacauuguuuauaugaagauuuaagaaaaucaaaguggauauuuguugcugacagacuaagauuacaaacauauaucuuuagaacaggguguuccccaggggacauacggcaauaucuggaaacgcuuuugauugucacaacugugggggucaggcaggagcuugcuacuggcaucuagggcuggaggccagggaugcuacuaaacaucuuaacagcgugcaagacagacccucagaagugcugagguugggaaguccugcuugcaaagugauauaucuggaccuuaagaauuaaauaaugucauaauaaguuccauaauuaaaucuuggcauugugaggcauuuauagaggauaacauuuuuuuguuuuuuuucuuucccuuucuauuucccuuuuccuuuucuuuucuuuccuuuuuucuuuuguuuccaaaacauuguuuuuuguuuguuuguuuuggcauagcacacuauagcauugcccagguauuucuacguuuuaccaugaaaacgugagauuuuauaguguauuaaauauuguacauuauuugugaaccaacuggaauggcuucaaagcagcuguuagaauauguugagucaguaacacaacaugucugcauacccuaaacauauauuugucuuaccuuuuaaaauguuuagaacccucuaucaguguaacuauugguuugucuugaaucauccuaaaugaggaaguguauuaccauuuuuucccuacaggacauaaaguggaaagaagaaauuagcauaaagaaacuaauuaauaauuauguuuuaaguuuuuuggcauuacggacauuguuuacaucaucauuaacaucauaacaucauaucgucuguuaucaagaaaagauuaaaauuuaaagccaacauugaagauguucuuuccagcuuucccaauaaugcaacuccuuuaccuccucacaacuggggaccucucucccugccacugcugcgcuucuccucaauguggauaauucuuggccaugauacggaagugauuuugaaaccucaguugccuucuguagcacccuguggaggaagguggcaggaucugguggcugagucuuacaucugccaacuucuagaccucacuccuuaggugccacauuuuggagcuaguugccaagccucacaguaacuugagccacucuucaauuuccuccccaugauauacaaaguucuccaagguuuaaugagaguagauauggaggcugggcacgggaauggcagcucugauuugcaguauaucuuugguguacagauaugcuuucauuuauugcuuagcccauuagcuaauggaauuucaauuccuucccacaggcauucucagacccugcacuucacucuuccuguuucccuguccagcuugguacaacacauucuaguaaaaucacacugauguguuuagguuuacuuuguacaucacaucuguaaccaucuauaaguuugcccuaaacuggcauuuauuuugaacugucuuccaccuuuuauuguacagcguugucuguacucaaagugagcaacugaaaagaaaauuuuaacauucuuuuugugugccagacaaguaauaaagauuacuauuuuuaugguaauuuuuuuauuugaauauuucuguuucuggaagaugguaauuuuuuuaaaucaugaauuuccuguaagugaaacuauuugagggaguauugaccuuuuuuugaucaaucauugauuaucuguguugcacucucaguauuucucuuauaguccauaugucccucugaauaauuguagaacaauaacuugcuuacacaguguuuuuagaauaugcuucaggaagcuugccugugugguauuuaacucagacauuuauggaguauaaaaccaaucuuacugugacuuuuaauuauuaggaaaguggcuuacaguuaaaauaaagcuuacagaaaauauuguagcaauaauuaauauccaguaaaauacaguuguaagcuucgguucuuucagacauuuucucaacccaguucuaauuugaucguuacugcaccucaguaagauaggugaugcaggagucaucaucccauuucacaggcaaagccuggccuguucagugagguagccacuggccccauguggcuauuaacauucaaaugaaggccaggcacaguggcuuaugccuguaaucccagcacuuugggaagcugaagcgggaggauugccuaagcccaggaguucaagaucaacaugaucaacauugggacacccugucucuagaaaaaguuaaaaaaaaaaaaaaaauuagccaggcaugguagcgcucaucuauagucccagcuacuuaggagauugaggcaggaggaucauugagcccaggaagcugaggcugcagcaagcugugaucaugccacugugcuccagccugggcagcagagcaagacccugucucuaaaauuaaaaauaaugauaauaauaauaauaauaaauaaaugaugucagucaaugagaauuaaauaaaacuuuaaaaagaucacuuccuugguugcacuagccaaguuucaauuacugaguuuucauauaugaucaguggcuacuguauuagcacagauacagaauauuuguaucauuguagaaaguuccauggggaggugcuggccugggaaauggaagcauugagggauuaaaacuugcugaagaucaugugggucaugacagaauagagucauugcugcuauauauuccaauaggauauuuuuacauuuuucuuagcuuuauugucaaauaucugauguaagaauugacauuuuaaugcuaccuuguagcacuuuacugaaugcuuaucucaacugaauuuaaauuuagagcuugaguuacacaaacuuuucaaaggauacagcccuuugccugucugcacacaauggggaccuugaauuuccagccagugauacccuccagaagggaccaugucuuaaugcaucuuuguagaccuuuuggcauauuguagacaaccaagaaauguuuaugcagccuaaugaaugugucacauccaccauacgggcauauguccauacauacaguuagacaagaccuuuggguagaaugcucccgagagagcuggugucugccaaauuuuacagagcucaugccucugcucuugcuguuuuaguaaaaaguaguauuuuaucaaaaguuaaauuggguucaauauucaccauuuggguaauggguacauuagaagcccaguccccagcagcaugcaauauuccauguaacaacaagcacguauaccccuuggaucuaaaauuuuuuaaaaauauguauuuacucacauaauccaaauauuuuucauaguaaaugaaaacgucuguccaucuuguccuuagcagucauuuagucccuaaccugacuuuguguuguuauaaaguugugucacuuaaguaguacuuaaguaaguacauaccuacauccauacuaucuuuccauuuccugcaucacugaguuggacaaaugugcccaguuagcguugguagugcugaagaccauguucauucauacaugcacucaaaaucauauuaauuacuuuucagugauaaccauagguggcaacagaugaaugggcuagcccuaggcuauuauuaagcacugggaaugagauuguuggugccuuguaccugugcuacuuuaacaggugagacaauuccagagcuuuccccaucauccucucguugcuacagucuagacauugggagcacuggaagccuauggugacacagacuggcagaugccuugggcuucuaaugguguauauguaagccaucauuuuguuuguaauaauuaugguguugagaagcauuugugugcugugcacucuuucagcuugugccacguuuaguuccuguuaugcaaauaccacuuuaaacuuagaaauuccaauuugcauuaauauuuugguuucauagagcuaacuauugcauuucacaaacaagugcauuuuaaugaguaccggcagaaugauuuaaaaauguuauuuauuaaauacuauuguagaaaaugcagucuuugguugccagaaacuauuaagacgaaauauaauguguguugaggccacagaguacaccucuucaagaguauuugacccuuauggcuuucagugauacaacagccaaugcucuucaugcaggcuuggagggcagagguaauuaauauaaaauagaagccagcguaccauugacguuuggguuuacuuuuaaaauguaaacauauuuuuacuauuugacauuugucauaagaccauaggucauuuaccucugaguuaaggugaaggacuuuaccagucauaaacacccaaguuuuaaagcaguguuuucuuauaucuuacaucuugauguuaaauccugaaauggaguuuguugcugcuuuauaauuuuuuucccucuuccuaaaagccuuuuuuuaaaucagaauuguggauaaaaaaauuuugauguacaaugugugggaaaauaaaaauuuugcaacuggauuuucagaaaugaacuauuuuaacacauggacuuugaaugcugcugucaugguugucauagcuugugguuccuaauuauaaugagcuuuuuuggugguguuauugcaguuguuuuauucccccugcccccacccagucuucaacucacuuuucccagaaggagaguuccaagccuuugaaaauucucaugauuuugcaaauccacucuauuuuugucuagaauacaggaaaguuaaaacuguggcugguaugaugccauguuuugaauccaauuuuaaagcaacccuuugcaacccagggaguaaagcugacaucuuuguaucuguaaugaagauaauuauaccugcaaggugacaucacuagcaaaguaacaaauacccuugaaaacggaguuccuggucuucucugaauucuguagaccacauuuggcauuuaacaccagacaccucuuucaugccugucguuugagaaguugcuuucagaugaauuuacuaaagcugacugacacaggguuaaauuaauucuuuucuuuauuacucaaagugauacagaccuuucuuggacuaauguagcuuaauuaguggucaauuaaaacugaacauugcugaauugaaguucuuugaucaaacucccuggcaugggcuugcuuucuuuaacuagccaccaucuugaauucauuuggaaucaguaguauaaacaaguuaaaaacugguucuuuuauaagaaagucagcaggcuuguauagcugugguuucuuuuuuuacuucuguaggcggcaauucaaaggcaugcuaaaugaaaacaguacuacacccugaaaaaauuacauuuuuaaaaguaacacuaagcagucagaaaacagucaacacccuuaccuguuuauucuagauacauuuaucuucuauguagaacaaauaauuaauaauucacuucccaauuucagugguugauuuuguuguuacauggaaggugaaaacuccccacccucccuugcaaagucuauaguuauaacaaaaagugaagcaaacaaaauccaaccugguuguugggaguagagucggaaggggcacgguaaaugaaggugugcccaguugcuccuaaauucauucuuugucacucuugggaaaauaguucaccucuguaucuuuggagugggagugacacacuacuucauuuacuuauugauuucaucauuuauuuugaagggcauuauccuaucaguauggaaacugauaauagcauauauuucauaugaaucacuugauuaaaaauacacauugcuuuuguuagaauuugggugaaguuacaaaaaaagagaauuaggggagcugaaaacuggggcagaggaaaucguaagcauugguaauaagaucacccaccuccauuuauccaguuacaugucuuaauauuuaaaguguauauaccauucuugucuaaacauaaauugauaccauuccguaauccuaguuuuugaaagcuuaacaaccaaaaacauacauccuagcuggcauucaguuagugcugugcauucuggaguauuaauugaaacugguacuuuuguacuggaaauaaaaguaauagauuagguuuaaauagauaauuugcuuaguucauagugauuucuucugguuuuuggaaauuuucacagagaaagaguuaaaggaaauuuggaagugaccauguacaguguucccccuguaagugacagaauuuuugugguuuucauuacuuagaucgaaaaauuguaguuauaaucaauaauuaaaauuaaaaauuuuaccaguugacagaaagagaaauuguuuauagucaaugugccuuucagccuucucucuugccuucucccuaaaaggcugauuaggauguaauaauuggggaugauagcgggaggaagacgacaauuccauuuaauuaaagauaauuuauuuuacuucaaauuggugaugucccacaugaauaagaguagcuuuagcagauagauuuauuaauggguacugacaucucaguugacagaaaaagcaaacauuuucuuuccucauuguuuuuauugugucccgucaccugaaacugcugucaccaugcuuccuuugcugcuugacagagcuguagacuuuuccaccaaauaugcaauuauugguuuaucauugaaacaaaguugauccucuucugaguuaaaaacuaggccaggagcuugaaaggcgguucaggcuuucagagcuaaugcuacaaaugcucucuucuuaaaucacauuuucucaacugauccuucccauaucuaguucaugaguagauugaaccuuuugaauaaggaccaaagauuuccuuuggucuugggugaggugcuugcaugaauauuccuuuaauaccuugaaugucuuggauaaugaaaugugccccaaaaaacuaccauuugcauuacuuagguucauuccugacaaggaauucugcccucgugugauauguucguuguugucucaugcaaucguaaauggaucuuggaaguugggacaguuuuuuuuaauuaggaaguagauucaagaaaugcaugauauuguuuuucauauaaucuccucagucuauagugguuguaaaggugugcuguuuagcauaccuuuagcaaaacuguauuuauaauucuauguaucuuaaggcacuuuuuaaaugcuucugacaaacugcauucuguuuuuccaaugucuauuugaucucuguuacauuaggcuuauuugucuuacucucacaucgaauuccuauauuuuuguuuauguuuucugguguucagucauuucuguaugcuugccuaguauguuucuuucauaccgucuucuucacugaaugaaaugcagaccaccuuggccacuuccuuccuucugggcuucuuuuccuauucacaacuuccgccauucacacugacccucuagcuuuacuuauaucuauugcuccugcugcuuuguugcucuaauuuucauauauauuuccuuuaugcuaauauccuuuccuuaacucuuuggauuucacugguuugucuuuccagcuuuauuuagaaaauuaggccauauaacuaauguuuacaccguagaaaggaaaaugagauucuuucuuucuuuuuuggaagugaagaggugagaagguugugguagagguuuucuuuuauuuuaaaccagauggauuuauuuuguccugcuuugcuauuucacuauuucaaauugauuuuaaaucagugaugguguuuucaaggauuaauuuuuauuaaaucuugauuuucaugucguguuaaccuuuuccuuccccucagccaaagggucuucuuccuuuuuucuguccauuucacuuguuuguuuuaauaaccugaucucuccagccauuauuuuauccucaaauccugccacuuuuauccaucuuuuuuuauugcacuguuguccuuacuucaccuuauaucuuuucuucuucuguaauuauuacagaauccaugauaccuucuccaaaauucuaacaaagaauucuggaaaaggagaaauugggaaagagaaaaauugcaaguaauguucuuugcugagcccuaggaagucugcuuggauuuuuauauucgacugauauuccucccuagaguugcagucaugauucuauguaguagggacacgaaggcaaaaguuuaaauagacuaacacugacccuuaauuggaggugauaauccuacauauaaacuuucaggagggaaagcgauccugcauuuuacaucagguaaacucaguugcacccauugccaguagcugggucagguguguagggguguguguguguguguguguguguguguguguguguguguguacguacugggagccagguuggaaguaggaagagaaggagguucuucuuuccucucccacuugcaagcuauuuucuuucuuuucugucuguuuucauuauuucuauggcaaguuuacuugccacgucuuaaacaccuucaaccuuuuugucucuuccuuuacuuuuuugcuuuacugcuaucaaagaguuaaggaaguccauuaaauuggaggccauuccucaccauaagagaaaucuggaugggaugcuuuugacaacugggcucucuuuaguagcuucucucuacuugggaaaaugucagauauuuugagaaauaaaugcauugccccaaacugaaaacaccacuuuuauucuguaaaagaggcauucagggaaggagaccuccucuauucccaggaggucacaggaacugggaguggcaagaaggaagcugcuaaacgggcuccagaugcagcuuuauccaggggacgccucaugccuggucauuuggguggcugggcuugucccaccuccccuucuucaugcccuccucccggucucauccuaggcccucccaccccuaggccagccacaggccucacagcggacaucugcgggucugaguuucauauauccagcaugaaguucccucucucccucccauuaugaauucugggcugugguccugcuugcuccuugugugucagauugaaguucugaugcugucagccaugucugaccaaucagcaaacaacaccacaggaugaaauuuaaacaaugcagaugcucagauacagggcuauguugccuggaccacgaagggaaagcagagguaaggucagagucuccccaaaguggucuauccugagccugccugacuugacaccucuugggcugcacugugcugcuuugacuuguauguuacccauuugcuuugcacuacuucugucuucccuggcauucaccagaacuuucauuuuaauucgcucugcccggguuacuuuaccaccuucaucugcucacguccuuuucuuuuggauuggugcugacugucauuacgaauguuccuggauugccucguggccgaggguccuuggcaagugccaccuuguucaggucuuuuguggccagacuuuuaggaauagaggacugcugaggaucagggcaaacggacggaguuaauaggccuuauuaauuuucccucugcaggacaguggaauuuaucauucgguuacaaccacgguuuuguuucuuaccauugugauguauugaauuguaaauugagcuuaaaucaucuuuuuuucucagaaacgguuuacuuagaaaagauauaaauagauacaaccuaaacgaggaugaaucagcucaucuuccaagaguuuuggagggggagaaagggaauugauaacucucccccacccgaauccccccccacuuuuuuuuuuuuuuuuuuuuuuuuacaguuuuugguguuagcucacuagauuacuguuugcaaaagaagaaucucaucaucauccucuucuguuuuaaguguuuacuuggcccuuuuauaauuuaaaguguuuacacgguucugugcucccuaggcccaucuggaaaauauuuaaacuucauaagaucuauaagacuagaauaucacauauaaugggauagggggaaggaagaaaaauuagagccguugcguguguuuagaauaaguuaguuguuuguucagaagcggcugcuggaggaauuggaacaaauagcugugugcggugaacgauuggguccagagcuguacauuucaccacagaaugagccuugguuugugaaacugacauucuguugugacuucuaaauccaaacaaaucucugcaaauuucugcccgaucgaguuaauaagaaaauauauacaugcagaggcgagagccguaugcuacuuguacuucugucaguguugguggaaauaagagacggauuuuaccuacuguauuacauucaaccagcaauuggcagaacccccagcucagcggguuuucuugacuuuuuuuucugcugugagaacaaugggaugcaaaagggcuucagaaaaggagagcagcagauacgggauuggggucacuuuucuucuaauugccuuguaauuggggagugguuuccacuuucccacuaucucacuggugggaggggaggaagacagauguggcuuagcgguaacgagcuuucuccaggccggaugugcugagggaccaggggggucauucccugcucugggccugugaucugcuucacaccugugcucauuuucccccaugaucgaugaccuuguauuaacccagagugaccuuuugccuucgccuguucucugggacgagcucuuggcuaguggacccuccuuucucucugauuuacaggugguuacuggagccacauacacuuguuuuucauggugcacugugcacuuagcagcccggcaagaccugcaauuucaucccucucaaggggccaagcaggggauuggaaggugggagggaggagggugccgcgagagugguugcuguuugcaugugcuuuucuauuuuguggcucauaugguaucaauuaccauuugauggcaacgccaggccugaggcccuucgcauguuuguccugugagaaagaucuggaagaaccgacauaugguuuugauugcagcaauugcagguugauagaaugaacgcaggggugagguggguggguuuuccuuccggcccuuuccacucuggguugcuaaugugcuucgcuuguggaacuggucuuuucaucauccagccccucccccacuuaccccucccccacccccaacucccugccacuuugcauucccugccccugccuuccaaaugaccgccaggaacauguggcccacauuaaggaccuucaauuaaaacaaacaaaaaauuguccacucuucuguucagucccagagcaggucaguccaucaagaugguuggaaguguaccacaguuaagaaacaaaugguuggcauagggggcagauucccuccagaagcuugggacauguuuuaaaauggcuguuaguucagauuguuaaacaucgaaaugaugcugaaaaauagcagcaauagagauuaaugugggguguguguguguguguguguguguguauaucuguauguguguguauuucauuuaagacaccucuuggaaucugugcaucugcugcauagggacaggaagaugaugauaauggauaggaguucuuugggguuccaucuuucuguacaucccaggccauaagaugauggaaaagcaagugaggcaugugugucucuaugagcauuucccuucagaaggaagauguuggagacucaucucccaugcacagugacuucucucuuacuaaauuugugaugguaggggguacuccucauuacuguggcucagcagggauugcaucugugaauaugccaagggagggucuacuauuggggaauggugagaggcaaagaggagaaaagaacauuauaggcacuuugaauguuacccagcaacauuuuuuuuguuguuucaaaguaacaucuuucuauaaugcuuucaaauuuaccugucugguaaucuguucuaagaugggcagcccaugagguuuugacuuuuuucacuuuggcuauugcauuucaaaauauuacucacaauuaggaauuuauaccauuugaaacaauaaugugguaucucaugaguaaaugcugccauuaacaucuuccuucuuuuaaacugaaaacaagcaaaccagacccaaaaaaaaaaaaaaaaaagcagaaacaugcucccccaagaaagcuuguuuuuuucuuugagauggagucucgcucuguugcccagguuggagugcaauggugcgaucucgacucacugcaaccuccaccucccagguucaagcgauucuccugucucagccucccaaguagcuaggauuacagguguccaccaccacaccuggcuaauuuuuuguauuuuuaguagagaugagguuucaccauguuggccaggcugguuucaaacuccugaccucaagugauccgcccaccucggccucccaaagugcugggauuauaggcgugagccaccacaccuggccaagaaaguuuuuuaaaugugagaugaauuuuuaguuuugaaggccagcuauugaaaccuaaucacacugcuugacauacuucuucauauuuaucuuuauauuagagcugaucuuuaucaaaagguaguagaaacuaaaaaacuuaaguuauugaccuaaauuguagggaaaugucugucugaucgacucuagagagaaaauuggccguaucuuuauaaugguuacugaauguauaucuucaugaggcuacaguuuuuuuuucuuugcuccaacuuucuccuuaugauguagagauugguguauuaaauaaucacuuuuucaacagucuugaugacaauuuuauuuugcuauuucauaaucuucauacaaugggauaaguguuuucagagauacguuugaauucagagcaacuggcaauuaagugauuugcucuagucacauguuuuaguaguagcuauuugguuauuugccugauauuuaaugcacacauauguacccuuaaaucaucauucagugugauagcuuaagacaacauuucuguuugcugcucaugccacuauuagcuacguuugaagagugauauacugagaaguuuaauuugcugggguuuuuuucuaaaaacauugcuuuccugaaauauauaguauugggggcucauagcaaaaaaaccguaguauauggguugugagccugucuucgaacauggugggucacuuaacagcagcugugcuggagagauauuugauuugagaagacuguuuugaaucuucucagcccuaacaccauucugguuuugaaaugggaaaauggaaaagaguuuuagggaauagagauaucucagccuugaaaggaagcauagguagaaaucuuucaguucucacucagaugaaccagcauuccuaaucuggcuacccucacagaggacaaagagucugcugggaaauguggguuuauauuuguagagacacacuucagaggcaugagauaguguuagauaccgacuggaugcuucgugcccaacaucaauuugguuugcagauugaaauuuaggaaagcuugcagaggagccaaucuuuuuuauauacagcaccuuuaaaaaaaagacuguccacuacuauuaaaaucugauucagucuucuaaaauauuacuacauucaagacaacuuuuaaaaugaucaaauuuagauagacaucaaugauguuaaaagauaaaagcccuccuacauguaauauauagugucuuaaaccuuauuuuuuaaaaaagggauaccacuuuugccaaaaguuucaauguagggauacucaaacuguccuuggaaguccuaaaaauugcuaguuuuuuuuuuguuugcuucuuuuuuuguuguuuuuguuuuuuguuuguaguuauucacaaauggagaaauauuuauaaaauuauauuauaauuuguaaugcacgcaaacaaccaucagaccacacuugaaucagagaguuacaguuauaaauugaggaaagaggaugccagcacaaugccuaauggagugaaaaauugugcuuauuuucacaggacucucuuggagaggagcuaacuacuuuccucucucuuaauacccagacccucucccucagcccugacagcacguuacagaaugcauucacuuagugugugaagagcuagcucaccaccucccuuuaagaucuauucuuguuauucauacauugcaaauuuguacuuuuguauccacaaggaagacauuacuaacuucaagaaaggcagugucaaugaggagcaggaaaauacaguaugauacaagccugccaaugaaagaauuauacucagacucuaugcgcucuguuaaacaaaauuugaaccuuugaggaaaaaauauuggggauucugaugaguguuuuuacucuuucuuuccuuuuuuuuuuuuuuucuauuuggaaaucauggcuuccugauccuaagggauaaaaaaaaaaaaaaaaaaaaaaaccucaaagaaaagacucaacaggcuuucuggacaucaaauaguuccuacaaaacaacauucugaugacuugcauguaaagaaaucagaaacauaugaauuaagcuucucucgaaauacauauggguugaaaaauagagagaagugcugagaaaauguguuuuggguuuugcugagcccaugacguuugaaaaauaguaugagacauugaacaaacacaaagcauggcuuggcucacccauuccuaauauuagccuucuaguucaacggcaaaucaguuuaccaugugccuaaaugugagccaccuuggugcacucccccacacuuaauuauaugcaguuuaaauuuuuucaauuaggagcucaaaaauaacauugcauuucaaggaaaugcaaaucuuagcauuuucuuaccugguuuguucaccucagaccauuuuagaaaacaccacagauuauuucaccuuaggagcagucacacugauguggcccucuuugauguggcuggcauauaacagaagaaacguaucauuuuuaagaaacuggcuccaaagacaauauugcuauuaaauugaagccaaaaaccacugcagguaaaacaugaugaagaugaaggacgcccucucuuagccauauaguagaagcccgaucauagacucucacccuuacaccaugacuugaguuccugcucauuuuuaucccugagcucugcagacuucuaagcaguggaaguuuucauucucuuucccacauugcacucaagagagcuaacaugagagauucuaaauccugggauuccucugcaucuggcuuuaaguacaggagcagaacacagggaauuuaaggaacaaaaauagccagagcuucaggcuucuuccacugaugguaagucauugacaugcacuuggaugaaauccuguaucuguucuuuggacuagcacuaucgccugagauuaucaguuucagagaguuacagagaggcaguagauuucaucuuuccuauuucaggaggaguuauuuugguuguuuaaaaaaaaaaaaaacacuuuaauguacuuuuccuaacuccuucacucagaugguggcaagaaguuugacagaauaaaguaauucagcuaauauuuaucaaaugccuacuaugagugagcuguuagaauauaacccugaacaagacaagcaugagauaggcaaacagacuauuaaaaccuagacugauaaugcauugauugggguguacaggcuccuuaagguagauauacaaaggacaacuaguccacauuuggccuuagaggaagugaagugcaaggaugaaugggaauuaagcuggcaaaaugcaaggguuauaacuggaagcaggggugagcauggcauauccggugacccagaaguaguucagaaugccagaagcuuaugguacaaaaggauaacauaaaagaugagacugaaaagguaaacaguggccugaucaaaaagcgacuugugagcccuauuaaggaguugagauuuuaucaugaaugugacgaggagccuuucaaauggguaugccugagaaguaauugaauuuaaaagucaagacggauaggaggaccuggaaaacuuagagucagagaagccaagggaggcagaucugaccagaaggaggaaauugucaacagugucagauguugcugaaagauagaagugacauuuggcugcagcauccaggaggucuugagcaguuucauugaaguagugaguguggaaggaagguaaagaaguggagaacaggcauugcaagauaauuuuccaucaucgucaucaucaucguccucaucaccggaaaaugagcaucaauuaucuuaucuaccagacauagagagugaccagguaaggaaugacacaccugcagccugggagauuucagaaaacagaucauaaauauaaaacagaagacagcaacacaugguacaacacaugcaaagggcaaaaugagcaguguaggccaacgggaugaagaacagaaagaauuagggggcaggugaaaugggagaguuuuucaagcagucagugcgcuugagguuugcauucuggauugugccuccuuauaagucaguccaaccuguuuuugauucuccauccaguggaaauaggaaacaccaucaaagaugaugcauagucuuaacuugccugugacuucugauuauguuuccgaauuuugggaggaagauuaaagucauaaacugacucuugguuuguuauaauuucuugcaacuguuauuuuaaaaauccggacacaggccaaggcaggaggauucucugaggccaggaguuugagaccagccugggcaacauagugagacccugucccuacaauaauaaaaguaaaauaaaaagaaaaucuggaugcagaaacugagguguagauaaauauagcaagucagagauauucguaaauucuacaucgaugaguuucuugagaaauucugcacacccagugcuggacaacuguggaauugcagcgugauaccuuucacaucugggucaucuccauaugauaucuucuuccugguacaaggccagaaguucaccccacgcacaacaccuauggaagccacuuacgauucaaaggacaguuuuucugaaaaagggugcaugauguauacuucccuucaacacuaaaauucugcugcuuaaacuuuguaagugaaggaaaggacugguucucuucuacuuuggcugucuuccuuguuuccuauuuauugggugcuugcuuugggcaacccauuguauuggaugugcucuaaaccacaaucuuugcuccuaaggaguccguaguauuuaucgggggauacgaccuggauaauucauauaagauaugaauuucuuucuuuuucuuuuuuuucuuuuuuuuugagacagauucucacucugucgcccaggcuggagugcaguggcgcgaucacggcucacugcaaccuccgucuccuggguucaagcaauucucaugccucagccccccaaguagcugggauuacaggcacccaccaccauacucagcuaauuuuuguauuuuuaguagagauggaguuucaccguguuggccaggcuggucuugaauuccugaccucaagugauccgcccaccucggccucccaaaguccugggauuacaggcgugaaccacaaugccuggccaagauaugaauucuaaaaaaaaaaaaaaaaaaaaaaaaaaaaaaaaguccuuggaaaguuuagaagaugaaauacauuuaaugaaaauugagcucauucuuccccaauauuuguuccauauuccucuccauauuauacuauuaguacacaauccuguuuggacuuacuggaaaaaagagcugaauagcuuauccacaugucaagaaacuuucuguuuaagaacacugagguucaucaacaucaaaaaauauuuucagcaucauucaggcacuggacaugcucuacaaauuaaauaccuuagggccccuacuauuucaguguuuucucagugucuuguugcaguggcaaaugcuaugaacuacauuuuucaaaugaauauugaagauugagaaagagguuaagaaccucuaucuauuaacgauagaaccaaaucuagaaagaugucuccugcucuguagagcacauuagggaucauuauuuauagccauuuggcucucuuaagacauuuuggcaaugagggaaaaaucauagguugauuuucuugguggaaugaagaacauugaguuugcuaacaaagagagcaugagugacuuugguaagagagcaguuuuuauuucaguggaaaggcagccuccucuccuaauaauagcuacauuauuuaccuaaauguuccauguagcaacugauaacaaggcuuacugcuuaagaaauuuggccaucaucuuguccucucuacuagaauuccaucugccuacagaugggcccuugcuaauauuuuuuuucugaaggacaacauguaacuuaagggcccacuacuguguguuauuuuguuuuuuuaauugaggugaaagucacauaauguaaaauuaaccauuuugaaguaaaccauucaguaauauuuaguacauucacaauguugagcagucaccacaucugucuaguucuaaaacauuuuccccagcccagaaggaaacucuguauccauuaagcaguuccuuccuaucccccuacuucuaggcuuuauaaaccuuuaauuuuaauguuauauacacacacaggcauacacauacauauaugcuauacacacauauguauguauauauguauaauguguguaaauaauguguaaauauagacguauaaagauguauaauguggguaaauaaauggauguguguauguguauauacauauauguacauguauacauauauacguauauauguauacauauauguaucuacgcacauguauauacguguauacacacacacacacacauucaugucuauuuauagauuaggaaguuccaaacagaggaccuaauauuuccuaauuauguaaacaaagaacuaucuacuuuaaugaauguuucuccaccaggaaaaagaaaaauaggaaacauuccuugcuucuuuuaaccugucuguauauuucucuuaaauucucacuagaugcuaauuuaucaaggaagacaaaaaagacagaaauaauccugagccuuuuguuguguaaaacugcugcucuucuuguaaagacauuuucucauuaauuucaucaacacugagaauuuuaaacugcuucucaauuuuaagcaauuguauggguuuuacauuucuauuuuugaaaauccaaaauuauugaacaaaguaauuuaguuagcaaaguuuacauuucuuggaaagaaauaugaaagggucauucuuacuauaauuuuuauuguuaaagaaauugcuguuguucacauguauuuaugcccuccucauuccggaagaauauuugagguagccaguagcacauuuuuuugaauuaagaaaaaauuagaucaaaugaaaaaauaccuaaaauuuaaauauuuagagaaagccaacucaauuauauuuuaaauaugccugaagucgugaacuaacuaauguugaucauuuagucuucugguccuaucucaggaauauuauugcccuucuuaauucaucuuucaccuccuuuaagaaguauuucugaauaacccuauaggauaacuuccuuuacauuucuuuagcucauaugguuuauacaaaaggcuacucacuuuaucacauuuucuaguugcuuauuguacuucauaaaucucccaacuaguuccuagugaaaauucugcccuucuaauuuuuuguauguaauuuaccaaagcaccuagcuuugugcuagcuaaaagcucugcucugaguuaaauuagugaaauauugcugguugauuucaccuaaaaguuugccccgggcaggagggaagagggugggcauuugaauggguaacagacagagaagcagcugauuggacauagauguugacaacuugcauacuuauuuuuuucauuucaaucugugccacagagucauacauuugguaauuauuucaugcuuuuguuuucaguugaaaguaguuagggccauauguuuugacagaaaaaagauaauucguacuuuuuuucagcuuuaugaaagggaagaugggguaacaauuuuacaguguaccauggcagugauuccuguucaaaacuuuaccagauuggaaacucacuguucauaacaauucucuugguaagcagaagaugaaggcaucuguuuaaagcacccagaguuaaguuugaugcuucaaagcacagcagaguucauuuauaacucuacuuagcacuauuagauaucuuuaacaaauaugaaaaguuguccaccagauuccuuagacuguaggugauuuggaaggauauucuggucaagugcuaacuucugacugaggauuucaaaugaaaagaccuagguuauaaccccauuccugcccuuacucugucuugugacucauggaaaaggaaggcacuuaacccgcuccaagcuuauguuccugaauguauaagauggguagcaugguugaccacuuagacagauaauccaucucaaaaugaugauuaaagaagauaauggaugagaaaaguccuuuugauuuaaaauacuaugaagaugugaacuuuuaauaaugacuaaugauagaauuuugucaaauuugcuuuacguaauuaaguucaagaucaaagaauauaucuagagaaguaccuauguauuuugugaaauguuucuuugaguauuauuauuaucauuuuaugucuguuagaaucuuggccucacugucuuuucauucuugcuugaaugucgacucuucaaagugugacuuucugcuugugucugaugcaacuuucuuccugaucgcucuugcuuccugagaaggaauagguacuuaggaaugauggcuuuuuggcugucugugcuuauuagguacaaacacagcacuaaagacauuugggacuggagaaauaagaagagcgccuuuaggguuguaugcaaaaggucaaacuauaauguaguuagcauuuuucuuuguacugcuuucccuucuuguaacaaccucucaauacccucauaccuucucugcuuuccagaaaugcuuucuaaaaauugauuauugggaaaagaucugagaccucauugcccugaaguguaauuacugcugacaaacugugacagcauuucccaaagacagggagugauuggagaugugaugaaaaguggguuugugacuguggaaacucuuucagggauguaggcuuuuaccccucuugguaauguaccuugacaaaagucugcagcaaugaaauuaacuuguucacuccaaucgcaucuaaaguuauuugagcuuaaguccuuucuuaaggaugucagcuuuaggcuucaggcaucaaccuguggacuagaauucaaagggaaaaggguagggaauggugcucuuaaaaucuuuaggaccauuauagguaauuccauauccuaaagaaagcucagcccuaaacacauuagagaaguggaaugcacuaaaauauauuuuggcagaaccaaugaauguuuaucuuucucuguguuaugauguuauucuuaguuugacguguaucccaugugugguguguuuauucauucaugcaugcaugcacuuaguaaaguuuugagccuauucugugcccggcauuacaugcacacacacauauguccaagcacaccugcacauuuuuuuuuuuuugguaaugccuuuuuuaccuuauuguuucugcaacuggcuauccuuagcaggccuucuuaauguacaauaggguauagaagaaauaacaaucaacauuggaguaaaccuaaaauuaauuucugucuuuauuguagagucauagaauuuguuuuccucuggaagaugugcugcccucauuuaauugauaaaacagugcuuucagaggucacaaagcuauuuuuuggcagauauaaccaaaccuauuuugauguuccagcaccuccuaaugaagcaguagucgucaucuaaaacaaaaagcagucgguugcuaaaggaggagaaaguguugagaugugagaugaucuguuagacauaauugacaaucaugaauuugauaugauagguguaaacagagauagaaauaauuuaguuacaucuguuuaagauuuaagauaaccagaagcaauaauguuuaauugaaauaauauaucagguucuccuuaacauuaccuugaauuucuucacaugcacaucaaugcauuugguaaauaaaaguuuggaaacaacuuaguuaaguguuuagaacauauuagaguugugaugugcuuagcauccgcagucuuuuaucugugccaacccugagccugguaaugaagccaacucccacaugaauaaguaacauaaggaguguaaccaggaagaagucaggguuucaccuggaccaaauuuuaggcaauuaaguguuucaagagaucuuuagccagguguaacuuaaucaguuuaaggcacucucagcuagggccaagguacucauaauguuggcagugggcauucgucugauacaccacguugaaaguaauaggaaacauagagugucugcucaguuauugccaagagcaagagaaaugcagguguaaaaauauaaagaaguauuuggagccagaggcuaguacacauagacaagacuguauuuacacuuggcuuuaauaguucagauaauaacauggugguuuuuaaucaguuuagugugcugauauuuagucgugggucugguuucaccacuaaacccuaguguaacucucagccgguuacuuagccucucucugucucuaguaauauuaaacaaguguauuaauaccugcugcaucuuagcucaacuucaugucuggaagacagaugaaugguccugcuucuugcaguaacacacaagaaccuccuuugugcugcccugacugagaugaucuuguguucuucucuacgggcaaaacagcccuaggcugcuaaauggccaggcaguauaggggacuuaggacucuacaaagcuggguuuugguaggaguccaugagcaccgcggagagaauucuuaguuaucaggagauacgguuguaguacuuaaaaacucaaacuccaaaacaagacuacgugguuuugaaucucaguuuugccaguuuauuagcugugugacuuuaagcaaguugcuuaaccucucugugccucagaucccuuagccauaaaauugggaugaucaugcaacaauaggauuaguauguaagcaaaaugaguauauguacaguuuggcugcaauagagcugauagguguaaacagauauaaauaaugacuucuuuucugaaaaugacuucuuuucuguuuuucucguuggugaucccugcuuaugucacugggauggcugcgggaauucaguaggauaauauuggaaaauagcuuaaaucucaaauguucuauagcuaugauaacaucacuaugacgucauagcagagugaguccacucacaucucuccuggcaguuuugcugccucagaguuggaauaauaacucacugaaaauacuuccaaaauagugagccacucugcagauuuaauuuguaauauuauucuuucuaauuauuaguggcucugucuuaaguuccuuuguuuuaauugaagcaggguuuuuuuucccccuuguaaauuucuauacaugucaaaggcuaccaacucauuuuuauuuagaguuugaaauuugauuugaaaaauauacugcagccagcuauaugaaaaacauaagaggauauuguugacuuuugaugaagggaagaaagaacaagguagagcugccuagccaugaagaacgccaggguuuuuguaaccccuggugugcuuugcacgcagaaggcacacacuuaaauuggcauggcucacuuuuuuuacugugccuuugcugagcuugcugcaggcugagugcacugguagaggagugcagggcuguguucuggccaucccugccugcucaggccucuccugcuccuuuguggaucgcccaggucucugcugcuuccuggugccgucuccuggauccucuugacauuuuuccguucuguaauuugauugacaguuacagacaaggaaggggacugaaauucuuaccguuuugugacuuccuaaaacgggaaaggaaauuuggugaaugagaaggggaaaacgccucuuggcugaaauuauuuacaggauuuagccccagguuuaauguacucaugaaugaauaaugacucagcugauauuuagaagccgggaaaauuaugcgauuuuugugaugggguguauagauauggauguauacuugaagugguuuguguucuaaauauauuaacaugcucagggaauuucuuuuuggggaaauacauauauucuuuuucauagauuuuuguggugcauucugguagacggaagaugggucauugcucaguuaguaaaaaugaaauaugaauaucauacacauaagugguacauuuuacacuuuuugauaguugugaaauacucuuuuuuuuucagacuaccaauaaagagaauuugaggaguaaaacucuucuuaccaugaauuguuuuggggcacuuagaacuauuuaguuaauucuuuuaaauacuccaacugauuuagauagaauaaaagugucacaauuuuaacagcuuacaccagugaaauguuuccacuuauaagaaauacccucuuauuugucagcauacugaagacauauauguguuauuucuaagcacauuuccuauuuaugugauaauggagaucgcccuuuaaccaucacuuggacgugaaggaggauucuucuuccuccauuaguaaauauuccuugacuugauaauacugaaaauaugugaggugaaugagcuuuaauccugugguuugguuugguuuuugguuguuugcagucuuggacuguucaccugcacugucuugugccuuugaguaugauuaacugccuugacgccuuacagugcauuacacaacucuacuucuuccauuucuugacuaaucucucaugcuguuugacugcccauuggaaucuuuaaguuagcuacuuaggaaagacuuuaggaaggagaaugcuaagagaacuggcagagaagucaggagccugggcucuguccaggcccuggcguaaguccuuucaccucuuccuuugacuccuuuacaaaaugaaguugaacucauucgagcuuuaaaaagaugacgccaagaggcaagacagagggcaguagaugugaaaguaacaugaaagagaaaggaacaucugaaaaaaaaaaaaagguagaaaaagauuuugacaaauaguacuaaaaacaaagaauauagaauagagagacccaauuauacugauaauuacaauuaucaguauuguaaaaacuacagcaaaaaagcuaaaaacauauucagcuuuuauuguccauaaaaagugaucacaccaugucuaacuguaauucguuugucaaaaacacuagaggccaaggacuaaauugcggauuaagaguuucuuccuuuuauuuccugcauauccagaaaccuggggucauagauacucuuccaugguguguuguuuggcacaacuugcaaguauuuuggcagaugguuagaaaaaaagacuuuaagaaauaugcaauaguacucaggacucuaaauauaauaaauaaagcuaagauaccaguauccugccauucauuacaaucaacauuuauugaacagcaguuauaugccagguagcagggauaccuagaacuugccccucccacuagcacuccagaagaguuccugcuuucccagccuaaagcaacagcaagucuuacaugagcuaggcuuacugugauagcuguccugacggcgaguggcaaacauggcccagugccuuccucauggaugaacaugacucuacacugggacuccccgguagaccuuuuugugaugaugagaaaguccuguguuggugauguucaguaugguaacuagugacuguaugugcuguugagaacuugaaauauggcuacugugacugagggacagaacauuuaauuuuauuuaacuuugguugaguuuaauucaaauaacuacauauuacuaauggcuacugauuggacagcagcuuucuagacccauuguuaaaaauaauuauaagcaaugaguaccucuuaugagauagaauuaauaaucccauuuauugagggcccaugacagauuaagaauuauguuugacauauauuaucccuaauccucacaagaaugguucauuugacaaauaagauaacugaaguucugagagauaaauugcuuuguuauguccucgcaaggaauugugagagcuggaauuugaaccuaauuggucagacuccagagcugggugauuucuaguaaucugccaaaucuguguauguacuguccggaugcugugucuucugaguacaucuucuccuugcuuuauggauuaguuagcaaugucuuuaucuuggucacauaggacaguuacaggguccaucuuaucucuucugaauauggacguaucacugcacuggaaccauucauuuuucuuacugaggccuauguccuucaaaaaauauuaagaguugaggguccaacccagcuucuugaguaguaagcuaaucaccuacaaguauauuuccccaguagaugcugagagaagcaucaaaguacauggguaguucuguggacaucaguggcacucaguaaacucuuggcauuugaguguuuaacugucacaguugaggauaucugugaacucucccaaggccugagucacugaaugagcccagccaguacuugggcgucuguggcuccauucugcuuugcuguuuucugcuuuccauggaacauacaguaacucucuugaagggucugaaagccucaauuacaacguuucagugauucugaacugauuuuucuuuggaaaguauauaugcagaugguacuugcagaaucaccaggggguaguaacguggaggagugguaaaggucuacuggacaaucagguggcuaccacccaaccacacauggugaugugauaugaagccacuuuucuuuauuccuucagauuuaagguuuccccuucaggaagcagguuacuuaacaaguacuugauuucaccauaacaugcauuaugacauuaucuuuuuuucuuuuuucuuuuuuuuuuuugagacggaaucuugcccugucgcccaggcuggagugcaauggcacgaucucggcucacugcaaccuccuucucccagguucaagcaauucuccugccucagccuccugaguagcugggauuacaggugcaugccgccacaccuggcuaauuuuuuguaucuuugguggagaugggguuucaccauguuggccaggcuggucucgaacuccugacuucguuauccacccaccucaaccucccaaagugcugggauuacacgcaugagccaccguuccuggccgauauuuuauuuucuuaaaaggucauuaucagaugccacaagaguauuucuauaaacuaugacccaaguauagccuaauguuaauagcuuaaaauagguuuuauuuaccuuuuuugcccuuuaaaagcaaggaauuauuuuuuaauggaaagaacauagacuuugaugaucaguucacauccuugcuuuaccccuugaaaaaugugcaaccuggaaagacagcuuaacauuccugagucacauuuguccaaauaauacaaacaauggcaacaagacuucagcacuaaugucugauguuuuuuguaugauuaaucugugccagguuccauucuaguuucuuuacacacauuauaccaucuaauucucacaacaacuuugcauagcaggcauugucauuuccacuuuacaagcaggaaucugaggaccagaguuaaaaguaacugguccaagauugccuaguuaauaaaugguggaauuugcagucagacccaagcugguuugggccaauacacuugaccuucuuaugauacgucagccuugugaaauagggcagauacuauuaauaauauccaccuugugugaucauuaugaagguuagauauaauguauguggaacucuugccaccaaagugguuccacaagaggcccuaaacaaaugaguaaucauuauuauuuuaaaauguccguaagugaaaccgauaugccaagaccaguaaaaaugagagcuucuuaaggaaaagaguaggaggcauaccuuuguuucauuuuguuuguugguuucugugcuugcuuuuuguucuuuucuguuaggcacagguuuuauuuagaauaaauuaaauuuuuuuuucuuugaugagugcagaaauaauaguuggaaacauugaauggaacagcuaauguaccauaguaauacuucuuggauuaccaaaaaaaaaaaaaauuaaaucuguaaaaugaaaacauuuuuguuuacuuuggucaguucaagguucaguguuaucuagagauuuuuguuaaacucaggauuucuauauguaugauugucugcuaaauucagaauuagaagagaagagauaauggcgcuaacuuugcauguuaaauauacuguguuacuaguuuuccaugaaguuuuuacucaacaaauagguuacuaaaagagcugugaccuaugaguuucaccaagucuuuccauuuccaauucggcaacaaaaguuucacacuucucaauuacucuugugggaggaaucagaaugccaacagucaccuugaucuaagcguauuauuggagaaaaauucaaggauagauauuuguuucucauuagauuuuccucauauuuuaucauuggggucacucuaguacaugguacuagaauuugggauuuuuauuucauuuuagauuggacugauuuucugguguuagucauuaaaaauaauuccaacucuuugaagagaucugggauguuuguuauuauucuauugauuaaauaaagcuauuuuauuuaacaauuguguuguuaaacuuucuauauacuuagaauaauaauacuaaaaacugaauggguaugagcuuuucuuauugaauuuaaugucaguauuaaauaccuuauugaaacccauacuuugaaagcuugauugagaaauuggcaaaagaguugacugaaguaaaaguaaugaagcaguucacuggucauccagguuaugaaaaauuaaaccauuagagauaaacugaacugugaaaauuaugaucaugguguuuucauaaauaccaucuaugucuccgccaccauucuaaaaaaaaguacccuaucaaauggugaaaaauaagagugauguuucugugaccauuucauuauucaguuuucuuauauuugaaaugugggagguugaacuaaaauuuguugguucccuucuuuaaaaaaguauaguuauaugugauauuuauuuauuuauauaaacaaaaauauagagaucuuaccuugaaaauaacuuuugagguaagaaugauaaaguaucuaaauggaagaugaauaacauuguaucugauuuguaaauuaugauauaaagaaaauguauaaaauauguagaaauugucuguauaaaaaacuauaaacagugguccguugccuauuaacaaagaguuucauguuaucuaaaaagucuucaauuggcuaaaacagcagaaaaauagaaauuacauacuauaauauauccuaaaaacauuucaauuccauagauacucuucuccaugcagccaauauuuaugaauuuggaguaagugaccuacucuuagauauuugagcuugauuauaauucauagucaaaguagccuccuuguaaauaaccaaaauuaaccaaagauuuuuccuuaucuuccaaaagcaaugccaaguaauucuauccaaauuggaaaaaaaaaaagaaaaaggauaaaccuuauuaggugucaucaaaugguguugacauaaugauauauauguuuaaggauaauguaauagaauauguaauuaaaauuaaaguauauaugaaaagaauugauuuuaauuguuuuaaaacauaagaugauuuaauaauaugggucggagauucuuuuuaguuuuauaauaaauauauugauuucugaaauuuggguauauuccauaguacacuuagcuuauguuaauacugaggccagauugcugucaggcuaauagcguguagauauauuauagucacacuacaaucauuccgucaguuuucaguuucccuuuuuccugugauguuucuuucaucuuguuagauuauucucaagaccuucucuaaauaccuucaguaguaauucacaaacucuuuguuaguuaauaguucucaagaaaauucugagaugugguugacagaacuuagaucauugguuuguuuuuggauuccuagccaaaguuuuauucuuuguuucuuaaaaauacucaaaaaaguuuuuuuuccuuauuguaagcccucuggaaauagaagcaaaucacuguuuauacauuuaaaaugugaugaaaauuacaaaauaaaguccagugaaauauagggcuuguauccauuagugccuuaagaaaaaucccuguuuucugaagugcgagugggcuuuucugguuuguuuuuguuuuguuaaagcuccaggaccucccaauuuucaagggcacuuuggggcauguguagcauuuauuugauguauggauguagaugcauauuuucccacaucugucucuguggaccuauccuuugugaaauccuaaaccuuguauuaaugcuuaguuuaugauucaugguguucugagagcaauuauauaauuuuucugggguguuuauucgaugugcacuguaaaaaaaaaugagaguuauuuuuugguaacccugcacuugccuuuuuauuggugaauuucuuuuccuuuuacugugaccugugaauaucacuguaggcucacugccaauuuugugagccgcugccugcuucaaaauggaggcaggaagguauccauuuucaucaagaggaugacaguguuucagucuuucugaccaucuggagagaggaacuuugagagcaaaagaaaauggggauuaaaaaaaauuauauuuagcagaaaaggcaagggggaaaaccaauuaaaguuaaacuauaccuuaugaauuugugcuuuucuacuaugcuguccuguuuaaaaaaaacauaaacaagaaaauacacaggcuauuuguauaaagaauugguuucccaagucucaugaguauuaguaaaugaauguaaguaaauuagguuuuuggcacacuuuuuaaguuuauuguacacacaaauauaauaagcaugaaaaaggagggcucccuccucccgcuuccuaugcacacacugauuguugguggucuuauguagauccaggcuuuuaauggccuuuuucaugcaucucugcaaaaagcugacacuaugggaauuuaauauucuaagauauauuuaucacuuucugugguuuggauaguucauuuguguucucucugucuccccccucccuaccuccucucuguaaaagugaaaauuuuaauugaaagguagaguuuuuacucuaccauuugaaagagguuugaugcaugucuuucuguuuuuaccauuuucacaugcuuaugggccaucuguguuuagaagaaaaagaaagaagugcuuagacucacaggauuacccuaugggcauuauacaguguauuuacaacuagacaugguuuacaucaacuggaauauaacacaccugguuauuuucuguucgcacaaauacaccgagcuuuuguuucguuuuguuguguuuguuuuaguguguucggaaagggcacuguuucuaggguuuguucagauuuaaacuggaaaggguagaaauguagcacuuucugccuacuucuuauauaagaauggagcuugggcugcuguggucaaugcaaaaagcaaaacucaguugguucuuucuccucaggucuaugcuccaucagcaagcacugccgacuacaauagggacucgccaggcuauccuuccuccaaaccagcaaccagcacuuucccuagcuccuucuucaugcaagguaagaugcugcugcuucugagggaaaggccacuggauagcauuuuccugggucacuuaaugucacagauggggcagaagaaauggaauaguaggcaaguguagaauuuuugaagucaugcucuucuuaggaauugaauuccuuaaaaauugauguauuaauuaaaacuguacuaagucuuucuuuacaauuaaaccccuuuaagcaguaauggguuaagauuagauugaucugcuucacuuagagccgaugcuuaugauggucuuccacucaugaccaaccauuucagcaucuucaccauccccaagacgauguagcuguuuguuuagaagugguucagcuccauguauguuuugaacauccuggauuuagccaacugggaacaaguuggccuaauguauaaccuuauguaaaauuuucacccacuuacuaauuuguagguaagaacaaggguccaagaugaaguaaccuaccacagacuggaauauuacauggugaaagcucugucccaacauaguaacugguuuaggauaaaaggcccaacuuuugggggagaagacaaauauaggaaauuauggaauuguccaguauguuuaaauacauggaugugugcccccacccugagcuuguagucuugcuacugauagcguauaccuuucugcugcucaaaaaagaccaagauguggccgagugcgguggcucacgccuguaaucccaacacuugggaggccaaggcaggcaaaucacaaggucaggauaucaagaccauccuggccaauauggugaaacccugucuguacuaaaaauacaaaaaauuagccaggcgugguggugggcaccuguagucccagcuacucgggaggcugaggcagaagaauggcaugaaccugggaggcagagcuuacagugagcugagauugcaccacugcacuccagccugggcaacagagcgagacuccaucucaaaauaaauaaauaaauaaauaaacaaacaaauaaauaaaugaauuuuuuaaaaagaccaagauguuugaaaugauagcagcuacuucaagaaugaaccacuuggaggaugccccuaagggcuccauccugauauguguguggcacuuauuuucuaauguaauuaucuuguuaccaaguuaaugcccugaauuuagauguggaauuuaccaagaaccccugugugcaaaauguuaacucuuuuugcccaggugugaaaaccuuauuuguauaagccuugucuacgggccaugggguuuccuucuuuaugcaucucuaggaagggccaugucacaggaaggggagcacauuuggggcaaagaguaccagggaagcagccugauauaguggacacacucaaaaucauucucauuaaaagauacuaaucuuccuucccuucaguguguuagcucuuuuaguuuguuaguucacgugugaaauuccauggaaaucuauaaaauuggauggaauggcucuguuaggaauagagagaauuuguuccacgcauaauagagcccgugugucagaaguccuuuaacuuugugacccguccuagguguaacucaaagggacacagcaggcuaugucaccugggugcguuuugugccgugacaaaaagcuaaucaccuucaguuauaaacaguagcuaccucagcaucaguccccuguuuugugagcagugggagauauuguccuacaggagcuuacagagauuggcaacucaaggauccaucacucaaaacagauuucgauugaaaacauugacggaaggauauauuuuuucuaucugcccaggaaaguggcuuucuggaagggugcacauugcaggagaggccagguagauuauaucaguaggcuccuuucccuagcagaccacacaaaauauggggaacaaauuuguuuaucugcauaugcauacccgaaaagcaaaaaaaaaaaaaaaaaauugaguugacauuuuugaugagcacaauuaauuugcacacaucuaauucuauucuuucuuucaaaagaacauuaugccaagaucaugggaugugauaaauauuaauuuacugugaaaagcauaauuuauguaaaauauguauuuuuauaagucugcaucaagcagaguacucuguguuaacaguccuaaacgcauugccacccaggguaucacauugucaggagacucuuguuuagugauauauguuuucaauuuauuugucauaugugccaucuauuuaaaauguuagugaucuugaacuucauauuugaauuuaaggugacauuuaaaccucuguaaucuaaggacuaaagcucaaguacaugaaugauaacuuuaaaaaaaaucauguguuuucacaugauggccacagaaacaguugcaucaugguccugucccacaucagcuuccuuucaguagagggguacuuggugcccugagaauucaagacuugaaggaauaugcaauuaaggugaaagauguucagaaacugucuggggcauauuguaaacucacuacuguggccucuuauuuguaacuucaauuuccaucuucuaguuaaaacucugaaguugucaaaaucacagacaugauuuugcuugcaugguucuuaaagagaggaaucugcaaacuauuccucccaauaugaaaugaguccaguuacaaaauucuaacuuccggauuuaagaacucaaugaaaaagagcuucacgaaauacagugucagauuuaacuuuucuauugccuaacuuuuuaauaggccuuuacuauauaaaauguuauggugaaaauaaucuuauuuucaaggaagcaauaucugcuauacauuuaacagccagcugauggccuaguguauaccuaguacucaauacuuuuuguuaaacuauugaaacaaagaaaaaaugaaugaauuuagcaguaauguagaucaucuuuucccuuaggcuugggaaaccaaaccuaaacauuagcaaucauuaauaauaaccuguaggccaauaggcccagagaaugaaaaaauccguagggauguuuuuaauaagaauguuaacaaaagguuaaccuuauguugaaagauacuuuauauaauuuuaaaccucuauaauucauaaaucguuuuauaaaauccagagacucucaaaaauaucuguaauauaauagcuaccuagggcauguuuguacccuuuggauugcuacugaagguuuaagauagcuauauaccuauacaccaaaaaauaaaaauaaaauauccuaagaacuauauauuugagauucaucuucucugcaugccguaauauaauuauaauuccaacuuuaauucuauuuauuguauauguuaaaaaugaaauuaaacauuuucaaucugagauuuuuuaaaauuaauacuucuuuacaugcuuuuaaaacuugucaacuuuguaauuucucaaguacuuuucaccccaaaguuuaggaacaauuuaacuuuuuaguugguuuucauagaaaaaacaguuagaagacuucuaagaaauguuuccuuuagcaguaauuaccuugcgacuugacauaauucaugguagaaauauacucuguuguucuuuuacaguucaauuuuuaccaagaacacuuuaacuuuuuuaaguguuuauauuuguuugacaauauagagccacuugggaagaaaugaugacugucuucugauguaaucagcuaaccaacacaaagaugaauaacacaacaggcagucauuuucaaguauaugaaaaaacccuauucuauaaggcaaggcugaaugccucagaaagucaugguugucuuuguccuuuacagauggccaucacagcagugacccuuggagcuccuccagugggaugaaucagccuggcuaugcaggaauguugggcaacucuucucauauuccacaguccagcagcuacuguagccugcauccacaugaacguuugguaaggcagacauacacgguaacgggaaugucacagcuaguugauuaaaccucguccucugucuuuccaugcauauacacaaggacucugcaaauaagugcaaaaauggcacacacccauuauucuuaaguuguauuguuucugugaucaaagacauaacagguucaaaucaccuuuguaaauucuuccagauucucucuggcauuguucuuuuguuuauuguguuuugcucugugccuucuuuaucacaaugucagcuuccuuggguacauaaauagauaccuauuuaaguuguagaaucuuaacauggugguuccugguuuuuuuuuuuuuuuuuuuuuuucuaucuguaguuucaaaagauguacugcagagggcagagugacagucgguagauuauaugcaucacccaggagcauuucauuucccauugacuggccuaugucagcuuuggccuguugugauguauccaaaagaaggaguuuguauuuucuguagacuuccaucaguaagagaaaccaugagguuucuacauagaucagauucccauuuuucaguauuuuaacuuuaauucccaucccagccugccacucauacuguguuuugcgucacuccaggugaaaacuggugggcucuagaauguuaggucuuucauuacuaaacauuuccacucuguccaucaccuacauucaucuaucauaguaugucucuuuauccuggaggaaacaacucagcugacuuucuucuagccuuaaauaucaccacagcccagaauccacuguugaacuuaagucugucauuaaagagaggaaagagccuagaucuugagugagauuugggaugcagauaagaugaaacuugaaucccuugugcaagaacauagcuuaaacaauauguggaccucacauccuacaaaugcgaaagcauaugggaaauccagugaucccaggugauacuuacaucacuacuauucaucuugcauuugccccuuuuucuucuucucauaucuacacuuagguuucuuucucuguucugauaaaggaaaucauucuggauucauguggucuuugcucucuuuugcucaaccaguacagauaagaaacaggaucugaucuccuacuccaauaaucaaaaaaauuccagaaguuaagauuucugauauccuugaaaauccguauuuaguugguccuagugguagagaugcuaaguagucaauuagccuauacauuccugagaggcagacaguggaaaugguauuggccuuuuuguaucaccucccaagauugaauguguaaaucacaaacuaucucacauuucagcacauuuccaguaaauagcagaugacuuauuuucaaauuuucucuuuucccaccuccuauuuggagauauuagagugaaagcuuagagaaauaucaacuauaucaacuauuauuaugcuagaauccguuuuggcuaaaauuuucauuucugcaccaucauuuuccacuucugugggaacucauggucaaaacuguauguguccuaugagcaaggaaaguuuugauuacaaauaaaaguuuuaggcacuauaccgcauguuggaauuucaguucuuuuaagaguugcccauuugacauuaauuuuucuucccuucuguguuucuuucuuucuucuccuaucaugcucaagaguuuugaguuaggcgauuugauuuuauccuaguccaguucacugcaugggaaguagcuuuaaaaugugcuuccaugcacaaaaaguauaauuucaaaauggaaaccaacuauauuccuuuuagaaaaaauuuuacagaaccaaaacaauauuaugaacuagagagaaaauaucauuuugaaguaguaacccaguaggcuauaucagaagccauauuugcaaugccauuuaccuaucacgaaacacaggauuuucauuuuucaucugaacaguuaacagauuucagagaguagaguuuuuguuuuaaaggagacaugaauaagcuaucuugcaauguauacuaaugaauuuucccacuguuagugaaacuauugaauuauuauaucuaguugucauuguacuuucaguauuuaaccaugugaaaaucuuuuacugaagugacuuagaagaaucugacacugacaauacuuugaauauauaguagcaguugguguccuuucaguugaaaauaaugguaguuccuuauaauuuuauucuuagcaucuggcuagccccauacugaacaaagggauaguuuaagaaaaagcuaagcgcuguuccuggauuauuugggguauaauuuggccaaguugauauuaucuguaaagauaaaauauuuuaaaaacaucauugccuucaucacuuuaugccauguuauaacagaauguguaauuauaaagcuuaagauccacauauuucaguagcgacugucaaguuacugauguuuagucuuuaaauccccuuuacaguuuuagccuguccaacagaaucccacagcuaaucauuacuguguuacacauacccacacaaaaucacucagaugaauggaguuugcgguuaaaguuuggaauggguuguuguagaugauuuuauguuuggaaugacuuggcagaguucuuuuuaagaacaggauagaguccucacugucuggcaugauuuaggcauggucuuugcacuacagggcgaaacaguccuaggagucuggaauuuuccuuuaaaggaaguucuguuuucuuuuauuuuuuuguaacauaaacccuuacuucaguaauucucaacugauggcaguuuuucccuucagggaacguuuggugaugucuggggacauuuucauuguuacaacuaggggcuagaugcuacuggaauccagugcguagaggcuaggggugcugguaaacaugacgucauguaugggagagccuccacagcaaagaauugucuggcacaaaagaucaguagugcuaagguugugaaauccugcccaaacccaaagcaugauuuuauucuuauuuaugugcaccaguuauuauauuuuucuaauguuugaauuaucaaccaguauaucaguaauggaaacauuuccaacaauuacucuguuaauagacacgaaauacaggacucuugggcaucauaaguuaaaaugaacgaauagugggcauguaaagccucgcacuuugucacacuccucauguccuuuguagcaagcaggaaagacaguaauagcuggaguaagagacuaagaggaccucuuauaguuuaucccuaaauccucuaaaagagacauuauucucugugguguauuuauuacaucucugaaugacaguaguuuucaagauaguuuuuaauguaaaauaaucuaguuauaaaucucguuaguuuauuucaacaacuaauuuucuaugagucucuaaaaauaacugauuuacauggauuccauugguucacuccuuuauaaucuauggggauuaauuuuucuuuuuauucugugaacucagcguuaacccuuugucaaaucccaaauuacugcccauuuuacauaaaguuaaaagggcccaaagauucucaccgaugugauuaucuguuuuguuucaucuucugauuauuauaguuaguuaaauauuuauaauucuucuccucuuuuuuugauuuuugcacauuucaggcagauuuguaguucgucuguucuucagaaauuccacauggaauaggacuguguagaagugagguuaaaguuagucaucucuuuuuuuguucuuuuuuccacauucuguuucuuuuccuccauuuuguuauagugcuuaccucuauagcagaaauaccucuaucccugcuaagcuuucagaauagcuguacuauggaaugggcccacuauauuuuucauuggagaaaauuccauggacuaccuuggguguucauuagguggcaaguagaaaugaguuuaacagguggccuaaggaauuuuggggucaaggaaagaaagagguccauggaauuuaaaaauuugaaaggcauucucaggaacuuggaaagauuuaaaggcaucaucucaacuuuuuuacggaagucuuuuaaguugggcuauuuuggucauacagagguaauauuuucaaaaacauucaugcgucuuugaaaauccuaccucuaauacguagauucauuuccuuagacuaguuggcucucaaauaaguuauacuucaauccacuguuuauuaaauucugacugauaaccaauuguucauugagcguauaguauaauuauguguucaguaguuagccacaaguugugggaugcagaacuauaagcucuauuccuuuaaagaguuuacaauacaggugaaaauacauuagaaaaagcaagaaaugaaaggccaaauauaauuaaguguuaaagacaauagugcagaauguaagugcauuagggaccuagagagaagagaugguggaagaguuggagguagucagggacucuucaagaaagagguagaauucaagacggaucucacagaguaaacagggcaacacucaagagacuaugguuucauuccucgugagcaaaugcuuggguuuuaaauacccgugacuaucagcaucauauucaaucucuuauuuugaaauaaacaauuuuuaacagcauuuccaauaaugauauaauaaagacucauaauccauuaauauauugcauaugaagaaaaaguguauuuuagcuuuaauauauugccuuuacauaacacauucagaugccuaugagaauaacuuuugaagcugcuuuuuaucuugaaaauagcucagcacuuuuuuguaaauuacuauguccauuuuagugagcuguucauucccaagcagauggguggauugcaacuaauuugccaccuuacaggcacuguggcauacccaagaaacacagcuuauuuggaaaacuaauauaauaauuaaacucaaagcagagucuuaaaccaagugauucuguaaagauguuguucuuucauugccagcuaugugaggauugcuuguagguggggcauggaaagaaaguacucaaaccaaaauaagucaugugguccuaauuuaauucaguauagucaauaguuacauauugaugaguaagagagauauuuaaccauuagugcuuuuuaaauuuuuuauuuacuaaauuuuauuguugcugggguucaaaaaaauuuaauuugggaggaagaagauuugagacugguuagucuuugccauuuaguuucaagaagaucaggaugaaauguaauauaagcccuguggaucauaauguuguuuuauucauuauauaguggaaucuuuuucacuugaucaauaggccacacaaaaaaauuaauaguagaguggucuuuuauguugccgaaacccuggagaugauuuuaagcaguaaucuguagauuucgagauugugaucauuucucaaugucccucauugccauuauaucccuccacaguugaugcaaacccaagcuauguuucuguauaacuuauuauuugaaaaaugaaagcugucagaucuaaacaagauauauucuuggcuauuuugaaauucuaaaagcugucuccauuguaaaauagagaguugugagaaaaguauuugaaaauaacucacuaaauaccuuaugauuaaauauggccaccuuuuucugcuucuugcuauagagcuauccaucacacuccucagcagacaucaauuccagucuuccuccgauguccacuuuccaucguagugguacaaaccauuacagcaccucuuccuguacgccuccugccaacgggacagacaguauaaugggugagucacagaaaugccaauucugauaccaacaauuggugucagaguuuaaucaucaaggaccucuuuuucccuuucauaacugaauagcaauuaggcacuaaauauuagucacaugacagaaugaacacacaaauguaccaaacagaaguaaaaucacuggcuugagcauaaccauauuuuucgucacaagacacugaaauuuagcuacguucuacguugcaagucauuagauugaacaaggguucaaacagaccaaaacuaucuuguuccucacauucaaaaagagugaacaaagucauaagaugagccaucagugacuagugagcuacaaagcagaauagcucuuaaugguaguuauugaccacuucccaaaauuccagucauugugcuaggcucuuauccaugaugugccacugucuuccgaggacugguuaaugugaaauucucaggugacugcuaauaacuacaugagguuaaucuccuggagaaugugacacuguggagucccucagaggggaagaaguauuuguucacuuaugagagaggagaugcgugggcaucaguuggccagaaauuauuugcugcuuuuuuaaauuaauuaauuaauuaauuuuuaccaaggacauuuacuaaugaguuaagguccaagaagaaugcuguucccaugaacugagccaucauccucucauuucuugugauguucacuguagucuuuuccauaggugguuccccagucaguauucccacuuugaggaaugaacugggcuggauguccagcugccccuggagggaagagguggaguugguggggagauagcuaccugcuucugaaccagcuuugacaccuuguuguucagaugagcagcacagcuuagugccccagggucuuauuaaaaccucagacuucucagguagucacuuucugcgguuauagcucaaacuaacuccuugcuuggccugaaugucacugucagagcgucgguggggagaauacucaguguaugucuuugagagaagauggcgcaacagaauaaugcugcuguugaguccucuuagcucuuugcacuuguuuucuuuagagaguguguagaauuuggggaaguggcgugaaucacuuauguaggaaaguuuuugauguuggaggagagauguguuuugaaauguuggaaauauaauuucugccucaauaaugcccucccugcguauucaauaauauaucucacacuugagaugagcuaucucgcagccucuccacuccgcuauccugucuaagaagcaaauugaggagagaguuuccauuuuuuuuaacuuuuccuaaccaagcuucuacaaauauguugcaucaguuugaccuuggagagcuacagacagaggucacauggggaaguuuguuagcuaucaaugcaguuuuggcagauuugaaaaacaagaagaaagaaagcagugcagaacugaaagagugagaaaagcauauuucacuucagugugguuugacaaauggaaagccccuuucugcagucaugaggucugguuauaaagaaggaugaccggucauucauccuuuuacaagacagauuuccugucuacuugugguuugaguaauuuucuuuuuuaggaagguaugaagguggagcagaaccuugaguugaggaaaacauacuuaggcucuguuugaaaaaaaacuuuuucugauugauuugcaaaacaguccucuugagagagaggcacuaugacuuggaagggacauaucaggaaauagggugguuaucuccaugagcuguagacagcuuagccacagcucucagugggaaugaguuuugcuugguuuuagcuggucaucuucauuaguuuguggaugaacaggagaaucuacuuguuggucuagccagaguggagcaauaggugacuucuauaugcugagaauagacuuaacuuguuaaaaaccauagggccuuauuuaagggucuugacaauaauaaaggagcuauaauuuaaaaacaaaaguaugagauuuuuagaacccagaaaagggcuuuuuagaaauuuauuucauacauuauuuuacaauaauggaugcacuugucaaaauccacuagcggaaugagaaaaagaugcauaaucuuuaaggaaauagguagacaugguaauucagcauuuuggaggagcaaaccuuuauuauuaugcauagauacagauauuacuuuaagguuacuuuaagggagaacauucuagaauguuuuucuuuaaaauaauauguucaccaauugcguacgugaaaaugcagaggaaaauuuaagcauaauaagccuuaguauugcgugaugucugaguggcccauguuuuuucacacuuaaguucucuuaggcuuugguuugauuuuuugagugugguagaagucagugauggcagcgugucuguauaacaagaagagaagcuuucucuucugauguuagugauacuacccuaacaaacaguauggauuaauaggauacaucugcagacuuuugaaaauauuuggcauauacucacucauucugaaacgcaggaaguaaagaaauauuacguugccuguaucucaaagaacaaacagagcuaauuaaauaauuggcaaauagggaacacauagccugacacauguuugagauuacacacgauucuguagaaaaugacuguaagcaauacuaaugccuuaagaaugggguucgagcacuaacacauggacaucacauuuuucacguuuuccugguaaaaaguugcaagacagugcagucuuuucauacaugguguugaugucuuaggaagcugcuuuuucaguucagaagagggcugcugcccuucgucucagugucauguuauaauaugucuuucugguggucagcaguuguccugaacugacacuagaacaacgcagugcauguggggugagauacaagcucuagaacucucggaagggaaccucucuguaaccacauucccuuucuucuucuguucucugcaucucaaagguggaagaugcccacugagguuugcuguuuguuuggcuugggggagugaccagguguuucuuguuuuguuuucuuuugcccuauaauacccaauaucauuuuuugagaaauccauaagaaggauaaagcuuacuuggauuacauuaaugagagauuuuuuuuuuuucaugacacauucauccauggauuuucaagagaauuguagaacaagguauuuuacucauugcauacaguccacuacuuuucucaagccuugcuggcaaacucuggagaucauauuagaccuuucugaauugaaaaggucaucuaauuagcccuccaauuagaggaauauaauguaugggacacagcauggauucacaguaguucagcugguggcgcacccaguuaaggaaagaagcugucaggggucuuugggaguuaccagcaucagcaccuucuacucaguucuucaaacuuuuucaauguuaugccacuggguauucucagaagcagugcaguucagugccucugcaucugagcauacauacggaggaggaaguguaguaaguuauuagauaccagcuauagagaauaggaaugucugcaggauauuaaccauacacauuugguuagccacauacuuccuuccuauuugcaauaauauccaguagcccuuccugauggaaagaaguaagaggaccuccuaccauagcacagaccacugagacugcucaagggugagaaugcgucgucuccccauugggacauaccaucuguauacauucacagggugugacccuuugugguuugaggcuacacacacucccuugcccucagagagaacuggucauauaacuaacauaaugguuauaauaacuauuauuguuuuauuagucuuuaacuggccugcauucuaauacguggucuuuuccacguuuuuaaaccucaaaccaaacaggguugaaggaacagacuaccaagauugauuuaauacaccauaugcuaaagauuacccuggaauaucuaucugguucaugaauuaaucuggcuuagaacuuuaacuucgaaugacauguuaguauguggcuugucuaguagaaacauuauguccuuuucucuuugaggacuugguuucacaguaauuuuauuauuagaguagucacauaauguucacuuuauauuuuacaagaauauugagccuugaaguagucaggcgaugaacaagcacagagcauaagaguaauaagaauuguauccagcaaugugaaggcaucuuaguuaccaagaccaccagcagagaacaauaaacuaguuugauuuaaaucuccuccauuuccugugcacgaucaggaagcccaacuucccccugaauuccuaggaaucccuccuguuaaaaaauagugcauuguagucuauauacuugcguuuguauuuuaaaaugguuguaguaggagugcuggaaauguuccuucuuuuugucaucuuuauagauaagcacauggcauuguuaugcuguuucuaaugguuuaauaacacgagggucacucggacacaguuuagaaaaaccuacuuugaaagcagucaucuucucucaggcaaacacagugugaauugugcugcuuauucuuuugaugccuucaugauguucccagccuuagaugaugggugugcauuaaaggggcaacacauuuuccaaauucugauuuuuaguaguugaucccaaggcaccacucaucccaguguuuuguugaggguguguucuaaugggaaugaacauuuccccaaagcugaggcugagacagaggguggucuagcauguaacccaagauacaaaaccuuucuuucugcuucaucuucuagccagcaacaccaccuguguucaagccaucugaacaauacuuggguggcaggcagugucgaagccuccuacaaaaauuacaguuccucuuaauaacugcucaucuuccauucauauuuguauguuacagcucuacuuagggacugauuauauuucucuugggcaagauaaauugauuagagccaaaauuagaaaucgauaaagucuuuaccaagcaaaugcauuaguuuucaucuuucuguuacauggacauuuugaucaucucuaauaugaauugacaaaaaucuugggccucaaagaguaaucaaguccuguuacaucaaacccacauuuucagcuuuaauguaucuugcuaaacauggcccacuucucaaugcaaaaaaaaaaaaaaaauucugccacuugagaauuaaaauauauuucuuuuccaguuauacccuuuguuauaucugucacacaaauaaaaagagaaaucuguaagagaaagacucauguagcuuaacauguucaggcaaucuagaaaauguagcuucuccaguguuuccuggaccagaacaaaaggcauuccaagugaaagggcaaacuggccccaguaaacugcuuugaaauuuaagcccuuggguuuggcacuccagcuguugcaagguaaaaucgcuucauguuaaaaaauagucuguucuuaucagugguuuccauggguagccuuuguaguuuucugaaauauuuucaugacgcgaugagguaagaaguugauucuauuuuuaauucuauuuccugagucauaauaucucccugcauaaaacaggcacugauagaauguuuaguuagaaagguguaguucuaaagaaaucagauuggucauaauaucuugccucuucuaacgugugauuuuuggggcguauauauuuaguuuuuaaaugcuccuaaaauauuuguauugguuuucaauacuuuguuuaguuucauaaaaauauauauauuauuuguaaucuucauuuuaaaguuguuuaaaggaagaauuaaucuuuugaaagccacuacuguagcagauauuaucuguagugaagcaauaucuuguucuuuuuuggcuuagguucuuuguuagauaaugugauuuuuccaauguagcucugaacuuuuugugaaaaucuauauucaaaucaagcagauaucacagauuauuuugacugauagaucuaauuuuuagguauauaauaaugaaaagaaauaucgcuucuaggaaaaaaaaaaagauaaguacccccaaauaccaugguaauacauacugaaaaaagguuaguaucaucuauauuucacaucauuauuauuuucucuuuagaaugguuuuuagguuuguuuguuguucuuguuguuugaggcagaguuuugauccuguugcccaggcuagagugcaauggcgcaaucucaaucucggcucacugcaaccuccgccucccagguucaagcgauucuccugccuuagccaggcauaguggugcaugccugcaauccauguuuuuaguuuuuaaaggacuccuuaaugcagaaauucuucucauuuucacacuagauauaauuuguuguauuuuaucuuauauuaaauauuuuuaauacucuugauaucugagcugcucccagugguccaauuguaugaugucagacccucauuucaaagaacuugcuuauacaauaccuaucaugaguacuaaugacucauguauuuuaauaucauaacuuugugauauggaaguuuauuuugucacgagauaauuguguucuucuuaucaugugccagauuucuuucaguauuuuagcaauuaacaaauaaauauggguguggguuuuguaaaccaaauaaaguauauaucaaaacauuaucggcugggcaccgugacucaguccuguaaucccagcacuuugggaggccaaggugggugguucaugaagucaggaguucgagaccagccugaccaacauggugaaacccugucucuacuaaaaauacgaaaauuacuuggcgugguggcgugugccuguaauccuagcuacucaggaggcugaggcaggagaauugcuugaacccggaaggcagagguugcagugagccgagauugugccacugcacuccagccugggcaacagaacaagacuccaucucaaaacaaaaaagaaaacucaucugacaaacucaacauauaaauauaugaaaauaacaagcauaaauuagcuaugcuaagcagaggucaggagaauuaaauuaugaccuggaaaagccauagaauuggaccacugaagauccgaccccacuacugcauuuuacaaguguggaaggugaugacaacacauuuguaagaaagaaggcucucuuaguucaagaauggggcuggaaagucuuugaaauuauauaccuguuuaaugaaguuuugcuuggauucauugggugauuuaaccuuuccuuuucuuauuucacaaaauagugaaaaacaaucuucccucagaacuuuaauagguuuuauuuagauacuaugucuauuugcuaauguugaggcuuuaguaaauacaacauaccccaagugcuaggcauucuguuaauacugaagaccacaagaauccuggaaaucccauuuuaucacuuaguucuaaaggcaagauaccuuccaaugauacauguuaaagaaagcuggcuuugaauuguauacuguaauauaugucuuuuauuauucacaauacucuuuguucuucucuuuuguagauaaaaauaccaguguuuaaggcaguagagauaagcuucaugaauauguagacuuacuuuaucucuggaauucgaggccauauugacuuuuaguagcauaccaguucacuuuuuuuagugugaacacagacuuuuaaauauguggagaauauauguuauuuaaaacauuaaaaauauuuucucuccuuguuagccagaccuguuguggaaauuuuuguuuguuuguuugguguacuguaggacugugagacgaauaccccguuuugcuauguaucaaauuucuauuuauuugaaaacagauggaaguuauuugugaagauaauuccauuuacuauaaaauaauauaaagaaaagccagacucugaggacuccagagaccugaaaguagucuauacuugucagcaaugaccgucacauagcuugcuacauucaccagcucaucaacagcaaggggaaagucauagcaaggaaaccacuuuaucuuuaaaccaaggugucagguuuauauuuuaucuguaaaaaaguaacaugaauauauuugacaucuaccucagcaaacaaauuaaugcuaauuaaagauuaauguguuguaauuagcauuaaaaaugcaauuaaauugugaguaaauggaccaggaauagaaaauuguuagacgucucacugccugguuuucauauucugccuuuuguuuuugcagcaaauagaggaagcggggcagccggcagcucccagacuggagaugcucuggggaaagcacuugcuucggugaggaaauauugacuuuggacuccauauguaccauuguaaagggugaacuuuaaucagaaguggacauuuggaauuuuagaaaaugaauggcaaauagcuuugauuuuuggaaaaugcuagcuuucuugcauaacagucacuggaaaauuugagaaggcucugaagcuuccaguauauagucucuuucucucauccucaaaaugguacuaagcugcacucaauuauggaugugggaauauucuccuggucuuuggguuuauagguuuuuuauacugaugucuuauuuuucucuaaaguaauaugggugcacauugaccagcuaagacugucuuagcaaggaauaguucuaaaacacuuugaaagaggcauuugaaaaaaaaaaaaaaaaaaaaagacaauaacugagguccaugaagaacugucacauaauuggcaccugggggacucagcuucucugcuuugcccaccuacugccagaaagcuaaaauugaacauuucuugcauguucccugaugacaaaauggcauaccuucauugucucagagaguauaucugguauuuuagucaaaagcuaaacauggucauuuagaaauguaaguggagggccagguaguguggcucacacugguaaucucagcacuuugggaggccgaggugggaggaucacuugaggucaggaguucaagacuagccuggccaacacggugaagcccugucacuacuaaaaacaugaaaauuaacuaggcauggguggcacaugccuguaaucccagcuacuccggagacugaggcaggagaaucgcuugaaccugggagguagagguugcagugagcugagaucaugccacugcacuccaacuugggugacagagcaagacuccaucaaauaaauaaauaaauguaaguggagauuucuuucucuaagauuuugucucuucaguuggcuuuuaccauugagagcauuaaaaaaguucacacuguauuagcauugugcccuaaguaaaaguuuuuguuucaucugggccuucugaugcuaugcaaucaaacgccuagaucuggcaaaagaguggcaaaauaucuuaggaaugauccuguucaaccucucauuguguagaugaggaaaggaaaguucaaaguaucugcuuggcuugcccauagccacacagccaguaggaacgaagaguugguuugaagucugcugaccccagccuggcucuuuucccaccaucccauaccacaucaguaauucuuguuuugaaaaauuaaaauaauuguuaaguucuucauuugacaauuuugguacuguaguugauuauuacauguaugcuguaacuuguaaguucuaaaugaauugcguugacaacuucguaguuuagaaaagugugaauuauuuuaaugaaugaggguguuuuuuuuuucuccuuauuguuuuaagaucuauucuccagaucacacuaacaacagcuuuucaucaaacccuucaacuccuguuggcucuccuccaucucucucagguaguguauuucaaaucccauuucaucauauaacaguuuauaagaaugauuccccccuuguacuuccugauuuuguagguggaaacucacuuccccccaaaucccaaagcuuuaacauuccuauaacagacaaauacaaagggugggagagacaaauuaccagauaacaguauagucguuuacauccaaaccuuuucuuaaaaauuagauuaucuuuuuaaaauauacaggcauauggaaaauguauuucuuacacuuuucuuagcucugcagaagacacccaacggcagaauaauguauuccaauaaaacgucucagaugaaaaaaacucaguuaauauagucaugaauaugaauauagacuagauagucaucaaauauagacuauuuaaauggaucauuuccugcaggaauuucaggcuuuccaaauucccucuuuaaaguacaugccauugggauguuuagagaaaacuauaauuuuguaaauaaauugugaaauaauugugugggguagaagggauguuugacuucaaaguauaauacauucguaugaccuguggcuucaaauugaauaacuauaauuuguagaauuaugucaguaaauaauuucacuuuucagggguccguuuaagagacucauugucuuuccaauauaaaugcuuccagaaagccuuccuugguucaugucucugcucuuugguaaggagacagguggcuuauuaaaaaaacaaaacaacagcaacaaaaccuaaaucacaucuguaccugauggaaaccuuaccuuacuguaauuuauaguggaguuacuugcguuuguuauuuccugcaugcagcucucauggcccaguguaaacucagcuccuuggucgaggacaggagguuucacauugccacaaaacuuucagaaaugauggccauggcuuagcugggauuuaaugucaaccucuuccaagccuccgugguaugagaagaucacagaauagagagggcagugggauucugaagucucuauguccagagagaccgcguugaaacugggaagcgauugaggugauuuuaagaggauaaucaaacguucccccugguggaaauagaaacuagaguucaguauuguuguacuccucggguucuguaccagauucuuacacucugaaaaaugauuucaauugucaguaacccccuuucgagacaacaagagauacaacaagggauagaggaaucugagcagguggaacuccaguuuccacauuucaaacaaaguagcuuucauuuuauucauuuucuaauuuagaaaaagaaauguucuaugguaucauaauguuugagaacgacuaauguagucugauacccugauuuuacagaugagaauacugagucccaaaaagggaguugaguuguugaguuuauuaccagugguaauagcagagcuuggacaaaaaucuggugcucacaguucugccauccauuucuagauuaauggugggaaagaaaaauuaggaugcacagucauucuagaaaacaucacaaauucccucgaccugaguagcaugaucucagugaaaggcacagaaacaaggcuagagaugccacuuuuugggucuugguaaugcaucauggaagaccacauguuaggaagaaagaacuuuuaugaagaugcaaauauggggacagauugcuauuuucacaccgacggcucuguccaaauucugucaagaaaaguaauugaacaaaauauucuauuuuuauuuagcauaaaaauauacaugcacacccagaaaagacaggaagaguggauuuuaaaagugcuaacagugucggggcaugagauuucagugagaucauagcuauuauuuuuuccuuuuuugaauuauguauuuuccaaguuuucuacacugaauguguauuauuuuacauuuaaaguguuuuuuauuuuguagguuagacauguaauauguauucuaacagcaaucuuuuuuuaccuucaaguuuaaugaaucauaaaaaaauuauuuucuucagaagaaacuuuuagucauugcuguauauugacuuuaaauuucuggcuuaguggaucacugauaacuaaucuuauucccuuaaaaaguuuuucaagauuuaucuuuuucuaaagauuguuuuaaaaacaaguggcaaagcuguuuuccacuggugcgagaauuuugguuuaacauaaacuagccuugcaugaaggucuaacaaaaucccauuuuuguacccuuaaaaguaccuugauuccauggugauaguuuuucuuccacaggaacccuucuuaccaaaauucagaaucaauuaaauguucucuuuuaggagacagccagccugggggaauugugagucuauguaaagucuacauauuuuacauuuaaaauguuuuccuugucccaaaauucuuauaugggaaguuuacauguauuuacguuguuguuuaaaugaaaaucaucauugccauugccauuuccaaaaggacuguuuaaaauauuggcaagcgucuuuuuacaugugucuagaucugauuguaauucccacuuuaauaucagcaggcacagcuguuuggucuagaaauggaggacaggccucaucgucuccuaauuaugaaggacccuuacacucuuugguaugucucauuugcuaaucucugucccacccauuuucaggucauguucuuucuuguucagucuccuuuacucuccaagauuuugauuuucccuguuaguaacuuuaagucagcauuaagcacacagguuugcgggagccagagucauuagccuaugcuugcuccuauuuggagaugggaacccagauacuacuguaauggcagccccagggcucuaaauaucuaguagcagauaaaauccuggaagggcaauggccuucuccccaucucuaggaaagaucccugucaaugauuaaaucacuuuccugcuaucagagugcuggaacuccagccagguccuauaccuggaacauuugauucccucuaccucugcuuuacuuuccagaauaacagguuuacaggagcuuuccuucucguagaaacccagugguauccuucgugguagagaaaugccuacucuuccaggagugaauugcugaaaauuuccauggauguaguuaauuauuauaaauacucacaugaugauucagugucugacacuucagucuuucucuccucaugauggugggggccagaaauaugcaggaaacaaugcugguugugcagcauuuaggcuguacaugaauuuagcgggaaggaauagcaguaagggagaggagccuuuuaguuccucgggguugagguuuucuuuucucccuccuaucuugagaugacacauggaagaagacauagauuuaucuaucugcuuuaguguugucuuauauucuucccuuucagcuuaaucuuaaggaaaaucugaaaagaaaagcaaagguggauuucccuccuuugcuguguucuuccuugcuauaguguaugaaucauucagcuaugcauuuuaaccaguaaaggaaaccagacagugaaacauauaugcacuacccagcccaauuaaucugcggaccacauccacauaauuaguuguuuuaguguuuaccuucaucaguuauucucuggggccuauucaucaaaaccaggcuucguccaacuauagaacuguaaagacgggguguauaguuaugggccacagcuuccauucuguuugaauucugaacacugaagaagagauuuacaagcagaaacugcugucucuaccaggaagcugugagccagaaacugugauaggcacauguaugauuucuuuuccugcauacauuuacacucagaaguaaguauguauuaucauucccauauuuauaaauuagaaagcaugcacuccaagagguuuaguaacuuuuccaaggccaaauacguagcaaagcuagcagucuaggggagguaguuuaacucccaaacccaccaaaucagaauguucuguaccauagacuacuauauuagacacacauucuuccugucaguauaaaauagaaauguuuuuucucaugcaauagagcugguacacuuguuugcacagccgauucaaaaucaaagucaauuguagcaugaucuagugcaaagagucacuagauuuaaaauaaaaagaccuagauuccaacucugacuuuaccauuuccuagcagugugacacuacguaacuaauucacuuugugucuuugagccucauuuucaugucuguacggaaggaaucauaaugucuucccugccugcccauacacacgugaaacaaggaucaaugagaugguauauuuuaaaguguacacuggagagugguauuugauaucauuauugaucaguuuuuaaaaugaauacauaccuuuaaaaugaauacauacauuuucuucacuaaaaacuauacgcauugucuaguugugaaaaacuagaauccuaauggcaaggaugaacaaagguugguugguuuuuaaugguuuaaaguugcgaauucuaugcuauaguuggggcuuugaacucaguuagaugcccccagugaacaguugauucaaguguuugugauucuucagucuuaaaaucuuauacuacuuuaguugacagaauuuauauaauuuuuuucuguaaccauuuugaggcccuuacacgcauaccaccacacacccacugguuuugaugacaggaagccagaaacaccgguaaaaacucaacaagaaauuaucauccauuugcuuuucccugucucugauuugguacuuagcacugggucauauaccacagggaagaccaaagaaauauaccuucaggaaaagaauuuaauuaagaaacuauaaauaggucaucuuuccagugguaauuguuuaaaacucuuuaacuuaauaccugccagaaaguuccuuaaauucagugaauguuuuucucuucuaaaauaaauuuaaauugccuuucaaaaggcaguaccguauauagcacauguauguuauaauguccuggaauaauuauugaauuuaguuuguucaugaaaaauaacacuauaauuuuaacauuaacacguucuaccaguuuucuggaaacaacacuauuuguauuauuguuuuaaggaaauacauuuuauuggaaacauguauuuagaaacacaguguguuuuuugucgacuaaaauuuuacuuguauaauuuaggcaccccuuuugaacuaaaucaaauuuuacaucauuuguuaaccaacagcaaagccgaauugaagaucguuuagaaagacuggaugaugcuauucauguucuccggaaccaugcagugggcccauccacagcuaugccugguggucauggggacaugcauggaaucauuggaccuucucauaauggagccauggguggucugggcucaggguauggaaccggccuucuuucagccaacagacauucacucaugguaagugaugaaauuuauagacucuauaguuaucauauagaguuagaauuucagauauagauacuauuguugcuguuuuuuaaaaaaucagcuuuauugagauauaauucacuuaacauacgaugagcccauuucagguguacaauucaaguguuuuaguguauuuacaagguugugcaaccaucaccauagucuagguuuugaauauuuuugcccccugcaaaaagaaaagaauccccguugcccauuaagcagucauuccccaucccuccacuuccagcccuuggcaaccacuugucuacuuccuaugucuauagauuuaccuauucuggauauuuugaauauauggaaucauacaacaugugguggucuuuuuugacuggcaucuuuuacuuagcaugacuguugcaguuuuucuacaguuugccacguauuagagcuuuauucauuuuuauugucaaauaguauuucacuguauggacauaccacauuacacaguuggguuguuccaacuccuuggcuaugaugaauaaugcuucuauaaauauucauguuuaaguuuuugugcagacacauguuucccuugaggaugaauugcugggucauuguugguguuugaaauuauucauuuuggugacccuggccaaaguguacaauuugaguucauauuauaauaugacauugcuaguaauucaaauauuaguguuuuuuuuuuaauuaaagaagccaaaauagugucugucaauucugagucugggagauagaaauauaugguauguuuauuuguauaaauacauugcaugugacuguguaauuuaauagaguagcuuuacuacuaccuauuuagaauaagucuuuauuugaauuauauuuaagcagauuuguccauauuacaauugugauuuuuuuccucauuacuuuugaaaggauuuuggagauaauucuuuuugaggaugauuaugaagauucagagacucuucuuaauagaauauuaagugaugacaauuaaugaggugaccagagugguggagaauguaacuugaccagugauucucuguaguucugauccucacaagcucuaccucgucucuaagcaccuuaguguccuauuuugccccuuacaggcucgcuaaaaguugcuuggaugaagguauauuuuccauuaucacuguagcauuucucguuuaagcauggucccaaaaggaaaugcaaaauacauacaaauuauuaugagguucuuuuaaguucuugcucaguaguauucuccuguccaucuuucaguuucucuuaauaaaagucuaagauuaagaguaccauucugaacgguguaguauugaaaucugcaaccaauuugaaaccaaaaauacugguuuauaaauagaagcaacgaacucacaucuaaaauguggaaagauauuuuugaaugccaaagagaaaucuuuuuuucuuucccuugaccucugcccuaaaaauucaucauugaauaaaaauuguuuauauguucauggcaguugcuuagaguuuacaaaagaaaagucuagauuuuaauuuagcuuggccucagguaauguguuaaauacacuugggaugcauauaauaugagauuuucguuuguacagcucuuuuuuuucuaacuacaauguuuaaacauacugcuuuuaauuaagaaaucuggcuuuauuaaaagccagaucugugacuuauaaccauuucuguauaucugcucucaaucaacagaaaaauaguuuaauuucuguagcuguguucauuuugcauauguuaaacggauguaacaugcacccagggcauugcuucagagacuauuuuuuccauaaauauguaaaguuuuucuuaaauaccauauguagguuaagugguucuuuuaaauauuaaacuauacauaaauacuuuuggggacuauuugaccuuugaauugacuccuuuuugagucagauucagaggugggaugggaggaaaagacuagaauuauuuuuggagaugggaaguuggacugaccucaguagaaccgaaagugagacgacugaauagaacgguagaaaaaaggaaauaauuagccaauauuacauagaaaccccuuuaauuugaucuugauauacacacacacacacacacacacaaaagcaauaaagccgccaguuuugcugauaaggauaaguuccuguuuucuccucugaagacauuuaauauucaaucaaggacagccacagagccaagcagaucauagcguaacuccaaagauauggcaugucaucacccugcugcccuuugaaccaaaugggguuuugcagucucucuccuuucuuccugaaaaccauucaacguguccccagaaucugagcuccucagccugaaacacuaaugugugugaaaaggauugguuuggccuaucuuucccgugcaaacugguaugaauuuuaaaacaaaaacauaagaacaaaggaaauaguuuuugaauuuaaucagucugaaguuagccuuugaccauuugauacauuccacaauaaaaaggaaguuuaaggggaaggcaaaaaaaaaaaaaaaaaaaccucaucccccuuccccacaacaacaaaaaaauucaaggaggauacugguaauguuuuccacauuugaauuuuaauacaugaaacaggcuauaaaacuuuggccagcugcaguaaauaaaguagccgugggagguaugcaccggaaacuucagcagagagcacuggugagagucucauucccaacuacacaccuucguuuguuguucugggcggaagcgaguugcaguaacuugauacucaucccagucccgguuuuguauugagcacaucgccuuucuaacucuccucaguaauuccuucugauuaaagaguagacagcucugaauccucucgaccuccguacgcuucucauuuccuuucucccugccuuccaaaaaucaaaacaaaauggcuugauaacuuggaaggugauauaagcauuucuuucugcagcagcuugaaguugugguggggaaaacugugguucugccucggcuguuauguuaucucauuuaauugcuaacauauuguccuuagcuuuugauucauaaaauguuuuccuuggaguucugaaguaggucuucagugauuuacuaaguauuaguauaaugaaagggauuuuuuuuuuucacagcggcauggcucauaacacaagagcgaauguuuguauacuugcaagcucucuggaugauauuauugagcuaugcuuauuuccugcucaaaaaccuucccugccuuuccauuuucuacaagauaaagaccaauuccuuagcucagcauuugaagccuauuaccauuuaccgaaagccuuauguugagcucuuccaaucugcaacaagucuuccagcaagacaaggcugggcauauuaccagaauucacccuguauguucuccuucggaacuuuuguaucucuuugucuuguccagcccuaucugcuuaucucuguacaccuaauacccacccauucucaaagcacugacucaaaucauucuucuuccaggaagccuucccuugcuaccccacucaugcuagccauuuuuuucucuauucuuacagcccuaugaaucauaccauuucuagauauuuaucuuaaccagcuccgcauagcugugcaucuuuuauagauaugacucugccuuaccaacuguuguaaauuccucgagucucacauauuauauuuugucucucuccccccgaccccuguaaauagaucauccauagaaacgggagaaaagaaacgaggaaacuuaacauucugugagugugaguuggcagccccucugcuaggcgcucugcauguguugucuuaggcagucuucacaacagcccagugaggaugauaauaguggucauuucaggugucgguaaagugagccuuagaaguuugagcaguuagucucaaguccugcagcgggauuuaaacucaagcacaucaacuccaaauucaaugcucuuuuuuacuaccaggcauacucuccagagauuaucuaugagaacaccuuuucagaacuuauuuuaaaugcuaggagcuugugauuuucaaaacuugauaaguguugguuggcaaaagaaguuuccagguauuccauggcuggguucccagagcagcucucuucccaaauguauagacagagaacuuucccuccaaagugguggcaugcuuggauuaaaacccacauuaucuaugcacuuauucuuaaaccaacauguuugcgcugagugccuaagaggugugaacucucccuaccaggguccuugagguagcaaauuuuaaguuaucaaguuauuuuucuuacuauaaccacccacuuuucuuccaaaauuaaagcagaaaucucugaaugugggagaauaaggaaauagccaggucuucacuacccuaguuagaaacucuuaccaaguaugauucccucucugccucagagaccuccaugauuaauccugauauuaaaugauuagauuucuuauaaauuauggaaagggcaauuuuccagauagaauucucucuguuacucauucaguauucacauccacagaugaggccugaaaagaagcguuucaaaugaccuaaccgcuuuuuuaacugacuaagaacaaaacccacaucaaacuugucuuuaugugacucuauguguucccguuuauuuguugguagagucagcaacuacgugaucauugagcuaaaaauccccucuacuauucauauaucgcauuaguguagcucucagauccuucuuguuuaaagucuauuuauucauuucaauaacauuuauccgugguuaccaaguguagguucugugcucucaaggaauucacaggcuaguaggaaaagauguguacuuaagcagauugcucccugccagucugcuaugcccucuaaaagaccaggggccugacccuuauccaguagugaaagaucacaugguuguuuaguagaggaguggucaucuccaguugacuuagggaugggggagucaugugcaacucaccccacacaccuguccuccacagcaucccuucagaguccugcaggugggggauguggaacccauuucagaaaucaccaauaaaaguggaucuuugcccaguuuuccucuuuucaguaacaauuuuuguuuuacuuuggauuaaaugcagucuaucaaaagagcauuccuuaggaaaagugguaucuuuuuauuuaacugacauuauauacaugagaacuuuuaccucuuagggcuucauaggacaaacaacuucaguuaguuuuccuuguauaguuaagagcucagaccacugaauuuuagauucuaaaaguacccuggaaaucagcccauugcccuucuuugaagacuaaggccuaggaaggggaagugaccaaaccauggguacucacuaguagaauuagaaaccagacaaaagaggcuggacacgguggcucaccccuguaaucccagcaauuuaggaggccgaggcggguggaucacucgaggucaggaguucgaggccagccuggccaacauggugaaacccugucucuaccaaaaauacaaaaauuagccgggcaugguggugcacaccuguaaucccagcuacucaggaggcugaggcaggagaauugcuugaacucuggaggcacagguugcagugagccaagauugugccacugcacuccagccugggugacagagagacccugccacacacacaaaaaaggaaaccagacaaaacagcaagcagaccagcacuccuugugcuauauccuacacugcucagccgacuuccucuuuacccuaauaccauaaccauuucaaaacugugagugguagaaauuagaaaccauucuguuacucugacuuaacuaaugaaauccaagaaaacucuguaguuggcccuaggcugccugcaaugaguugcuauuuagcucuaccaguaauauuuggcaaaaagagaggguagugggcauugaugugauguggcaguuauugguacauagucaugggagcagcaggagucagaagauucuguuucuaugugggccucuucaacaaagauaugaucaacagaggcaucagcaucuucaguugauaaaguugauaaaauagaaaacuauuuucuaaauagccuguuacagaauuucagcgaagcuauugguggucagcaucaucuuuuaauagcuacuaucuuguuuuucuuuaaauuaggauauuugccuucucuaguguucugucaucucuccuaaucuccacaacuaucagguauuucggagagcagauuaguaaccucaacugaaaguuuugaucuuuaucaauuuaucaguugcuccucuugggcuuucacagguuuugauuccauaaaguucugugucuauuugagugcauacuucauuucuaagcaguuauucccauggacucucagggaauuuaagagauuaucucuacugaaaucucccuacagauuuccugccaagcagucaacaagucuugaucagccuccuuccuucaagggugacuagcuccaaaugcccacaaaguccauuuucaucaaauauuugaaaguucuuccuagguccagcccaaauuugcuuuuuucuacaguccuuauguuucugcccaauagaauugcccacaaaucaaguccaacaagcacuugagaaacucaguuauuugaagacagucugcugaguguuuuuucccucuagacgaaacaucacuaucuucaaauauuuaaccugaaaaaaaguuuggacucccugucaugaacuccauugcuucccagugcauucucccuaguuuagcaaggaugccuuuuucuccacaagaaccuuuuaguguguggaaccgcaaacugaacacagugcuuaagaaaggaucaaguggacuaggguggaucuaucuccucccccauucaguaccuuguaucuucauuaaggccaccuaacaauauccuguuuugcuauguuugaugcuuucauuguccugcugacauauauucaauuuguaaucaacugaaauccauaagccaccuaucuccccagucucauuguguacuuuuuguugugucuguacaaaacuucaugaaaccccauugaauguuauguuguagccucagucugauuccuguuuaaugguuucccugaagcccucauucagucacauacucugccaucucuguugcuggcaaaugugaugggugugacuaaugcccacaucaaagccaccaauacaauauuuucaggggaggggauugaccagaaggccaugaggcucaguguuacagacauucuuucuacacgagugcugucuucuauccuuugaguuuaaucucagcugguucugucucccuccuuauacaccguauggcccaccuuugcucauuuuguccguagcguugucacagaagccgggcaugcagcacucacugugaagcaggaaaugaggcuuguccagaaugccuugcucugguggaaccaaacugaguuugagaggccauuccuguguuucagagcacuuucaaaacuauuuucuaaauacccuguuacagaauuucacccaagcuauugguggucaacaucaucuuucaauagcuacuaucuuguuuuucuuuaaauuaggauauuugccuucucuaguguucugucaucucuccuaaucuccacaacuaucaaguauuucggagagcagauuagcaaccucaaccgaaaguuuugaacuuuaucaauaucauacuuuauuuuuuuaaaacugaaaaaaaaaaggacagaaagguaaaagaacuugaagaaauucuuuuagccauggaugagugauaacagcugagaauccuugagcuuaccauuugauauuucuauauuaauuuaaagaaaagucaaaagauuuugaaaacagcaauagaaguaagauccuuuaagcucuauucagcagccccuaagaaaagugaugaggacacugugcaugcccauaugugaacaugguuggccaccuuagguauuuccccuucucuccacaugaauacauauuuuacucaaauucagacucuaugauguugaaacagucuggcauuggauguuuaccucaaaacccugcucucucugcaccuaggacaaacaaauccuaguucucugguguuuagcaucuuggagccaugaauuuuaaauaaaucaaagacaaaaaccuugucuuucccaguuuuaaaauauaaaagauacacacacacacacacacacacacacacacguguauuuaaaauagacccuauaaccucaucauauucuuacauccuuacaugguuuucuucuuaaauuguggaggaaaaggcaggcagacacauuuaauagcacagugaucaucauuuuuuaaaugaacuguuacagggacauaaucuuaaacuauccauaauuuggaauaggcacaacugugcauuuaaaaaaaugcaauauuacccuuauuuucucaggaaagcagauuuucuggagggaaaaguauauauuguauauauuagaaaauauacauauguucauucacucuuucugcaucugcugugcuucagaugcuuuuggggaugcauaaacguguaaaagaaaguaucugaucuuacaggccuuuuauccugguagagugauaauacaaauaugggucuaacuauaaugcaagguagaauuaugaaaugaccuaaggagcaauucagaccgcuaggaaaagcuucccggagaagaugccauugagcucauauucgaguccacauagaauuucaacaauuagagacaggauagaaaaggcguuucagagccauauaauaaacaugauuuaaaaccaaaaacagaaaauaaaggcucaugcaccuaaauggaaguaagaaaacugccugaugauaccaguccuugcagcuugccagccagggcugcauugggugaaaagccccuccacagcacggcagcuccagcaguuggcucgaauauuucacaugagaguccacaggaagagcgagcuuucauguauauuuuuuacauccaaauuaaguuaacucauggaauuuuccacccuuaggaauuaaaguagcaacucaugaaguaauucaguuaugucauucauaccaaaacagaaaauacuggagcaacuuggcacuguuuaaaagccaagauuaggccuuggccauuuuauauuuuuucacauuccauggccguuguguuauuuuaacuuuuauuauggcuguaaauuuuucaaaucaaaaguaucuuaauugcuuagaaaacagaaguugaaaauggguucauaguaagaagaggguuuaggcaaagcagcuuuaggagugagaacugaaaaaaagcuguagcauuacauuuucuguaaugcgaggguucuaccuauuugguugacauucacaguugugcauaauuauagcuuccucuauauccauaaaucaucuuagaacuauaaaguugaguuuaaccaaaagaucuguccaauauuagugaaaugacaucuuuagggaagcauuguccugauacaauagccacauucauuuuaaagcaguuaauuggacacauugucaaaaaccacgguauugaguuuccacauuuuaauuucacauuugccuucucccuggcuucugcacacggacgggucucuuuuggagcugaaagugugugaaaguuauuggagaaugguagucucuggguaauguuucuguaagcugcccaaaauuuucccccuguagucuagaugggaaacagcugguauuuguuuaaaaagcuguuuugcaaaaugucuaaaccuugagauauagaacugaggucaccauuaaagcaggugcuuaagagcaagugagaaagacuucagaggccgacuggcucuggaaucuucugcagggcacuuccuauuagaagaaaaaguguugaaguuugcuccuuuauuuaggacacggcuauaaguauuaauaaguaagugcacuagcaauacuacuagaaauugaguauuuuugaacauagccagcccucaagugaauaauuagcucaguaugaaaggaacuaaaauggucauuuuucucacagggcuucaagauacaagagcccaaggcgcucuagucuccuuuggguguuugaauuuccucuuuaaacacaccaacaguaaaagaacuacuauuucaaauaagcaguaccauaacugacuauaucuuccaagguuuuggaugcaaucuaagggaaagggggaaaagagacccgacuuggcaagacccguaccgaagcagucuggaaaaaaagcaaagcaaaaaacauguggaaccacuaaaggccagugcacgucagguauccaccagucugaagaugaaaggaaguaagccuccuccccugggagcuggagguuauuagcagcuguuuauccagucgggaauagagauuaacauuguacuuuuuuuuuaagaacuagaagaaaauuuguuugggaaguuggcuuuucauaucaagucacugugcuuugccaaaaaaaacuuccuuucucagaacucauguacuagcauugagcaauguuaugauucucugagaaacucugaauuaccaaaaagucuuucuccauuaaauagaacagaaaaggacagagaaaugggugaacguuugccauugacacauugcaguuguacucuuuaccaugugaaauuugccguuuggucuauuaccuguucuccaaccugacucuaaaugggacacucugcccucuaccccucacacguacccucacaacuuaaucauugccacucuaaggugcacacaauggguucugcagauaccuacugcuugcaaaaagaccuuucaugagauauuggggaaacugccuaguacucugggugcuuuauucucaaaaaacaaacaaacaaacaaacaaaaaacgaguuggauauagguauuuuuccccugauuuaaugcuacucuuaaugucauuuucuuuuauuaaauccuuucuucugcuuuugaucuuauuuauagcagagccacuggucauauggaaacuauuacuguauagcugcgagaugaaagacuucauggcaauuaaauaagagugaaucauuugggccaauaauacacacauacagugagguaccauuuguguccaaaaugcccuguguuguucacuuuguagcaaagccauugagcuuuacaaagggcuuuacaaaaaucugcuuuuugucagaaauauguagucugacaauaugaaaacacauguuaacacacaguccuuagcugcuugcuucuucacacauacacaguaucuaaaucaugccacuuauugauauaaaaugaaauuuucacuuaaauuugggauauuauuuaguuguguuaagcgucagcucuuuaaaaauauauuuggauaaucuauaucaaaauucgacccaucacucaaaaccugccuaaaaugucauguucuucuuaaaguagucccugguuuccuaaacggguaugacuucaucauuuuuuaaaacccuacaugaccuuguacuccuuuaugacauucaucguauuuugccuuguauaguaauauuaucccaucauuaaaauaucagugccugggcuaggcgcggugguucaggccuguaaucccagcacuuugggaagccaaggcgggaggaucacaaguucaggaguucgagaccagccuagccaacauggugaaaccccgucucuacuaaaaauacaaaaauuagcugggcguaaaggugcacgccuguaaucccagcuacuggggaggcugaggcaggagaaucgcuugaacccgggaggcggagguugcagugagccaagaucaugccacugcacuccuuucugggcaacaaagcaacacuccaucuuaaaaaaaaaaaaaaaaaucagugccugcaaagucauagacguguuuauuuuuccuugcaaaugcccauguagugccuugcauauaguacacuuucauaaggcgcuugucaaauuaagugaaauguuuauuugauagaaacaugcuaaauguauauuuggcaauaucaaacaauuaaauuucagacauagucucacagauccauagcauuugugucaucauuugcuaagcaucuaacugcacauuguacuauuacacucccgugcagugaccugugcaguuccuguccuugggaugggaugcccacaaauggagacaaguauaggcuuuacgaauggcagcaaaacaaacuuauugaaguuuaugcccugcaccauucaacaaugaccuugaauguguuuuaaggguggugucuguaaugcauagugagcucgugaggugacaagaaaguggagauuucuggagauccacucagcccugaagggucagagagugaggggaucugugaggcuaauaaaagagaagcaguuggugaguuaggaggaaaaaacuagcccagcagacagagcagggagggcuuugcucaagccuuagugaugugggcguuaacccagcagaugagaggccaugcguagguaauugaacauugauagugaggaauuuaaaaauaggagggaacugcauugguccugggagucuaggugaaggaugcaucagcacaagguggaccucuuagacuggauccauacagcaagcaagagccaggcugaagccuuaauauugcaucaacugauggagagagaauauugcauuuaaaagaugaguauuuggaaagugauggggaagaaaugguucauucguuuaggugagcuucuuuauacuucuacucucuuuucaaauauauuacaguaagcauguguuacuugaauaacaagaaaagcauuuaagaaauaaaggccaauggguaaugguaaaucccuagggauccuuagggaugggccaccuggacuggcuaaaaacuguguggaggucagcagcaugacugugcacucucacagguaugcuugcacuucaggcauucagaauuccaaguguaaaucaaguguccaguugucuuuuccuuuaaacaaaagcuguuuacacauaauugcuagacuucaccauauucucugugcuagauauguuugguucacuaggauggauuaacuuuaguuccauaccaucuacuuacuagccugcuauguggagcaaggaagagauagaggaaugggcucuguuaaucugccaguguccccgcuaggugagcucucuccaguuaugguuuccacuguauaggaaaaugaugucgagaauugagggugugggacacagaagagagaaaugaaacaguuuuaauagauggaacguaugaguuaguacaagaaagaugaacugaggucggcucacauccguuugcauuucuugaacuauaucauagaaucauucauuuaaccauuuuggugaacauccaggggaguuucagcccagcugaucauaugauagacaagcacugccaaggucaggaucauuuagaucauguuuaaauccucuugaaaauuacuuuauuaucuggagaaucaauauuaaauaaaucuccaagaauugcacaauaaggaauuaccuuacauuucauacagaacauaagagaagcugugauguuucuggaaaacaauguagguguucucaagacaguuaugaaaucuucucccgacauacauguuaagaaucaaguaaaaauccaaacaaaagaauugaauccagaucugauguuaaugaaaagucucuuaaagguuuaaucacauguacuaaagaaaaaucaucugauaauuuuuuaaacugagaaauauggaaauuauguuugugguuggagugucccagauguuagcucuuucucccacaacaggugguuauuagagguaggucuuguuuucugcagagccucugugccucuaguguuguuccucacaguaucuaucuacugcugccauuccaugaacuuccuaauucccaucugugagccauuaaaaaaguuugcaugaccgcuucccaccucuuuaaaagaugcacuuuuguacuaaaugguguuuugcacauuugagaaaauaaguuugcuuuccucuaauaugacagaggucuggcaagauaauugaaacugaaaucuaguacucuacaacugucauguauaauugauauuucauggggagauuacaguucagacaccaaaacuguuuucuguaucaauggguuucuaauuacagugaaaacccaucagcuuuucuuuuguguuaauggaaaaacaacagagaaaaguaacaguaaguugcaguuaccaggacuucugucuuugucccauuuuguuguuguucuucuuucuaaaaaccaaaaaaaucuauguccaaaauuggaaaccagaugccauuaauagcaaacuuuaauuuugauguaccaaaauguuuauaauaguauauccaguuuugugucauuaucacuuggucuagaaacugaugacaaguuuccuaaaguucccauuguauacucuuuuagaaggauuaugguagaauagaagugacugaggucugaaagccuguuuugaagcaguuaucucuggagauaacauuaacuaggauugaauaacugccaaaugaaauuuaauacauuuucccauccaugaaauaggccucuuaaauacaacagaauaauuacuuucacaauacucccuggaaacaaagagagcaaaaauauugaaugucuuuuuuguuugugguguuuguuguuagcuagaggauaaggacaaggauauuuaccacaaugcugaaugcaucuccauauaaaaacagccuugccaacagccaccuaauuugaaucugcaugucuuuuaaaucuguuuauguuggagggaucguggcaaauauuaaauuuuauaauuuaguuagacaucuuggccuuggccugaguuaaugaacuaugauuuucccccugcaauaaagaaaaaggaaaugauuuuccucuaucuauauauguacguauauauauguauguuauaugcuuguaccuagguguguguauacauguauggacacacacacacacuguuuuaaaacaaaagcucugggaaauaaacgcaucuugcccccuaacucuccuccccucuccuauauaauuguucaguguuguaaguuuucugaguucaaaaucuguuuuagaucuccaacuaagcaucgaaaguuggaucuuaagucacuucaccauucuuggccuuagcuuucuuuguaaaaugaagaguuugaccuaacugauauauaaccaagguccuccaagcccucgacgucuaaguucugugauuuaaaaguguuucuaucaguuugucaagcccuuucuuggaaacuaagguuauuuaaaauuauauggugcuuacgugauucaaaauaauuauugcauaucuaaugacauuuaauuauuuccauugacaaauucacacaggagaauucaaauagcuguguuggaauuugaauauaauuugaccuaagauacaauguaacucagacauuuacaccuacauguaccagucaauauguggacgggacaggccaagccgccuguguuuggacuacaugaucuuauccccccuuccucguuuguagcucucuggaccgggaaaaugccugucauuaagguggcccauucauaguaugaccuaugucugcuucaaaaugagcugggccauccagugaucuuggcauucugagcuuagaaauacaaagacaaagaggaaauuagcaggagguacagaaccagaaagaaugcaccaagagguaucaugaagaaagaguccaaucugucaucaugagagggcagaagccagagagaagcagagguccccccagagagaggagagaggcugaauagcccagcagaggcgaggaguggcauucgguucccaagagcucucugaguccaaaaccuaagcuacagaaaacuauuuaugauaaaucuuuuauuugaacaaacucaaauagguuucucuuccuuacuauuaaaacuaccccacuaaauugaucagcauacaaaaauccccccaagaaucauuaugaguuccacaaaaaccaggaccacaucugaguuauuucucauucuauccccagugucucccaaagugacaggcaugagcuagauuagaaaauguuuguuaaauuaguaaaugcauucucugaucaaucaaugaauaaucauugaauaauuuuuaaauuucacuucuaucuucuauuuuuagcauagauaucacuaaaacugcauuauacgugacuaugggaagauucacauuuacaaugaguauuaauaaaauuuucauaagcuggcuuuuaacuuuagacuauuguuaucucuaugaaaagguuaucaaaauagagcuuuaacgaaguauggauuuucuaaaaauagggacgaaaugucaugcuuagaauugacuugugggaaucuccuuucuccuagucacauuaugacguauuuaaguucagaaugccaagaucauuggaugccccagcucauuuugaagcagacaugggucauucuaugaaugggccgccuuaaugccagugggcaaaucccugacccuuguauauacagagaacagugugaguuucuccaucuauuucuguguuauucuagcgauggauuugugccgacaguccacuguguuucuucccuugucucuuaugugaccagaaauaauguuucugaaagagaagaaaacaggguuagaauaugccaucuguggccaaggaaacaagcaaagccaagccaauuauucaaauuggaauacucuuccacagccacaggcaauggaguugauccuauccuggagaaucaagcucauuauuacauggcucuggaccuaucagagggcauucacaugaccuggaauagacacaaggggagucuuaaaacaucacgacaaauuagccggcgugguggugggcgccuguaauuccaguuacuugggaggcugaaacaggagaauugcuugaaccugggaggcagagguugcagugaacggagauugcaccccugcacuccagccugggugacagagcaagacucugucuccaaaaaaaaaaaaaaaaaaagucagaacaacuuugucucuaacauucuuuauggaaaaugauugauauuauuuaagaugaucuauagaaaauagauggaguuagguaacauaugggccuaaaauccaaacaaaaauguaguuggaacaacuauauccucagauauauuuauaauauuuaagaguuuacagucauuguauaggggaaagauuuaaaauuaaauggauuuuaacaaaauagagacaaagaucaccguaacugaagauagcuugaguuuugaggggguucuugaacuacacaggcuauuauuucuauauaacaugcaaguauuuucagucaaaacacaugauucugucugcaguuauuauguaccuauuacauaccaguugucauguacgauugcauggguucucuuuuucucuuuugagaacuuaccucaaugugaucuagagggaaaaaauuucaggagcaguaacugaauauauuuuaaguaaaaagcaaaacauuacucuuaaguuaugucacagaugcuugcaaagaaaucuugagaguguuaaugauucugaaauaggaguacacuucuccucuaugcucaaaucugugguuaccuucagugauuuugacuuagagucauccuuuguagaaauucaagaaauuagauccauugggaauacaaauaaauaugaaucagcacgaagaauuauuuagguuuauauugauugacagacauaaagagccaccauuugaucaaggccuguaaaaauucaugcuuacaaguugacaucuuagauugaaaggauaaucauugauugaauccguuuucuaaugcaugaauauaaaaauagcaaaucaaaaccucaauggaaaauagcuaucaugcuucugaauaaaaauuaaaauauauaagagagugaguuacaaaugguugcuggagcaggugggcguggucugccuauaagagagcagacuucagucacagaggaaaggagugguguggcaggcaacaggguugaauauguuuaaaaaaaaaaaaagguuuguacuuaacgccacagagcucuagaagcugaaacuagaaucagugagugaaaucuacaaagaggccaauuugugguaaaaauggaaugggcuucuuugggagauaucagucucaguacauuugaagcaccccacagaggccaaauaaccaccauucagaaaguucuguguugcgacacaggcaccggggagcagugcuggacuuccuacaucucucugcugaaacauucauuuauacuuccugaggcucauaagccucaaguguugucuuauucuugcuguauuuugaauccaaacaauuaauaugauuuaugugaucaucuccacccaaaauuuaaaaaaaaguuggagugcauacacacacacacacacacacacacaugcacacaugaauauaaaaauggcauacuucaggaucaauuacuuaaauauauuuucaguaaaaagcaaaauauuauaggugauacuuaauacauggcugccuuuaaauagcaugugcuuauuagguccugugaauuuguuguugguucagauacuuauuguugaugcauucuuuggaaauacccuuuuaaaauauauugguaacacaagagugaugauucuccuuucugguuucauauuuuugacuggaaaaaaaaauaaaccugauucauagcaguauaaauguaugguuaauuuuuuguguuuuagacccaccguccuguguaaaugcucacuuaaccauaggcuaagaaaauacuuggaaauagaaaagaaaaugugaacuacugauuguccucuuaguugacaaaugcuucauguuuucgcuugaaggcaugugcuaugaaguaggcaguugcugucucagugccacaaguucaaugucucuggaccccagagucgauaguaguaguuaauaaaaagcucagcaguauuuuuuuaaugaaguaaucaugcuguacucuauaauuuuauucuuggaagcauaaagaguauuuacaauauggugucuuucuagggucagaauagugaggaaaaaaauggaaaaauguccaaacauccuuccuugcauggcaaugauggcauuacugguguguuuaauaaaaccuuuauugguacauuuuccggugugguggcauuggcagaaaccaucccccuuuggauuuggaacucagcagcugaugaaauacaguaaacauuaauuuggaaugggcugccaguuuuggaaagccaggugacauuuuauuauauuuguaccaagcagaggcugugucccauacugcuguagcuuccgcugucagaggcuuagcuggcauuauggaaaaaaaaaaauggcaggccugagaaucuuauccccugaaaugaaagucgaaugccaaauugaaauuccuguaggauuuccgauagcaaugggggaauugagaagcucacaauuaagcauaugggcauuaagauaauugucagaucuguuggcggacaugauagaagacagauggguacgaaucagugcgcuccacugcagcacccugggaggcaauuugacguuuuaccugccugagcuacucugccauauuugucacugaauguacagcacggcaucuuacugaguguuaaguguuuucgccgggaacuauaggugcaugugcgguccuucagcgcccucuagugaaacgcguuugggaguaugguuuuugaaaagccagccuucaucagguccucuuggccucuggaaauagcugucgcaccuccgguuccugcucaccucucugguuccucucgcccuuucagguggggacccaucgugaagauggcguggcccugagaggcagccauucucuucugccaaaccagguuccgguuccacagcuuccuguccagucugcgacuuccccugaccugaacccaccccaggacccuuacagagguagguuggccucaccagggcacuucugaccucacuuucacaauaggaccaguguugauacccagccucuugguguucaucccucaagaagcacuggcagaaacccaggaaucaaauugggcacaaaaaugguaaggaaauggcaaaguauuuagaacuucgcccgcuaauuguguuucuccagggacuguuuuccucaaacauccucugaaauccugguccuauaucagcagggaaugaggccacagacugaugagaggaaauuuuauuuuagcuauuuccacauuuuucucauucagguccucuaaugugguuaguuguggccugaaaaugauauuuccaaaugaauaggaaggaaggaaauuguuuuuguuguuuaagauggaaggaaauauaggugcauuuaaaaaauggagcuugguugcaugauuuucgcucuugagucaucuagcccucuaaugauugccucauaccggugauuacgagcggcuuuucaugaccccaggaaguugggcuauugcuggccagcugacuaggagucgcuuagauaacaucuucucagucccuucacauuuaauauaaaaaugauaacauugccacaggaauacaugugggcauuuuuucagcuguucaacauuguacagaucugagugucaauuauauguauggguaugucugcccauuuuuuaugaauaauaaucauuuuauggacuuuuuuuuuuuuuuuuuuugacagagccucacucugucgcccaggcuggaguacaguggugcgaucucagcucacugcaaccuccaccucccagguucaagcgauucuccugccucagccucccaggggguagcuaggauuacagacaugcaucaccaugccuggcuauuuuucguauuuuuaguagagacaggguuucaccacauuagccaggcuggucuugaauuccugaccucaagugaugcacccgccucagccucccgaagugcugggauuacaggugugaaccaccacaacuggccaggaccuuucuuaucaggaggcuuuggauuuugcccucuuuguccuaaaccugugcuucucaaacugcacauaagcacaaccugagcaucuuguuaaaaugcagauuccacuucuguaggucugggauuguccauuucuaaugggcucacagaugaugaggccgcauggaccaaaguuugaguggcaagguucuagaauacacagauuacaaauaaagaggaauacuugacagauaugcuucuaccuuuaaaaaaauuacuacauuagggucguguuuuaaaaugcagugugacuuggaaaguugagcaaugauaaagcuagaaauuucuaaaaugaguagcaaacugccuuccauauguaccauuuuaaaaugcugauuacuucuugagaauaagagaagccuaauuucagaauaucauuaggguaccuauugaagucuugacugcacauauuuagcauacucccugggaauuauauuuuaaggacauuuuucuauuaaaucauugcauauggaagaaacucaauauaauagcugauauuuacuuggguucuuaaucagaacauuggcugugugauuuucaugauuaugauuuucauugcaauuaaguugauguuuuguagacagugaaauuaccaucuacuccaaaagauugcaaaauagaauuuaaccuuagagccaaugcagggaaaacuuguuucugcaggugcauuuuuugaaacuucaacagauagcagggggaaaaaaaagugacagaaggaucacaguucagcaguaugaauugucugcuggcagccuugcaaucuggugugcaggcagugagauugugguguacaugucaccugauuucucuuuuucggcaggcaugccaccaggacuacaggggcagagugucuccucuggcagcucugagaucaaauccgaugacgagggugaugagaaccugcaagacacgaaaucuucggaggacaagaaauuagaugacgacaagaaggauaucaaaucaauuacuaggucaagaucuagguaacaguauauaauacugucgcuucauuuaauuccuuuauuggacuuugaugaagugaacagaacgggaagaaacuauucaguuuuuuccuggcagguaaauuuacagcugaaaagaaaauuaaaggccuacucuagaaguacuaaaaguaucguuucagauaccuguacucuauuggagccuaaacuguuuuggcauuuaugaaucuggacccaaugcuaaugacacacagugaaaaaauuugucucugauucaaguacaguuuauuuguaaaacuauacuuauucuacaaauuuggucagaaauguugugucuauaauauuucuaaaaagagauuguagccauguuaaaaacucaacugauguaugugccaacuauaacucuuuucuuaccucuaaaguaagaaaauaauuuccuagauuuauccuaaacaugcugauguauauaagaguaauaccuuaauuguuuaugguuuuucuuccuggacacucuuuucuacagaaaacacaacugcaggaaaauagcuucugucugguuuucuuaaauaucugcuaucuuuaaauucaaaucuauaucuccuugaacuuuaaucugguaaucagaugguuuuugaauaccaacacccguguacuuugccucaauucccugagguuguuuuuauucacaaauucaaccaauuguccuaagacuacagcuuuccuucuaaaggcugugguucucaagguucuaucuggaaucuuuugugaauuaagaacaugcugccucuuuauguugcuguuguaauuauugagauaaauuccgugucuugccacaaguuuaaaaaugccgaauacuucuagauaaccccuuuccuuccuuguugucuuuuucugauucuuggccacuuuggcaagaaaucccaaggaggggauuucauaccuuuagcagcuucuguguuagaccagucaguucuugguaauuuaacuuauuguggccaaacuuaugcauguuaauggauucuuugaaguuuuggaacaacauuuucauucgcuguugagaaccuucuuauuuaaaaaggucacucuuaugacauuuacuuauguaugccuccaaaacuguauuauaaggcagugcuuuuucaaaucuaggcaguuuuauuugcauaacuaguuuauuuguaagugaauaaccaauucuaauuggucguuagccugaaaaucuuuggaagaaaaguuccuauuuuccagucuccuuuguguaagguguagcauuuguuggauguauaaaaauaucacccaaaugcucagcuuccggacaggccuggcagagacuguuuucauuugcuuuuuacagccuauuugcauaguagaauauaggagugaauuaaucauuacugauuuccuuggcacuggcagcaguugggggugagggcagaggagggauccgcagaaggcagagaaagagggccuuuuccaguggacucaguugacuuccauguuuaccauacacaccuguggcagacagugccaucuggaaaggcgcuuacgcuauggagagagaggagccuggucuuacagcauccuucuguggugucauccuccuugccccuaacuuuucuccuucacccaaguguucuugacuuacgugcauuaucuuuauguguaacguauacuugcaaccgaagaauaccacucccacuuuugauugauuggagcuucucaaguguaauugguccuuauugccacuuggaaguuacccagagauucuccaaaauggaacaucagagucauauauuuuaaaccagcauucauuaaauauacauuuaauugaguagauaauuucccacaucuuccaacuccgaaauguugugauuaaucaucuuuauucugugaacauuuccaaugugugaaauuacccuuuagguuaauuguuagucacuuccauggaguuucuugugauggggagucuacugauguucagugaaguuuguuucauuuucugugucucucauaagccccccaaaaguccucacucauguuuauucacaauagucauucagagcuuuauagcacgugcugcucugccuucuugagacaagacgucgugcacacuucucuuuuuuacaugacagcccuuggaauauuugaacccugcugcugugacgacuuccucauaugauaugcuuuccagguggcucaucauccucuuugccuuccauucaaaaguuucuaauuugucacuguaacacucagaaauggacagaaccgaucuuaucuuuucagacuauucugggcccggccaugcauuuguuaugaaucauggaauauuuugguuuucacaauuagaaauuaccuuuuggcuuuuuuuuuuuuuuuuuuuuguaagagacagagucuggcuguguugcccaggcuggagugcaguggccugaucacaucucacuguagccuccaccuccuagauucaagugagccucccaccucagccuccugaguagcugagaccgcaggugugcaucacugugcccagcuaauuuuuuuuuauuuuuuguagagacgaggucucacuauaucguccaggcugggguuauaggcaugagccacugcacccagcuuucuggcuucauuuuugacucacaaugaggucauggucauucauaagcugcagguguuugguuuguugaaucguuuugcaugacugauaucaguucagguuucccaaacuuguucuguggaucauaaacaucuauaagauuaaagaccauggaagucauguuuuuguaacuuuuuguuuaauacauagagaaaaugagacucacauaguggguugaccaggccuucaaagcaagguaauggggacaccugaauaaaagccucacugucuucacucccauugcucuggugucuuacauauaggccuuucuucuuacuccuguuaagcugccuuguauuuuuuugaccuaucaaaaucauuuuucaauuacuuguuuccccuagauuucagaugucacgguaugaaagguuuuauauauauuuaaaaaauaaaguauaaacauaaagucuuuuugaagcgugguuaugcaacauaugcuaggcguaaguuggugaaugccugcuuugcagaguguaaccccauugaauaaaaaaagcuuuguuuucccuuucugccccccuguaucaguaugggcacacccugcacucuaacuuuaaucuacgucacccucaccuguuugguuuggguuuaaugucugcgagaaaaccaaauaucuuguguauugugaacugucaaagccaucuaaaccaaucccaaggucaaguggauauaaaaauucugccaaaaacauggcauaagauggaaaaguucccugaaaacucuggaagaaaacaaaguaauguagacaccuucuuuuuccccacaccauuagaaaauguugcaucccuuuugucccacagcaauaaugacgaugaggaccugacaccagagcagaaggcagagcgugagaaggagcggaggauggccaacaaugcccgagagcgucugcggguccgugacaucaacgaggcuuucaaagagcucggccgcauggugcagcuccaccucaagagugacaagccccagaccaagcuccugauccuccaccaggcgguggccgucauccucagucuggagcagcaaguccgaggucagugcaggccagccuccuugcagagcucgugaggagcuuguggcaggcacaagcugagaugggcacgccagucuugagcaguggcagacaguagacuuucaagcaucauuccaaagaauuguuuccauugcagacugugucuaaauccauaaggcagcaucccuuucuccuguaauuaaguugugggauucucuuauaacuaagauuauauugcaacuuucccuauauccuuucaguaauuugagcuuaguuuauuugcuuuaccaaccuuugcuuacuguaaaguggcuguacacacucacaugcaguucaccuuuuacuagugacugaccaaauggauugccacaguacuuaguaacuguuccuuuuguucuguaauauaaacacugagaaaaaggucagacacgcaagaagagugcauugcugcccucugccagaagccucagcauuaaacaaagguucugugcuuuaauccuccacagaaaggaaucugaauccgaaagcugcgugucugaaaagaagggaggaagagaagguguccucagagccucccccucucuccuuggccggcccacacccuggaaugggagacgcaucgaaucacaugggacagauguaaaagggcaaguuuguuuucagccauuucugagaucgaucauucaaaacucucaucaguguaucagccauaaaagugaauuucacccaaauugacagauauuuucuuucauggaaaaagaauuuuuuuuaaaaaaagcauacuuuuucuguuacaaauauauuaaugaauuuuuucucucuuuuuuccuuucucagguccaaguugccacauugcuucauuaaaacaagagaccacuuccuuaacagcuguauuaucuuaaacccacauaaacacuucuccuuaacccccauuuuuguaauauaagacaagucugaguaguuaugaaucgcagacgcaagagguuucagcauucccaauuaucaaaaaacagaaaaacaaaaaaaagaaagaaaaaagugcaacuugagggacgacuuucuuuaacauaucauucagaaugugcaaagcaguauguacaggcugagacacagcccagagacugaacggcaaucuuuccacacuguggaacaaugcauuugugccuaaacuucuuuuggaaaaaaaaaauauaauuaauuuguaagucugaaaaaaaaauauuuaauuuaaaaaaaauuguaaacuugcaauaaugaaaaaguguacuucugaagaaaacuacaugaacguuuuuguugguauucaagucagcuaguguuuauaauuacuggauauugaauuaggggaagcucggcugcccuaguaacaaaaccagcaaacguccugaugacaacgaagugaugacauuagccauuccuuaggguaggaggaacagauggaucuuauagaccuaugacaaauauauauauaaauauauauauaaauauauauuaaaaauuuagugacuaugguaagcuuuuguucauuuguuucagacuuuuuucuccuguaaaaaaauaguacugauuaacuuuuuuaaaagaaagauuuuacuguaaauauggauuuuuuuuuuuuuggucuuauuucugucccuuucccugguuuguuaucguaaccuguagugccaacucugcuuccagagggguagugcaggaugaaaugcugacccugauguugcuucucauucauaaauaaguagaaaguuguuucuccagucuuuugggaacacaggacuuaaaagucacaucauguguagauauuacaagcagcauuaccaagacauggcaaaaagaguuugucugaauuguaauguugcguuugugaaccuauucugggauuuucagagguacaagguuagaaugcuacaauguuaccacugugccuuccaauguuuauaucaucggaaacauaacauaaucaaaguggcugugauuuaacaaaaugauuaaaguguuaccuaccuguguagccgaaguagugugcagugaggcguuucugaauacauggucagauuuuuggaaaaaaacaaaaacaaaaaaaacaaguaaaguucaaaaaccgucaaaugagaaaauugcaaguagugugacagagcugauugauuuuguugcuuucuugauuuuuuuuuucaaaauggguuuacuaaaauguagaugacuuaacugccuccuccuucgucugaaaaaugccaauauucaaucaucaugcagcauuauaacaagccuuauaaguccuaaagcauuaaguugcacuuuuuugaggagggguagugcaguauuucucuggccaguaugaaugaaguuuauacuuaccauauuugauagaaacauagaucaagcuauggcacagcgacucaucagauagcuagcuuugacgucugggcacaauugaaccaacuuccaucgugaaucuuuauaaugauugacuuugguguauagugcaguaaacaaauagugcuccuaguuaaguauuugucagcauccuuuugucucuaacuuguuucuauuuuuacagccacacaauucuuggcauguauuaagaaaaaaaaaaaucccuguucaaguaguuuuuccaccuaucagcacugaguaaaugccauaaauccauugaaauggucuaaauguuccaucuguucuccuguuuugccaguuauauaguaaugaaauacauuuguaaauuuuaugcaacaaauggcaaacguaucauuauuuugaaauuguguauguaaaaguuauauuuuuacauguagacucuuguuauuauguguuuuaauacauuguaucaguuuuuguuuuuuuuuaaaaacugugguuuaaaaagaagucucauuuaaaugaaauagcuacaagaaucagaauuuuauguucauuucugaaaauguaagaacaaauaagauaguuaccacguggucaucuuuuacaaacccauaaacauuuugauuagcuguguguguguugaaaaacuguaaauauguucaguagcgauaaaacuaaaauaacuuugauuuguugauaaguuccuaaaauguggagguggauuaaaaccuuaggagaauagcagaaaucaaacuucaugaaaaguuauuuuggggcuuuccugugaaauguaugaacaaagaggcucagagaaggacauggaagacaauaauguauacucucuccuccucccugaauaaugaaaaccauguguauuuguucccuccguauguuaaagauuuccuuuuagugguacauucugcacucauuuuguauagucuaccaaggcggguaucccuaggaacaauauuauauaggaagcagguauacucugaucacauucaggauaaguguacagaagaaaauacgguguuuacucuuuagggaacuggaaacacucccugcauugauguacauuuuaagaauggcacuuuugauacauguuaucauaaaggugcuuaauagagcugaauuaaaguuuuucaaaucuguaaacaaagcaaaaaaguaaauuguagucauuugauuauuuuuuaaauuggugcuuuauauuuuguucucacucagaguaaaagcugcaauuuauuguucaccagcuuugauguauucauuacucaguaaugcaauaccucuauuguugaauucccuuuggaaauaagugaaaauucuaacggccacugaaagcugcucgcuagguuuugcuugguggagaaacauaaucugcaccuauccauauuaauuggguuguauccccauuaaaaaagaaaaaaagggaauguggccuuuuuaguguguuuuuuauuguuguuguuuuguaauuaucaaacccagguaagauauugguauccugcacuggauuuucaaaugaaguucagcagaagacaguuaagauuaaaguacuauacaaaaauuucaaaaggguccauacuacgcuaucuguaugacgacacuuaggcuggggaucucuuucagaaacucggacuuuaaaagcaacuuggagcaguugauccaccuccacauucaaguaauuuaugaauaugcagaauagggaucuguucaucuagaaauuuuuaccauuugucuucuguguagcugcaaggaacacuaauguuuauacaacugucaguccacccaguggugcaacugguucugauucagucuuccgauuccuuuuuauuuuucacuuuuuccuauuucugaauuuuuuuuuuuauuugugaucuugauuuugaugagggguuggggaguggggagggagucgaaccaagacuuggaguuaagaggauuuucaucuuuugcauccaacaggcagaauaugaucuguguccaaaagugaacuugagucaggaaugaaucaauuucagcauaaacaagcacaaaaauuuagucugcuggcugacuggaagcaaaaaagucaagauggaauaugaugaauuccaacacaauggggcaccaaggccuuuaggccucucuuuuuauuuugcuuugguuuuguuuguuuuucuuuagagacaugcucuuucucaugggacuugaaguggacucaucuuugugcagugcugguuuugccauacucauuucaaguauuauagacauauguaauggugaaaauauaugaacuguggccuuuuucauucuuguuacuugugaugcaauuaagugaagauaagaaaaaaaaaaaaaaagcagagauuuaccauguaucagugccuggcuuuuuguuauaaagcuuuguuugucuagugcucuuuugcuauaaaauagacuguaguacacccuaguaggaaaaaaaaaaaacuaaauuuaaaaauaaaaaauauauuuggcuuauuuuucgcaggagcaauccuuuuauaccaugaauauuacaaaaaaauugucagauucugaauauuucuucuuuguagauuuuuggaaucauuaugaguaaaaguuuguuacuuuauuuuacuauuuaaaagauguuauuuuaccauguguuaccaagaugaaacuguauggguagcuuuuuuguuuguuuuuuguuuuguuuuuguuuuuguuuuuguuuuuaguuguaggucgcagcggggaaauuuuuugcgacuguacacauagcugcagcauuaaaaacuuaaaaaaauuguuaaaaaaaaaaaaagggaaaacauuucaaaaaaaaaaaaaaagauaaacaguuacaccuuguuuucaauguguggcugagugccucgauuuuuucauguuuuugguguauuucugauuuguagaaguguccaaacagguugugugcuggaguuccuucaagacaaaaacaaacccagcuuggucaaggccauuaccuguuucccaucuguaguuauucgaugaagucauguacaugaccguucuguagcaauaaaugugccauuuuuauaaacuguuucugacacuuguuucauuucauuuugcauuguccauauagcuaugauucucuucuguaaguaaaacgcaucuauauuucauuuuccaaguguuggagguauugacagcuuaacaaacaaaacauacaaaaaaaaucacaaaaacaaauugaaaagcaaagcacaugauugaucaaggaagagaugcccuuaaugaaaauggaacgggaugcaugcaaaacaaaaagaaaacugucuagaggauuaacuaauugaaggaauauaauuaauguguguguaacacugaagcuaugcauuugaagagcucugaacugcaccaguguuuucgguugugcugcagguugcuaagucaagucagccuuaaccuuuugcaccaguuggucggcuguuuggcagaacauucucagaucuuuucagucaaaaaucuaagaugauuuauuuuguaucacuuuguuaaaagcugaauauuguuaacuacaguuaauauuaacacuguauuuauacuuucucaaacuacauccgccccaccacuucugguugccucuguugacuauuaauccagauguaaacaaccagauguuuuuuucuaacuuguacaaacugacgugugucaacuaucauggaaggaaaaaaauguacagauuaaaauuauucaguguuauguacuguaaguuaauauuuuuguagaauggacaucaaucuacuuugcaaaauuuggaggcuauuucaacauugcacuguagaaauguaaaguaauguaugcaauguaaaggaaagcccgcgguagcugagcgcuucauaacagaauguucuaaucaaguacgugguauuuggggaugucuccaauauugcucuuguauucuuucuaauuggguuuagugacuaguugaaggaaaauguuauaacgccauuugguucacaugugaagugcccuccauagccaaauguugggauuuuuuuuuuuuucguuuuugguuggacuguuugcagauauuuaaauuuuaugaaauuuccaaagauuuugguugauaacccccuuuuaccuucuaaaugauuugagauguucuuauguucuuacuguguguuuuaaauauauauaaaagagccacaagcauuu

SEQ ID NO: 6323 - RNA, 181665 nt, Homo sapiens; identical to SEQ ID NO: 6319

SEQ ID NO: 6324 - RNA, 367484 nt, Homo sapiens
cuucucuuuauaagcccgcaguucccggaugugaauggauuacaauguaucuuucagggaaaccuauuauuaucaaugugacuccacgggggaguccauggugaugaugaugaggaggaggaugaugaugaugagacaccucuaaacuuggaacaaguuuaagacuuuaugagagaagaaaaaaaaucaccaacaagaauuguuugaggaaaaauuauaacuauccuguguucauuuuuuuuuuuauaaacaauaagaaaaaguuguuggauuuuuuuuuaaugauuucuuuuuugggggagggaauuuuguugcaguuuuaugguggaaaaugcaaaaaccagagccaggugcauaaucuuguaaucuguggauaucccuggagcaggacugaguaccaguuaaaauacuuuuuggggauacacaugugagauacuaaguacuugcagaagauuuuugucucucuuuuuaaagucucuuuccuuggaauauugugagaauauuuguggccauuuaagguaacguuucaauuugccgucagaguaaacuguuuguaauugaauuuaauuuuuaaaaugucgaucccgauguuuuauuaaaacaaaagggacaaccuauuaaauaauugccaaugggaaaaagugugugcaugcauuuuguguauguacucgcacaucuagcaauaccaggauuuguagaauguguguuuuuuuuuucaaacacacguuaaaauagcuuauguugcauauaccggauaaagcacgcuuguuauuacgaaacgauagaauuaugaagcuuaaauuuuauccuaaaaagugaugugaaaaaguauguuuuaagagcaugcagggccuauaaugguaaauguugaauuaaaaacuuacagugcuggcgaacagggacuuagcgugccuaggaacucaagugcaaaaacaaaacaacauccacccccaaaaauugcccuuuuuuuuuuucgaaguuugcaguuauacuauucugugacuuaaaagggaggggaaagaaaguaugcaauucagauuucgcccccaacgcaaaacuaccgaaacgaaaaucuccccaggaaaauguggcuugauuuauagacgaaaaagaaaaauauuguuccucuuggcaaagucuuuuugcaucacguguauuugcagccuaguauaaacuugcuuugccguguguggaugugugagugagagggaacgagaguaagagaaagaaagaagugaggggauguaaacucgaauaaauuucaaagugccuccgagggaugcaacgggcaaaaacugaacuguucaggcuucagauuguaacugacgaucugaggaaaaaugaggugcucgaugaauuuucguuuguauuuuuuggcgaggcgggggagguguugagauuuuuuuuuuuuccccucggggugggugcgagggggaugcauccuagccugcccgacccggagcaagucgcgucuccccgccggagcccccccacccauuucuuugcugaacuugcaauuccgugcgccucggcguguuucccccuccccccuucccuccguccccuccccuccccggagaagagaguugguguuaagagucagggaucuuggcugugugucugcggaucuguaguggcggcggcggcggcggcggcggggaggcagcaggcgcgggagcgggcgcaggagcaggcggcggcgguggcggcggcgguuagacaugaacgccgccucggcgccggcggugcacggagagccccuucucgcgcgcgggcgguagguaccggcgccugcggggcucggcggggcggaggcgcccggcggcgcgggguucgggcucggcggccccgcacgcggcuccgcgccucccgcgccgcgggcucccggcgcccggcgcucccagaagagacaccccuuccccucccgccgcuucccucccccucgccgccagcccccccgccccuccccuugaugcccccucggagggaccgaggacuuugccaggggccugacuuuaauuuuuauaaccccuuucuuucacaaauuagggugcuggacaauuagaggacccgacccuccacuccgcuccccccaacccugucaccccaccccucccccuuuggacguguuuucacuccagagacgcucaucuuuaauuucuugauagcuacuuugaaaagcggaggggaguggugugugcgagugugugugcgugugcgagugugagugugcgagggggguggggugcaggguggggggaaaguugagaucggaucguucucaguaguuucucuuuucucugugauccauucauuucucgcucuaccuccuguugcauaaaaugaugcgcugaagagcggcuuuuuuuuuuucuuucccugauuugguuuuauaguggauguuaccaguuugaucgucucuuuggaaauacaauaucgcuuuuuuuuuuuuuuuuuuuuuuuuuuuuuuuuuuuuugcuauugcugccuauuccaucuuaaaaaaacaaaaccaaacccaacccaacaacaagucucccaucccuuccuccuuuccaccuuaaucccacccgcccccacguccccacccccaaccccccagucuccaaaaauccgauuguguuuucuccaaggauugggacuggauuuucugauugcgguuauuuccauguuucuagguuugugugauuuugcuaaaaugcaucaccaacagcgaauggcugccuuagggacggacaaagagcugagugauuuacuggauuucagugcgguaagaaagaacgguggaaacuaacaacagcugugaaaaaaacaaaacaaaaacccaaacacuucagcuagaaaccaguaggaaucuaaaggacaguaauaauuuuuaauuggcugaauccuugguaaauaugaaggucuuuuugacaaguuuuuaacuauaauuuuguggugugauggaagauucaggcuuuuuuuuuuuuuugaguuuuauuacuggccuucaauucccuacccacugauuaccccaaauaauggaaucucaccccaguggaaagcaaaaauagacaccccuaaaacuaaaccaccccuaaaacuuggccaugucugaacacugagacuacuaauacuuugcacacuacucuucguuuuauuuauuguuuuuggaaauggaaaauagaaaauaggagacccaguugucucuuuaaaguuuuaagcuaaugaugcuuuggauugguaggaccuguuccuuacaucuuaccuccuaguuacaucuuuuccuaggauucuuaaaacuaguauggauaugcugagcauacauucuuuagaaccuuuuggacuguuuugguaaauuucguagucguaggaucagcacaaagcggaacuugacacacuuguggaguuuuacggcuguacuugguccuucuccaucccuuugcuuccuuuuccuaaaccaagucccagacaugucaggagaaugaauucauuuuuaaugccagaugaguuugguguaagaugcauuuguaaagcaaaauaaaaagaauccacaaaacacacaaauaaaauccaaaccgccuuccaaguggggcucuuucaugcugcugcugcugcugcugcugcugcugcugcugcugcugcugcugcugcugcugcugcugcugcugcugcugcuccuccuccuccuccuccuucuccuccuccuccuccucuucuagaccuucuuuuggagaaauggcuuucggaaguuuugccaggaaacguagcccuaggcaggcagcuuugcagcccccuuucugcuuguugcacuuucuccauucguuccuuugcuuuuugcaggcucugacucagggaaggugugcauuauccacuagauacgucgaagaagagggaaaccaauuagggucgaaauaaaugcuggagagagagggagugaaagagagagugagagugagagagagagagagucuugcuucaaauugcucuccuguuagagacgaaaugagaauuuagugcagguggcacuuuuauuuuuauuuggguucacauaugacaggcaaauccuauacgagauggaaauggacauugccacguuuauggccaagguuuucaauauaaaacaaaacaacuuuuuucuucuccuuggugaaacuaguguuuuucuagagaggcugcuggccuccaaccugaaucuugauaacauuauggggacuguguuuguuccaaauguagcaguaguacugcuuggccaucuaaugaaccugaggaaaaagaaagaacagagugauaaugggggcuggggugggaucuguaauguuguuucucuuuuaguuuuaaguuggauggugauguauuuuacuaaauaaacccuuagcauaaacucuaagcuguuugguaacaguaugaaagaucuuugaggagcucugaaggcacaagugucuucuuuucaacuguaauauuucuuuguuucuuuuagauguuuucaccuccugugagcagugggaaaaauggaccaacuucuuuggcaaguggacauuuuacuggcucaaguauguaaauucuuuucuuaguguuaaguuaaauguucugggcuguuuauuuacucaauuguauguuuuuggcucuguugaagaguucugaaaaagucauugaauuuuagccuguaaucauacgguuauugcauuacccaucagugguauaacuuacacaaaauguuaucuugugcgauuaaaauuaggucuuuuuuuuuaagucaaggaaacucucucaaaauuccaucacuuaauuuaagagcaauuuucuaauacaguuguaaucaaacacaugaagauaagaccaguguuaacauggggaauaaauuaauguuuucuauuugaaaauaaggggaaaaaaucucuaacauucauaaaaugggaaaaucccuuguaaauaauaucauuuauuagguacuguauacaauuaacccuuuuaaagaaaugaacacuuaauucugcaaaugaaugcuauguaguaaaccauagcuguaaauagccucuugcuaaucuuagaggcuaaauaugaauucauuuauauuuaaaauacccuuuuugaugcuuuagcuguuuuuuuuucccuaacgauuuacuugugcaaugaauuuuuacuguauuuaaaguugcaaaucuggaaggacuuuuacguuuuauaaaugaaagaucuuugggugaugcuuaaaaaagaugcuagcacuauucacaaaggaaucugugugcacagugauuaucuggaaucuaaggagggguuuauuacagggcuauucgaauaucucuuauuaaaagugcagagugaaaauauucauuuaaaauguauuuuuuuuaauccaaugaauuucaaauaagaaaaaguuauacauuguugccugcuauccuuuaaguccguggcuuaaguccauuuaugcuuguuaaacagcugcaguauuuuaggaguucuggcaaugguauauaacaguacauuaggccaaguacuauucuuaagucagacugguaaauguugacaucuuuuaacugugagaugccaguggaauugucugucaacuaugaauauaauuuaacaucuuuuaauauucauuuggugcuauagcaaugaaagaaguuuguucacuuaugugauuuguauaauugguauauuuuuauaaaacuaauggcuuuaaaaguugcucauuuccaaauaaguuccuucuccuucuauugccugccuaaguuuagggaauuugugucucgauaacuuguuuuaaaaaaugugagaugcuucuuguauuuuuauuuuaguuuucuggugcacauugauuaaaaggaccauugacagacaauauguuuguguuuuacuauccuggaccugguuauguuuuccacuuagggauuugggauaguuuuuauauuaguauuauaucuuuaaauuucuguaugguauccucuaugcaacuuuuaagauggaaaauauuaauaugcauguuugauguaaagguaaggacaaguaucuuuugugggcaaauuaauuuuucauguuagacaagaucaaaacuaacuguuuuugacaguaauuuuuuuaugacuuaacuuaaaaauguguauucaguuucaaucuaaaaguagcuuaugucagacagacacagagauagacuacuuuuaaagucaaugcuaaaaaacuaguuugcaauguugugaaaauaugcauuuagaauaacuuaaguauauuacauuagauauuuaauaaaguaagguguuuagaaauaugagauuguguuacauuuaaaaagacaacuguaugucugauccauuuucuauguucacauuuaaauaaaguucuugcugugauguuuaaauguuuauagagaguacaggcuuaauaaguugaauauguauuaaugcauuuugguaagugaugauauaucaacacuuacacaguucugaagacaauaacacacacacauacacacauacacacauacacauacacacauauguucaugcaugcaaaccuggagagagacuucacucuuaauaagucauguuacacugcuucuaaugcauacacagugauuauuuugaagguguggaacuuuaaguuacguuguaccagaaaugguguuuucaggaccaaauguuuacuuguaaggguaaaaaguguaaugguccuuuuauucuggcagccugaaugagaaugcaggguauucauuucauguaguaugauggugauuauaauauguaggguacagauuggaguguucaguuuuccucuaucaagauaguauuugaacacagggcuguuaguuaagaaaacggguuguauuuccacuuaaaagaguuaaaucuuuuaaaaagcguaauacauuuuaaaaaucaugaauacugcauuuugcccuuuaauuggaaggaucaacuaggaaacuuuggagagagaaauaauuuucuaaauuuaccucaaguuaauauccauugucuugaguggacucagaugucccuuucauggauugcuuugaaacuuggauuuaggaaagaucuaaacuauaaguagacuguuccuauuugaaaaaucagcuaugguuuuucaaagugaggcaugguaauaauucaugcuuaaaguucccaauagcuuuugauuccauuaauauaggaugcuccauagugauuugcaaugugagaauaaaaauaaaguguggccauauucccuuuaaucuuucauuucacaaacaugguuuuuccuaccaccuuaagaaauggugaggcugcuagggagaauggaauguaaccugagcuacagccugacauucccagggagcauuuuucacaugaaaggcuuuugucaacccaggaaaggacuagcaguuuuuguuugauguuugcagguguucagcagaaagcacuaaaacaauucagccaugaugguucagagcuucgaugaccuuaacagggaaaauuggugggcucuggaauuauuuuuaagaaauaguuauaaccuauaugguaacuuaaacaaagggauuuaauauccguuauaucauugaucuuaaaacaaacuaaaagcauccacaugccuggaugauuggaaaauuauucucauugaaaaguaggauaccuaaguuaccaaaaaaagaaaaucaucuaaagagucuauaauuuauugaugaguauggacuuaauuuucugauauagcagaaggacaguuuauuugguuacuuuugacucuugugaggaaaagauaaacauccuagcuuugacaucuuuuuaaaaagucguuuuaaaguugggccacuaaaaugauacauucuaaagaacuuguuagaucaggucuggucacaucuguuacauguauuuacugcuggucuaugacagauacuacaucuuucucccuuaguuuaaaaguugagcuuuuuccccugugacuguuuaguuuuacugagguguucagguauuguuaaaagauugucaaaugaacgaguguuugaacaauuaagagcagcguuaaaacacaccacaucucuguugugggucauuuuuggaagaggaaaguauugccugaaauuuaccuaaguuagcuaaccuauauccacaugacaccaacauaauaugccaauuuagugaauucauugaggcggaaaaaaaucaguccgguggguaguuuuguaugauacagaaaauuaacguggucacauccugaauuaguuuugaguucauagugauggcaugaaaaaaaaauugguuuccccuuaaagauauuuguugaggagagcugcuuaauauuguguguguguguauaagugagugaaaacacccuuaaaaucguaaaugguauaauucauaaggguucuguggcuuuuuguaaagggcagaguaauuuaacagguuaaaagaaguacaguggcguuaaacccauuauguuagaaucacagaauuuuggguauagaaacccauuagaaauguugcccagugccuucauuauacaggcaaagaaaacugaggcccaagauaaggaguuccaaacugugcuuucuuauuuguuauuuuaaaaaacaaguuuuuauuugcuaauucucuauggcccugcaaauccuuuauuggaaauaaccuuggucucacugcugucuuucuguccuuuguacugcguaauggggcuugaggauuagugugcugauauuugugcauguaaaugcuucuguauaugcaugugccuucugaaaacuuuuuuagguuuggagcugaauuuuggauuauugaucauucucuuuugccuggucuucccugugacuguuuugcaugauguuggguaaaauaauagugugggugagcaugucacagugcuucucaguguguuagagaggugugcuguguaccuuauaccuguuguauuuuuuaaauccuaacaagaaccuaaugagaugcaaggauuacuacuauccuguauucauagcugaggaaacagagacagauguuaaacaacuggaucuuaaggcagccaauaaugaaauuagguuuuaaccucagguuugucuagcucaaaguccugaguucuauacacacacacacacacacacacacacacacacacacaucagacagcucauuuuugcaagauuauauaggcaaacagugugauauugaggcuucgcacgaaaugcuaucugugaucuuuaggguagauagcauuuuuaaaaaugugucuaauguuguaaugaugucaaccauauccauuauuuuucccgccuuuguauccaaauaaacuacccuuccaauuuaugacagauaucaaugugacuaaauaugucuuucucauaucuuuauuaguuuuacuaagaaaauacaguagauauuuuaaaaguugugcuuucauucuguuguaaguugauagucuacauggaugccaaugaaaacauguuuuuauguagcuaaucaauucagaauuugagguaaccaagccugauguauuaauauguaaaaaaauaaggaucuccugucuuuaaauauaaaaaaguuuugcaguucguuguuagaucuuugaaacuuaauauucaagaacaauacccucaauucuaucugcaucacuaaaauaagcaguuuugaagguuugauaugucuguuaccagacaugugcuuaaaauguuacauuuucuaaauucagaaggcagaagcaguacucuauuugacacugacuuaaguaaauaaaaugcauuaaacaagcguggggauccaagaacuguugaaacugaaaugcuuaacauuuuugacagcaucagcaaauuauccuuacccuacuauuguaaugaggaaaucacuuaaauaacagaugaacagccaagucacauaaacauauauaauagaacuauguaaugaaaguuuaugcuguuaauugcucgaaucugucuuaaaugcuuagaaucauggagcaguaaagacugucauauaaacaguuuuguuuugagcuuaaaauuauuccuuuuugcuuucaucugcuaugauaaacaaaguaauuuuguaagcuuuaaagaucaaacauuuacuccuaaugguaaacuacauuuuauauuggaaguuugcaaccucguccaagucauagaguugaguccugguggccccaggccugugauuuucaacguuuaguauuaugaugcuauuuagaucuguucccauaagccaagauaacagaucuuaaguugccuaauaaggaacaugguguguuuugaaauguucuucaguuuacaagucuuaaaccaaaauguucuuggccaaaccuuuagaaucuauauguaaguugaauaagucagauuuuauacagacauagcaugaaaaugaagcuaaguaggaacagaaaaaucugcccuuucuuuauuauuuuuuuuuuuguauuuuaugagcuauuuuuuauggccagguguuuguucuuccaaguuaauuagauagugcuaaguauuagaaaauguaaaauacauuacagauuuuuuaaaagguuauuuuuguuacugguuucuuauuacucuggguaaaauuuucacaacugaccaccagguuuauuagcuuauaugugagcuacccauuuuguacauucgugagccaauugacuaggaauaagguaugcacauggguuuuauguggauacuuuugacccauaucucucuuaauacuuaggagagagauauaagagaaauaauaauuuaaucuuuggagaagauuaacacuuuguuauaaguuauauauagguaaauauauauauauauauuuauauuagacuugcaggaauagugaaaauguugaaaagguugucauguuuacuuucauuucaaagauaaaggcccaguuaaucagcauaucaaauacccagguguguuuaaaaucaguuuaugugggugaauuucagggcuguaagaaaguauuuuauuuaaaggugcagccacacgauugauuguucaaaugggugcuuuuguacuuuugugugacaauuaacauuuaaugaaugacuuucuggacuggcauuggugguaauuacuauauguaguuuauuaacugcaauccauuguuggaugugccuuuauugauuuguuuugcaaacaccccuucacaugugcggcaguauuugugcagccguauuuguacguuacuuuuuaaagaaccuguuucacuugcugaugcugacauugccucuaaaaauguuaguuuauaaauucucaugugccagaaugucucuuugauccaaguaauuuuagcugaaauacaaaauccgucaacuuuucugcuauaaaaaguuugcauucaaauccucagggaaucccaaaguaaugacacaauauuguuuuucaaguaaauaauuuauggaaauuuacauuuauaagagacuuuagagaugcucuauuuuuuagguaaggagccaagguucgggaggguuaaaagucuuuugcccaaaucaugcaguugguuauuggcuguaauaggacacaaauacacauguccugacccucuggucaaagaccucaugcugcuuuuaauuaaggcuuggacucaauucgaugguaccaacuguauauuucuuaagaagggaaaaauguguauaaucuaccauuucugaaaaaauuauuaaaaauugagauugugaaagauggacguuguaauccagcccacuugucaucacguguucuaauuuggccaaggcaguugacaaauaacuguuaaaauguauuguguuauuaaaaauaacaaaguaagacccaugauuaaauaucagggcuguaauuuaaucuugggggaucuggugcuguucauaaaccauuuggcuuuuuucuguaacggaugacgucaaaauccagcuugauugaauuaugacccuggguuacagcagcaccugcuggugccuuuuuacuucauggccugucagcauuuccauuacaaacuuuuuucucugacauuuuaaacuucaaauaguuaaacuggacugaugguuggcauauaaacuuucugcuccuugggaaaagaccacuugcucaauaaaaacagagaagguggugacaaagccccauuacaggauaccccuuagaauguucugcuuugcuuuaaucuuccauucauuuaaacauucuuuugggggguacuuagcugaauugcaaggcauccaaauggaagguuuuuaaucucaaauuucccaugugaagacuuaaguaugggguguuuacaggacugguaaagugcaaaaagaccuagcaucuaugcagguuauugaaacucuggacaauccaguuuucauacaguguguaaaaugcugaggagcaagccaugaaaaacaugcaaauuggcauaccuugucaguaauugcuuuuauauucacuuaagaugaguaaaaauugauaaugauuaugguuagaaaaguaucuuuauuuauauuuauaucuggagacugguagcauagcuucaguuuguccccuuggguuuuaauauguugggaauggagaugggauguuguuugcaucuagcuagucagcuuuucaucuaucuagucuaauucugauugauggaucaucauauauauauauguauauauacacauauauguauaaauauguauauacauauauaaauauauaaacguauauauacauuuauauaaauauauaaauguauauauacauuuauaaauauauaaauguauauauacauauauaaauauauaaauguauauauaaauauauaaauguauauauacauauauaaauauauaaauguauauauaauauauauauauauuuaguaccugcuauucucauaucuccauguuagcaauuagaggacauagagggcuuuauggaagagagaaccuucucucagagggcauauauucuaacacagggguguccaauauuuuggcuucccugggcuacacuggaagaagaagaaucaucuugggccacacauaaaauacacuaacgauaguugaugagcugaaaaacuuuugcaaaaaaaccucauguuuuaagaaaguucacgaguuuguguuaggcuguagguuggacaagcuucuucuaacaggagaaaauagaaaaguaaaaaugugauuaacaucuagcauugggaagacacaauaaugugggaguuuagagaaaugaaaacuuauuucuuucauggggaaauuaauaaugaaggguucauggaaaacucaauucuaauccuugaaggaaugguagaauuuugacaaguagguagugagacugagcgugcauaucaggaucacugugaaccaagcacagaugaaagaaacuggaaaggguagauuaaagagagcucccagaaagagaaguuucuuggcucuaaaguggagucaacucuggucuagacacaugggaugauuuccaggcaaaaaccccugucuugguugccguuuauuuucuugacugaguuugcguuucacucggggguguuaccgauuauaauccaguuccauccaaaaguauauguuuuuaaugguagugucgggauggaaauugaagauuuugugucccuacuucccaaaauucuuccuauaauaucacucagcaguggaaacuuucuugagccaaaugaagcugcuuuggagaaaauuguucauguagccaaauucuggaaaucuagguucuuuugcaauguuugcugguaaguagcuguuucauauugaggaagugguagaaucuuaaaggcugcaccucaaaacuaaacaaaaucgaaacucaccaguacaauucaagagggguuuucacauuuuuuaaaaaggaauacugcuguauuuaaaacauuuuaagauugcaaaaauucaucauuauaauuuuuauuaucaucacuggcaucaccaugaccagugucacauuguuuggucaaaagcuggaauggaaaugugauaguuaucuuugccauauuauauauugagaaaugcguuuaaaacuuuuccggagauaccgugaucuuagcaaaaacuaauguaauauuuguaaaaacauugugaaguggccagauauaccuuuuaaugaaacugaccagaaguacaucacaaauagaaaaauacacguguguguguauguguauaccaucccuucccccaaauauuguucagauuaaagugucuuucucucugugaccugcaaguaucuuaacuuagcauguguguccaauuuccauagugaagccaaaaauucaaaugaugguugauauuggcuuaggaagaauuuauuaaugaaugacugugcuugguauagaguaaaaaaaaaaauuuaugacaaagaggauauucuagacucauguaaaagauuucaguuaagaaccuaugaauuccucaaccuuuuucuucacuuuucaaaaaguaaaggauuuauauuggaaauauuuugcaacccuacaaccugaaacucaaagcuuuggucagcaggugguaauaauauuuccagguugaauauccaauuucauacauaacccaauuuguaaguuugaaaagaaauauuaaacgaugucaguuuuaaugcuuguuugaauaauuguucuuuguuaugugcccucuuggacauuauuguccacuagugccccaaaccauugaaugcuuuucuguucucuuauggccacugugauucuucaaucuaguuacuucuaacugcaagauuaauuuucuucugacaucuaauuuuccccugauuuuauuaacaucuuauuauucuuuuucuggcucauuuugaacaauuucucuuuuauaugggguguauauuuguagugucccacuuguaagggaauucuacacuuuaauccuuaguaauuuugguagaauugggauaagaugagagauaguccauaauuguuuaaggcuugauuguuuaaagaagguugaaagcuucagaaaaguggaaguggaugaaugcaugccauguucuuauuauuuuuucagugugaguguguuucacuggaguaacgauagaguuauuaggaauuauuaccuuuaauuuacuuaugugcacauucauucguccacucauucauucauucauucauucagugaaaguuuuuuuuuuuuugagagccaagauacaaguuauagugcuagaaauuauggugcuacaaagaacaacaaauuucaacuucagcacugggacauuauguugcaguuguuaaauaaaaguucuacaguaauucaaagaagguacuuuugaaauaaaugauguuggccaggcuggguggcucaugccuauaaucccggcacuuugggaggccaaggcaggcggaucauuugaagucaggaguuugagaccagccuggccaacaugauuuaauuauuuuguagaaaucccguuucuacuaaaaauacaaaaauuagcugggcgugguggcaggugccuguaaucucagcuacucgggaggcugaggcaggagaauggcuugaauccaggagguggaguuuguggugagcugaaauugcgccacugcccuccaguauuggcgacagagcaagacucugucucaaaaauaaaauaaaauaaaauauguugaaauaugcaaguauacuuuuucaaaggacacuuuucaaauauaaccaaguacagacuucacauuucuaacugaaacggaaauccuaaaaucucuguauauguguacauguucuaugugaauauaaaggaaggcgaauggauuugaaugcuuauggaaauuggcccuugaaguguaguguuaggaauguacucugaaauuuagugucagagguugucugggaggcaaugagaauuaaguuccauucguccuuuuugagcagaaauuaaaauuuuggauguguagaugguacucauuuacuucuaggacacuagauauacaugcuuaucuuuuuuauccccacacuugaauuauguuaauauuuguguuuaaauugauacacaguaaaauauucuuuuaaaauuaaguagaugauuauugagcaucuaccaugugucagguaauacuuuggcagcucuauauaaaaugaugagcaagacaggcauguuucugauguugccuacauggaggacacagacauuaauggauaaucagccaaagaaggucaaguacuacauuugagagguguguggccugagaagaguuugcaauagggauaucugaucaaggggagcagucaggaagggcucagagaucagcccaggugaacuguggucuuacagaugaggaggaguuaaguggauggagguugcuuggcugacagguagggcaugauuccagccgcuguggcugguggggguugguaggugucagaucccgcaagacugagccacagggagccuugacagugugcugcuaaucagauuugugucugggacauggacccaaaggggagucacuguggguggcccacaccaguugugaaguuuuugcagaaguuuaggugagagacaggguugcugguucuacagugugggugguaaaguuggagaauuaacuuuguagacuuuauuugaaaucuguaccuuuaggucauuggggagcauucauaguggcuacuuguuuuuuuuuuuuuuuuuggugaaacuuccuauaacuuucuaauacuugaaaaucuaccauacuuuauacauuccgacaguaauuaugagaccuaauucagcugugugauagccacugccuuuuuagcaaccaagcacuaacuagagaagugcucuuuuauuuucugagaaaaguuagauugaguuugcaauucugcgaggguacagggguggaagugggucuuauugaauggucuucaguaccauuuuggcuuuuuuuuuuugagacggaguuaagcucucauugcccaggcuggagugcaauggcgcggucucagcucacugcaaccucugccucccgaguucaagugauucuccugccucagcuuccccaguaguugaaauuacaagcaugugccaccacaccuggcuaauuuuguauuuuuaguagagacaggguuucuccguguuggucagacuggucucgaacucccgaccucaggugaucugcccaccucggccucccaaagugcugggauuacaggcgugagccaccgagccuagcccuguuuaggcuuuuuauagccuauguucuuaugagcaguaaacauuaugaugguuuaguuagaccuguugaauugaauucacuucuccugccuguggucagguaucagguagcacagccacagaaguuacugaaugucuuuguugguggacuuuaggagagugguuuaauuuaugugguauucuaucugggauugcagcaguauuguuagauugcauuuugucacagggaggaaauuaccugguaacuccugauuaggaacaaaaugaagcuuccccuuuuuacaaauccuggcuaacauuccauuuggcucucuucuguugaccaccucucucucuccccucccuccucacuccauuuucucaguuauuuuauuguuuacuauuggaagucaccucccaacucaggauacuuguuaguccauuuuaggaaaaauaucaccauucuuucacuauuauucucuguugaaguugaagaacagaauauuacuuuuuuucuuuccauuauugguuacaccagcuaguuagagacuugggguaauacugugggcauggguuggauccugauaucugugucaguuagugagaguugguucuaugacccuagagcucuuuguguccuucaaacgagggugcugaaacaagacgaacauagaacugucuauaccaagcaaaaaacuccugaaagcacaugcccacugcaggugaauugguagcauaguguggagauaagugggcagugcuugguccuguuucugccuccuagagaguaccucucagcauccagggaugcuuuaguaacucuuaguuaaaacgaaaugaacuauaauuaauuaccuuucuuuugggagggacacagagaguuucaacagcaucuacaaugcuuuuuuuuuuuuuuugaaaagaaaauaugauagaauauuaagauugacagagcuggggauggguuggaggcugaauuaugauguguguuuucuuuaugcuugaauuauuucauaauuaaaaacaaaacauauaauaacaaaaaaaaaaacacccucuaccucucauucacauuccccucuggccauagccucuuucuugacuuccuuccuagcaagacuuuuguuaaguguuuucuacacaggcugcuacugcaugcuucaaaauuuaaccccaagcaaauauuagaaaacauauuuuaucuuauaauacuugauaccuacagaauaaucuguguaacaaauguaaguugugaagcuuaauaauggagugaacaucuaugaacccaccaccaacauaaguacuggagcaaugucagauccauuggccggccuguggguuuguucccuguccaccuuccccuaucuuuccugccagagagaaacauucucaugcccuuuuuaaaguaguauugugacuggcauauguaucccuaaacaauacuguauguuguuugguuuugcuuguuuuggaggauuauaaaacugauagauuguuuugugcuacuugcuuuuucacuugguauguuauuguccauguuguugcaugugguguauguuaauuuucucugcugaugaauagguuguaguuuauuuaugcauguuccaguugaugaaccuuuguguuccucuuuuuuggaacuacaaacuuucuuguauguuucucuugaugcacauguguaagacuuucucugugggguauaugaguggauaucuaugaguagaauuguugguuuguagaguuacaugaaaguccagcauggcaggauaguguccaguuguuuuuuaaagauucuuacugaucugcacucccaccuguagcauaaaggauuacuauuggugcagucuacugguauaaaauagaaaauguaucccauuauagucuuuuuuuuuuuuuuuuuuugaggcagggucucacaucucacucuguugcucaggcuuggagggcaguuuugcaaccucggcucacugucuggucucgacuuucugggcucaaguuauccucuugccucagccucccggguagcaggaccacaggcacacacaucucacccagcuaauuuuuguauuuuuuguagagaagggguuucaccauguugcccgggcuggucucgaacuucugagcucaagcaauuugccuuccuuggcuucccaaagugcugagauuauaggcaugagccaccacacagggccgcauuguggucuuaauuugcauuuccuugauaauucgguuaaacaacuuuguauauauuuauuucagaucauucauguccacucuguggaaucuaccccgcccccauuuucuauuggguuauuuguuuuuucuuauugauuucuagguguucuugauauauuuuuggaugauaauuauuagucauacaugcugcaaauaccuucucuuauuuugugacuuuuacucucucuaugguagcucuugauaaaguccuuaaauuuaagauagucacguaauuauuuugaaggguuggaaaagccuucuuaccccaagguuguacauauauucucuuguauguuuccucugaaaaggauuugauaauuuugccuaucacauuuaaguuuuccaugcaguugggauugauuuuguguggaaauccauucacacguacugaaaaguccauccuuucuccagucauucacaauacuauuucugugauauuuuuaguuccuguauuuguggggucuuuccuucugggccuuuuauucuacuugguuaguuuggcuaccuugccucgguaucacauuauaauaaauguuauaacuguauuuuguuguuuguuagguaaagcccuuccuccccacuuuucgugucccauauguacacauuugacuuugggcuauuguggagccugaguucuucuacgugaauuuaaaauucagcuugucaaggucuuugagaacccuuugaggcauuuuuauugaaguugcauggaaacuaaagaucaauuuugggagaauuauuaugcauuuaaugauuaucucuacucauuuauaucuccauuguuuuaggugucugauaucucaaaacaauucuuuauaauuuuuuagcuguaauuucguaauuauaguuuuauaauuuucuccaugaaguuuuacauuuucugaugauuuauucuucaguaccuuauuuuucuguuucuauuauuaccaguauauuuuuuuaauuauucaaauuauuuguuacuuguauauagaaagucuuuuuuaaaauuuuuauuuauuuuuuauuuuuagagauggaaucucacucuguugcccgggcuggagugcaguggcgugaucuuagcucacugcaaccucugccuccuggguucaagugauucucuugccucagccucccaaguagcugggacuacaguugcccggcaccacaccuggcauucaauugauuuuuguauaucaauuuucauauucagccauguugcugagcucucuuauuaguucuaaaaaugucuuuguguuuuccuuagaguuuuuucuguagaucugucacaucaugugugacucaagacaauuuuauuguuuuuuccuuucaaaccccaauacuuggccuuuuuuuuuuuuugucuuuacugugcuauauaugaccuuaaguacacuguuaaauaggaauggcaauacugauuaucuugucuuauuccugauuuucaccaugaauagugauguugauguugauagauacuugauuaagaaaguuucauucuauucauauuucaugaagaguuuuuaucaugaacagguauugaauuuuaucaaauacuuuuucuacauaaaauuaaaugaugacuucuuuauuuccuuuaaucuguuaaugucgugagugacauccguauauuuuccugugguaagccaccuuugcauuuuguggaugaaauuaaugauguagcuucauuacucuuuuaaaaauauuguccuggacucaauuucaaauauuuucuucaguauuuuuacaucuaugcuuacaaguaagauuggcauauaauauuuuuuuccuccuacuuucuaagucuaguuuugucuacaaaguuagaauaaggaaguguucucacucuguauucucuggaauagucuuaaauaaggaugaaacaaucuguucuuugaaauuaggucaaacuuaucuguaaaauugguccuaguauaagaagauuuuaagccacugauauaauuuuuaaauauaauaauauugagagugagagcuuuacuuuuucugcagauacuuuaacaauuaaauauauauauaaacuuauauggauguguguguguauagauguguguguuguauacauauauauguaauauaugucaguuuucucucuauuucauuuacauuuuaaaauuuauuaccauaaaguuauacaaagguauucucuuagcuuuuuaaucucugcugacuccauaauuuucauuuuucauucauaacuuuauuuauguauuccuucuuuuuuucaugaucaagcuaauuugaaguuuuucuuauuuauuacucuuuucaaaccaacuuuuggcuuuguggauuauuuuucuuguguguuuucuacuucauuaauuuuuaaucuuuguuauuuccugcuuucuauguacuuaggcuuauuauucuguuuuuuuuuuuuucuaaauagaguugacuacuuagugcacuaauuuaucauaauuucuuuuuauaauauaagaauuuaaggcaauauaauacccucugaugacuguggugacuguauuacauagguuuuaauuuauuacauuuucaucaucuuauaaguauuuuaauauuuacaguaugauuucuucuuugauacuugcaauauuuuuuggugccuucaaaauuuuacaaaugaauguauuacuuaucuuuuuauuauugaccucuauuacaauuuaauuguugucagagaacuauucuguauggcaacaguucuuugauauuuguugaggcuugcuuuguugccaauuuugugaaucaguuuuaaaaguuccauugugugcuucagaagaauguguacucuaugaauucagggaucuauauguguccagaaauuaaagcuuguugauuguguccuuuuuuuuuuuugagauggagucucgcucugucucccaggcuggagugcaguggcgcgaucucggcucacugcaaccucagccuccuggguucaugcaauucuccuuccucagccucccaaguagcugggauuacaggcgugugccaacacacccagcuaauuuuuguauuuucaguagagacuggguuucaccauguuggccaggcuggucuugaacuccugaccucaagugauccacccaccucuguugauugugucuuaaagucaucucuacauuugcuaauauucgaaaucugccugacauauuuguuauugagaaaaguagauugaaauaauuugcuaugaugaugaauuuauaaauuuuucccuguauuucuauuuugacuuuauacauauugaaauuauauuauuacaugcauucauuuuaagaauuacuauauuuuccugguuaauuaaacccuuuauucaguuuguauguggcuauucucuuucugcccuuuuaucuuaaacucuguuuugucugauauugguauaauuauugcacuucccuuuuguguaguauuugucuauauaucuguuuuuuaauuuuuuguuuucaguuauuccauguugcuauguuuuaaauaugcagaguggcauuuuauuuuucuuaguauucugaugguuuuauucuacuguuuucugaauuucccuguggcucauaagaaguucaguaucuuucugauugccauucuuuucuaguagaucuacccuuuucccugacuguuuuuuggcauuuagcaguuuuacuguaauguaucuauuugugaauuuuaaaauucuauuuggucuacauuguucuucaugcaucuguggcuucaugucucccuccaauucagaaaaauuaucagcuuuuauuuccuuaaauauucugacuccuuuauucauucuguucucuucuuuggggauuccgauuacaugugugcuugaccuucuuuucuguccuucauucucuuaacuuuucucucauauuuucaguccccuuguaucugcugcauucuggguaauuucuuuagacccaucuuccaguuuacaaauucucccuucagguuucucuaacguguuaucuaaugcaaugauuaauuuuuuuuauuucauugcuuacuuuuucauuucuaaaaguuccauuugguucucucuaaauuaugccuacuaauuuuuaaauacuuucuuauuucuuguucauuuuugugauucugucuuuaaguucuucuuguauuuaugacaguuuuuguauuauauguauuuauuuauguguauaaauuuauaggguacaaguacaaaacgugacaugcauagauugugcaguggucaagucaggacuacauuguacccauuaaguaauuucuuagccacccgccuccugccccucuaccuuuccggaucuccguugucucucugcccacugauagacuacauccaugucuauacauuuuuauuuuuauuuuauuuuuauuuauuuuuuaguuuuugaggcagaaucucgcucugucgcccaggcuggagugcaguggcaugaucuuggcucacugcaugcuccgccucccugguucacaccauucuccugccucagccucccgaguagcugggacuacaggcacccgucaccacgccgggcuaauuuuuuuuuuuuuuuuuuuguauuuuuaguagagaugggguuucacuguguuagccaggauggucucgaucuccugaccucgugaucgccugccucagccucccaaacugcugugauuacaggcgugagccaccguaucuggccauccaugucuauacauuuuuuagcacccacuuaugagugagaacauguaauauuugccuuucuaugucugguuuguuucaccuaagauagugaccuccaguuucauccauguuacuacaaaagacaucauuuuauucugguuuuuuuuuuggcuucauaguauuccauuguguauauaugcuacauuuucuuuaauaauuguaaaauagacuaugcaauuuuauagauauuuucuaacaaauccaaugcuuaaauuccaugggcuugagguagucuuguuauuucuacuaacccucacuuaagcuucuuuguuuugcuuuugugagaugcuuaugaauucacaucugguggguauugaaucuaugaaaaucugggagucuaaagugagaauacuuucuccagagaggaauugcuuuugcuucauagucucuuuccuacucugggaguccuagucuucuuaucacagugcugauacuggcauuugcucucagagcaucccugcuucuugugccuaccuuucaguauugaaaacucaaguuuuguuuuauuuuuuggugcuuucaagauuuccuuauuucuugcauuuauacuuuuggagaauuuuuuuuuuuuuuaauguugaacauugguuguuuuguagugugagaggccuuggguguauugucauacuuuuggaagcagaauucugauuuacucuuuaacccuuuucagucugacuucugucaccauuuauuccaaugaaacuaguugugcuaagauuaccuauaacucccauucuucccagcaacuuuagagaaaauguucuuuuuaaaaaaauggaaacucugugcuucuagauucugcacaacacaguuuccucuccuaguguucuuucugccucucuuuuguuggaagaggaaauguuggggaucuuaccugggcuuucuuuuucucuucuauugagaggcaguuuggugcagugccucaaucuggaaucagacugaguuguuaucaucugguuauuagcaauaugaccuuguuuucucacuguaaaauggauagaaauaggguuguugggagaauucauuaacauaacacuugccaugcacucagcccauuucuaacacauaguaggcauccaguacaugucuacuuuuauucucugguacauuaucuucuuaagucaucucuuguuuccaagaugacagcucacguauauauugcuccaguaugaucugugcaucucagagucaguuuguagagccaucuguauguuauauuugauuuucuucugucuccuuaauguauaccuucccuaggcuucugcauauaggaaaugacacugccaugcaccuagaugauuaaaccaguuccggacacuuugaccuuaucauuuguguuaccaucucacaugauaauugugaguugugcucuccacaucugcuuucaccaguugaguucaagacaccaucauuucuugccuggucuacucuaguagccuccuaaguacuuucugcacuuugacuucuucccuguugaauccauauuucacagcaaccagagugauuuuuuaaauaagaaagucaaacagagcaugcuuucucccagcuucaauguuuuucucauagugccuagaauaacuucuguucuccuuaauauggacuugagguaccucuacaaccucauuugguuuccuucugcugcuguauacuguuuggcuacauugggauucuucuaggcuuuggacuuugucaagcuuuuucuugauucagggccuuugcacaugcaguagaacacaucuucucucacucugcguggcugauuccauucagagcucaucugaaaugccacuuucucacggcgacuuucuuuuauuuccuaguuuaaucaagacucuuugguucagugcgugcugaauuugcuuaauaaaugauuccauaaacauacauauuuugaauagaaucugcugauuaauaggaaugauaguucugugagaucaugcucauuuuaaauuuagucauagugucauuggaaaccacuacaugucuuuucuauucauuuaaugaauuuucaaggucauaaaaauuucugaugauauuauaauuuuugcauuugcaaauacacuuugcauaguauuuauugcuggauaaaauauuggcccaaaucagggguuggagaacugacauucacugagcaccauaugucacguucucuuaccuuaauaucguauguuaggcccugaaaucuaguuauccccgagucacugaagaggagcugagauucagagauuccccuaggcuggccaaggccauaccuuguggagggcacagccuaaguuuaguccaggaguuugaacucuaaggagagaacucuuuccauaucugcugccuuauuucuucucuaagcaaacuccuuaaguucacaaaguucuuucauguguauuacucauaauauguaugucaaguucuagagagugcagggcauuuuugacauuuuauuuuggaucaagcuuucauucacuaauuuuuuauuuuucugagcaucccuuugagguccuugaauucacggaugagaaaaauuaaacaaucagugauuaaguggacucucugugaaguuacacaauggaauauuaaauuguugauggauauuuuuuauuagccagagaaagaaaaaacgcagacuuuuuuuuuuuuuuuuuuuuugagacagggucucacucuguugccugggauggagugcaguggugugaucacggcucacugaggccucaaucuccuggucucaggugauccucccaccucaaccucccaacuagcuggaaccacaggagugcaccaccacagcuggcugauuuuuguauuauuguaaagacaggguuucagcauguugcccaggcugguccguaacucguaggcucaagugaucugccugccucggccucccaaaguguuggaauuacaggugugagcuacugugucuggcccaaagcauuuuuuauuccaguaguugugucagucuguuuucuuucuauguauguauguauaauuuauguaucuauguaucugccugucuaucuaccuaucucugguuaaauauguuuuagaaaaaauguaacuagcacaacuaggccuggacuuauagauauuauuuaugguagaaggcuaaguuguuuauuuuuuuaaguuaauuauuuauaaagaaaaauauuaaccauauacaaguacauuuaguacuuaguuauggcaaaaaucaagaaggugaaauagauauggaaaaugugauugggugaguugguuuuauuggacugguagggugugcccuuggccaaaccaaaggccagaggguacaaggaagucagggggacacacugcuggggagauagagagggggcugcccaguugugaggggaacuaacuucuuguccagaacuucccuagggccuucccuggcucuugccuucuuugcuguauauuuugguuacuggcaggacacugguucaaauauacauuuccgugguuugauuuuauaaagcuaaaaaagccucaugcuaauauucagucucuuauguuaugaauguuaccauuuuaccucuuagcuauauagguaucuauaaaggacauuuuuuaaaaaugaaaaucauccuuccucaguaaagaacuagagaauaaacauguuucugaaaguagaaugauguggacuagagcaggggucggcaaacuuucucugagaggggccaaaugguaaaucuuucuggcuuuguaaccacagacucucuguugcaaauacuaaauucugcuguuguagcaugaagccaguuauagacagcaaagaaaccaaugagcauuacuguauuuuaauaaaacuuuauuugcaaaacagacaguaguuguauuuugcccaggggacuguaguuuguagaccccuagaugaaagaaauguaucuuagggccuccccucuuagcccuuuccaucaucagcaaugugaucuuggacaauauacuuuaagucuuaaugaauuuauucauuugaaaaacugacauuuuauuuuagaucaggcuuuucauucacuaauuuuuuauugcucuggacaucacuuugagguccuggaauuuacagaugagaaaaauuaaacaaugaaugaggacaguuuucuuguaugagggauuuuuguuuucuucauauuuuuaauguguuuaauauacuggagugagcaugucuuauucuuguuaacagacaagcuaucuaaaaauuaaaacacaaacuaaaaguagaggaagauuguuaugagaaacaugucauguaugugaaauacauuuuauaaggaauagauuagauucuuuauggaaccaggauggguauaaauacaucacuagauaaauauuaaguaggaagaucauuauggacaaagauuguuucuuaggaauuuugcaucguauagcacuguguuagacagaguccuuaacugauuauuuuuguagcauuuguuuacacauucacuuauuaauuaauuuugccaauguauugagccaucuauggagauguguggaggucuguguugaaagcuugagauagaaaaaaugagaaauaaaauaguuuuggaucucgaggcacucacauugaaggagauaaacauguauauaaaauauuauccuauuguaugauaaguucucaauuagaagcauguauguauagggcaccacuaggaaaucuguaucauuggaguagagggaagcuaggcaagagaccugcacagaguuugagcaguugggucuugaaggaugaguagggauucuuagacaaaagaagauugaaaggcagcuugagcugagggaaaugucugugcaauugugaacuuuacaaaucauagguaguucuguaagauuauaacuggagucaugaagacaggugaaggaugggauacucaaaguuuggcuagggccaugcaaugaaagccagggaauuugaacauauucagaaccauggaaugcuuugggaaucuaaugaaagauaugauacauuucuauaggaaaaucaucuuacauaaaaauuucaauauuuugcuacaguuuuaggaauaaggauguagugaucacuuuaugaacaguacagacuuuuuauaugguucccuucugaaaaaaaaaaggaguucacagauagacacauacuucaucauccugcuugaugguggcagcaaaugcucuggaugcacuuaugugaaguuuaucaugacuuuauuacuuaagagccugggaguauaugagauugugccauacuguuauuuauaauuuccucaaagagauggcuaggcaugaucagagaagccuucuuacugguagauguccacauaugucaguugccuaggcaugaucagagaagccuucuuacugguagauguccacauaugucaguugccuaaaugcuggagaagucacguggcuucggauagaauuuccucauuuguaagauggugcuccucaaaggaccuaccugccauuagagugguaaggauugaauuaacucuucugaugacagcacugagcccuaaauuuagcacauacuaagagcucaauaaauguuagcaguuaauacccuuauuagaauuaugaaaagucgguaauuucauucauguauguucauauauggagugcucacaaauacuugaauucuuuuauugaacaugugaguuagucuugcauuacgcacugcauauauguccauguauuucuggaucaucaugggucauuuguuuggaauaaaacuucauuuacggaaaucgucuguacagcccugguuaauuuuuucucugugauggguugcauuacauauuuucuauauaaaacagcaauggugaagauaaguuaacuaaugaauauauauuauuaugugcuuuuauuuuacagcuucuaauauucaguggggaaauuuuucuuguuaagagacaauggcaaggccaguuggccuaaaauuagauccagcagcuguguuuugaaucaaggccccacaugugcacuuuauacuccccacccccugcgcugggcuugucugcuucuuuuucuugcuucaggaggcagcauuuuugggugaauguuaacauucauguuuuuccuaguacaaccagaaaggugcuucuguuuaauuguaaggcagguuuauuuacauuuacggaauggaaaaaaagauuuauuuaauuauuaauuuuacaaaaccacccuuuagcaccaagcauaaaacuuuggagcccaaaucaaggcacuaggucacuuauaauuugauuucuaccaaaauaaguuuuuuuuuuuuuaaagaaaaaacccuaugauaauuuuuaacauuuuugacagcuacaaguaauuuaaguuguguuuuaucaguuuauauucagaagccaauguuaacugguguuaauuuuauagguccuaguuucuuuguauuucuugcccuacuguuugguuaauaaaccuuuuuuaaagaauauauucauguacacacaacauuaucaugauucgguuuaaguauccguguuuauaagugcacuucauuucaccuaauuauguuauuuauucauuuacacauuagcaacguacuacauauuccacuuuuacaggaacuuauuuuaauuauaccuacaguucuguucugcuccauuauaucauagaucaagcugaauaauagcagucuuaaaaggcauaugcuaaaagugauuaugggucauuaaggccaaauuaagguaacauuucugauagccacaagcagaagucuaacuuacaauuacuuuuuuuuuuuuuuuuuugcuuuggggaacguguucuaguuggcuuugauguugacggucucaugguugaaugccuaguggguguauggauugauccuugaucagacugauuuuuuuuuuuuuuuuuaggggggagauauauacaaaccauacuuuuuauuuauccagaaaucuguauuuauccagaaauagucuauucaaugacuuuacugccauauuucucaaaauguaugcuuuuucuuuagcccucucucuuccugccugccauuaagagucacacaggcaaccaaucuccccaucuaggaaagugaguacuagaaugcauuaaagucacuuuuuuauugaucauuagcauaaagccucauugugccauuggagagugaccuaaauaaguauaucacauccuuucaaagagaaaugccccauggaaaccauaccuaaaaacgauaacaauaacuaacagaaucugcguuuuaaugaguugauuuuuaauucuuguuucgauuggcccaauguaaucuauuaagaaauuaaagggcaucuuucaagcuuauccauauacuuuuauaaucaggaugugugacucuaguguuguuaauuuuauuuuugagaaauacuuagauuuuguaugggcauaaguaauucaaaauuauuuuguugauuuuauagacauuuuacuagggagauccauuguuguuacuuauuuucuaguuucauaauugcugauuaaaauuaauaagauucaaaugggaaaaugacaguagaaauauuccaauuuagaguucuuaguagguuggcuuacuuuuugcuggauuuaugaugauuuuccuacauacucagauuuggaagauacagcaucauaaaauaaacuguaguuuauauggaaccucuacauuuugguuggagauacaaguuucuacuggcucagaaauuuuuucuuuuaguuuuugauuuuuuuuagagacagucucacccuguugccagacuggaguacaguaguaggauccuagcucacugcagccucgaacuccugggcucaagugauccuccuaccgccgccugcugaguaucugggaauacagguguaugccaccaugcccagcuaguuuuucauuuuuaaacuuuuuguagaaauugaaucaaacuauguugcccaggcuggucuggaacuccuggccucaagugauccucccaccuuggucuccccaaguucuggcauuuaaagaacucagcccagcucauguaauuuuuaaauauucccacuccaugugauuacuucagucuggacaugucagacugaacugucauuucaguuuacaugucaauuugucuuucauguaaaaagggggaaaauaggaauauaugcuuauauuuuguuguaucugcauuuaaaaaaacacaagaaaccaaagugguuaccugaguagggguggggaaggcaguaaagaauagugugauggggaugagacuuccaaauagauaacuuuuuguauuauuuugacccuugaaccaugugaauguauuuucucuaaauauauuuagauuuguuuuugaacaagaaaaaaauugauagcagcuaugaacauuuuuuucuuuuuuucauuuuccuccuugauauaaguuacauuuuaauugucuuuuggauuguuuucuucagaauuuuaaucauaaaauaaaugaaauaaauaaaugcaaucaucauuccauuccuaucaguaauuucuauuaguguggcuuuuucuguguuuguuuuugucauuuagagauggcaucucccuauauuacccaggcuggacuccagcuccagggcuccagugauccucuugugucagcuuccugaguagcugagacuacagguguacacuacugcucccuacuuugugugugugugucugugucugugucugugugucugugugucuguguguuugcauuaguuuaugggcaacuagaacacguuagaugcuuuuaagcaucgauuuggauaaagaagcaguauuaaaaauccaacugaugccauacuucauggaagaaaaucauugcauuaaacaggaauuacacauaccgauaugaauuaguugauccaaugguccuuugaaauggaaguuacauuuuuaggagauggguauagcaaaagcagagguguuuuuggaugaugagcaauaaauaggggguuguuccuagauucccagagacuuacauaaaguugggaaugggagaaguaagugauggggacaagcuaaauuuuaaauuacucuuaaaguacuuuguuuagauuauauuaaccugucaaugugacuaaaaugucaacagaauucucuuaaguuuuacagauuuguagaugcuaaaugcucaugaacugaacugaauaacaguaaugagguaugaugauuugguaauuuuauuuuaauuagcaacaugaguaacuuuaaccuuuauuuaagaaaauaaagguaauauacacauguguauuuauuauacaaugggaaaaguucccuuugaaauucuccaugugguuugguguauuggcuuaugccuguaauuccaguacuuugggaggccaaggcagguggauagcuugagcccaggaguuugagaccagccugggugacauggugaaaccccaucucuauuuuaaaaagaaagaaagaaagaaauucucagugcaacagucuuuaaaucaugaaacuguucaguuggagaauuugcauuugcuuauugauagcugcauaucuacuauugugaauuuaauaucuuauuuauuuacauuuaugaauauaauacuauugagaaauuaggcucuauucuuuuuacaguggcauuuuuacugauugaucuagucucaucaaauauaacugagauguggaagccauuaucauaguucuuaaacacuauugcucuugagcaggggaugugagauacagagcauuguggaaaaaaaugcuauucuggaaaaccacucacuccuuugaaagucaaagagaauaaacaauguggaauuugaaaaaaaaaucacacugaaagauaaagguauauaagcucacuuaacuauuaaugauacaaauuaaucugcaaagaauuaaaagcagcuuuguuaauggcagaagacacaugcaguuaauaaggacauuacuucucauuugggguuagauuggcuucuccuuuauuaauaucuguuuaaacuacaaauagaaagaacuccauucuuaccagacuucuugucacaagacccagucucuaaagagaaauaucauugauaggaaaccagaaagacuaaauagauguauuuggucucacaggcaguccauuaauuugcucaaauuaaauauuaucuuuaaauauugaaagguuaaauguacaccgauaauggauuuagacagcuauuaagcuguaauugcuuucuaaugcaguuacuaaaagacauuugauauaacauauugagaaggaaggauuagagacuucucuaccucaguuuuaacugagaguuuuauggcuuuaauucuggcaguuguaggaauuggauaacaacaguuuuuaugagaacgcacacaauaugcauaaaauauucagugggcagauuguugagggaaugcauuauguacaguguauuuauguucauaguuuuugcaaaucuguaccagcaguacuaucagaucaacuauucacccuaaauauuuuucuauuagaucuaaaagucguauuucugaaaauguuaccauuuuaugguuucgaccccucuaagcugaauuaauguguuuugugcccuggauauaugguuacaguagugaccaaauuaauuugaaaacuucucagucuguuggagagucacaucuaguucagguagucaaacugauggcuuucccugccuggguaggcagcuuucuuuuuaguauucgcauuguuugaauuuguaguaugagauuuucacauuuuuacagguugcauuuugugaguugagugucuagcugugacaaauuauuguuaaccuaagaacauaugcugauugauacagucagccacuugccuccagaguucaauggaaggacaaaaaauuuuuggaaaagaaauaugaaugagagcuaggcucuucaaaacauauuuuccuggugaauuauuuaaacauaaucuaaguaugaguaugggucaggaaaaaaaauuaccugcaguuaagauaucaagccaaaguauuuuuugaauugaauaaagaaagggaaggaaaaagccugcuguugaucccugucacucauguuuuuguauuaauaggcagcaucugcuauuuguucuauuaauguuuuauauuaacauuuucauuuaguuuccuuuuuaaaauggugaaguuacagaauucacuuugguuucacaaaccuuuauggagaaauaaaugcauaugaagaucuguucuggggccuggggaagauguuuaaauuccaggugaugccagggccacugcauggcacccccugggguuguacaugcacauuguauauggcagccgcuugcuuccuucaaagaagagugugauaauaucugugcuuucuguugaacuuucagaguacuuccacagauauguuuuuaauacuuuuaaauccucagaaauaauuugauuauuucaguuuuauacaugagaagucauguucagaggaguacacacgaauauaaggcagaaaauaaaaaauauaagaauuucauggauuacaaagaaauaaaccacuacuuccauucacuguaaaccagagaagaauauauagggaaguuagaauucaguguguacccuuauuaauaaaacuaguguuuuauuaauaaacuauaauaaacuaguguuuauuaauaaauuaaauuuuuucaaauuuuuucugcuuucucaauagaugcucuauuuucuccccuccuccuauuccacccuaaaauuaaaagagaaaauacauuucuaaauuuuacugagauaguuaagcacagaauggaauggcauuacccauaagagucuaauauauaauguuuauaauccuuuaaaaguagaauuaggguucugucaucucaauauacuaugcugacuuugagauuucuuuuagucauuaaaucuguucugcaaaucuuuuuuaaaaaaauuaugagugacuuuauguuuuguuuuagauaauuuuaucacuaccaucuaacuaauuuuucuuuauguauuuucaaaaauuuaauaaugaauaugauugcaauaugcuuugagaccaggauagaugcuugcuuguuuuuuucuuuuccuuuagacuaucaucuuuuacauaccuuucucuuucucuuaaaguaaguggaaaaauuggauucauugaauuggucuugauacuaucuaggguuauaacauccuaauauucugugagucuuauuuuaggacuugcauauuuaauacaguuuuuaagucuuugaucuccuaaauaugcuuauagcagccgcuaccuucaccacacccaaauccuugaauguuaugauacaucauacuacucaugcuggauauuuacugaucugcuguguucaagacagacugcugagcuucguaaacuuuaccacccaaacuaaagacagagaguaaauacauaaacacagggaguuggggacuuggcugaaaauugccacccaaagcuugaaauuuauuugcaugcuggaacaaagaauauccaugaacuugaaacucaggaugacguauguuugauguuuauccuguaucauuauguauucuagggcaccacuucuguauacccagauggaaaucccaauuuuaaagcaaugcucuuggguauugagggguauauuugcgaagucacagucaucauuuauuccauguucccuugccuucuuuucugucaaguacucugagagucuugauguugaggauuuauuggaagcaaacguuguuaccuaaaugaagucuagugaacaaaaccaccaaaagaggacaugaagugacugcuauguauguauauaugauauauuuuuccucagaauuaucuaagugcuuugguugguugcaaauguggaauuuugcuguuugucucuaagucacucuuauagaaaugaucugugugugugauaccauaggaugugcuuccacugggcuccugagcagugggaauauauaccugaaacaguaugugacacuucugugcuuuuucucccucugugguuucuguucuuccuauaauguacgcaagugcaaauaugagcagugagcgaguagagagaaaacccuguaaguuuugugcucuacuuuagguguaugugauugcuucucuugcugugccauucauuucugauuuaaaugucuaaugacucucaucaaacaacauuuaaacuuucuaugagauccuguaaauguuccuuuagaucauauuaugaguaacaauggaugaaacgagcuuuaauggggaggcugcgguucaguccggggguucugcagcuguuggugauggcagaacacgucaauugaacugcagccaugcguucaguggcauuuugcccauuaagcgauguauaaaaacaguauuccugguacaguuacauuucauuucugcagcguuuucacagucagcacuggugugucccguggccuggccuuuucuccucuuggcgacugaaaaaauaaaagcccagugcuuuaaggugguguugcuuaagcaugaaugaaaucacucaaaaaaugucuucuuagcauugaaaaaauuggucacaagucaguaauuaauucauuuuagaguaaguucaucuuggggcugacaaagagguguaguagcuaauuuuaaaagaugaguguaacaucuuucccaugucauacaugucaagauuaaacuuaaauuauguauuauauauuaaugaccuuaauuuuauucauaaacuacuguaaguacaacagaaaucaauuuaguucuauuucagccaucauuucugggugugaacuucuaguuucuauaaggaauaaagagauaggcaugaacuaguaccugaccucaugaagcauacacuguaguuggagacguauagaccaaaagcaauccuagauggaaugggauauuugaaugagcuaaauagaggauugcuuugcacuuagagaaccuucaguaaaugaguguugaaagaaaguguguucaagaguuaccuuugaauuuuagauauuuauaugucacuguggacuuccugggagcugacugaaaauggugauugucauugucauuugacauuuuuuagucuaccagucuggggccuaauucagcauugaaaauaguuuuuccuguuuuaccagaaaaaguagaagccaggaguuuguuuuucucucuuuuccuugugcucuuuuaaaucuuauuucccucacaguugagcaggaggaggaaaaaaaaaguccuauuuccuucaucuuauuuuccacuaggcuuuugaggaggacgagauauucugaagcauauuugaaauaaauugaggaccguaacuuggcaaguaugaggugcaggaauaauccaugugcaggagagacggugaaagauuacucagagguacagagccauggagagucggaaggaacacuggaaguuucucguggagauggaaaccugagaacuugacugugguuaggacagguuggaggaguccuggguggugcugaagaggcucgguuccggagucaggccguugagguugaagccuggcucugccauucgcuaacauugugaccuuggaaaagcuuaccuaccucucugagucucaguuugcucaucuguaaaauggcaagaguguccacuucauggauuugcgaggaguaaauaagcuaguccguguaaagugaugcauacagaaagcaccagaaguauuagcugugauugauugcaggagccacagcaugcagcaggagaaugauuuuugagguguuugaagaauaauauguaaagagggcugggugauaugacucacgccuguaaucccagcacuuugggaggcugaggugggcagaucacuugaggccaggaguuggagaccagucuggauaacauggcgaaaaugccaucucuacuaaaaguacaaaaauuagccaggcuuggugcugggugccuguaaucccagcuacucgggaggcugaggcaggagaauugcuugaaccugggagacggagguugcagugagccaagaucgcgccacugcacuccagccugggcuacagagugagacuucgugucauagaaaaaaaaaaagaauaacaugaggauguguuugguguuggcauuuuggucacauugaagcagggagggaauggacauuucuuucagaaccaugcagcccuaaacguuaaacagagagguuuuuggggauaaguguuaagauuuugauguggauauuuuagaagguugggcguaacagcugauucaacccuuuuuuaucaccaucaaugaaaagggcuacauaaagauuuaagaagaggaggacauucuuuucuccacagcuggucaugcgcccaguguaguuggcaggaaaacggauuguuuggaaugugucccuaaaauccuguaauuuaauuuucauuauuuauauaacgcaguccguauauguggcgcuguacuacaugcacacaagaccaaauuucuggccaguguaauuuuaccaaagaagagacuguaacugaaauauuuguaccuacuaaauuaucugcagcuugguaacucaccguuagggaguccaugugaucccaaucagcaacagggauuggaggaacgcauuguuggcagugaaauaaggggucaggaacuagaauaaauagugcugggaugguaaacgggcccauguuauacuaaauguaauauaaagucacugacuuugaggaguccagaaaaauaaguuuguaaauauugacauuaaaguagcaaccaguuugcaugcuacuauguaaaaggaaacuauuaaaauaauuauuauacguaguuuuuugcuugcagcacuuguuucauucuguucacuuuuagaaacacaaauuagaaaggagugagucucuugaugugugucuaagagaaguuagaguaagauuucuagaaaucacgagauauauaacuuggauaguuuauaguuuucuacaaguguuucauguuaaaaguuccuacauuaaugguccuucaaugaauaguauuuaccucuggaauccaggagauauauccacaguuaccguauuggucaugcuaggcaagggcaugauuuauuggacuugauauuaucuguauauaguucuugcuuuucaaaacagucaucuggaccgggaguaagcuaauaaggccaugcacugcauaauggcguuucggucagugguggacugcauguaccacuuuggucccauaagacuauaauggagcugaaaaauuccuaucuauauuucuuaucauuauuuagaguguacucauucuacuuccaggaaaaaaaaaaaguuaacuguaaacagccucaggcagguccuucaggagggauuccagaagaaggcuuuguuaucauaggagaugacagcaccaugcuguuguugccccugacagcgccaugcuguuguuguccagugagacaagguguggaagacugauauugaugacccagacccuauguaggccuagacuaauguaugcauuugcaucuuuguuugugacaagaaguuuaaaaaauaguaaaaaaagcuuauaaaauaaggauguaaagaaaaauguuuugugcagcuauauaguauguuuuguuuucagcuaaguguuauuacaaaagagucaaaaaguuuuacaagaguuaagaagcuuauaagguaaaaaaguuagaguaagcuaaggucaauuuuuuuuuuuuuauuaaagcaagaaaaaucuuuuuucuguuuuugagacagggucacucugucacccaggcuggagugcaguggugcgaucuuggcuuacugcagccuccgccuccugggcucaggugaucuuccucccucagccuucugaguagcuggaaccacaggugcgugccaucacgugcagcuaauuuuugcauuuuuuguggugacgggguuuugccguguuacucaagcuggucuuagacuccugagcucaagugauccaccugccuugaccuccuaaagugcugagauuacaggugugaaccaccaugccuguccaaagaaagaaaaauaagaaaaaaaaaauucaauguauccuuaauguacaauguugauaaagucuacgguaguguacaagaauguccuaggccuuugcauucacucaccauucacucaugacucaccuaaagcaacuucuuguccugcaagcuccauucauggcaagugcccuauauagguguacaaucuuuuaucuuuuauacuauauuuuaaauguaccuuuuuguauguuuggauaugcucagauacacaaauaccauugugauacccuugccuguggcuauuuaguacaauaacaugcugugcagguuuguagccuuggagcaauaggcuaugccauauagccuagguguauagcaggcuacaccaucuagguuuguguagguacacucuauaauguucucacaaugacgaaaucaccuaauguauuucucagaauguauccacaucaguaaguaacacauaacuaauuuauugcaaggggcagaauguaaaccauugguuuaguaguuuuagauugaguuaaaaaaaaaagauauccuugagguuagugagaggaaucaaaaucaggggacaguguaggcauuuggggucaaaauuuauucagcauaugcuagcaugccaccaggaaccagaaggaauaaauuauucugacuccauucuuggcaagaucuguguggcuacagaacguaauuauuuugcaaaucauuuaaguugcugaccacagcuaggagauuaccaccuaagugaagauuaccaccuagauggagugugauuccucccugggauucccuuucagaauugucagaaaacaaagcaguaaauccacauguuaaucauuaaaauaaacgaagugcaauaugcccagcaaaucauuucacacauuuucuauuucaaggaauugggauucaaaucuuaaccuaaauuuuacauauucacauuuuaaagcaucacucagacuuguucagauuacugagcggaguaaggguuucaucugaacacauagaagcuggcugcguucuugaaauggggaggaugggguuggugaggucacaaaacuucuuuucagcucccugguugcaaagaauaugagugcuaugacauuagaugggaauucaaguucuggucuaaauugauaaaauagaguuguuauuuuauggccucaucuuuguuuuuauauaucacagaaucacugcgaaaauggcaguuuguuuucuaaagaggccugagaccagagcagcaggucacaaagcgagcauuuuacagcguugucagucagccuauuuggcugaacugaauuucccagggcaaaaguuuucuuacaacguuucaaacaauucaucaaaaagauggccuaggaaguauuaaaugucuuacaauguaaauauagacaaggcuuuauuaggaaagugugcaccuguuuauuuauugacuuauuuauuauaauagccuuucaaguaguuuucuugauccuuacacucuucacacaaugaguguaaauagacaccagucauaguuguagguggugagcuacagagcucuguauugauuagaucuucaggcugucaaaacaacuagaaauuuuaauaaauguuuucaaacaagugaccaguuccaucuaacccaucagaauguuuuauuguaaauauaacauggcugucaguuugacagaaauugucuucccagaauaauuuauagugugauuucaaaaugcauccagucacaggcuuuuaggaauccugucauagaauauuauuuuaugccaucauguuuuaaaaagacacagugauaacauugaauaggaauagugcaaugacacugaagugcaguuuuagaugggaggggaagucuuccuugcuucagcaaaucagguguuugaaguuuaaaaacugcuuaaguggauuuguaguaaagcucugucuguuuuaaaguacuggugacucaacagcuguggggaaucugucuggaaucggcgcggaacuuuggagaauguuuucuccucaggagcuggaacucaacucuuccucagcccacacaaugcaggaucugugguuuucugucccuguuucuuuuucuccauuuuucuccccuucacuuacucugauugauggaaacacgugcugggagcuuucccugacauucuuuccaaagacugaaaguaagaaauguuaugguggugcuaugucuauuuuugaaaguaagucuguuaacguaaagccuguguugauauauugggaugaauuauaauggugauauuauuacagccuucaaagcugaaaauuuauuauuuuucucaccuacuuuugguugcugauacuugaucauaggaacaugcugugcaucugguuaauuuuggggaacccauuuguagauuuucaaaaguuaaacuuuauccuucuuuauaucuucuccaggcccucuuuuguuauugaaaaacaaauagaaauacaauccacuacaacuucggugcuucugcuuuucuggucacucucauuauuaaugcuuauaaugaagauauuuuuggaaacacugacuuaucauugguuuugcaaauacaguaaaaauaauauuguuuguuggaacucuucauuaugauucuuuuacuuuuaaauauuuaauucauaauuauucuuguuucuacaucuguauuuuaauuuuuauuuguuuuuauuuaguuuuaaagacagggucucucucuguugcccaggcuggagugcagaggcaucaucauagcucacugcagccugaaauuuccagguucaagccauccucccaccucagccuccugagucgcugggacuacaggcccgugccaccaagacuggcugauuuaaaaaauuuuuuuuguggagacgaggucucacuuuguuacggaggcuggucucuuacuccugggcucaaaucauucuccugccucggccucccaaagugcugagauuuacaggcaugagccacuggacccugcacuuacgucucuauuuucaaauguuaaaugucuuuauguauaggaggucauguuggauuuuaaaagucaacagaaauugauaggaagcagugugcagcccugaaugaaacucuuaaguuaugggggaaaaaaauaccagaaccuaugagugaaauuauuuuuuaaaaucucgucuugcugguagacagguuuuuuagagacagggaccgcaucuucuuuaaucuuugcuguaucccuuguucccagcauauugucuggcacagaguauuuaauacauuaagugggugaauaaaaaagugaauggcgccgggcguggugucucacgccuguaaucccagcacuuugggaggccgaggcaggcagauuaccugaggucaggaguucaagaccagccuggccaacauggcaaaacccugucucuacugaaaaauacaaaaauuagccaggugugguggugggcaccuguaaucccagcuacuugggaggcugagguaggagaauugcuugaacccgggaggcagagguugcagugagcugagaucccgccacugcacuccagccugaguaacauggugagacagugucucaaaaaaacaaaaacaaaacaaaacaaaaaaaaccccagaccaaacaauaacaaccaaaacaagugaaugggauaacuuggugcugaguuuaagagccaagguucauuuccuugguaccuguugcuugacuagaagacaaaucugucguaaaugaucaaaaaaauguuuacauagacggauguggaggagaauuuuauguaugcauacacacagaauacuaaguggcauuuuuuaugugacagauucauuuccaugcauauuccauauuguaagucagucuucacaacuguuuugugaaguagcagaucccuguuuugcagaugaggcaacugaugcauacauagguuagguucacuuuuccaaaguccuagaguuuuuauuuggcugagccaggauuugaaugucagcacuuuagucucuuucuagaguuucugugugcaaucacuacugucuauuaccucuagcaguuuaucacaugcacaauuguucguaacaccuggcugugcaugauguacaucuacagguagacacuucauguacuugcugugguaguacucuagaaacacugguaaguucacauguuaucaaagaaacuccuguauccgcucuccgagugcugaucuggucauuuucugcuugaugacgccagucuuuugaguuaacucguaggugugcauguugguuucuuuaaaguguuagauuaugaaccauagggcagcaggugauuaauuucugcaucauaagaauucagcuacuguuuuuaggaauuugcuuacaaaccaucaaguuugcuuauucuuacagaguuuugucuuuauuugugguauuguaauauauaauaguuaguaucugaccccaagagccuuacaaugaggccacgaagacaaacagaauuucgagaagucagaaugaagaaugguccucaaaagagaaaggauagaaucuugggguuuuauucuugugagggauguuagaaaugaucuuaucucuaaguaauggggagagaacuuagcaaaauccuuaaagagcaggggaguccacuuuagugugaguuauuuaacuucucugugauuuguuuaccuuucuucaaaaauggaaugauaaugauacucagcccccuaguauguugugaggauugaaugagggaauaaacauacauggaguacuuaaaacagcucuugcacacaggaagugcauaacaaauauuaucauugaaauuaucauuuuacaauugaggaaauugaaucccagagaaauuaaauuacuuacucaaggcuaauccagcuagcuaaugacugagccagggcuggaaucuugacauacaugucgucagcacucuuguaauauucaacagaauuacuguaaagcaauccucuauuugacaaguaauaauacauaaucucugcauuuacuugggaugcugaauauauacugaacuucuugcuguucuuuauuuuuucuucugggaacuauauauugggugauucuuuuaaaaaaugugguuauaugccaacauuaugggaaaggaaaaaaaaacuuaccagacuuuucuuccauacauaauccaaauuucaaauguauuaauuuugccgaaugccauggcaacauacauaucuguuuuucaguucaugaaagguauuuugggaauuauuggcucaugcaugcuugagcguuuucgucuuucagcuauagaaauacacuauguauccucuucauuuuguguuugugcuucuauucaagaugagaauaaaagcaguuaguuucuggguuguaauauucuucagugaacgguggcuuucuaaaacaguuacaccuugacugaaaugaaaacucugcuguaucauaaaagauauucuaauuacugcaucuaguuaaaaggagaauaaaucacugggagauuauuuuaagugccuuaaauauaauaaaaaagaauaauggacguugaacagcuugacagguuugaugaaugcagacuauggcugauuucugcugcuuucuaauggaaaaggagagcauuuuacuuucuagguguauugucaaagcaaauuuuuguuagggaagauaaggagaagccuuaucuuuguugagcacuugccuuguaccaggcauuagccaaggcaguguauuaucucauuuaauuucauuuaauccuccccaaccuuguagauaauguuauccccauuuugcaucuaagaaaaaugaggcucagagaauuugaauaacuugccucaggguauauagcugcaaaguaggauccagacuagguucuuucucuuuauuucauuaccccaguaggguugugaugaugauguaaauauaaauguaaauauaauugucuccacuguuacaaagauacuaauuucaucccauuuaauuuagaaugguuguguccaaacaauuuuaacuucuuugagccucuguaaaaugggaacagucaggucacugugaucuaaaaggagaauauaugugcaaaccucuuugcuuagugcuugacaguaaauggggagugccugggagauuuguuuuccauaucaucaacagacaaauggguguucccaacugauucuaaguuaagaguuuuagauguuuaauuaauagacucauaaauugugccuguaaauuuaaaacgguaucuguugaguuuuucuaaauguauuuuacagauuagauggugauagacuuucuuaaaauguuguguuuuccauuggauuuugccuucauaaauguaugaaaauauauuuaguuaguguggacaugauugcagugcuaauacauggcagauuguguguacauauauguguguguguguuggcuauuguucuaucuguaggaggguaaaaaucuaaauggugggcaaauaaaaucagaagaaaauguugguuaauuuuuggauuauguugucucuauaagagaauguuauuacugguaaguauuuugcaaaguuuuucauccauguagugaauaugaaacaugucuucuugguugacucauuuguaucuuuuacaguacauuuugggugccaguuuauagauucuuuuccuaaaaucugcaaaguaauagaagaguuagaauucaguaccuaagauacagagauucuauuacuccaacccccuugccauaugaagaucuguguuuaaaugagucaagaaaauuaacuuuuaagauucuauguggauguaugaauuuauucauauuccaacauucaguugauggcauuuaugggaacuauacucauggaaacucagaaacaaagaaacuuuuauuugccacuauauucacacacuuuaguaguucuuuccuaaaucucuuuugaaguaaagaauacuauaacaucauauaguuuuguguucacaguuuuacaccuaauuuuacacauucacauuuauagauaugcacaauuacuggacuuacucuuugcuuguguucaaauauaaaagcuuauagaaucuuguaccagcuaucaacacauucauccaaauguauuccggguuucuccauugcugcugugguaguaaauauaaaucuacauucucagugguauuaguuguucuuagucaagcaugagaggaacuguauaugagugucauuaucuaauaauuuuucuaacuguguuaaauaacgucguauucucccuuccuuugccaugcugaaucagcugaagagacaaauaaguacagaagggaugaguguggcuucauaaucagggaugaauguguuaugauccaucuugauccaauaagcagaugaauauuucacaacugcauuauuuuguaagugaggauacugucaguuuuguagcaaagguucugguagauaagauugucuuucuugaucuuuuauaaguaaauuuuuauuguaaauuauuuaacugcauucucugaaaaauguacuuuuguaucagagaaauaugcuuaggauauauauguguaagaauuuaaaggacagguuuaguuaugggccaaaaucuaauguuguagcaucaacaugauuuuuauuaagaaaagagaauuugauguugagaguuuucaguucacauacagaauaaguaaaccuuauccuauaaacuacacuuauuauugguauccguguuuuuaaauguuuuauguguaccucaucaaaaugagaucaugaucuccuaauuuauagugauugugauuauuuaaaacuagcugaacuaggauaacauaaauaguguaaaaagggaauccuacaauugugauuacuacauuaaaaaugcaauuugcaguauaaaaugccaugugaagguuaaaugauguuaaagauaauaauguguauaaugaaaucaagaauagagcauuuaacaggaauguaucacuuuaugggcauagaaggcaagagagaucuuuacacugucauuauuacguacaugguaguauuuucuaauucaguggucuucaaauuguauacuauggaacucacuauaugaaagagauaauuuuuuuacaugggcacaaacacacaauuaccuuagcaauggcugaagucuuauucuuaaaauauauucuuuguuuuguuguauauuuuucucuaaaauaaaauaauuugaacaaaauaaauauaggacuauccuuuucaaaguaauagucagcgauugaauuuuugaaguggaaagacugaaugaaggccuguggauaaagacgaaauccugaaauaucaaaaaacaauaguuuauucacaaaauagauguuugugaaauaaaaguuaugcccuuugcuuucucaauugugugauauuuauaugucuuaguguuaaugcuuguggaguagggacuuaauauuuguuaacugaauaaaacugccuaauucuaugaagaauacuaaguuuauaugccaggaauuucucuuauuuuuugcaaauauguaauaauaauguuuuuuauaacuccucagauauuaugauuuacucuugauuaggcaaacugugggaggaguaucagauuauacaacaugccaaaaaacauuaauuauauuucucuguaaugaagaccugcaaauaaguaaagauguuuguaagcagucaaaguagaugucaucaaguucauguguuaaauuuguuuugggcagauagugaacagucauuuacucuauuagacaaaauaucauaauuagugaaaacaauauucuguuuuuuuuguuuugagauauucccuuuguuuuggggguucugcagauuuccugugauaugucugcaucugauuuuguuuauuuagucugcuucuucaaugugcugacuucauaccuugcaaaaauucugaaaucuucucaacuaguauuuguguauugccucuuccuuacuccuccucuguuuuuuuaaugaaacuccucuaagaagguuuuggacaauucucauucuauauuaugucuauuuaugucuauuuaauauagucuacuuuuuuuuuugcaucucuguuucauucacuagaauauaagcucucugaggaccauagucuguuuuguucaauaacguauauugagcauuugaaagagugacucagaauggauguccggugcgcaaguggaagcauuuuuugaauaaaugaacgauuucuguguaauuuauucugaucuguuuuucacuuuaccuagcuuucauuggucucguguauuguauaauucaagcucuguuucaauggcuguauuuuuaauuuauugguguucuauuugauucccauucaaacuuaucuuuucauuaugauguacauuauuuuugucuguauuaacacuuuaaauaugaucauuuaaaaaaucucuuucaaauuacucuauuugucaagaucuugggggcacuaauccuccuuugugugucuacugacuuguccacaguggauaaguuuguguguguuucuaauuuuugauugugagcucaucuucaucugggauguuugucuccuuuggaaguuugugcucuggguuaugggacaguucuuacaaagugguuuucuguuaguuucugccaauuucucaggaauuucauugguuuggcauuaguuuuuacauuaauuuuauggcuugugguucccaaacuaagcaaauaguauaaauuuagauucugcaacugcauauggaaaaguuuucaggguuggauuacucauaggcaacucuuucuuugcccaccaaagcccuugccagacauguuuucuggccauuucccugaaucagugacauaagaaucaguagccuuuccaaaucucuggcuuugugcaggggucuuaggaccugugccucuguggguuuaaaaacuccagccccuaucccuuagggcccauagaucugcuaauguuuccaguucuguguuuuuuguucuggcuguaaauucccucucagaauuccauuucuuuugaguuuggguauguauuuaacuuuuuucucaucauguuuuauccaggcuuuuuuuuuuuaaauggagugugugugcgcgcacgugugugagaguguguuuggaggaguguauuauuugaaccaucauauugcugagacuagaaauccccucucauuucuaagaucaauuauuauguggauauuugcuuucuuuuucugaguguaauauuaaauacgaaauggacucgugaaccuggagaaugucugucagaaauaccgaaccuuccuucuuucauuuucgccuguaaaaucuuacaauuuuuuuaaagauagauauacagccaucuagagaauacacagaagagugauuugguguucaucuuuguguuugcuguuugcugaaggaucacucgcuaagauacgucuaacauugcuauaauuguucuguuucccuuugaauugaauauuuaggguaaggcacugauaugucaguaggaugaccaacacuaaaaguccaguauccugggaaaccucugucuuugguagaccuggauugucaccuuagucuuggauuccuuccggagacugaagaaauccuuuaaaaacuuuccugcuguggagucuucuggcucaggccccaacuacaguguuacauucagacuucuuuguuagaacaaaguuuuacauauauucaaauaguaaggauaaauauuaaucuguuuagaaagagagccuugaaaggauccuagucuuuuugcauaggaaaaauguccccaaucaaugagaaagucuaggagcaugaucaagacuuauuuuauauaguuugucuuuuaggggguacugguggauuauacuuuuagaguuacauucaguauuauuguggcuggacuaaaaaccccucaagaauacauuucacauugauuuuauuauagacaucugucaagcaaagcagaggcaaaugauagcauacucauuuaccaguaaugcaaaucaaaugagcuaguggcaacaaaaucacuccugacaccuuugcccuuuuucucuugauuugaacuaaugacgugugugugugugugugugugugugugugugugugugugugcgcgcgcgcagacuagcaaaauccagacuagcaaacaaaggccaaugacaggauaacuuucauaccuucaugccugggucacucaccauguacgauaggagcagugcauucucuugugaauuaaaaaucuauuuauccuuccugggugcauaagucccauagaaggcugggaggggaaguggaacucuuuauauaggaggggcuuagaccucaauagccugucccuuugaaugacaaaaugcccaccagccuugccacaaauagcuucugaaauaugagaaccuuuuuuaauucuuaagauccuugaccacugcaacuaauguaaagacacacuccgcaacaaacuuauacacacacacguacacacacauuuuauucuguuuuauaggaauggcagucuuuagcagugcauaauuuuuuuauuauuauuuuguuugagacugggucucacucucacucaggcuggagugcaguggcaugaucauggcucacugcagccuugacccccuccugggcucaagugauccucccacuucagcguuuugaguaguugggaucacaggcacgugccaccacgccuugguaguuuuuguguuuuuuguagagaugguguuucgccauguugcccaggcuguucuugaacuccugagcucaagcaaucugcccaccuuggucugggauuacaggcgugagccacugugcccggccaacauuccaucauuuuaaaagcugggcaaaaagggaaggaacuaguugagaaaggaagguucuauggccagaacaucagaaugcuuguuuuuaguuuuugcaaacauuggugaaauaauaguuggcuuuuuuguaaagccuuuccaguuggaaacugcaaguacuuuuuuuuuuuuuuuuuuuccgagacggagucucgcucuguugcccaggcuggagugcaguggugugaucuuugcucacugccagcucugccucccagguucaugccauucuccugccucagccucuccaguagcugggacuacaggcgcccgccaccacacccggcuaauuuucuguauuuuuaguagagaugggguuucaccauguuagccaggauguucucgaucuccugaccucgugaucugcccuccucggccucccaaagugcugggauuacaggcgugagccaccacacccggccagaaacuggaaguacuuuuaaaaguaugauggaagauacauacuuuguaauauacauacauacaaaauuuguucuuugagcaaauuuauucaguuuuacuggcaaugaaacucauaauguuuacuccucagaaauuuuaaaacauuuguuuguugaauguauuuauuguuucuaucggcagucuuuggaaaucugucuugugauaguucuaauaauaugguuugaauacagcauugucauaugucuuauauguuggggcaacauucuaauaacuauacauuuuuuaucuuccgauacguuuuucugaauaacucuuuguguugacugcaaguauguuuuugcagagucaccaaguucugaaaguaugcuuuuaggauggcacuagguuacuguguuuguauuaaguauaauuguguucuuuuguagauuuguuccuauagagcuaugguuucauggucugaagcugaaagagguuuaaagaggucaucacaguuccuccucccacccuuacuguuguuaaauaugaauguacguuugacuauuggaggaauuuuguuucuagaacuuucaagaguaauuguuuucuguaauuuauaguaggaaaauauugauuuauuaauaguuaaaauguucuuugggaugcuugaagaccaugaugugaaaaacuuaaaaaaauuagcauugauguuguuucuauauauuugccaaugggaguacuauaacuuugaaauguaggggauuguuugaaacaugaauugugaaaaauaacgcaacuuuaguuauuuuauauuggguccaggcuaguccgcugaagaguaugaaguacaguuuuauguaaaauauaucucagauugagaauguggaaacacuguucuuuaaaaaaauaaaaucuucaguaagauccuuuuaugaauuuacugguuuguucucauuugucaucggacuguuuccagauguaaaauauuacuuucuugaaauugcuguugagucuacuaucaagaccaggugcauguuguuuuacagcuauuuuacuucugauuuuuaaugcugaaacucauagaaugccuugaacugauaauuuguuuaacucucuaccuacuaauuggaccaagaaauaacuuuguaucuuuaucucuuuuccauuucauguuuuauuucuguuucaauuagugugugccuuuggcaaaaaggagaugauuuugcuuucuguuuuaggauuugccuccaagaaaaaauauauuuuauugccacauuuucucaauugauccaguagaguucacagacaaugaaaagaguaagaaaacuaauuuuuaaagcuugguaguguuauaauuuucuuccuuauaauaaucagaaaaagaauuuguauaacuuuuguuucuaauauagcaguucugaaaaucuaggcuuacacauuuuccuucccauuacugcuguuuauacuuaaguaaaacaaaaauggucgcugcagguuuuuuucucauuuuagugcagaguuugaauucuucaaagacugcuaagguuuucccaccuuaacaauuuaugacagacccuuauaucuucauaggcugaguccgcugcuaagaguuugcuaacucaugacuuuaauacaccaguagagaucacacuggaguuaaaacaaagagagcacgaacccugaaaugauuuaagacuguucuuagcugacuacuggaacacagugucucacgugguguuauugguaaccuuaaugcagauuauaauucuguaguuuaaccaggauguguuggcuaugguaaagugccuuuauaaggaauugugaaagggcacaaggaauggaaacagaaccucaguuuucucaguguaaaugaugaugacaagaauucccugugcacauuuguuguugugagaaagggugagauagaauagauuggacacauaguaggugcucacuguuaguuuuucucauucauucauuacugugucauucuauuggcaugcucacagucauguaguggaauaugaaguuacaucgugauauuuuucauucauucaccacugugucauucuguugacauguucacaggcauguaguggaauauaaaguuacaucaugauauuuuaaaagcuaccgaugugguagauuucacagucuugaaaagggguuuuuuuuaagcugaauuuucaguuucacuugagaagaguccugauuugcuuguacaaagagcaguaggguugcagagaaggaaagaaggcaacucuuuuaagucccagccgcuacucugcugugucuuauucucuaaaacagugaagaagucuggguggacauucuaguggucagaagccuaagcuuugucuuuugaugagugcagacaggggagggagcaacugacgagggaguagaggggcuuggagccccuucccaagucuaccaucccucacuuaugugucucuuccucaguaaagcacccccagugcccuuauuugcuguauuuuucuucauggaacuuacugucuaugggaccuauuugugcauucauuuauggugugucucugcauugcuuucccuuucacuacccauguaaguuccaugaaggcccagucuuaagcauuacagguugagcgucccuaaucugaaaugcuccaaauuccaaaaccuuugaacacugacaugagauagugacaccuuugcuuuuucuguuguuccaaaguacgcaaacuguuuuaugcacaaaauuaucaaaaauauuuuguaaaauuaccuuuagcccauguguguaagguauacaugaagcugcauaugaaacauaaaauacauuucauguugaaacuugguucucaccccaaaguugccucauguauaugcaaauauucaaaaaucccaaaaaauuagacauccaaaacacuucugauccuaagccuuugagauaagggauacuuaaccuguacuggguccucagugccuggcacaggguggaugcucaguaaguauuuucuuaaaagaaagaacaagggaaagguagaugagacgauaagagguggagguacagggaagaagaacacagaaacauggugaugaaaagaacagucugauaccuuauuugggccccagaaaaugauugguacugaagggauuuuauuaguggucauuuaagaaacuuguguuguacuguuuuuguguauuggaaggaggcuagacauuguuacauggaaauucacaguuacauuuucacuaaauguuucauugugaaaaacgucaagaaagguuggagaaggucuaggaaaacuuaucuuugaagauacugucuuaugaauuuccagcucagacuugcagcuuuugggagcugaggcuaugaggugaucuugagagcagcugaggaggcucuaauggguuccagcugugugcccagagaacccacccucucaggauaacauuaaccagguagacccugcccugacugacuuccucugggcuuuauggguccccguggucuguugcauugaucuugcauuuucagguuuuauagcaauucuaaacaugugaggguacauauuugcucuuugaugugcccuuugauagaagccagagugcuuuaccugagccugccuguaauaaugggggaagguggguugcaugcccugcagccauacgcucccugggaggcugguuuuauugcgguuguugauuggcagacuuuaaucagggguguuucuuguuguauuuuugaacaugaaguauauuaaggauaguuaaacauguaguccugcugguguuuuguuuuguuuugaaccacauuuuguuccauugugccacuugauagaaaggagggcagaauggaaacauauggggagcagaaauaguaacacuuaugucauauaacuacacuguguuggugauuuuuuguuuuuuuccauguuuuauaauaccuuuauguacaucccuauuaagaaggcagcuauugugucuccauuucacagagagguaaguuaaggaauguggaauuuggaaacaugcuugccgguuaguguggauggaaccuaaauuagaauucagagcucuuauuacuagauaggagaccaaucccaggcagucauggcauuucugugaacucuuucgaagaguaaagggacaggaauugccuuuucagaguagaacucagugcauaucaguggaauuauagaacuuuaggguuagaagggccuuugaugggaccauccuuuaagcuagaacugccucuugaaguuugcagugugcaugaccugcagcuccauuguuuauauuccaaaucuaugaaacuagugagagaauaggacacaucuuuguauguuuagguuugacaguacuuaucagaaguggucauauuacgguuuucuaucuuccuuugguggcuuuucagcuuuccuugguaccagccuuccaaaagaaauuagcucccuugugcccucacuuuaauuuggaagagauugguuuggaagagccaccaagggcccacuagacagcuccuuagaaguugcugugacuuggcagauggcaccugagguuuaaggauuggggaucuagccauggcguguugaugaugaugaugaugaggauggcaaugacuauuaacuccuuaauccauauuuaaucauaucaccagaacugaugguuguucauugaagauucacuucaugaaguacaagcuaggugauuccuuuuugaaaauaacacugugggccuaagauauauggaccuuauguggcuuaaaaugacccacuucucugugcuuacuccuaauuaccuucuuauuucuuugaauuuaguaaugggaguaaauccgacuuuaaagccauuugugguggcaaacccuaacuauucaaugaaauacaaauuugguacauuugcauccuaugcaaguuuuauauuuuugacagcuauuuuuguauuuaagcaagaagccgaaauaaaaauuucuaaacagauaugccagauuauauucaccauguuugaguauaguauugauuggucauggcugauguuuaucagacuaagcaaagugugucuguauuaguugucucaagagggucuuuauucuuaaaugcuuaugaauuccauaauaagucuuggaaaguggaacauacccaagcacaauuuauaacuuuucuaggcuuuauugguauucugagccauccagugaggacuggagucauucacaugauagaauaacacagauaccauuuauuaaucugcugaauauugaucacauuuagcaaauugcugaauauuaguagugaaauacuauuccucuacaaaauaguaguagccauaguaguagcaaaauuauccucauguguccaugcaugauuuauauguauguguguguuuauauauauacaguguauacauccauaucucuauauuucuauuuugcuaucuuuguugggauuuauaagguaacuuuuaauuauuuuccuucccccauucucuacuuagcgauccuuucuuuauaccaaucaucaugguaaacacugggaauauaaagauuaauaagucacaguaccuauccuuagagcuggaagcaaauacuuuuuauccagcauaaugaguguuacgagagaugguauagaaaaugcucugguaggccuggugugguggcucaugacuguaaucccagcaguuugggaggcugaggcagguggaucacuugaggucaggaguuggagaccagccucgccaacauggugaaaccccaucucuacuaaaaauacaaaaaaauuagcugggugugguggugggcaccuguacucccagcuacucgagaggcugaggcaggagaaucgcuugaacccgggaggcggaaguugcacugagccgagauuacaccacugcacucccgccuggaugacagaacaagacuccgucucaauuaaaaaaaaaaaaugcaaaaagaaaaugcucugguaucccagaaaaugccuacucuguuucaggaaugcaauucagaaagguguaccagagugucauuugcagucuagugguaguuucauagaaugucuguuucaagaggacccuucucuauagaucuguaguuuuuauuaguuauaauuucuucacacuucugucagaaauguuugcuguuaauuuugaacacuguuuuucaugugaauauauuuuuuaaguggauaucuuuuucauuuuguuuuuuuccuccuggcuuuuaaauauauauuuaaaauauuuuuauccauaucuaauuuuugcaacuuucaaaaaaacuuucuaagcagucaccuccugacccucuuuuucccccuuagcuguuucccccccccuuuucagggccaccuccccuccuucagagcccccgcauaaugcuauuccuuuaccguccagccaucugccuguuuuagccucuucuucacucucucuguuucuucuauauagauuuccccauaugucugcuucuuccuuuauccacaaguccagacacuccuccauagcuuucuuaccaccccauccuggugucccgucuguucauaaauaacucuuucauccgccuugaaucccaacccccuacucuuucuaaaaagagugugcaaauaaaccuaaagugcacggagccaagaugcauagcauaguuuugauucagaauagacuuucuccuuccaaucaccuguuuuaguccccauuuuuuguugcuuggcuucuuuguacagauccacaauugccguucaauuuuuguaugaaaguggaugcaaaguuauuuaaugucuucaugacaaaguuuuugccucuuacuggcagguuauuuugcccuaaucaguuacacagucuugugcagccuagugguugcuauuuuggaguagucagguuugaaccuuuuguucuucagaaauuaacguauuaucucagaaacagcagucucugcuugcgugcuuggcaacacaaaacugcguuagguccuuuucuaagucugaguucuaggacaugugccaugaaaggaguguuaacugaaucaccugcagaaauggccacaaggagggcuuuguaauguucuagauauuuaaaauguugguguccuccuccuagcauggugugcuagugacaggcuccuuucucccuggucaagaguaaacauuggcaauuuacuucccuuuagaaauguguuacuguagccaucgcggaguugccaguguuuuuccuuccuaaugucagugauaauuuuacucacagauucccugcagagauuuuagcucagcaggaaguaaaucuagguaagauugccuugaaaacugaucuaaaacaauaaaugcuaacuguaucauuccuuuuuauuuaaaaaaaauuggaggcauaacuaacuugauuauuuguaacuggugagaucuaauaaucgugguuaagaccccauucguucauacauucucucguucucucucucacugcuucuuugccuauagaaaaauaaaagucagagauugaaaugauucacacuauauuuuuuaaggaugaaauaucauaguagaaaugaaagguagaacuguuuacucaugagaugcugagaaaaucuaaacuguagcuuuccuagaguuuaggaagcuaaauauuuuauugguaucaaaaucagaaauaucuaaagaauaagauauuuaguuuuaaauguuucauacuuucuaaaaagaguuuuugcuuuguuuuguuuuguuuuuguuuuuugagacgagucuggcuguuaccacccgggcugaagugcaauggcacgaucuuggcucacugcaaccuccaccuccuggguucuaguaauucuccugcuucgaccuccugaguagcugagauuacaggcaccugccaccaugcccggcuaauuuuuguauauuuaguggagaugggguuucaccauauuggccaggcuggucuugaaguacugaccucaggugacccacgcaccuuggccucccgaaguacugggauuauaggcaugagccacuguguccagccaaggucuuuuguuguuguuguuguugauagucaagaaugagauuuuacugaaacaaggacaucagaauaaaaagaaauguaaaaaaugggaaagacacugaaaauuacaacaacccauauuacucauucagauucuuuuuggaauuucaaauagucaauaaugaagagacauaaauuccuuggagaaacguagcuuagggucagcuuuccuuuaaugacacuagugcuauagucacuuauauguaguauuuuugguguuguccaauuucuguggauucugaacauuagcuguacacagauccaagucuguggcuuuagcauauuuuugcuuuuacaucuugucaaaaauauacuguuagaauaucuuagacucgagaagauuuuagaaaucacuaauaauguaacaacuguuauugguuaugaaugaacaaagguucaguuaaagaguauuuccagguaaggcuguacauauccacaguauauuauagagacuucuggguuaugcacuggauauuaaugguuuggauuauggugauguuucugaaugugugaagggugaaguucuagacuucauuuuuauuaaaugaaauugauuuucuuacccccaccaaauuacuuaccaaacauuagauaccuaagaucuuaaacauagccauccucuaaauuauuuguucuuuaaguguccagagaauaucgugcagcuuccagaucauggagaaaccaguucugugcucuugaaguugcagugguaggagaaauagcagucuucuaugacagauuuuucaacuuuaacccucucacucucugcuaauuagaaucauacggucauacacuuuugguuuuuuuuguguguaacaaauuuuuucuaaagauucaacaaaagaguuucaagguuaccuucaaguagguacaaauaucuuagcucuggcuucuuuuucucccaaauuggcuguggacuguaggagcuuaauuaguucaggcucagugcaauugguuugcuccuagggugugucuauacuuaaaacauuuuuuuauaacagaaaauacguuuuugaccacuuuucauaacuuccucuuguuguuuaccaguuuuaauuuuaucuuggcaauugaaaaucuugggggaggccaaucuaaaaaaaauucuuggauuuucaaguuggauauacaucgguuuccuaaaaagaacucucuuuuucaauaacuuugauaucucauucauucagccuguauuuauugagagcuuaucaugcacgugguguuaugcuuuuuaauugcugguaccuugaauauuuagagaaaaaauaccucgugcauuuugucucuguguguuugacaugucaccuuguugaaucugcaccaagaaaaugaugaauuccaaugaucuaugguaguuacaaggccuuagaagaaccagggaugugaauuuuuggucugcuuccuccguauuuccuauucauugagaaacgugcuuguaugcauauaaacaauuccuuacuauuuuucuuucuggagaggaaacaguaauggguggauuuuaucacaggacaaagacucuuccagauagcuguuacagucccucccucugcucaccugauuuagaugaaccucucuuugacccaccacgauggugguaagucugccguugcaguuuuguagacauguaugugaaggcgauguuuguuauggggucaguguugccuuaaggaugcgggcuagagugaggggaccuuuguggugggcuuugcagacuucuuggcagagggaagcacagaugcgugagguuacuauuuucaccuaucuccuccuuucuuuauuguuuacaggaacacuugucuaaguggugcacaauuuugccuugcuuacgcuucuagagugaaaaauaucuguccagacucccugggauagguugguucuaacaucuugguggauugagccuggaccaggaguuuugacuuagaauucauggagagaggugucuguaaauguauauauaccccuuuauguuugggagaaagcaucuguggagcuuaucuggguagcaagaggauuuugugacccagcaaagguuaaggcacacugccuggaaaaaucaauuaggauccaguugaggguuagaucuggccauagacuuugccugguguugguaaauaaucugaaagccuuaaagcaucucagaguaaugaaaggggcccaaggguucacagugccuuuucucaggauugcugcaaggauucuggauuaaaaauccuucugcugucuguggaacagaacauuuccugggaucaauccuugagccuuccauagacaaagaauuucccaaaacuaaucuugccccauguggugucagagguaaaauaagugccaagcaugagaagccagaguaaccuuuacuggaguaaccucugcuagaucucuuguuaucuauguacucuuagaauaucuuagacucgagaagauguuagaaaucaccaauaauguaagaacuguuauugguuaugaaugaacaaagguucaauuaaagaguauuuccagauaaggcuauacauauccauaguauauuauagagaccucuggguuaugcacuggauauuaaugguuuggauuauggugauguuucugaaugugugaagggugaaguucuaaacccuuuuuagauaggcaagugugaugugagcaguagaguacauuuuuuguuuuuguuuccugaaguggggcacauuucucuccccuuugugguucuguaaauacauuguugaguccaguggaacuucaaagauggcacauagcuacugaugacacacacaaauauuguaaguugauaaggaugucugaaauguuauaaguggcuaccugaugccugaugucaaugcugguaucuguaaagcacacacacuaagaauagagacuggcagcucaaggguguugaugguaauuuuauuguaucuucaagaaaguguguuuccagagaauuauuaucaguaauaaugacuaccaccuuguuuucuuuugccucauuucucuuucuucuuccaugaaacugggguaagccuuauuguagagagaagcccacauggauauccagcaccuagguuccgccgagggcaaggcggaaaugaacugaguuauuccauuucuguguaaaucggcgucauuugcuacaugugcaaguuuugggccagagguguggaaauuggguucacuguuaaucuaacuagugauagccuuuuuaaucauguauuuuaauaggaagguagcacaguugagggaccucuuuugccucuugugccuaagacagcuggguuugaaacucaguuuuuaaugaauuauuuaacuuuacugugucucauuuucaaaucuauaaaaugggguuaauuguauuuugcaggauuauacuggagaagaugauaguacauuucagauuucuaccacaaauauggcccucgaauuuacuuuucucuacuacuaagcaacaaaauaaaauugaggaaaugggagucucucuaccuggucuuugauuuagagugugguauuucuucauuauggguagaagaguauuuuucuuuauagagagucauuaaccuucaggaaaaaaaaaucaaucaaagguuacguggaaugaagaagcgaugucauguaauugagauuuuuuuuuuuuugauucaaaauguaaacucacuugauuuagaauugauuggaacauggcaugugaaaaaaacacaggagacauuuaaaacuguaccuaaaucugauauaguaguuaagaaagcuagcuuuauaggaaauuaaagggggcugauuagaguaagauaggagagagagggggaaaggggauaugguggguagcuagaagaaaggcauacacaugcuuagaaguaggaagccagagauggaggaagaccuaggaugggcuuggaaaacuucugaagccuuaaugaacugaucuugucacacacagcuguucauuugaguugugggccucagaguauuauuccuuuuuaucacugucuuuugaaaugcuaauuagauaauugaccauuguucccaguucuuugguuacuuuuuauucuuaaacuucuagagacuaggccuugaaugggauacucagagcagcacaccagaugggaaauuauucucuggccuucaguugccaaaugaccaccacaguagugcuugggauguauaaaauccagcugagaggcagaacuagccuaaggggugguuagcauacuucuugggauaguccuucaucaauagauuuuuauuuuguaaugaugaaggggacugccuuuguauuuuuauacagauuuaucagauuuacuuaaucaauaacuuaaucaauauugauuacuuaaucaauaaucauggucuucuugaccaugaaaggcucauuuaaagaaaagaacacuugaagaauaucugaaaaugauuagcaagauaccuuugguuuuucaugaaacaccauuauaagucuaauguuugaagaauguuuuuauucuacuucugaccuaguuaacucauaguuuuuuuuuuaaauugaauuagauaauguguaugaaagcaucuugaagaauauacacucagcacaaauguaagauuugauuaauaaggugguuauuaaugaauaccauauaguaacaauauaucugagucuugcagaaaaacauucuugaccaacaggacgugaucuaguagaagagcugccuguucuacauauuuuauaaagagaacuaaucauuuuucuucuguauacucaauccgauaucaggaaaccucauuuaggucuauucacacuguagaggcagcaaaauaacaugccugaccuuuucuauguaaauauuaaaaauuauuaaaucugcauguuggaaagauugauuucggcaauaccuucuaaauuuucagugaauauuuaaguguaaguuugcagauaguuucaugaaaauaauugacuuuuaguuuugguacuagaacaauuggaauauuggugguauuuuucauuuuaaaucugugugaacuaaaauuuucuuauuugucuggcaugaacaucacagaaaaauccuuucccuucaagcuauuuuuuuaaaaaaauuguaaaggagauacuauguauugcagaacauuuagcaaauagugaaaaaauaaaaagggaaagucaaaaauucccucuuauuaguucaguacuguaacagucgauuguauugccugggcuauuuuuuuaaaaaaauuguaaaagagauacuauguauugcagaacauuuagcaaauagugaaaaaauaaaaagggaaagucaaaaauucccucuuauuaguuaaguacuguaacaguugauuguauugccuggugguagucuuuauaucuguacacauauacauacaauuuaaaauauguaugcaauuuuagauuauuuaaauaaauucauacuuauuguuauauauuuuucuuuuucuuuuuuuguauuugcauuuuuaaaaaacugauaagaccugccaggguuaugugugcuguaguguuuccugaauuuauuuaacuacuaugguuuuucuguuuucuaauuuauuaauucauuaaacauuuguuauuccuuuguuuucuugggucaguuuuauagaagucauuuuccuuaaauugacuguugaguuaaauuauuucacucuuauguuccagaucaugaauuuguauuguguaaaaauuuggcugcauuccauaaguuuuguugauaauguaauauucucuguguuacuaguuucugaaguuauuuuggcaguuuuuuccuuuuaauacaauagcuaacuugaacucucauuuaaauuucaaagagauuaucaaguuuagcuuuuaaaauuuucauaacuguuuucuaguuuuauuaaaguguggccaguaaagaaacaguguauuuucugugucuuaaaauuucuuauacucuuagugucccaacaaaugauauuuuaggaauuucucaguauuucagaugagauuuauuuuuauauuuguaauaguuggaaauguggcuuauuuucuguaguguacauuuuaauuugcuuuucaguuuuuaaaguuuuuucuuaacuagaucucuuuugaaccuagaaagauguguuaaacacucccacaaaauaauacauguuucucaugcauaagcgauucaugaugacuguguguuuaugguagauauuuucaucuuugaucuucaguacucccucuuuuauuauuaucucuuuuuuuccauguauuauuguaagagaacuuuucaaguuugucgucuacaucagugacaauuuuucuacaauuuuaugcaaauuuuaauuuuguuaaugcauuuuuaguuuucuuacaauauuuccuauuacauccaucugcuuuuacaucucuucacaaaucuuuuguguugacaccuauuuuauagaaauauucuauuuuauauaacugucaaaugugauguuuucuagacuccacuuguauuuuuuauagggugaaaauguuuuucaaaguauaauuucccucugaauuaugaguacauauuucccuauauuuuauugugcagauuuuuuucucacuacacaguuuuuaacauguuaaacuuuaggacgcugcaaaucugccuuucuuaauauauucugugauguugaggcuaacuacauauauuuuguaaagagguaugcuggucuccaugucagccucuaccaauaggaggcgcuggagggagaguagaaggcuagaggaggaagaacuuggccuuuccuguucuuguuaucaucacucugguaacaucagucuuuuccaguuuuuaguuuugucuacauuccuaaaauuaaccuccuuggagauaacagccccagucugcuggugucucuuccucaucacgucucucugagcuuacaggcucuggaaacccaaccgcuucccuguuuccccagccguggggaugguagcuguuuccauccgacuguucaugggugcuucuucucaagucuaaagccagaggacuguaaauguauguuguuuaagccacacauccaaccauacugguucaggaaggcagcggucuuccaguaguuaguuagcuuucuaaaaacucccuuuaaaaaugagacuuuagaaagaggaugacaaauccugaggacucgugucuuaagcaaauuuucugucuagauauuuauuauaaaccuaauugcaucugauaagugcuguguaugucauacucuaucaaagguaaaaggguuauuaaaguaaccugcacuuuuuagagcaaugguggauggccuugcagaaggcacauggccuuuaucagucaacucacuguggggaagcuggagaaauaaaguucaggugagaguaagccgacaguucuggugugauuuucuugggaggauaacguauaauguagguagcaaacacaugggagaaagaagguuuugcauuaugagauuugacuuaauguguacaguuugcuuuugguguuguaaagcaguaaagaggcuuauugacaucucuauugaaggucauugcagugcaugaaauguaaaucaaaguguuauucuuuauuagaagcuagaagauaacauuuacauaacaugcuuuuaagguaaugaguuaaguucauuauuuuuuauuacuauaacuguuugaagaaaguuauuuucaugcuaaaaauacuccuacuugaauccgauuugucauaauuuuugcaugauguauaaucuauuguuaggaaacgauaauuccauuuauuuuuguuucugggggaaaauuguuagacagcuguuucagucuuuccaaauaaacucgcuuccagaauuccuaguaaguagcaaugcugguugauaggaaugucaccauuuuucugaccccccucagccuuaucacaaagacauagugcagaagccauauaagaaauuugagaaaaggaaaagauaccaaggccuagguauuucacaaacuggauaauuagacucugaauugcgacgaauaggcugaaagaaaaaaaugucacaagccuauaguggcuuaaggaacacugauuucacagugaaaucuuucuacauaaauuuuaugguuaacugguaauaggaauaaaacuguggagcaaugucagacaauucuguuaugauuccugccuaaugaauggcaggcuuucccuugguauuuucuccuuaaccugcccauugcccuuucuguaugaucacauuuucuuuaaccaguucuuugcucauaaauaaagccguguguuccgguucaaaaguugcaucuucauuuauaaauucacagaauauguuuuucagggaaaaauguaacucaaucagcuuugcaugguuuacauaaugugauagucucauauuuacuaugugguuaacaagaaauaacuguuaccaacaaaaaucagagaauuuaaaaacaacgaacauuuugcuugggagccuauguauaucucuauauaaauacauauagacaucuauaaacaucaucgauccuucccaugugcacaugccauauauauguggaugugggaugauacuuguuuuuauauauacauaucuauauuuauauagcugaagaagugaaacauauugcuuuuuauuuaagugacucaaugcguuuauagacaagcuuuauuuuacaguacuuuaucaaugccgagaugauaagauacugcuuugauuuggucuucuaaaggucaaaauuugaaagaauaaauugauuccuagagacauucuuaugcuaucauuggccuuauauugaacagagaauuucuaggaaaauuauuauuccucaauggaaauaaaaauucauuuuagguagcuuaaucaauuugaauuauucauuuauggcauugcuuucaauuguugaugaguguauuuguguacuggguguggggaggucuucaggggaugggaagguggagggaugagaagauucuuauagcacuaaacugaauuuucaauucccugcuaaagugugaagaaagaagugaagugcuucauuuucuucuuuuuagaaucauuuagcaaccacaguucguacuuuauauuuuuuauggaguacuuucaacaacuugcuuuugcaguugggaaaugacacuuaccuggauuuucuuggguucuuuauucaugacaucaaugaagacuacugcuaaugaaccauagaugaaguuacacauaugcuaagcagggaaaugcaggaagaaugugaagguccuagaguaucucaauucagcauguaagugaguugugugcacaguagcacaguucugucuuauggcuggucaaugcuccauauuaugaauuuacauaggcuuuauuuuaggcucugaaauaauuauuuuuauuauauuucucaaauuugccaaaguaucucugagagagauucagaucccaucuguuugacagcugaggaaauggggacaguugguacaaugguuucucaacauuagaacacaucuuuuuuuuuuuuuuucuuuuuuugagacggggucucacucuguugcccaugcugaagugcagugguaccaucagggcacacugcagccuugaccugccuggcuuaagcaauccuccuaccucagccuccugaguagcugggaauacaggugugggccaccaugcauggcuaauuuuuguauuuuuuuguagagacaugguuucacaauguugcccaggcuggucucgaacucccaggcucaagugaucugcaugccuugggccucccaaaguuuugggauuaaggcaugagccagcacgccuggccagaacaugucuuaacuuuuuaagauucaugauccuguugggagucuuauguuguugcuaauguugcuuauguaauuuacuuucauaauguccuguuuccaccuauuuuucccucuuugugcugaagacuauugaagagcauugacuagugacauucagauaauagucuggugaguuuggguugaauguucuuuuuuguguggcaugcuuggauauguguaaauauguaagaauauagggaacuaaaucuuacuuuucaagaugcuaucgugacaccucugcuuguuaaaauguuggauaauugugagaaaacacacaaaaaaauacaaggaccccgucacacuucuuuauucucuuucagauuuuauacacuuaaacagauuuacagcaaaaaauccuccaaugacuuuuuaaaaacacuguuauguuacugauaaacugauuuuugucugugucccuucguauauauucacacaauuuucauauuucuggguuauucauccuugcuucacauguguuaucucacgguuaaaaaaauuuuuguuggaugaucaaaagcaauuaaaacauucuuauucagugcuuacauacuuuuguguucuuuuucugugucauuuuuucauauacagaauauguuuuccaauaguuuacauucugaauuuuuuaaugaccaguguuaaacuguuagacuuaccaucauuuacuuaagucucuccuacauauuuggugauuuugguuauuucuguaucuuugcacacguuuuuucauuuuuguuucuauuuucuaauaugcaguuuuuauagcuucuugauagagucuuugaaauuuuguuucugugaaauuguguaguuucauagaacuaaauuugcucuacuuaacuguaccugaugaauucauauuagcuauaaauauuuaaacauuuuauauaacagacagcaaaucaucauauugcugggaauguaaggaagauaaacuccaugcauucuagaagucauuagagauuuugcauauaaagaccacagcuaguuucaagaucuaaaucuugaagcaggcauucaagguguuucaauaaguacuuaacgguaggccauuaauucauguaaucauuuaggauaaaugaugggcagaaaaguuacugugcaaaaaguauuauuuggagaauaauggauauaugaaaacuuacauaaaugauuauuuauuguaauuuuuguuacuuucaauuucuuggucauggcaaaaauugaaaugcaaggucaaacagaagagagauggagaaagcucuaaccagcaagggccuggacucucacacuucccugauuggagcugcugugugugucugaggagucaccauugcuuuacugcuuauaccuaaacagaaguauauguagcuuugcuugcacugaggauguuuauaaauccucuggguuuuacauuugauuuacuuucuuccucagccuucccaucucauuugaagacaccuuuaguuuuuucauuucucagacuuaaccucuagggaauuauucauaucuccauuuucucuuauauuguacauuuaaagucuuccuaaauguuguuagcuuauauuuauuaucuaucgcugcauagcaaacauuccccaaacuuagugauuuaaaacaauaaccauuuuauuggcacacaaaucuguauguaguuuaccugcuuggacugagcucagccaguugguucucuuguugaugucaaugguggucacucaugaggauacagucugauggcggguggacaggagggccugguugguuuagggagccaucaacugaauuggcucacuucuguuccaugugguuuaggccuccagaggauagcucaggguucuucacaucaugguagaaaaucacccagccgcacaaaagagcaagaucaaaugaguaagcacuuuuuaagucucugcuuacaucaugcuugcagauacuccauuggucaaagcgugucauguggcauaguccaguaucagggugcuaagaaacuccacaaaaucaugggugaaggaugguguuauucauuaggagcucuuauuauaaccguuucccacaagguucugacuuuuaagaauucaaccacuuuuccuaaccucuguugcuaggacuuuguagcacucugguaauagucugcuaacuggacugccugcuuuagcccuugaccuuagucuguuuuuuaauggagcagugaucuuuaaaacauaauucagauguuauuccuccucuucucagaacacuucauugaccuuacaccuuauuuaguuaaagccaaagaccuuaaaaugguauguggcuucccugguaccucugugauaucauuugcuuucucucccacucuacaccagccacacucuuucuuaguguucugcaaaugcaccaugcaagcucccaccucagggucuucacauuuguuauccuuucuguuaggaacacuugacucagguucuccauaguuggguccuucaucucucucuucacucaaaugucauaucagaaagccuucccugaccacacucuugaagauuacagucauuuccucuucuaaugcucaccaucguguuuccuacuuaguuuuucuccauccaggccuccggaucacucuccauccugcucugugucucaagaggcuaaccuucuacaguugcauaaucagacugccuuucucucguucucucagucuucugguuggguucaccuaaugggaagcuguagcuuucccuucauuuugcuuauaaaccuuuaaaaaaaaacccaaaaaaccagacaguauauuauuuuagauuuagauaagaccaaacuaagauuuagugagcauuuuccaugaaccaauuucugugcuuucagauaugucauagaaaaaguuaagugaacugucaucccuguuuaagagucagggauacugagguugagguuaaaugacuuguucaagguaacaguuagaaaauaaacaaacaagacuuccaaacucacguccagucaucuuuuccaucuacagcccugucuccguaagucaucacugaaugaucgcuguuacacacaccuuuggaauuugucuuuuaucacauacacaccaccaccaccauuuucuggaaacuucuuuuaaacccaaucugacuuuuuaaucaagucuauauuugcuagucucaauagcuguuaccuucauccucuuacaucuaagggcauguucaccaggagucuuucuccggaaucaccaaccuccucuucucuccugacucuucagcauuuuaauaugcucauuucuccuaucuuaaaauuaaagauggauuuuuaaauuuaaagaugaauuuaaauacgcccaccccccuccaaauuuugagacuaacuuuucucuucauuuuguucuguccuuuucaagccaaguuuucucacacgacauucuguauauaaugugccaugaucuggcuucuuuccacaacacucucugaagauuccaccucaaaacgucaucaguagcaugugugauuggcuuugaccuuucuacugcuuuaccucuuugaagcguuggacuuuggaacacagccuucuucuauaccuccuacucucuuucaaaacucagcucaugucuaccucuucaugggaguuuuucuuaacacagaagacugaucugauugucccuccagcuuguccucuuguaugcuggggcauaugccagcaaucacagcugcugagaugcuuagucuuccugacggaacuguaguuuuuggaguggucaggaucaugucuucagaacuugcaccccagccaugugucugcacguaguucagugaccagaacauagucaacacucaguacaugccugaugaaugaacaaaugagugugaccauacuuaacuuggugaggccauuuuuuuccgugaguuuuauacucuggguuguuuuccuaccuuggauucucugacuuuuuucucucucaucuacuugccugacuuucuuaggucuuuuaacuuuguuucuccaucuuuacauuaaguguugggauacagggcugaacaagaacagguaacugucuuauggcuuuacguuuauguguuuuccucugaaauuaggcaaauuuccuaaucuugcugaaguuauuuucauccuuaagaaaguaauauuauaggucuuuauagaguggggcaggaucaaaugagcauguuuauuaauugcuuagcauuaugccuggcacaaauucaauuaccauuauaugguaauaauuuuaauaguaauaaaccauauauuacacauguauuauucauaaucagaugauguaugcauuauauaaaaauuguacuauucuauaaauauuguaaaaaaagaguaaauaauauacaucaauugcuuugugcauccauauauuuuuacgugugcuccuuuuauuaaaucauauguuuuuccucaguuuauugguugcuuuuuacuuaccaaaagcuucuguccaaaaaaaaucaaaugcugcggcugcccugagcagaguucaccuuggaagaggcuuuaauugugaugaaccuguaagaacaaaguuuaagaauugagauaaucagcagcuguguauuucuuuaaauuuuuauauuuaaugauuuauuugaauuaacuguuaccacguuuacaucuucuagauuaguuuuuaggccuuuacuuuuccuuggcuguggguacugaccagcauggugguagguaugauuggggugugugugugugugugugugugugugugugugugugugugcauggauagauguguguguaugcucauggaugugcaugugcaugcaugaaugcauaauauuucaaacacaugcucagugauugagucacugucaggaaguaaacuuggagaccauguugcucgaugccacaauaguccuguuauugcauugucaccacaggaugccauuaaaauagguaugaagaaugucaguguucauuaauuugguucucuucagagaacauuagccauggggaaaagauacaguagaaaucugagaagagauggaagauaggagagaaaccuggcuuuugaagaaugaucuuugaucuuucagaagaggaauacaugucaagagcuuaucuaugugaaagaauuuacaugcaaagcaaaucaagaacauagauuuugcuuaucuuuauagauuauaguuucaucuuagauggcaaagaaaagccaggcuucucuauacaaagggauuugcauguuuaugauaacucaauuagccuuaacagagacuaccaguauaugcuggcugucuggccucaaacuuuaaugcauauguauuuucaaagagaacuaaaagauuuugggauuguaacacagagaaagaagagauagagaauuaucaaacauuggggaucagcuuuaaaauuauaaaacaaauuauauauguucugaaaaauuacuucaggaauaagcagcuuuuuuuuaaauaugagaaagcaaaaucauauccuguaugccauuaaagguuauugcguuuuccaaauuuauaguugcaagugauggaaauuuucuuuaacaaacugaaggaugcauuuguagucuaaaugguagcuuugagaguaguuagauauuuauggaaaaauuauaagaagcaaugugcuuuuaaaauuuuuuuuucaaaaauagauauugguuaggaaaacuacacucuuucacuauuugguaaugcauauucugacucauucacacagucauuguggcaccuaaaguguugcaaaauuagacauuuauauggagaugggcuauugauguaaaaaaaaaaaaaaaagcugagggcuaggaaugauaagacaugaguagaggguuuuaaaaaugagcucuuuguuuuccacucuucaucaugccuagaucucagagagguuuuguccagugagaauaaagaacccaugggaauuaugcagaaaucacuguccaguaaaaggaauaguuuuccuucagugaccaagggugggaccugaagucagcacuagucagugacgcuguuuuaucgucuucaugccaggugaagauuugcauaggugaaaugcccacuuauuaggagaauuacacccugacagaaauccaaaagauggugccccuuuaucuucuaucaggggauuucaucuaauacuagaaggagcaguaagauaccaugaguuuguuaccaguuauucacuggccugauccugaaggucauugccuuucuucaguguuauuugcucaguauccugccugcuacccuuaagcacuuacuuugccuauugaaaucuuacuagcuauucauucagaaguaccaguauuucuuucaagguugaucuuaugaugcuacuguauuuuuucuugccuuuuaauuauuuuuuuaacuuuuuauuuugaaaaauuuuuaaacacaugcaauguauacacaguaguagaauaaucuucugugucaccaucauacaguuucaauauuuaccagcauucugccuucuuggcucaucuauauauaccacucccacucgauuuugauaaauucuuaauaauagacuaugagauccuugaaauuugaaacuauaauuaaauaucugucuauagacaccauacacauauauauacagcuauauaugcacauacacacauauaugcauagacacacacaccuaccccuuuauuuuauuuuuuauuaaaauguaacguauccucauuguggagauagccaauguuaauauuuugauuacuguguagauucuaucuuccauugguuuuuaaaaacauaacaugaaauuuguuuauugcuuuuaaacuucauauuuuaccaugaauauuuuccaauguccuugaauguuuugaaagugugauuuuuaaaggcagcguaauauuccaucacauggaucuuccauaauuuauuuuaagaguuugcaacuguugaccacaucuuaaacuccuugcacauaaacacuugucugcauuugcaaggauguuauuaggauaguuuccuagggaauuauuaggugaaaggcucuuuauguaucuugccaaguugcuaucuaggaaggcugugccaauuuguauuauuuuuaucuuauuaacgugguagucgacauaguaucugguuguguucuuuuagaaauuggcauuuucuggauuaaugacacugaacguuuuucauguucaugauucuuauuacauguguaaaauaagguguuaucuggaauuguagugaaugguacaugccauuuaguuuagcuccaaaucuagugcuuugcagcaaugauuaauuauuuuuaguauuucacaaaucaguuuuugcugucuuuggaccagaaugucugccuaagugcaaguuacauuaguugagaguuggucuuauuuuacuuuuugaguauuauuuuaaaaaauugucacuguguauaauuuucucccuuuaugucauguaacuuuauugagaaaugcaauucaaucaggaauaauuuaguuuagguaaaacuucuuuguccaagaaauauacugucagguccaaauacauuuuaaguuuugaaaaaaauauuuauuuagauaaaaauuuguaaucacucaggguauuugacuggauuugaagcauaauuuacuuccagaaugaauuuagaacucuguuguuaaaguacuugguacaauuuguauauccaguaaaauaaaaguugccauuuuugcaagucaguguuuuaaugcugauuugguacuuuugcuaugugaaauuccccauacuccaguauaggaacugaaugaaaacauauaccuuauuaaaauaguagagguaaguauuuucagcuuccuaaacagcagagaaugcuuuuuuuuuuuuuuuuuuuaaacuuuuggaauuacucuauuaccuacaucuaaguugcaaauccaaaaauaaaacuaggauuuuauuaacauauucugcccuucauugcuuccgguuauacuuugcugaacuguguucgaguauguugaaaaauaauuccguguauuguguguugaaaaugauauuaaaaguauauguguuauguggaagaaacaaucaaaacagaccuacucagacaucaacaggauauuauuaccccaaagaaaugacgacaguuugccagcuugaugcguaaaggaaggaaauuuacaaacaucuccaagagaggcauguugaacgguugaaggaaaugaggcacguccugcuuuuauugugcuuauugcagugggauucccagaagacugaacaaggcuguccugagaccucuguuuggcagagaucuuguugauucauauuuuauuuuuguuucagaaaaggucugcuauuguucaaauuucuaauguagcucauaaacacacagccaguaucauuuccccuucuacugacugauauauacaaauaaauuaaaaucuacggucaucauuaacucauguucuguuuccauggagcacaggagaguaacaaggaaggccccuuaaaagaaaggccuuuuaaaguggaggucucaguucacaaacuuuaaaaguuuacgaaguaguauuuuagaauuuuaaucaccagauauauugggggaauuuauuacuuccuauucauauggaagaggacagcagagguaaauauuuauguaacuuguauuuuaaaagcuuacucuugauuaaaauguuugaucuaucgacuucuguauccuuagaaguuugaauugcuggacauauuugacugggguuuuuacaaaggcuucuagguugaaaugcaugguucaggauuuugguuucaaauuucugucagguuggacacauauaaaugagaaaguaauguggaauauuauaaacauuucugcuuuuuuaagcucuaacuuuuuuuugcuaucucuaccaaaaugccugaaaaugucaugacucuuuagacggagaaauagaggaauggaaaccauucuggauccucugcugugacucagucagucuaaggggcagacugagcgcuauaucuggaguuuuacuuuaugaaugugcaccuuuaaccuugagucagaaaaugugguuacugucagucuuacucaguaaguggugcugcauagaacaucagggggagacuuggccuugguuuaguagaaacuugaaggagacaaacaugaaaagcagugucagaaaauggaagaccaguguuaaaaaucuuugguuuugcuuucauuucucuugguuauuucuuaggauuauugcuuuagaucauuuucccaggcauuuucauggaugaagaauuccaaagaaaguuauuauuucaacucuugaaagcuacgcuucagggugaagguagggcuugauuaucaaaggaauuucccuggcugcaguccuaacaguuuaacuuccugugauuuccccccgccccuuucccuuuauuuuuggcucagaacuucaguaaugucuggauugauggaauuccucugggaggcagauuugagggucuaaaggugcuucucaauaaagauuuugaggaaugauauuaacuuauuagaggcaacccucuauuguuuuaguauaaaggggaugagauuugggggaaucauuuuggaugucacauuaagccacuagccauuuuacucuugaugaccuuaguugccuuuaaacuguauuuuuaguggggaucauucuuucaacaguccauucuuuuuuaaacgcaauuugguuuauaauucugggggcugccucuacaugcuguacugucaagagagacaucaaauauuuucugaguaguuuucaacacagugaauuaaagcugaaaaaacaaguagcgauacuaccagcaucuuaacugaguaugugguggugguguuugaguguuugugugugugugugugugugucugucugugugaguguuuuauguugcuguaccuacuugcuuuuagguagcuacaguuuuaccagagaagagaauaacuuagauuauaucaaaguuuuuuuuuauauaaugguuuaaaaaccugcccugugucuaguacuccuuuacgaaguccgcaagacuuggggauaacaguggacaauaauguuccuuaaggacuuacagaaauaagacacacacagauauauuuaaauuccaauuaaucugauuuuuaguguggauuauugaagggcuaggaacuuagacucagaaauggaguauuuuuccuguuuaaaauguaaagagauuuaauaacauacaggagucuugcuaugauuuuugagaggagauuuacucuaauguuucagauaaucuguuuaacaguuaauaaaaauacgauuuacauuuuguuuggauuuuuuaaagucagcacauaauuucuaaaaguaagcaaauuucuugcagggauggugaaaugaaaccuuguagcauuuagcguguauugcgguuuuguuauuugcaguuuguuauuaaguguuccuaggaauaaaaggaggugcacagcaacaauguuuacugugccgauuucugguauuuuauaauuaaagagcaagugugagcugggaagggugggcuggaaagcauggauucuggcucuaaaucucagcucgaccacuuacuaccuguaaccuggggcaacacaguuauuuaauuucucuguaaaaugaggauaauacaagucccugcuucauugggcuaugggaauuaaaugagugaaugcaucuaacauugagaacaguguucagcccauaguaacugcucagugaguauuuuuaagcuauuagcaugaucaaauuuagagaggagaaauauaauggagcaguuucucaguucuuguuagaaauaaucauuacauuugaaaauccaacaaaauauuaacauucaaaacccauuuucagaagugguggugguagaauugcuauaacggaggaaaauuuaggaauggcagccugguuaaaagaaagggcggguagaccuggaguagguuauagaucaauuuaaagcagcaaaguuuucuaaaggugcuucuaguuuuacuuuaaaugaguuugcaguugcacauaucaaauaauaagguguuauuugccagaggcauuuuguugguggggggugggagaaaguuuugggguauauuguguguguuggggguacauuuccccggcugccuuuuuccacugcugcugguccucuggucaggaagccucccugucccgcacugguucuguuauuuguucuuggauagcaucaacuugaggaugagacuuuauaggcaacacauuagccucagugucuccuccugguuguagucauuucccgguuacaugggucaguuucuccaccuuacuugagugaaugccuagaaaggcuauuucagccuagagaauuuuuaggggaauggagaagcugaggguaacuccucagcaccaacacuugaacccaaucaauacuugauagauuacucccagcacacacaauacacccagaaaucuucuccccaauccacacccaauuaaguuucagccaagguuagaauucagugguucccucuguguguguccccuuagcuguugcuguucaggugcaaagguguucauuucuuugucuacccauguguaguugccugauauccaacuaaacugcaucaaaauauggaaccccuagguaggcaaaaaagauaauuagaauacaguaguccccccgccccccuuaucuguaguuucauuuucucuaguuuuaguuacuguccaucagcugugguccaaaaauauuaaauggaaaauuccagaaauaacuccuaaguucuaaauugcucgccauuugaugaaaucugcacuguccuuugccaucucauccgggacaugaauccuuacuuuguccagcagauucacacuccagacacucccugccuauaagucaccucuagguuuucagauugacuguuacuauggcagugcucagguucuagucacccuuuuuugacuuaacuauggccccaaagcacaaaaguagugaaucuggcaauucagauaugccaaaagaaagccaugaagugcauccuauaaguuacaagggcaaaguuccccacuuaagaaaaggccaggccugguggcucaugccuguaaucccagcacuuugggaggccaaggcgggcggaucaccugaggucaagagaucgagaccagccuggccaacauggugaaaccccaucucuacuaaaaauacaaaaauuagccagacguggugguggacgccuguaaucccagcuacuugggaggcugaggcaggagaauugcuugagucugagaggcggagguugcagugagccaagauugugccacugcacuccagccucagugacagagcaagccuccaucucaaaaaaaaaaaaagaaaaaaaaaagaaagaucauaugcugagguugcaguauauuauaauuguucuauguuacucuuaguuauuguugucagucucucacugugccugauuuaugaacuaacuuuaucauagguauauaugcauaggaaaaaucauagcguauauagaauuuugugcuaucugagguuucaggcaucugcuggagaucuuaaaaccuaucccucucuuagagugaguacugugauuauguuuaaauaaaugaaugcaugcuugcuuguggaaauauuuuugugugugggguauguauauguguguguguguguguugcauguggacauuuuaauguguguguauuauccuagcugaugguuuuccuuuggacauuuggguucauuuuguagaaagaaaaugcaguuuuagaaucaggaagcugauuggaugauuccaucugaauauauguguguguauaaauaaaauauauuaucaaaagccugacuugacuugggaacugggaaguagcagccucagguccuccuagguuuauuggaguuacacuuauuaguaaguagccuaauccucucugcaaagagaggaaguacaguuuuaugauagaaucacgugggaugaggaucauugaaccagagagaaacugcugcuguuugauuuccacugcaggucaucaguauuucuugaucuagaacaaugauaaaaaguguucuggucuuuaagcaaaacucagauuuaggcuuuauccuuagaaucugaucuuuaaaacuggaagcacaagcuuuccagcuuugaauucacuccauuucagagaugaagaaaccauuucucaaagaggugucucuguugagguuucacagugaacaagucaggucagcugaauccaggucuaguguuauuuccugcaaauacauuuuauuuuucauuuuugcaguaaucuuuagauuaaacccacuccuauacuguuggauuaguuaggcacauggacuggguguauguuucccagauuugaagguugguucuccaugucauaguuauuuguucugguugcuuuuuuuuuuuuuuuuuuuugagacggagucucgcucuguggcccaggcuggagugcaguggcgggaucucggcucacugcaagcuccgccucccggguucacgccauucuccugccucagccccccaaguagcugggacuacaggcgcccgccacuacgcccggcuaauuuuuuguauuuuuaguagagacgggguuucaccguuuuagccgggauggucucgaucuccugaccucgugauccgcccgccucggccuuccaaagugcugggauuacaggcgugagccaccgcgcccggcccgguugcuauuuuuucucaguuuucuuaucuguacaguggcgguaguuauuucauagaaucauacugaggacuaaauaaguuauuucuuguaaauuacuuacaugaguacccagcauaaguguuagcuauaauaauuauuauguuauuaaugauuaugucauuauuauguauuguugauaguaauauaauaauauauugcuuuuuagacacuuuaguuagcuauccagcauaugacaauaaaaagguggcucuauugaagagaaggauuccauaauuuucuugugaaauuagcgccauaaaucauugaacaucuugcuucaguuuugugugaauuauuuggauugacuaaguacucuugguacugggcugaguuaccaucugcuguguuuugcuuccauaggucaggcuuauucuccuagggaauggugagguggaaaaaaaugccaauaaccuaaccccaaaauguauccuaacugucuuguucacauuuauaggacaguuuuauugcuguagguaagacggauaacugggcacuauuccagcaucuuggcaguuuuccuuuuuucaagguacuaauauuaggauuagcauguuguuuuaaagccauugccuuucugcaccuuauaauugcuuguucuugggggaggcuuggaacauuugaauuacgguuuuucugccaaauaugggagagguugucuguuuuguuuuaauacuucgauugguuuuuaaaguugguacuacaguccauuuugccaacagacaacacaaauuagaggcagugugggcacacuguguauggggcagaugcagagaggggcagcgaauaugcaugagcgagaauguuauagcucugucaguuuuuguaugugugccucaguuuauuuuugguauugauaccaauguucggcaauacagugauuugccuccucuauuuuguuucuaaaucaaagccuuggcagauuaaaaugacuaggaaaagauuaaauuguuaaugguauaaucauauuuuucucuaaagcauugaagaauuacagugucuauacuuauuagcaugugauaacuuuagugauugaaauguuuagcuaguuuuacucaaauauuaguaggauuucuaauuuucauaggagagccuagugccacaaaaguuacugguaacuagcacucuucaguuuucaucuucauguaacuguugugagcauucaaggaaggagcugggaaaugguuuagucuucauagaugcucaacagaugugaguucucuuuucucccauguauacguuucuuaucuuuuuguagaguucaugggagcagcauuuauggauucagacuuauauuguugacaauguccuugcuaccugauagaugaucaguaaguguugcagaacgaauacauaugagagcagcagagauaggaguacauuagggcaauuagaauagauuccuuuuuuuguuuguuuuuugagacagagucuguugcccaggcuggagugagguggaucggucucacugcaacuucugccuccuggguucaagcgauucuugugccucagccuccucaguagcgggacuacaggcaugugccaccacaccuggcuaauuuuuauauuuuuaguagagauggaguuucaucacguuggccaggcuggucucgaauuccuggccucaagugauccguccaccucggccucccaaagugcugggauuacagguaugagccacagugcccggccauuagaauagauuucaaagaaaaguugacugugccaaucucugcucccuccuguauguuguuaagucuacagggccauauugccuaaagaaacggaguuccccaagaauguguuaggaauaacaaaaauucuguacuuugaccugaaaauugcgguucuugagcugguuauuuuucuagguauuguuggaaguuaugagucagaguuagguacuuauucguggauaacacaaggacuucugucagagaucuggaugcugucaguagaaucucuguuuacccucuugggcucaguuuauucaucuauucuaugaggaggaguaugccuguuuggccuuccucuuagguugcuuuugagaaugaaugaaauaauaugugaaaauucuguucauaaguguagaagauggcuagugaugaugaugaugaugaugaugaaauugaugaugcccaaaauauggagaaucuagacugaauuuauggcuuucuaacuucgaauuuucggcuuucuaacuucgaauuuucaggaaugcaugaugauagaauguuuuuauuucugauauccacugcauuguuucuauagaccuucaaaguuugacacaaauaacuaaauuauuuuguuuuguuggugaggaucacuuuuauuuuagcgguguauccuguuaaaauaaccuugcaugaggauucucaaaguuauacuaauguugcacuaguaacuaaggcaguuccaaaaagagacauuuagaaugaauaaggauaaaucaaaaguaauucauauccauugguaaggagguggcacauaccaagugucaacuguagauauuuuagaaauugaaguguuaccauggaaucaaaguauuccacuguaagguugaauaucucaggauaccuacuuuaagucgucgauuaagaugaaguuaauauucauuuuacauauccugcuugaaaccucuuaugcugugaaauuuuccugucuauuaagaauaguuuuagaaaaaugaauuagcuaauuccuuaacuuguauguaacuugaauauaaguuccuuuccuuaacuugugugaaaaucaguucuccuuugugaagagcaugagagauaccucaauaaaauaguaauuuuauauugacaucgguugcaguuucaaagucagaguuuuacacuuaugugccccuauauugucuagcuuuguaauccccacuuuaaaaggcaucccaaaauagcaacagaagaauaaauugugacuuggguguauuagauuuguaugaucuuguuuauugagcugcuuuguuauguaguuaccaaggaugauguaagcuucucauccaaguuuuccuuuacuaugcugcauuguccuuuaaaugucaugagaauacaaauauuuucaagguagcagugaggaacaaucuagaugagaugaccaaaaggaccucucauaugaaacugcagugagcaaagguuuauuggucuuuggaucucuaaauagagugacuuuagauaucuaaauuuagugaaaaccagaauucagugacuuuagauuucagaccauaagggguuguaacaccuacuccuuuucucuguaaugaagaaaaaugaccacaacaaugugguggauaucagaaauagaaacuuuucaucgucaugcauuccuggaaauuccagguuagaaaggcauaaaagagagagaaaaccugucauaguuaguauaucuaccuugguuaguguuuuucacuuaggggauugcaaauucauaugagaauugcugagagaaacaauuaauuuagaacaaauauucuccuuccauuguuacagccuguaaaauguuacuucugaguugcuacuuaucuaucaccauuucucuuucuccacuucauuguuaguguuuguaugauuagggugggcgggggucuucuggaugggguugcucacacuccacaaagccuuuucccucuucuguugaaagaagacacagcugaaaucagucucuuugccuuuucaugauauggggaugcgguggaaucaaagcaggcaggaugaaagcccaaaagcuuccuguuuccagcuguuuucuucagcgaagguuuuuuuuuuuucucccaaagaugaugcuuccuuucaagggguuuuuaaucugcuaacuguuuccucaguuuauuucacuacaguaaaauguguucccuuuaggucauaucugucucuuuuaaaacccaaccuguccuuuucagccguguuaguugcuacucaaaagaacaaacgugauuuauaaaaguccuuuuaaugagguacaaagaccaauaaaccuuugccacuagaguuucaucuuuucaguugcuuuauuuucauuuaugaaaaauuugagaugucaaaaagccauugagaacacuauugauuugaccauuuaauauuuguaaacaaagccguuaaaaauaaaauauauuguuauggccuuaagguugguugugguuuuuuuuucccuuccgaaugcaguauaaucauauguaauuuguuuaauguaaauucuuuaaaauuaaggcacuggaaacugcauaaaugcuaaaaugaauacuaagaguggcuugauuuauuaagugauaaugugcaugaaaauauggcuuuuuugcacugauguuuauugcuucacuuuuugcauugauguuguuuuggaauuuacauuucuaaauucugcauccucuagggauaaaugaaauauaaaaaugaauucuuuuaaucacucauuaaacauuaacuagaccuuucacccauuuccuagaucuuccaggguucucaguaauaaucaucaucauuauacauugauuuauaaaggaauaucagagugagucagaauuuuucuguuucuuuaucacuugucuuuccccaaauauccauacugaccuaaacguaggagaauuuaucagcaagaagguucacauugcugcccuguuauuugagcucauucuuugugauauaaugaagccaguggcauaugggggagaaccaccucauuucauuuucacuuuaaugcuaacucuaacauaugcuuuugaauugaaguggggucccaaaugccaauauauguuaaaagaauuaaacacuuugaaaaaagagaaaguuuucccuuauuuacuccuguugcccacucucuugagggugagaggcugauagcgcuuaaaaacaugagcaugccuauuuuaucuguacuguuuaauagagagcuaugaaaaaaauggcaauuaacauauucagacagaaaaucauccuggcugaaugacucauuaaauagucguauaaacaggaugugccgaaaugaacugguucagaauuuaguuccauuggucuuuucagcacacacugcucauuaucagcacuuuaagaagcagacuugugggugcuuagaggacacuuaaauuucuuuucucuuuauuuuuuucuuaaauacuucuccccuccuccacuccuuuccccugcuauuccuaauucuuugcaggcuaagauuacucgucuaaacaugaaacauucuguuggcaaucgaguuagggguaagagcuucugacuuucauccaggucggugguccuaaccccagaugacaaucaaaauguauuugaagauuuuuuuuuuuggagacaaagucucccucugucgcccaggcuggagugcaauggcacaaucuuggcucacuguagccucagccucccagguucaagcaauucuccugccucagccuccgaguagcugggauuacaggcguauaccaccaugccuggcuaauuuuuguauuuuuaguagagaugggguuucaccauguuggccaggcuggucucaaacuccugaccuugugugauccgccugccucagccucccaaagugcugggauuacaggcgugagccacugugccuggccauguuuuuaaaauaugcagacauugcugaaccucauuuuuuugggcuucccauucaguaggucuagaggcaaggccugguaguccguauuuuaauaaaagcucccaguaggauucagauagccagccgggcuuggaaacuauucacugauuuguguccccucacaguaaaaaugcucuuuccccagguacaggauauauggccaucuggccuggauaucagugguuugcagaccuggcugcaaauuagaaucacuuggggagcuuggagaauaaauacugauguuugaccccacccccaauuaaauuguugguggggggaguaguuaaaaccuccccaguugauucuaauguacagucaaguuagaguacuucuguccuacauaaacagauggagcuagguuuagcugaaaaagucuaguuuucuuuuagaauaugcuuuacccugugcuaaaacuccucuguuacugugccucccuagccacacacacagagcuuaaacguauugccucuacuaaggcuuucacauuuauugguacccuguucucaggugggaguagaaugcuaggcucucacguuguaucagauuccuguuucuuccuaccugaguaucacaucugugaugugcagauguguugguauagcaugagcaccccacaaaggcuaaguaauaaggaugaagaacaaaauugcaguuuagcaaaggaaggagcauccaucuuuugagucccuguauacuccaagaaaaauucugaguaaacaaguuucuucuuuagcaaguugugauauuaaaugggugccuuucauuacauuggcuaacauuugcauuucuuggaccuguucuggaaaagggucugagaugaacccaucguugaagaucuaaaaaacaaaaacuuucaccaugucaagggaaagaggaaagauuuccauaaguguaaucuuguauucuggaugguacaugaaaacucuacuuccuaacugcccacagggauuuaagggguauuuuaagggguacuuacaaauaaaaggaagaagauacauuacaucacauucucauuaccaaggagaaacucauccucucuaggaaagguuucucuccugucuuacgugugacuuuccaccugcuaaguccccuugaaguuacugagcaaagacacucuuacaacacuaagccauuggugcuagaaguggaaguagacggagccccugagguucaggugccagguccuuguaucucugauggcgugggaaacaaaagucagcagccauuucucuucacuagagacucagaggagguaaaaaggggggauucacgaagucaucuugauuuuuccguaucuuauggcgaagucuugugguagaccccagaacccugaugguuggucucacgcucguaaguuuacauaaggcuuucucaagaaacugacauccagagcgcuugccuuagagaagacagcugaccauggucaugacacuggcagguguuaggacuggcuggucuacucugguauggcagaaacccugggccccugaauaagggaggugauuaugcuuuaaagucuaggcuuaccauguguagggcugugggacucacugucaggguuguguaaggcgagggccaucgcuugcagaagucugagugugugagcacccccuuaaauauugcccccaggugcuguacuugcuuaaccccggacccagcccuggcagggagcaacagcaggagggaaaaccauugguaauuuaggucuucacaucuuaugcuucauuuaaugugguugauaaagagccuccuuguaaaaauaucuugguguagacucccagggaaggaaacacuugugugacugacaagcuggcagugcccauggccacgugugucacccugguggaggauaaucguccuauuauuuuuugucaguagguauaacaaguggguagugcuuuguguauuccacugugaugaauuaauuuuguguucauuguaguagcacugaucauaaugaauuaauuugguauucauguggaugucagagguuuuuuuuuccccuuccaauuucauguagcuuuaguuaauggauacuuuaaaguacaguacaucugaucugauuucuguucucucauucacuucucauaauuuuccccccgcuggauauugugaggucuucuguuuuuaaaacauuuaacuugaucuuuaaauaauuaauguuuuaauagcuuuacaugaacucaaacauuccuccugcuuuuaauuuauaaaauaaggaaaauaagguaaauaguuauaacaaauauaacugcuagguugaaugauauacuuaauaacuuguauauuuuaguuugguuuaaaaagaucugaacuaaucauuuguaauuuguagccuuauugaagacaaauauuguauccccuuaugcaaauaugaaauaaugaaaacugcaugccguauauaauaguuugcucuucuuuuaauuucuucucucuuucccucauagacaagauugauaaauguaugugcauauauuauuuaucuguucauauaaggacauguaauugacuauuagauaugguaauugcauaaauauaucuuauucaagcucauuuccuuuucuguuuauaaaauaaauguuuuuguuaaauuggaauauguacugaaauagaagugccuaauuuaggauucagaaacuagguacacaaacaaaaaucaaacaaaauucugggaaccuuugacaaacuuguucuuuaaccuauauguguuuaaaaaauuuguucaucauguuugcugauuauugaagauauuuauaauagaauaaggguuuccuucaucacuaacacaccugcucggcugauuugcucccaguggaaauaugguugaaccuuuagaaagaacgauguuuuuuugccuuacgaguaucaggaugccauuuuuggucuuucuuuaaauuuaaacuuggaaaugguauccuccauauauucucuuguggcuuuaaacuuuuuuuuuuuuuuuuuuuguaauuuuacagcucuuguucaguuugauucucagcagcagcuguauuccauuguagacugcuguguuucagcaauugauggauccuguauauauucuacuauuuagaguauauaaagaaguugggacucuugcaaguggcaaggacuauauaacuggguuacuauggcuuucauuauuuuuguuauuauugugacagauuguacaguaauaugcuaacaaagauuuauggcaucaugcagcaguaggaaauguugggauggaggagaaaacucauguuaaaacaaaugucuauaauaauaagaggaaaacaaaacuucaaaaaagcugagaauuguuucuaguauaaauauuuuuauuaacauuuguuaugguugaagaucuugagaggaacuguucaugcauuucugcaguuuagauuaugcuguaugccuauuugugcaucaucguucuuaggagauuguucuuucuucugguuuuuuuuuuuuuuaguuuuuuuguuuuacuggaacacauagguauugaauaugcaaugaacagaaaauuuauggagggcagaguuaugaguaucugaggaaaguuuaauuacuuuuauaauuuagauaagcuucauaauuuauuguaacacgcuguacuuuggcacaauuuguaacaauuauaaagcacuugaauuuagguucuuuacuuggcagcuaucaacagaguuagcuguaugaaaacuuuaagcauuuacuuuccuuccuccgccuugcauuacaggcuuacgcuguaguaguuuuguugcucccacuuucauuugccacaucucuggguuuuauguaucacaguauaguaggcuuguggcuauacacuaggaagcagacgaagagagaaccugaagauaccuccugaugcccaaaccuaggaaagggaaaaaugcagaagaacucagacgacucuuggaaaugauucuugccucaauuaaaaagaccucaccacucaccuccauguaaaggacaggucgugaauuauucaaaugauucagaaaucaacauuuaaaaaaaugaacauaaauuccuuuucauaauuaaagagcgguggaaaauggcucuuuucuuaggucuagauuauauugcuguuaaaggaauugcugccuaguauacaauuuuuugacauuguuuucuacaacaucaaucuuauuuguuguccuuuuuugucacgccuguuaaauguguauuuuucuguguugauauugaaacuaauguacaaagugugacaucuccaaaaacugauuugguuguuccuaaaaacauugguccuuaaaaguauauuuauuugcagcccaggaauuuuuagcuucacauuuuucuuuuaauaacuaaacuguagaacagaauuagcucucauaaaaccuuguacuugcugaacaacucucauaauuaaaugaauauaaugauuuuaugugacacuuugaacuucuaaaguucuuucacaucuauguauguuuaggacaagauuuaaaaguuaaauuauucuacaguuggaguagaaauaaguggccaaguauccaacuuuuguaucucaaauaccuucuuuuuuuuuuuuuuucccaaauaccuucuuauauucuccaccgacuuuuugggcuggcuaagugugacagaaaugggaacuuuaguucuggcuuuugauucucucauguuaauguagguuuuugauaagucacuuggugcaaaacacugaaacaacuuaucuauuggcuuaaaugagucaacagucugaaucaaacagguugugaauugguuaaaauaauaaaccaguaacccugugguugagcucuugaugauuaaagaaccagaccuaagaaugcauuuauagucuuuuaaaagagaguaaagacucccacuucuuugagcuguguuucuuuguguagauuucuuuuuuuuuuuuuuuaaagaaaggcuucauuaucuguuucagaucuuuauagauguugcaauaagguacuccuuucuauuaguauaggauugaaaggaucaaaguuaauaacuugaacugagaugcuuuaaaauaacaaaauaguuuauuaucucuuuccuuuucaagauuuauguucuuacaaggguacaauguucaugauugaaugugguccuacugguaaggcuuccauguaauagaagaguaauucccuugucuagcauucucuggguuguuuuaauguugcaggugaauguguucugcugugcaaauaaauguaguucucuuauucacauuccugaugacuugcauccuuaaacccuuuuggucaggguauuauuguccuuuauccugaaaaaugucugugauuguagugcccuaauacuauaaaucaauggggacugaauucagcgccugcuaaguagagugaggcaacccuuuaaaugcaaaugcaucagggcuaguuuuaauguaauuuuaauaaggcugaaaccauuuugaaguagacuuaaaucauaauacuaaucuuaaaagacucucuauuuagcugagaagucccuuuauucucacuggccauuuuuccucugugugcauccaaaccaccuuucaugugauuccacaguuuuucauuucuuuuuuuuuuuuucucaaauagaauauauguacaguuugugguuacuuuauuaguuggagaagagcuuguauugacuaaaauugcuucacuucuuuuucuuccugguuguacaugccugacuaaucuguguguguguguguguguguguguccauaauauuucaaucacauugcuguguuuuggucagagaaguaaaaaucuagcugucaaugccaacuggaguaguuauuuaagaauauaauauuuaaguaggggaguauaugcaaaguaauauaaaaaugaggaaaacauuuacaaaaucaaaugugaccucaaguccaauauuuuucaaucuucuaagucuguugguuucaccaccucacauuauuucaauguaugugaaauauaucuugcuguuuauauuuggguugaugggacaggugcaggaucuuugaccuggggaaauaaauuggauuaaggacuagcuuaacuagucuacagaaacuguagacuacaaaaacugaaggcaagaaccuacugucacaucuuuugcagagagacaaaggcauuuugguauuuggauauuuuacuugggauauguauuuuguguauuuguguaauuuuguauuaauuuacacaaacuuaaguaaacaauauauuaauaagauucaucaaguaauuuauaaauuaacuuucccacauuuuucuguguucaagaauuaucaaggagauguguaaauauugaagccuauacuauauuccauuauuugcuuuuaauguauuucauauaauucagaaaacaguaauuuaucauuuacauuacuucccuuuuccuauugagccuucugaaagaauaauguagaccagcauuuuaaaaaaaagcuuguuucaagacauguuaauagaaauuuuauuuucaguccauucugcauuaaauauuguaaaacaccccuagagagugauauuauuuguaaugauucccaaauugcuuugaccagagaacuccuuuuuucaugaaauaccucccauguggaacauucugcagaagaguuuugugaaaugcuaacucagcccaaaagguuuuuuaaauuaaggccuuucaaguugguaaugguauuuaguuucuuguuuuuuaaaauagacuuuguuuaggacaguuuucuagggucacugugccacucaugcugacuguccugucgucuugaaaaauacuacugguaacaugugaacagauauggagguccucuacccgaguauuuuaauaccaaauaauagcuauaucuucucagauauugguagcuaugucaauggagaugugaaauuggcucuaucgauggcuuuuguccauucuccaagagaggccugucuuuguggguggagguguugguggauauguguaugugucuccuucucuuacccucuuaacaguuuggucacaguggugaccagugaguauagagcagagccuugacaaugcaccugacuuugggcuuuagccagauaguaugaaugagugaagcagauguuaaggagaggugaguuuagggcaacuggggcauucgugcccccucauucauucaguuaacauuuccaagaauccugugcagggcaaauaagaucuaucucaggaccagcaauaucucauccuugguaugaagauaagaagucaggagacuugagcuguagguuugguugucuccuugccuggcaggcuugccuaauuuacagcaaguagaaaauaaucugugucuuguucaaaucuaaauaacaaugcuuuaaagguaguguagaauauuuguuaaaaagaacauauuaauuauguuuuuagaagcuucuguaaggaagaaagaaguuugaccccccaacuuuucucuuuucuagaacugcaaauuacugcuauuuuaaauagacuuuguuguuuaacuguacauccaggaaaaucuaggaaauuaaagaagcaugcauauaaaugauuguguagcagaacaugaacauuaaauucauacagugaagaaauuaaaguuagaaauacucucaaacauaagaagguucuagaaucaauccuuuaagcacagucugagacaugguauaucuuugcacuuacuuggaccuugguuucuauuccugugaugauuauuggauuugaugccaucugauguccuguuccucagauucuaugaagcugagucugagauuaacuuaggucugagauugacauaaaggggaaccggucccuagauuuccucagggcugagaaguuauugauuucucaaguauaauaggacugcacagacgcacaauuugcaccaaucggaacaaaauguuuaacaaguucugaguauagaaaacacuuugcaauuugaauuucuaugauuccaaaauucaaaaaagcuccuuuuugauuaaaugcacugcccucaaccacacaugcucauuuucucugucuacugcuuugucauucuguuuauuuaacuuuacuuggcauaccagaguuuuaacgcugagauuuuaaaguacauaugcaaaauuggaaugugucagagaaccuaggaacagauucaucaaaggagucaugaggcacauugcacaugcuuuaacaucaagguguaaacggagcccauuaaacuauuaguuaaguggugaucaggagcaagagccugauuagauuacaaaaucuucugugugugagcgcgguaugugaaaacauaacacuugauccucaccauagugccaggaagauucaauuagagaacugguaugugcccagauuuggggacauaaagggcaacuggauuuugaaggaaagaugguaaggaaacaccugcaaaaaucugcuucucugugcaacagacuggguaauugcauaugcagauggauaguuagggauauaauugcuugauuugugaacauaaaugcccuuucgauugugucaguguugaauuuugcagugacaggugccugcggauugcuguguguguauccuuugcaccccuguuuaaauauuuggccuggaguaugucuuccauucauugugaauggaaccaccgccgucccgcccccaugauggucuggggguauuguuauagcucuuaaugucucuccaacuuuuucucauaaauaauaaccuuaauuugaaaccuuaacuaaaagaaggacugcauagaggcauguggugaagggcuuacgaauuaugcacagaauucauuuuuuaaagcugcuggauguaacucauuaguuuucauuguuuucucaaaauaaggaaaacuauuaaccaacacugcagacuaauagccuggauuuuuuuucccccauaaucaacugaaguuuaauggaaaaucaucuuuugaaagacuuccuuuuuucuccuugcuuuuucuuaaccuuuccauuaauacuguuccaauaucuucucuaaucucucucaacuaaauagcauucucagucauuccuuuucuaugucaacauuucuauaccgcacugaagauguuuguaaaaauacuggugcaguccaaaugggauuuauuuuuaaauugaagaauuuguuaagcacuuacuuauguggaauggucaggucaucuccguauuccuuucucuggccuuauggagaaaguggaggaaauggugucugccuuuaaugagguugcuaacgugccugaacuacacaauaaguuauuaagucauauuuuaugugauuauucaguuucuuuuuuuuuuugcuccauucuaaaucaaacuaucuaaauuauuuuugucaaauaaagguuaauuucagcaguuguugauaauaaacacuugcauguacuauucauaucaacguguaugauacucugcuaaguauaguacaucaguaaucucauuuaaucugucaaacaguauauauuauucccauuucacagaugagcaaacugagcuauaagauuaaguauauuacuccugccauauaguuaauaaauagaaagggauuggaguucagaaauaugugccucucuagcccacguuuguugcuguuuuggcaucuaauuugcaaauauaaauaaauauaucuaaauaaauaaaaaauaucuugaaucugccuuuuuaaaggagccugccaaagagaggcaaaauaaccgcagaaaucccauuuugacuggcuuugauaugaagacuucacacaacucuuauuuuaauuucuugguauuuccuuaugcuuugcugcucuucugaggcacauuuucucaguaagauauucuuuaugcuuuuuaacuaaaaauguggggauuaaauuuuacccacaaaaagguuugaaaccguucuuucuaauucuucaugugucauuaaaaaaguauccgcauguauuuuggugcguguggagaaggagcuggcacugugugcucaaauaaugcucagaaccaccugcuuugaauguggucugauugaaucaaaugacgacugcuuuucaucaccgagccgggauugggaugugggggaaguguuuuguuuugauauuucacaugugcuuagguguucgugguuucagguuguuuaagaacagacucucauugaguguuggugaguccugugggggagauuugaaagcaacguugaggauuucuaggucuguuucaaaauuacauccucuuguguggugcauuuauuuguguucaggaugcagauugccuuguggaaaauggcaaaucauuuucccucauaaaagguuucuuuuguuuuuuuguuuguuuggucuucagcuauuuuuuuugguaguuuccccuccugaguucagauuaucaguacuuucaucauuuauaccacucgguucucuggaguucuuggugcacuguggguccacuuuucuuguuuggggugaugacuaacaucugcccugauacucgccugguacuugaggcucugaacuuuauuaucuucucuucaacugcagcucguggcacuuguaggcaacgugccucccaaagagccugaaagagauuacagcucacuuccugccaucagacaguauguggggaggucaaggggugggcagaggagaggcuuggugaaauucagacuuuugggccccaucuagaagaaucugcuucaguaucucuuggagcuacccaggaauauguauuuucaacagugcuccagaucugagggacaguuggaauuaggaaaacuguggcucuaacugaugccccaguacuucucaaagugggugcccccacauccugauaugcuggauguguuuuguaacugcagauuccugggcuccacugggagugguggcccuggaccagccucugucauguguccccaaccacacucuugggauucguauuuguaugaacuuuagagaaugaacugccacagagauucuaggugacaggaaauugugggguaaauuggaggauuacagaucaugcuucuaauaucagcacagguacacacaaucgucaaaauaggggacagguguguuuggaaagcuuguuuuguaaagaaagucuuuucucccuuugacuucucuucuuuacguggaagcuacacuucugaauuacaaagagacagagaaaaaagagaacaauaacaacaaaagguuccugaggcauaccuaagcugcaggagccaagggagugucccuuguuuuacuuggugauggcuguuugaacagccguuugcuuucuccuuccuguccucugaugugaggaugcaggauuggaaucauuagaaacccuagguuaguagcaucaggcucccugcccuguguagucucugggaggacagagcugcagcuuaaguugugcuuuugucuuggcaagcaccuuucaauuuuuauccuagcucaguugcuuuguuuggcauuuuacuggccaauacuccuuuuuuuuucccucucuucuccaucuccuaauucucaaccucuucuggggccaaaaacuuggaggaaagacuuuaaaaaaaccaauuucacuccuguuuauguaaucguuucuauauuacagaaggcuaugguauguuuuaaaauguauacaucucuuugcuuuucucccuugugacugaauuuuugaaaaaugcuugaaauacggacaccaaaacggaauguaugugugucacauuuaaacggaaaacccuguuuguuuuguauauuagacuauagccaaugaaaacccagggaguaaggauuuucaugaccacaacugaauauagaaccucauagguuucuguuauaaguauaaauauugagaauaguuuuguuuguuuaugccagugcaguuuuauagcaaauccuuucaaauggggugcaaagccauccauggauauuuguaaaggcuuugcaaaaucauacauaaaauaaauuguccauuugauuugaacaaguuuugcaauuauuuguggcuuuaacaggggcuuuugaagggcacuguauauaucuaccagcugguucuacuuuuuuuuuuuuaagaaaauggagagcuuuguauacaaucccuuggguaaaccaguaauaaacuauauaucagguagucaagucaugccauuucaaaucuguuuuacauuuuaaagggguaauaauuugugaauuucaucucauagaaauuuuuaugcuucaaaucaaguuguuaucccauccuugucuauuuuuuuuuuaucgauccccucacucaguguuuuagagaaauaaagcauacaauggaaucucuugcugggaaaaaauacuuucuuacuuauuauauuguaucuuguaauaauauauuucuaucaccauuuaaaaaacauucuuuuaguuauugaugauuauuuugucaaauuauaugaauuugguucuguuuucuuuuugugacaaagauucugaauuuucauguuuaauaaaugcacuucuucacaugacaaauguucauugagcccuuagccaggcauuggugucaacccugguucauaggugcccagaguuccuguccuucugaagcuugcauccugguggggaucaauaaacaaagauaccaaccaacaaauauaaauauauguauguauguaauugauugauugauaucugugugugaguguuuccucaauggcauuaugcauuuauuuauucauucuucaugcauuuguugugugggaaagaauguuuuccagguugaggaaagacacgagacucgacagccagggauauauuagguaacggugaggagucuggugugauugaggcacagaaggaagugccaguguaaaguaacaugagaagaaaguacacacagauccugagcaccuuaaaugcuagccuaaggaauuuuaaguuuauacccaaagcaauagggagccacugaagauuuuuguauggagaagugacaguugucaguggcucauaguagauuggagugggcaccuuugcugaaguuagggaaccuguuuucagguccuuauuaugagacgugcuaguuaaaagaggaaaggaggggaggggguuggcaaaggcugcaguuaguuacauugagugaggucaaguaaaauguuuugaagcauuucuauggagaagucccagaucuucuuaccuuucaugacuuuguuagacucacucuucagugaaauaagacuggucuugauuuuuccaugcgucuugaguuaaagcguuacccuuugcuaccugggcucuacgauuucaccuguucucuggccacaccuuggaauucacuucuuugugcucuccaauauuugauuuccuucuugucuucuuuucuuuguuguuguuuuuuguuuuugauacaagagucucacucugucacccacgcuggagugcaguggugugauguuggcucauugcaaccuucgccucccggguucaagcgauuuuccugccucagccuccugaguggcugggauuacaggugugcgccaccacgcccggcuaauuuuuguauuuuuaguagagauggaauuucaccauguuggccaggcaggucuccaacuucuggccccaagccaucugcccaccucagccucccaaagugcugggauuacaggcagcauggccaccaugcccggcuuuccuucuugccuuuucuuaagaguccugcuucaaggaaacuuccgucuccuuuucaaaaacuauuucaguaacaaucccuugguguuuauuuaccauuuguagcuuaaacuuaaaacuuuuucccuguauuaguuauuuuucaaauauacuuuuugucucuucaacuaaauuuugagcucaggauucauaauuuauuugaagagguacaaacagaaagguucugucccauauuucuaaguaguaggauuuauuuuuccuucuauugaaaugaaaauauaaauggccuuugaggcuccaggagagcccacaaaauuuuauuuaguccaaaauaccguaaaacuucaguauuauuaauacuuaaagaugguuugccucaagcaagaaauaugaagcucuggggaacacauucugugugugugacacauccagacagugugguuugccaaaugguagcugauccagagugagguucuuaaccuucaucaagucagggacugcuuugaaaauccaaugcaagcuguagacugucuucccagaaaaaugcguauagcuaaauacaugaggaaaauucugcaguccuuagucuguguauguagcauguguguagguaugauauugguaaauccaaaagaaaaaaugcuuuuuaguuaccuuuuguagccauuaacguuaccugugcuaagugcucauuaggcauuugcuggcugauucuauucaugugagggccacagggaccaggagaggugagagcaaagaugcaugcacagaucagagaaggguuaaauggggaauuaugcagcauguaacuuauacauuuccugaaaaugaugcuucuguggacuuagacaaaaaugaguggccaggagaggauugccguuggauagaugaagucuagauuuauccagaguugguauuucuuguuaaagaaccucagugagcaguaaguucauaaaccuacuggggugcugguggagggggagaucuacuguuuauuuuaggauguuuucagcugcaacaaaagaaaacccugacucaaauggacuuaaacauagggaaaugucuuacauuacguuaccuauuccaaaaucucuggugguuuccuuccuccguguacugccuucauccuaggaaugauaaggaaauuccugcuuugguucugggcaucacauccaaacagaaaaaucaucaaagaggauaaguggucgucuacugaugugucucuuuccuuggaguagggagauauuuccaagaacccaguagaggcugcaccuuugugucuuagugcucauuuugaaaccaguaucuggccuggggaaggcaaggggugugauuggcuguaggacuuggggguuucccucuggaacuggaaaugaggucaccuguuccugauccacuaggaggagugguggcuaugugaacaaauagcaauuauaccaaaaacugcugcacguucuacuaagaaggaagaagagaaaaauagauauuggaccaacagaacuaacagugucauuguaucuucugauaaacucacauucugaauaaaaaaggaagucauguuuguauuuuuaaaauuuaucuaaaucuguuguuauuuucucuaccacaacacaugggguacagucauaugcuuaaguccaugugagugagcuuuuauaauagauguucuguccacacaaggacugguuuccaaggcccgcacucaguuuacuuaugggccccacugccaugcacaauuaagaaaaagacgagauuuuagcaacuuggacugaacuauagacuuugccuaaacucauuauuuacagcagcacuuuucuucauaggugaauuguuaauagguuugauuacuuauucuugccuuggagaauuuucagguauggcuuacaaagugauaugaauugucaucucucaaaugcaucuuuaauuuaaacauauucucuauguuucuggguagaggaagaggaaaaaagucuaugaaaaugaauuuaaaaugcuucucagagucaguauuaauuuaaaccguugcgguuuucuguggggcauauuuaacccaaaagaaaagcccuuauaauuaggaaauugggauucugaauaauuaauuugaaagaggaaauauaacuuuuucuacagagaacaucuuucauccaaauuuggaguuccaguuucugcagaugucacuucucucucauaacauaagaaaauagguaagaggcaguuuggaaagagguugaaaggagaaauuauagguucuccucccagcuuuuccaauaacuugccuugaggacuuggaccaagcccugacuuucucugauguauaaaguuguaaaggaagaugaaauacugugcacgaaagugcuuugaaaaauugaaagcaguaaacugcucuaggauauuuauuguuaguguggugguucugguuauuauaaaugaagcagaacuuuaaauauuaaugguacucuuguucaucaauggggaaguuauaggggaaagguuuuccaaaaaaugcugagcuauaacugccauccaaguaagugacgcagaaugccuaacccaauuuguaucuugcuaucaccugaucacagaaagcuguuucacuguagagguaacaguuguuuucuccucuguccugaggccaaugauuauauaauauguaucaaaucacuagggugcauaucaaagugagcauaaagaggcaaauauuucccuuuacaaugaccauauaagagauuauuucugucaggggauaaggcauacaugaagucugacuguuucacugcauuuuuacuauagaaaucacugagcuugagacuuguacauuaacuccaucuggucaugugacuggcaagugaaguguuucaauguguuaagaggacugaucugcauauuucuugcugaaucuuaaucuguacuugcauauuugugaaacgaaugaguauuuaaauuauggagaaaagauguauugugccaaacuaaccuuuauagcauaccugugguuguaguuucucuagcuaacaguggacaagaugaaaacucauuauacauuuucaucauguuagguauucuucucaaagucacaggagcacugcagaaugguucguaacuuuaugaauucagcuggcauuuuggauauauggacggccccuuugaggggcuaaagacacagccauccauuucaccaagagucgccgagggugccuuauugccccuaccccgugcuggguacugagggugggauagaaggcaaaccagacacaucccuuguguuuaugcagcuuuuucuucagugggcaagacauuacuugagaauccuaaaaauauaaaauuacgucuaugacaaguccaaugaaggagaaggacaagacacuugauugaggaggacauuuauugcuagucaggggggacaaggaaagcugacccaaggaaaugaugauucagcugaguugauagaggagugaaauagucauaguaggaaaguggaguggugggaguugggaggaaaguacuguauuugaagaaccacguguucaaguucugcagcagaagggccaaugaaguacuugaguguugucaaaggcaaucaagguaacuggaagagagaacacgagggcgugaggguauguuaucaggaugaccuugauguucacaauuaagaaaguugcucuaauccugacaucaauaggaagacugaaguaucugaaggagggaguuugcaugucuguucacaaagaccucuuaagcaauacacuguacacuauuaauaugccagugguucuuggggcgcugucuccaaccugugguugucucacuacuguauacucuacuccuuccccagugugugcuaucugugugauuugugugggaucacuacaucccugguggacuacugugacuggacuaaaacaaucaagguaauccuaucccucucaucacggugauuaauucgggucauccaggccuaagcaaauccaugcaugguauuuuuuggcuuuagggauuguuccaugauggucccaaucaggacaaaguucagcaggaauuuugcucuuuuauagacugaacuugcugccauugaaagucaaugaggaagcaaguagaucuggaauccuaugaccaugagagaagccugcuuuagggugaaguugacauggaagugucagaggugagggguacaaagaaccauuuuguccuugcuaauauaguagauccacuguaucucagauugcaccugauaccuguugaaguuuucaggcuuuucucaccccuaggcccuucuccaauccugaugcuagcuguugacaacagucauuauuaaauaaauaucagaaaccucaucugaauucaaggaaucucccagcucuuucuaaacccauacuugcucauuguaacuguagcucaggccaagauggaauagacuaccuuggugaggacagguguaugaagaaucacugauuuaaagauuguucauaacguaucgcagucauuaggcauaagucuauuucuugagacauuguaagggauuauucuuggaaggacauagguccaaaauguugaauuggacgucuaggagucagggugguaaaaaugaaguauauauugauuaaguggagaguuacaugaguagagaagcaaaaugaagccgaguagaaaauuaaagguuuugggaggaguacugccugaauuuagauguuuuuaaaguacagcuuucugucuucaugggaauaucuuuucgauauacugagaaaaagaaauccagguguucuucacuuuuguaagcauccugguuuuucgugcagggagcacagacaacaggauuucuugccaaucaguuaccauugugaggccugauuuuucaucuguaaaaugaggauaauacagucuaccugaguaauggcugugaaaguuaaaugaagcaauuugaguacaaauaccucacaaugaaugauuguuuucauugauguggugguaaauguuuaauaaccucuuuuucaaagaauaaaagccguuauuggucauuuuugccaauuuccaugguguaaauacuuccaacauugugccaguuccgaguuaccaguguguuacaaaauugaaauggaguuagagaaauacacauauaaugccggagagcucaccaggaugccacugcuuucuuuccuucuuuccaaauuacauacaucccagauuuuuuuuuuuuuuuuuuuuuuuuuugagauggagucuugcucuguugcccagguuggagugcaguggcacagucuuggcucacugcagccuccgccuuccauguucaagugauucuccugccucagccucccaaguagcuaggauuacaggugccugccaccacgcccagcaauuuuuuguauuuuuaguagagacagaguuuuaccauauugccuaggcuggucucaaacuccuggccucaagugauacacccuccucagccucccgaaguguugggauuacaggcgugagccacugcacccggcccauaagccaccacgccuggccuaugccagauuuuguacaaaguaaaaucaauccuugucccccaccacugugauacuaggguuuguuugauuuuagugacaucuguauuaggguugacacagaauuaauaacugaaucaauaaagagaccgggaacagggccacgccuuacacaaggugacaugaaaaauguugagguguagcaguuuauucccuuagguuaaucaugaaccuuucuguuaggccccuuugaaauuuaguaucacucuguccuaaaucaccaguaccuugcaaguguugauucuagcccauauaacucaccuuucucaaaaauucugcuauguuuguuuuaguaaccaaauacuguauuuuauuuucguaagauuuucuucccaaucuagauuauauauuucagagagaaagcguccuauuuuauguacauuuuguauccuuuuggugucaaauaucaugcuaugaccauaacaguaaguguaauacacauaauauccuccccccgcccccccgcuuuuuuuuuuuuuuuuuuuuggaguuccuacuguguuccagguuccaugguaacauuuuccuuguuaucuguaaucaucacaacaguacuggaggguaaauacggucauucccauuuuacagaugaggauacauucaaugugagauguuaaagauguucuucagaauuucccagguagcaggcagcucaugguauucaaaagguaaugguuaagagaaagaauggauaaugaauaucuugugucuauuuucuugagacagacgagacugagcagccugagaacauuuggugcucagagggaggaaaugcuaagaggggaaaacaagucugaaagggaaagaaggauaguucaaagaccaguuuccccugcuucagaauucugacuggugccagcucuaacugcguauguuugcuuuacuuggaagauagaaucauagugccagaauucacggaagucuguuuuggaagaugcauuagucaggguaugcuaauugcuggaacaaacaauccccaaacuucaguagcuuaacacugcagaggguuauuacccuccggugucacagagcaacgugggugggcucugguccuagccuggcuucuuccauggcucaggucugcuauccccuaggaccuuggaguucacuagauauuggcaucaggcugaucaaagaggaaaaggagaguggugcauagacgauuacaugggaaauuuuaagggccaggucuggacaaggcaaguauuacuucugcucacauuuuauuggccaaauccuagucauaugaucccaugacugcaaaggaagauggggaauuucagauuccuagguggucacgggcagaaagagauggggauuggugaaaacauagccuggcuuuagccacagaggguuacaccagaggccugcaaguuuggugaccacuaguuuucagagguauuggguauuugauaaaauccagugucuuccagagguugagcaugagccacauauaaauaacuuucccagugacgggccaucagcaguccaaugaagacauugggucuucaugucuucauuggacugcugauggccugucauuggggaaguuauuuaccuucucugaggagaaaauaauaacuugcauuucagagugguuugggacacuaaaggaaaucagaagauggaacugauuuguuaacuagaaauggacauaaguauugguuacagguuuaaaaugaaacuugcaauguuugaggaagaaagggaaaauguuaaugcaaaaacaaaaaagguaaagaaauggugggaaguagauuauuggcacuuuuucuuuggaaacccauugccauauuucauguaauuaaacuucauuccuuuuaaugaaacaauucuucuaaauaauacagagauuucccaccaauauaauauuuaacauuuauaauuuucaccuuaaaguuugaacauuuuuaauuuuaaaacuguuuguugcaguuuaaaucuccuuaugccacagaacuguggacuuucucugguugcaaaauucuuuacagugucuugaauugaaaagggcuuaaguaaaaaaagcugggggaagugggggccuuuuacaaacaaauuacaacucauuugguacaauaaggauaauucauuuugucuuguuuugcauggcuguauauuguuuugaauucauucugcauuucggaagcuugcaguauuucuuuucuguagguuucuuacuuguaacugcagauuucgcgguuucuuuuguguaccacuugccucccagaauuuggcccaacaguuuugaguagcugaacaauuuaucggggacagaucagcugaaauguggcucaacuugaguaaagcagaaggaaugacauaagguuaggugacugaugugugaguuuuugaauuugauuugguuuuacauggaaagguugaagcaaugauccauguauucuaauaaaaaucaucaguacaaaucaaauaaaaucuggcuuaguggcuauuuucccacuguaucacucauggcuagccugugcuguuacagaccacauuuggcaggcacggcuuuuuccuacaacaaaucuuaaaguaacauugcaaucuuugcuguguuaaaaaggcaucuuuucuaaucaaacugucugcuaaucucaucagauaaaucauuauucucuacugacagcuccggcuuucccggaaccccuucccugcuucuuguuuucucucaagaugucugguuaucgucauucuucaggucuuugccucuaucuccuuucacacuaaugacauaucuuccauuccugaggaagaguuacagcuuuuuaccauuccacuuacugaauugguaagaccaguaccucagagcagcucaucucuuucugaccgguauuccacuaguuaucagaugggcaaaaggcaggaugcauccaaguugcagaccuacuagaaccaaaaaugccuauucccaggaauuugaugugauuaaaccuaagaaaucaucaguugaugcguucucaucucuuucagcuggacuaguaaaguaaggcagauguauuuucacuacuucaguagugaacauguuuuauagaaccugaaagugaaaguaagggaagcagcaugguuuagaggaaaccuugguccauuuuuccgucauagaccuguccugcuagcaaaguccugggcguuucuuaaacugauggcaacugcgugugcccugguggugaaaugguguugcaguaugccugggcacugcccugugaaaaaggacacacagaggggagacucacaguuuuguuuucauugcugacaugguuuaaaaauguacguugcuagcugugaaaacucagucauuauaacaccguacaccuuucuucuuucagcaaguauuccuugugaacauuagcaaguauucuauucucuguuagaauuaaacagguaaucguaauagcaugaaagggugaaaguaugucuuaugcaaaauagccucuuuuauauagggcaucuaccaauuuucuugugauuuuuguuuuuuccucuuuugaaaaaugauuuuagucugcucguguuuagguagguaacuucucuugaucccaauuuuauacuuuaaaugaucccagauauugcauuuuaaaugagaugaguauauaaaaaauaggaagcagaaagcauaauuaaaaauugugguuacauuaucgugagaccaaaugaccagucagacuccucugaccaauuucauagaaaauaaggagguaucauuugaacaaguuguaacauaugggaacuguuuuaaacaccaucauugauaucaagaaacuauuaggaaaugcaaguuuguguaucguguguguguguaugcugauuuuacacacacaggcacaugcacacacaugcacacacacauuuauaagcccaaguaagagaaaccuuugccaaugucugccaggcauuuggcugaaguggaauugugaggaacauuuucucagccuuuauaaaucacaguugaaauaugucagcacuguucaguuuauaaaaugacaagggcuguaggcugggcaugguggcucacgccuauaaucccagcauuuugggaggcugaggugggaggauugccugagcccaggagucggagaucaaccugagcaacauagugagacccugucucuacaaaaaauucacugggugugguggugugugccuguggucccagcuacucaggagggugaggugggaggauugcuugagucugggagguugagguugcagcgagcccugaucgcaccacugcacuacauauacccuagaugaagagcaggaccccaucucaaaaaaaaacaaaaacaaaaaacaaaaaacaaaaaaacaacgagggcuucaucuaaagguuaaagggacuguuucuaccuuauauugauuauaacaaguuaacucacucaauauuguaugguaugcuuaugcuguauugaauggcaaaguuccucucacagucuuuuuuggggucacccuucacucuucacuuugugagguggcuaguucauuuguauaccugcucucuaaaugugggaauauauucuuuuaaaaguggcaacucaacuuaucucccccuucuaaaauauuuuagauguuuccaauuuuuuuuuuuguacgucagcccauggaaaccacacuaaauuuuucugugucaugaguaugcuugucucugcauuugaauuuaauugggaagugccucugaaauggcaggucuccuuuuuacacagugguuuacagaauguggugggaggaggcaccaaauagccuguuaggauagcauggcuccaaaacugauucuuuaacuugccuuuauacauugcauuaauucacaaguggaucaguccaucuugucuucaucuuggccaaauuccuucaaaauuaauaguaaaauaugccuaaauauauucuuguuccugcccuccccacucccaccuaggucacagggcuacaacuaaucauugucuccauugaaaugucacuagaugaucaacgauugaagaauauuucuuaccaauucaaauagaacagaaacuucagucaaguuuagcauuuauugcccuacauuucugcggcugucaaaaccaguugaucagagacgugaagauauguaaggaaauaggaagcugugauggguuaucgcuugucuaagagugguacaagugagacuugagggcauuaucacuuuuuaccuuauacauuuuuguauuuuaauuuuuuucaauaagcacauacuuaaaaauuaguuugaauguucuuaacgaaucuuuccauagguuacugauuaguucaacagggacaaauuauaaucauacauugcagaauuugcaugccacuuugaccaggugaucaaaauuggcauagcacaugaggggcagaccaacaugccaucaaggggcucuggaagugauguccugggaaggacaccagaccacuauuguaguauuauauccacuggaauauaaucaugaggaagcaucugauccucccaaauugagaaacauuuccauaaaauaacuggccuguauucuuccaaaauucuaauaucacagaaggaaaaggcugaggaauuaugucugauucaaauggauaaaagagauagacaauucagugcagugcaugauccuggacuuugucuucuaccggagagggaggaaguucccuauuggaauauggauuauggauuggaucuaaguacccacaguauauuuucugauuuugauaauaguacuguuuuuguucuuaggaagugcacacagaaguacuaaggugcaaaaggauauaauugaugcaacuuacacaugguucagaagcaacauauuauauaauuauaacugcacuguaauugaaaacuuuuaaaauuagccugguguggcagucccagcuacuugggaggcugaauugggaggaucuccuaagccuaggagguugcggcuguggugagcuguguuugugccacuggacuccagccugugugacagaacgagacccugucucaaaaacaaacaaacaaaacaaacaaaaaccccaaaacuuaaaaaaaauaaaaauguaaaauaugggaagaaugaaaaaauuauacauuuuccuugacuucaacccuugaucuuuucuugaucaguucccaggugggguuaggauaucuguguuuuuuaugagguuccuuggaguauuuggguggucagccaccauuuggagaucaccauguagugccuagauuauaaauuauccuuuuagaaagaguugcuggaaucauuucaagauuggucagguaccaauaaauaaguaauagaaacacccucaaaauuggaauugaaagaguggaaauuuauuuuauuuaguuuggggauaugaacaugguauaauauugucgcauuuuuucuggaguuuagaugaauaagagcagccuacaguugaccggaugacuuaauauuuuuuucguaccacaaaaauuaaaugcuuuacuaaaacuuucauucucuuacaauucugaugaacaagguuguacuguaugguuaaguaucacacuguaaauuuaggcaauacauguccuauugagcccauggaguaaaauagauuuucccgugauccaagcuauuacaauuucagauguguaaaguauuucaaauucauuuuaauagacugcuucccuucaaauacauguggagguagauuuauacaacuguaaacaguuuaugcauuuuuacagauuuucauuauauguguuugauacuaauuuaccucuuuuuaauuguaggagagauaaagaauuaguaguuuaaaacaguaggaacugcguguucugcugugaucaaggaauuagauaaucuggcuuguuugcuuaaggggucuguaucuugagacuuuuauagggcaguauuaaagcucugagccuccuuauuaugccaguacccagaagauugcuuuaaugagaaguaaagggccuuuuuccaauuacaagggaauaacugcauuaaguuccuguguuaugucaaccugcuuugauuugauuacuaugaaagaaauggauuuaucugucaguguuacuuaauuaagccuucucauugauguuuugcagaguaauauagugugguuugcacauuugagccuaaguacagagaaaauuggccuaaaacuaagacaugaccccugaagauaacaugcaagauugaucauuugucauugccaggucauaggcugcaguguuaaacauagguggaaggauugccauguugaaaggguaaaaugaaaaucaguuuaugggagugaguauuuuaagcaaaagggguugugguggaaaacuggauuuuagggaggaguuuugaauauguaaaacuauugacuucaccaauauuagucaagcaucuggaauaggaaaugacaauaaaacaaacaggagaaguagauuuuguuaaaguauaaaaggaaauagaagaaaaaggagaaagcaagaggaaagaaugccguuugggagaaguagaccauugugguuaggcagagcaauuacagccuacagauauuucaauuaagccagccuccccuucucagaaccucacaaauggcacccucgggagaaaagagguaucaggaaagaaaagaagaaaagaggaaacaguuccauguuucauguuggcuaaccucucccaagaauaaauucaauaaauuauuuaccaaauaggcauuuuaaauaccaguuuguauaucugaagucauuacaauauuauggauuuugcacuauaaauauuacauguaugguuugaaaaauacacacguaauuacauguagacauuaucagagguauauauucaguuuuauuaggaaaugaagcauauucuuaaauguauuccuuaguuguuuaacacuuuguuuucuaaaguaucuaccuuuuauuucuugcacucugugauauaucuuuagaaggugauaugucuuuaggaggugccaaacaccuacuuaaaaacuuccuugcaauauuuucacauuuauuuaaguacuuugaaacuuaucuguguaauguugaaguuagaugguacuuugauuuuuuuuucaaagucuucagauaugguaacuuacuuccaauuguuauucucacgcaauucacaauguuuacucuccaagaaaacugucuuaguuaagacugauuuuuaagugcuuuuagauuggucacauuucgaaaagucaaagaagguauauauaguucacguuauacucuugcuugaguuauucauggcucuuauuuguaggauauugcuuuaaaagguaggauccccaaacgacuaacuucucuucaagaggaagaccccagcuagccagucccauacacuugaaagguugcuaaauggcacucaucucucagcauuucacauuauauauucaagcuaggguauaauucaaguuagaugaucguugacaccuccaaauauauaaauuaauauaaaggcuucaauguacguuugguucaguugcauaauguaacuguuuaccaccuugagcuucaaaaagauuucugaguuucaauauaaggaacaccacugacauauuuguaacauaacaguuacccacuucauuuuguuacuuucucauuaucugaauuuuauguuauaggaagaugcuuucccuguuuaugacagcacacaauggaauuaacuccauaucuuaagcagcagaaauguaguguucauuuuugaaaaacagguuauuuugaacuuaaggaaaauaauacuguuuuaaaggacuuauuaauggaaguuuaaguuggauguuaauuaaggcuaaaauauugcaguaauugucugcgaacacuuuuuuccuacuauacuuucucaccagcauaucuacccuuuaacuuuucuuaucauaugaaaaauacucuaagaugaucucaugcuugaccuuugaguuucagauuuauuugguuaggaaauccauuagcucugagaaagccaggguugacagcagucaucugaaaauggaaagcccaggucuguauucuuuauauuugacuuaucuuuuuuuuuuuuuuuugagacagagucuugcucagucaccgaggcuggagugcaguggcacaaucuuggaucacugcagccuccaucuucuggguucaugugauucuagugccucagccucuugaguagcugggacuacaagugugcaccaccaugcccagcuaauuuuuguguuuuuaguagagauggguuuuaccauguugcccaggcugaucucgaacucuuggccucacuuuuucuagucugauaguuuugauugcuguccacauaagcaaaguagagcuuugaguaaucaaaucauaauccaccugccucggcuucccaaagugcugggauuauaggcgugagccaucgcaccuggccugacacaucuuaacauuugugugggaagcauugacacaacccucauccuuugcuuagucagauuugggaagugcuggaagcuucuugucgaguuucuuguuagugcccagaucacucauucugaagcaccauuucuuaugucuaauagaaaacagaaacaaucaugcuuguguggacaucaucugucaauauuugaaucuccucaacucuuccuaugucuguaauaguacucaaauuugacuucaaauuacucuacuuagagcucuuauuauacugggugcuaaugaaaaugugcacauccuuaacacgcucuuugcugaugaaauauuuugaacucuaaauucaucuggcacugacggagagcauaugccaucucaguuugugugagggcucagccaaggguucuuccuggacuaggaaauuaguaggagccacagauguacgcagucugugagucuccauaaugguguagaggauauuuaauagugucuguuguugcaggaagaagguuuugaggcaguguagacuucauuguguuucagaaugauuaucuuuccuggaagaacuugacauccuaucucugaacgcauucugaauguguugaaauuuuuauuaagaaaucaauauauuuccacaagagcaggaaucuguagacuuagagcaaugcaaaauaccauuucaggcauuuuucuaauuucauaaaacucuaggguccugggugauuggcauguuguaggcucagaguauagaaaggacaacuacacagcucuacgucaaaucaaucuagguaacuuucauacuuguuuauuucaaaucaagcugaaaguuacaugguauuuagucuguguucuuagcuugggacucugaucagcauacauaacuucugacaacaugucauuuguguauuacacauagaaguacacugagauauaaagagaauacucuaaugguaaacuaagccacugaauaaaucuaaugcuuacugaauucuuacucugauaguguuauacagggucacggagaagguaggauuguuuaaccuaaacguuuuggguguuucuaagauccaggagaguauuuaaaaaucacugaccuguuuagcagaacaaggagucauaaaaauguaaggcucagauuuucuuagauauuggaggguauuauuaaauuaggcacucaugauaaauacuggugacuaugguagauauuuacuacggaucaaguacuuuccuaaguguuuaacaaauguuaguuaauucauuuacuuuaacaauaacuccuuaaucuugcaaauacuaucauccccuuaucuucuguuagaauacugacuuugggguaugucuuggguuuucacuucuguucuccuugacucaagaggccauuacauuuucaaggcugacagauguccccagggcaaaaaauguguuuucuucuucccuggguuccagccuucacuuugauuuuggcucccugauuccuuguuaucuugucugcucaguauuuuaaaauuuuucaaaaaacuguuauccaucauuuuuaguuuucugugggagaguuguccaaauauacuagccugcccuauuuccaagaauggaaaucaaacuugcuuauuucguaguucacaaaaaugaguacggagaggccagugacuugcucagaccagagaacuggucacugcagagucccugcugaaauccagcucuuuaucccaacucccagugcuguguuuucuaaaguuugucuagucugucugauaguuuugaucuugcugaccacaagagcaaaguggagcuuugaguaaucggauuacaaguguaaugaauguggaugggaaaucgcagaagguaagaauuaugucugaacaucuuuccccuaaauagaguguuuggucauaguucugcccaaacuguuguguuuuggcacugaucugucaaauacuuuauuuauuauuuuuuuuuuugagacagucucgcucugucacccaggcuggaguacaguggcucgaucuuggcucgcggcaaccuccaccuccuggguucaagcaguucuccugccucagccuccugaguagcugggauuacaggcguccaccaccaggcccagcuaauuuuuguauguucaguagagauggggucucaccauuuuggccaggcuggcuucaaacuccugaccucagcugaucugcccgccucggcaucucaaagugcugggauuacaggcaugagccauugcacccgaccaaugugucagacacuguagaggggacucaugcagaaugaaucaaauaagaugaaaauuuguggauuuucagauugccuccuaaagcagccagcaaucccauggaagaguuacuaaaucuaucuugguuuaggguaaaauaagaaauuagaaaaaucuugaacugagcccauuucagucuuuuggaacaggaauuucuaucaucuacuugcuuucuuccuuucuuuuugcccgggguaauaucuuucucuuuauucucccaucuuggaaaaaggguggcaauagaacaaggggggggggggcgagaacuaaauagauucagcagcuucaucccaggcaguuuuucauuugucacuauguugccuuaauggauuucacacaucuauuuccuguauauuguuuagucucaccucuagauguaaacacuucucauaccacaauauuaucuuacuuuucacuuucugcuguuuuaacucauuucaauaaagaacuaaugagcccaccauuguacaguaccacacaagauguuauuugugucaaguauguuucuuuccuauaauaaacguacaucacaguuggguaugauauaaguauauagcucuauagcuguauauauauucacaugguuauuuggauaauaaauucuguguacuugcugaacuaucguauugagccagccauacaaguuuuaucauugugccuacuguugauacuaugggcugcuaugggauauucuguccucuguguugggagcucacagauauuuucugucuggcuuaauaccaggauuagguaugcuucuccuggacacuuuguguguuuuuaucugaugguuauugucaaucuuguuucccucucugcuuugucuacuuaauagcuucuaaaguuuugacccacuucuagcaaauagccaguccuucacugugugcauuuugauaaacucaucauaccucuggccuuacuguucugcuacuuuuauuuugcagucacuuggguccuucaaauauugauuucguauauuuuguguuguauguguuucuguaaucuuuuguggacacaagaguuggguauaaacucccaaauaaauauauucacucugcguggggagaagugacaggagggaacguucagcugguuagacagagaugugacauucuuacuggggagucuuuacagcagugggcagagcuucagccuccuuuuguguccaagcucugccauuuccugaucccuugggcaaguuuucuaacccaucugagccucaguucagauauauaaaaccagaauacuaguaaggcauuugagaguuuagcgcagugucugacauacauucaagcucaccacaugugagcuguuacucuuucuuugagaggugaggaacaguuuaggcagaaggaauagcaguuacaaaaacauggugguauaaaagaccgugcaguguccugguacccuagcaggaguaaggaauggccagguguaggcccugugcaagguuuacaugaaaaugagucuggacaagaacuucuuggaugcucaugugauggagguguauagugaaugcugcugaaaccagcaacccagacagcaauuuuaagauauggagugagagaggcugcuguuggugguguggggcaugcauuugucuuguguuacaguggaguaguccugugguucucaaacuccugugugcauaaaaguuaccuggggaccuguuaaaaacaguuuucucagccccacccccagaguuucagacugaguagauaugagacggacccuaauaagccaauuuaaaaaugggcauacaggugauucagguggcggauacacuuugaaaugcacuugguggugcacuggaauaguuauugaggaaaugcuaacuaaggggcaggccugacaaaguucaaggagagggaagauggaagaaaaugacuucaaaguaacauguuuacauucauuaugaauuaccauugcgcaugcuauggaaacacuaguuuauagugucuucuauggauauggauaaaugagcaccgguccuauagauuuuuuucaaagguaaaauauaauuagaauucauaugauuauucuauuuauuagguuugggagagcuagugauuuguccucauccuugagauccagcaggagaccaagggaaggggaagccuguucaacagagagcaaucaaagaaagaaaggugcagcagcgugaggucaggaagugggaaagauggaaaugggaaaggguggaaaaagagcagucagauccgauuggucaggaaucuauuugugaaggaacccagccaguauuuaaccugcuuugaaaaagcuagacuuccagcauuuuuaauuaguggauugcucgcuuuugaaauugcccaguugggaauacucaaguguugauguguuuuaucugccugcuaauuagcaggcugcuugguugaccauuacuuuuccuuuuuucuguggacagaagauguauaugaaggucucuugguacauuccagcucaagucuagcuuaaagugcauaagaaaaacuguguauuuaauaagaguucuuacuaaauuauaaaucaaauuuuaauacaucuuuucuccaacuugauuccuuuugcucuagcacagggcuucucaaucucaacacaauuuuuauuuggggucagaacaccaaaaauauauauauauauuuuuagggacagggucucacucaguugccuagguuggagugcaguggcacaaucguaguucacuguaaccuugaacuccugggcucaagggaucuuccugccucggccccuccaauuagcuaggacuacaggcaaguuccaccacacuuggcuaauuuuaaaaauuuuuguagcgacagaaucuugccguguuucccaggcuggucucaaacuccuggccucaagcaauccuucugcuucagccucccaacgugcugguaucacaggugugagcugcugugcccugcacaggguauuucuuacuguggagagcuguuuugugcaauuaugagauauuuaauagcaacucuuggccucugugugaucaaugccacuagcaacacccaaauugugacaaccaaaacugucuccuggguggcuuugccaaauguccuuugggaugcaaaagccccacugaccuggcaguagcguccucuuuccuccaagucucugccuacuuuucauguuuaaaauccucuuuuaaaauugaaaagauaaaaugaguccaaacaauuugaaaucuuaugguacuuauagggauucaaaucuguuccuccauuacuuuuuggccaaauucaagaggagaaaucucucaaaugaauccaagcuggcuguuauaggugaaaagaaagucaagaugcgccagacuuuuaaaagcuugcagugguugagagauuuuguuauuuauacacuuuuuauuuuggcugaaaauauuugguuuuuguuuaagaauuaagagaaccguguaggcuacaaaauuuauuuaugugcgaaucccagaggguuguaaguagcuucuuugugugcuucaguucaacauauacaggauaggccagcauguuggauuguuaaacagcagaucuggggaagguuuuacaccuuuucucuaggcuuggugcagucccgagagcuuucuugacaugccuugaagcucacagugcacugauuuaaacuguccauaggggacaucuguuugcaguuuguguuaucugcugaagcaccaacuaaaaggaagugaaauaauauuugucauuaaaaaaaaaaagagaaguuaauuuaaugguaauaacuuaguuguuguugcuuuucuaucucuuaagauauucugaaacaccauguacucuacuguaucccaaaauaaauaaauuaauuauacuaugauuacuucugcugauaauaaaauagcaguaauaauaaaaggaaugacaguagagcauuaagagaauaaacaguaucacugaaaugugaggaaacacaauaaaugggauugugucuccugaaccuuaguuucacacuuccuccuccacuucugucagaggguguuugugauggccgucuguuaucagccgugaucaaaauaauauaacagugaaacuuuuuauacuuaugaaggcccuuucaucaaaaaucucacagccauuucuaaauauagagcaacugaucuuuaaaacacuuuuauguuuuaagcaauuaauaugguaacuuagcuguuagacuuuccauccugcguauuugccauuuggagcguggauggaacauuucguaaucuacucagcauuaaaacuuugcugguauugaguuuagaauuccaacuuuucgaugguucauguaggucuuuucacugucaucuaucaaaacaaaacauugcuuuauaauggaauaaccacauucauuuccacauaucaaaacccagauuaaggauuauagaccaaaugguaugucuaguuuaaaaaaaaaaggaaagacagagacaguauugucuuaaccuaaaaaaaaguuuuguuucaguccuaauaucccuguaaugugcugguggaaauagacuacugaauacuuucucagucucauuuucuguugcaugucuggugucuucugugauaagccugggcuauggaacaaaaaggauccaagagcauuauggcgaggaugcuaaagguguuaguguggauauuuaccuuaauuuaacuuuuuuugcauuaaaguuauguuagugcauuuuuaaacuuauuuuauccaaaagauuguaauaaaacuuuaaguacaguuucacaucuauaaagacugaggcuaucaaacacugugaaggauggaaguaauuuuuauguuuauaccucugguuccugaggguccaguucauuucuacugugaauuuaaaugaguuaauuuaaguagaugggucagaagccacuaucaucaugguagcccggugccugguucuuaauuaaaggcaacaggagauuaauuugaaacauuaauuugaaagugcauauacaaaaagaaaaaauuacugcaagaaagccuaaagaacuuuucucuugucccuagauguagaagacagaaguagcucaggguccugggggaauggaggacauccaagcccguccaggguaaguauaucuaaucuuuucucccacaaccagacaucccacauauguaaauugacaaacagaagguguguuucucucucucucucucucucucucucacacacacacacacacacacacacacacagaggcaugggcaugcacacgcacacaaacacacacgcauauaugugcauacuaaguuuaaugaggaucagcuugacuuuggaauuuuuuucccccauucucuuauuggaugcuguuauucaauuugacaccuguuccacuucugcuaaccagaagaaaauuccuucguuacauguuuggucuuucuuuugucaguuauugauccauauuacauaaugcuguuuguuguagauggaaaaacuuaaaaaaauuccuaauaucccuauaagguauuggugugaauagacuacugaauaaucccaaagauacacuaugaaguucuauccuaccaguauaaucuacguacugaaucugaguugauuucgcuauguagacauguuaucauuccaccaguagggacuuugaucacuagauggaucauucauuuauuugcccucaacuuuuugcuauucuucuccacaguuuuccuacaugcauugguuguuucuuggggaagacccaaggaauauaauguaauaggaauguaauaggaagaccauggaauaagaguugggugggugguuaagcaauacguguuucuuguauguauaugaucuugggcaugucauuucaccucuuggguccucauuuucuuauuuugcaaaaugaggaaguagauccagaggaucaucuguguuucuuccaguuuaaauauucaugauuuuguaugaaauuucuuuaacugaaucauugcuaggcccucuaaaauccaugucaguuuuuaugauguacauacaaugccccagauuaaaaguacacuucguguacaugguaaaaccagcaugucuuccuuucccaaccagcuauauauauauagaugaagcauucugcagggaggguaacauuuuacuguaaguguucacacaaauuuggguugggggaagguuccauuuuggcauaagaggcagggaagguaaucaagcugucaaaaugagggcauuucagcaagucagagcuagacauuuccaccuguccuuggcauugugauccuuagucuaguguucaggguacagcaggaucucuaagcuuaccaguaacuuugugagcccuuacaccagcugucgagcuugacauucuaaugcuuuauauggauggguugaggaaaucuuuccuccuccucauguuacagucugcacuugcagaaauaaauccauuccccuugacagcaaguggagaucauagaacuccccucaauuguuuaguucauccagauuuucacaauuucuuaugauuuauccauucaguacacaugguacuuuuaauuguguuucagaaaacaaggucuguuuagaaucaucuuaauuuaggauuaaaacuaacuagcuuuugguuuuuguuagcuguccugccauuuuucucaaggaauauauuggugaauaauuucaaaccaauuuuguguaauuuauauuuucuaaauccagaaguuugcaugagacaaaucauuuguggcagauuuauacccaggcguacuuucaaggucucucuuuuuucaucuuaacauggggauagugucuaccuuacagcacugugcugaggauuaaauuagauaauauauauuaagcuuuuaguacacuaucuaggaugaggacacuuaauaagugauaauuagcauuaugcaaugccugguauagagugagugaguguacuaugauggguauuuaaaauguagccucuuuuuauagauggacauguuggcagaauuagauuacaguaucaggcaaguuaauuguuauacacgaggaaaggugauugagaacgggguaguuuuccuuaagguugaggggaugugucuuuuccuuguucaugcagcagcccucucuuuugugugggcagauuuugcccuuuggcucacaugcaaccgauaccucugaguaaauuugacuuagacuuucaugggcaguuccaccagcugagcagaaugacuuuuuccccccuuuuuggucacuuuaugcacuuuaguagacugaaaguugaaccauguaguauagaugauuuuaacucuuuccuauugcguuaucaaauuuccccauuaaaauuaaguaacuggacagcuuaagaacauuguuuuaauuuuaaauuccccuuaaaacaauaagcugauuguaauaaugaaauauuucugucaaaauuugucugccuuacaacugguuguuuuuugugacaugcuuuguccaacuccagaaaugcuaauuuaugcuaauguuuugauguucauauccuaguuaaacccuaauauucuuaacuuucuuauguguuaauuacuuaugugacaaucuaguucucuuacaaccacaauaccacaauaguaacuauaauaaaacauugaaacuucaguauccuaacaccaaauguuauuguuugaauggcucuaucuuggucuuugaaaagcaauucauugcaugcuaugccuaauuuucccuuguggcacaauuuugcuuuaauguggccuuauuaaaauaauaauuuuuaacauaagcaauauacuuuguaugugucuggugucuuacauacacuauuuuauuuaaucaugucaacaacuccaugcaguugauaccauuauuauuauuccuaagauuucucagcuauuaugaggaaaauuuggacuucguagacucuagagcuuucuuuuagccacuauaccugugaaagugcagauuccuucuagugaaguuccagggagggaauaguggacuccaauuucuuuggaggggagaaguuuugguaguggagcuauguuuguuuaugugcuguuuauuaauauaaaauaauaacuuacacugucauuuuauuuacagaacuauggagaugggacucccuaugaccacaugaccagcagggaccuugggucacaugacaaucucucuccaccuuuugucaauuccagaauacaaaguaagacccauuuuaaauuaacuuacacuuuuugaaugcucaaguuuuacuauagaagguaaaaccauguccuagacagagguucugcuuuuagaaacuuggauauuuagucaguucacuuguaauaaucuuaaauugcagagaggauuggcagucuguguuugguaauagugcauuaaggauuaaguuuuacaagcauauggaaugaaaugcuuuuagugauacugaaucuauguggaaauuuuguuuuccuuagaccuaaagcacggaccacaguuucaauguuguaucaguaguuuccuaaguuaagguagaugaagucaaaguggugaauauuuagaauaaaaauaucacugggcuuguugguuggcagugauauauagucaguguuaacugugauuucugcuaaagggguuaugaaaauaaaugguguuaaugggcuuagugugcuuaaaucagaguagugcauucaaguugaauuguaaaaucugauuguauauuuaucaaggcaugaacuuuagugcuaauggccuaggcagaccccauccugcuuuauuaaagcaaguuaccuguuaguuugaggcugucugugaaucuccggcaugccauucauccuggcauccucagcauguuuuucugcuuuuggcuacccuguagggauguuuguuuaacagcaguaacuugagcaaugaaaagaugauuccuaauggcuuaaaaggucccaauagcuggcuacuuuaguuuugauugaaaaaaaaaaagaucuuuguucuaguaaacaugaguucuuaacaauauuaguaaaucucucaaccuggccaaauucucuugagaaucugucaauaagugaaguuaaauuucuugguacaaucuguuggacaacacuccaaggaaacacacacagcgaugauuauauuuuucugagaccauaacugcaaaugcuucuaaagaaugucaugauuuuaagcuuuggaagcuauaccaguuacuucagguccuugaaucucaggcauucuuugaaaaaucaccaucaaauccaucuaaauggauuucagauauuuaacacaaaauagucaaagcagauaaauacuagcaacuuauuuuuaauggguaacaucauauguucgugccuuugaguaucuuaccaacuuugagaaccacaaaguugguuuuggucauagaauguucuuauuuuugugcuauuuuugccuucaaaguaguaaauuucauauuuacguuuuaacauuguaacucaagcaggaaucccaguucuuuaucaguuguugauagaaaggugcauuguuucuuguucucaggauauguagauacaggugaccagauauauuuaucaacuuagauuuuaaaaggcagcuuuugacucuucagugucaauaguuaugauuuuauuucuaacacccuugcuucucuauucaucuccacacaaccacuuagaauaaaagauucacuugaaaauguagucuugagaaguagcaccuaaauaauauacuaacuuccuuggauccuaaaaugauccuccaaugagcuacaguaagaaaaauagaauaaauaaauacucauagggagacgcuuauguuaucuaugugaaaaaaguuuuaacucuaaagaacaacuugauaaauuaauauuacagaauacaccaagcaguacaaacagauuaaaugauuguucuguucauguuuccucaugggcaacugcuuuacaaaucaaauuaguuuuucaacccaaauaguauuuaaaauauaaguggccugacagucuagagcggagagagcugauucuuuucacuuaguuguuguuuaggcugcaaauccaugucagcuuugcucuuuuauccugucugcccuccuucccauuaaacucuuaaauauggagaccaagacagucuccugcauugugauaggaaaugcuacuauguccacgaggcccccacccacuguucccagugaaaggacuucucuguuagauaagcugucugguuugaaacauggcucuuuauuguuuacaaacugcuacauuuuccaccucgagcagauuuuugcacagaaaagaauugugcuugggcuaaaugguuuaucugacauuaacggcgcagugucagacuggggucagggaagucacccucagagcgagaggguauugcgcgguaugcaaaaaaaauggaaaagggagaaaaagacauugaaacaaguaugaaauaccuuacauuuuuaguuuagagaagaauaauuuuuuuaagagaauugacucuuaugcugcauuaaaaacuucccaucgcuauaauuucucacacacccgaugccuucuugauuggcuugcguaucugaaggcuagauucggggaacaaagauucucauugauuuugcccaagcugcuguuuauuuaaaaugaaaccacuuuucagaugagccauauuugguguuauguuacagcuuuacaaagaaaagauagaucauuuucaagaaauuaacgacaauuaauuuacaaaugauaauaaaaacaaaguaagaucuauugguguaggggacaguuugaacucauagcauauaugcuguguucuaaaccgcacuuuguguccagacccagagcccauguugugaccuuuguggauauuuuccuucuaccaaaagaagguaguagacuuuagcauaaguguuugacaacacuccagucuccacuuucagaauguuuaacugguuuuuguuaaaacuacaaaguauuuguuucugucucaaaggcuuaauucugcugugaugucgcaucaggguaaaagcuauagcaucagaaauaaaucagccacuuuauuggagcagauucucuauugucaaaucaaucaagccugugacugaauuaggcgucugcuacagaaauaagugacacuaauuuuauaggaaagaguuauuaacugcagaugaccugauuuuuuuuuuuccuuuuuuuggugaacuguucauuuaguaagguuuuauuuuauugcaaagaaagaaaaaaguacuggacuacucuuuccuuuugagaguggauuaucauuaauuauguauuuuguucuuuauggcaguauacaauuuuagggaaaugauaacaggcauugcuaguauauuuguuuauaaccucuaugguaaugaaacccauuauuacaacucugaacuucuugauuucacaugaaugguuuugcauuuuacagauuuuuaaacauaauacuucuauuuggcacugaaauuccaaaacuuaguucauuugugucucuauuucacauuuaugcaaagugggauauaaauuauaagaguaauaaaguguuuuagccuaggcaacauggugaaaccucaucucuaccaaaaauacaaaaacuuagccaggcgugguggcacacuucuguggucccaacuacuugggaggccaaggagggaggaucucuugagcucagggggcggagguugcagugggcugacaucaugccauugcaccccaaccugggcaauaagugagaucccaucucaaaaaaaaguaauaaaauguuuguuuuaauuuauucuuuuagaaauaaucuuguguguguggaaaaaugcacuauuugauaguuugugaaucccuaaaguaaauaaaacacccaugugugguuauacaugcaugcacacacauguacacccauacacacaauguauguaucaugcuagaagacuuaaugacguuucuugguuuauaagauuguucuguauuccugucugugguuauaguugucauacaggguuuuagugguugauacuuguaaguguuuuaaagaagaaccuaacuaacagaaacaaaaagcaagcuccuaaauuuuuuuuaaauaggugugaauagccuuuguguuuguuuugauguuggcaggguugagagaugucaguacugacugccuacauugaccaauucauauacuuuuaccugacauuuacuaagaacucacucguugcuuucauuguguagauacaugccagguugcauuuugccuuaguugaaauuccaugcauuguuuuauaucuggagaaaauaaaucauuucuuccuugugacugccuaucauuauuaaugauuauaauguacacuggaccuauuggagacuucuucauugcaguuuuuaaacaauuugaugaaaccuuccuaggugguccauuggauaccuuucagaguaugcuaaugguagaaagggucgaugagucuaauuccucuguuuuuuuaagaggguuauuuauaugcuauggaauaguuugagaauccuggcaagaaguguauggaaagaauauggacauuaaaaaaaacuuuuuuuuccuuugucaagcacuaaacuuuugcagguaauuguccagauauuuuuacaaugguagacaauauauuuucuagcuaaaacuguuugcuccaaggaaggagcuaagcauuccauuuuccuuuuauuauuccagagcaucgauugaaagcuagauugaggauaagugagcaaguugccccauaaaauuacauacaugcauuugugacugaagggugugaaaagcgauacuuuuguacauuuggcuacagcuuaguucagcaucggggcuaugcuuucacauggcccauuuugaaugguucaguuuccuuacugugguauuugguucuaguccuacucaugguacucucccagagcauuaaauaauuuaccgccauaggguagcuggguucuaaccuagcucagcagaacauuuuucugcuggauuagauugagguuucaggcagaacugaagaaagcugcuggcuuacaggaugaccuuugaaucucaucuggguuagcgguugauauuuugauuugguuacuguggucauauugugacagcugcuagcucauuauaauucgguuccaccgcuccguuugccuagcaggaauauuuagguuuguauuacuucagaguguuuauggcuacccugaguuuagcccagcauaaaggugaaguguugugaguguuuucaaaucccaguggcagaagcaggugccacagucuucuuguaaaacagcaaaugugaguacaugcuaauacagggaguuuuacucuucauuguaaaacagagaauaaccaaugaaucagcuuuuacuaggaaaaguguuuuuggaagccuuaauguacaaaggaaaagcaugacuacaaagaaacauaauuuuucaaagcacgaaugagauguuaccugacuucaugguuagauauuuuguucuuugcagaagugugaguauuagaaaauaguaaaaccuguacaauaauggcaaucauuugauguuugaaaguuccaaaggucaaauaaucuuuaguaacuucauaagaacggaacugugaauauagaugucagcucuagaaauuuuaguucacuuuuuaaaugcagcgaaauuagguagugauacaagcaggccccuuugcuaguucauuaguuagggacaucuuggugugcuucuuuuuuuuuuuuuuuuuuccaauaacaccuuucagcuugauguuaucucgacaucaacucuuaaguguuggacuuauaauguggcacaaguaauuucugagaaaggaaauuauuaauuguggucuuauuugauuuuacuuugggaauuuucauuucuuuaauguuaaauuuaaaaugcccuccugaaauauuaacaaguaugacucguuugagccucaucgcugguguuuuuagcaaucuugauuguugagcuaaggcugguagucaggagucaggagaacucaguuuuucuuucuucuacuucuuccuuucuucuucuacuucuccuucuucuuuuucuuuucuuuuuuuuuuuuuuuuuuuuuuuugagacagagucucucucuguugcccagacuggaguucaguaggaugaucucugaagccucaacuuccugggcucaggugagccucccaccuuagccugcugagcagcugggacgacagguguacaccaccacaucuggcuaauuuuuauauuuuuaguagagaugggguuuuaccauguuagccaggcuggucuugaacuccugaccugaagugaucugccugcuucagucucccaaagcccugggauuacaggcgugagccaccacgcccagccaagaauugaguuuucuauucuguuuugcuacagcugccuguggguccucuggucaggucguuuucacaucuuuagguugagggaggaacagcucuuuaggugaucucugagauaauuuuauuaucuaaugguccauugaucuuucugauaugucauuuuauccuuauacuauauuuucucuuuggagauguuuuauuguucuuucuaauccauucaucucuauuuuaugaauaccuucaagugacuuugccagugauguguuuuccaaauguaauucuuuaaagccuaacuaaaauagauauuccuuuuauaucucagcugauuccagaucuauagcuaaggaauuggauugguuggggauaaauaaaauaauaacucauuaaguugagucaccaggagaaaaguucugugcauagaucaguauuuagcauagagguuguaggaccucaauaaaugacugucgagugaaucagggaauuagauagauaggguuuaaacguugaaugaaaagcccauacauuaaaguuaggccuauaccuuacuguaccaagaagaagacccuaaaccagagccagucauauagaaauucacauuuuguucuauaggacuauauccuugacugggcaaaauauucugccaagauaggaaacgggccauauuacaguguggccuguuucaguuuucaguacaccacagauuauuuuauauauaagcggaaauaaguaaaaucaauaauauuuugggucgggcauagugccucaugccuguaauccuagcacuuugggaggccaagguggaaggauugcucgagcccaaguguuugagaccagccugggcaacauagcgagauccuguuucuacagauaauaaaaaaauuagcugggugugguuuuaugcacuaguggucccagacauucaggaggcugagguggaaggacuacuggaggcugggagguugaggucacuacagugagcugugauugugccacugcacuugcacuccagccugggugacagagagagaccccauugcuaauaauaauaauacuuauuacuauauuuauauuuuuguaauuauauaauaauaauaauuacuauuauuauuauaaauaauuugaaaggccauugaaaaaaguugcguuucugguauugagcuaagauaacugauuuccuuuuguccagucagaggacauuuccauucuucucucauuggucuuguuuccuuuccggccuacucugugauauagcacagcuaaugcugugguccucaaacacuuuuagaguccaacuagguuuacuaauccaagucguauaacauuuagaagaauuucuaaacagaaaaauguuacuugaaaacuauggccaacagagauguauagaccuucuaaauaccaggggaagauuucucacauagaaaguuauugacccaaagagaagauaaaucauuuaagcuucacauaaaaguaaaaagcaauuuguaucagguaggaaugcuuuugcuucgaaguaauggaaaaugugacuaaugauggcuuaagaauaauuuuucucauucuagaaaucuggugguaggucccugcuggaagugguuugcagcucagugaugucagggcugguggcucugugauucuuuuguccuuccccucauugucuaaagaugggggucacagcuucuugugucaaguucagguuugaugcagaaagaaggggaagggugaguugaguggugucuccccaccacacugcuuccccauaacccaggccaucuccagcugcagagguuggggcagggcugggaaugcagccugggaaauagacaggagagaagcaaguuugggacucauacugggcuuacuaacuugcaguguucaauucacacuuuaauuuuuuaaagagaaaaauauauaauuuucuauuuaauaauuuugaaaauuaagaacaaggccuuaacuuucauguaauaaaaauauauaaaaagaugucucagcucuaauuucuggucagcaaauuagagaggaagauggaguaggaaaaaagauacuguaaagaggaagauggagaaaguacaggcaugagcgucuugcaugggaaggagcgugaggucugcuguuugcaucucaccuucaaggccugugucuucauuguccuaagcccuugagcaaggcagcaaccagccaaagccagcucuccuuaccuuugcuuuccccaggaccuucucuuuuaggucucuggcuugacuuucugccagccuguccagggcacccuugucacgcaacaggccuguagcuccagccaccaaccacucuuuucuccaguccccuggguggucuuuggcagagccaaaggccaggcuuuacucccagugucuccugcugcacccauccagagcaggccuggcacccuggagcacgucccugggacaugcugcuacaagugacagacaaagaucuuucuccuggaccauugcccaaacaguuuccagggaacuuaccuccagcaaccugccaugucaccaugaaacagucagacaagaaugccuacugccuaggggagaaaacccucuauuuucuuuuaauauguacacaauugcaguuguugauuuuuaauguggaggauuaggugcagccaaaagacauuuaguuuuagacaacaugccaagacuggaugaaauggugagagcuggauccaacuuuuguccagaaguuucccaacccuauugaacagucucaugucaugaaucagacccauuggaacagaggcagggggaaggaccaucuaucauuaaagguaaccaggaugugaaauaaacagugcugcuuuuauuuaguagaaaaaguuuuucucuagguuuuuacauuuuuauuuauuuucauguuuuuauuuacuuacuuucuuuuuagacacagaaucucacucugucacccaggcuggaguacagugacaugauuauagcucacugcaucuucaaacaccuaggcucaagugauccucccgcuuuagccucccaaaguucugggauuacaggugugagccacugugcccagccaauucucuaagucuuuccuugggaagaugguuucucugaauuuugcauaagcccuauacuuaaaaugugucugugacaguauuaaccaguacccuacuucuggacuggaucuuggguggcgggguugcgauuaaacacuuuguguuucucaaaccucucauuacuccauggcuucaggagaauaacaucaguauaguuagggaauccugaaccucacauccuugaaacuucuguguccaccuuaagugcuguauucauccucaauaaaaauaagacugcuuucuuuguucacauuauauauucuuagaaccaaagaagcaaaggagcuguuuugagcagugcacaucuuacagggugucaugggacaguggauucuaggucuucaggggucacuucagcauaauucuuggcuuuucacuuccuagugaugggugaugggacauugggcaaauuuccucagagcccccguuuucugguuucccaggugaggacagggaugccagccuggcccaccccucccaggcucacugagaaagauguggugaugugauacacuuuguaaucacugugcucugcuguguaacuguuagggcauugcaaggcuaaccacuggucaucugucauuuucgucuggguaaugaauggaaaaaucuauagacuuugggguuuugggugguagcaauuuuaaaauaccuauaccuucuaaagagauuggaacagaaggcaggagcagguggagguaguauagaauguucacuucuguaaacaucaagaccaaaaugaaaaggcuucuuuuuuagccaguccacaaaacaguaauccuauaaaauaaguaccucuuuggggacagcuguguuggauucagaugcucccuuuugugaaauauuugccuacagccauguuucucuccauuuuaaauguucucaaguuucaucuuuaaacacaaggccaagaacacccuggugugguguuugaguggugagacuagggagaacccacugacaaaugcagauuucuuugccuguguuguaggucaucugaauaauggagucacuacaagguaccaugguuuucaucaaggagauaguuuuacaaauaccuuccauauucuugggaauguuuuggagacaguccuauuccacuucauuucuuucuucuccacagaugcuugguauagaauguugccucuguauaugggauuauucucucauucccuuuacuccacagacgcuugguauagaauguugccucuguauuggauuauucucucauuccccuuacucuuaagaguuuuugaauccgaaggaaacauguuuuguuuugaguaaaaggagguguucaguggaucucauuuucuuuucuuuugcggaauaugaggccuaggaacuaacaauugcaaaauauauggagcauagguugagauuaaauuaaauuuauuucuaagugguuaauagacacagcucgaacauuuuucaucuucuugaugauugcuuauuaaucacuccuuaauuccuugacacauuuauuaauaggaaaaauugcaaggaagcaucauuugaaaguaguauaaaauacagcugguuauauuguuuauguuuaagauaaaacauuuaaagcuuucacguagguugaaaaugccacaagagaacuaacaugggggaagugguggaugguggaccuagcagagcacuguggucagcugggcauugcugugagcaccagcucaccacucuccaguucugugaccuugggcaaguuucuuuagcacugugaugaaauuucucaucuaaguaguugcccuguguuuaaaagaaauaacguaaagccaccuggcccuaaaauucaguuaaugcaaauuauuauuacaccuacuauuauguuaucuagucuguuuuucuguucauuggguccgaucagcuuggcaaaagugauaugcuaacuugagcaucauguagugaauucuggcagaacguggaagugauuaauuaaaugccacccccucgugggccauauuaaagcugaaugaaaauagaaaguguguaauaucugauaacauuugguggagaagggggagacagaaaaauugaaggauaagagaaaaggagacacauauaaagcuaauuuuagagcgauagaucacaaaguaagauuuucuagcuuuguauuaucagcauuggcuuggcuuucugagucucgaaauuacuagguuacugacuggccgugccuuuuccucaccuuggcuauucagaccaagcuguacucuuaacagcucaguagccaaaucugaaugcuucaaauauaagcauaaacucuuuauguguaacugauugcacuuaauugggcaauaccaaaucauggaagaaaauuuauuagugacccugucuccuucagaacuuucagaguaauuggaaaugagccuaauauccguguuuuugaaagcuuuaacaauuggucuacugacaggauuaaauucauacuuuauaugguguguauguuuuuucaugcuuaaguuuuuuuccuuauuuauugauggucuuacaaauauuauuuggaaauugagaugcagugagcacagaucuuaaauaucuuggcagaccgccucaguagcuguggaugaucccuguuagcuagagaaaaaccaggaaaaaaaaacccaaccugguacacaauaguuuacgaaaugaucuuugugugauuuugaacaagcuguuuuucauuuuaaucucaguuuccuugcuucuguuacugaccuaacucauggagauguggccaggagagggugggagagcucucugaauuuuuuuguuucuccugaaauaaaacaguucuaaauagacauacuuuugugugauuacauuuuccauuuuucgcaaagucguagguauaguuugaacaccaauugagaauaaaagaagcugccuucucccagucuuuucaagacauuuuaauaguuaaugagauuuugccccuuacccucaugaguuucauuugguucugaaauaaaaauuuacggcuguucucucagcugagcugauacuaguuuaagaguggaauugaguucacaccugcucuggcauaaaaagccucuaugugacuucuuugaaauauucacagagcagaauaagagagaguacucacuaucucuacaacuguaguaacuacacgguaauguugcuugcaagcacuuuagagaagcugcucuauaaacugacucuaaucugcugauauuguccacagauagaugccuccccuaagucaccuguguuccucaagguggaaugugguuguggaaaugcaguugguuuguguaggcagugggucuacauuaacacuguaaaguguacauaugggaaaaucuuugcauuugcuaggccauuuagccguucaagacaugguccguuagucaggcaacguacaauggauuuucugaguguucuaguuaaagagcaggauguguaaaguaguauacauuuaggcggauaauuaauaauugguguaggcuuguaaggcuguaauagaauauauaaauuucagcaccuguuaaaguuuuaucagagcagaucaccuuuccuuacugugagggaauauucccgccuguagaaaaauaaagugcucccacuacacgugaaaaaccuuuaugaugaaaggaggacugguuuuuauaacaaauauuauuuuccauggucacugugauuaggugacauuuuagcagucacauuuagagagcguuccuagacaauaguauuuuguauggguuugacuguagguggcaaaacacugcauagaaacaauauuuuagugcauucuaauauucagauacaguuuacuugucaaagaagccaccuccccccccauaucauccccccacaaaacaauaggguuguucauuuuauaaguucaucacaaguaaauauucagagcgaaagccuuuucuaguggcuacguuggaagggguagagaagaugaaacauagaucccaaguucaguuuuuggcuuugguuguaucauaagcaguuuuuacacuucauaucuuagcugucuucauuuucagacauagaggaagugcucccuuacagcagugagggaaagggcaaaugauauauuugugaaagcaaagcagacuaucuuacugcuuuaaaaguuucauuggcugcuugauaaauaaaauuaacauguuaucgauaugucugcaaucauaugguccucaguauauguauuuuuuaaagccauuuauauaaauuccauuuauucuagaagcugcccaaaaugauaaacuucaauacucaaaugagucuuugguucguacagucauucacccagcaaguacuuuugggaagcuggugaucugcaagcccuauguuagguacuagauaguggcaugcuacuuuucuugcuuucaacuuggcccacauccuaauaaaagaaucagguagauaucagauaauuacaauucagagaguuggggaaauaauccauguguucccaggguguuguugcauacauaucagggauacuccaccaucagcuuccucauaauaaugucuaauuuuuuuuuuuuuuuugagacggucucaccccguccuucaggcuggagugcaggggugcuuacugcagcuucaaacuucugggcuuaagaucuucccuccuuggccuccugguggcagggacugugggcacgugccaccacaccuggcuaauuuuuucuauuuuuauuuuuuguagagacaaggucucgcucuguugcacaggcuacucuggaaccucuagccucaagcagucauccugccuuagccucccaaagauuacaagugugagccacuguguccagcuuggcuaagauuuuuuuuucuuuuuuuccuuuuuuuuuuuuuuuugagacagagucucgcucuguccccaggcuagcaugcaguggcgcgaucuccgcucacugcuagcuccaccuccuggguucacgccauucuccugccuuagccuccugaguaucugggacuacaggcaucuaccaccacgcccagcuaauuuuuuguguguuuuuaguagagacaggguuucaccguguuagccaggauggucuccaucuccugaccuagugauccgccugccucggccucccaaaguacugggauuacaggcgugagucaccgcgccuggccuggcuaagauuuuuggguacucacuguguaccaggcacuugcuaaguacuuuacacauauuauccugcuugcuccuuauaauaaacuucuuuguuagacauugucauuaccauuuuacaaaggaggcaauugagaaucagagagauuagguuauuugcccaguguuguguagcugguaaguggcagaauccagauuugaagcaagaucugcugaacucuaaagccuuguccuuacccaccacugcauugccuccuuuguagagaauuuagaaagaauucccagagguggaauagcagcuaaacauggguucagcugcaacuaauagaauaccugauaacaaugguagguuaguaaaacaaagggguuuuuccccuucauuuuaggaggugucuggaggcaggagguugccugugugaguucagcaaaucaauguuucuuucuucccauucugcccuccuuagcaugcugauuuucauucuucagcuuuuuccucuccucuugcauuucuuucuugcaagcuggcucuugagccucacacagcacauuagaguccccuaaaggaggcaggggaggcagagguuaggguaacauuuauccuuacauauauccuauuccauccaggaagggggaaaaacauuaccagaaucugguggccuugagcaggauucugcuaacaacuuauuggcuaaaccucuagcagacaucuacucauagcugcaagggaagcuuggaaugugaacucuuagagccaugguugggucucugacucaagagacaggcaagggaggagggaguuaggaauggcuauuguauggaucaacaugaauuuucuuaauaauauacgugguaaugccugagcuucaucuuaaaggugaguugguuagaacuauccugauggaaagaaaauuaccaguugguagagaugcuugagcagagccuugggagcuggaagacguaauaggaauacuggaacugaagucauucugugagaugacuaugagauguaguaccacagaggaagggaugacagguugauauggcuuggcugugucccacccaaaucucaucuugaauuguagcucucauaauccccacauauugugggaaggaccuggugggaggcaauugaaucaugggggguggguuuuucccaugcuguucuugugauagugaauacaucucacgagaucugaugguuuuauaaaggccaguucgccugcacaugcuaucuugccucccaccauguaggacgugcuuuugcuucuucuucgccuuccaccaugauugugaggcuuccccagccaugugaaacuaugaguucauuaaacccccuuuucuuuauaaauuauaauuauuuauaaauuauaauuaaaaucuauaaauuguaccaucuccgguauuucuucauagcaguauaaaaaugcucuaauacacaggugaagcuggaauacaauccuggccccagagaaaugaagggucucuuguguuuaggaguggaagaugucagauuuucaaugaagcgugugguaaacuacucaaggauugauuuuaaauagugagauaccaugauaugauuuaugauuuaggacacucaagcaacugugaauaggaggcaacuugagggcaaggagauuacucaggaggugauuaaggcaauuccaagaggaaaugaugagauugagcugaacugggaacaaugaagaugaagaggaggauggauuugagugauauuaaaaugauggaaaugguuggacuugguaacugaugggcaaggcaggggucguccuuggcuucuuggugucuggcuugggccacuuggugguuggcagugccauuuguuaagauguagaauauaugaggagaaguaggucaugggggauuaagguggucaguucaguuuuggaaauaaugaauuuuugacaugucuguggguggacagauuugugauucuggguuugggauugcagauuuggcacacaauauuaauauuucauaguugaagucaugggaguagauaaguuccccagagagagacaugaaccaccaccaacaaggcaauuuguugcauugugacagcucuaacuuuuagaaaguucucaauucuguagcugucagccugaaauacucauuuuucccucugaagcuaacuaguauuguguauugucucucuuuccacauguuuugaaggaugcuaaucuuggcuuccuucaaaagcgcaacuggaaaacuuucaacacauuguagaacaugguuuaaucacaccuuguauucccggucaccauccucugcuguguucuaguucaucucuuuuucccuccaaguggugaauccaagucuuacccuaguauuccagaucugguuugaucaauaguggaucugcucucauuuuuaguguuaaugcagucuaagauuccauguauacauucauauuuuaacauugacugaaaauggagcuugugguccacuaaaaucauuaaguguuuuuaacauuaauugcuuuacauccagggcuuccacaucuuuguguagaaugggacuuaauacguauccucgucugauuucuucauguugguuuuggucugcaaaugugcaauaauucuguccuuucacucuguugauauaggaagugagauggugugaugcuuaggaaugcaaacucuuggauuuauauccuggcucugcccacccuuuacuaccugggugacaucuaaguugcuuucucugagucacaguuuccucaucucuguguugaagauauuauaaaauccaucuguugggauuguugggugaaguaaaugagguaaugcauguauaaugcauagaggaauccccagaacaucaucaacacucaguaauuuuucccuguuacuauuguagggcauauaaggaguuaauggcgcuauuuuugugauuguggauccuuucucucaguauucuuucuggaauacuuucaguaucucuuucuggagagaaaguuuaaggcaagugguucaucugugacgaauggaagaaggaaaugugguucuugauuuugaguugugugaugaacccaaauuuaccaggcaauagauaggauaugaugauuacuaaauuugccauugacugauaguuaacuggcuaccuuguugggucucuugagaaaagaacuaaaacaagaacaacaacaacaaaagcuuaaaauuaccugaaaauaugucucuuuaccuacaccuaauuuuaaggcagaaaauuccaaagugagccagcuacucaauacaggugcugaagguuaugugaaaauucggguuaacacuaaugauagauugagagguaacuguuugcuuuacaaaccgcuugccaaggaaugcccauauuagacuaugaaaauuagacucauggcaaauuuucaggaacaugauucuugugauaaacaagcuaucuggagggugaugugugagcucacaggggaguuuuaagaacagguuuccauuguuggacaguaaccugacagcuaggcauacucagaggaagggcauagauuaguauccaacaaccuguuuuaaaaccaagcaaugggaccccauacaagguccagguugacccgaaccaagguuagaugaaccugacuuguuuuuauaguaaacgucacaauggugacaagccagcagggucaucagcacacuuugcagcuacagacuucccacuggacaaaccauuuucagcuuccucuguuuggucacacccacaagaaguacgaaugguauauuuaaaaagcuaguccaucuugguucauuuauaccaguguguaggauuucuguagacucugggcugguuacaaccuagagcugcagaagggugcagagcuucauguguucauucuguacugugauaaaguucuuugcacguuuguggaaaugcaaaaguucuucuaugcaccuggcuucuguuccggucauuuccuuguauauggguuuugauccggugugacggaagagggaagcuaugcauucugagaucucagauuucauuguauccaauuauuuauaagaccugagaggugcuuuauuaguuaggaagcacugcagauuuucucuguagcuuuuaaaaaucauccugacuuccuauguguuauuuuuugcauuggcacccauugccaaugcuaugucucagaagagccgagacuuguggccaauaauccuuagaaacugauggggcuguagaauuuauuucucugucacccuuuuugaaaauaaaauaaaguuauauuuuucauuuacauggauggacaaauuggggucuuuaaaauaaaaccuacuuccccuuuucauucuuuuucugaucauuuguagcaaaagcuuagugguuuucuguagaacugcuuuguuuuaaaaaucaaauugaagaccaacuugauucugccugcagagcaaagcuaucugccuuuuuagaaaaucuggaugguuaaauuggaagcacauucugcacaugguuuagcaguuaguagccuggaaaaugacccaauagccaagauaguuuuuuuguuuguuuguuuuuuguuuuuuuaaucuucauuguaagugcuuguuuaaaguguaagcuuguaauggacuauuuugcacauuguucauuguuaauucuuuucaggcuauuauaguucuguaaauacauugccugcuaaguugugucaguggagaaacauuagugcuauaagaaaauccagugaaaugugcuuaaaagcauuaccaauuagcgcaugggacuggaucaccgcgauuucuuagugauccuagagaagucaguuucaguugacuucccauuuauuuaaaauggguaugacaacguucuuuuuggagaauagggcagcacacaaaugcacacuaugcuguggccugcugaagaguuuccacugauuugugacuauauuacucaauauugcuuuguagcacccuuagucuaauccacauugaaggagcaaaauccuucuguaucuuacuuauuauacgauuauguaauacauauguuacuuuauauauaauauguaguaguacuuauuuuacuauuuuuauucauuauaaugaaaauaacaaauuuacugggugguaucuaccaucuagcucaagcuguucuauuuuguauuguuuaaauuugagaaaagcuaauauugguuaauaauuaaagguuacaaaaauuguagugggaaaggaguuaaauucugucucucagauaguaaagacugccagaacauggacauaaucaugggaaauaauaggguggauagaaugugauuuaucugcguauguuaaagaaagaaaaauagugaucgugaauguacugaauauagcuuaaacuauuuaucauuauguacaaauggaaacuuacauaaaaccccuguugauuaaguuuuaucugaaacaaaggauaugauuggaaguggagaaugggagaguauuuuaagagcaugugauaauccagcuagaagcuucagcaagucuguggucaaacaagagaagagaaagaaagagcaaggaagcuugauuugguuaugcaaauuuggagcacacauaugaguugggaccuaauggauuguugcacuggauuuggucaucaaaugaugcuuuucauagcaaauauuaucugagccauuaauucaaacacugagaaaugcaggccauguguaggcagaaccacagccuuuuuaucccucaaaacaaaauguaaaaguuggccuugaugguuagaccuuauaaagaagaauaaggggggaagggggaaaggagcaaguagugaaggaaaaagcacccagaauggaaacaggcaugcguauucagacauaaauccaauaaacagacaccccaaaguuaugcuguguaagaauagacacacaguaagaaauuuccagcuaucaggcuaacaggauggaaaacuggagagcacagagcaauuacuuacgaagaaagaggcacaguugacaucaaguguuauagaggagacuggcaugauuacaggaagauguugagaauaucagaaaacauccccaaauuaagagugccaaaaagaagaaagauuaccgaugagaucaugauaaauaauaaugagcuguuucucaaaguaccugaagaaggggccugaaaagugguuugucaagccuggaagacagagaaaggguaauguauugacggacgauggagacacugcuaaaaaauaaaugaaauuuucaccccaguguucacaaaggaggaggugguuggggacagaugucagacacagacacaaauuucccaggggagaaugaagaaauacaaaagaaaucaggauccugcuaaaacaggugaucaaggggugagaagaagaaaaugaauaaaaccccaaaaaccccaaagcuuagcgguagucaccuaaaaaucuucaagaagugagaacaaagaagcuaacaagaagaggaaaaacauacccgcaucacuuagaaaggcuggaaauauuuucauguguguguguuuuuaucuaguuaauuuguuagacuagcccuuuugaaacuuguccuuaaaggaaguaagauagaauacuuaaagaaaaaugauuguggcugggcgugguggcucaccacccagaguggaaacaggcaugcguauucagacauaaauccaauaaacagacaccccaaaguuaugcuguguaagaauagacacacaguaagaaauuuccagcuaucaggcuaacaggccuguaaucucagcucuuugggaggccgaggagggcagaucauuugaagccaggaguucgagaccaaccuggccaacauggugaaaccccgugucuacuaaaaauacaaaaaauuagccaggcgugguggcacgugccuguagucccagcuagucgggaggcugaggcaggagaacugauugaacccaggaggcggcgguugcagugagcugagaucaugccguuauacucuugccucggugacagagugagacuccgucucaaaaaagaaaaaagaaaaaugaucguuuaaguggccuugaauaaccaagacaucuuuccugcuaaguucuuuucgaguuacccauuaugcccagcguugaauguuuacugugcuuauuaaggaugauuuuuguguccuaggugaucacugaguccuugauugggccaguauuuacuggauggaugcuucuuagugccagggagugcgcuagauccuggacuacugggauggaaaagcuagauacuuucugaggguuuuugaagucacuucuuccucacucauauaagcaaccccaccucuuuccaggcauugauuucaguguguucaucaucccuggucuugcuuuuaaccagcuacuugaugggcaaaggucuggagaggggcagccuccuuuguugcuggcucagugugcugugcuguccucagcguggugccugcuuuuugcccuuauccucagauguggaucccucucuucccaagcucuccuccauccccugugcugcaaacaaaacuccuuguuuguugcuccccaccaguggccacgaaggaauuugcaaaccccucaaccuccuacuguuuuggaauucaugaaguuuuugcccugagcaagaggcuauacuuucaaaaguacuuuuuccuuucuucauuuucccacccccugccuuucaaccacugccccgcccuggugcacacaccuccaucccaggcugauaacucccaucucuauuugaaccacccacucccuucucuuggccucugucaauuuuagggcucagcaaaacugggcuuacuaaaaacaccuuucaauuucuguucucagcauuaaucugucuuugcuuaguguucaaagaauacuuuaagauacucauuaaugcaaacacuguuaugaggagggagcuucacuucggucccuucuucucaccuucagauacuacuguaacagcugugugggacuggaguauggaauguuucagagaagcugcuucugaguguguaggagagggcugaagaaacuuucauccaguacacaguuuuguccuguaguccuuguucccauggccaaaagucuucugguaaaauuaaucuccagugcuaccuuuccuaccaggacugcagguggugucuuuuaguugaaacagacucccguggucccuugauucucauauguaauguuccauguucaggugucucugaaagcuguuagacuucauccaauggagaaggguccauugagcuacaucacuuucuuuuuucacauuugcguuucuuuauguagagugaguugcaguuugguuggcuuuuuuucugggaauagaucacucuucuggggacugucagacuuggucccugcccugggugaguuugccaucuuauugaggggguacuaacaugugcgagacaacuauaaucauagcaauaccaaccccaccucaauggcugagugacuaaugagaggagagagugaggggcugagcagaggccucuaggaagcagcuguggucaaucuuagccuacauuuacuuuuuuuuuuuuuuuuuuugagacgaagucucacuccgucacucaggcuggagugcagugguaugaucucugcucacugcaaccuccaccucccagguucaagcaauucuccugucucagccuccugaguagcugggauuacaggcaugcaccaccacacccaguuaauuuuuguauuuuuaguagagaugggguuucaccauguuggccaggcuggucucaaacuccugaccucaagugauccgcccaccuuggccuccgaaagugcugggauuagaggcgugagccgcugugccuggccuaaaccuauauuuacuuugaauuucacuauagucuaccauuuccugaugccuuauauaucugacauauaucugaugagugacauucuugagaugucugcccaggacuccugaaccccaugagaaauaagauugcacuuugcaguucuucaaccuugcugugcaucugaguaacauguggcccauucauacacugcagaugccugggcuccgucugugagauucuguguuuagaggccugggcugggaucuaggcuucuguuauuuaaacaggaauuucugaccuacacauugcuucaaaaaauugucaauuuuguuuucaaaauuguuauuuuuucuugaacucaauacuuauuuuuaaauccuuuuucacucaggaaaagugaaucaucaccuacuuagcaccuaauuauuuaccacuaagauauuugugugcaaaaaauuaauaauuuuuagaucaaagaaaauggauaacuucuaauauguuaaaaucgugcauauuuccauugagagagagaaugggcugaaauuaucccucuuuuauauuuuaauuguucaucaaauugauagauuuaaucuacuggcccuaaagauuugcuucuauaauaauguugugaaugaaaccuucauugcuguagauucacaauucaacaucauacguaugugguaggugugauuuuucuuguauuaaaggaaaaaggguuagcagauuuuuaccaauuuagaaaaaaggcaagccaaauuagagggaagucagcauuauaaauauuucgaaaagaacccccauucauuauuuuuuguaauguguagcuaagaccaagcaacagugaagugggaaucuuugccuuaugcaaaaugguuagggaaauagcuaaggaugcuaagaaauuagcuucaauauugguuguaggcaugaauguuuuucucagggacuugggugauuuuguuacacuuucuaauauuaucucugcuaucuucuaggacuuauuuugugcagucaaagacuuuuuaaggcugucuguucuguaaaagaaauacaaacuccaaguuguuugauuuuaugaguuuuguuguuguuguuguugcuguucagucuguaaaauagugacguggauaauaaagauauuuaguuguauguccagugaccuuuggaauaauaaaacuguuuuugucuguguggguuuuucacauacagguaauguuuuguucacauucuggauacagaccugaccucaggcugcucagcacugcaauuucauaggcuccuaugagguccccggcuaacauuuugacuguggugguagaccuucaccucuuagauuucauauaucuuucauuuugcuucuuuugugcuucuguugaauucuguauauuuaagaaaauuaagaugcagagagaaaauugguuaaugucuccucugugucuuguaauauguggcccaaacagaaagaaaauguauggaauuuagaaauuuuauuuacuuguuuucuuacaucauagaauaccauuuuaccauugaaauuauuaaaaccugcuuuuauugagaauuuuggggaaguugaaaauguaaccuuuacggggaauuaaagcuguuuuauuuuaaugaauaaaguaguuaaauuauuaaucauauaaaauuauuucucuggauguuaauaaccauuucuuuacccaggaacuuuuuucuaaucacagaaucuugauuggugguuuauuugaaggcauaucucacuauuaaugguucaagaauacccauaacuuuuggaaagacucaaaacauauugcauaauuggauuuuaaguuauguuguuuguaagcuuauuugacuuguaucauguagugauuacuaucaguuuuucuggauguagguaggugcuucuuaugauucuuucauagauaguauugagucauucauuaagucuauuccucagaugcuuauugagcaucagacuugugucacauacuugcacagcuugguguuggagauacacccuuuaucaccacauacuuggaguugcuuuuugucugcuguaagacacaggauguagugaacaggccaagagaaauauaggguccugugggagcuccuuacagggagggacauagcacagagaaacucaggguaguugacauuuaaguucagaucugagugaucaggaaaacagccagccagagggagcuggcaugggaauggauggaggcguguuugagucauggcagccagaucuaaagaaggcuacaaguagagagaggacugugcauuucuccuucccaucacuggaagaggaaggguaugaggaguaggcucuacaugaacaugagagccagcucaugaagggcuguacaagccauguuucaguguuuaucauucauucugcaaauacauacucagcacuaugugucagguacuuggcuucaggaaacaaggcagaaaauaaugccugcccuuguggagauuuuauucaaauggggaagagacaaacaguaaacauggcacuagugguuuugaaaaugggucagaaguauguguaguccaaaugguuacagacucagcauuugccaauaucauggagccaaaucuaagacuauuuaauaaaaauaaguuugcaaucauuuccaguccucagcugauaacuacagauagacuuauucuuaacucaacauauuuacagguaaaguugaagguuaccuaucauuuauauuuauugcucacucacauugcaucaggcauugggcuaagcaagcaagcaaaccacauuugagagaaggugcuacaguuuagugcaaucaguauuucaaguucaccagaguagaacuuaagaguagaagguuuauuuguuaaauaagaauacuugaccuuaauggcuaccaaaaaagaguuggaagaaugaauaagaucuaguauuugauggcacaacagggugauuauaaucaauaauaauuuaauaguacauuuaaaaauaacuggaagaguauaauuguauuguuuguaacauaaaggauaaaugcuugaguugauggguacuccauuuacccauauaugauuauuacacauuauaagccuauaugaaaauaucucauauaccucauauauacccacuauguaccuacaaaaauuaaaauacacacacacacacacacacacacacacacacacgaauacuugagaggugaucagaauguccuguauuccuggccgggcacgguggcucacgccuguaaucccagcacuuugggaggccaaggcgggcagaucaugaggucaggagacugagaccauccuggcuaacagggugaaaccccgucucuacuaaaaauacaaaaaaaaaaaaaauuagccgggcgugguggcgggugccuguagucccagcuacuugggaggcugaggcaggagaauggcgugaaccugggaggcggagcuugcagugagccgagaucgcgccacugcacucuagccucggcaacacagcgagacuccaucucaaaaaaaaaaaaaaaaaagaauguccuguauugcuguuugaaaacacauuaccagaaccagaauucuuccuugaaguuuugaacaauaucacaauaacagaaacaucucaagauuuuaucaugcagccagcaaacaaaaaaauucuacauagugauugaaguagacauuugcuugucacucaagaugaauuauuguaaauaaggaguuuuuauuacaaugaacacuuuuuuuggcagaauuaauaaagagcagaggauacuagaagucagugcauagaagcaaaaggagaaauguaguugagcauagugaauagagaagauuugcuuucguuuauuugcccuauacauuaagaccauugaaugagacuauuuuguguaugacaagcauuugaaaaaauuguuuuacucuggcaaucuuaggcugauuuguuuuauuuccuuuagaauaaaaguugcaaguggguaggaauuaugccuuaaaguguuagccuacaaaggacuggaaaacuacucaaggguaacagcugaagaggaaauggcucugucagugucgugcgcauggaugauugggcacauaagggacacaagcagggagaaaggugcagagagaagagcucauaaaaccaaggaggcuugcuuggaacuaaaauagaauagcaaaagugaaaagccuggggagccacuaaugugauauaguuucccucguaacauaaugcaaauauguaaaguugaaaacgugugccgccucuugcauagacauugcugucaucagcagcacacacaguuggguauauuuggcgaggcauuuaaucuccuggcucucuggucucucaguccauaucaccagaggcauguauuuucaaaacaguccagaucaaugucuggucuuuguaucugugguacaaauauaaagcuuacuuguccacauaacagcaaaguaaauccgugguccauuaacgcuaaauuguaaauagugauagucacuuuuguccaacagugucuguaauguuuauugcuaaagcccauacauguuuauugauauuauccuaaucugggaacaguagcugcuaguuaucuaugugccaaacacugugcugcuguuugcaaauuuuaucuaauagcaacuguuugugaggagcauuuguuaucugcauuuuacccauaaggaagguaggagggacagaaagguuaaaauaauccagauggaggacccacucuuggucacugguauguuuugggcuuagcacacaguucugccagacucugcaacauguguucuuaaccaucagacuuuauuucucuggugggcaacacagguagaugugacagguuagaaguauuagauauaaauauaaguuaucgagaugauaugacuaccgaauucacuacugcacuuuuuuuacuuuuuuaaaaacauguauuucagcacacugcuaaaccacagcaagaaucuuuuuaaaaagaccuuacaagaagcaugauuacaggucacaaaaucaagggaaaauauugucaucauuauuuuuuaauaagugauaagugaggcugaugaguguagaccuguugcuuuauuaauagaaauaugugcaucuggugaggacuuguauuugccaagcacacugcuggccuggaauuagacuccucuguggaauucaggucaguguuuacacccauaguaguuuacaaucuuucauaaauuugagcaaaauauuaggaaagcacuuagaagcaauuuagagaaucagaauuaaaguagaaucgguguagcauguauguucaguggagaggggcgaguagaggagugaguuucucugacagaugaugaaucuaguuuguuuacuuuuugggagacccuguuuccacacucacugacaugugaguuugcauccuggcucaagcacuuaaacuccccagucucccuuucugugugugugggauggagauaacaaggccaaccuuacaagguuguauaggguaaagugcccaguguaagauuugaagcacaguaagucuucaguggggcuagguuuucuccuuccucccugcuacuuacuucaugaagaggaugaauaaguacaaaucucuguucagcgcugcaaaggaagauuaucauauuuauuuauuuauuuauuuuugagacagagucucacucugucgcccaggcuggaaugcaguggcaugaucuuggcccacugcagccuccgccuccuggguucaagugauucugcugccucagccacccaaguggcugggacuacaggcgugugccaccaggcccagcuaauuuuuguauauuuuaguagagacaggguuucgccauguuuaccaggcuggucucgaacuccugacuucaagugauccauccaccuuggccucccaaagugcugggauuacaggcaugagccaccuugcccagcccagauuaucauuuuuaaaugcugaaaaccuaaauuucccauugcacugugcuauuacuuucacaguguugacuuucagagauauccgugcaccgccuuuugguagcucccuauguccucuugcuucucuaguugccauuucuuuggaagacccccccgacauuaguuaucucauuuuccaugagugauuuugaaacccaguuugugccacaguaaaauuuauugaaauagaagaaacacuggaucuugagagauaccaccagcaccugcagucuuaacgcuucaucuccucuccugaccuggguccaacucaucuuuuuuucucaucaccgccugcugccaucuuguuuacuccaagucuucaccguucagucagaaauacaaagcccugcaugggucagguaguccucagagaaggagagaaguaagaaagaaaguggaggccggccacggugguucacaacuguaaucccagcacuuuuggaggcugaggugggcggaucaccugaggucaggaguccaagaccagcuuggccaacguggugaaaccccgucucuacuaaaaauacaaaaauuagcugggcuugguggcaggugccuguaaucccagcuacucgggaggcugaggcgagagaauugcuugaacccggaaggcggagguugcagugagccgagaucgccccauugcacucuagccuggacaacaagagcaaaacuccgucugaaaaaacaaaaaacaagaaagaagguggaaucaaagggauguagggguuccacaaauuuagaugagaugucagguuucucagauguguuccuugauuugagguaggugaucuuagaagagcugcaacuaaacuccaacuggcuccuuuuucccccaugucuuagaagaaaaugugcuucguuuuuauucucuugacaacccucugcauuugcaucuuucagcuucuucuaacuugugucuccugggaccuuucuuuucauaacucuauuuucuuucaucaucugucuuuccccugacuccuuuucccuuugcuucaaaaugugcaaauggauccucucuucucuggcagugauuaucaaagugugguuucucggcgaaaugugaucacuuacuucaaaucuccugggaugaugugaaaguugggacccacuucaggccuaugugucaauaccucaguaugauauauuccagcaacuuucccaaaaaacuacuuaguuuccaaggcaguuuggcaucuccuagaguggcacagcaaauuccaugauuuuuuucuagcccuguucguuuugucuuuuaaaaccugucucccucaacauccacaauguuaaaaacgucuaacuugccuucuguuucgcucacuacucuuuuuuuuuuuccugcuuucugcuucugucuucauaagugcaggcaugggaagagcugggaauuuggagucccaguaggguuugauuccuuaaugucauugcucaguagcugcgugaucuugggucacccauguaucuucaguagggcaucugcuuuggagguuuguguggcuugcaagugucauuuuuaaauugggagcccaaaugcaauuguuugugcucuaaaaaucugccucuuccaguuugcuguuggaaaacuuggaaauuauuggcuuugccaggguuguggccucuggaugagagcuaaaaggugaacagccuuuuauccauucugcuuccccccacuuacucaggguccuuuccuguuacaaaucauaguuuguauggcauggcaaguacuggaagggagaaauucucuccagugagccagaaaaugcaacgggaucuguuugugauugauagagauaagagugccugaucuacuuuucccucugccagaaaaguauuuuucccugacagcuggagacaucaaaggucugaagcugugaauacagagagaugaauguucuaauauuaauauuauauuuaaaaauauaccacguaacauuuaacaucaacaugucuaguuuccucugucugguaacccccagucguccauaugcaaaaagaggaauuccaaucacagagguccucacuccaaggagacaggcaaccauuacgugucugugaauagcugaguaagccaaacugugauaguuucugauagaucaugucaagaccuaaauaguggaaucuucaggauuuggagguggggagcaagucaccuggauugaugaggacucacugaugaacugaccaaauuguuuuuuuuuuuuuuuuuuuuuuuuugagauggagucuugcucugucccccaagcuggagugagugcaguggugccaucuuggcucaucgcaagcuccgccucccggguucacgccauucuccugccucagccucccgaguagcugggaccacaggcgcccaccaccaugcccggcuaauuuuuuguauuuuuaguagagaugggguuucaccguguuagccagauggucuugaucuccugaccuugugauccgcuggucuuggccucccaaagugcugggauuacaggcgugagccaucgugcucggccccaaaugggcuuuuuaggaguucucauggaagagauggaaguuucuucuugagugagagcaaucccagagucugauauuucaccuaguacaugggaagggaacauguuuuguccuaagccaggugugaaguauagucauucauguugggcaaaaacguggcaggacuuggaacuucuguggggacccacaaaggagaauagaggagaagacuccaugaaauuucugguccugguguuguguggauggcccagggcccuggccagagagauucaacuacuaggugagguuuuuuucacuuuagacaacccugcuaaggcuucauuucacuuauaugccgucugugggccuuugaugguucuuuuuuccuauauuugcuauggauauauuuaugcauuuaaaaaauuugcaucauuguaacuuuucauugacaaaauauauuuaauaugcucgguuuuuacaguuuugcuuaauuaguuuuuuucccacuuauauuuauuuucuguaacuuuucucuuuuuuguugucuguuuugcucuauuaagauguuauauaucuucuccuccuucuccagaguagaccucucaucaguucaccaaaaucucucuccaguaagagucaggaagcuuaccgugugacaaccccuucaaggcaauaaggcuccaacuaagggauuaagauuguuuuuugacaccaaacauuguuuauccucuuaauuuugagcuauguagccugaaauccaugcucugugaugaaauggaggugguuuaucugagcuuuaauacucuuaaaaaugaagauaaugauagagcauaguaaugaaaauuaaauaagaugcaugcaucuagcagagaagcuaagaaauaggagauucuuaacaaauguaaccucauuucuucuuuaguuucuguaaaaccccaggaauguuagaaaauaucuaggucgaaaggagaagaucaugaguuugguguuaauuuugagguaccuuuaaccagucaagugaagacaugaaguagacaguugaauuuaagggugugcagaucagagaugucugaguggagagucugcaguugaagagcuguuuguagagaugccaguugaugguaugagauugcuuauggagucuugaguaacaggugggccuugagccuagcaguagaaggauuuucaagauuuaaagacauucaauugagaacaaaagagcaugccagggacugggagagaagggaaaugugauguuauagaagcuaugcuaagcauaguuuuuuaagaaggaggggaugggugugucuuuuuuggucaucaaggaagaugaguacucaacagugucucuuggcuuuaaccacuuuaguggucacuguugacauuuucagagaguuuucuugguggaaucauggaauaggaacugacuuuccaucccucagaguugaguugucuuucaucugacuuggcaaaguauuucuuuuauguacuucuaaugugauuuuucucuauuguuuauaguuguuugcacuuuucauucacguaauaaauuaucaguuuccugaagacagaggucaugcaaaaucccauguaaauuacaccuaguuaaguauuuagucuuagaaucauugguucucaugaugaacaaaacacauuucuuggucuguucauuuauucauucauucgcugaacaguuuuucauuuaccaauuccauacaaauagcagguacuauuuuagguuaugugaauauaguggugaacauaagauacucccuuuucuguaaacuuucauuguagguggagacagaugagaaggaaugaauacaaauguugagggcguucagugucuucacuuauuuguuccucacaacaauagcaugauguagauguuauuccuaguccuauuucauugaugagaagauggaggcaucaagauauuuaguaacuugccaggguucucaguucauuggaaacagggaugauguuuggagcuaggauucaaacccaggcgguuugacucucagauccacuuugcuaaucaucucacuacacugcaaaguguuuggcacggggaaaaucauuauucuuauuauuaauguaguuaauaguaacuauuucucaagggagcugaggaaucauuuacucuaauucagaugagaaaauggacacucauacagcuagcuauuggcagaacugaaauuuagaagccauauuuccaggcuccccuuccaauguuuuccccucauccaguaccucuucuuuaaggaauggaguauggaaaagggaaaagaagcuggaagaaugaaggaaugggcaaggagaaggaaggguguguagaagagauauaggaaauaauuaaaccuguuggauuugggguuuuugaugcuauugaacugucugguuuuuaaaguuuuuuucccccuuauauucucaagagguagauauccuugaaaugauaucuucaugcaaaauaguguuuuauuucaucuaugaccaaaaaauaauucaggagcuaggaaaccuuagcuccuuaaaaguaaaagacuguauuuugggaaagaacauuguuacuggaauuuauacugugaugacacugguugguagacacacuagaagcuuugaggagugugugugugugucuuugugugucuguguuugugucuuugugugucuguguuuguauauguuuguauauuaguaugauauauauagaaguacauauuuauuuuauaaaauacugguaguguuuaauuugugcauacucuuuaggggagaggguauugaaauauuuuucuggguuggaaaaguuuuuguacuuacaugcaaggcugcucuaaaaucaagcaccauauugaaacaucacaaauauacacuaagcaagggacagaugcacaaggaauuuaagcagaguuuuucuaaauggcaaauaauuagaggggaacagaugccuaugggcagcaaaggaugaaaugagguaccaggaauuuuaaaagggagauggaaauacaaauguagaaugcaguugcucucaaggauguuuaagccuagagggugugcuugcccaaaguucacucuuuuuguggguauugacuuaaauuugguucucucuucaccugucuuccccaaagaaguagaugaugcuaaucauucugaaguggaacagauuuucuguggaaccucaguuuuggaugaucuguggcugcaucucuuucuucugccucccuagggucuuguccuuuuauaggacugccaggauaugacauuucacaaccaugucaguucucacuuauuuauuauuuauaccccauauccuuccaaaaggguuuuuagguagccuaccaauaaaagacacguaugaaaauauauguguguguguguguguauauauauauauauauauaaaauuuuuugucuugguuuguguuuuaggauggacaugucccuucuuuagaaacaagucugcuguaaaauggguuguauccaucucagagcuauucugcguagucuugauguggaaaaggaaacaaaucuccaagaauaaaguagagcacuaggcauuucccaucuuccuguagagugguaguuuaaacagcaggggcacugagcagagcgauugagccacccagcaaagcugagcuguagcaccugaucauuaucccucagguuuaagauuuaccuguugugcucauuguaacaaaagaaaugaaaucucuguaauuauauuggaagggggaggagaucguguuuuaguuccuuugaucuugagcuagaauaggcucugcuuuuggaaauuuaauuugaaagagcccaacguacacaucugcuuuuuguacugcaauuucuauugagcuugaaaauagaaauuuauuaaugcaaauguguagagucuguuccuugaggaaaagauauacucauucaaaacacaaggugaucccuuccuacauagcuauggaagauguuaauauguuuucuguuuuuuuuuuuccuugacuucagauaugagguuccuugcuaacaaggacuaagcauaaaaauuauaggauccauuggggaauggaaagauucauucaauacuuaaaaguuuccaaaggacaaauucauuggugaagagcugggggaagcauacugaauccucaaaagaaaaaaaaaaagccaaaaacaagugcaucaucaaaccauucugaaaauauguuugaauugaugauagggcccaugcuaagagacaaagcuuucauuucaacgaauccaaucugccuaguguuguguaaaauugccuuugccuguaaauggaauggcaugcagauuuuagguaggacacuuucucacccaacuuagccuguacucuauuucauuuuuuccaccauuacaugaagcuucacauaaaugacaacuugacuuaauccuuaaaguggcuggauuguguggucuauuuugauuaaacuuuuucuuguucuuaguguaaauuuucaguaaugccuaaaaugucaugagcauuuugggacauaaauccuuuaagcuauuuugcagucauauaguuguucuuuggaggguuugagugcuuuccuaaacuccuucucaucucuaaauaggcaaaauaaauuauaaauugucgagaacauucaaucacucuucggaugagcaggcaucuccuaaagcuggggaaaguauccauuuucaauauuuugaguaaauauaguugauucuuuauaauauuuguacuguaucaaaagaucucaaaaacuguuauaaauuaccuagacuuaaggaagaagacaugauuaaauaauucauuggaucaauaaaaccaaucugcuuuuuucugauguggugugaugaaguuuuuuuucaaaugggguaggugggccucagugcuguguauuauccuuuugauucuauugguuacugucuuucucugcuccccccuuaguuguuguuugauauuuuugugcuuuuuguuuguuuuguuuuaaagaaaggaaagcugcaagccauagaaaguuaggcugugaguuaggaauucugaguuuaaagcagggagccugucccuaacuuuguguuuaaguugguguuucaguuauguugccaguguaagcuugugacccuuacaaauguacaauuucauuuggguucagugauuccuggaugaguuugugauauaggaugccaaaggcuguggaauuucuuuaagacacaaaaucuugagacagagcugauuccuuggaagcuuguggguaacuagagucucauguuaacuaaucuggagggggcuaagaaaagucuuccuacccacuuccaauuaauuaauuucuaacauuuccaucuaaucaugacuuugucgagugacacacaucuuuuuuccucacaggcaagaaacucacacacaaaauuucuauuucuaauggcagacaguuggggugccgcagccaagcagucacccuuaaaaauuaaugagcguaaugaugguuagaaaagcgauucugauggugguuggagagggaggggccauggggauggcagaaggaggaagaccggacuccucauaagugacaaugaugugagccccuguccucaucuccccucccauccccccuuccgcccagucaccaccccuuccauccuccucucuuuacaggagccaaagcagauagaaagacagggcgauuaugaagacgucaguuggaguguaggcaggcgagaggggcgcagcgccccagaugagguccggggggagcugaggagggucacucauggacgaccgugugugugugucugacagacugugaaauggugcguuguugcacggcugcgcugcaccugggcccuucaucugugauugauugguuuggucauguguaauggucccaucugcucuguguuguuuuucuuuuuuuacuuauaaacaccguucccagaggcugagagaggaugagcuauguuuugucaucuucacuuacacuuuagcucaaaaaaguggucaaguagguaagcucuaaagucuguccaaguaauguaguaggaaaguacgguuuuuccccuuugcuugauugugugugugugugugugugugugugugcgcgcgcgcgugugccucuccugcgcacgcgugugugcguggaguuuuaaugcugccuguuaauaucugaauaguucgugaaccacggaagaccaaaauaucgcagaaaugauuugcacaacucuguguauugugacucuuacugcagugaggauuuuuuuuuguaacggagccaauacuuaauuaaaaccgcugacaucaugguguuauaauuaagcguggcauuaauuaagcuggaauaacgauuuuuuuuuauuaagaacugcuucuauuguauaagaccauuaucgccuaaaaacaaaauaauuuuaaggcaaaaauaaauuugcuuuaaccuagcccuuuucaacuucccccaaaguccggccucaggacugucaucaucagggcuccgagucugugugugcgugugugugugagcaugugcguguguguguguguguuuggugguguuggguugggggagaguggaagugaaauuuguuuuuuuucacccaaaaaugcugaucggcuccuggcauucugauggcuaauuaugcaucggagagcuucgacagcugcauucaucaucauaaaauguaauaauuaaugacauuccaacaaagaaaaauaugcaaaugaggacucauuagcauuuucauauucagcuuugauaaugcuuuugcugacaagguuguaauuaaugaaaauucaugucgcagucaggagauuggaucgguuucauuccgcucacaauucccaaaugcuugcauuauggaaaaucggcggcucugccaacuuuucagggaagaaaaaaacacacacacacacuaaaagcaccagaugcaaauuaaugguagggagucuuuaacucuuuaaaccaccccccuaaauuuccaucauaggaaacaugugaugaguguuagccuaagaacuagauucucuuuuuuuuaauaauaggaaaguacuuuuauuugugacccaaguaugagaauuucuggcaaacuuuuuuuuuaauauuaaaaaaaaccccccaaacccuccaccuuuucccuucuuuccuuuucccuuucaagacuauuuaaauguacauaguaaaacauguuaggacagccaagccccagcauguuguguucuguccucuggcuggcagauucacgccacaacaguuuauucauccacaugcuuuuuggcgacucuucaucacguauuugggcuuagaucuucuggugccucccucggcgugcuacccauaaggucgaaagaaaagcaaguauucgauuucucuauucaggguggguuuuuuuuuuuuuuuuuuuuuuuggaugauagugguuuuuuuuuuuuugugcuuuuucuuuuuaaucuauucccuuugugguuuaguguaagaguuugagaaugugcccauaauucucucacucaacacuucugguuuaguguuguucuucaaauguaauuuuaggagacacucugcaaucaaaauggaaacccagaaaccccagagcagagauaucgacaaauauuuaacacagagagcuguuaauuuaugaaagccucuguguguugcuuucaaaauguggaacuuuagguuggcaaauguacacuugaugccaaccugguaccauguuugacagacaagccugaaguuaaacugaaaguucuaucuggcccucaagguuagaaagaaaaacuuaaacagagucugacuucauuuucuauuugaucuuuagguuaaaaaaugaugauuauuaaaacuggucuuuuugcugaggcagauguuuuaauaaaagguuuguauaaugauuaagaaaaagggaaaauagaaguguacuucuuuauaaauuauaacguuuauaagcauuuucacucucagaugaauaaaaugacuucugggaguuccuaagaugcaguuuccuguuuauuuaaaguuaaauuguaauucccaaaguugcuagcccagcauaaauaaagauuauaauacgccuuguuaagggaagagagaaacuuugauaugcggggccuuauuuuuuagaguauuucaguaaaacagaaagaaucaucaguuauuucacgaaaauuuuaaaauaaaucuuuuuucccuuguaugugauuaagaaugacuggguuucauuccuuguuaaacucuugggguuccaagaaacagaauuuuauuucaaucucuugcuucuuccaacuuuuauuuugucacaguuuguacaugaaccuguguguguguacacaggcauguguguaaauguguguguguccaugucuaaagauuaugguggcucuguccucucuccuguaaaaucuauugugguaaaauagcaggcaaaagaagguuuuacuuuuuuuuuuuccuuuuaguuuauuucuuuuuuugugugggcaaacugcccauccagaugguagaauuucaccuguaagcaaucugaaacgauagguuaauucugacauuuuauagagcuuuuuuuauuuucuuuucacacaguacaacuaagugcagaauaacugcucaagauaauguuucuuuuuuuuuuuuuuuucuuuuaaagcgcuuucugcugugauugguucuuuuuucccccaaaucugaauuuggggcucauuuaaaaaucuguggcuuuaggcacuuugcuguuauugucaaaaccacaucuaaugaaaucuuugaccagcuucuaauauguguaaaugaggaagugauggcagaagugaaaaagcagguuagucgccgagaagcagauccuuguaauuuuauaacgcugaacguuccacuggcuuugauaaauuuacuguuaguuuucuccucccaccaaauucacagauguauaccaacucauaacuucccaaguaaugccuagcaugguauuagcccccggaauccugggacuugcuuuuguugucagugugguuagccucugguggcuuaugugacugaguaaacuggagaaaaacuucagggugauucguugucccgugaucaaggaaucccauuauuuccaaaagcggguuagaagauguuuuuggaguagaguguggaagggaaagggaguauuggagauuguuuuuacacauaaucaugguaaucaugcuguguugacaaguuaguuuugaaugugccaccuucuuguuuuuauuucuagaaaaccuucauuuucaugaauuauuucuugagcugaugauaaagaugacuuuagagacaucuucuccccugguguauuccuuuagggaaacguuuuugaaaguguuucccuuuauuauaccuguaaggcuugggaccuuugucauggcauuguuuguuguuuuuuccguuuccuguuuugcacguguuaauuccugugggcauuuucuuuuuaaagugaugggauuuccacuguccagcagcaagccacauuuacuggaguuauugaacucuguaauaggaaaccugugggugaucaguuuuacccucccuagaagauacugcuucagucaaugagaauuacagccccaugacugagaauuuuaaagaagggguuccacuaagacacccagauguuuuguuucagguguugcaacaaaaucaacauuuguuugugggcagcgaagccaguguuccugccaguauucccguucagucgcuucucauauuucccuugcaaacuuucccauugguuggggucuguggagagauuucaguggcuggcugguggaaauguuugggagaacauuugcguaucaaagcaaccuaaauauuugcaaaaauguuugcuugagaaaaaagaauccacuuaggauuaggaaguaacugcuuaaacauuuuaaaagcauuugugauuucccuaaguauauuacucaugagccacugccuaaccugaauuucaggggucacucuggaaucuguauauuuaaaaacccuauaagauaauaaagguuuugcuuuaugauuaagaucugaauccauacauuaaaaugaaaaaacacuugacaagacaaaauauauuuuaagaauuguuuaucauuuagugaaccugcaaaacaaaagguguaaagaaagggccucaugaaaugguuggauguugaauaccucuaacgucauucuuucccucuacuguagauuuuuuguugguaaaacccaauuguauugcuaugauaugacauuccuucuguuggaguccauaagcuuucuuccagugguaaugauuugaaugucagaucuuuuucuugaguuuaauguaggcauuuucuguccacauuauuaaaguuucagcuacauuuuacugaugguuuggaaacaguauguguaaaacucaguguaggccaauuuuuccaauuuguuaacaagguaggaguugagcauugacaauuacuguacuuaaaagccccucggaucagguguuauuuuaccaucuggacauuuuaauuaguaauaaaaguguggaucuggauacacagaaauaggaucuacaguacacaauggcccaaugcacucuguuggugcugagguguauguggcuacauuuuauaaauauguauguaugugugugugugggcaaguguaauuaugugccagguguguccuuuuucaaacugggcacuaacacaacaccaaagaauuuggcuacuuuucuuagauaaaaaguaaaaauguauaaucuauaaacuugcacauaaguaaaacuguaucuuuuuaaugcuccuacuuccucaaguauggcaugacaaaauauaaugcugacauuuagguaggccugggcaaaagaugugacucuucucuuucauagcugugugcucuaaggcaaauaaauuaaccaccaaguaucccuuuuuucucauauucagaaugaaaguauaaaugauaauuguuaugguaucuaccuaacaggauuaugaggaagcucauuugagcauguauguugaaaagcacuuaaugaaauauaaggagucauaacaguucuuaacaauugauuguuaauacaggaugcagaugaccaauucauaccccacauaccaucuuuuauaauucaguaaaucaucucauauuuaaaaauaagggagaugcaaauauaauguuacauuagauuauuaacaaaugauaaguuuaagaccaccagaaaaaaauguguucauaaguuucaacauaaagcaaaaugacucauucuuauaaaguauauacaggcucauugacgcaauguuauccuuaauuaaggcaaaagcgaugcauuugagggaaauagugacccucuggagaaauagagaaugaaaauaguuuagggaaaugaaucuuaacaucuucucuuuuggaaaaauucaugcauguuucucuuaaucauuaugaauuucauguuugcaaaccagugugaauacuuaaacgauaaucauuauuguuuagaaucuaccuauuacuacacacacagauacacacacacacacacacacacacacacacacacacacacauuugcucaagaaaaucauccucaggaaguaaaggaguugauaaaauuaccauuggagcagaugaguuuggauacuucuacugaaagcuguuucaguuuuuauuauagguacaguucucccccgagaauucuuugggagaaauaaaaacauuuguuuuuaauuuaaaugagugguaacaugcuguagcauaauauuaacuauuucagugauuuuaucaauuuuaucuuccucugccuuaauguaauaaaugcauaucuugauuaaguacaaaucuuuacauuacguugucccuaaugacaaauauuauuuuaggcaacuuaguuuuaaucaucagagugucuuagggagcuuauaaaacuugucucugggacaugguauuagcaggauguacagaguuccuuuuuggugccaugcuaggaggagagacugacagagucaguccaguccauucauucauuugauagauaauaaguaaaccacagaagaaacgagaauaugucaguucugacuguacagguuuuaagauuuuuuagacuuaauauugaaaacuaguuuuacuuaauguucuaucaguuucauuuaaaugcccuaauccaaugaucacuuucauuuaaauauccuaaucuagugagcagauagggcuuacauagcauuugucuugaagacguuuuaaaaaugcagcugcagguccucaucuuugaaacuccauuugguaaaaauggccaugucuaccuuuaccuguagauuuaaguguccacagucgcgggaugagaaaagaaauugugacacuucuugaaaaauggucucaucaaagggauucaguugaaaaugugagggacugcauuuaaacuuugauaaaaaaaauaaguaauucuaaguaaagucuguagccaaacuccuuaauugugaugcauuugcugaguuccccucuuccgucgucgggccugcucugaugccauauggccuaccauggaacauuuaacuugucagauauaauggauuguccuggaagcagauuuuugcuuugagcacucggcuccuuucuugcauuucacucucagcuccaggcugcaggaugaaggauugugguagaagugcaaagaagagacacacaguugauuccccuuaagagagugaccuauaugccacaaaauuuuacccacguaaagaggcauuauccccgucacuggccuuagcaggcugcaugucaaagucauuuaaauuucccuggacuuaacagauuguguaaacauuucagaacugagagcuuaggaauaaugaaacaucgucauuuuaacuuaggcaaaaauggugcagccauauuggccaaaggaggcauauuauuuauugugaccuacauguaacguagaccaccugguuuuuagauucuauaaauuaaguucucucaaguuuaugaaggaugcuaaaaaauauauauauuaugauggaaauguuacuuggcuuuauuguuuuuguuucgugaauagagaggugagguugaaaugaucauuuaggaaucgcuucuuagccuuuuggcuaagaucaagugaaaugaucauuuagguggagggacaguggcagcuaauuauccuaccaggcuuucuagcuugaaacuuaggggcagaccuuccauucauucuaaccuauuugaaauuagagauuggauguguuauggacuauuuaauuuuuaucuguaaaaguaaauaauguagucuuuguucauuuuaauuuggugcuuuuaugaguuaauuuuuuuuucaauuugugcuauuguuucaacaagcuuggaaaacaguaggaacaauuugugacuuuugcaucuguaggaaaacuucuuuaaaagaauaaacagugcccuaccuauauguguguguacauacauagcugugagguacucuucugguauaaccuacuguaaaccccaaagcaaauauugugauauagagacacagaauagacaauuuacaaguaaucaaucaagcacaaaccagugggaaaauaaggaacuuauguaucucaauuuauucuuuaaaugcuacauauuugauugcuuuaggguugcaaaaguuaauuaauagauuuguauaagacacacagaaauauacauacacuaaaagagacuuugcuaaguguaauucaauauacucacaaaaauauguguuaauuauguuagaaauuuaauauuuaauuuaauuccauaaauccuugcauuacaaauaaguccucauacaggucagauagggcaauaaaaacuacuguggccuugaaaacugacagaagcucacuucuguacaaaucuuuuuaaugaacaacuuuccaucgagcagcuaagaaauaucuguuaaagucaguauuuaauacuaaaguguacuuauguauguuucuuacugauccuaaauugagcacguuaguuuuaucaaugccacucaucggcugacuguaccccuccucccccauacagauuuggugagacuuaguacuaaauaaguuuggggagugccuggccauagccggcucuuguuggggcaugugcgcccucugcuggcugcucacauaggaacugacuggugugugagguucuuucuuucuuuuacuuuucaagguuggguuuuuuuuguuuuuuguuuuguuucaauuuauuuuuauacaacugaucagauauuuaccaugauuauaaaguuguagcuuaauacugaguauggccguuaauuuguuuuuauuuggaaauaaaggugagguuuuguuuuggguguguuuuugguaaauagauaguccugauaguucaaauaacaugcaauguguguaauacucuugaguuuuuuaagugguugauuguauaucacgauuaaccauauuuucauugcuuucauauuccccuugccuugauuguauuugagaaguauucuuguuggacuaaguugggaauagaacuuaaaaggggauagauaagucauugaaauuuugaaauaugauuauuugucuguaauggaugugguagguaaucccuaguagaaaaauuccuguuaugguugguugauaguuuucacuugcuuugccaaggaaaaugaguauauuuacaucauaauacuuuauaaaagcauuuuugguuuccuugcaaaccaaauuaagcugugcucacuggcagacauugagaaugguaguuugaguaaaauauuuuuuguuuuguuuugcuuuugcaguugcuguuuauagaguaugagauguuaaaggaacaaaucacugauggucucuuuacucccaggacacaggacuaaacuauacaagggcaguuacagaggaagagugucagccucucuaccauugccuggguggagagcauccuuggguccugguagugaaggccagggcucuguguaaugagugugucuuuuaaaaauagcaacaauuuuuguugacaaggcuccaucaaagucuuuauaauaauuuaguuuguauaagugauuucuguguaucucugaaauuaaaugacuugauggagucaguuugguauuuguuguacagagaaggcaguuuagauuuuuauaguucuuuugucuuacauugcaaauuuuucuaauuuguaagcaaaagccauaaaaacuuccaaaccaaccguggagugaucaaagaacuuagagcuguggaagggcagaaaugucaucuacguuuuuuuuuucuuuucuuuucuuucaguuuuuccccuuugcaauuuuagguuccaguuaccuuaaaauuuguuuuggauaaaugauauaaauuuuuacuuaauagucuuuacuuacuuugauuuaacauugucaaauaacuaagaauugcauucuaacaaauauuaaguccuuauuaccucuguuagaaugucaucuugcaugaaaucucacauacaugucucuccuguuaccaccuugucuucaaugagguuguauugggugcucuuucuuggugcuucucuggguucccauuauaucccuuacugguggauagcauuguguuacuccugguauuuagucaucuaaacucuuaccuccuugagaauaaugugcauuguugacucucuugcauccagcacauguuacacagaaagcacccaacaaauauuaaauucccuauauuguguuuuuuaggccucauucaccacuauucagaugauaauuuuugcaaguuucaggauuaaaaauuguggucuguaaacauaguauauguaaugcauuuuauuuucuugcauacuuuuuauaggaugaggucauucuucuggcuacuccuugucugcuuucuuuuuucucuuuuuccucccucucauccuucccucugccucuccucuuccuuccugugcuccccaccuuccucucuugauugagucaugcuccuagauucagucauugagaggcuucucuuaaacacugcagcaugggaccauucaucuaccaaccuuccccuuccuugaacaauaacuagugcugcaggcugguuggacucuggggaguguggcccugcguaucuggcaguuugguuauuauuaugggcccauucucuugaaguugaucuugaagagcaggcuuggcuggaaaacaucauucuucuauaaauauaaugguuagcaaucuuccuacucuuugucuuccuuggaauguguuuucaauucugggcuguuccucccacuccccuccaguuucucucaguagugcauguuuaggggauauaggucaauuguauucagugcuaaggcuagagaaaugaucauuuaauauauuacagauacguauacaaauggcaguuggauuaucuucugucugggguuaaaaaugucacuuauauauguguguuuauguauguauuauacauaucuauauaccguauauaacauugucauguccccccccauucuuuugauguaguuuugaguaucauauccaauguguauaguuuaagagaugaacauuguuauauucuuguucacuguaaacuuagcuugaaaguuaaggccaucaccuguguaccauggugcuaaaauacauaauuuuucuauauagacaacuaagugccuauguagacuacucuauaacaaacaaaccuuuuccucucuuuuccaucucacuguggcuuauuuagaguuguaucauuuuuaucuuuuacauugacuguugcuaagacucugguggaacauucaguuaagugagcagcauauaauuuaugauuaaaagugauuuguguggugaaaugcggcugcugauuuccuucauauuuuccaauaaauuccaaaauauuuagccaggcaccaaagucuugcccagaugauguugucucuauuacauucagccagaaaugucacccaucuccuccaaugaaagggaaaggaccggauuuucucccucacuguggacuugucaugccuccacagaacguggacagagaagggguagaaggacccuuuuaaaugaacgaaccaggucagguucacuagaguuggauccuggauucuaaaggugacauccacucuugagauagaagagagaugcuuucagagcagcgggccagugggucugaucaaugaggagcaaccuuaacaaaacuccgggauucucauauuuugggauacuguuguuuauuaggggaaucgauuuggcaauguaaaaucgauuucuuaaaaaaaaaaaaaacagccuucauuauuggagaugagcacauuuaaaggccuagcacgcugccagagaaagguuucucuaacccaugaaauguaacugucugaaaugaccuuggggaucaacaaguccuugucuuuuaaaaaacucugcguaaauaggugagugcuaguaguaaucuacuuuuuguuaucuaccauguuaccaggucuauuggaguuuuagcuaauguaaccuauagagcugugccuaucacuuaaauugguugcuugucucccuagcuggucagaauaaccaguggaauuuuauuugcaagaaaaaaaaaucuguugggcaugguggcucaugccuguaauccuagcacuuugggaggcugaggcagguagaucacuugaggucgggaguucaagaccagccugaccaacauggugaaaccccaucucuacuaaaaauacaaaaauuagucggaugugguggcacaugcguguaaucccagcuacucgggaggcugaggcaggagaauugcuugaauccaagagauggagguugcagugagcugagacugcaugccacuguacuccagccugggcaacagagugagacucugucuuaaaaagaaaaaaauaaaaauaaaaagagagaaugccagacucuaccgaauucacguaccauggagaagagaacccaggaaucuguuuuuaggaaaagucuugcugauaauucuccugaucagcaagguuucuuagccaugaauugaauuugaggaaauugcuuuucuccacacucaccaucucaucacaagucuuccuucugccuaagaacauagugaaaauauuuuauuucugcgugcuuuugacaccuuuagcauguauugcaagaugagcuuuuuuucauuuuuauaugaaaaacuauuauguucuuuugaauaaaaaauaagcuuucaaaugcauaugcuguuuuuucuaagaccacacaaguccuuaauugccuugguuauauccaauuaucauagacucaaacugcaguaaaaauauaagauaggguaggcaucacugugaagauguuauucacauaaagccaaugguaaguuacucauuagaaguaaguugagugauuucaggguugcccuuaguccuucaggucucuaggggacccuuguacaaauugcugauucagaaaaucauuacuuuggugguucaagugguacuuuaguggccuuaaagaguuauuugacacaccuccccaaacagcuaaguuauccccaugauuauguugauuaauugcacacucuguggaauuaguguuauuuucaaugaaagauuuuccugcguucggaaaaucaagcauaaaacucaugugcuuuaauuugauaauguguguacuucuccuaagcaggaugccaagugaggggcugauuuugguuguuguugucugggccaugugaaaucaucuaggacaauauuuuuauucugcacugaaaagguaguuuuugauggacuguaggauguucacucaaaaugcuuaucgauucggacauuuucauccaucauggaacuugagaacucuuugacuuuaugaauugaguuuaaauuauuuggggagaggauuacgguagugagaaggcaaugguuguugcuacaguaggcacuaauaaugauacaucuagaaaacuccaaacggagguggcauauugugggaaagccuugguacuggaacuggaggucugugugcuaacuucaccacuucauaucugugcagccuuuuuaacuauaugagcugguuacccuuaauuuuagugacuucgucuauaaaaacauggacuaaaaugcccauuuaaugagcuuuuaggguguguugccuuaaauaauguaaguuaaauuugcaugcgagauagugcauuacaaauauaagugcucuauggagaauugaauauagaaucugaaauucuucacuuaggcagagcccugaagugaagacuuuugguggcaccuuaagauacuaucugggguuucaguacccacacuguguuaaaggcagcacaaugccuagaugagaugaggggaaucagugaugaaaugcagccaaaacuccccaauuuccagugggaucagagcuauaggccauuacugaguauucuauuuuuaggacuaaaagaacaucagcggaagagagaguuaaugccagucuuuuccagaaaaaaaugguuuacugcccauuuuucauuaucccuugauacauacaagcuaugugccuaguuaguuaccuuuucccccauuugucuuuauaggauuuccuagguuguuggaugacuaguuuauuugcuggaauggaguuguaauucuuuuagcacaaauuuauuuuacauuuagauuuuuaaaugacuguggaugaaggcagaguugucccuguaucguaagauucuguaggagagaaccaguacucuucucugaaauguuggaaauugaaagaauaaugucagcuucugcuuuuuuguaaacccagagucucaccuccaaacugggaucaggaguaaaguugacuagcuagucagaacaaugaagcuauaccugcauggccacagauuaccguaagacauauaagccaauagaaaccagcaaauuaaauagucaaaauguuuucauaucaauuuaaauaaaauaaaaauuuaauuuuugaaccuacaucauuuaucugauagaaaacuacaaauauauaguaaccugauauauucuuaguguuaaguuguaaauaauaguaguucugaaaggucaucagcucuuguauuaauagacacaaaaaagauggggacgggcauguaugcucaagucaguuuaggaaacauuguauaaaacuaaauugaaagccaaguacagugucucaugucugugaucccagcuccucuggagagcagugcagaagaauccuugagcauaggaguuagagagcaccuuggguaacauagugagaccccaucucauuaaaaaaaaagaaaacccugaauuaaaugucuuaacugcaguacuucucaagagucuuuaacaugcuagauacaauguaaaucuguuggggggcagggcaauagcuuguaacaguucguagauucuuuuaauuagucucccuuuugguuuuuggagcccguugugggaucacuauucuauagaugacacugagugaugcuggguuguccuguauuauaauuauauuuuuacuuuuacucuucuguacaucuuaauacaaagacauagucuucacauagagguguagaaaugcaguuuucugccauguuuuuguuaauuaguugcuuuguguuaaugugcggagaugguggcaguuuauuguaagaugucacagaauccauguguaucauuugugcagcuauaaaguaccuagagaccuuuuaggaauaaaacaccauguaaauguaaauuaucauugccuauaagacacuuucauuaauuucauaucaaauucaugaguguuuugagcucugggauuugagagucuucagugucgggccucuaguuuauuuauacuuuuuuuuuuuucccccagaguuuaaacaccagcagcauagcauagugcuaagagcacagucugggcaaacaaacugccaggguuugaauccuggcucugucacuuguaccuguguggcugugggcaauuuucuagaucucaguuuccucaucugcaaaaugguguuucuauuaccugccuuaugggguugugcagauugaaugaaucauuuuauguagagcuuugagcagugguuaauacaugauaaggacacagcuauucuuauuuggacagggaaggaaaaggcaggcauggaaacgaugaaggacuguaaauaauaaccucauguauguguucagaacuacuaaaaaguucaguuguuguuuaaugaacuaguccuuucuacauauauauagauucacaggguaaucagagauggaugggacuggggauggggacagaaauuuauucugagucaaacauguuuaugaugaguucccuagucugaugccagggaacaaaaggcucauucuucaguucccagaaugaggauuaacagugaaacagccuugcuugguguuguccugcagcaucagauaauuuuucaucaaggcguuucacgggaugauauauucucccauauagaugaaucuauuucagcggugggugaaacaccuaccauuuauauauaauuuuuaaaguggcauuuuacaaaugaaaggcuacacaaccaaacaugacccuguuauuauccuacuggucaaccacaagagggaucaucucuguuagagcuuaucucuagaaaucauuuuauugauaaguugcucgucugucucuagcucuuucuaggugguuuagaacugucauguguauccaggggcaguaaucuaccaaaggugauccuucuuagaaguaucccuaugaguggaauggauuuaugagaucauuuuuuucccuucauguaauauuuucauugucacccaguucccuuacaauaggauaccauggauguaucggaagaaaaauuggaagucaaauggcugauaauacaagaauauaaaaauauucaauuugaaauucuauagacauuuguuaaccauaucacccucaaauaaaaagcaaauuuuccugcuccuucuugggacagcaagauaaaagauuguugaauagaucagcaaaacauugacuuuuuuuuuuuuuuuuuuauauggaaguugcuugccuuuccugcucauauuaguuuuucugggccaggggaagcaagugaauccuuuauugauugccauuuggugccauuuuuaauaaucaaauuuaaauauaggcuuuagcagcggacggguucgauuuggacagaacacauguugacuuccuggacuguuugcucacuggagaugccgacuuguucuguagacggggcugcauguugaucuccuuugucuccagaaggauugauugacggauguugugucugcucauuuacagcguuuuccuuguuuaauuuaaaaaauugugacauaguauuacauguucccuuguauacaucauuuuugcagaagaaaguuguuuagccaauaugucgacuuaguuuaugaaauccucucuauagcuuucauucagcccuucguguacuccauuaggucauauucauuucaugcacggcaaaucgucaccagcagcaaaauuuaacauuugguccuuuuagguauaaaaaugaaucaaaugccugacaagauuuguuucugguauauauuucagaaucuccccccgccccccgcaccaaccccaucuuuaugggcauacaacaaauguuacuaacggguacuuuuaguuuuaaaaauauggacaacaguacuccaugcaguaaaagacuugagcgauuaaugcuacccuuaugccucuuuugaguaguuuuagccauggggcuuggcacugccaccauugucuuugugccaaaaaauauccgcagcggcugucgcauucuaguaccggaggguugucucgaaaauuccgcagugaacgcgccggguuuguucaucacugcuaucucuuuuaaauauuggaaaaauagaaucuuuagcucuuucaaagccccguugugguuguggggauggggggaggcggguggugaagaauggagaaaggaggaaagaggcuguccgcgccagccaguugguauaagugacaaaaauccaugccugacauagaguaaacacagauauuuaagagcuuuuguguucaugagcacagauaguuacuuaaggauccuacucaaacauguuaucagcgcucuugaaaauuuuauuaucugaaacaaauguuccaagugaauuuuaagcagaaaaucaacaucaagaccauagcuaauuuuuaauggauaauuuacacaaaagauaguuucuuuucuagaaacugagguguccuuuuaaaauggcugcuuuuagucuuuaaaaaaaaugauaggaaucgcgauuuuauguuugagaaggugcgugggcuuuauccacagugccugauuauuuugcucccaaacagggguucuggcucugagggcagauuuauaguugaauuggggaacaaaaagauguaauaaaguuaaaagcuuacacuaucagaaugaaauguguuuguucaugaucucuggaccgaucuauuugaugguaaaaguggaugcuacagaugaaaucuuuacaaggagcauaauccuuaaaaaaaaaaaaaaaaaaaaaaaguccaccucccagccuccugcuggcugugcugccucuuugguaccucgcagacuucgacagagcccuggacgggugcccauugaugucauggaaacacucaaauuacugagaaugauucaugucuaugcuggucucuuauccucccccacacaaacaggaguagauuuuuaacccugacaacuuguaauuugcaguggguuuauuuuuguaucuggauaaauauuuuuuaacaagcaaaauuaagauuaagcagucuguaucugauaugauaguaaagaaugcuggguuccauguagccaagaguacuuuggggacucugcagcgugaauucauauucuucuccuccuccucucccuccugccucuuucuuuuccuaccucuugcucuuugcauuccacucuuccucucuuuguuuuucuccuacuuauucucucucuccuuuuaaaauccugcccuuuuaucuuuaaaauaauggaaggaguagcccaacuuauaucuauaagugaggcaaauccuggcagaaagauuccucccuccuguucuguguguuggagucaaguugggaaauaaugcugaguggugaaauucuacaggggauagcuucaggaauuccuucuagagaaaaaaauagaugcuuuuucuuccuuaaacuguauuuuacaauuuggauuuuuagaaauuaccaaaacaggacacuagauguucaguuucuuaggaagucagagcagauucuacuuuauccaucuuucugucuuucugccugccuccuuaccugcccagcuuccugccugccuaucuaccuguuaaacaagugaauauuacaucaaaguaagugauguaauggugauauugaagcauucuuagaugcaagagcuuaaggaaggacacgcguccuuugauagcucaugaaggucgagccuuuucuguuaguaauauuuauagagagaaguuaaaggguauaaguagcuuaaauuugauguacacagaugaguaaauaugucuuugugaccauucacacugcugauacaaguauaaauuuaucuuuucuucagugcaaaauccucauacaauggaaguuauucuguuagaucuucuaagacugacagucugugcgauggugucuuguuucacugaaauugaaacugauauggggcauugauuuuauacuuugcgcugagcgcuagaccagaaauggggcggagguguuuucccaacuuuaagauucauuaaaaucaguagaaaaguuaauacugggaaacgggguuaauuuuaagacuuagguuuggcuuucuuugaaaaccaccauccauuuuauauauguaaugacuuggauacaggauacccuuuugaccacauagaaaaauuuauggauauaaauguaucaaagauacauucuuuguguggggucaggaaggcauacucuaauaacauugccauugccauugaccuaaaagauaaaaagacuacuguuacuuuuagcauucguguugaguugagaggggaaaacuuggggguuguaaacuucagaaggaaaucuauucagccucucaaaauacaaguuuagaguuuuccuguuggaaaaaggaauacuguaguccuauguaucaaguacaauuacuguaaagcuccagucuugacgaaagaaguauccuuuagacuugcgugggguggggucuuaggcaccugccugccucuuuuagccccuuuuaauguucugguauggacagauuucuacaaugauucuccacaugucacuaucuggacucuacugcuuagaucucuuguaaugugauuucauuauccucccuaaugauuauugggguuaaacuuuaaaaagaaacaaaugaacacccuugauuuuauucuuagauguggccgaauagcaucgaagggucuauagaucucuguagagcagucuacagauaaaaauuggguuguuagaauuggaacaagacauucacauuccaugaucccuuguccugcugggucuauugguggaaucugaacuuggguucagaguaggcaauuuuucaaaagcccuguuucccaaauguaaauuccaucaucaucuugaucaugaugggguucacuccugggaaagggaguuuuuaaaaaagagagagagagagagacucagaauuuugaauaguuucuuugcuaaauucaccaucuggagagccugugauugauuaguuuuggccucacuauuaagugucaauauaaucaaugggaauuacuaggcuagggucauuacauagauaauuugccugcuguguaaauaaaaaugaaauuguuuaaauuuugugcaagagaaagugaaaauaaggaguuacgauuuguuuguuagagaaaguggaggccauuggaaugacaguuuuuggaaguguggagcaguuuggcuaagaauaggaaugaaggauauuuuuuuccaguuuaucauagccagagugaggaaguguuauucccucucuugcuugcauacauugccaguagugccuacuuuacguauguaaacaucggggaagagcaguagaugucuguuaccuggaggagauuuuuuuuuaaggaaaaacacaauuuacacuuuuuugucguuucucuuggcagguaaaacagaaaggggcucauacucaucuuaugggagagaaucaaacuuacaggguugccaccagguaagugagaaucucuguugcggaaggguugagaggauuaaccugguaaaucaguuuguuuucuaaauuagaugaugcauuuuaaacugugacaccaaagaugcaccggcaagucagaugauggcucucucuuuaaguaaugaaauaacacagagcuuagaacuaauaaacaccucaucuuuagaucgcugcuguaucagaacuacauucaugggcuuguuuuuauuuuuuaauccaucagccgguaccaguggcacuguuugcaaaccagcaaugucggugaaagugguucuauuaaaagaguuuauuugcaauuaagaacuuaagaauuucuuacgcaggaaauacuucgcggagucaugugucagacccuggguuucggguggcuauugcccuaaauuauaguuuucauaggggcuguaugauguugugugaaaacaggguuguauugagggauaaaaaugucugugaaaauaugauuuguugucccuuuuuguuucugaauuguuuuuggcuggaagucaaggccagcaggcuaacagcaaagccgucucaagggaagcaugcgugagcuagaaaaauaagaguacuuuaauuaaauaauaaaaugccaguguaauacaaagguauagcauguguguguuugugucucugggcacuuugcauuuguauacuuuaaacucuccagagagagccuauuucuaaaaauacugucaauagcuaaaaguauaagcuuuguuucaagacaacugaguuuuuauagaugcuuucuuuuucaguucaguaucaguauuaaucauguauuuaaaaucuuuuuuaaaaauuuauacuuccuuuuuauaagugcauugguuucuuacuuuggaaaacucuugauggaauuuaauaauccucuuuaauauucagagcucucuacuguuuuuauuauucacgcaaacaaaauguacuuuuuuuuuuucaaaugcuggaaaggggaugcuuacucucuugaacucucucacccucugauguucuugaugggggaaaaaaaucuauuuuaauuuuauuuuaaacagcccauuuaauauaccccugaaaaauguaagcaaaguuuuguuuuuguaauuaaaucgagccuaugaggaaaguuuccuuuacguaccagacauaggaagguacgacuucugguggguugguguguuuguuuuuucccuguauauauuugcauuuuuaaaguuuacucccuuggcccagccaccaauucagucauauucggcaucugaaagauuuguugcauugaggugaacagugcuugguuaagagcuccugccggagugcaguucauggcaguuuguuuggaaagaauucugcaggaaagaaauuuacagccauuccagcgcaacggaaacaucuuuggaaugugagugcaaauguucgggcuagauagccugggcgacaagccucugagugcugugucucugguguaaagcucucaguuccugcagaagaccguguuccugugggucugguuucugagggucaaggcggaggucauuagaguuuuggggagaagaaaguugacaacauccuuccuuucugcagauggucauggcagaggucucuguuuucgcugggccccuuuuucuggucauugagagaauaggcuuccucaccccuguauccuuucuuacuaauaggaauuggcgugauuccucacagacacaaagauuuccucugcugaguaagcgugaggccccuuaacuugugaaagcaucauccagaccgugugagucugucuguguaugugcagaacacagacccuccuuucuccguuuguggggaauacuucccucgggugaaacugaaguuaauuuuuuuuuuuuuccaaacacaaggugagaaguggaaaggggcagaggguggaagagagguggauggauuggcaugugauggcugaauuucugggccuugggagguucguuuugaggcauuaauguccaggaaaauucuuuuguauauagcacuaugacugcauaugcuuuucuuaaaaagccuucguaauguagccguggaguguggagauuccuucauucuuaauuugugcuucaugguugugagucuugcaagagucuacuaucucugugcuuagcguggucgcagcaaucuccauaaacagugugauuacuuagggauaaauaaaagugaaauuuuggaaauuugcugacagagggaaaauagggacugaagaugaaaaauguacagaguaugaauuucugcuuucugugaaauuugagaauagaacagaccauagugugucuuccagugaaucaguuucucuugugccguauuguuauuugaaucccugucuacaacaucagcuaugcaaaccaaagagaaaggcaaaaucucaguaucuugggcuucaagucuaaauagcagaucacagcugaaaugauuccccacugugugacaaggugagugacucguggaggggaggcuuuuguuuucuucuguuuacuacaugauugagauacggaauaggaaaccuucagauggugugcccuaaggagcuccaaaagcugcuuuaucguauuauaacaguguauccuauggacuuaaaggggugagcagugcuauauggaaacaugcuucuuccagucucaauagccuuuuguuugguguagagacagaguggugguaagcaacagguagcaaagcgcuguccuggaggaauacauuauuauugugagacguguguuguuucagaaauauaucaaguuaaaaauagauauauauuuuagauuucuccuaaggauuuaacacuaauacugauggacauaugacgcuuuuuuaaauggauauauuuuagcagaagaaugaaagccggcagguucuuuauuagcaauuaaguuguuuucauuaaaaauaguaaugagauauuauuucauuaaugcauuuccaccugaaguuaucagaaauaaacauggugacuuuuugagacuuuuaaaauuguguugaaaaugaaucaauagauaagcaaaaguagccaaacgaacuuuuuugaguucuuacuaaauaugacaaaacuaauuuaaaucaaauugggguacagaaaucacacccagcuuaacauguucuugccaaaugguaaccucauacuccuuuuaacuggcagagaaaaugaaauuuauaauggaaagucugacagaaacgaaaaugagugggaauaaaguuuuuugcaagcuaguccaaccuuaauacuauaauagccaauaacuaaaacuuaaugggcaucauugcaaaugccagaagggaaaaaaugucauuuguuuugguuucuuuuugcugcuuugaauagaauguugggugauuugcaaacuuuuaaauuuugcuaaaaucuauuuuuuuaaugagaugaugauaucaaaacaaauacuuguuauuacuucuccccuuaaauggaaguuuagaguugauuaucaggaauuguuuguauuuucuuucugggauauagcccaggucuaaagccaugguuucauuuuuaguauugugugugugugugugugugugugugugugugugugugugugugugagagagagagagagagagagagagagauggggagagagagagagagagagaaagaaagcugccuaucugagaccaaucaaauuagaaucuugugagcugggccugugcuuuucugacaacuccccagguuauucuaaugugcagcuagguuuuaucauuuccuagaauguucuguagaaauauacccuguauuaaugacuuguguucaacauaugaccuugaaaaugcuuuuaggcuuuuugcauuaauuugauuauucaaggcauggaaauauauugcauaugaacuucauuuaaaaggcagugaaaauuagugauauagugaaaaucuucaaaucuuuauauagaauuccacaacugaaugucccagcccauaucuuguuuucucuagugaaguccaaggcuuuaaccucauccaaauucuuuuucuucuucagcaagugaucaaauaggacuuugcugauacaguuauuuaauguuuacaucuuaaaaugacuaauggaauuuaagaauuagaccuaaucuaggagguuguuguuaauuuccagaaacuuggagaccagggaggaaacauauuuucuuaguuugcccauaggcuugcucauuuuugguucaucgaaauuaagcauguaguugauuccaaaaugaauuucacauuucagaauugauuucuuugucuuguuauuuuuacuuuugauucaauagguauuacaaaugacuuaauucuaaacuuuuggccucuuuuaguuuuucuuaucuaaagucaaaauagaaaggauguaagugaaaaccguacaaaauuauuuuguuuauuacgaaauuggcaauugaggccaauuaggccuugcgcaagcagaaauacacaucgcuuuuuaauuuacuaagaugccuaaguguuuauccugaguguucagcacauccaucgaggucuuaugcauccuuccugggaagcucucccuugcagggccuuagcaccugucuucaucgugcuuuuuaaaauuugccaucauuuuuauguguuuguugcaugcugauuuccacaggauucuguaaacuccuggagggcagggaccaugucugcuuuauccugaauguguaccaugugccuagcagggcaaaaauugcaaugaccuaguguuucuuuccucagcaucacuuuuggaagccauuuugagggaguaaggucugaauagcaauguacaugaaccauauugugagcaucuuuuucaugccuacgaaaaccagaaaacugcacucucccaaaaaaguccuuuggaagcucuuccuucuaacaugcugugcaggcucuggaaggacaccaaagucauaccguggagagacacccacucugacuuuuugggggguugaaucgucucauucaccuggugacuucacuguucuaggccuguauaucuggaaaggccugaaugagggaauuauagaugaucugugguucuggcagagguguuguuggaaccaaaggucagcauccugguccgaacauugaaauguagcagugugaaugguaggacaggauauuuuaaauugugacaguuucagacaucacagggccugaguuugcaguauauaugucaucgcagcugugucccugagcgguauuuuucgggcagcggcuuauucauuuugggggauuguuauggguauauacccuucuuucaaaagucagccgguacuuaucaaaggggagaauggguccauucuuucauugcauugguuaagaaauacuuauugacccuguagugguguguuagauacucaggagaaaaaccaagggaucuuguauaccuucccuucuauccccaccagcagcuuccuggauguuaacggggaaaaucgagcucuauuuauuuauuuuuauuuuuaaccuuacauagcauaaauuuuugagcauccagaacaguugaaaaaauaauaaaaugaaugccacauaccugcuauuuagguuaaacaguuguuuguauuuguuauacaguauuuucuuguguguauguauaauauguauaagaauacauauuuuucagugaaccaaccauuuuaaguugcagauuuaauaagaaugcacccauagauuuuucaguacaugucucuuaaaaauaagacauuugccuaacuaacauacuguuauuaucccuaaagagauuaacaguaguuucuuaaucucaguccauauucagauuucuucaguuguccucaugcaaaugucuucaguagcuuucuuaaaaaaggcaacuaaaaugccauuuacgcgugucauuugauuucuaugucucuuuauaauuucuuuuaaacuagagcuguuccucuauuuguauucuuuuuuaaauuguguaauuuauuuuuuagggaugggguaucgcuauguugccaaggcuggacucaaacuucugggcuugggauuuucccaaguaauuuuuuuguugguuuguuugaaugauagugacuuuaaagagaccaggccaacuguccuauaaaacauuccccuuucuagaauuauuagauuucguuuccuuguggugcuguuuaauuuuguucaucacuuguuuugccuacaaauuuaaaauuaguucuaaagguuuaugcagguucagguuaaacauuuucggcuggaguacuucauugggggugcuguguauaucaaauuacauuccaacagaauauugagcuaugcugcuguugguaaugcuaacuuuaaucacuuggcaaaaguggugaccacuggauuguuccauuguaaaggaaucuuuccccaucugcaauuaacaaauagucuuuguauugauacuuuagcaauggacagauaccccuuuuucccaacaaccuuugaccuaauaguuuuagcacacauugaugacccuugccugaaucaguuauuucaacugaagacuucaaacuggugauucuuuuaaaauuccaucauuccuuccacauuuauagcuaguauucuucuauaaaagggcaguuucuuucaucauucauuuuaacacuaucaguuucauguuucauauuuuauauaagugucauaacaauuacuguuucuaauguuuccuuaccuggaggauguuggaagcauuaaaguauucuugaaaucucuuaagguauauugauaagaaaaguaguuauggcucaggcugauggucagagaggcuuuaauuguaagaggagggagguaauuguaggcauguuuccuuguaaacuaaacuucaguauucuuuuggugaaauuuggaaccuugcaacaaccucugugccccuagcuguguuucucugauucucauauugccacucuauaauugcuaguaaacaucucacaagguugaucaucaguaguugacuggccgacucgaggggguugcuguggugcucugugaagcugcgcuaucagggaucagcuaauaaucccugccucaguccuugcacaauccagacaugguugauagugaaugucaaaaugagugaauuucuaaaagauaguuugggcuuaaucuaaaggaagccugaguaacuaguauuaggugccaauauaaaucucugaguugguuaauauuauugucccuuaauaauuaagaaagggaugcucagagaaguaaagcaaguagaccucaaaucauuugcuucaaguaaguuucagagccagacucugaacucuaagauguuuuguuucaaagccagugcuuuccaacuuggguucccugcuacuuaagcccaugaaggaguuuuuaggcucagaaguccauauuaguucucaucuagaaaacccugucuggucgauuccaggcccacugggggaucugggccugacacaguaucuacaacagaguagcugcacucagcuccguucaggguuagcuagaacucugaacagucaguagggaaaggcauagcggagggcagaucgcaucguuccugacugcccagccuuaagggggggaaaaaaagauuauaugaauaaucuauucaguaacauccucagaauuagcaugugcaauuuccuuaaaaccaaugaggauuuccugugaaaaggcugggguggaauaugccaauucacauuuuagcaacagcgugaacacuuucuuaaaaauguauagauuauguuuuggcuuugcuuuuugugcaauguaggcagaauaugguuugcuauuauauaaauuuggauucauuauagaucacauuauuguuccaaaaacacaagagcuacauacagcgagauucugaaacaauaccuuuagcagguucuuaaauaugccccaauaauuuuucgauuauggcauuuagcccucaaguaaaauauaugaaacaacagaauaugugcuaggagcauaggcaaguuuuauacaacaacaguucaggcaguuagugcauaaaaagccauugaaauugcuuugagaugauuuaugagacaccgaagaaauggacuccuaguauccaaauugaaauuucaccagaaucaugggauuaacuucucuuuucuuaugaaaaccauuaagcguuuuuaaaauagcuucuagcaauuaggacuacaguucuucaucuuuauguuucugauagguguaaagacaaaggggaaaaaucaauuaaugacuaaagaaauaauugauuuaaugcugagguguaucugauauaauuuaauguugaaacguaucuacauaucauguagagaucaguguagcucuauagccuccuucuguaagaaaggcaguauacucaaaauucaacaucaggauaguguuucaaugugaaaugacagaaauauuuauugaacgucaugcuugauauuauuuuauuguugagagcuuuuuacugaaacucuuuaaaacugaacccccaaauuaaaauauuggcaacacugaaagauagcaacagaagccuguaaucugaaguaauggacuuauuaaggacuucagaaaaaaagacuuuagaaaagaagcauauaucguugagucugcugccgugccugauagugauaaccugcuuagaauugaagcaccccauucuuugaaaaauugugugcgcucuguggauauugacguggguuuguuuacaugugcuuucacucacagaucaacugagcuuccuaaagcauggaccuuucauguucagcguguuguuuucuaaucucauagaaguaguuucauagggaggagaaaacagaaaccgacaagaauauuucuuugcauuugccuuagcauuuccaacaugcaaauguugcuuuuuucauaguauggcacuuauuuuugucagacauuucuuguacuuaacaaagggcaaaguuacauuuuggcgggagagcgacuuucgcccggcacuucaccagaucucguugaauagaauauauuaucacuguuagcauucuuaggguucuuaaugaaagcuacauacccuuuaucuccauuuuccucuccuuuuagaagacaucuuccaaugaacaauuucuaugacuugaauaccagauauauguuauuuucaagcuaccucaaagccauguuuauaugcauuugcgacaauaacaauuccgugcuucggaauaauuauguaggaguaucauugagguuauuaggcaggacccacccucuagaguucuguacaugggggggucucuguguguugggguuuuacugugcaagcacacagaauauccugagcucauuuguaccaugauaaugaacagcagggcacugaaucuuuuuaguuuuauuggcauuguauacaguaaguuauuaaauuucaucucuguaauauaccugcaguaaaauaacaaaauauuggugcacuuaaagaacauguguguguggaacaaugcccuccccaucauuucagcccccugcaaacagcugcuuacagauuucaagauccauuguauguauucccucgagcccaccucuaauaaucgagacacaucugccauugcaguauuauaggcauauguaguuuuauugaaaacuauaccuguaaaaaaauuaaauaacuccugccucaauuaaauuggcaagcuaccuuuugcaaagaucauauugcagaccucuugagacccaagugaguucauuuuauucuuacauuacaaaucacuaaauauguuauuuuuauuuagcugaguagcuagcuuuccucguacuuugaugguaaguuacuuucauccauucucacuuuuguuuuccuucuccccucaucuuuacauauuaaaaaaauuaugcaaauugcaugaagcaaacauuuugagaaucugaacagaauaaaaucaaagggaaaggacccuaacaugcagcuuuaacucugaagugauuauuaaauaaauacaugcaaagguuacaaaauuggggucaaauuuauaacucacguuguggcuugugauuuuuacaaacuucuuugagauccauuugaucaucauaaugguagaauaggaaguaauaugaagaggaaaugaguuaguaggccauacaaagcauaugcagaugaauuccuauuggauuaaauaacuuaacacuuacucuuaagaaaauaauagauacgagaucucacucuaucacccaggcuggagugcaguggugcagucauagcucacugcaaccuugaacuccugggcucaagcaauccucccuccucagccuccugaguagcuaggacugcaggcauauaccaccauggcugguuaacuuuuuuauguuuuguagagccagggucucacguuguuguccaggcugucucaaauuccugacuucaagccauccuucuaccuagacuuuccaaaaugcugugauuauaggcaugagccacugcacccagccaacagucuuaauacuuguugaagauugagucaguaauagaugucugcaaaauaguuuuuuauccaaagaaggaauaagaguaaaauauuuaccgauauaaaaaugugagccuaaacuuauuuuaaguuauguaagguaucuguauaggucuucaugugaguuaaucaugccaauauauagugauuuaaccaagaagaauuuuuuugcuuuauauuuucauagaaaaaauccaaaaagacaaguugcccacuauaugggaaacauauauguguauauaucguauauaucugaauuauguaugucuauauauaugaaacacacacacacacuguuauaagacaguaagcagguuccuuaucuauaguuucuuaguuaaaaaaacaaaacaaaacaacauuuugugcuauucagaugaacuguguauaacuggaccgagggagugguuagaggugaauacugucccaaagugaacauagagucagaggaaagacucuguugaaagucagaaaguagaugauuucauaggaucaagucacggauaaauaugaggugaugacuguuauagagaagguagaaaaucgaaaaucaagcagugauauucuuuuuuuuuuuuuuuuuuugugggguuguuggggauugggucucuauguuguccaggugggacucaaaccccugggcugaaucagucuucccaccucagcccucugaguaguugggacuguagguacacaccaccaugccuggcuuguaguagcaguauugacaaccagucaggauagaaaauaguuacauguuuaaauaaagaauuuccuucuuugggccgggcaugauggcucaugccuguaaucccagcacuuugggaggccgagguggguggaucacuugaggacaggaguucgagaccagccugacgaacauggcgaaaugccaucucuacugaaaauacaaaaaguuagcuaggugugguggugcaugccuguaaucccagcuacucaggaggcugaggcacaagaauugcuugaaccugggaggcggagguugcagugagcccagaucacgccacugcacugcagccugggugacagagcgagacucugucucaaaaaaaaaaaaaaaaaaaaaaaaaagauuuuuuuuuuuucuuuuagaugaagucucacucugucgcccaggcugcagugcaguggcacaaucucugcucacugcaaccucugccuccuggguucaagcgaugcuccuguuucacccucccgaguaguugggauuacaggcgugugccaccugggcuggcuaaguuuuuuuuuaauauuuuuguagagacaggguuucaccauguuggccagacuggucucaaacuccugaccucaagugauccgcccaccucggccucccaaagugcugggauuacaggcaugaaccaccgcgccuggcagaauguucuucuuuuuugauaggaauguugauucaagucagugaguggucguuugguuccacuugggcuuaccugggcccaggagacucugcucacucuguguucucccaggguauuuugugccccacugcugguucacagagaugccagguuucacggaauggagggcugaguccuagagagggucaucacuuacaaguaagauaucaaacccuaagggaaucagaauuuaaagucuuagaaggguuucaguuuugucauauagaaaaauauugaaaauuaaaaaauauauauauuaugaauuguaaacaaacuuuuugaucaaaacucaugaaaguuggggaauacaccuuaacuugcacccugccacugcuuugaagucccaucccugggaugugguucacuccuguggaaauauauauuaucuauuacauuugaacugugaauuguguuugucacacugagcuaagcagcucagaacugucauguguagagugacugguacaauacaacaucaguggugguaaaagauuuguauggacaaugacauguggcaaagaagaaugucaacagcugccacugcuaugacaucgucccucaaggagucuuucugcaucucugccauguaacugucucagccaaagagaaggcacuaacaugaacuucuuccccagaaugcuacucccaacuagcgaccacguaagacucgcuugagucuuuuuugagggugcaaguccugggugccauuugucaccggaaagaacauuuaaguuuggaguuuuauguauagagggagggauuauucuuugauuuauuucgaaagaacauguucuuaauguccuuuugcagauaauacacacacccuaucaguuuuuggacuccagacugucuccauccauaugucauuaugaagcagguuuuuaucuuauuaugauuuagguaauuguacuagccucuaaaauuuuauaauguaccuuucagaagcucauagaugccaagaucagaggcuccuuuggaguuccaucuaauauaucuuccuuagccaacugguacagauaauuuuaucuuuccucuagauaguuacacauauagcucuagaaauaaaauguaguuauccuaaaucagcuguauagagccuuaaccagcaaucagaccauuuagaacauucaacaauaauacauucuaccaaacucugacuuucuguguucaguagauauuuauuaggaaacucacccugugucccacugaagauccucacaugcucucuagguagaugacuucagcuaauaguauaguaaccaugaggccuuaguauuuaugacuuuucuuuucuuucuuucuuuuuuuuuuuuuuuuuuuuuuuuaagagucaggguccugcuguguugcccaggcuggucuugaacucccggccagagugauccucccaccuuggccucccaaagugcugggauuauaggugugagccaccacaucuggaaguauuuaucacuuuccaaauucguauucuuacauguguuuggauuuauuuuucaagaagccagaguaaaauuuggcaauuaccaaauugugaguugagaaaaauagauaauucaccuuugguauugugcuuuugaauuugaauuccauugauuggauuucaguccgucgggauuaguucuuccaucugugucccuuggugugaugacugacucccagccaccaucugagacugcucggucucccucaucuccaaaaguccucaguuuccagaucucaucaauucugcuugcaagauaccaauaaaucugcugcugccuccuagacccccagucaccaccguggcugcccgugcugcucugaucccucuacccaccuucucccucacaugccuccuguccacugcugcuggagugacagucuccacaaaacauuguuccuuggcuuuggggccuguccuuagcauggugguauccuggccccuguuucugccugcagccucagccuucguacucaccauucacaucucauguuccagcccuacugagcugcuugcaguucccucaagaguucuuucacgguucucucugucuuuauaagaaccugaaauaccuuugccuugccuccccuucuucuugccuuacaucuguucuaccagcuaacucaccugcuuuguucaagauucagggacccuggauguuauaaccagggcagagcgagcugccucucuucugugcucaggaagccuuuggagcacuucuuuuuccucacagucaucacacugucuacagccagagaagggcaaaggcuaggggcaagggcuaggcuugccgucucuaucugcagugucuaacaggggcacccaggaagugcuuguuccagagucacaggauggaugagugaaugaaugaaugaacuagcaauaguaagaaauuguaugugagcauguaacuuacuauauuuaaauacuuccaugcaaauuucuugacuuaaauuaaccaugccaaugaccccugaggcuggauuuauuuauuuauuuauuuuuugagauggagucucgcucugucacccaggcugaagugcaguggugugaucucggcucacugcaaucccugccucccggguucaugccauucuucugccucagucucccgaguagcugggaccacaggcgcccaccaccaugcccggcuaauuuuuuuuuguauuuuuaguagagaugggguuucaccguguuagccaggauggucucaaucuccugaccucgugauccacccgccucggccucccaaagugcugagauuacagcugugagccacugugcccagccgaggcugggauuauuuuuaauccaguuuuauugauaaagaaacugagauuuagagagauuuguuuucacucugaaggcagagaugggacuggggaacaaacuccuuuggauccagauuuggcauuuucuuugucacuucuuuagcacuggauaaaguugguguagcuuugugucauagcaaguagcccacagagucuuuucauagaugguuccagcucucuauucauuauuaacuuagggaucauucauggaggcacuuaccuaguuaccaggcugagaccucugucugccaaugagaaaaaaugugcauuucuaaagaggauaugaagaaccuagcaaucuguauaucaggagcauugucuuuacauagacaaaaaagaauauuuugaauguuuccuguaaguaaguaccaguugcaauagcguggugcguaccgcccaugcuaucuauugcccaucagugguaccucuacucucugguuguggugaaaaggaccaugguccuccuggaaauuucuggcccugaagcucaggggagaagugcaacaccagccacaucucaucccccaaguuucauucuccuucacucucccugguacaacuuggcagaggauggggagaacugggaagaaguggaugcauugaguagaucaagcuuuuccucuucauguuuacuuuauaugauuuuaauuuuguaaccuuguuguaggacauaaaaaaugaaugacaguggacuuagcuuuuauuuauaacauugaaauccuuaaagauagaauguuagagucagaaaggaccuagacaucaucuggcauccagugccgcuuuguagcaaguggaaaacuaaagcucagagauguugagguuggucgucaucacacagcaagcagaccuugcucagacacagccacacaauacaaguaaaauuccuagccuguaacacggaaguuuuccuuugaugucuuuguacccgcuuucuuccaaagagcaaaaggucaccuagaccaugaaguaauagccagcagcagccggaaacacauccugaggaaauuucuagacgauugucccuuuguuaagcuaccauugaaucauacugucacagagccagagggugucguuugcuuguaaauacugaguuuuugaaaugucacuguaacacuggaaaaauguugucucugaagguugccaaagugacagaaucccgacauuguaaauaccagccaacacaagugcuuauaaaugacaggaauaaaauauacuugacuaaauccauaauaaucacugauaacacuguuuacccucagugaccaggagcugugaacuuggauaaaaagcacaugugugcagauaucauuaauaugucugagccucuagccauuccagaauauuuugauggaaaagcucccuaaauauguaaaagcuuugcaauaacuaagaagcuaguguguaagguagggugucagucgucccugaugaaacuagagagagccuugacuaucuucagcccccagaggacugauaaggccucccuuguucugguuagacccaaacucugagccaggcuacuagggcaggcaaugcuguauuuucaguagaugugauucucagaaggcccauuugccagaagcaugagcccacaccuauaucauguuccauggagaaaauguggaaugaacuuagagauuaaaaacuuuggagccauaagugggaggaucccaugaacuacccuuugacuuucaaaggguggauggguggucagaccuuuccacaguccuaauacucuauagcccaggcuuuuucuuaauaauaacuuccuccucucuagaaaugauucucucccucuuuuuucuguucuaguguaaaaauggugccuguguguauccgagucuuuaagaggaaauggacacauuggcaaaccagugccuccuuuggcucugugauguggcugcuguuacuacucaacuggagcaccccuuauauuccagucuccccagaaaugcucaggaacaguggagacucaaugacagaggguugagcccuccugguuuuucaacuggugaaagagaaauucagaugguuaaggagauagcagaguagccagcacuccgggagcugcucuuaucucugcuaugaggcugugcauggggaagaguagggcugcuuggaaugaccuccuuacuuuucauauauugaaacauauuucuuuuuccuugauaugcuccuguauuguuugaauuuuauuuuauuuuauuuuuugugguaagcauuguuuucuuaauuaacaaugaaagguuguagucaauaaacuaguacuugaugagauuugagaaaaacuacaaaacuguagauugcaaguuggcauuugaccaagaaauuaugauugugcuccuuggauuuuuaugcuuaggaaagagugcacaagagggaaaaagcuuucggucagaagauacccauucuaguacuagcuggaauggugguaaagaauacgaaauggucugaauguccauggcugugugauauuggcguauuuugcuguccaugggucuaaguggaugguauuauagcuuugaaagagucauggcaaaggagggaacaggugugucccaaacccuaaugaacucagcagauuggccuggcauucuggcaauguagucauucagcggagccguggggacucccuggguggggacccagcaugcuucuggagguaccugggaggcgcugggaguagggccugcuguacugguuugacuaaugugguguagguguugauguuggagaguugguggccagucucaggcucuguucuggcacuacuccagcuuguuggucaugaaugcagauugagauugaauggcuccuuacauuucccuugaagaaaggcagcuuugucuuccaggaaugagcugauggcaguggccguguggacauucugcagcuuuggcacccaguagcgauggccugauugccuugaaacugggagccucuagggcccugagaacuugagcagggcuggacaagccuuggagcagaacuuugcugugaauucuuucauugacucgcaaaagaugaaggacucuaaucccugauaucuaccuuuccacuugaccuuuuuagucuucaguggucuuuuagaaguaauuuuaccuggccgcgguggcucaugccuauaauccuagaacuuugggaggccuaggcgggcagaucaccugaggccaggaguucgagaccggccuggccagcauagugaaaccccaucucuacuaaaaauacaaaauuagcagggugugguggcucacgccuauaauccuaguuacucgggaugcugaggcaggagaaucacuugaaccugggaggcagaggcugaagugagccaagaucgugcauugcacuccagccugggugacaagagagaaaccaucuaacaaaaaaaguuauuuuaugaaaaacauuuggagguuuucuuuuggguauggcaggcagauuggccucuuauuuggcauaggugaagaagaagaguugaauaaaaguaguuggggcauagaauggccaugcaaguucccaacuaaaucagggucaaguuuaaauguauuuguauuuuguucaaauucaucuuuaucuaaaacaggcugaugcuguuuugucucugugcugcagguggauagccacaaauuugacucuauaguuaccaguuaucccccugccaccccuuguuuuucuuccugauuucucuacuuccaaucagcugcucuuuuagaaaccaauagagaagugagacggggugggggcagaggaagagagaaaggggguaagggggagggagaaagaggaaagagagguuguuuuuugucauuagugaguaaaaaucugucgggcucggguaguuucuuagugaauucagcauuuagugauuagauuagagggguauauuugagcugaagauuuugggaacucaccuuucugcucuacagaaucccuagguuucuccuuuagcucuacuuucugauucauuccauccccauccacugaccccaccgccaauauugagguacuugugaaagcucagaaucuccaguguccucaaggagcuagccccaaagugcccccugguggcuagaggagaaaaagacaagauggaggaugggaaaaaggucagguggauggauaacuuuggcucuucuuuuggcucuucuuuucugauaguauuuuuguuaacagcaucuaauggguugucuucuuucaguaucaaugugaaccagcucugaauagguuaguguaucaauguauuucccuuuuugggugauuuugcugcagggauuucuuucccuaugccaguuuuuguuggucugauuuuuguuucuaggcauauugcauugaccugagccuucucacaguacugaugacacuggggguagggagaacaggagcaguugaagacgacacaugcugucaccucaugugcuggugugaguggcgcagggaagggcugugauuuuuuauaggcacacugauuagccaagcacuugucaccuccacugccgcucauuggccuacugagugugagcgugccaucuaauugacagcugucuguugucagagggccaucuuuucuccuuuucaguuugagugaacacaacagagacaucugcagagcucucugcagcucugacaagguugcccugccugccaacccucagacuucuaggcagcauaauugaagagaucagaaaagaauauuaacccguugaccaucuugggcugagguguaaugaccaaaaagucacuuuuuaaggugacugugagucuuucuuaguagaggaagacaugagauucucugucagaagagucaggccaguaggaagugcuauuucuugguagugauuguucgugggguuucaguucaucugagcacuuggaagaggaugagaaguucauuuucaagguagacccaguguuucauggugggguuacacugaagccugaaugcugggucacaucauucaugucugauuuggcuuguguaaugacaguagugcuuuggauguguguaguuuggaugaggguuacucuuuuucuuuuaccgccaggccugacacugcccuuuuagcguaagauuccagaaucucuuaugcaguagcauggaauguauggccaaccccguaguaacguggacugccucuuugggacauuuccuguaagccagagauaucaagguggacuuugugauggguagauuguuuauuauacagauaucagcuugggaauuugaauguuuaauuauuugccuugucguagugucuucaaaugaagcucuauuugagcaucuacugggauugguacaauaugcagacaagcuggcuuugugugggucgagucaccugugcuugcaggaugggggugcuugcuauauuuggaagugauuuagugguauccuagguuuaucaggaggaaaauacaucuuugcauuuauuugaacauuugauuuagaaagggacaguguguggguauuggauaaauugcuuuuacucuuucuuugcuuugcauuguucuccccucugaugauuugcaacuuagcaagccuucaucauugaaccugggugaaaaagaagaucugagaagccuugaguaauuuguuucagacuguuuauacucuaguguuuuacagaugugggcuuauuugaggaauaguauuggcgaaagguagcgucauuaaacugguuggagaaauuucaggcaaguagauagagaaauuucaggcaacuccuuuuccaaguuguugcucacagauuauaauagaugaauucagcagaauguucugaccuccuagacuaggucagauaacugaguucuuguccuaacucaaauccuaaguagcuguuucuuaaagcucuguucugccucugcagaaugaaggcuuggccuauauaguguaugagauuccuucuagcuucaggguuuuguaacuaucagaauagguaaugaggaaggagacuaugcccugguagccuuuagccauaucacaaauauuuaacauacucccaaaauagcacauacaagacagaaauucuuuguacuugaagggaauaauaaauacagaaagcauuugagaaguacacauuuaauuucuguuaacucuuuuuuucuuauuuauguuuauuauuagaugauaaaugacuuccuuuuuuuuaguauuaaaacaaggugaucaggauagugagaggauugggucaggugaaacacaugacucaccugcgugcuuaugauuccccuuggaagaugguuuuggguaacauucugggaaaacuauggauaaagucauaggcuuccauauuuaauuaauucuaagacuuuuuuuucacauuucaacaucucagaaauuuaugguaugccaauucaauuggcaacuuuuuuccucucuugguaggaaauagauaaugauguuuuugacauucaguggcaucuuauaggugaugaaauacaauucugaggggaggaagcaagauuuuuuuuuuuuuaacugagaaaggcuacgugacuaagugacuucuuuguuucaaugcugacuaaagcugugauguccuuuuuaaucacuuugaaagauucaaauugcuuuaggaagacaauucaugcauggagcucacccucccagaacuccacacuuaaugcccacugaggaaggagagaaaugcaugcaaauauauaucccaauauagaaggaauauucuaguucaguaacuuccacuccugagcuuuuaucaaauuuuucucuauagaauuauuuuuguuuuauuguauccaaaaugucagauaucuuuuucaaggaaggucaagggacuuugccauuuucuaagccagaaguauucucaccuaguccaguacuagucaaaguuuuuaguaaaucacuuagaauuuccuuuuuuaaaaaaaaaaaaaaacccuucuagaguuuguugauaccuuaaagaucaucaaauccagcuccuuauuucacaaaugaguaaaaagaagacauaaguugcuuguucagaguucagcuaggaacuagauagaaccuggguagccugacgcucccauucuugcugcuaaauuccaugcaauguaaugaaagcgggauugaguauaaaaccgauacucuacacaucuuuuguugauauuucugagggagaaacuugaauuucuguaagugcacauagcugguuucccuuugcuuuguauuucugaaugcuacacuugucuucugccuacuacacuuaaauucauaggugauuucacaaggcacagaagcccaacuugucacaugugguuuaauauaugccacacuuuaugcugcaguagcaccauuuggucauauuuagugaacucugugguuguugagaaugccaaagcagcaggcucagcuauugcagcauaggccuguacuuaguuagcaagcuuagcuuaaaagcugucagugcagcuaauguuacaguggcuuacugagaccuuggccugguugugauaguucuccaaaccuggguguuuucaccuuugaaauaugaaucuggauuuagcuuuuucuuagaaaacagcaacaacaacaaaauggugaaaucuuuaagcucguuaaugugaaugcaguaagaauguaaauuuaauacauauucacuuauuauuaaaugcuguuguaaauaacauuuuuagauuuaauaaugauuucccaagacauuucgugcuauucuuuacuuugaaacugauggggugagaagagaguugaaucuuaauuauuauuuuuuaguuaauuaacaugugauuuaaaaaaaucgagauauauuuuguguuagacccuaauuagaaaagaugucaagaauaacauaaugcuaacuuaauuuuaaaauugauaaaugagggcaagaugauuggaaaguauccucuagaucacacaggaaacggguuaauauucaaaugaauagcucugaaacgcuacuuuccuaccagcuccugaagcaauuuaguuuuuaagaccuaaaacugacucacaaucugugguaugaaggauagauguuaauaguuuaaauauuuaggcauugcgugggcuguuuguuaaaccauugguagcuugagauugaccacagugggaguguuuucaccaugcgaaugagcaucccugcucacaguggggcaugagcauagcacugcaggauacggaacugacauuuauuacauaccugacauuuccguuacucuuuuauuuaucguuuugggcugcuuguuuguguccuauccccacuccccaaauucauauguugaaaccuuaauccccagugggaugguguuaggaggugaagccuuugggagaugauugggugaugaggguggaccuccgaugaaggaauuaauguccuuauaagaagaggaagacacacuggggccugucagcggugggggacgaggggaggguuagcauuaggagaaauaccggauguagaugacggguugaugggugcagcaaaacaccauggcacguguauacccauguaacaaaccugcacauucugcacauguaucccagaacuuuaaaguauaauuuaaaaaaaaaaagaaaaguaaaggaagagagcuagccagccuucucucuucuccaugugaggauaccacgagaagauggucaucuguaaaucagaaagaggacccucgugguggcucacaccuguaauccaagcacuuugggagguugagguaggaggaucaguugagcccaggaguuucgagaccagccugagcaacacgaugaaacccugucucuacugaaaaaaagaaaacaaaauuagccagauguggugacacauaccucuguaguccuagugacccaggagguuaaggugagaggaucagcugagcccggaaagucgaggcugcagugagccaugaucaugccacugcacuccagccugggcaauagacugagacccucucucuccccaaccccuccagaaagaggaucuugucuggaauccagccauucugguccugaucuuagaauucuagccuccggaacuguuagaaguaaaugcuuguuguuuaggcuacccagucuuucguauuuuguuauagcagcuaaauugacuuagacaucauuaauuauguauuuuaaguccuguguuuuagcauucuggaaugagagcauugaaaaugaucaucaagccgaguaaauuaacugaauuaacuauuccaccaaaaaaaaccccaaaaacugaaauguucguuguuccuggggaauggcuaugcacuuggaggcugguccccuuccucccuccucuucuuccuggugaauccccugacuuuucucaaucaggcuuucugauguggaggcuuccucugcuucccagggacacacucccuucccagggcuccuggagcugcugcaucucugcuacccugagauguaauucuugccugagauuucagcuccuccccuacacuucagaggcuucaguggacuauuucuuauucaucugugcaggcacauuguccaauguacaaccugcucaaugggcuuguugaguuaauaaacuacucuguguucuguauuauguggauuuagauguuuugcuucuuuuucagccuuccuuucgcacccuccaccuacccgaccccugcuaagaugcuaccuuuuaaagaaaagaaauaaguucuucacacuuuucuacauuuauaauucaauauaaauaacugcuacugguauacuuaaucacaauuagauuaaauauguucuuugaaacagggaggucaucuaaugaauagaagugaaauaugucagaaaaugucacauaacugagagugugacaucuuuaguaaauagaauguugagaugauuuuagugcuaggcuaguuuuguaagagacaucuuauuugacaccuuuguucaaacaacuuuugugguucucaaacuagccucuauugaaaagaccaaguucccuacgucuucucuuugaacacuuucuucuuugcauuaaccuguucuugcuagugcguccaaguguggaaagcaaagauuaguuuuaaaucuuccgggucaaaacuguuuuggcuuuuuucuagagcugauaauaaguaguauaguuuucuguguaccauguguaagagaagagaaaaggucugacuuuauguuagauaauccauaauucgguugcucugucccacuauauggagaccaaagucacacuaaauggaugccuuggguaggggagaaggauguagccuuucaaucagacuucuuagcugcacuagucacauggcuagccuggggcagguauuuaaacuugcuauaccuaagucuccucaucuauuaauugacauuaauaucagcaccuucuucauaggguuuguaaggauugaauaauuuaauguauguaagacacuuagaagagugucuuaaauaaugugagcaccuucuucauuaacauuagcacauauuucauaugauuuugugaggauuaaauaauuuaauguauguaagacacuuauaagaguguguuaaauuacagacugugcucaguaaauguugucuaauauuauuuuuaaacugaugguuauuagccaagcuauaccauaucuucaacuuugggugcacaagagugggcaguaucuuugaagaggucguuguuucucaaucugugggucaaguauucuuagggaaacuuuucauuuugguccaacucauaacuuuagugacauuagucuuugcaauuuccugcugagaagagaagguagccuuucuauuuuuuuuaaguuuucaaagccuaauuuuauauuaaaagaaaacaagguauuaaaaccacguauuucuuuuaacuuauuaaaaggaaauaacacaguaacauuaauaaaaaguuacaaaauggcacaguaacauuaauaaaauguuacauugucuuuuuauucuauagcgugaauggaagaaauaaaguaacuuuucuagagcuacaaaguaguuaaugguggcaaagauucacucucuggcaaugugucuuguuucacaaaguaauacaaguucaacacaguauagaauugccuuugauuucaaaugguaacagcauuuauuggauuauuuuuguagauguucaaugccacaaguaaaaugaaguuuucucuuuaaaaggaugauagauguggcagacccaucacugggucccuggacagugguaacaugaugggguuuaaaguccuuuuugaaauagccagguuaaucugcauaaaggcuauggugcuucauuaagcuuuuugaaaacuuucugggguaggccaaguggcuauuuguaucaguuaaacguaaguacaacuacuuaaaauaacauuucuucccacuugugcuugagucugggucuauauuuuuccugauaauaacaggauaaaaugaaucauuugauuccauauuccaagaaaaacguguccauuagguagaggaagcucuuagaaauuaucuccaagaguggcuuguuuuguaccugucauauuuauuauaagguaaagggagauguagacuggugggggugaugguaguaaauugaaaugaguugccagcuguguugcccaggcuggucuugaacuccugggcucaagccaucccaccagagaagguucuuaaaccuuuugcuuuccauugggcaucuuuaucuacauuuuaccucaucaagcucaucaagugaaucagacgcuuugacucagucauaacauguugauggagagucacuuaguuggaaaauauagacaagaagaugggcucugggaagaacugguagguaggcaauggcucugaaaguguggggcccugguuuacaguguaaugacacccaccauuuagugccucagccauuauucaagugugcugugccuuuccuacuggccacguuaaugagaggguggagauagcaaguuccugcugaaauuuucacaggaaagcuaagcccuuaaaugauguuuugaaggaaugguuucucuaccaucuguaaaaaaggcuugauuaauuauuuugguggcagaaacuauaugcugugcuucagguuaaacagcaggaacauauugagguucuugggaagaguuuuccuacagccaucaaauagguguccacacagguuaaccggacugugcaauaagaaugugggacauuggcaugccagugugaagucuggaaaagucggaugugauauaugcaaguggaagagaacugaaacuaugaagagucauuuggaaagccccaguugugaguuugugauaguugagaaauggcaccuccucuuugcauacuuagguuugagcaggaaacaaagaagugacuugaagucauguuaugaaaagaagaauuggguuggaggucagacucuggauucuagaccugauucugaguuaacuaacauuuuagccuaguuucaggcacuccccaguggcccaaugagccaccccuucuugcaggccucaaaaugcacugugauaaaacugcauaguauuuucuuuuccuuauuuucauguucuaagaaauauuauuguccgggcacgguggcuuacaccuguaaucccagcacuuuaggaggccgaggcaggcagaucucuucagcccaagaguucaagaccagccugggcaacauggugagacccugucucuaauaaaaauagaaaaagacaaaacccugguguggugaugcaugccuguggucugagcuacucaggaggcugaagugggaggaucccuugagcccuggggguggagguugcagugagcugagaucccgccgcugcauucaagacugagugacagagugaaacccugucuaaaaaaaaaaaaaaaaaaaaaaggagaagaaaauauaauaaaaauaauacauggauacuuucuuaaaauaucagacacuugagaauguugaguaaaauauaaaaggacuuaaucuggagaucauugccuuaguuauaacauagaaccuuucuacuuaggagaauuucccucucuccuacucccuauuuguaaaaauuuucuuuuguggcuucagucaaguuucauacuuuuaaauguuuuuguuaauuuuauucuuuguguuuuuuuccuaaacuguauuuuuguuccauuaugauuuuuucauugguuagcugagguauaggaaaguugucuuuuuuauugucuguuaaucuuauaacccguaacuccagaacuuucuuacuagccucugguaguuuuuuuuaguuguuuaagauuuuuuaggaagaaaaucauuggcaaauauugggaguguugucucuuaaagugucuuucuguuauauuuuccuugugcuaguacauuggcaaagacuuacaggagaguguuaagagaauaguggaauacaggucagcuucgcauuuuguugacuugagcaaagaaucuucuaguguuucauuauuaaauaaguuuucuguaggcaucuaguagauuaagaaaacuuucuuaugauccaccacuucuuaaaaugaauguguguguucaaacuaaagagauauauguauauaguagaaauauauguguaugcuugugugcauguguguguauaaacuuuaaaucauccucucaaaauuccugaaguaaaagucuauuuuguuguuuuauguggaauuuuauuuuauuuaaauuuuuauauuuauauauuuuauuuaaaauuuucaugaaauggccaagcaggguuuaauauaaaauggaaacaggguuuaucucagaaauuugguggcuaaauuccuuguaucccgucuuaucuagggauguuguuuguuucaagguucuaccuugagaggagccugucauuuucuuuuuugugugcugcuuugccuaguugacaucuuggcuuuaugugcuccuguugaaugcauugggaaauuuucuuucuucuuucuauguccugaaauagcuuauauaagaggggaauuuuugauauuugggggaaauugcaugggacuuuuuuuuuuuuuuuuuuuuuuuuagacagggccucacucuauccucaaaacuggaauggagugcaguggugugaucauggcucacugcagucucuaccaccugaguagcugagacuauaggcacaugccaccaaucccacuaauuuuuguauuuuuuuguggaggcggaguuucgccauguugcucaugcuggucuugaacuccuggacuuagccaucugccugccuuagccucccaaacugcugggauuacaaaugugagccaccgcgccuggcaagacuaguacuucagaacuggauuuuuuacuaauuuuuccauuucuguuucuuuguguuucaauugugauaguuuuuguuauccuagaaaacauccauuuuccagacuuuaaaauuugcuacauaaaauuauacauacuuucucuuguuuuaaaaaacuccuuaucuauuuagcaaauauauuuuguaauuauguugauuucuguuuucucucuucuuguuuuuccuuacacuugccagagguuuguguguuuucuuugguuuuuuuuuucaaguaccuucuuuugguuucauugauaaucuacauuuuguuuuaucuaaauuuaguaaauuuuaaauuuuauuaauucaucauauuuaaauauguugcacuuuuucuagcuuuuuauauuguauguuuuguucauuuaauuuuuauuuuuacaucuugcaauuuaaggccauuauuuuucauugguuacagcuuuggcugcaucccuuagauuuucuuauauacagcuaucacuaucauuuauuuguguauuguuuuaaauguuauuuugcauucuuguguaguucaagaguuacuuaaaacacuguuuucacagucccacuuuaauaaaauguuuuucauguuggcagugcuacuguuuuguuuuuacuauuuaauuuuauugcauucugaguggggaaauggcauggauauuuccuacuuuggggguaaucuaguaggauuuuuaaaaaugcuuaguuuuuuuuaagcauuucauaugcauuugaaaauaaugaauacuauuucccuauuuuauuauuauuauuauuauuuuugagauggagucucacucugucacucagguuggaguguaguggcacgaucucagcucagugcaaccuccggcucccgguuucaagcaaucuucccaccucagccucccaaguagcugggaucacaagcaugugccaccaaccuggcuacauuuuguuuuuuuuaguagagauggaguuucaucauuuuggccagccuggucuugaauuccugaccucaacugaucuucccaccucagccucccaaacugcugggauuacaggcgugagccacugcacccggccuauuuucccuauuuuaauauauuaaaccuuuuauuacuuauuguccuucuaauugauuuaaauuucugagagauauuuguucuagucuucuacuuugauuauggauuuaccaaccgcucaggguauuuauauuuuaaaaaauauaucucaaagcuguaucauaaaugauuagaaguucaggaauauuuuauauuuuugguggacuauagguuucaucaguaugaaauauccaacuuuuuucuuuuuuuacauuuuugccuuagauuggcuuucaauguauaguaauguucucuacaugcuuuauuuuuguagauuuuauauuacauauuuuuuauauauuuuuauuuuucauagucucuguguuuuauuuuugaugguuuguuauacacagcauuuagcuuuacauuuuucuagccuaaugugacagccacuguaacuuaguugaggaauauaauauccaaauaaacauaguuuaauuuucuuuuuuuccuuggcuugaucacauuuccuuuguuuuauauuuuuugcugcuuaaaaaaaggucuuuuuuuuucuaauggugcaggaauuauacaucuuauuucuugugaaaguuauucuugccuuucuaacucacauauuucaaauuauauaucucuauuaaagucuaaaucuguuuggugucuguaucuuuccuaaaaaagaugacggagaguguuagcacauuuuuaauuacugaguuucucccuuuguuccuccccuuuaccucucauguugagguugauauguuuccuuuuugacguuuuaaauugcaucaacagucacauagagucuacuagcguuuccuugccccaucuugcuaauuuuuguggaccauguuguucuggguuuuuuuggguugauuugucauuauacaguuauauauccuuauguaauuuuuuucagaaguguggggguauaaauuuucagagucuuugcauuuucuaaauugccuguaguuagcucaccuuuuugaaggcaaguuuggcuacauauaaaauuugaguuuuaaagucuuguauccccuuuuucugucacauuuuuguucuggcuugccuugcagcucuaaauguagcaccccaauuaaucacccgauuauugcaucacacuccacuccagcuccauguauguauugacccugggauuggagcauccuagauuuagcuguuucuuugcagucuucuugauuggcugcugcuuuuuggcuugugauuuauuuauuuuuccucuguagagcaaauccaucuacuuuuaucuuuaagaauaauucaaaauuguuauuccaccgaagcuacucuuccuuauuuucuggcacuauuuggcauguauaucucuucuaaauucacacacacacauacacacacacccaguaucauuuaugacauaugagguuagaggaaaaguagaagcuuauguuuaaucuaccaucccaagccaaccccuuuauauggaacuuuacacauucuaaaugcuuucaaauacaguaccuuauaaggaaggagaugcuauuauucuccuuuuauaaauuagaaaacugagagguuauaagucauuuuauuuauuuauucuuucauuuauuucuccauuaauccauuggcuaaauuugcaucaucugcuauguauaagcagcccucagugccagagacacaaaaccccagcuuccaggaccucacagcugagaguggaagcaaguggguaacaauagagacuugugacaauaauuucagcauaggguggauuucaguuccaugcauguuugagacacgugcuaggugcagaggaaccuggggagaggcgucucuaugucagacuucccaguggaaguguugaggaguguuucccagcggaaguguugucauugauuaaaauccaugcuguaaauguaggcaugaguugacugcugugcucuugguaucuaguaaaguuccuggucccugguuggcacuuaaaaaaaaauaagugaaugaacaaacaaagcuuccuuggcucucaccgaagcacuccuuuuguacuaacauaugugauagucuccacaggcaugauuucuuuauuucuccaagcaucucuuugaguagguacagugaaugucuccuguccacaaaugaaggggccaaggcuguggggaguuaagugucuugucuaaggaggcuuggaucccagguuccucugacucccgacaggcaagacuccuacuggcccuauggcccccucauccagauuauuuuagccucuuuuuucaaacucuuuccugcccucugaucauguuucuaccaagaccaaguaucacaaacuaaugaagagguauaacuggcugccuccuggaggagguauuaagaagcauacaguggccaaaguggaggaggaauaaaaauaccuccagagaccucaauaauaccaaaauagcuagucacaccauauaugucuaagcuuugauacagccuuucuacaugacauguucauuuggaauuauauuagacauucagguuugaaucagggcaggucacuugaaaugucucaauucaaugcaaaaguuauaagaaaaauaacauuuccccccacacaaguauauagcauaguauaaaacauucucaaaaacuuuguaaaggaaacacauuuuacaguuuaacucauaccuacuucacuuccuucucccucuccuguucucuguucauuauuucccuacuuacuaacuggcucuuaguuaauauuuucguggccucacccccacaccuuuuuaguuggucucuuuuuugugcaaauugauuuuauuccuaucuaaggagaugcuuucauccuuuuuuucaugcuuugaggccucauuagaucacugcacucuaauuuugggggggagaguugucauuugcacuauauguacagucugagcauccuaaaguucuuguucugagaaaaacaucgccauggugagcggcccauuuugaauuaggaggacuggcuaaggugcucacuuaagcucuuuguaguuuuguucagucaauugaguguuucuauguuacaucuaucugucuauaugucugucuaucuaucuaucuaucuaucuaucuaucuaucuaucuaucuaucuaucaucugucuaucuaucuacauaccuaccuaccuaccuauguacugagcccaggcuggagcaguggugcaaucagagcuuaccguccccuugaccucccagacucaagugauccucucaccucagccuccuaaguagcugggaccacaggugugcaccaccauaccuggcuaauuuuuuuucuauuuuauuuucuguagagacugagucuugcugugcugcuuaggcugcuuucaaacuccugggcucaagcgauccuccugccucagccccgcaaagugccgggauuacaggcaugagccauugcgcccggccuucucuuuuuaacguaauauugagauuggggucagacugugcugguuguggguaaagcuauugcagccuuccagcuaugaaggccugcccuccacgaugggauggccaggcugguaccugagacuaguguuggaggcaguggcagcuucccuuugaucuauugcagaaugcauuuucaaacacacacacacacacacacacaaauaaaacucugauguucacuuuuuaauugaaagcuaaaaaugcccagcuccuuucugcagauugacaagcugauauuucagcaguagcuaaagaacccgguuuaguaagcuacugaauuuugacguuuauaaacauuuaaugaauacauuuuuauuuaugucagcuuaaaaaauacagcugcugauaucugcgccccccaacaacuuuuuuugucuuaaugccaaaauuagaauauuuaaauauuuuaaaauuuccugaugagcaccugugcaggugugagggcagcaugaauucacagggagaguguaugaaguugguuaucuugaugugcuuguggggaauguguauuuccuugcaaggacugucaugugcuaccugauccucuuucauggaccucagccacuuucgccucuaacuugaaaaggaaacuggcauuguggcacaggggccaaagggacacauuuguagccuuguccucaaaucaagugggacuucugguucuuucucugaccaucugcuugaccuucagucuggugucuccaaggagugugucucuauggcaguuuaaaaaauucuguuacacugagaaagagacaaaauguaaaucuuaaaggaaucaguagauuuuuaaccccacugcugguguugagaagacaguuugagucuuaaucucuuuccuuaaguuucaaaacauguaggauuuauguuauugacaugucaaacuuuuuguacuuauucauuagggaagguuucaauacacacaaaaauagaguauuauaagaugcgcuacuauguauucauuauccaguuucaacagacgucaccauuuucccagucuuuuguuauauaguauccccuucacuuuauguuccugaaauauuuuaaggcaaagccuugacagcauauuauuucaccuauaaauauuucagaagcaucucuaacaaauaagcccccuccuuuguuuuacauagccauggugccauaucacagcuagcaagacuauuaggaauucuuaauagcauuaagaacugacguuccucaguugucucacaaaugccuuuuuacagcuggcauguuugaaucagaauccaaaccagguucacacguugcauuugauuaucaugacuuugaagucuucuuaaaaucuacaacauggccagucucccucuuuuuaaauauuuaaacuggguccauuuuccuguagaaagcccacauuauggauuuggcuuauugcuucuuuguggugucauacaccauguucaucuguucuccauacuuccuguaagcugauacuugcauuuagggcaagcuugucuaacccauggcccacaggacacaugcggcccaacacaaauuugaaaacuuucuuaaaacacuguguuuuuuguuuuuuuguuuuuuuuaagaagaccaaguuuguuugcaguguaugaaugucuaggugaggcuggguuaauggggagaaugagacuaacauaacaucuauaacucucaugacuuuuuguuauuguuguuguuuguuuuguuuuuggagacagagccucccucugucacccaggcuggagugcaguggcgcaaucucagcucacugcaaccuccgccuccuggguucaagugauucuccugucucagccucccaaguagcugggauuacaggcacgugccaccaugcuaauuuuuguauuuuuaguagagucgggguuucuccauguuggccaggcuggucucgaauuccugaccucaggugacccacccgccuuggccucccacagugcugggauuacaggcaugagccaccgcgcccggcugaaaacacuaugagguuuuuucauggguaaucuuggauauguuauuugcuucauucaagaaguaguauguggccauucauuucucaagaugcuuagauuguucagugaguucaugugcugcccaccagaucucccuaauacagaguuuuacauugucuuucaccuguuuguuuuaggaucuauugaugauuauuucauuggagguugcaaaauagccauaaguaaauugguuuaaugaagcuucuucucccuacuaaaucuuaucuagaguuuaacuaucuauuaaucauucauuuuugcacauuuuuacagcuuuugugggguauuuuacauucuuucuucuguuugaauauagagggugccuugcaaacuucacucauuucacuagaagaggcaacuguuuaaauccuacucuucuaauauauuuccugguucauguuuuccugcacauucauaaaugaggaggacguugauuugucaguuaucuucagugcuuagaauaguugcugaaaugugacaagaauguuuauggaagaaauuaccuuauagguuguacauguccucuaaagacaucauaggcacuccuacauugcauuggugaaggggccaccaaacagcagaauccugcaacuugguugaacuaugaaaauguucuugauacauuauaauuuccucaaccccuuuagccaguauuggccauucaggcaaaggaauagaauuuccaagacuuguacuguauguuugcagaaggagggaggauggcagauagguuuguguguguugggauggagaaaguaugcaaauaagcuaauuaauaucaauuguuuuuauaucuauauuacacauacacacacucgcauacacauaagcacacauaauuaaucacacccaugagcacauguacacagcuggucuacaccagauugcccugacaauuuuagagcugugugcugaaaaauuuuagaggaauuuggcuuugaaugugcaacacguauuacagagcaaagaucaccuuggguccuaagggagaugacuuucaucucuaccaugugaguaaaaccugggugauugaaccauaaauuauuuuggguauauagaacuuucuucaaauaacacuuaaaauuaaauguccagguaagugauuuucaaaucagaacaaccaaaauuguuaauaguuaugaucaugcuuauauacguauggaaauguauauguauauggaaauauggaaauuuguguauaagcaugcucugcaguaaaucaaaaaaugaccauggagcaaacauaugaaaaugcucaccagcaaugaaaaaaaugacccuauggcaaacaauaaaguaaaaugcuacacugucuuccuguagaggaccuacuagguuuggacaaacuggcugugcucaaauacaugugccaaaauugagcaggcugggugcaaauauucuaagggaauugaaagacacuuuuucgugaaauagguuuagguguugacauuaucucuaaaaguaauuaaaagaugauugauguaguaaauuuucuuuuaagccaugccuuuaagcacauuguaggaaaaggacuguuaaacaccacauuuucuuauuuagaacccuuggggccauagguauuucacaauuuaagaaucauuugcauuuuaugaaguuaauaugguguauauaacauguccuguguaacucuccagugaagucugaaacagccgcaauguauauauagauuauuauuucuauagcaaaacauaugaauagauacaccuaguaagacaaaaacaaaaauuauagauacguagauauucucacauuaguucagguuuugucacaaaguacagcuuucaaaccuucuggaauuuuucaauugagggaaagauugugaaccuucaaaugaacaaauaaauaaauaucuaccuuuucugaagaaaaacaaaagccaaauaacaaauaaaucaagaaucacuuuucaugguuuuuaaaccccucaaauaaaugucuuccuucuuucaguucauagaagauuuagaauuauaaaauaaagaaggccuauccacauggucuauauaugucuuauauaucuauaucuauaucuauaucuauaucuauaucuauaucuauaucuauaucuauaucuauaaacaauuuuagaauuagcucgucccacacaaaaauaguuuuuuuguuguuguuguuuuuuguuuugcuuuuuuugggauggaguuuugcucuuguuguccaggcuggagugcaauggcacuaucucagcucagugcaaccucugccuuccgaguucaagcgauucuccugccucacccuccucaguagcuggaauaacaggcgugcaucauuaauuuuuuuauauuuuuaguagagaugggguuucacuauguuggccaggcuggucuugaacuccugaccucaggugguccacucaccuuggccucccaaagugcugggaucauaggcaugagccacugugcccagccaaaacuuuagauuuuuauccuguuugugccucaaagccuauucaguugaaaggcugaugggcucgcucugagguccauuguuggcugggggagagcauuagggagcugacuuuuggcagaugaggaaaacagcaugaucacugcuuuugccacucugcuuuguggaauugacccacucugaaguuguucucacucgacagcaaugcaggcauuuauccagugcuucuacaagaaauaauuugggcaaaagcaguaaggaaguaagccuuaacagaaaagugggacccagcaauaggagaaucuacacaucugcuaagcccagccaucauauauauauguguguguguguguauauauauauauauauacacacacauauauauacacacacacacacacauauauauacacacacacacacacacauauauauauauauauauauauauauauauauauauuuuggagauggagucucacacuguugccuaggcugaagugcaguggcaugaucucggcucacugcaaccuccaccucccgaguucaagcaauucuccucccucagccucuugaguagguggcacuacaggugcaugccaccacaccguuaauuuuuuguauuuuuaguagagacagaguuucaccguauuaggauggucucgaucuccugaccuugugaucugccugccucaguucccaaagugcugggauuagaggcaugagccaccaugcccagcccuuauauauuuuuaaugugcauuaguaaauuauaaauaaugacagucuccauguggaaaaugaaaaucaacuuagcuuauacauuuuuaaaaaucagucaaguggucuugucucauauacauagaccuugaaagauuuguuuucaguacauucuguagaaggcucuugaauaucugauagacuccccuggcagcuuucaccuggugugugcaugcacagauauaaucaccuuagucuuuauccugcaguaaacaaaguucaagagagauuucugaaaugaagauaaucuucauucugccuuuugccgcuaccuaaaguucccuuggaggacucugugaaguuacucagguuauauuuuuuauaacaaauauaaaccacagaauuugccagaaugagaaauauucugaugaacaucaugauuugacugaggauggaggaauuguagggaaugguuaaacuugaagauacuuuuuagaaaaacaggucaugugcuacagaagcuacuuuuaaaaacaugcuuuuucauuaaauguaaauuuaccacauuauuuuauauaucuucauuaauuuaauaaaacuccugcuaggcuuuuguaaauuuucacagauauaauguuaccauaggcaucuaugcacauguauuuuuguacacuuguccaauauuauccauagaguuaaaauuuuuaacuugaaacuucuaagucagaaggcauaugcuuuuaauauucugcaguacauuuuaacuugccuuccagaaaguuuauaccagauuacauucccauuagcuauauaugaaagugaacuuccucacuggcaguugaaaauuugucuuauuuuaauuugccagauagcuugucauauauuuauugccaaauuucaaauucauuccuuuuauaaaggaaugguucauguucuuccccagucuauuuaguuuuauucuuauuacaauguaagagcuuuucauuuauuaggaguaucuucucauuaaauauuuguuaagaaagauuuuuguucaacuuuguaugguuuggauaauguuuucauuuauuuuuauuuauuuauuuauuuauuuagagacagagugucgcucuguuucccaggcuggagugcaguggcaagaucuugguucacugcaaacuucgccucccagguucaggcgauucuucugccucagccucucuaauagcugggauuacaggugugcacuaccacgccugguuaauuuuuguauuuuuaguagagacaugggguuucgccguguuggccaggauggucuucaacuccuaaccucaaaugauccaccugccucggccucccaaagugcugagauuacaggcaugagcuacuacgcccagcuggguaauguuuugaaaaacgaguauguagucugggucccaauauguucuaauuuuucuagcucuaaugucauagcuaacaaaggccaucucuacuuaauugcuuguacuuuauucucaggcuuuuauguuuuaaccuuugcauuuaaacauauuuuaguaugaagugugaagcaaaaacguaaauuuuuccccuuaaaugcuaaacaaacuuuaguuaccauuuauugaauaauuuaucauuuucucauugauuuuuuuuucaaugacagccucgccauaaaucuuucuguaauauuuccugaucuggcagcagccgcacauugcuuuaauuuacuuuguuuaaaauguauauauucucaacuuacaucuuuguaaaaauuuucuuaacuauuaucaugcauuaauauuccagauaagcuuuagaauuugugucuucucuacccuauccauuuuucucucuuuggaauuuguuugaauuugcauuaaagucuccuuuaauuuugagucauccaaucacauuuaugcaaauacuuuccugggaaauauuugugugaaaagauuuucuuuuaaaaauugauauacaagauuauuucggucuuuuagaaguguuuauacugcugaauccuuucaugauuuuuguuaaacuggcuugugaacuaguucagcaagucagugucguaugcugaauaucuaaauauauuuauaaugagaaauauaagaaaacauaauaagaauauuucugucuuacauccguggagagaaaauagaauauuuauaaaugcaaaugcucuacaauuacucuaaggaaacuuaaagaucacaguccuauucuaacucuguaaaguuauuugcuuguuuguuauuuuaacagcaucuuucucauaagcauuuaaggcugguuauaauguuuugugugugaauauugaguaaaccaaaugauuggaggcccguuauuuuuacaaagauuuuauggaauaagcaaguucggaauggauuucgaaaaagagacagucccuguuucaguguggaagggacauuggaguccaaaggucagggucagauacauguuuucuucuuuuuuuuuuuccuuccuuccuuccuuccuuccuuccuuccuuccuuccuucuuuccuuccuuccuuccuuccuuccuuccuuccuuccuuccuuccuuccuuccucuuuuuuuuuuguuuuuguuuuuggagacaaagucucauucuguugcccaggcuggagugcaguggugcgaucauaacucaccgcagccuccaacuccugaacucuugggcucaagugauucucccaccuuggccucugaaaaugcugggauuacaggcaugagccauuacaccuggccauuuucuuuugacuagagcugaaguucugaaacuagcagucauuggagauaagacaggagaagacaguugggaggcuccaagcaugugauuucaggaaaagcaugaguugauuauugagaauuucagaugugagauuuccaggaacagugugaguccagaagauguaagaaagaucaguggaauucacacaguuugguuauucaugcaucuucgaauauuuuucagauaaucucggguggauacuucaguuauuucugccucagcccaccuuauuuguaaagcaguauuaguagaauccccuccuugagggguucuucauauuaaauaaguugcauagccaacagccugaggcauaccaaacacuguauagauauuugcuguuauuuguaugauugcugccuuuuacugaguggcauccugggcuggugcuugggacucaacagugaggacauucccucccacaucugccuguaaugccaaggccuugugauagggaguggccugaagcccgggguagaggaguggaccuccccagcauagcuggggaaggagucucaaggagaugacauuugaccaguccucaugguuguuugcaaguggcuucucugcuguggaaugggaagaaagggucuuccaggaagagggguuagccuuuguaaaagugcagagaaacguuuguaugagcaagagaguaauuagggaaccgugagcaauuccaugugacucugacuauagguaggcugcagggaagggaagagacagaugaggacugucuuccuagugccuagaacaguggcuggcccauaguagguauucggugcaucuuaguggagaaaugugugaaagaggaaagagagggcugggagguagacuacuacuagauuggcuauggguggagcugggggcucagcauuuucaagcucugaaguuuggucuccuugaaggaacaggagcagcucuggauuuuagaaggccaauucuguccacagugcaccaguguucuaggugagguuggaugauggggagagggaagucugaagauagcauccauaaaucucaugacauuucuaucccagcagugcaaucaaauguugagaauauguccuguagcuuucuuuuagaaaagggguuagcaggccaggugugguggcucaggccuguaaucccagcacuuugggaggccagcgcggguggaucacgaggucaagagauugaaaucaucauggccaacauggugaaacccuaucucaacuaaaaauacaaaaauuagcugggcaugguggcaugcaccuguagcccagcuacucgggaggcugaggcaggagagucgcuugaaccugggaguuggagguugcagugagccaagauugcgccacugcacuccagccugguggcagagugagacuucucucaaaaaaaaaaaaaaaaggguggggggcgggcaaauuauggcuuaaggccaaauccaaccaacagcuucuuuuuauaaauaaaauuuuacuggaacacugucugaccuguuuauuuacauauuauguaugguugauuuagcguaacaauggcagaguuggguguuuucaacagagaccacauggccagcaaugacuaaaauauuuucuaucugguccuucaagaaaaauguuuggugaccucaguguuagaagauuguuuuuagguauuuaauggugccauucuggaaaaguuggcauuguuggaagaguucaaauugaugcauguguagccuaagaaaaauggggccauaucacuuccuaugaagaaacacaccaaaauuuuaauucaauucuuaaguuguugucuugauuaucuaaguucugucucuagucuccuauggcuauuuuuguggcuuugacccuagcugacccagccuauugucaguaguuaagaagguagauuccaagugcucaaugucauguuaagacuuccuugcuaccuacuaagggaagucauuuuuuuagccagcuguuuuaaguucuccuaaccuauuucauaugcuauguucccacaauaaccauucccuucucuugccauuucuuuguccucucuccugcaauguuucuucuacugaaagaauacggcacuacugaaucuguuucuccugggcagggcuugcauuaucccaccuguuccaaauucuuuuuagaaccgggcccuuugggugaaugaugaaccauuuaauagccccauguacuauagaaauuuaaccauuuucaaccaaaccugucauagauaagaacaaagguaagccaucaugugucuagaaaaacauacaacugauuuccucacagacauuacaaguucuuacucuucaaauguacuuuaaaggacugagaguguaauuaggaaucagcagaaguuuuguggaaaagaggcauugagccuuuugcauauuaaggaucaaauuuuauguuuuguaugaagcauucaugaggugauguucuuaaaaaccacuccagaggcacaggaggaacgcugaggacaagacugaauauagagauggaggaauuacgugucuacuggguagagauggagaaggcauauuuauacuagggaugguugaaaucaugcaagcaucuuccauagcuaauaaauuauuuuauccaguuggccuuuacugagggcauacuguguaccggggcccacccuguuggaugccaggaauacaaagaugaucagaguucacuuucugcgcuugaggaucccacagauuagaaaggaggaaaaagaguuacuuuccauacaaggcuauaaauguuacaacaguugaauuuuucagaugaaguggaaggaaacgucuagaaggaagaggacugaaaugaaagaagacugggggaaaagaaauaauaauaaacaaaaagaaaaauaauuugaaacuuuuuagagaagaugauugaccccauuguggagaucaagauuaaagaugaauggcaggcagcuguggagagcagagguggagauauugggaggaucagacuaaagaacugaaauuucaguuguccaagcgggcaugcuguucuacagccucacaugucuugggccuauuagaaauauauauaaucuaucuaugcaugacuuauauaccauacaucacaucauuucuuccaaacuuacauuauaauauaacacauucuguauuaguauauaguaagauuuuaaaauguacaacauauuuaaauauacuccuuacaauuaagccucaguaagugcuaggaacuuugcuaagcacuuuguauuaucuaacugaauucuuaccauggguaggcacucuuauacaacauuucccaggcaaggaguuuugcccaccaagguuagacagauuguccaggauuauccaggggguaaguggcacucacaccagggcuugucugacccuacuuaauuagaugggcuccuaugaaguaaauuuuaggauaagcucuugacuuaaaaaugagccuucuaaugguugugggagagggagaaaaaacaaguuuacagaagauagcgggugaguguggagcagagaacuagcauaggcuuugaagucaagccuaacugaauucccagcuuggcuccacugcuugccagccacauggcauuggucaggucacauaaccacucugaauguccccaucuguacauugggguuuguagcaucugccuuguuagcauguaaaggaucugcaccugugccuggcacuuagcagacacugugacuuguagcugcugcugcuccugcuauaccuaccguccuugccacucuucuuauauucacauccacccauccuccuccucauacuacuauuacuaccuaugcuaauacuauggugguuaugaugagcagcaguaguaguuggaaugccucaaagauaagauuuaugcuaaaaaacagaagcacaguaguuauuuaagaccucgauuugaucaauagcauuaguucugcauuuacuucaauauuuagugagcaugugccauggcaggucucugcgccaggcacuguagaaaguuaaaacaugaagaagucauuuccucuuuuagcugccauauccucuaguuugaccuuuacgccauauacucuuggucagauauucaagaaagaaucuugggagggaaagaguuagugcucaucgagugcagacuggcuugaagcugugcauagcuuuggaaggaaugucaggacuuaaauaauuucaggaugaguugaagauuacauugagcauuuacuacuucuccagauaaucucaauuuccgcccaucaugugauggaggugucaccuuauuuacagguucagauuguuagcgggacacuuuguuauagugauaucuuacagaguuggccauuaggcuauaauugagccuuuauguggggugcuggguaggccacaugacccugguuccuguuuccagggaggccaaccuacauaaaaauggcugucauauaucguugcucagaggggcagauauuuacaacaaccuugaaauggaacuuccacccaauaugaugaagacugacuugugacaguuugauaugccuuuauuuugcuaaaauagcaaccuggccaaauauauuuuucagcacauuuauuauagcuacuuguuuauauuuauagcaaaaguguugcuaauucccuaguauguuaacaggucauauucaaauuguucuauuuuuacuuuggcacaaaauugcugaaggaaacauuuuuaaggcaaguagugauuauagcauaucaacucacuacauagugaauuauauauuaaaugaacuuccugaacugagaaggagcuuaaacugacaaagaagauaguuuucuuaaauucuguauuguuuacauaagauuucuucaaauccauuuuuuauuauagguuacugauugucucaauguuuucuuuuugcuaaauuucuaccuucccgccaacaaauauaaucccccuuuuaauauauaauagaugaccugggauuccagaauggauuuucagaaaccaucaaaaaaccuccucgcuuuaguguauacaauaaauaauauauucuuuuuuaaaaauaugagagucaaauagguauaugcguaaaccuggccaacccuugggcaguuguaauuuccauaccaaaaugcaugagucuuuacuugacuguuacucuguuauacauuaaguacuaguuaccauggcaaccuuugcaucacauuaugacauuuaaauauaaggugguguguuuccuuauaaggaaagacaauguauuugaauuuuugaguguuuggugaaauacaaucacuacuaaaauaaauaauuuuguuuaaggcaauugauuucuuugggaauuacguacauuuccaaccaaaccuauggagugcauucauuuauuuuuauuuuuuugugaugucauggagaaguaaaagauuuuuuuuaaaacaacgcuugauaaguauaacauaauaauucauuaaaugccuauaauuacccucguaaguggcaaaacacaaaauugaaccauauuugagguuauuuaucagugaccaauacuguagcaagaguucgaauguaacaucacaagauuuaugaaauucuaucgcauauaacacauuucuuauuuuuguauaucuaguugguuaacuguaacuaguuuugaucuuaccuauaguugaauuaacaguagcaguuugcucaugcgugcaaaagcaaaauuaaaggagccacugaacucauccuuguggcauuuccaggaacauggccacuuaaauuuaauuaugaagauuguugggcaauuucuuuauuaaauauggaaaaaaccuagucauuucuuguugccaguguagcucuaggccauaaggcuaucaucuuuguuauguagacucccauauauaacucauuuuuaacuuuuuauaguaacuuuuccaaauuauuaucacagcuuguacuuuuuaaucugaaaauagagaaucuaaugaucacucauaacuuuuggugcaucuuuucaauaauaaucaguggauuguaauaugggacuguuuugugugggacauaagaaagagguaagcucugugcuggacccuggcucugcggaacauuuuacauauguuguuucaucuauuccugauaacccuaugauagagcucuuauuagucccuuuuuacacgggaagaaaguaugguuuagagcaguugcauaacucacccccaaauacauugucuguauuucuuugagcuaagguucaaccagauuggucugaccuuaaagcccucccucuuuccuuaauagauuugacuucuacuucugacuuguuacagacacaaugugcaugauauguuuaauguagaaauaaaaaacacugacaaaaaaccuuuaaaaauguuugcuaaauaauaauuucaguaauuuguauuucucugcagcacagcaguuuuuuaagucccugauuugcaagauaucuuggucuuuguaaguuacccaaguccucuuuuguugaaaccaagcauaggacagaaauaaaaauaaauuauaaagguguacucuuggaccuucaggaaucaggaaagaagacuguccaaagacugaccuucaauuuugagcuuugaaguucaaaaguggacagguggaaauacuguguucuucauugcccuuuggugcgagauauauucuagguugcagaguaagugccaacagcagcaaaauuaucgccccccuccugcuacuguaguaagucagcaauggcccuucuguggucagaauggcacauucagcagcaacuauucgacagggauuuacagaaacuuccccauggcuguuaggaaucuuauucagcagugucuuugaaaacccgauucugugcagaauuagcuauguagaaaugaccuagguugugauaaaagguauuuuaaacaaaucuaacuuguaauuucacucaauguguauuuugcauuuaaugccacaaagucugguagauaccuacacauauauuuugcauucauaaguuuuauagugguucagaauuuuuuuccauauuaacauuuuaaaaaauccuggcuuuauagagucaguucaccauacaaagccacuauacaucacuuagguuugugaugaaagaauggaauugcagcugugugaguacuagaauacccaaacaugaauuagacucacaagcauuuggcaauaguucagaaaaagagcuuaaucugguuucaucugagacugcuuuucucuguucugcaacauccccccaagauguugugucugauaccggaucacaacguaaugggagugacgcagaaucgagaaagcccugagaaaccaggggcacauuugcuuuucuccagagauuuucuuucuccuacuucuuuuuuccccucuuccaguuuccaacucugaaauucaaggucauucaccuauuagaugcauuaauuauaagccaaaaaagcaguauucaucguacucugaucucagucauaucuauaauuaaguguaaauauaaucuuccuuuuuagaaauguaccacccacccauuacauuuaaagugcugacugaaaugaaauaauaguucagagcaagaugauuuuaguuuaacuagaaaaaaguugauaauuuaagcuucaagcagugaguucuauuuuugauuaccauucaguuauaaaucuaauuugagauauaugcugcuuuucuguuacucaaguuuaauucaugguuugcuuucuugguuguauaagcaaaguucagugguugaucaaggcuguuaagaagcuccccugaaaaggaaugggggcaggguugagaauguguucgaaagacauucugagaccuauaucugauguaaaacaaacaaauccgauguaaaacaaacaacaaaauuuuaauugaaaaagacacucacagagugcuguauuuggggauuugaauggccaaguuaggaauggccauuugcaggggaauuggcugcagagggugaaccccaaaacauuccaaccugguugauaaagucaguguguuuuauucuuugguuacaguauuuuaggucuuuugggaaaaaaaauuaggagcgaguaaggggaagggcuugucucaucacacuguggacaguuaagcaaaaugcuaaacuauggguuuaagauuuacagguuagcucugccagaugccacaucugccuccaguguuuccuggcagauucgggcagccuacuacugggacccagcauaaccgcagaacaugagcuugcacaaugugaaaaaccuaaaaccauuauaauccuauuuaaggccaggaugaauuugcccauuuugaaaguagauguaguuuucaagcuuaacuuuuauuaagcagaaacuugucuucagagcuauaucuauauaugcagguaaauucauaauauaaacaaauaccuuauccauuuugugcaaaauuuaauuuacuuuaaaucaaacgccauucacuuuuuaaaauucauaaacucagguuuuucagccaguggaaaauuuaucuuucucauugcuacagagaguuaaguaucugacguaaaggccagacaauaguaaauggucauuguucgcuuuauaaguauacucuacaauaagaacacauauauuuuuaucuucauuuucccuaaggagguguuuagggcccccuuaaaugugaggaaauguuuauuuuuguugcuuuagaagaaugauucuauuguccaagugagaaagaaauaggaacaaacaggucuaaggagaaagaaacaggaaugugcuuugugaaaaaaauaaagauuaacaggaaccacuaaagguuuguaagugcuaucugguccuagugcuauguuacugcacauaguccuugcgccugcauauguaagaguuggaugcgugauuuauuaugacuggcccaugaaauuauuuucuuuuaaguuaacaacaauaaggucaaccacagccuguagcuguuuuguaguuauuuuauauuuuucacagcucuauugugaaugcugcuaaaagacaguauagcaaguguguguuuuuagguugaccccuugaaugcauuuaauuucuugagagugaaaaccuuugccaccaggaccaagaggaauuaaccaaugguuaaacucauuuaaaaacacaagcaagcauuucaacauauuugcuuagccguuuucugaauauuuaauauacuucuagagaaagaaaaaugaagaaauaggggugauuugugucuagaauacaaaguuauuuucaaacuccucuuuccaaugaaaugaagacucauucguagauuuaccaaacuguaaggagguugugauuucaaaucauucacagcuuuauugauggaaauuucaaagaaaacuuggacacagacuucacuguaacuuucuuuguuaauaagaaaugcgaagagugaaauuuagguugagauucaaaaacuuuugaaugccacuccuaaaugauaaauuauuuguuacuagauuucugauuuaugcaaaacuuuauuauaauaagccuuauguuuuaguuugucauuguguaguguuuuaauaugucucauaaguucaaaagaggcaauaguugagcaugcagaugucagauuuuuaucugauaaaucugguuuuaucagguauuuaugugguaaacauuaagauacuagcaaugaguuuauuacucaaaaugugcuuucaaucugaaaucucauccuugaaguuguauuuugaaguaauguuuauuacauaucucuugaaaaagucuuaaacuggaaucaguaaaggcgagcuugucaguagcugauuaguccuuuauauaugacucauccaacacucagaaaaaccccuuggaauagagagguucucuuuaugauauuuagcuauauggcgguggaaaggggagguuugaauuuuugauuuuccagcuuaugggucauauuugaccaacugcuuucacuagaagacaugccacuuuguugagcuauuuaggaaucaaaaagacugucuuaauuuaaaacaaggacccuuuguuuuaguuggugacugccuugugaaauuuuucaguucucagcggguuaaccagggaacaggggcagagucauaauuggccuauuuagaguauuuugcaugugaauaguguguuagugaagcaucccuaagucuguugugagugacauggugauuagaauuuagauuagggaaaacacauucuguacuuuaucaaggacaguaauuaguucagucaguaaaaguugauuacaaguaacgauaaaguuagauuuuuaguacuuaauuuuaaaauuucuuuauuaaauaguaaauuuguucuuaauauaaaugguacuaucuacucuuguuuuauugcauaucagaauaauuaaaagaacaauguguucaaugcagaguauaaucaagcgauuuauauauuauggguaaguuucuauguaguuuuuagaaaauguaauauuauauaaucuuucugaugucaucauuuuuagaaguuuaauaauugucacacugugauagguuauuguggaaguuuucuaguguucagguaaauguuuaaucugugggaugugucuuagcuuccgauagaccucaagagggcauucugaaguccuuuguggcuguuagcuuggaauaucugcuauuucuguaauuuugagaguuagugugaggauuugaauuuccucuugguucaguuggcauuuucucuucugugggugcuaugucaguucguggagaaucaugauaugcgguacagagaggcaggguucucagucgaguucauaggcuacacuuacccccaguguaugcagccaggggaaguugugugcguucacaaaaugagguucuucuuguuaaggaaggggaugaauaguucccagauaugagccucagucuagagaaaggaaacauuagucuuauauaaaugccauuuguuuugugaaaugaaaacgugagucaucuuaaaagacuuaaaaaaauauuguuuaaagggaaucaucuacuuuccuccuaaaaguaaagaauuaaaaauucacaaacuuugugauagcuucuuagacugccuuucuuuuggguuuuuguuuuguuuuaauugucucagcuuagcagaugcuguuugcuuuauugcauugguuuaaguacuaacaaucaguugggagguggugaaaguaaaaaauuaaccuuauauguuuguuuucccuuuuuaaccuuuuagcagagucuccuuggaggugacauggauaugggcaacccaggaacccuuucgcccaccaaaccugguucccaguacuaucaguauucuagcaauaauccccgaaggaggccucuucacaguagugccauggguaagguauuccuuuguuugaaugccugagggaugauuaugccuuuuucuuuuuuucuuucuuucuuuaaaauaucgcccccccauccuaccucccaccccaagaaaaccauaaaauuuggcucaguugucagccuggagacuuccccccuaguacacugaguagguacguuaacagcuuaugguagcagaacuuuuuuggugucugcuuaugucuaguuuucucuuagcugcacccauaaggaagcuauuaaaagaucaaaguagcaaaaaguuaaauaucuucauuuuuaugaacaaagcagaauuugauuucugcuagaaucgaaugugaucgugguaacuacaguuugcuaagguaaugauuuaaggaaaugugguaucaucuagaagucuuugugguuuaaccuaucuuaguuaggaaaaugggcauuugggagcugaaagcaucuucauuuucuuucagagguacagacaaagaaaguucgaaaaguuccuccagguuugccaucuucaguaaguacugcuuguuucugcuuuguauauugcuuauuuuguucuguuuuguauugaugggaaggagauagaaguaaaugaguuuccaugcgcccagagcagcacguuuaucuagaagguggaugagguagaaaugaccugcacauccagccaccugacccacauuggagugauuaauugcacauccuggaagacugggugguuauguugauauucagcagguuaagcucuaaagagagccuugaaaaggugccugaaguuugaggaguuuuaccuguacagggcuugcaagagaaugaguauuaguuucauguguugguuaaauucuuugucaguauuaugaugauuuauggauuugcaugcgaaaggagauuuguggagaggauuuaggaaaaauuuacauggguuucagcccagagugcaggaagaaugucucuauuuucuggagagguugcugaauaaaggcugcaaagguagcugcaucaguagccauuugugucuuuacuaccaggugacaacuagaaguagucagcuguaaccaagagcauucugggucuuuuuaacagcuggagcucuaugcagaaguugcugauaucccccacccacccccaggucccuaguacagcaaaaguugguugugaucacaacucaauacaugauaucauauuuugaauucuuacguuccuagauaauuguauuuaauuuuauuuaggacuaguccauuucuaguaauuuucuccucauauaaaaugaaaacauaguuuccucucuucuuucuuuguuucuuuauccuuccuccuuuuuuucauucuuccuugcugugauauaaaguuuugauuuaauucuguagaguacuaguauucuuugaaaagaaugcugagacuuauuguuuuuauacuuuaauauaaaaucauauuuagauuucuuaaaguauauuaccaaucaaugcuugcauauuaguuucauuucauuuuuaauguauuagaagaauaauaggucuugcaaaugugcuaagauuagauuaacccaaacaccuguguauuugacuugauuucaguucagcucauccaaacaauuauuaaaugaauauaucagaauaagucuuaucaggaaaaagaguaaauuuuguaugcugauuaucauagaguuggugauguugaagaagcaucacaaaauuauucauaaauauagaaaaauauuguguaaauaagauugccaaugguguauagucacuuucaacuagcaauaagucacuuaaaauuguacucaguuguuuauuguuugaauuucuguguuguauugaaauugacuaauaugcccaaaggauuuuauaagcauauuuuaagcuugaaguuagggguggauuuaauguugaugaaacuuuagcuuuuaauagguuuuaugacaacuucaaaugauacaguccuaacagcuguuuacauuuuaaacaugccugaacuuaauauggacaauauuaaaugcauuugguggaccuuugaauguucugaaacaauggaauaacuguccuauaaaagccauaaaaaacuuaaagcuaucauacccuccuuaugcuucauauucaaauuaacuuguuuuauccaaugcuaagauuaggcagaaaucuagacaauuucuaaggagugcauugguguggcauuggaugguauguaucugcuuaaucacugucaacaacaauuuucauaauucguuguaaauguuuaaguauuucccuauagcuaacuggccccuuuagaaaauuuuacugguacaguguuuucuuugcuguuaagacaauuuagguguugcugcuaugucgugauacauucagaaauauaaaaauaauuuuccuuucuuucccaauaaacaaaacuugggaauuaggaauuuaguuuuauucuauuuaauuuucuguuuuuaguggucaguuuaggauuuacucuucuuagaagauuuaucuugacuaaauguuuucaugguccuuaugaaacauuuugaugaauagccuuuuuucugaaauauaaggaggaagaaaauacaauucaaaaugaaauuuuuauugcaauuuuuugagcaagaagaacaaguuuagguaauuuuauaauuuaaucauccauuuacucauuaccuaaaaaaaucccagcucuauuuucauagcaauuuaacuuaguuuauguaagcuuuguuguaaauaucaauugcuuauuacuuacaacaagauccacauggcuuaccaccacacaaaauauuuauuuuaacuugauuccaaaaaaggucugcaguagacauggucacacuuuucuaguagcagaucuguauuucuauauuuuuagaccucugccaugcuuuuuuuaaagcucaaauaaaauuaugacuauuugauaagagauacuucuuaaauuguuucaguauguaugaguauuuguauaacagauacuaaaagauuggagauaauaaaagguuuccuuuggagugauuaugacuacauaagacacuuauauguuuucuuugauacauauuuaccaugacaaauaguaauaaaucugucacaaucuguuguggcaacucacuuuaccccccauuuugaagugggcccucucuuucccuuauaauaaaaggaagaaaacuuaaacggugacacugcaucaucagguauuauuugugacacgccugugguacagagacuggacuucugccgccauuaggcugggucuuccucccaggcaaucaggagagagaggggauugccuagcccuguuuugaaaacacugcagcaucugugggagagagaaaacguaggccuggccagacaucaugccauggaucuggcaggauccacgaauguguguuuguacugugugcugcaccuagagaccucacgucacuguggaaguaugacacgauggugggauaacagaagacccaccaggcagggucuacaggacaagcacagcgugucggggggaagccugucccucuagugcacauagaccaguacuugcuaaggugauuuuuuuuuuaaaggaaagccugugugaaagacagcuaucuaauugcccacgagagcucugcuuauuacugcaguacauuuuuaucuucucgguucguauuuuaguauguugcucuuuuuagucacgucccaauuucucguagcccucguuuuuugcgaagaccuuaguaauaaaguguugucuuuuguugaugucagaauuuauuuugcaugucuaagcucuugaaucuacaugagaacaucuuguuuugcuagauuucuacauuuugguuuuccauuucaaaccauauuucaucuuaaacucaauauuuugcaacuuuacugcucauuucaacaaauuuguuuuauauaaccuaauaaucauacacauugaaucaugaauucauacacagaaaaauguacuauaguaaauuaaaguuggaaaaaaaugauuuaugauucuuaacagaaauuaacaugaaaguacuaaaaucuagaaaguagcaaaaaauuuuauauugugcuguuuuaagauacuuucaucaaacacagaaacaaagcaaaggcauuaucuuuuggaaacuuuauucugcccaucaacauguaaacauguaaaacuuuuaucuuagaauuugaaauauuucaaaauuauauacguuuuaucagaaacuguuaacaacuacaaacuuucuacuucagacuuugguggaauuugucuccacuuguaauccgauuugcaucuuuaaugauggucucaccaugaccccaguuggaaucucuugaacaucagauuuuucuggaaauaggauauuuuauccuuagaaauaguuuaugaccucucaucuccagugaucuuuccuaaagcuguacuucucaguaaagucuuuuuucuacguuaaaguacagagggguuuugugugucuguuuuguuuuaaaacucaggaggaccuggcaaacuuuaaguggucagagauaauuugggacacauggaucccaagauaaacaauuucuacuacuauaaagauucuaaaauaagguuuggacgcuucaagaauauuugugacauuaguuaaucaguagguagguuugaaaaauaaaaacaauguguauuagauauuagguucaccaauuuucauaaggaaagaauucuuaaauaaaaugaaauauuuaaguauggauuagaguuuccuuuacagaagcaauuauuagggguaucaagaaaaaugaguaaugcuaauggccuuaaauguccuauguauuuuguguuauauaaaaacuuuccuauuugaagauuucaaacaugauguugaauccauaucuugagcuauuuagggaaaaccccuuuuaucccaggugcuugaagaaaucacaaacaauuuaaaagagauauugguaaacuguuuuuuccuuauuagugggcuggaaauuauguaugauuuaaaaaaucaguacugaacucagaaauauauaauuuccuacaucacuuuugaaauugaucauagggaaaucagaacgaugcuuuuucaugucaacaaauuuuaacaaguaauaauacaauuuucuuuaagaugaaaguuuuauugaaauaugauaucgaucacaagugaacgaaauaucagccaucugggcucuauccuuuuuaggaaagucuggaaguagccgauugugugguaagacguaaaaggaggaaacucuucaagguucaucccugcagggauagauacuuugugaagaaguauaauuguuaaguguuuaaaauauuaagauagcucucaguauucacuuuuaaacuuagugugcccauuuucuaauuaaagauauuggaauaugagguuuggauauuaaaauugugcuuauuaauguuuaggcaagaaggagguuaagaguggcacaauuaagucaucucaaauaggacaaaacuauucacacaauuuacacggcauauauaacaugacaauggggaacagugaaagcugagaaaauauucaugacagagaaaguauuuuugugugugugcaguuaaugcugaauuugcuaaaccagacuucuaguucagcaugugcguuuuuuuuuuuuugugaaaaccaaucuuaucuucucuauuacacauugagacuauagaguuuaugauuuuuaugaauugcugauauaugaaaaaauauaggagaaucuuuauauuuguuuugauuggaggcuuuuguuccauuaaaaauuuuucagaaagcacacaagaggcuugcacauacucaacauacauacuauuaggcauucuaauaucccagaaguuugcucaaggauuucugaauuuuuguuuggaauuuuggaauaaugagcuccuucauccacuauccuccucuucucugccuugaagcccaauccugcacccuuuaagaaagaaggcuucuggugugcauauuuuagauagaaagagagaagaaauauaaaggaaaagacaagcaugaagguuaacuguggaugaaagguuuguguauuuuugagcuauuccugcuuuaucuuuacaaacaaaaagguuguaugccccaaacacucaaacaaaacaccaccaguucauuccuucccccagaaagaagccuuccuggccagcagcaccccauuuuucuacucagugaucucuucuaaggaguggugccugauguaucuuccuacucuccaauguguuuuuauuuuuaaucaaguauucaaaauaguauuuugcaugcuaagauuuaucaggacuuucguuaagauguuagcagcugcuaacauaaacaauaauagcauuuaguguaaaacuggacuuguugagaaaagagaaauacauuucugggaacugcuauuuugaacuuuaucauuuucacugaagaguauauuuuggugugaaguuuuggacucgagagugguuuaaauuacugagaaguguaggaaaccacugcagggcugcuuuacccagagagaauuauaacagggcuugcauguauuuugaaaauaaaaccuuuuucuauggcauccagcuuaacugugaauuuauauuuacgaaauaauguagauaaaugccuugauaauuugauugaauaccauuuuuuaacuuuuaaaauuuaauugauugaaauaguuuuauuugcuaacauagcaaaauguucuccuuuuuuccagaucacugacaauuucugcauuuucuauguuuucuugguuuugaauaauucuaaagguuuucauugaaaguaaugaaucaggaauuggagggcuaaauaagauucucuuagaagauguggcaguaauccuaaaagaauaaggagucucuucaagaauugucaaaguuguauuuucuuaaggcagaauccauacuugucaggcuguugacagacacuugcuuugucuuggcuuuuguuugauuuuuuacauaacugcacuggauuauuaaacugaacauaaaauugcaccucaaagcaauagcacaggauuuucagccuugaucaauuucuacuauccccggaugugugugugcacgcgugugugugugcacccauguguaugagugugcuucuuuuaaaggaauaggagcuuuuauacaauguggugcaaaacuuauaguuuuaaauacuuaauuauuuuaucuggaaacagcagcaugugagugauucuuuuuuaaguugcagcugcugcauagguguagagcuauuugaggaguuugaugcuuuacuugagcauauacucccucuucagagaaguuaagguagugcagaaguuucugcauuuuguaaaauuucaggguugaaaauaaagaugcuuuaugauuuggugagauggauagauuucacuucugaaagaaugugcaaguuguauuuugaaaggaacauuuuaagaauucuacuuaagugguuuagugacacccacucuugucucuugucugacuuugucaucugaggaauuaaucauaaauaagccacuagggaugaaacuugauauauaagugcuuacuuccagaguaauaagaagaggaacuguguguguguuaaauuucacuaaauuuauuuugauuauuccguagagcaggaaauaggaacauuucguagugaagcucucuucauagcaaacuguaaagaaaauuucucaguguguugccauauguuggcagugauuaaagggcauuuccuuugugaaacauggagccauauuagaaagacuuauauuuucucauaaaaaugaccuuugcaaguacauuuaaucaugaaaacuggugucauucgucacauacacauacaaaaagugucacuguuaccauuagggauuuuaggaaaaugcuacuuuggaacaauuauuuugauggcaucugagaaagaauaccuaagugucuacaggagccuccucccuccauggcccauaucauucuaaauaugccuccugaauuacgcuuauaauaauauuguaaugucuuucauucuaccgauuggcacaguauaucauuauaucauuagcugcuaugagaaagcaguuucaaguagguggcagauucuuagcauuaauguuuucaaguaacccuguuuggagaauuggguuguuucacaggugcucagguacauuaacacaguacaauaauauuuucuggcuugcuuuuuaugaaacgaacuugaaguacaaaauaauuuaauaacaaguggaguauaaaaacuggagcucuagcuuaagaaaguuuaauaacucaagacguuaaaggauaagaaaaaaauugucuaaggaggcagcaguguuuagcucauuuugcguuacuacuaaagcugaaauuuauuaggagaauguuuauggccugauuauuuagacuuguugaguuaguuuaaauuuuuuaaacgauuuggucaaguagaaaagcacaguucuguaucuauuguacuauuugaaaguauuguuacauaaaauaaauucgaaauucugccauuuaauacucaggcauaugauucaggagugaaauugcauugccagaaccuuggggucccucauguaucuuaauaugaauuuuauuuuuagagguguauaagacauuggcacauauaaucuguggcuuaauugauaacagcaaagaaaauggaauuaaaaauauuuauuauuaacagauacaguugggauuacaaaauucaaacugcagucaguaauuauuuuacaaauaaaugcuauuucauuuucccuuuaguaaauauaucaguaacuucacccaauauugauguaagugaaacccgacaguaacaagcugggagugcccagguagaaggggaaaaaagcauguucauuuauucauucauuccuuucuccguuuauacuuauucaaagaguauuuuucauugcagcuaaaaacuagacacaccauguaacauggaacaugucuuuuucuucuauguauucuuauuuaaaucguggagcuuuucaacugagauucuucacguuuaaugaaauuugcagucuugugucacuugcgucacaauuuguaggaauaaccuuagcauuuuaaagaguauaccguguagccuuuugagaaagucaugcauuugaaaaauaaaauaacccacaaaguguaacacauggacuuuugucccuuaagcugauugcccuuacucacuugucaccaccuuuacgagagugagggauauguuuuagauacauuuuuuuuuguccuauagaaaccagacucacugcuuuacuuaugcguauuacucugaaauauauuuccagugaaugaauauaguaguaaaagugguguagcaagguagaaaaaacacugcacuagacauaaaaagaccuuucaaguauaacgucugacagccucuacuuacacacccaguggccuugguuaggucacaaaccugcuucucugucuacaaagcagguauaaaauagugccugcauaauaagguggugucaauauacugauaacaaaccuuuaucaaaguacuuauuccaugccagaguacuuauuccauguucuaagugguacacuauuacaucauuugcaucuauugaaucauuuauuccuauaaaaauccugugagauggguacuacuguuuauucaagagacuuaaaaaugagacacagagaggugaagaaacaugucugcggucacacauaguaaguggcagagcugggagugagaccugggcagccugucucuaaaguuucuguguucuuaaccauagugcugucuaugcugccuagcguuucagacacucuguagaccaaaaagcucucuacagcaagguugucauuaaguuagcaaguauuugacuaucuacaauaaauuaauauucagaaauuucauuucacuguagagugaucaucaguaucucuguauagucauguccuauaacuuuugcccaagcaaaucaguaugccaggcaguccaggggagcaucuguguaaacaaagacaguauaauauagugguuagaguaugaaaucugaucaacuggguuuuuagggggcuaugucacuuccuagcuacacaguuauuuguaaaauaaguacucauugggguuugaaugcauuuauguaauauccuugaauguuacauacuauuguuacacauaauaaaaagcacugucaugcuauuaucaguaacaagguaacuaccuuucauuuggcauuugagaaacaaaucuaacauggcagccuacuuaggaguaguuagcaguagaauagaaacuaagaccagggucucagcuauguucaaaagaauuuuaccuaacagaggucacuugcuuuuucugaaauuauguaauauugcuuuuuuuuuuuuuuuuuuuugagauggggucuugcucugucaccuagguuggaguacaguggugcaaucauaguucacugcagucucaaacucccaggcucaagcgguccucccaccucaggcuccugaguagcuggguacacagguucacaaccaccacaccuggcuaauuuuuuucuuuuuuuuugguagagacagggucucccuguguuucccaggcucugcaaacccaucucuaucaaaccaagacacguagucagcccuuuuaaucauuagaccuaguggucugcaaaguuuguguuggaaauacuuuaucuucucucuuuugaacugguacaucggcugugaugcccggagcugcuuauacugugguucccuuggccaauaauuuguuuaugccuaaaucagccuugccucuaagugauaaggagauacgugcuuuuucuuuuguuuugugucagugguauucucuaauaggccgggaacgggucugcccaagugaugcacagccccuugguggggcuggcuauagauccccccgcaaaacugaagguuaggccuaagauauuagcuuugccuggcaagaugaagauguguggacuagguagaccuguguggcagucuguuucuuuuauaaaguaaacagaguucaguuuguuuaggacugcuuagguagauuucuuacacugagcaggaauauuuguacagauguuuuaagguaaagucaaagaauggcuagauuguagccuuugacgcauuauaauguaucuuuucucagugccccuguugaauucacaaaagaaaagguauuuuugaucaucggcuaugagaaacuuaaaacacuuuuuuuuauauauaaaggcugauuuaguuaacucuucuugcauuuaaagaaaaaaacaucugcugaaaguagggaggggggaggugugagcggaagcguggucuccacauuccacaaugaaugucuuuucccagccaauuuuaauuugcagaaaaaccaggcacugaguuagauuccucgggaaaagucccuguuggcugaugagcccugaacuucuuccguguacacccugaacagggacugaugcuucaguucacagagauaauuuuucucuggaaagccgauagauccgauuuagccaccccucauuuguagucauugccaccuuguggauuacaaaggauauugguuuucaucaaacuuccauuucgauuuggcuuuuuauggcaaguacacguuggcaguggauugccguguuccucaccaaaaggauccugguuuguucagcaacaccucacuucuccacucacaguucauuuaugauucugaugagaguguuuuuucaggaaacacacauuucacuuuuugaccuaggagcaucuguuagaauuuuuuuuuaauacuacuuuggcauucugaaaguguuaaugucuuucauaucuguuuaaugcuauuuagggauauuuaugaucaccucuugguuacucaggguaaagugugucgcaauuuuuuuuaaacagacaggaaagcauucacaugaggaaacagauugcuuuaaacaugugcuuccugugacaguaaaaagaacaaauuagauuuaacacuguguaaugaaugcauaaauguguacauuuaagcuuuuaaaagcuuuauguucaguucuggucacaacaaaaauugagucaccuguaaaaauuaaagaugcccaggguacucucagacuuuugaaaugcccagcaauugcaguccucaccugacgaugccucguuggaauuauaaaaagcaugaucuauuagugcuggagagaacuagaacauuacaaggcacauucagagguuaaaccagguuacagucagauuccguacauuuagcaaauaaaucagaauuuguugugggggggagaauacuucacucucaucuuccucccuaagaaucaaugaaaaaaucaauuuucgggaaccccauauauuccucugucuuucaugaaagaaaaagaaggaaaccugauguuuacuuacuagcauuuacuacaauuuaauuauauaagaaaaugacucuuuuucuuauguaauucaguuuguguuuuguaugcuggcagggagugaauagaaucugaguuaauauuuccaguuagacuagaguguggaauuggagggccugaauccucuccccggaagaagaggcacucauggccauuucugucugagccugcggauagugccucuccguccccugugcuuucaaagcuaaggauuuguggcacgcuugccaucucucuggccaaggagggccaggagagagucccucgggggagggcacauaguuugaggacaucugacucucuucuaucacauacugagguacuaauaucaaaacagacugcuugucgucgcacgguggggcagugcuuuuuuuggcugccguggucgaaaugaaaugggcaagcuguaguccgcuuggcaucagaaugggcuaagggaagcagggaaaucagagucagacugugaaugcaagucacagccaaugguuaacuuccuuuuugugugucacuuggcagcagcgagacugauggugauuuuuuuuuuuaacaugggugagaguucagugcccuaggaagagccguagaugcuguuauugugcuuccucauacaguugacuuguguugauuucuugaggccaguacagcuguuccaagagccagcuccaggagcuuuguguguauguacauggccaucggacgucggaugaaaaagguaaacagaugagaggugauccauacaaaaucucacugcugaucacuaggcagucuuaggggaaucagguucuggcauaaggcaauaauaccaaagaauaauauauagugcacuugaagggauacucccuuguauacagacacccaaagauauuuuuaaauuaucaccacuccgcaccccucaucucacauacaggauucaaaucaauuuuggacugucuggaaaauguaggacuaaaauagccagauugaauucagauaaaauuaccuucugcuuuuuugggagguuguugcuuuuugguuagccacauuauuuucuuugaagauucauuuggaagagaguuugguagaauuucuagccucucucaagauuuuccucccauuucucuguuugcaaagagcuguuccccaaaggcaaaaagagcgaguugccaucuugagcgaauuguauguuuagugaacaccaaauggucucagaguuacccuaaauuuucauuauaucugguugcuuucaaauacuauuuauuccccucaaaacuccuaaccauuuauauaagauaucaguaagaugaccaacuucugacaacccaaaagcagggaaggaagcuuagaaauagaauaccauuugucugguaauuagaguguaucucuuaagaguucgagagaauucugauuaaccuuucuguucccacauucucacguaaaauuagcacaccuuuuaaauuauuaucuaguauuuaaacacauauuuuugagucuucuuaaugcaacagguucuggggacacuaaaaguguguuauaguuuucuaaaaaacuucauuuuucuuacauuuuaaauguucuguuugugcaaaauuucgagaaucaccauaagggcuucuuugcauuuuuaauuuaguaacuaacauaugaauaaauuugcauauuaauuaguugcagauuaaaucaugcauacauaauugccuccuuacuguguuuaauguuugucaaaaucuccagccugguuugauggaugucguaugaaagauuacaauuugauguacccuuggaaguauuuacaccaauaaugcaagauucuuaauagcagaauuuucuaguuauauacaguuacuaauaaacauguaagauagguacaugucccuuugacuaaaauuuuuuucuuugcaccaaaucauuuacuauucauaaucauuaaugcaucuccuaauuauacagcauaugucuguuaacccuuucauugcuggccuucaaaugguagcuucuuucuuuuucuugcccccuaaagaaagcaaaauuguuugauaauacucugaaauuacucgauugccuuuuauuuauuucucuccuaguauauggacaaaccucauuugccauuuauuuuaacauacaauagauaauuauaugaucauuuuguauuuucuaguuaaagaucauaaaaugacccacgugcacaugguuaguagcugaugggcuuuugccuuucuuuuaccaaugcugaaaaaaauugaaauauuucagauacuucauauaguaguaaaaaaaaauguauacacagacauacucucuauuuaggaggguaauuguagaauaaguaaaaguauuaaaauuauauuuaaauucauuuugaauauugaaaugcauuuaauguaucaugaucaaacauaggauggaaaugugauuuuuuuuauuagaauugagaucucugaaguagaaacugacaagagaauagaugcucuugauuugacauaauuuuaaaaugccaauaaauguuuucucaaauuucuucagguauuuaauuuuuuaaguuuuaucuuacucauauaaaaaguagaccaacuggcuuuuuuuuuuccuuuuuacuauuuugaugucuaagcugcuuaucacacuguauuacccugcauuaaugaguauuccuacugugcaaaauucuaucaaaaaugauggugugaaugucauuuuuaauuggaaguuuauacagucaaauuuauaguacacaacaaaaaauauguauguaguucugcuccaagccuuuuuuuaggcuuuugaucuuuuuaguuuaaguauacauuuuuauuaaucuaagugucauuugaaaaucuacacaaauaugacuacauuuuuuauuaauaccauuguauuauggaagagagggaaacuaaggcauagaguaauuauaaugucuguaaacuguaagaagaacaaauacaagaaugaccaagaauagauuuucaggggucuuuuuuagacaugaaaacuugcugaccgguucuguauguuucacauaagucagacuguaugauuucugucuucuuuauuuuugaaugccugcauuuauaugccuaguaaaaaggcaaagguuaaaaugaguugaaagcauaaacagcugauuucccuucuuugauucuuucauaggagaaauaaugucuccuggucaccuaccucaggagcauuuauuugcuuaucacaggacacaaugaacuauuuauugauuuaacacaacauucuuuuacaacacgcaauauuacauuaaauuauuuagcaaugugaaaaaugaaaugaaagcugcaaaacuuauaaaaggaagcaaacagucagaccugaaacauauuuauccacagccauugugccuagguaauucagggcauaugguauguaaaugauauuuggagauccuugccaaaucuacacacgacgggauaaauuaaggacagguuucccugggugugagucccaugauuguggccggcacacuuccugcuugaauguguguguucuguucuugucuuucagcaagagcgucacagagcauucaguggccaaaucugguccucagcugacuucuaagacauuauuugcaauucccaagaauugauuuuaugauuaaauuuaaaacauaguaccaauuugccaaacuuucccuuugcucucacauuugaaaaguaagaucugaauaauuugucaggauauguuuagauauuaagccauuuaaauggguaucuuugacauuagaaauugagugccucugagcuucuuagucacugaagaaagguguuccugagcagugacuuuucucuaagcuaggauuaagauguuuccuagaacagacuaugaauuauuuugaacgauugauaauuuugguuccagguuggcccaguaauaauuuauuaauucaacuugacaacccaaauuacugguaucacuuauuuuauuuuugaauuauuauuuugaagcauauacucucauuucuagaaaggugaaggcacugacuccuauuuagaauaaauuuuaaguagguaagagguuaugcuguuuucuuuuuuuuugaaaggaaugucuuuucuaagcugggggucuuagcucagaguuuuuaaugcuuuaaauuaagguucauuuuuaucuuggaauuaugcaauuggagauuuugauuagaaacuauggcagaauuuuuucuccuauaauuuauuggacuauaccuaaagagugcauuuacugugcacacuuaauuauaaauacaagacuuauauguuauuuauaaaaguuauuucgggguauuuuaagacauguagaguauggcuuaggauguuuuauuguuuuuacuauuaagaauaaugcuuuuacuaaauaaaacuguguuucuuuuauaaaagauaaugcucuuaauauuaugguuuuauuugaauuagcaguuuagucuguguccccacauuccauuucauuuauggaaugcaaauaacacuaguuacugcauagaaaaugaaauuaggcugaguccuuguucauugcuguguaaauuggguaaaaaucagagaaaaaaaaauacccuugagaucaauguaaaucaauacuacuugagacagauccagcuaaaaauucaugaaaggggucacaguucuggaggaguuuauauaauuaucauguagccuauaguuugugaacucagggcaaaguucugagcugguuguucugggaccauuccuugguucauugaaacuacuuugcacagcugugcuucaaacucaacaacagagagcaaaaacaauauucacuauaaaauaaaccucguccugccuuucaacuucacugugaacuugcagucuugaaaacaacaaaagggauaaucgcaauugagauuacagaauccagauuagauguaauacacaguagggugguauggcccaauuuuacuuacauggggcaaguggaagugcugugaaugccaacauguuaagcaucauagccacuuauuaagauguuagcuuuaaaugucagucuuuggaccccauuugaaaugaagcaccugcauuuuauucaaagaaauuaagauauauuggggaaugcggaggugaguugaggguuuuuuuuguuuguuuuucuguuuuguuuuguuuuuuuuuucuggugggagaaagugccauagacaauagagauaaaauaucucaaguauuaaaagucuauuuuuauacacuguaugauucaaaaugacugagcaguuuugaaauuuuguagaaagaaaggaauauaaggagaauaagaaaugauauuugcaucuuuacagacaacucuguauagcacauuuaagauucuggcaauuuccuuacaaguaucugaaaauuaggaauuaugaaggaaacccagacagauacuuaacuauagcauugcuaccaggugucucuuugauaucaaugaguuaggaaaccuuaagaaaaaaagguuaaaacauccagaaugauaacuuauuuuagaauaugcuuucagacaaaauauuucuuuguuaagaauguugaaagguuuuauuuaauuguucacauauauuuaguaaauuuuuugguagacuugaccgauuaggcuuguuucauaaaagaugugggcuucuguguauuuagaucuuaaguuuauuucaaauuggccuuuauaaaacuuuagugccuuucucuuagaauucuagucaacaaaauuauauucaucaaguguauacaucacagaaguaacuggugauacagaguauaauuccuaccauauugucaaauggagucuauaucuccucaaagggaaagaaacacugacgugagucagaaguuuucacucacuuggcacugaaucagcuuaaaguucgagguugaaaaauucacaaauauuuauagcacaccuacuaagugccacgccuccuggaagguggacagcaauggccaauguuucugccauuggaaagauuugcaccgaaguguguauggccacauguaguuguacaaaucagaguucauuuuguaaugcuuuauaagggucugguaccacugauucuccuugcagacuaauaaacacagagcuuauaugacucuuaaaaauacagugauagcaagugcauccuaaauuauguaaucaugugguccaugauaacaguguaauauaugauauacagauggaaucagccaccuggcuuacuguaauuguuguugagguccuuuguuaugaacauauauuucuguuaacaaugcaacaaaauaauuuuuuaagcuguuuuuuuuuuucuguacugccucaaaucuagauaaacggaauguguuggaaaggacaacaaauaagaaguuaaauauguggaaaugacauggaaagcaccuguuucuucccuuuguuuucuucuacgucaucaggaaauaauauuuaaccauagaauauggugucccucuaagaaaauguuuauaauugaauguucaaaguagaauauagauuaaauaaguaaagaugacuugccaaaaaaaauuaaagaacauuugaaacaaacagaagucugcaucacacauaauaaguggcauaacaguaucaccucucaaaagugacaauagauguguccaucuuuaugccuuuagcauguuguuggcauuauuaguuauuguauugagagaguagccacgcuauacaagagaaaggaagguaaauuagaucccucacgcccccuucuucugugaauuguauauguuuuugaauacacucucugccaggacagcaaauaaaauuugguucaucccugauccucagcagauuauaaucuagguaaaggacagaccagguucaugaaaucaaaaauaauaauuagaacauuuggaaacuaggggaacagguccucauauugugugcauguuuuaucagucuaaaguagauauagcucuauugaaaauuguuggcuaguaauaugcucauuuucccauuucaugaagacuuauucucaaauggaaguuacagcuggcuaucguguuuuuccgacaaacucucuucucuguggacaugaugauuucuguuguuguggaaaggaaggaaauaaaucucuuuuuguuccucauucacucaaugagcaaagugugauugagcuccuauugugugcagauuauauuguuggagcacaggacaaagaaagcuaaauuaucaucuuuguuuagaaauuuaagauauuugggagcagcaagguagaugccuaugccuaguuuauuuaacaaggcacugaacuuugcuggagaauccuauauucuagaauauaguccuuaucuggaagugacuacagaaccugauucuggaucacagagagcugcagaucuggugugauuaagacaguggccacagauacuccacugagcuucugucuugcagcuucugucugucucuucccugaaaaucacagggaccacagauacuccacugagcuucugucuagcagcuucugucugucucuucccugaaaaucucagggaccguguggaguuuugcuuggucaacuggagaaacaacuuuugauuguuuuuauguuuuucagagauuuauuugccagagauauuacauuauaauaaaaacauaaacacagaaguuagggauuggaacaaagguuauauggucacaauuuaacucauaguuauuugaaaauuauugguuuauaaggaaacagauuuagacaaagcuagaacuuaugcagguaaguuacaaagcuagaacuuacucaggcaguugcucacgucuguaauucuagcacuuugggaggccggggcgggcggaucacgaggucaggaguucaagaccauccuggccaacauggugaaacccugucucuacuaaaaauacaaaaauuagccaggcgugguaguggugcaugcugguaaucccagccacucaggaggcugaggcaagagaauugcuugaaccugggaggcagagguggcagugagccaagaucacaccacugcacuccagccuggugacagagcgagacuccgucucaaaaaaaaagaaaauguaguggacacaauacauuuagauuuuuaauaaaguagacauauguuuauugcagaacauaugagcaguugauuaguuaaagauauccaacaugccaggcgugguggcuaacacuuguaaucccagcacuuugggaggccgaggcaggcggaucacgaggucaagagaucgagaccauccuggccaacguagcgaaaccccaucucuacuaaaaauacaaaaacuaucugggcaugguggcacacaccuguacuccuagcuacucaggagcugaggcaggauaauugcuugaacccgggagguagagguugcagugagccgagaucgugccacugcacuccagccuggcaacagagugagacuacaucucaaaaaaaaaaaaaaaaaaaaaaauccaacauugcuggcaaguuugaaggucacagcccauguacaaaauugguauaucuugaggaacucuugucuuuaucauauguucuguaccauuuccuugcacacaacacaguuacuauaugaugguacuaaguagauacagguccagaccccauaaagaauguggcauucaguucuugaacagauguuagagaacacaacccacucggcaguaagggauaucuucaacuagagggaagggugagaguugaccuguuuguccuuuugacucauauuuagaaaugcuaaaguuguuuuauguucaaaaugcauuugauaaucaugccugaagaggucaaagugcugacauuguugaaaacaaauaccccugucaaacaaauagagacaauuuucaugucuuugguugguaagcaccauaauuuggccuuuggcauugcugucaguaaagcuaguugaugacuuuuacaucaauuuuuggcccaaccauaaaugaaggaaauaagaccaauacugccacaguacuuuuucucacucaucacccauaccugauucagcuggguuaauguuaaaagccaaaauuuaucaauaucaauuuuuuucccaaaucauucuuauuuuaguacuguuuaugcucaauaaaaguuuaugaauuucuuucacuguuauuuaaugaaaacccagaauuuuuuaaaauugcacauuaucucuuuaaaaaaagucuuuuagauuacucgugggauuuacucuaaguuguugucuuuuaauagaagaugaugcaaaacuugucucaccuguuccuuccuggucgugucuguguuuaugugugggguggguauauaagugcuuuugauuaacagaaugaagagagugcuuauuuugaaaacucagucguuaaaauucaaguuuauuuugaguuaaagaacaccauauuuagauuaggaauggaccaaugaccugcuuaagcuuuaggcuaucgauuggccuugagggaacuuagaucugcuaaacacgaacuugaaaaggcacuucagugauggauguacguuggaugcucucacuguauggucauucacuugcauuuuaaaauuuauguuuuguuuuuccuuuauaccuacucuuuucauuccguuugucagagguggccauuuaaaguauuugacaauuguuuguucucugccuagcaaguuguccuauugcuccaugaugugaaagaacaaagguaaucaacaguuagaaaccucaggaaauugcuagaaucuucacccccaaagaggguuaauaaacccuagauaauuaguucauuuagaaugaaaaccauuuucauuguaauaaucacauuuccccucugauuaucgagcaaugcauugggaagccugauauuuauucacaaauuuuuuaaaauugagaacauccugugcugagauuccagucagcuucauccauccauuuuuuguuaaaaguuucucaacuaucauccuucauccagacaaauaaacauaaccaggauuuccccucuaacuuuuugggaauucauuuacacguguaccauuuugagggaaaaaaacaauuguccucgaauuucauuugacucaggugauugugguaagcucgcuaaccagcuucaucuaggaagugcagcaaucugagucaacuuccuccaucucuguuuuuacauuguccagugugaugcuuccucauuguaccaaaauagaaaugguuuguuuuuguaucaaacuuggagacuggcuauggauuacacuggguuaggauaaggguuuguuauuuuuuuuuuuuuaagaacauuccacuuaucccaagggaaaaagauugacggccuggggaaaaauaagaggcauaaugaagucuuuucuccuuaaauaaaaaucacaucuagucuucagaugugucaauugcacuauguuugccuaauuucauuuaauauuugagagauuuaguaguaaauuuaugacuuuugcaguuacuuugcaaaaaauugaggaaggaagaagugaauuucacuuugagucaaauguguagguuccaguguaauuaaaccuaaaaaucuauauauucuggucuugcuacuugguauuacacuuugccauaucacauaaugcuauuagcuacauuuuaccuuguuugcagggugaugccauuuuguaucucugguuuguugaauuuccuagaagauguuauguucauguagauaauggcauacucauugaauucuuuaccucagacaugaaaauauguggaaaaguggggaaaugaaucugaucagauuucacuguauacugaaauuugagaaucugguuuuugcaucuauuuugcaugcugcugucucuccaaaccauauaugucugugugaguuuuuauaaugccacauaaagcaaaaugagaagucucuucuuucuucuaaagggaaauagugccacagaaagguagaagucaaauauuuacuuauggaucaaaaaucuaguuaaaaaacaacccauugcuuaccuuaguaaucaaugugaauuacuuuauaaucaauaugaauacaagcuaucugaccagucacucagaaaauaaauauuugaucaugugauaaaccauuugaaugucuacauaugaacccaggccauauaaaaauaaccaauucaagauaacauaggaagucacuaaaaaagacacaaauaaaauuagauuucacaguuuacgcugauauuuugauacuuuucugugauaaaagcaucuuccaaacuaaauguguccauauuugaaccauguaaauaguuaaaaguauuuuaccugagaauaucuaaaugaugccaagaaaauaaguucaugccacuaaaaagauugagaugauuugugcuuuaucugacuucuugguguaauauggauuuacuucagauaaguauauuuucuacuuauccgauaaguguguuuaucugagauaaauauuuucuccagauacguguguauauugaaaaaaaauuuaaaauaauuaggaucccaauugaaaaaguaaaaaucuuaauugcuuaauaagaaaacaguuauuucauagucuuaagauuucaauacaaagaaauaugggaauauacacguaagagguuuguugguguucauuauuaaauugcaaggcugucucaaguuauugucaucagaauaaauucugugugugugugucugucugucugcguccuccuguuaguaauuagaucuuuuaugaaguuguacucauaccuauuagggauuuuugucauugcaguuuuaaguugaauaugacacauggauccuuuguugggucuaagcuaucaccauuuauuacaauuuuuuauaacauuccauauauaugcaucuacuaacuaaacaucagccuuaauuuagcuuaugaauuaaauuuuuuguuaggagugacuccugcuggagagcaaaaaauaccaauuaguuuagcuucuaaauaaacuauacuccuuuuuucaauggacaaggguaaccuccuauuccuuggcuuggcaacauuuacuauuccucuaaguuuaaagaugagaacauagauuugaguacuaacacaucagcagaaauuauauuuuuaaguacauacauaauucucaggccagucguguuuggugcuccaaaaagauuugugauugaauaucuuugcuccauugggaagaguuuagcauggugcuguauuuuuauaauucuuuuuuccauuuuagcagacuucaccuaagucuauuuuagguggagauuuuuuuuuuuuuuuuuuuuuuuuuuuuuugcugcugcucuuuaaggcacucuugcauagaggaaacagcagaggagacacaaggaaaugcacucuccuuuauaacaugcugcugauucucugaacuagguguccucucauuuaagccucaaaagaagcuguguauuaacuagaugaaggaacuaacacucaaaccugugauacagcuuggccagagucacacugcuggggagcagcaagguuacucaucaagaugugucugacccucaaguuuaagugcucugauuuaauaacuuugcucacacccugauuccagugucuuaguagcuuuugaucuauaaaaugucaucuaaggaucuuugagccuuaauucuuugucuuuaaagugggaaugauaauaccugccacagaguacuaguuauggagauuaaauaagugaaggcaauuauuauauguucuuuaaauugugugucacuguacugugcauguauuaagugucguuuuauuagcaaauaucuuuuugauggguagauguuuaccugaggugguuauuuaauuuauaggcuggcuuguucacacuauguuauguaaucauuguauauuaaugaauaucacuauuuuccuuaggauaugauguuuagcuaauucagccaugcuaggcaaaagaggucagcauuguagaaauaagcaaugucuuauacugaaaaaaagaaagacaacaacaacaaaacaacaacaacaaaaaacaacuuuccguguucagugacuuaaacagaaacauggaguuguucaaauucuaccaaguuauauucgggaggagaaaaaugggaauuccuuccauaugaccauucuucauucauucauuuauucagcuucuauuuguugaguugccugccuuacacugcaauaugcagggcaguuuguguguguguagauguucauuagguuuauuugcacuuugcaguaaccauguaauauuaucauuauucagaaauaaagguagaaucuacucuaaugagcucuguggucgaguggauaguucagcucuuuacccuguaauaguuuguuaucuaauuguuuaauguaugugcgauugccuucacaauuaaagcauuauucuuuagucauauuuucucucuuuucucaauuuucucaggaagaaaauugacaugucugugaacccugugcauguccccaaauggagcuuaacccaaaguugggaaucacuaaauaauuguucaugaaaugguugaauauagcucuucauucaagugauguagauucugaauauuuacuuauucuuuaaugcaguuauucauucauucggcaaguuuuuauugaacaucuaccuuguagguaauacuaugccaaugcauuggggguuuuaggucaaauauuucccaguuucuuauaacaaauguauguguguguugucaguucugcuucaccucaaauauaucugucaaagacuuuuuggaaaauuacaaaagaacuguaaacuuuagauucuagaagaaaauaagaaucguguggguuucauuuaaguggucaacacuucuagacaguuugcugguaagaauuuuuuuccccaaaaguggcagaaaaagacaacuggguucauugccuacccccaguguccucaauagugcuuugucuaagcaccagagagggaugguggcuuucuguauaguguggcuaaccaucauuccccaucauuucagcgauaacaaggcugggcauggggggugggggugguaccaaguagguaaccaaguuaccuacugcuggcaagguaacuuguccaguuauacacuacugugaaaacugugucugugaaacaagcaguagacuaguucaggguccuguaaaaauuggcugcuuaagauuaagacuucuuuaaaauuauucugaaacacauggauuuaugcauauagcuucaguuguucuuauacuucuguucuaacuccccacgcaucacacuaaaaauuuaucauggaugauauuucugucacaaagaaaacuucaaaggcugagaucgcagaaaugucucaguugacaagccacugacuugaguucugugauugaaauguacuccaaggucagcaaaccaaaaccaaacaucacuggaugauaauacguucagugucucacuggcuauaauucguagaucaccuuucaaagcauuauaucuuuauuaaucauuguaaauuugugcuuuugaaaucuuagacucguuuccauuaggcaaugaagcccagaagcuuaauguucuagucucauuuuaauuuuuucagucuuaugugcugaauugucaggguuuaaaaaucgauuucaccucaucagauuaaaaauauuuauuuaugcacauguuaacaauauauuaaaagaaaugagagcuucaauuuuaaaaauaggaauuguagcucauuaagccaugacaauuugguuuauauuuacauaauuaauaggaaggcauuuauauguuugcaaaauagguaagaaaagguauuuaacguagaugaagcagaaugauuguuuaucaaaagaguuuagagaucuuucuagcagucuacccauggaaaguuaggaucuagaaaagccuucucaauaagggaagaaacaacaaagaaacaacaaccaggaaacuccccaacuuaucucuuuaaauuccagccucuuuucuaaguggugguuuuuacauacuguccucugguagguggguacccuggccuuguguauuaagcagugagggugguuuaaagguuacaaaugugauccugucagauugacaacuaacuguucuaaugaggaaaaaauccucaaagcaugaaauuugaaugaaaugugugauuauaauucaaguacuguuuacacaaaccucuggggaccuuccgaauaaaugcagagcaagugaguuagacaaaccucugggccuucgauacguguguguggaugugcgguguguguguguuuauuuuagagaguggggaaacuuuccaccauuagcccgggcuuugcuccucggaaccaacaccacuauuccuccuuguuuauuaauacuguauguguuuuguuagcauauugaguuguaaggaaauaggugcuuugaauuauuaaaguugauucuugagaauagauguaugcucggguggcauuugcuucggcauaugcaaaugauuuaguuucauuugggaucaauucccagaggcccuccuuuccugugaugcucugaauuuggcaagcucaagucagcccaucuccucuccccacaucccucccuuucuuucuuuccuuuuuuuguaccuccccccgccuuuuuguugauugguauaauauuuuuaaaagacaauaaauaaauauaucaacuugcuugugagaaaccuugccaucuauaaggauucuauuguucaguugugaucaauaaaggugaacaaagguuuucacguucuuaaaguuuagcaaaaucgaaguuuaguaaaaaugugcaugagauguuugcuaaaauauuuauacagauacugggcugcggggaugcugcaaaacucugaaaauguggucucaggggugccuuuggggaaacugacagcuguaagauauucgucgguucgaagguaccaauaaacuugcuuuagagcccagcaaauagcgugaaguugcaguagauugucuaaagcuacagugaaagcacccaacuccagaguggagaacgugcgcccuuggggcgcccagcgccagcgaggggagcagcgccccagccccuccguaggcucugggcccaugcggcugucugcggcggggcgaggugaaguucaugggcggccgcgcuucccaccagcuccggggaggccggggcccgcggagcccggggcgggccgcacugcuacucuguuucauuccgcaaccccguuuuguagguuguugaccaagcagucagaaaacacugcccccucucuccuuuugagcgaggucagagacgugguguuuuuuuuuuuuuuuuuuuuuuuuucuucccuccccuuucccuccccuuucuccgagucgaguucucaggcagcugcguacaaugcugggagcuagccagcagcagagacagauggcagaguuauuagaugugcaucauacgauucccuuccugccacucgcuuuuuaaucaaauuaaaacaaaaaagaaagagagggagagagagagagggggagucaauuaacugcauuuguauucugcucaauaauggacccuguuccacuuuuacccuaaggcaguugaguggaaauuuuagagaagaaaagggugccuagaacaaaacaaaacaaaaaaaaaaaaaaaaaggaaaaaaaaaaagaaaagaaaaagaaaaaagugaagacugcagaaauuuguaagaaucggcauuauucgaggaacuaauaaaaaccccucggaaaaguugaaucgaucucgcguaugcauuaggauuucgagcuccaucagggccgggcugccuuccagcuccgcugcgcaaaguugagcgucugacagcagcgccgcggccucccccgcccgccaggaauggucucuuccugcuuugcauauucaccacgcuuggcccggccauaugggaaaaugcaacugaaggaauuguugugaaaaaagggacagcgaguuugaaauaaaaguuguuagagugguacugaggagaaaaaagaauccgagaccauguacugcgcauacacaaucccgggcaugggcggcaacucuuugauguacuacuauaaugggaaagcgguaagcgaaugcgggcugcgagggggauuuuugacaaguuuuauugucgcagggaugagcauccuagguggugaucauuguuugcaaaguugugcaggacugccgcaccuuccugggugccaugaaauauuuaucauuugccaauccuaagaucuucuucuugccuacuucuucuccuucgucuuuuuuuccccccacuccucccccagaguagaaaaauagaugcuuucagagcuuuagagaguggauccuagagcgaaaguuugcagucagguaaaguugagaggugguaugauuuuuuuuuuuuaaagaguuuuggaaaauucuuauuccuuccaaaugacuguuagaaaggaaaagcagauaugagaagcagaauugagaaagcccaaguuaggcugagaggaaauuugggguaaguuucucccuggauugagguuuugugauaucuaaagucuuacuaaguuggaagcuugagugcaguggauagaguggagagaaccugaaagguuaaaauagagcaaacacauaaaacugagagaucaaauuaaggaguagauuauauaagcuuagauauauauuuaaagccaaaauggggaaggaaaaacaaacggguucauucaugcauauaacaguauugucauaaguuauuugugcuguguggcuucuucccucaauuucccccccuuccaacagaaacgcuuuauuuaagaaaaaaaugugucugguauuuugugcauaaccccagcagaagguuuauacuugccaucuggagguuuauuuuuuuuuuccuucgucugggcccacugaaggaaaaggauuucaauauuuucaaaucgguauguggggcucucgggaagaguuguugggugauagaggagcaaaaauuuauuguuuuaaaauagaaaagaagaaugagagaaaagugaaaagcagccauuuauaaacuguucucuuuguguacuuugaacuuccauuuggauugaucuuaaucagggauaguugggccaaaggggacagaucagagcuuucaggaaggcccaguucagcuguagcaauuggcgcaaacgaauuaaacauguguaugugcugcuauaugccugugaguguauauacauacagaugcaugcauaacgguuauuucuagaugagcauauucuguaauacauacauauacacaacuguuugaaggugcaguuucagaagauuaauaauuucauuuaagaagccaguuuuaugaaugggcaacuugaaauaauaucguuuacuuuuauuuugaaaaguacgaguaaaucaucaaaaguucauagcgcuauccuauuuuuaucuuuuuuaaaaaagagcacgguguaauuaaaauaguuaagugugguaagggaaauauaauuuuaaaacaaaugguuuucguugugauuugaucaaaguguuuaaaucuguaaacauaaauauugggauuauguaacaucuuuuuuuuuuuuuaacaaguacaugauuugcaauugguaguuacucauauauagauaagacuuuugccuauuaucuuuuagauguucucauacauaacuuauucagcaccuuucauuuuaaagcacuuuuaaugaaaauuuugugaaugaugccaucguagucaguaagcaaaagugucucugaagcagauucagggauuagauagcccuuauccguaaugaaagacuuacauuauaaaagaauauaaguuuccaugguuuuuaucuuucaggauuaccaaugaugugacuuuuacauguuaauuguuaauuuugcaucuuaaauaucugaacugacaaaauuuuaauuuaaguuuuguaccuuuuaacucccuuuuggccaaaaggaauuuucaaaaauauguauuccauucccacagcuugccaguugccuccaccguaagaaaaugcugaauaugacaucauaucacuaauaugcccucucaguugccaaauauuuugguuguuagauuuuuuuuuuuuuugagaggaugguacucauaaaaucaagaucgcucugucacaggaaauguauuuauaggaacuguuuuaaggcguuuauuaaaaacaaaucuggugauguguaucucuauugauucaaacacuagaaagaggcaaauuguacacacauuauaguuagaaaaaaaauagccauuuggaacaccagcagaaagcuuuugaaacugcggauggcuaccaguuguccaucuuagcuuuaugaaacagacagcaaaguccaguugugugugucccaaggaaggggccaauucuauaccauuuuuuaaaaugcccucaugcauacacugaggaagcagauuuuuguuuauucuacaguguguauucugcuggcucuaauucugcauugaguggcuuuugauuuggugccagacauguuguggagauuguauauaccaugcguuaauuguucaaaaugccuaucgaagagacuuuacauuucuugaguuuuacuuaucguuuggagguugaauaucuaugcuuuuuuguguguaugugcaugucuaaccaauguguguuugaaccugaauuguugaaguuaaguguggucagcuauuuguugcacaaguuuuccucugaagagaacacagcacugaauuccuucuuuuuucccagugacaagucaauuacuuguuuaaauucaguuugaacucccugaacugagagaggccagaggaagcagguuuucccugugaauaaacaaaagaagaaaaauggaaaaucauuccaaaacacagugauuuuagcuugugggaagaauauaauuaagcauuacaagaauuaugguuucuucuuuuaugaacuggcaacuauaggguuuguaaaaucaguuguccucuaacuuucuagcagaaauauaaucaaugauauuuuaggacaaacgaaaaaaacgugaauuuuuuuacuaccuuaaguuaugaaguguuuccauguccauaucccacaaaaaaauuuuuccuuguuucugugaacaacuguaccuguccagaaguguggacucugaaaaaaauacuuaacaaaaaaucguaacacaagagcuaucaaagaauaaauuuuggauauaaaccagaauguauuuuuaaaaaucaguuucuccucaggugagaguuucaugaacuugauaaaauaauuuuugugauuuuuuuuuccucuaugcauuagagguuuaaauacuaacggauccaaaucuaagcuuaaaaaaaauuaaagcaccacuucugaacuacgaaacagauuuuuuuuugcagagaaaaucaguagcuuauuuuguguuggaaauacaagcuuguaucaaagugugccaaugugucuguccuuauuaaggcuauaagaaguauuaggcauuaccugcucuccaauaaguguaguucuagcucuaaauuuugaucuuuauggcuucuugcauguucauugaagaagaauuuuaauaagugauuauuuggucaaauuucacauaucuaauauuauagcauauccacgaagauaaaauuauggcaaauaaaacugaaaacaaaaguggcgaaauguccucguaaugguaauugaagaucacaucaucagcucucgccagcaugugcauguguuaaaccguagagagaaaccuguaauuauuguaauugcucuuuuugcuuuauacuaacaagcuucaaaccauguuucaaaguaguuguuuugaaauaguuauuugucaaaucaucaaaucucggaaaguaaaugguaaugagcuuuuuauguuuauauucugacuguuggucauauuaugcagcuuuucaaguccauaaaguucagagaugaaacuggauguuaauuauuucugauaucaaggccaaagaauaaaauaauguuacgaguccugcuuaaggugaaaaauuaggaauauuugaauaucagaaucucucaauugggaaacucucuauucuuagaagaaaguuuuccuguaaauaagugacaauaucagucagcaaccuaaauuuuuuaaagcugaaaauugggguaugaagaguguagcuuuuucucauuuaucacaggaagugcuaagauaaaaagaucaauauuuaaaugacgccacuaauaacauuuuucaguacauuuuacauauggcucuuuuuuuuccccccaaaccucacaguugguuggaacagccacacauaggacauagguagccacuggguuuuaaaguuuccaguagagugucaacuaugcaaauuacauuuggcauuuuaaaaauauauuucuuauacuuacuauuuucagaaccaugauuauaaaugaaagcagccaguauaaaugcuuuuauuuuuuuuaauugcuguuuacuugcuauuacacagcaaaaauuugcuuaggccacaaaguaaucaaauuuuuaaauuccccacugguucaauaaaauaaaacauaucaaagagaaagcauguaggaaaaacugcuuuuuugugagcuuauuuuuuaaauauaguuggcacuuuaauuuacccauuuaaaaauaacaaugaaauuuuuuuuuaugcuucauuacuuuaaaacaaaauuauguugauuuuguucuuuauguuuaagcugauaaaaauucaccagacacuuaaucuugacauuguggcuacaucuugccuuccugccucugauuaaauuuucaaaaucccugcaugagauucacagauaccaguuugaacguuucugugaggcuaauuucucagggaaaaaauauggaucaguuacaucuuugguuaauuuuaucuaguuccuaauuucugcuaggucuaagcauuuuaaauauaguguugguaaagcauccuucugucgcugggugauggcauuauugcaggcagaauuaggagaaaggacauuggcauaggagaaagaggguuggggagaaaaguggucaggaaaaaagaucuaauaguugaugcagucuuuuaaauaccuuuccaacugaucuacaggaaauugugcugaagaaucauuuguuuccuguuccacuauaaaugugguuugcauuacauccccuguucggcuuuuuuuguuguuguuuuguuucuacuaaauuguaguaccacgauggaggcuugagaauaagugaugucuuccuuuauaacuuaucuuuuaauggcuugaucauaguuggauuuuagacacugucauauuucauuauaugaauuuuguauguguguguuuccaagccuacuugaaacuucuauuacugcucugccacuaagaaaaacaaugcugcagucuaaguucuuuagaaucacuauuguaggucaaauacauggucuacaugcugccaucagggaucuauuaaaugaaucucuuguuuacucauucagaaaauuuagagauuuuagaugugguucuggcaauuguaaaaguuguuagaauucagauuuacuuuugccuuaagaagaaaauacaguggagacauauauuugcucugcacagcugaccuaaaugcaugccuuguaccugugagaauuucaguaugcggacacauaaaagauuacugggccuuuuuucccccuccaauauuaucagaguuacaaaauaaauaaucuuucacagucaacauaguuuaaaaguaauuuuaguuuuaagcuuuuucaaguuuuuauauguuuaauugcacuuuauuagcccuuaauacuucaaacauaacucuaagaugacacaggcuaaaguuguauaugauaaacauuauugauuacuuaaaaaaaagggauaucuguauauucauaaaacauuuauaaucuauuuaggaaaucaucauaguccuaaaaaaaaagcaguuguuuguauaccaggaaaaagagaucaguagugacaaaaguggaaaagauacuuguauaaaauugucuccuuuagugugaagugaucuacugaaaguuauacuuggaauuuucagaaaauguccauaguuguaggcuuuauaacauuucaaauucuguaauaaacuauuuggcacauuaucauaucauuuuagguauauagauaccauggcauuuuauuaagcaaaacaauuuuuuucuucugaagaauacuuaaggugaaauuuacugguuuugagcuugaaagugguuugagaauuauacaugaacuccacuuaaacuuuggagacuuuccuuuuugcagugcuaaagauccaugacuugguuccaaacuacaaccuuuuauuugcagauguauuuauggcacaguaccacauucugauuagaauuuaagaguucacauuucugauauuucugucucuaaaugcuguguugcuucuguuuaccuaguuuucuuccuauucuuccuaauuucuuaaagaaaucugcacauauucauugagguauuuaauccaaaaagauuuaaaagagacacuacgccucuaacauucuguuuaggagaguauacuacuuuaaacuccguucuccccaccuaaaaaaggggggcuaaagaguggguuugaacaccugagaagucagaggugggaacaguguagaugauggucuaauuucaggcucaaccaaaaaaaaugcaggcuuuggcuggcauccuccagggaccuagcucugugcuuuccuagagaccaaauuacacucaucuugagagagggcauguugagguaauuggugggagagaguggggagaguugaauuccagcugcuuccauuguagcuguccugaaaaugaauaggggauguuaacaauggaggcuaacauuugacuuggcuuuuucaccuccacaaaccuaagggugagaauuauagaguacugaaugacugcaccaauaaugauccuguuuaagugggaauugcuauguugggaaaaacucacaccauuuuaaaaauaguugaugcauuuaccaaccacaguccuauuacuguagcccaauaaaguuuauccacaguauggaaacacuccuuuuuuuuauugucagccaucuaguguguguauuggaucuucaccucuuugguuaccauuuuaaaaugcuccuacugaaagacauuuggaaggcaccagaaucccaucuccaagaagggaagcaagauacaagugcccuguacucccuuucuccuagaauguguggucuuuuuuuuuuuuuaaggagaauaaauacuguaugacucaauagcuuuucuaacgaauaaaacaaauuaaauugauguuacaugcguauuuaaacccuauccaguuaaguacugaugugauuaaaauaaucaaauguauuacuuaaaaaauuaaaaaggauaaauucugcaccccauuauuuuauugacuuuuaaauauaaauugcagaaauguuuacauuccuaauggcauuauuaagcuaaacugacaaaucagaggaaaaaguugauuggccagcacauuauuauuucugcaccuguuauuacagaaguggaggcucagcauuaaaggagcuggauggaugcuguuuucuuaggcuuccuuugugugauguggggguugggauaaauguguaacaaguguaguuucacuuuguagugccuuuuuguguguugaugugauuaaaagacuacaguguuuuucaugucgcuuugaaauuaauaugcaaauaauaugggauauuagggcuucccucuaccugcugcacuaagcuucccuaagccaaaugggguggggauuggugucaacuuuuuucauacaaguuguuuaguugcaaauaucgccaacguuuuaucucuacucugugaauuuguaagggggggagggaaaugucaaacucauugaaguaggauugaagaucugggaugaaaauacuuuaaauuuuuauuuucuacuuauauaucagccaggauguuaggagaccuugaaaacauuuugaaaaaguuguguaacauuaccaaggcuuugguauaagauuauacuuuucuucugguugaguucuuccuuguauuaaucaugcaauaucauuucucagacacuugagcccggcucuccccuggagcauagguggcaauaauuguuuguuauuauaauucuagaauuucuuggguguucauuguccguaauucauuucacacagagaaaucuaaacuuucuucagccaguagaauaaauaaugccuucccuguccuuuccuuuucuuuuuuaaauuuugaguucuuuaggaaugucauuauagucuuugaaacguaaugacauuaaauuuggauugaaggggaagggagaggaacuuuuauuucaugccauccaguggcuaguuugaguuugcaaagaaauagauacaaugccauuauuuucugcaagauacuaguuaacacuauucucauaucaguuuagacuuuguccuguguaauaauuuaaauuccuagauuuuaauaacacuuaauauguagcauggaucccacuuaaucuccccccggcuucacaacaaaauguuuacauaaaugaacucucaauuuugauaucaacuauuuaacucacucuuuccugaguuaauacuuccauaauuaaacauguuccacaguugccauaggaguguaucuuaaaaaugauguucuucucuguucuuuugagccaucuguuugcuaggucaguaaagaaaugggagccugauuuuauuuuaaagccaauaaguuauuacucuacuauuguauuagacauucagcuucagagggaguaaaagauaaaauuccaucacauuuccacuuucuuacauuugcagcagaaacuuguaugcucaaauugguuauuuucaacucaugacagcugugauauuuaaaaugaucacagcuguugugacuuaaaauugauuuuucuauuaacaccugagaaaaagaccugugccguauuaaaaacuuaaauaagguaacuguaaaauuagauguguugaugugaaucugguaauccuacuucccagagguugcaaagugcagcacaccucuugcaugcuuccagggaaugagcuaaaacugcuagaaauagaugcaugauuguuaaaagcguuuacauuuuaaaggauuccuguaauagcagauccucuuggcccaacuuuacagugucacuuuugcugauaaaaucauuuaggauucaguuuccuuaauuaaccccaagaaagaugacuuacaugaaucauuaugauauccuaaccucuagacuagagaagcugcuuuaccuuucagauaugacauugaaaaaugcaaaaccauacggaauuguuucuuaugaaggaaguuuugguuuuauggugcuuuuccuccauuaucuuuagaugacgaaaaaggaaaaacagaugagaaaggacaaauagaucauggcuaaguagcuuuaggcuagcacuuguuuuuggaaucuuuaauacauuuuuaaucuucauguugaagauccauuuaaccuguuuuaaaguuagauggugauuccuggguucaguuggucuguuuaaauguuuaccuuuucaggauaauccguauuagaaucuugcaucucucaauagauuaccuauuuaacaaaguaaccaauuuaagaaaaccuaaacacauuuauacauuaagauauuuuccuguuucgaguuagaugauguaguauauaaaauauauggcuggccugauguggaauuauguauagacaacagugucuucacagaugcauugccaauagggagcuauguagauuaaacucuuuggccaguccuaggcuuuuuaccuguguaacucaaucagaauugaaagcaugacagguuuuaugaugaugaauguauggcuggauuggagaaaguaugguuggguggguagauagauggauagauuucauaacuagacaguaauagauaaugccaauuauuuauuacucaaacuuguuuauuccucagaaauuuuucugcagaguauuauuuugauuauugcauguaguucagaacauuuaguugaaaaugauaaaauauuugcugucacauaaucaagacugcuauagaguugguucuaaaaguuccagagugaacauacauuaccugugucaaaguuagaggcuaagacuauggagggccauaagaucacaaagucagacuaucacauacuaagugaucaugggugucaauggcuauuuccuuguuuaguugaaagaagauacuccucgagauggacauuguuuauaugaagauuuaagaaaaucaaaguggauauuuguugcugacagacuaagauuacaaacauauaucuuuagaacaggguguuccccaggggacauacggcaauaucuggaaacgcuuuugauugucacaacugugggggucaggcaggagcuugcuacuggcaucuagggcuggaggccagggaugcuacuaaacaucuuaacagcgugcaagacagacccucagaagugcugagguugggaaguccugcuugcaaagugauauaucuggaccuuaagaauuaaauaaugucauaauaaguuccauaauuaaaucuuggcauugugaggcauuuauagaggauaacauuuuuuuguuuuuuuucuuucccuuucuauuucccuuuuccuuuucuuuucuuuccuuuuuucuuuuguuuccaaaacauuguuuuuuguuuguuuguuuuggcauagcacacuauagcauugcccagguauuucuacguuuuaccaugaaaacgugagauuuuauaguguauuaaauauuguacauuauuugugaaccaacuggaauggcuucaaagcagcuguuagaauauguugagucaguaacacaacaugucugcauacccuaaacauauauuugucuuaccuuuuaaaauguuuagaacccucuaucaguguaacuauugguuugucuugaaucauccuaaaugaggaaguguauuaccauuuuuucccuacaggacauaaaguggaaagaagaaauuagcauaaagaaacuaauuaauaauuauguuuuaaguuuuuuggcauuacggacauuguuuacaucaucauuaacaucauaacaucauaucgucuguuaucaagaaaagauuaaaauuuaaagccaacauugaagauguucuuuccagcuuucccaauaaugcaacuccuuuaccuccucacaacuggggaccucucucccugccacugcugcgcuucuccucaauguggauaauucuuggccaugauacggaagugauuuugaaaccucaguugccuucuguagcacccuguggaggaagguggcaggaucugguggcugagucuuacaucugccaacuucuagaccucacuccuuaggugccacauuuuggagcuaguugccaagccucacaguaacuugagccacucuucaauuuccuccccaugauauacaaaguucuccaagguuuaaugagaguagauauggaggcugggcacgggaauggcagcucugauuugcaguauaucuuugguguacagauaugcuuucauuuauugcuuagcccauuagcuaauggaauuucaauuccuucccacaggcauucucagacccugcacuucacucuuccuguuucccuguccagcuugguacaacacauucuaguaaaaucacacugauguguuuagguuuacuuuguacaucacaucuguaaccaucuauaaguuugcccuaaacuggcauuuauuuugaacugucuuccaccuuuuauuguacagcguugucuguacucaaagugagcaacugaaaagaaaauuuuaacauucuuuuugugugccagacaaguaauaaagauuacuauuuuuaugguaauuuuuuuauuugaauauuucuguuucuggaagaugguaauuuuuuuaaaucaugaauuuccuguaagugaaacuauuugagggaguauugaccuuuuuuugaucaaucauugauuaucuguguugcacucucaguauuucucuuauaguccauaugucccucugaauaauuguagaacaauaacuugcuuacacaguguuuuuagaauaugcuucaggaagcuugccugugugguauuuaacucagacauuuauggaguauaaaaccaaucuuacugugacuuuuaauuauuaggaaaguggcuuacaguuaaaauaaagcuuacagaaaauauuguagcaauaauuaauauccaguaaaauacaguuguaagcuucgguucuuucagacauuuucucaacccaguucuaauuugaucguuacugcaccucaguaagauaggugaugcaggagucaucaucccauuucacaggcaaagccuggccuguucagugagguagccacuggccccauguggcuauuaacauucaaaugaaggccaggcacaguggcuuaugccuguaaucccagcacuuugggaagcugaagcgggaggauugccuaagcccaggaguucaagaucaacaugaucaacauugggacacccugucucuagaaaaaguuaaaaaaaaaaaaaaaauuagccaggcaugguagcgcucaucuauagucccagcuacuuaggagauugaggcaggaggaucauugagcccaggaagcugaggcugcagcaagcugugaucaugccacugugcuccagccugggcagcagagcaagacccugucucuaaaauuaaaaauaaugauaauaauaauaauaauaaauaaaugaugucagucaaugagaauuaaauaaaacuuuaaaaagaucacuuccuugguugcacuagccaaguuucaauuacugaguuuucauauaugaucaguggcuacuguauuagcacagauacagaauauuuguaucauuguagaaaguuccauggggaggugcuggccugggaaauggaagcauugagggauuaaaacuugcugaagaucaugugggucaugacagaauagagucauugcugcuauauauuccaauaggauauuuuuacauuuuucuuagcuuuauugucaaauaucugauguaagaauugacauuuuaaugcuaccuuguagcacuuuacugaaugcuuaucucaacugaauuuaaauuuagagcuugaguuacacaaacuuuucaaaggauacagcccuuugccugucugcacacaauggggaccuugaauuuccagccagugauacccuccagaagggaccaugucuuaaugcaucuuuguagaccuuuuggcauauuguagacaaccaagaaauguuuaugcagccuaaugaaugugucacauccaccauacgggcauauguccauacauacaguuagacaagaccuuuggguagaaugcucccgagagagcuggugucugccaaauuuuacagagcucaugccucugcucuugcuguuuuaguaaaaaguaguauuuuaucaaaaguuaaauuggguucaauauucaccauuuggguaauggguacauuagaagcccaguccccagcagcaugcaauauuccauguaacaacaagcacguauaccccuuggaucuaaaauuuuuuaaaaauauguauuuacucacauaauccaaauauuuuucauaguaaaugaaaacgucuguccaucuuguccuuagcagucauuuagucccuaaccugacuuuguguuguuauaaaguugugucacuuaaguaguacuuaaguaaguacauaccuacauccauacuaucuuuccauuuccugcaucacugaguuggacaaaugugcccaguuagcguugguagugcugaagaccauguucauucauacaugcacucaaaaucauauuaauuacuuuucagugauaaccauagguggcaacagaugaaugggcuagcccuaggcuauuauuaagcacugggaaugagauuguuggugccuuguaccugugcuacuuuaacaggugagacaauuccagagcuuuccccaucauccucucguugcuacagucuagacauugggagcacuggaagccuauggugacacagacuggcagaugccuugggcuucuaaugguguauauguaagccaucauuuuguuuguaauaauuaugguguugagaagcauuugugugcugugcacucuuucagcuugugccacguuuaguuccuguuaugcaaauaccacuuuaaacuuagaaauuccaauuugcauuaauauuuugguuucauagagcuaacuauugcauuucacaaacaagugcauuuuaaugaguaccggcagaaugauuuaaaaauguuauuuauuaaauacuauuguagaaaaugcagucuuugguugccagaaacuauuaagacgaaauauaauguguguugaggccacagaguacaccucuucaagaguauuugacccuuauggcuuucagugauacaacagccaaugcucuucaugcaggcuuggagggcagagguaauuaauauaaaauagaagccagcguaccauugacguuuggguuuacuuuuaaaauguaaacauauuuuuacuauuugacauuugucauaagaccauaggucauuuaccucugaguuaaggugaaggacuuuaccagucauaaacacccaaguuuuaaagcaguguuuucuuauaucuuacaucuugauguuaaauccugaaauggaguuuguugcugcuuuauaauuuuuuucccucuuccuaaaagccuuuuuuuaaaucagaauuguggauaaaaaaauuuugauguacaaugugugggaaaauaaaaauuuugcaacuggauuuucagaaaugaacuauuuuaacacauggacuuugaaugcugcugucaugguugucauagcuugugguuccuaauuauaaugagcuuuuuuggugguguuauugcaguuguuuuauucccccugcccccacccagucuucaacucacuuuucccagaaggagaguuccaagccuuugaaaauucucaugauuuugcaaauccacucuauuuuugucuagaauacaggaaaguuaaaacuguggcugguaugaugccauguuuugaauccaauuuuaaagcaacccuuugcaacccagggaguaaagcugacaucuuuguaucuguaaugaagauaauuauaccugcaaggugacaucacuagcaaaguaacaaauacccuugaaaacggaguuccuggucuucucugaauucuguagaccacauuuggcauuuaacaccagacaccucuuucaugccugucguuugagaaguugcuuucagaugaauuuacuaaagcugacugacacaggguuaaauuaauucuuuucuuuauuacucaaagugauacagaccuuucuuggacuaauguagcuuaauuaguggucaauuaaaacugaacauugcugaauugaaguucuuugaucaaacucccuggcaugggcuugcuuucuuuaacuagccaccaucuugaauucauuuggaaucaguaguauaaacaaguuaaaaacugguucuuuuauaagaaagucagcaggcuuguauagcugugguuucuuuuuuuacuucuguaggcggcaauucaaaggcaugcuaaaugaaaacaguacuacacccugaaaaaauuacauuuuuaaaaguaacacuaagcagucagaaaacagucaacacccuuaccuguuuauucuagauacauuuaucuucuauguagaacaaauaauuaauaauucacuucccaauuucagugguugauuuuguuguuacauggaaggugaaaacuccccacccucccuugcaaagucuauaguuauaacaaaaagugaagcaaacaaaauccaaccugguuguugggaguagagucggaaggggcacgguaaaugaaggugugcccaguugcuccuaaauucauucuuugucacucuugggaaaauaguucaccucuguaucuuuggagugggagugacacacuacuucauuuacuuauugauuucaucauuuauuuugaagggcauuauccuaucaguauggaaacugauaauagcauauauuucauaugaaucacuugauuaaaaauacacauugcuuuuguuagaauuugggugaaguuacaaaaaaagagaauuaggggagcugaaaacuggggcagaggaaaucguaagcauugguaauaagaucacccaccuccauuuauccaguuacaugucuuaauauuuaaaguguauauaccauucuugucuaaacauaaauugauaccauuccguaauccuaguuuuugaaagcuuaacaaccaaaaacauacauccuagcuggcauucaguuagugcugugcauucuggaguauuaauugaaacugguacuuuuguacuggaaauaaaaguaauagauuagguuuaaauagauaauuugcuuaguucauagugauuucuucugguuuuuggaaauuuucacagagaaagaguuaaaggaaauuuggaagugaccauguacaguguucccccuguaagugacagaauuuuugugguuuucauuacuuagaucgaaaaauuguaguuauaaucaauaauuaaaauuaaaaauuuuaccaguugacagaaagagaaauuguuuauagucaaugugccuuucagccuucucucuugccuucucccuaaaaggcugauuaggauguaauaauuggggaugauagcgggaggaagacgacaauuccauuuaauuaaagauaauuuauuuuacuucaaauuggugaugucccacaugaauaagaguagcuuuagcagauagauuuauuaauggguacugacaucucaguugacagaaaaagcaaacauuuucuuuccucauuguuuuuauugugucccgucaccugaaacugcugucaccaugcuuccuuugcugcuugacagagcuguagacuuuuccaccaaauaugcaauuauugguuuaucauugaaacaaaguugauccucuucugaguuaaaaacuaggccaggagcuugaaaggcgguucaggcuuucagagcuaaugcuacaaaugcucucuucuuaaaucacauuuucucaacugauccuucccauaucuaguucaugaguagauugaaccuuuugaauaaggaccaaagauuuccuuuggucuugggugaggugcuugcaugaauauuccuuuaauaccuugaaugucuuggauaaugaaaugugccccaaaaaacuaccauuugcauuacuuagguucauuccugacaaggaauucugcccucgugugauauguucguuguugucucaugcaaucguaaauggaucuuggaaguugggacaguuuuuuuuaauuaggaaguagauucaagaaaugcaugauauuguuuuucauauaaucuccucagucuauagugguuguaaaggugugcuguuuagcauaccuuuagcaaaacuguauuuauaauucuauguaucuuaaggcacuuuuuaaaugcuucugacaaacugcauucuguuuuuccaaugucuauuugaucucuguuacauuaggcuuauuugucuuacucucacaucgaauuccuauauuuuuguuuauguuuucugguguucagucauuucuguaugcuugccuaguauguuucuuucauaccgucuucuucacugaaugaaaugcagaccaccuuggccacuuccuuccuucugggcuucuuuuccuauucacaacuuccgccauucacacugacccucuagcuuuacuuauaucuauugcuccugcugcuuuguugcucuaauuuucauauauauuuccuuuaugcuaauauccuuuccuuaacucuuuggauuucacugguuugucuuuccagcuuuauuuagaaaauuaggccauauaacuaauguuuacaccguagaaaggaaaaugagauucuuucuuucuuuuuuggaagugaagaggugagaagguugugguagagguuuucuuuuauuuuaaaccagauggauuuauuuuguccugcuuugcuauuucacuauuucaaauugauuuuaaaucagugaugguguuuucaaggauuaauuuuuauuaaaucuugauuuucaugucguguuaaccuuuuccuuccccucagccaaagggucuucuuccuuuuuucuguccauuucacuuguuuguuuuaauaaccugaucucuccagccauuauuuuauccucaaauccugccacuuuuauccaucuuuuuuuauugcacuguuguccuuacuucaccuuauaucuuuucuucuucuguaauuauuacagaauccaugauaccuucuccaaaauucuaacaaagaauucuggaaaaggagaaauugggaaagagaaaaauugcaaguaauguucuuugcugagcccuaggaagucugcuuggauuuuuauauucgacugauauuccucccuagaguugcagucaugauucuauguaguagggacacgaaggcaaaaguuuaaauagacuaacacugacccuuaauuggaggugauaauccuacauauaaacuuucaggagggaaagcgauccugcauuuuacaucagguaaacucaguugcacccauugccaguagcugggucagguguguagggguguguguguguguguguguguguguguguguguguguguguacguacugggagccagguuggaaguaggaagagaaggagguucuucuuuccucucccacuugcaagcuauuuucuuucuuuucugucuguuuucauuauuucuauggcaaguuuacuugccacgucuuaaacaccuucaaccuuuuugucucuuccuuuacuuuuuugcuuuacugcuaucaaagaguuaaggaaguccauuaaauuggaggccauuccucaccauaagagaaaucuggaugggaugcuuuugacaacugggcucucuuuaguagcuucucucuacuugggaaaaugucagauauuuugagaaauaaaugcauugccccaaacugaaaacaccacuuuuauucuguaaaagaggcauucagggaaggagaccuccucuauucccaggaggucacaggaacugggaguggcaagaaggaagcugcuaaacgggcuccagaugcagcuuuauccaggggacgccucaugccuggucauuuggguggcugggcuugucccaccuccccuucuucaugcccuccucccggucucauccuaggcccucccaccccuaggccagccacaggccucacagcggacaucugcgggucugaguuucauauauccagcaugaaguucccucucucccucccauuaugaauucugggcugugguccugcuugcuccuugugugucagauugaaguucugaugcugucagccaugucugaccaaucagcaaacaacaccacaggaugaaauuuaaacaaugcagaugcucagauacagggcuauguugccuggaccacgaagggaaagcagagguaaggucagagucuccccaaaguggucuauccugagccugccugacuugacaccucuugggcugcacugugcugcuuugacuuguauguuacccauuugcuuugcacuacuucugucuucccuggcauucaccagaacuuucauuuuaauucgcucugcccggguuacuuuaccaccuucaucugcucacguccuuuucuuuuggauuggugcugacugucauuacgaauguuccuggauugccucguggccgaggguccuuggcaagugccaccuuguucaggucuuuuguggccagacuuuuaggaauagaggacugcugaggaucagggcaaacggacggaguuaauaggccuuauuaauuuucccucugcaggacaguggaauuuaucauucgguuacaaccacgguuuuguuucuuaccauugugauguauugaauuguaaauugagcuuaaaucaucuuuuuuucucagaaacgguuuacuuagaaaagauauaaauagauacaaccuaaacgaggaugaaucagcucaucuuccaagaguuuuggagggggagaaagggaauugauaacucucccccacccgaauccccccccacuuuuuuuuuuuuuuuuuuuuuuuuacaguuuuugguguuagcucacuagauuacuguuugcaaaagaagaaucucaucaucauccucuucuguuuuaaguguuuacuuggcccuuuuauaauuuaaaguguuuacacgguucugugcucccuaggcccaucuggaaaauauuuaaacuucauaagaucuauaagacuagaauaucacauauaaugggauagggggaaggaagaaaaauuagagccguugcguguguuuagaauaaguuaguuguuuguucagaagcggcugcuggaggaauuggaacaaauagcugugugcggugaacgauuggguccagagcuguacauuucaccacagaaugagccuugguuugugaaacugacauucuguugugacuucuaaauccaaacaaaucucugcaaauuucugcccgaucgaguuaauaagaaaauauauacaugcagaggcgagagccguaugcuacuuguacuucugucaguguugguggaaauaagagacggauuuuaccuacuguauuacauucaaccagcaauuggcagaacccccagcucagcggguuuucuugacuuuuuuuucugcugugagaacaaugggaugcaaaagggcuucagaaaaggagagcagcagauacgggauuggggucacuuuucuucuaauugccuuguaauuggggagugguuuccacuuucccacuaucucacuggugggaggggaggaagacagauguggcuuagcgguaacgagcuuucuccaggccggaugugcugagggaccaggggggucauucccugcucugggccugugaucugcuucacaccugugcucauuuucccccaugaucgaugaccuuguauuaacccagagugaccuuuugccuucgccuguucucugggacgagcucuuggcuaguggacccuccuuucucucugauuuacaggugguuacuggagccacauacacuuguuuuucauggugcacugugcacuuagcagcccggcaagaccugcaauuucaucccucucaaggggccaagcaggggauuggaaggugggagggaggagggugccgcgagagugguugcuguuugcaugugcuuuucuauuuuguggcucauaugguaucaauuaccauuugauggcaacgccaggccugaggcccuucgcauguuuguccugugagaaagaucuggaagaaccgacauaugguuuugauugcagcaauugcagguugauagaaugaacgcaggggugagguggguggguuuuccuuccggcccuuuccacucuggguugcuaaugugcuucgcuuguggaacuggucuuuucaucauccagccccucccccacuuaccccucccccacccccaacucccugccacuuugcauucccugccccugccuuccaaaugaccgccaggaacauguggcccacauuaaggaccuucaauuaaaacaaacaaaaaauuguccacucuucuguucagucccagagcaggucaguccaucaagaugguuggaaguguaccacaguuaagaaacaaaugguuggcauagggggcagauucccuccagaagcuugggacauguuuuaaaauggcuguuaguucagauuguuaaacaucgaaaugaugcugaaaaauagcagcaauagagauuaaugugggguguguguguguguguguguguguguauaucuguauguguguguauuucauuuaagacaccucuuggaaucugugcaucugcugcauagggacaggaagaugaugauaauggauaggaguucuuugggguuccaucuuucuguacaucccaggccauaagaugauggaaaagcaagugaggcaugugugucucuaugagcauuucccuucagaaggaagauguuggagacucaucucccaugcacagugacuucucucuuacuaaauuugugaugguaggggguacuccucauuacuguggcucagcagggauugcaucugugaauaugccaagggagggucuacuauuggggaauggugagaggcaaagaggagaaaagaacauuauaggcacuuugaauguuacccagcaacauuuuuuuuguuguuucaaaguaacaucuuucuauaaugcuuucaaauuuaccugucugguaaucuguucuaagaugggcagcccaugagguuuugacuuuuuucacuuuggcuauugcauuucaaaauauuacucacaauuaggaauuuauaccauuugaaacaauaaugugguaucucaugaguaaaugcugccauuaacaucuuccuucuuuuaaacugaaaacaagcaaaccagacccaaaaaaaaaaaaaaaaaagcagaaacaugcucccccaagaaagcuuguuuuuuucuuugagauggagucucgcucuguugcccagguuggagugcaauggugcgaucucgacucacugcaaccuccaccucccagguucaagcgauucuccugucucagccucccaaguagcuaggauuacagguguccaccaccacaccuggcuaauuuuuuguauuuuuaguagagaugagguuucaccauguuggccaggcugguuucaaacuccugaccucaagugauccgcccaccucggccucccaaagugcugggauuauaggcgugagccaccacaccuggccaagaaaguuuuuuaaaugugagaugaauuuuuaguuuugaaggccagcuauugaaaccuaaucacacugcuugacauacuucuucauauuuaucuuuauauuagagcugaucuuuaucaaaagguaguagaaacuaaaaaacuuaaguuauugaccuaaauuguagggaaaugucugucugaucgacucuagagagaaaauuggccguaucuuuauaaugguuacugaauguauaucuucaugaggcuacaguuuuuuuuucuuugcuccaacuuucuccuuaugauguagagauugguguauuaaauaaucacuuuuucaacagucuugaugacaauuuuauuuugcuauuucauaaucuucauacaaugggauaaguguuuucagagauacguuugaauucagagcaacuggcaauuaagugauuugcucuagucacauguuuuaguaguagcuauuugguuauuugccugauauuuaaugcacacauauguacccuuaaaucaucauucagugugauagcuuaagacaacauuucuguuugcugcucaugccacuauuagcuacguuugaagagugauauacugagaaguuuaauuugcugggguuuuuuucuaaaaacauugcuuuccugaaauauauaguauugggggcucauagcaaaaaaaccguaguauauggguugugagccugucuucgaacauggugggucacuuaacagcagcugugcuggagagauauuugauuugagaagacuguuuugaaucuucucagcccuaacaccauucugguuuugaaaugggaaaauggaaaagaguuuuagggaauagagauaucucagccuugaaaggaagcauagguagaaaucuuucaguucucacucagaugaaccagcauuccuaaucuggcuacccucacagaggacaaagagucugcugggaaauguggguuuauauuuguagagacacacuucagaggcaugagauaguguuagauaccgacuggaugcuucgugcccaacaucaauuugguuugcagauugaaauuuaggaaagcuugcagaggagccaaucuuuuuuauauacagcaccuuuaaaaaaaagacuguccacuacuauuaaaaucugauucagucuucuaaaauauuacuacauucaagacaacuuuuaaaaugaucaaauuuagauagacaucaaugauguuaaaagauaaaagcccuccuacauguaauauauagugucuuaaaccuuauuuuuuaaaaaagggauaccacuuuugccaaaaguuucaauguagggauacucaaacuguccuuggaaguccuaaaaauugcuaguuuuuuuuuuguuugcuucuuuuuuuguuguuuuuguuuuuuguuuguaguuauucacaaauggagaaauauuuauaaaauuauauuauaauuuguaaugcacgcaaacaaccaucagaccacacuugaaucagagaguuacaguuauaaauugaggaaagaggaugccagcacaaugccuaauggagugaaaaauugugcuuauuuucacaggacucucuuggagaggagcuaacuacuuuccucucucuuaauacccagacccucucccucagcccugacagcacguuacagaaugcauucacuuagugugugaagagcuagcucaccaccucccuuuaagaucuauucuuguuauucauacauugcaaauuuguacuuuuguauccacaaggaagacauuacuaacuucaagaaaggcagugucaaugaggagcaggaaaauacaguaugauacaagccugccaaugaaagaauuauacucagacucuaugcgcucuguuaaacaaaauuugaaccuuugaggaaaaaauauuggggauucugaugaguguuuuuacucuuucuuuccuuuuuuuuuuuuuuucuauuuggaaaucauggcuuccugauccuaagggauaaaaaaaaaaaaaaaaaaaaaaaccucaaagaaaagacucaacaggcuuucuggacaucaaauaguuccuacaaaacaacauucugaugacuugcauguaaagaaaucagaaacauaugaauuaagcuucucucgaaauacauauggguugaaaaauagagagaagugcugagaaaauguguuuuggguuuugcugagcccaugacguuugaaaaauaguaugagacauugaacaaacacaaagcauggcuuggcucacccauuccuaauauuagccuucuaguucaacggcaaaucaguuuaccaugugccuaaaugugagccaccuuggugcacucccccacacuuaauuauaugcaguuuaaauuuuuucaauuaggagcucaaaaauaacauugcauuucaaggaaaugcaaaucuuagcauuuucuuaccugguuuguucaccucagaccauuuuagaaaacaccacagauuauuucaccuuaggagcagucacacugauguggcccucuuugauguggcuggcauauaacagaagaaacguaucauuuuuaagaaacuggcuccaaagacaauauugcuauuaaauugaagccaaaaaccacugcagguaaaacaugaugaagaugaaggacgcccucucuuagccauauaguagaagcccgaucauagacucucacccuuacaccaugacuugaguuccugcucauuuuuaucccugagcucugcagacuucuaagcaguggaaguuuucauucucuuucccacauugcacucaagagagcuaacaugagagauucuaaauccugggauuccucugcaucuggcuuuaaguacaggagcagaacacagggaauuuaaggaacaaaaauagccagagcuucaggcuucuuccacugaugguaagucauugacaugcacuuggaugaaauccuguaucuguucuuuggacuagcacuaucgccugagauuaucaguuucagagaguuacagagaggcaguagauuucaucuuuccuauuucaggaggaguuauuuugguuguuuaaaaaaaaaaaaaacacuuuaauguacuuuuccuaacuccuucacucagaugguggcaagaaguuugacagaauaaaguaauucagcuaauauuuaucaaaugccuacuaugagugagcuguuagaauauaacccugaacaagacaagcaugagauaggcaaacagacuauuaaaaccuagacugauaaugcauugauugggguguacaggcuccuuaagguagauauacaaaggacaacuaguccacauuuggccuuagaggaagugaagugcaaggaugaaugggaauuaagcuggcaaaaugcaaggguuauaacuggaagcaggggugagcauggcauauccggugacccagaaguaguucagaaugccagaagcuuaugguacaaaaggauaacauaaaagaugagacugaaaagguaaacaguggccugaucaaaaagcgacuugugagcccuauuaaggaguugagauuuuaucaugaaugugacgaggagccuuucaaauggguaugccugagaaguaauugaauuuaaaagucaagacggauaggaggaccuggaaaacuuagagucagagaagccaagggaggcagaucugaccagaaggaggaaauugucaacagugucagauguugcugaaagauagaagugacauuuggcugcagcauccaggaggucuugagcaguuucauugaaguagugaguguggaaggaagguaaagaaguggagaacaggcauugcaagauaauuuuccaucaucgucaucaucaucguccucaucaccggaaaaugagcaucaauuaucuuaucuaccagacauagagagugaccagguaaggaaugacacaccugcagccugggagauuucagaaaacagaucauaaauauaaaacagaagacagcaacacaugguacaacacaugcaaagggcaaaaugagcaguguaggccaacgggaugaagaacagaaagaauuagggggcaggugaaaugggagaguuuuucaagcagucagugcgcuugagguuugcauucuggauugugccuccuuauaagucaguccaaccuguuuuugauucuccauccaguggaaauaggaaacaccaucaaagaugaugcauagucuuaacuugccugugacuucugauuauguuuccgaauuuugggaggaagauuaaagucauaaacugacucuugguuuguuauaauuucuugcaacuguuauuuuaaaaauccggacacaggccaaggcaggaggauucucugaggccaggaguuugagaccagccugggcaacauagugagacccugucccuacaauaauaaaaguaaaauaaaaagaaaaucuggaugcagaaacugagguguagauaaauauagcaagucagagauauucguaaauucuacaucgaugaguuucuugagaaauucugcacacccagugcuggacaacuguggaauugcagcgugauaccuuucacaucugggucaucuccauaugauaucuucuuccugguacaaggccagaaguucaccccacgcacaacaccuauggaagccacuuacgauucaaaggacaguuuuucugaaaaagggugcaugauguauacuucccuucaacacuaaaauucugcugcuuaaacuuuguaagugaaggaaaggacugguucucuucuacuuuggcugucuuccuuguuuccuauuuauugggugcuugcuuugggcaacccauuguauuggaugugcucuaaaccacaaucuuugcuccuaaggaguccguaguauuuaucgggggauacgaccuggauaauucauauaagauaugaauuucuuucuuuuucuuuuuuuucuuuuuuuuugagacagauucucacucugucgcccaggcuggagugcaguggcgcgaucacggcucacugcaaccuccgucuccuggguucaagcaauucucaugccucagccccccaaguagcugggauuacaggcacccaccaccauacucagcuaauuuuuguauuuuuaguagagauggaguuucaccguguuggccaggcuggucuugaauuccugaccucaagugauccgcccaccucggccucccaaaguccugggauuacaggcgugaaccacaaugccuggccaagauaugaauucuaaaaaaaaaaaaaaaaaaaaaaaaaaaaaaaaguccuuggaaaguuuagaagaugaaauacauuuaaugaaaauugagcucauucuuccccaauauuuguuccauauuccucuccauauuauacuauuaguacacaauccuguuuggacuuacuggaaaaaagagcugaauagcuuauccacaugucaagaaacuuucuguuuaagaacacugagguucaucaacaucaaaaaauauuuucagcaucauucaggcacuggacaugcucuacaaauuaaauaccuuagggccccuacuauuucaguguuuucucagugucuuguugcaguggcaaaugcuaugaacuacauuuuucaaaugaauauugaagauugagaaagagguuaagaaccucuaucuauuaacgauagaaccaaaucuagaaagaugucuccugcucuguagagcacauuagggaucauuauuuauagccauuuggcucucuuaagacauuuuggcaaugagggaaaaaucauagguugauuuucuugguggaaugaagaacauugaguuugcuaacaaagagagcaugagugacuuugguaagagagcaguuuuuauuucaguggaaaggcagccuccucuccuaauaauagcuacauuauuuaccuaaauguuccauguagcaacugauaacaaggcuuacugcuuaagaaauuuggccaucaucuuguccucucuacuagaauuccaucugccuacagaugggcccuugcuaauauuuuuuuucugaaggacaacauguaacuuaagggcccacuacuguguguuauuuuguuuuuuuaauugaggugaaagucacauaauguaaaauuaaccauuuugaaguaaaccauucaguaauauuuaguacauucacaauguugagcagucaccacaucugucuaguucuaaaacauuuuccccagcccagaaggaaacucuguauccauuaagcaguuccuuccuaucccccuacuucuaggcuuuauaaaccuuuaauuuuaauguuauauacacacacaggcauacacauacauauaugcuauacacacauauguauguauauauguauaauguguguaaauaauguguaaauauagacguauaaagauguauaauguggguaaauaaauggauguguguauguguauauacauauauguacauguauacauauauacguauauauguauacauauauguaucuacgcacauguauauacguguauacacacacacacacacauucaugucuauuuauagauuaggaaguuccaaacagaggaccuaauauuuccuaauuauguaaacaaagaacuaucuacuuuaaugaauguuucuccaccaggaaaaagaaaaauaggaaacauuccuugcuucuuuuaaccugucuguauauuucucuuaaauucucacuagaugcuaauuuaucaaggaagacaaaaaagacagaaauaauccugagccuuuuguuguguaaaacugcugcucuucuuguaaagacauuuucucauuaauuucaucaacacugagaauuuuaaacugcuucucaauuuuaagcaauuguauggguuuuacauuucuauuuuugaaaauccaaaauuauugaacaaaguaauuuaguuagcaaaguuuacauuucuuggaaagaaauaugaaagggucauucuuacuauaauuuuuauuguuaaagaaauugcuguuguucacauguauuuaugcccuccucauuccggaagaauauuugagguagccaguagcacauuuuuuugaauuaagaaaaaauuagaucaaaugaaaaaauaccuaaaauuuaaauauuuagagaaagccaacucaauuauauuuuaaauaugccugaagucgugaacuaacuaauguugaucauuuagucuucugguccuaucucaggaauauuauugcccuucuuaauucaucuuucaccuccuuuaagaaguauuucugaauaacccuauaggauaacuuccuuuacauuucuuuagcucauaugguuuauacaaaaggcuacucacuuuaucacauuuucuaguugcuuauuguacuucauaaaucucccaacuaguuccuagugaaaauucugcccuucuaauuuuuuguauguaauuuaccaaagcaccuagcuuugugcuagcuaaaagcucugcucugaguuaaauuagugaaauauugcugguugauuucaccuaaaaguuugccccgggcaggagggaagagggugggcauuugaauggguaacagacagagaagcagcugauuggacauagauguugacaacuugcauacuuauuuuuuucauuucaaucugugccacagagucauacauuugguaauuauuucaugcuuuuguuuucaguugaaaguaguuagggccauauguuuugacagaaaaaagauaauucguacuuuuuuucagcuuuaugaaagggaagaugggguaacaauuuuacaguguaccauggcagugauuccuguucaaaacuuuaccagauuggaaacucacuguucauaacaauucucuugguaagcagaagaugaaggcaucuguuuaaagcacccagaguuaaguuugaugcuucaaagcacagcagaguucauuuauaacucuacuuagcacuauuagauaucuuuaacaaauaugaaaaguuguccaccagauuccuuagacuguaggugauuuggaaggauauucuggucaagugcuaacuucugacugaggauuucaaaugaaaagaccuagguuauaaccccauuccugcccuuacucugucuugugacucauggaaaaggaaggcacuuaacccgcuccaagcuuauguuccugaauguauaagauggguagcaugguugaccacuuagacagauaauccaucucaaaaugaugauuaaagaagauaauggaugagaaaaguccuuuugauuuaaaauacuaugaagaugugaacuuuuaauaaugacuaaugauagaauuuugucaaauuugcuuuacguaauuaaguucaagaucaaagaauauaucuagagaaguaccuauguauuuugugaaauguuucuuugaguauuauuauuaucauuuuaugucuguuagaaucuuggccucacugucuuuucauucuugcuugaaugucgacucuucaaagugugacuuucugcuugugucugaugcaacuuucuuccugaucgcucuugcuuccugagaaggaauagguacuuaggaaugauggcuuuuuggcugucugugcuuauuagguacaaacacagcacuaaagacauuugggacuggagaaauaagaagagcgccuuuaggguuguaugcaaaaggucaaacuauaauguaguuagcauuuuucuuuguacugcuuucccuucuuguaacaaccucucaauacccucauaccuucucugcuuuccagaaaugcuuucuaaaaauugauuauugggaaaagaucugagaccucauugcccugaaguguaauuacugcugacaaacugugacagcauuucccaaagacagggagugauuggagaugugaugaaaaguggguuugugacuguggaaacucuuucagggauguaggcuuuuaccccucuugguaauguaccuugacaaaagucugcagcaaugaaauuaacuuguucacuccaaucgcaucuaaaguuauuugagcuuaaguccuuucuuaaggaugucagcuuuaggcuucaggcaucaaccuguggacuagaauucaaagggaaaaggguagggaauggugcucuuaaaaucuuuaggaccauuauagguaauuccauauccuaaagaaagcucagcccuaaacacauuagagaaguggaaugcacuaaaauauauuuuggcagaaccaaugaauguuuaucuuucucuguguuaugauguuauucuuaguuugacguguaucccaugugugguguguuuauucauucaugcaugcaugcacuuaguaaaguuuugagccuauucugugcccggcauuacaugcacacacacauauguccaagcacaccugcacauuuuuuuuuuuuugguaaugccuuuuuuaccuuauuguuucugcaacuggcuauccuuagcaggccuucuuaauguacaauaggguauagaagaaauaacaaucaacauuggaguaaaccuaaaauuaauuucugucuuuauuguagagucauagaauuuguuuuccucuggaagaugugcugcccucauuuaauugauaaaacagugcuuucagaggucacaaagcuauuuuuuggcagauauaaccaaaccuauuuugauguuccagcaccuccuaaugaagcaguagucgucaucuaaaacaaaaagcagucgguugcuaaaggaggagaaaguguugagaugugagaugaucuguuagacauaauugacaaucaugaauuugauaugauagguguaaacagagauagaaauaauuuaguuacaucuguuuaagauuuaagauaaccagaagcaauaauguuuaauugaaauaauauaucagguucuccuuaacauuaccuugaauuucuucacaugcacaucaaugcauuugguaaauaaaaguuuggaaacaacuuaguuaaguguuuagaacauauuagaguugugaugugcuuagcauccgcagucuuuuaucugugccaacccugagccugguaaugaagccaacucccacaugaauaaguaacauaaggaguguaaccaggaagaagucaggguuucaccuggaccaaauuuuaggcaauuaaguguuucaagagaucuuuagccagguguaacuuaaucaguuuaaggcacucucagcuagggccaagguacucauaauguuggcagugggcauucgucugauacaccacguugaaaguaauaggaaacauagagugucugcucaguuauugccaagagcaagagaaaugcagguguaaaaauauaaagaaguauuuggagccagaggcuaguacacauagacaagacuguauuuacacuuggcuuuaauaguucagauaauaacauggugguuuuuaaucaguuuagugugcugauauuuagucgugggucugguuucaccacuaaacccuaguguaacucucagccgguuacuuagccucucucugucucuaguaauauuaaacaaguguauuaauaccugcugcaucuuagcucaacuucaugucuggaagacagaugaaugguccugcuucuugcaguaacacacaagaaccuccuuugugcugcccugacugagaugaucuuguguucuucucuacgggcaaaacagcccuaggcugcuaaauggccaggcaguauaggggacuuaggacucuacaaagcuggguuuugguaggaguccaugagcaccgcggagagaauucuuaguuaucaggagauacgguuguaguacuuaaaaacucaaacuccaaaacaagacuacgugguuuugaaucucaguuuugccaguuuauuagcugugugacuuuaagcaaguugcuuaaccucucugugccucagaucccuuagccauaaaauugggaugaucaugcaacaauaggauuaguauguaagcaaaaugaguauauguacaguuuggcugcaauagagcugauagguguaaacagauauaaauaaugacuucuuuucugaaaaugacuucuuuucuguuuuucucguuggugaucccugcuuaugucacugggauggcugcgggaauucaguaggauaauauuggaaaauagcuuaaaucucaaauguucuauagcuaugauaacaucacuaugacgucauagcagagugaguccacucacaucucuccuggcaguuuugcugccucagaguuggaauaauaacucacugaaaauacuuccaaaauagugagccacucugcagauuuaauuuguaauauuauucuuucuaauuauuaguggcucugucuuaaguuccuuuguuuuaauugaagcaggguuuuuuuucccccuuguaaauuucuauacaugucaaaggcuaccaacucauuuuuauuuagaguuugaaauuugauuugaaaaauauacugcagccagcuauaugaaaaacauaagaggauauuguugacuuuugaugaagggaagaaagaacaagguagagcugccuagccaugaagaacgccaggguuuuuguaaccccuggugugcuuugcacgcagaaggcacacacuuaaauuggcauggcucacuuuuuuuacugugccuuugcugagcuugcugcaggcugagugcacugguagaggagugcagggcuguguucuggccaucccugccugcucaggccucuccugcuccuuuguggaucgcccaggucucugcugcuuccuggugccgucuccuggauccucuugacauuuuuccguucuguaauuugauugacaguuacagacaaggaaggggacugaaauucuuaccguuuugugacuuccuaaaacgggaaaggaaauuuggugaaugagaaggggaaaacgccucuuggcugaaauuauuuacaggauuuagccccagguuuaauguacucaugaaugaauaaugacucagcugauauuuagaagccgggaaaauuaugcgauuuuugugaugggguguauagauauggauguauacuugaagugguuuguguucuaaauauauuaacaugcucagggaauuucuuuuuggggaaauacauauauucuuuuucauagauuuuuguggugcauucugguagacggaagaugggucauugcucaguuaguaaaaaugaaauaugaauaucauacacauaagugguacauuuuacacuuuuugauaguugugaaauacucuuuuuuuuucagacuaccaauaaagagaauuugaggaguaaaacucuucuuaccaugaauuguuuuggggcacuuagaacuauuuaguuaauucuuuuaaauacuccaacugauuuagauagaauaaaagugucacaauuuuaacagcuuacaccagugaaauguuuccacuuauaagaaauacccucuuauuugucagcauacugaagacauauauguguuauuucuaagcacauuuccuauuuaugugauaauggagaucgcccuuuaaccaucacuuggacgugaaggaggauucuucuuccuccauuaguaaauauuccuugacuugauaauacugaaaauaugugaggugaaugagcuuuaauccugugguuugguuugguuuuugguuguuugcagucuuggacuguucaccugcacugucuugugccuuugaguaugauuaacugccuugacgccuuacagugcauuacacaacucuacuucuuccauuucuugacuaaucucucaugcuguuugacugcccauuggaaucuuuaaguuagcuacuuaggaaagacuuuaggaaggagaaugcuaagagaacuggcagagaagucaggagccugggcucuguccaggcccuggcguaaguccuuucaccucuuccuuugacuccuuuacaaaaugaaguugaacucauucgagcuuuaaaaagaugacgccaagaggcaagacagagggcaguagaugugaaaguaacaugaaagagaaaggaacaucugaaaaaaaaaaaaagguagaaaaagauuuugacaaauaguacuaaaaacaaagaauauagaauagagagacccaauuauacugauaauuacaauuaucaguauuguaaaaacuacagcaaaaaagcuaaaaacauauucagcuuuuauuguccauaaaaagugaucacaccaugucuaacuguaauucguuugucaaaaacacuagaggccaaggacuaaauugcggauuaagaguuucuuccuuuuauuuccugcauauccagaaaccuggggucauagauacucuuccaugguguguuguuuggcacaacuugcaaguauuuuggcagaugguuagaaaaaaagacuuuaagaaauaugcaauaguacucaggacucuaaauauaauaaauaaagcuaagauaccaguauccugccauucauuacaaucaacauuuauugaacagcaguuauaugccagguagcagggauaccuagaacuugccccucccacuagcacuccagaagaguuccugcuuucccagccuaaagcaacagcaagucuuacaugagcuaggcuuacugugauagcuguccugacggcgaguggcaaacauggcccagugccuuccucauggaugaacaugacucuacacugggacuccccgguagaccuuuuugugaugaugagaaaguccuguguuggugauguucaguaugguaacuagugacuguaugugcuguugagaacuugaaauauggcuacugugacugagggacagaacauuuaauuuuauuuaacuuugguugaguuuaauucaaauaacuacauauuacuaauggcuacugauuggacagcagcuuucuagacccauuguuaaaaauaauuauaagcaaugaguaccucuuaugagauagaauuaauaaucccauuuauugagggcccaugacagauuaagaauuauguuugacauauauuaucccuaauccucacaagaaugguucauuugacaaauaagauaacugaaguucugagagauaaauugcuuuguuauguccucgcaaggaauugugagagcuggaauuugaaccuaauuggucagacuccagagcugggugauuucuaguaaucugccaaaucuguguauguacuguccggaugcugugucuucugaguacaucuucuccuugcuuuauggauuaguuagcaaugucuuuaucuuggucacauaggacaguuacaggguccaucuuaucucuucugaauauggacguaucacugcacuggaaccauucauuuuucuuacugaggccuauguccuucaaaaaauauuaagaguugaggguccaacccagcuucuugaguaguaagcuaaucaccuacaaguauauuuccccaguagaugcugagagaagcaucaaaguacauggguaguucuguggacaucaguggcacucaguaaacucuuggcauuugaguguuuaacugucacaguugaggauaucugugaacucucccaaggccugagucacugaaugagcccagccaguacuugggcgucuguggcuccauucugcuuugcuguuuucugcuuuccauggaacauacaguaacucucuugaagggucugaaagccucaauuacaacguuucagugauucugaacugauuuuucuuuggaaaguauauaugcagaugguacuugcagaaucaccaggggguaguaacguggaggagugguaaaggucuacuggacaaucagguggcuaccacccaaccacacauggugaugugauaugaagccacuuuucuuuauuccuucagauuuaagguuuccccuucaggaagcagguuacuuaacaaguacuugauuucaccauaacaugcauuaugacauuaucuuuuuuucuuuuuucuuuuuuuuuuuugagacggaaucuugcccugucgcccaggcuggagugcaauggcacgaucucggcucacugcaaccuccuucucccagguucaagcaauucuccugccucagccuccugaguagcugggauuacaggugcaugccgccacaccuggcuaauuuuuuguaucuuugguggagaugggguuucaccauguuggccaggcuggucucgaacuccugacuucguuauccacccaccucaaccucccaaagugcugggauuacacgcaugagccaccguuccuggccgauauuuuauuuucuuaaaaggucauuaucagaugccacaagaguauuucuauaaacuaugacccaaguauagccuaauguuaauagcuuaaaauagguuuuauuuaccuuuuuugcccuuuaaaagcaaggaauuauuuuuuaauggaaagaacauagacuuugaugaucaguucacauccuugcuuuaccccuugaaaaaugugcaaccuggaaagacagcuuaacauuccugagucacauuuguccaaauaauacaaacaauggcaacaagacuucagcacuaaugucugauguuuuuuguaugauuaaucugugccagguuccauucuaguuucuuuacacacauuauaccaucuaauucucacaacaacuuugcauagcaggcauugucauuuccacuuuacaagcaggaaucugaggaccagaguuaaaaguaacugguccaagauugccuaguuaauaaaugguggaauuugcagucagacccaagcugguuugggccaauacacuugaccuucuuaugauacgucagccuugugaaauagggcagauacuauuaauaauauccaccuugugugaucauuaugaagguuagauauaauguauguggaacucuugccaccaaagugguuccacaagaggcccuaaacaaaugaguaaucauuauuauuuuaaaauguccguaagugaaaccgauaugccaagaccaguaaaaaugagagcuucuuaaggaaaagaguaggaggcauaccuuuguuucauuuuguuuguugguuucugugcuugcuuuuuguucuuuucuguuaggcacagguuuuauuuagaauaaauuaaauuuuuuuuucuuugaugagugcagaaauaauaguuggaaacauugaauggaacagcuaauguaccauaguaauacuucuuggauuaccaaaaaaaaaaaaaauuaaaucuguaaaaugaaaacauuuuuguuuacuuuggucaguucaagguucaguguuaucuagagauuuuuguuaaacucaggauuucuauauguaugauugucugcuaaauucagaauuagaagagaagagauaauggcgcuaacuuugcauguuaaauauacuguguuacuaguuuuccaugaaguuuuuacucaacaaauagguuacuaaaagagcugugaccuaugaguuucaccaagucuuuccauuuccaauucggcaacaaaaguuucacacuucucaauuacucuugugggaggaaucagaaugccaacagucaccuugaucuaagcguauuauuggagaaaaauucaaggauagauauuuguuucucauuagauuuuccucauauuuuaucauuggggucacucuaguacaugguacuagaauuugggauuuuuauuucauuuuagauuggacugauuuucugguguuagucauuaaaaauaauuccaacucuuugaagagaucugggauguuuguuauuauucuauugauuaaauaaagcuauuuuauuuaacaauuguguuguuaaacuuucuauauacuuagaauaauaauacuaaaaacugaauggguaugagcuuuucuuauugaauuuaaugucaguauuaaauaccuuauugaaacccauacuuugaaagcuugauugagaaauuggcaaaagaguugacugaaguaaaaguaaugaagcaguucacuggucauccagguuaugaaaaauuaaaccauuagagauaaacugaacugugaaaauuaugaucaugguguuuucauaaauaccaucuaugucuccgccaccauucuaaaaaaaaguacccuaucaaauggugaaaaauaagagugauguuucugugaccauuucauuauucaguuuucuuauauuugaaaugugggagguugaacuaaaauuuguugguucccuucuuuaaaaaaguauaguuauaugugauauuuauuuauuuauauaaacaaaaauauagagaucuuaccuugaaaauaacuuuugagguaagaaugauaaaguaucuaaauggaagaugaauaacauuguaucugauuuguaaauuaugauauaaagaaaauguauaaaauauguagaaauugucuguauaaaaaacuauaaacagugguccguugccuauuaacaaagaguuucauguuaucuaaaaagucuucaauuggcuaaaacagcagaaaaauagaaauuacauacuauaauauauccuaaaaacauuucaauuccauagauacucuucuccaugcagccaauauuuaugaauuuggaguaagugaccuacucuuagauauuugagcuugauuauaauucauagucaaaguagccuccuuguaaauaaccaaaauuaaccaaagauuuuuccuuaucuuccaaaagcaaugccaaguaauucuauccaaauuggaaaaaaaaaaagaaaaaggauaaaccuuauuaggugucaucaaaugguguugacauaaugauauauauguuuaaggauaauguaauagaauauguaauuaaaauuaaaguauauaugaaaagaauugauuuuaauuguuuuaaaacauaagaugauuuaauaauaugggucggagauucuuuuuaguuuuauaauaaauauauugauuucugaaauuuggguauauuccauaguacacuuagcuuauguuaauacugaggccagauugcugucaggcuaauagcguguagauauauuauagucacacuacaaucauuccgucaguuuucaguuucccuuuuuccugugauguuucuuucaucuuguuagauuauucucaagaccuucucuaaauaccuucaguaguaauucacaaacucuuuguuaguuaauaguucucaagaaaauucugagaugugguugacagaacuuagaucauugguuuguuuuuggauuccuagccaaaguuuuauucuuuguuucuuaaaaauacucaaaaaaguuuuuuuuccuuauuguaagcccucuggaaauagaagcaaaucacuguuuauacauuuaaaaugugaugaaaauuacaaaauaaaguccagugaaauauagggcuuguauccauuagugccuuaagaaaaaucccuguuuucugaagugcgagugggcuuuucugguuuguuuuuguuuuguuaaagcuccaggaccucccaauuuucaagggcacuuuggggcauguguagcauuuauuugauguauggauguagaugcauauuuucccacaucugucucuguggaccuauccuuugugaaauccuaaaccuuguauuaaugcuuaguuuaugauucaugguguucugagagcaauuauauaauuuuucugggguguuuauucgaugugcacuguaaaaaaaaaugagaguuauuuuuugguaacccugcacuugccuuuuuauuggugaauuucuuuuccuuuuacugugaccugugaauaucacuguaggcucacugccaauuuugugagccgcugccugcuucaaaauggaggcaggaagguauccauuuucaucaagaggaugacaguguuucagucuuucugaccaucuggagagaggaacuuugagagcaaaagaaaauggggauuaaaaaaaauuauauuuagcagaaaaggcaagggggaaaaccaauuaaaguuaaacuauaccuuaugaauuugugcuuuucuacuaugcuguccuguuuaaaaaaaacauaaacaagaaaauacacaggcuauuuguauaaagaauugguuucccaagucucaugaguauuaguaaaugaauguaaguaaauuagguuuuuggcacacuuuuuaaguuuauuguacacacaaauauaauaagcaugaaaaaggagggcucccuccucccgcuuccuaugcacacacugauuguugguggucuuauguagauccaggcuuuuaauggccuuuuucaugcaucucugcaaaaagcugacacuaugggaauuuaauauucuaagauauauuuaucacuuucugugguuuggauaguucauuuguguucucucugucuccccccucccuaccuccucucuguaaaagugaaaauuuuaauugaaagguagaguuuuuacucuaccauuugaaagagguuugaugcaugucuuucuguuuuuaccauuuucacaugcuuaugggccaucuguguuuagaagaaaaagaaagaagugcuuagacucacaggauuacccuaugggcauuauacaguguauuuacaacuagacaugguuuacaucaacuggaauauaacacaccugguuauuuucuguucgcacaaauacaccgagcuuuuguuucguuuuguuguguuuguuuuaguguguucggaaagggcacuguuucuaggguuuguucagauuuaaacuggaaaggguagaaauguagcacuuucugccuacuucuuauauaagaauggagcuugggcugcuguggucaaugcaaaaagcaaaacucaguugguucuuucuccucaggucuaugcuccaucagcaagcacugccgacuacaauagggacucgccaggcuauccuuccuccaaaccagcaaccagcacuuucccuagcuccuucuucaugcaagguaagaugcugcugcuucugagggaaaggccacuggauagcauuuuccugggucacuuaaugucacagauggggcagaagaaauggaauaguaggcaaguguagaauuuuugaagucaugcucuucuuaggaauugaauuccuuaaaaauugauguauuaauuaaaacuguacuaagucuuucuuuacaauuaaaccccuuuaagcaguaauggguuaagauuagauugaucugcuucacuuagagccgaugcuuaugauggucuuccacucaugaccaaccauuucagcaucuucaccauccccaagacgauguagcuguuuguuuagaagugguucagcuccauguauguuuugaacauccuggauuuagccaacugggaacaaguuggccuaauguauaaccuuauguaaaauuuucacccacuuacuaauuuguagguaagaacaaggguccaagaugaaguaaccuaccacagacuggaauauuacauggugaaagcucugucccaacauaguaacugguuuaggauaaaaggcccaacuuuugggggagaagacaaauauaggaaauuauggaauuguccaguauguuuaaauacauggaugugugcccccacccugagcuuguagucuugcuacugauagcguauaccuuucugcugcucaaaaaagaccaagauguggccgagugcgguggcucacgccuguaaucccaacacuugggaggccaaggcaggcaaaucacaaggucaggauaucaagaccauccuggccaauauggugaaacccugucuguacuaaaaauacaaaaaauuagccaggcgugguggugggcaccuguagucccagcuacucgggaggcugaggcagaagaauggcaugaaccugggaggcagagcuuacagugagcugagauugcaccacugcacuccagccugggcaacagagcgagacuccaucucaaaauaaauaaauaaauaaauaaacaaacaaauaaauaaaugaauuuuuuaaaaagaccaagauguuugaaaugauagcagcuacuucaagaaugaaccacuuggaggaugccccuaagggcuccauccugauauguguguggcacuuauuuucuaauguaauuaucuuguuaccaaguuaaugcccugaauuuagauguggaauuuaccaagaaccccugugugcaaaauguuaacucuuuuugcccaggugugaaaaccuuauuuguauaagccuugucuacgggccaugggguuuccuucuuuaugcaucucuaggaagggccaugucacaggaaggggagcacauuuggggcaaagaguaccagggaagcagccugauauaguggacacacucaaaaucauucucauuaaaagauacuaaucuuccuucccuucaguguguuagcucuuuuaguuuguuaguucacgugugaaauuccauggaaaucuauaaaauuggauggaauggcucuguuaggaauagagagaauuuguuccacgcauaauagagcccgugugucagaaguccuuuaacuuugugacccguccuagguguaacucaaagggacacagcaggcuaugucaccugggugcguuuugugccgugacaaaaagcuaaucaccuucaguuauaaacaguagcuaccucagcaucaguccccuguuuugugagcagugggagauauuguccuacaggagcuuacagagauuggcaacucaaggauccaucacucaaaacagauuucgauugaaaacauugacggaaggauauauuuuuucuaucugcccaggaaaguggcuuucuggaagggugcacauugcaggagaggccagguagauuauaucaguaggcuccuuucccuagcagaccacacaaaauauggggaacaaauuuguuuaucugcauaugcauacccgaaaagcaaaaaaaaaaaaaaaaaauugaguugacauuuuugaugagcacaauuaauuugcacacaucuaauucuauucuuucuuucaaaagaacauuaugccaagaucaugggaugugauaaauauuaauuuacugugaaaagcauaauuuauguaaaauauguauuuuuauaagucugcaucaagcagaguacucuguguuaacaguccuaaacgcauugccacccaggguaucacauugucaggagacucuuguuuagugauauauguuuucaauuuauuugucauaugugccaucuauuuaaaauguuagugaucuugaacuucauauuugaauuuaaggugacauuuaaaccucuguaaucuaaggacuaaagcucaaguacaugaaugauaacuuuaaaaaaaaucauguguuuucacaugauggccacagaaacaguugcaucaugguccugucccacaucagcuuccuuucaguagagggguacuuggugcccugagaauucaagacuugaaggaauaugcaauuaaggugaaagauguucagaaacugucuggggcauauuguaaacucacuacuguggccucuuauuuguaacuucaauuuccaucuucuaguuaaaacucugaaguugucaaaaucacagacaugauuuugcuugcaugguucuuaaagagaggaaucugcaaacuauuccucccaauaugaaaugaguccaguuacaaaauucuaacuuccggauuuaagaacucaaugaaaaagagcuucacgaaauacagugucagauuuaacuuuucuauugccuaacuuuuuaauaggccuuuacuauauaaaauguuauggugaaaauaaucuuauuuucaaggaagcaauaucugcuauacauuuaacagccagcugauggccuaguguauaccuaguacucaauacuuuuuguuaaacuauugaaacaaagaaaaaaugaaugaauuuagcaguaauguagaucaucuuuucccuuaggcuugggaaaccaaaccuaaacauuagcaaucauuaauaauaaccuguaggccaauaggcccagagaaugaaaaaauccguagggauguuuuuaauaagaauguuaacaaaagguuaaccuuauguugaaagauacuuuauauaauuuuaaaccucuauaauucauaaaucguuuuauaaaauccagagacucucaaaaauaucuguaauauaauagcuaccuagggcauguuuguacccuuuggauugcuacugaagguuuaagauagcuauauaccuauacaccaaaaaauaaaaauaaaauauccuaagaacuauauauuugagauucaucuucucugcaugccguaauauaauuauaauuccaacuuuaauucuauuuauuguauauguuaaaaaugaaauuaaacauuuucaaucugagauuuuuuaaaauuaauacuucuuuacaugcuuuuaaaacuugucaacuuuguaauuucucaaguacuuuucaccccaaaguuuaggaacaauuuaacuuuuuaguugguuuucauagaaaaaacaguuagaagacuucuaagaaauguuuccuuuagcaguaauuaccuugcgacuugacauaauucaugguagaaauauacucuguuguucuuuuacaguucaauuuuuaccaagaacacuuuaacuuuuuuaaguguuuauauuuguuugacaauauagagccacuugggaagaaaugaugacugucuucugauguaaucagcuaaccaacacaaagaugaauaacacaacaggcagucauuuucaaguauaugaaaaaacccuauucuauaaggcaaggcugaaugccucagaaagucaugguugucuuuguccuuuacagauggccaucacagcagugacccuuggagcuccuccagugggaugaaucagccuggcuaugcaggaauguugggcaacucuucucauauuccacaguccagcagcuacuguagccugcauccacaugaacguuugguaaggcagacauacacgguaacgggaaugucacagcuaguugauuaaaccucguccucugucuuuccaugcauauacacaaggacucugcaaauaagugcaaaaauggcacacacccauuauucuuaaguuguauuguuucugugaucaaagacauaacagguucaaaucaccuuuguaaauucuuccagauucucucuggcauuguucuuuuguuuauuguguuuugcucugugccuucuuuaucacaaugucagcuuccuuggguacauaaauagauaccuauuuaaguuguagaaucuuaacauggugguuccugguuuuuuuuuuuuuuuuuuuuuuucuaucuguaguuucaaaagauguacugcagagggcagagugacagucgguagauuauaugcaucacccaggagcauuucauuucccauugacuggccuaugucagcuuuggccuguugugauguauccaaaagaaggaguuuguauuuucuguagacuuccaucaguaagagaaaccaugagguuucuacauagaucagauucccauuuuucaguauuuuaacuuuaauucccaucccagccugccacucauacuguguuuugcgucacuccaggugaaaacuggugggcucuagaauguuaggucuuucauuacuaaacauuuccacucuguccaucaccuacauucaucuaucauaguaugucucuuuauccuggaggaaacaacucagcugacuuucuucuagccuuaaauaucaccacagcccagaauccacuguugaacuuaagucugucauuaaagagaggaaagagccuagaucuugagugagauuugggaugcagauaagaugaaacuugaaucccuugugcaagaacauagcuuaaacaauauguggaccucacauccuacaaaugcgaaagcauaugggaaauccagugaucccaggugauacuuacaucacuacuauucaucuugcauuugccccuuuuucuucuucucauaucuacacuuagguuucuuucucuguucugauaaaggaaaucauucuggauucauguggucuuugcucucuuuugcucaaccaguacagauaagaaacaggaucugaucuccuacuccaauaaucaaaaaaauuccagaaguuaagauuucugauauccuugaaaauccguauuuaguugguccuagugguagagaugcuaaguagucaauuagccuauacauuccugagaggcagacaguggaaaugguauuggccuuuuuguaucaccucccaagauugaauguguaaaucacaaacuaucucacauuucagcacauuuccaguaaauagcagaugacuuauuuucaaauuuucucuuuucccaccuccuauuuggagauauuagagugaaagcuuagagaaauaucaacuauaucaacuauuauuaugcuagaauccguuuuggcuaaaauuuucauuucugcaccaucauuuuccacuucugugggaacucauggucaaaacuguauguguccuaugagcaaggaaaguuuugauuacaaauaaaaguuuuaggcacuauaccgcauguuggaauuucaguucuuuuaagaguugcccauuugacauuaauuuuucuucccuucuguguuucuuucuuucuucuccuaucaugcucaagaguuuugaguuaggcgauuugauuuuauccuaguccaguucacugcaugggaaguagcuuuaaaaugugcuuccaugcacaaaaaguauaauuucaaaauggaaaccaacuauauuccuuuuagaaaaaauuuuacagaaccaaaacaauauuaugaacuagagagaaaauaucauuuugaaguaguaacccaguaggcuauaucagaagccauauuugcaaugccauuuaccuaucacgaaacacaggauuuucauuuuucaucugaacaguuaacagauuucagagaguagaguuuuuguuuuaaaggagacaugaauaagcuaucuugcaauguauacuaaugaauuuucccacuguuagugaaacuauugaauuauuauaucuaguugucauuguacuuucaguauuuaaccaugugaaaaucuuuuacugaagugacuuagaagaaucugacacugacaauacuuugaauauauaguagcaguugguguccuuucaguugaaaauaaugguaguuccuuauaauuuuauucuuagcaucuggcuagccccauacugaacaaagggauaguuuaagaaaaagcuaagcgcuguuccuggauuauuugggguauaauuuggccaaguugauauuaucuguaaagauaaaauauuuuaaaaacaucauugccuucaucacuuuaugccauguuauaacagaauguguaauuauaaagcuuaagauccacauauuucaguagcgacugucaaguuacugauguuuagucuuuaaauccccuuuacaguuuuagccuguccaacagaaucccacagcuaaucauuacuguguuacacauacccacacaaaaucacucagaugaauggaguuugcgguuaaaguuuggaauggguuguuguagaugauuuuauguuuggaaugacuuggcagaguucuuuuuaagaacaggauagaguccucacugucuggcaugauuuaggcauggucuuugcacuacagggcgaaacaguccuaggagucuggaauuuuccuuuaaaggaaguucuguuuucuuuuauuuuuuuguaacauaaacccuuacuucaguaauucucaacugauggcaguuuuucccuucagggaacguuuggugaugucuggggacauuuucauuguuacaacuaggggcuagaugcuacuggaauccagugcguagaggcuaggggugcugguaaacaugacgucauguaugggagagccuccacagcaaagaauugucuggcacaaaagaucaguagugcuaagguugugaaauccugcccaaacccaaagcaugauuuuauucuuauuuaugugcaccaguuauuauauuuuucuaauguuugaauuaucaaccaguauaucaguaauggaaacauuuccaacaauuacucuguuaauagacacgaaauacaggacucuugggcaucauaaguuaaaaugaacgaauagugggcauguaaagccucgcacuuugucacacuccucauguccuuuguagcaagcaggaaagacaguaauagcuggaguaagagacuaagaggaccucuuauaguuuaucccuaaauccucuaaaagagacauuauucucugugguguauuuauuacaucucugaaugacaguaguuuucaagauaguuuuuaauguaaaauaaucuaguuauaaaucucguuaguuuauuucaacaacuaauuuucuaugagucucuaaaaauaacugauuuacauggauuccauugguucacuccuuuauaaucuauggggauuaauuuuucuuuuuauucugugaacucagcguuaacccuuugucaaaucccaaauuacugcccauuuuacauaaaguuaaaagggcccaaagauucucaccgaugugauuaucuguuuuguuucaucuucugauuauuauaguuaguuaaauauuuauaauucuucuccucuuuuuuugauuuuugcacauuucaggcagauuuguaguucgucuguucuucagaaauuccacauggaauaggacuguguagaagugagguuaaaguuagucaucucuuuuuuuguucuuuuuuccacauucuguuucuuuuccuccauuuuguuauagugcuuaccucuauagcagaaauaccucuaucccugcuaagcuuucagaauagcuguacuauggaaugggcccacuauauuuuucauuggagaaaauuccauggacuaccuuggguguucauuagguggcaaguagaaaugaguuuaacagguggccuaaggaauuuuggggucaaggaaagaaagagguccauggaauuuaaaaauuugaaaggcauucucaggaacuuggaaagauuuaaaggcaucaucucaacuuuuuuacggaagucuuuuaaguugggcuauuuuggucauacagagguaauauuuucaaaaacauucaugcgucuuugaaaauccuaccucuaauacguagauucauuuccuuagacuaguuggcucucaaauaaguuauacuucaauccacuguuuauuaaauucugacugauaaccaauuguucauugagcguauaguauaauuauguguucaguaguuagccacaaguugugggaugcagaacuauaagcucuauuccuuuaaagaguuuacaauacaggugaaaauacauuagaaaaagcaagaaaugaaaggccaaauauaauuaaguguuaaagacaauagugcagaauguaagugcauuagggaccuagagagaagagaugguggaagaguuggagguagucagggacucuucaagaaagagguagaauucaagacggaucucacagaguaaacagggcaacacucaagagacuaugguuucauuccucgugagcaaaugcuuggguuuuaaauacccgugacuaucagcaucauauucaaucucuuauuuugaaauaaacaauuuuuaacagcauuuccaauaaugauauaauaaagacucauaauccauuaauauauugcauaugaagaaaaaguguauuuuagcuuuaauauauugccuuuacauaacacauucagaugccuaugagaauaacuuuugaagcugcuuuuuaucuugaaaauagcucagcacuuuuuuguaaauuacuauguccauuuuagugagcuguucauucccaagcagauggguggauugcaacuaauuugccaccuuacaggcacuguggcauacccaagaaacacagcuuauuuggaaaacuaauauaauaauuaaacucaaagcagagucuuaaaccaagugauucuguaaagauguuguucuuucauugccagcuaugugaggauugcuuguagguggggcauggaaagaaaguacucaaaccaaaauaagucaugugguccuaauuuaauucaguauagucaauaguuacauauugaugaguaagagagauauuuaaccauuagugcuuuuuaaauuuuuuauuuacuaaauuuuauuguugcugggguucaaaaaaauuuaauuugggaggaagaagauuugagacugguuagucuuugccauuuaguuucaagaagaucaggaugaaauguaauauaagcccuguggaucauaauguuguuuuauucauuauauaguggaaucuuuuucacuugaucaauaggccacacaaaaaaauuaauaguagaguggucuuuuauguugccgaaacccuggagaugauuuuaagcaguaaucuguagauuucgagauugugaucauuucucaaugucccucauugccauuauaucccuccacaguugaugcaaacccaagcuauguuucuguauaacuuauuauuugaaaaaugaaagcugucagaucuaaacaagauauauucuuggcuauuuugaaauucuaaaagcugucuccauuguaaaauagagaguugugagaaaaguauuugaaaauaacucacuaaauaccuuaugauuaaauauggccaccuuuuucugcuucuugcuauagagcuauccaucacacuccucagcagacaucaauuccagucuuccuccgauguccacuuuccaucguagugguacaaaccauuacagcaccucuuccuguacgccuccugccaacgggacagacaguauaaugggugagucacagaaaugccaauucugauaccaacaauuggugucagaguuuaaucaucaaggaccucuuuuucccuuucauaacugaauagcaauuaggcacuaaauauuagucacaugacagaaugaacacacaaauguaccaaacagaaguaaaaucacuggcuugagcauaaccauauuuuucgucacaagacacugaaauuuagcuacguucuacguugcaagucauuagauugaacaaggguucaaacagaccaaaacuaucuuguuccucacauucaaaaagagugaacaaagucauaagaugagccaucagugacuagugagcuacaaagcagaauagcucuuaaugguaguuauugaccacuucccaaaauuccagucauugugcuaggcucuuauccaugaugugccacugucuuccgaggacugguuaaugugaaauucucaggugacugcuaauaacuacaugagguuaaucuccuggagaaugugacacuguggagucccucagaggggaagaaguauuuguucacuuaugagagaggagaugcgugggcaucaguuggccagaaauuauuugcugcuuuuuuaaauuaauuaauuaauuaauuuuuaccaaggacauuuacuaaugaguuaagguccaagaagaaugcuguucccaugaacugagccaucauccucucauuucuugugauguucacuguagucuuuuccauaggugguuccccagucaguauucccacuuugaggaaugaacugggcuggauguccagcugccccuggagggaagagguggaguugguggggagauagcuaccugcuucugaaccagcuuugacaccuuguuguucagaugagcagcacagcuuagugccccagggucuuauuaaaaccucagacuucucagguagucacuuucugcgguuauagcucaaacuaacuccuugcuuggccugaaugucacugucagagcgucgguggggagaauacucaguguaugucuuugagagaagauggcgcaacagaauaaugcugcuguugaguccucuuagcucuuugcacuuguuuucuuuagagaguguguagaauuuggggaaguggcgugaaucacuuauguaggaaaguuuuugauguuggaggagagauguguuuugaaauguuggaaauauaauuucugccucaauaaugcccucccugcguauucaauaauauaucucacacuugagaugagcuaucucgcagccucuccacuccgcuauccugucuaagaagcaaauugaggagagaguuuccauuuuuuuuaacuuuuccuaaccaagcuucuacaaauauguugcaucaguuugaccuuggagagcuacagacagaggucacauggggaaguuuguuagcuaucaaugcaguuuuggcagauuugaaaaacaagaagaaagaaagcagugcagaacugaaagagugagaaaagcauauuucacuucagugugguuugacaaauggaaagccccuuucugcagucaugaggucugguuauaaagaaggaugaccggucauucauccuuuuacaagacagauuuccugucuacuugugguuugaguaauuuucuuuuuuaggaagguaugaagguggagcagaaccuugaguugaggaaaacauacuuaggcucuguuugaaaaaaaacuuuuucugauugauuugcaaaacaguccucuugagagagaggcacuaugacuuggaagggacauaucaggaaauagggugguuaucuccaugagcuguagacagcuuagccacagcucucagugggaaugaguuuugcuugguuuuagcuggucaucuucauuaguuuguggaugaacaggagaaucuacuuguuggucuagccagaguggagcaauaggugacuucuauaugcugagaauagacuuaacuuguuaaaaaccauagggccuuauuuaagggucuugacaauaauaaaggagcuauaauuuaaaaacaaaaguaugagauuuuuagaacccagaaaagggcuuuuuagaaauuuauuucauacauuauuuuacaauaauggaugcacuugucaaaauccacuagcggaaugagaaaaagaugcauaaucuuuaaggaaauagguagacaugguaauucagcauuuuggaggagcaaaccuuuauuauuaugcauagauacagauauuacuuuaagguuacuuuaagggagaacauucuagaauguuuuucuuuaaaauaauauguucaccaauugcguacgugaaaaugcagaggaaaauuuaagcauaauaagccuuaguauugcgugaugucugaguggcccauguuuuuucacacuuaaguucucuuaggcuuugguuugauuuuuugagugugguagaagucagugauggcagcgugucuguauaacaagaagagaagcuuucucuucugauguuagugauacuacccuaacaaacaguauggauuaauaggauacaucugcagacuuuugaaaauauuuggcauauacucacucauucugaaacgcaggaaguaaagaaauauuacguugccuguaucucaaagaacaaacagagcuaauuaaauaauuggcaaauagggaacacauagccugacacauguuugagauuacacacgauucuguagaaaaugacuguaagcaauacuaaugccuuaagaaugggguucgagcacuaacacauggacaucacauuuuucacguuuuccugguaaaaaguugcaagacagugcagucuuuucauacaugguguugaugucuuaggaagcugcuuuuucaguucagaagagggcugcugcccuucgucucagugucauguuauaauaugucuuucugguggucagcaguuguccugaacugacacuagaacaacgcagugcauguggggugagauacaagcucuagaacucucggaagggaaccucucuguaaccacauucccuuucuucuucuguucucugcaucucaaagguggaagaugcccacugagguuugcuguuuguuuggcuugggggagugaccagguguuucuuguuuuguuuucuuuugcccuauaauacccaauaucauuuuuugagaaauccauaagaaggauaaagcuuacuuggauuacauuaaugagagauuuuuuuuuuuucaugacacauucauccauggauuuucaagagaauuguagaacaagguauuuuacucauugcauacaguccacuacuuuucucaagccuugcuggcaaacucuggagaucauauuagaccuuucugaauugaaaaggucaucuaauuagcccuccaauuagaggaauauaauguaugggacacagcauggauucacaguaguucagcugguggcgcacccaguuaaggaaagaagcugucaggggucuuugggaguuaccagcaucagcaccuucuacucaguucuucaaacuuuuucaauguuaugccacuggguauucucagaagcagugcaguucagugccucugcaucugagcauacauacggaggaggaaguguaguaaguuauuagauaccagcuauagagaauaggaaugucugcaggauauuaaccauacacauuugguuagccacauacuuccuuccuauuugcaauaauauccaguagcccuuccugauggaaagaaguaagaggaccuccuaccauagcacagaccacugagacugcucaagggugagaaugcgucgucuccccauugggacauaccaucuguauacauucacagggugugacccuuugugguuugaggcuacacacacucccuugcccucagagagaacuggucauauaacuaacauaaugguuauaauaacuauuauuguuuuauuagucuuuaacuggccugcauucuaauacguggucuuuuccacguuuuuaaaccucaaaccaaacaggguugaaggaacagacuaccaagauugauuuaauacaccauaugcuaaagauuacccuggaauaucuaucugguucaugaauuaaucuggcuuagaacuuuaacuucgaaugacauguuaguauguggcuugucuaguagaaacauuauguccuuuucucuuugaggacuugguuucacaguaauuuuauuauuagaguagucacauaauguucacuuuauauuuuacaagaauauugagccuugaaguagucaggcgaugaacaagcacagagcauaagaguaauaagaauuguauccagcaaugugaaggcaucuuaguuaccaagaccaccagcagagaacaauaaacuaguuugauuuaaaucuccuccauuuccugugcacgaucaggaagcccaacuucccccugaauuccuaggaaucccuccuguuaaaaaauagugcauuguagucuauauacuugcguuuguauuuuaaaaugguuguaguaggagugcuggaaauguuccuucuuuuugucaucuuuauagauaagcacauggcauuguuaugcuguuucuaaugguuuaauaacacgagggucacucggacacaguuuagaaaaaccuacuuugaaagcagucaucuucucucaggcaaacacagugugaauugugcugcuuauucuuuugaugccuucaugauguucccagccuuagaugaugggugugcauuaaaggggcaacacauuuuccaaauucugauuuuuaguaguugaucccaaggcaccacucaucccaguguuuuguugaggguguguucuaaugggaaugaacauuuccccaaagcugaggcugagacagaggguggucuagcauguaacccaagauacaaaaccuuucuuucugcuucaucuucuagccagcaacaccaccuguguucaagccaucugaacaauacuuggguggcaggcagugucgaagccuccuacaaaaauuacaguuccucuuaauaacugcucaucuuccauucauauuuguauguuacagcucuacuuagggacugauuauauuucucuugggcaagauaaauugauuagagccaaaauuagaaaucgauaaagucuuuaccaagcaaaugcauuaguuuucaucuuucuguuacauggacauuuugaucaucucuaauaugaauugacaaaaaucuugggccucaaagaguaaucaaguccuguuacaucaaacccacauuuucagcuuuaauguaucuugcuaaacauggcccacuucucaaugcaaaaaaaaaaaaaaaauucugccacuugagaauuaaaauauauuucuuuuccaguuauacccuuuguuauaucugucacacaaauaaaaagagaaaucuguaagagaaagacucauguagcuuaacauguucaggcaaucuagaaaauguagcuucuccaguguuuccuggaccagaacaaaaggcauuccaagugaaagggcaaacuggccccaguaaacugcuuugaaauuuaagcccuuggguuuggcacuccagcuguugcaagguaaaaucgcuucauguuaaaaaauagucuguucuuaucagugguuuccauggguagccuuuguaguuuucugaaauauuuucaugacgcgaugagguaagaaguugauucuauuuuuaauucuauuuccugagucauaauaucucccugcauaaaacaggcacugauagaauguuuaguuagaaagguguaguucuaaagaaaucagauuggucauaauaucuugccucuucuaacgugugauuuuuggggcguauauauuuaguuuuuaaaugcuccuaaaauauuuguauugguuuucaauacuuuguuuaguuucauaaaaauauauauauuauuuguaaucuucauuuuaaaguuguuuaaaggaagaauuaaucuuuugaaagccacuacuguagcagauauuaucuguagugaagcaauaucuuguucuuuuuuggcuuagguucuuuguuagauaaugugauuuuuccaauguagcucugaacuuuuugugaaaaucuauauucaaaucaagcagauaucacagauuauuuugacugauagaucuaauuuuuagguauauaauaaugaaaagaaauaucgcuucuaggaaaaaaaaaaagauaaguacccccaaauaccaugguaauacauacugaaaaaagguuaguaucaucuauauuucacaucauuauuauuuucucuuuagaaugguuuuuagguuuguuuguuguucuuguuguuugaggcagaguuuugauccuguugcccaggcuagagugcaauggcgcaaucucaaucucggcucacugcaaccuccgccucccagguucaagcgauucuccugccuuagccaggcauaguggugcaugccugcaauccauguuuuuaguuuuuaaaggacuccuuaaugcagaaauucuucucauuuucacacuagauauaauuuguuguauuuuaucuuauauuaaauauuuuuaauacucuugauaucugagcugcucccagugguccaauuguaugaugucagacccucauuucaaagaacuugcuuauacaauaccuaucaugaguacuaaugacucauguauuuuaauaucauaacuuugugauauggaaguuuauuuugucacgagauaauuguguucuucuuaucaugugccagauuucuuucaguauuuuagcaauuaacaaauaaauauggguguggguuuuguaaaccaaauaaaguauauaucaaaacauuaucggcugggcaccgugacucaguccuguaaucccagcacuuugggaggccaaggugggugguucaugaagucaggaguucgagaccagccugaccaacauggugaaacccugucucuacuaaaaauacgaaaauuacuuggcgugguggcgugugccuguaauccuagcuacucaggaggcugaggcaggagaauugcuugaacccggaaggcagagguugcagugagccgagauugugccacugcacuccagccugggcaacagaacaagacuccaucucaaaacaaaaaagaaaacucaucugacaaacucaacauauaaauauaugaaaauaacaagcauaaauuagcuaugcuaagcagaggucaggagaauuaaauuaugaccuggaaaagccauagaauuggaccacugaagauccgaccccacuacugcauuuuacaaguguggaaggugaugacaacacauuuguaagaaagaaggcucucuuaguucaagaauggggcuggaaagucuuugaaauuauauaccuguuuaaugaaguuuugcuuggauucauugggugauuuaaccuuuccuuuucuuauuucacaaaauagugaaaaacaaucuucccucagaacuuuaauagguuuuauuuagauacuaugucuauuugcuaauguugaggcuuuaguaaauacaacauaccccaagugcuaggcauucuguuaauacugaagaccacaagaauccuggaaaucccauuuuaucacuuaguucuaaaggcaagauaccuuccaaugauacauguuaaagaaagcuggcuuugaauuguauacuguaauauaugucuuuuauuauucacaauacucuuuguucuucucuuuuguagauaaaaauaccaguguuuaaggcaguagagauaagcuucaugaauauguagacuuacuuuaucucuggaauucgaggccauauugacuuuuaguagcauaccaguucacuuuuuuuagugugaacacagacuuuuaaauauguggagaauauauguuauuuaaaacauuaaaaauauuuucucuccuuguuagccagaccuguuguggaaauuuuuguuuguuuguuugguguacuguaggacugugagacgaauaccccguuuugcuauguaucaaauuucuauuuauuugaaaacagauggaaguuauuugugaagauaauuccauuuacuauaaaauaauauaaagaaaagccagacucugaggacuccagagaccugaaaguagucuauacuugucagcaaugaccgucacauagcuugcuacauucaccagcucaucaacagcaaggggaaagucauagcaaggaaaccacuuuaucuuuaaaccaaggugucagguuuauauuuuaucuguaaaaaaguaacaugaauauauuugacaucuaccucagcaaacaaauuaaugcuaauuaaagauuaauguguuguaauuagcauuaaaaaugcaauuaaauugugaguaaauggaccaggaauagaaaauuguuagacgucucacugccugguuuucauauucugccuuuuguuuuugcagcaaauagaggaagcggggcagccggcagcucccagacuggagaugcucuggggaaagcacuugcuucggugaggaaauauugacuuuggacuccauauguaccauuguaaagggugaacuuuaaucagaaguggacauuuggaauuuuagaaaaugaauggcaaauagcuuugauuuuuggaaaaugcuagcuuucuugcauaacagucacuggaaaauuugagaaggcucugaagcuuccaguauauagucucuuucucucauccucaaaaugguacuaagcugcacucaauuauggaugugggaauauucuccuggucuuuggguuuauagguuuuuuauacugaugucuuauuuuucucuaaaguaauaugggugcacauugaccagcuaagacugucuuagcaaggaauaguucuaaaacacuuugaaagaggcauuugaaaaaaaaaaaaaaaaaaaaagacaauaacugagguccaugaagaacugucacauaauuggcaccugggggacucagcuucucugcuuugcccaccuacugccagaaagcuaaaauugaacauuucuugcauguucccugaugacaaaauggcauaccuucauugucucagagaguauaucugguauuuuagucaaaagcuaaacauggucauuuagaaauguaaguggagggccagguaguguggcucacacugguaaucucagcacuuugggaggccgaggugggaggaucacuugaggucaggaguucaagacuagccuggccaacacggugaagcccugucacuacuaaaaacaugaaaauuaacuaggcauggguggcacaugccuguaaucccagcuacuccggagacugaggcaggagaaucgcuugaaccugggagguagagguugcagugagcugagaucaugccacugcacuccaacuugggugacagagcaagacuccaucaaauaaauaaauaaauguaaguggagauuucuuucucuaagauuuugucucuucaguuggcuuuuaccauugagagcauuaaaaaaguucacacuguauuagcauugugcccuaaguaaaaguuuuuguuucaucugggccuucugaugcuaugcaaucaaacgccuagaucuggcaaaagaguggcaaaauaucuuaggaaugauccuguucaaccucucauuguguagaugaggaaaggaaaguucaaaguaucugcuuggcuugcccauagccacacagccaguaggaacgaagaguugguuugaagucugcugaccccagccuggcucuuuucccaccaucccauaccacaucaguaauucuuguuuugaaaaauuaaaauaauuguuaaguucuucauuugacaauuuugguacuguaguugauuauuacauguaugcuguaacuuguaaguucuaaaugaauugcguugacaacuucguaguuuagaaaagugugaauuauuuuaaugaaugaggguguuuuuuuuuucuccuuauuguuuuaagaucuauucuccagaucacacuaacaacagcuuuucaucaaacccuucaacuccuguuggcucuccuccaucucucucagguaguguauuucaaaucccauuucaucauauaacaguuuauaagaaugauuccccccuuguacuuccugauuuuguagguggaaacucacuuccccccaaaucccaaagcuuuaacauuccuauaacagacaaauacaaagggugggagagacaaauuaccagauaacaguauagucguuuacauccaaaccuuuucuuaaaaauuagauuaucuuuuuaaaauauacaggcauauggaaaauguauuucuuacacuuuucuuagcucugcagaagacacccaacggcagaauaauguauuccaauaaaacgucucagaugaaaaaaacucaguuaauauagucaugaauaugaauauagacuagauagucaucaaauauagacuauuuaaauggaucauuuccugcaggaauuucaggcuuuccaaauucccucuuuaaaguacaugccauugggauguuuagagaaaacuauaauuuuguaaauaaauugugaaauaauugugugggguagaagggauguuugacuucaaaguauaauacauucguaugaccuguggcuucaaauugaauaacuauaauuuguagaauuaugucaguaaauaauuucacuuuucagggguccguuuaagagacucauugucuuuccaauauaaaugcuuccagaaagccuuccuugguucaugucucugcucuuugguaaggagacagguggcuuauuaaaaaaacaaaacaacagcaacaaaaccuaaaucacaucuguaccugauggaaaccuuaccuuacuguaauuuauaguggaguuacuugcguuuguuauuuccugcaugcagcucucauggcccaguguaaacucagcuccuuggucgaggacaggagguuucacauugccacaaaacuuucagaaaugauggccauggcuuagcugggauuuaaugucaaccucuuccaagccuccgugguaugagaagaucacagaauagagagggcagugggauucugaagucucuauguccagagagaccgcguugaaacugggaagcgauugaggugauuuuaagaggauaaucaaacguucccccugguggaaauagaaacuagaguucaguauuguuguacuccucggguucuguaccagauucuuacacucugaaaaaugauuucaauugucaguaacccccuuucgagacaacaagagauacaacaagggauagaggaaucugagcagguggaacuccaguuuccacauuucaaacaaaguagcuuucauuuuauucauuuucuaauuuagaaaaagaaauguucuaugguaucauaauguuugagaacgacuaauguagucugauacccugauuuuacagaugagaauacugagucccaaaaagggaguugaguuguugaguuuauuaccagugguaauagcagagcuuggacaaaaaucuggugcucacaguucugccauccauuucuagauuaauggugggaaagaaaaauuaggaugcacagucauucuagaaaacaucacaaauucccucgaccugaguagcaugaucucagugaaaggcacagaaacaaggcuagagaugccacuuuuugggucuugguaaugcaucauggaagaccacauguuaggaagaaagaacuuuuaugaagaugcaaauauggggacagauugcuauuuucacaccgacggcucuguccaaauucugucaagaaaaguaauugaacaaaauauucuauuuuuauuuagcauaaaaauauacaugcacacccagaaaagacaggaagaguggauuuuaaaagugcuaacagugucggggcaugagauuucagugagaucauagcuauuauuuuuuccuuuuuugaauuauguauuuuccaaguuuucuacacugaauguguauuauuuuacauuuaaaguguuuuuuauuuuguagguuagacauguaauauguauucuaacagcaaucuuuuuuuaccuucaaguuuaaugaaucauaaaaaaauuauuuucuucagaagaaacuuuuagucauugcuguauauugacuuuaaauuucuggcuuaguggaucacugauaacuaaucuuauucccuuaaaaaguuuuucaagauuuaucuuuuucuaaagauuguuuuaaaaacaaguggcaaagcuguuuuccacuggugcgagaauuuugguuuaacauaaacuagccuugcaugaaggucuaacaaaaucccauuuuuguacccuuaaaaguaccuugauuccauggugauaguuuuucuuccacaggaacccuucuuaccaaaauucagaaucaauuaaauguucucuuuuaggagacagccagccugggggaauugugagucuauguaaagucuacauauuuuacauuuaaaauguuuuccuugucccaaaauucuuauaugggaaguuuacauguauuuacguuguuguuuaaaugaaaaucaucauugccauugccauuuccaaaaggacuguuuaaaauauuggcaagcgucuuuuuacaugugucuagaucugauuguaauucccacuuuaauaucagcaggcacagcuguuuggucuagaaauggaggacaggccucaucgucuccuaauuaugaaggacccuuacacucuuugguaugucucauuugcuaaucucugucccacccauuuucaggucauguucuuucuuguucagucuccuuuacucuccaagauuuugauuuucccuguuaguaacuuuaagucagcauuaagcacacagguuugcgggagccagagucauuagccuaugcuugcuccuauuuggagaugggaacccagauacuacuguaauggcagccccagggcucuaaauaucuaguagcagauaaaauccuggaagggcaauggccuucuccccaucucuaggaaagaucccugucaaugauuaaaucacuuuccugcuaucagagugcuggaacuccagccagguccuauaccuggaacauuugauucccucuaccucugcuuuacuuuccagaauaacagguuuacaggagcuuuccuucucguagaaacccagugguauccuucgugguagagaaaugccuacucuuccaggagugaauugcugaaaauuuccauggauguaguuaauuauuauaaauacucacaugaugauucagugucugacacuucagucuuucucuccucaugauggugggggccagaaauaugcaggaaacaaugcugguugugcagcauuuaggcuguacaugaauuuagcgggaaggaauagcaguaagggagaggagccuuuuaguuccucgggguugagguuuucuuuucucccuccuaucuugagaugacacauggaagaagacauagauuuaucuaucugcuuuaguguugucuuauauucuucccuuucagcuuaaucuuaaggaaaaucugaaaagaaaagcaaagguggauuucccuccuuugcuguguucuuccuugcuauaguguaugaaucauucagcuaugcauuuuaaccaguaaaggaaaccagacagugaaacauauaugcacuacccagcccaauuaaucugcggaccacauccacauaauuaguuguuuuaguguuuaccuucaucaguuauucucuggggccuauucaucaaaaccaggcuucguccaacuauagaacuguaaagacgggguguauaguuaugggccacagcuuccauucuguuugaauucugaacacugaagaagagauuuacaagcagaaacugcugucucuaccaggaagcugugagccagaaacugugauaggcacauguaugauuucuuuuccugcauacauuuacacucagaaguaaguauguauuaucauucccauauuuauaaauuagaaagcaugcacuccaagagguuuaguaacuuuuccaaggccaaauacguagcaaagcuagcagucuaggggagguaguuuaacucccaaacccaccaaaucagaauguucuguaccauagacuacuauauuagacacacauucuuccugucaguauaaaauagaaauguuuuuucucaugcaauagagcugguacacuuguuugcacagccgauucaaaaucaaagucaauuguagcaugaucuagugcaaagagucacuagauuuaaaauaaaaagaccuagauuccaacucugacuuuaccauuuccuagcagugugacacuacguaacuaauucacuuugugucuuugagccucauuuucaugucuguacggaaggaaucauaaugucuucccugccugcccauacacacgugaaacaaggaucaaugagaugguauauuuuaaaguguacacuggagagugguauuugauaucauuauugaucaguuuuuaaaaugaauacauaccuuuaaaaugaauacauacauuuucuucacuaaaaacuauacgcauugucuaguugugaaaaacuagaauccuaauggcaaggaugaacaaagguugguugguuuuuaaugguuuaaaguugcgaauucuaugcuauaguuggggcuuugaacucaguuagaugcccccagugaacaguugauucaaguguuugugauucuucagucuuaaaaucuuauacuacuuuaguugacagaauuuauauaauuuuuuucuguaaccauuuugaggcccuuacacgcauaccaccacacacccacugguuuugaugacaggaagccagaaacaccgguaaaaacucaacaagaaauuaucauccauuugcuuuucccugucucugauuugguacuuagcacugggucauauaccacagggaagaccaaagaaauauaccuucaggaaaagaauuuaauuaagaaacuauaaauaggucaucuuuccagugguaauuguuuaaaacucuuuaacuuaauaccugccagaaaguuccuuaaauucagugaauguuuuucucuucuaaaauaaauuuaaauugccuuucaaaaggcaguaccguauauagcacauguauguuauaauguccuggaauaauuauugaauuuaguuuguucaugaaaaauaacacuauaauuuuaacauuaacacguucuaccaguuuucuggaaacaacacuauuuguauuauuguuuuaaggaaauacauuuuauuggaaacauguauuuagaaacacaguguguuuuuugucgacuaaaauuuuacuuguauaauuuaggcaccccuuuugaacuaaaucaaauuuuacaucauuuguuaaccaacagcaaagccgaauugaagaucguuuagaaagacuggaugaugcuauucauguucuccggaaccaugcagugggcccauccacagcuaugccugguggucauggggacaugcauggaaucauuggaccuucucauaauggagccauggguggucugggcucaggguauggaaccggccuucuuucagccaacagacauucacucaugguaagugaugaaauuuauagacucuauaguuaucauauagaguuagaauuucagauauagauacuauuguugcuguuuuuuaaaaaaucagcuuuauugagauauaauucacuuaacauacgaugagcccauuucagguguacaauucaaguguuuuaguguauuuacaagguugugcaaccaucaccauagucuagguuuugaauauuuuugcccccugcaaaaagaaaagaauccccguugcccauuaagcagucauuccccaucccuccacuuccagcccuuggcaaccacuugucuacuuccuaugucuauagauuuaccuauucuggauauuuugaauauauggaaucauacaacaugugguggucuuuuuugacuggcaucuuuuacuuagcaugacuguugcaguuuuucuacaguuugccacguauuagagcuuuauucauuuuuauugucaaauaguauuucacuguauggacauaccacauuacacaguuggguuguuccaacuccuuggcuaugaugaauaaugcuucuauaaauauucauguuuaaguuuuugugcagacacauguuucccuugaggaugaauugcugggucauuguugguguuugaaauuauucauuuuggugacccuggccaaaguguacaauuugaguucauauuauaauaugacauugcuaguaauucaaauauuaguguuuuuuuuuuaauuaaagaagccaaaauagugucugucaauucugagucugggagauagaaauauaugguauguuuauuuguauaaauacauugcaugugacuguguaauuuaauagaguagcuuuacuacuaccuauuuagaauaagucuuuauuugaauuauauuuaagcagauuuguccauauuacaauugugauuuuuuuccucauuacuuuugaaaggauuuuggagauaauucuuuuugaggaugauuaugaagauucagagacucuucuuaauagaauauuaagugaugacaauuaaugaggugaccagagugguggagaauguaacuugaccagugauucucuguaguucugauccucacaagcucuaccucgucucuaagcaccuuaguguccuauuuugccccuuacaggcucgcuaaaaguugcuuggaugaagguauauuuuccauuaucacuguagcauuucucguuuaagcauggucccaaaaggaaaugcaaaauacauacaaauuauuaugagguucuuuuaaguucuugcucaguaguauucuccuguccaucuuucaguuucucuuaauaaaagucuaagauuaagaguaccauucugaacgguguaguauugaaaucugcaaccaauuugaaaccaaaaauacugguuuauaaauagaagcaacgaacucacaucuaaaauguggaaagauauuuuugaaugccaaagagaaaucuuuuuuucuuucccuugaccucugcccuaaaaauucaucauugaauaaaaauuguuuauauguucauggcaguugcuuagaguuuacaaaagaaaagucuagauuuuaauuuagcuuggccucagguaauguguuaaauacacuugggaugcauauaauaugagauuuucguuuguacagcucuuuuuuuucuaacuacaauguuuaaacauacugcuuuuaauuaagaaaucuggcuuuauuaaaagccagaucugugacuuauaaccauuucuguauaucugcucucaaucaacagaaaaauaguuuaauuucuguagcuguguucauuuugcauauguuaaacggauguaacaugcacccagggcauugcuucagagacuauuuuuuccauaaauauguaaaguuuuucuuaaauaccauauguagguuaagugguucuuuuaaauauuaaacuauacauaaauacuuuuggggacuauuugaccuuugaauugacuccuuuuugagucagauucagaggugggaugggaggaaaagacuagaauuauuuuuggagaugggaaguuggacugaccucaguagaaccgaaagugagacgacugaauagaacgguagaaaaaaggaaauaauuagccaauauuacauagaaaccccuuuaauuugaucuugauauacacacacacacacacacacacaaaagcaauaaagccgccaguuuugcugauaaggauaaguuccuguuuucuccucugaagacauuuaauauucaaucaaggacagccacagagccaagcagaucauagcguaacuccaaagauauggcaugucaucacccugcugcccuuugaaccaaaugggguuuugcagucucucuccuuucuuccugaaaaccauucaacguguccccagaaucugagcuccucagccugaaacacuaaugugugugaaaaggauugguuuggccuaucuuucccgugcaaacugguaugaauuuuaaaacaaaaacauaagaacaaaggaaauaguuuuugaauuuaaucagucugaaguuagccuuugaccauuugauacauuccacaauaaaaaggaaguuuaaggggaaggcaaaaaaaaaaaaaaaaaaaccucaucccccuuccccacaacaacaaaaaaauucaaggaggauacugguaauguuuuccacauuugaauuuuaauacaugaaacaggcuauaaaacuuuggccagcugcaguaaauaaaguagccgugggagguaugcaccggaaacuucagcagagagcacuggugagagucucauucccaacuacacaccuucguuuguuguucugggcggaagcgaguugcaguaacuugauacucaucccagucccgguuuuguauugagcacaucgccuuucuaacucuccucaguaauuccuucugauuaaagaguagacagcucugaauccucucgaccuccguacgcuucucauuuccuuucucccugccuuccaaaaaucaaaacaaaauggcuugauaacuuggaaggugauauaagcauuucuuucugcagcagcuugaaguugugguggggaaaacugugguucugccucggcuguuauguuaucucauuuaauugcuaacauauuguccuuagcuuuugauucauaaaauguuuuccuuggaguucugaaguaggucuucagugauuuacuaaguauuaguauaaugaaagggauuuuuuuuuuucacagcggcauggcucauaacacaagagcgaauguuuguauacuugcaagcucucuggaugauauuauugagcuaugcuuauuuccugcucaaaaaccuucccugccuuuccauuuucuacaagauaaagaccaauuccuuagcucagcauuugaagccuauuaccauuuaccgaaagccuuauguugagcucuuccaaucugcaacaagucuuccagcaagacaaggcugggcauauuaccagaauucacccuguauguucuccuucggaacuuuuguaucucuuugucuuguccagcccuaucugcuuaucucuguacaccuaauacccacccauucucaaagcacugacucaaaucauucuucuuccaggaagccuucccuugcuaccccacucaugcuagccauuuuuuucucuauucuuacagcccuaugaaucauaccauuucuagauauuuaucuuaaccagcuccgcauagcugugcaucuuuuauagauaugacucugccuuaccaacuguuguaaauuccucgagucucacauauuauauuuugucucucuccccccgaccccuguaaauagaucauccauagaaacgggagaaaagaaacgaggaaacuuaacauucugugagugugaguuggcagccccucugcuaggcgcucugcauguguugucuuaggcagucuucacaacagcccagugaggaugauaauaguggucauuucaggugucgguaaagugagccuuagaaguuugagcaguuagucucaaguccugcagcgggauuuaaacucaagcacaucaacuccaaauucaaugcucuuuuuuacuaccaggcauacucuccagagauuaucuaugagaacaccuuuucagaacuuauuuuaaaugcuaggagcuugugauuuucaaaacuugauaaguguugguuggcaaaagaaguuuccagguauuccauggcuggguucccagagcagcucucuucccaaauguauagacagagaacuuucccuccaaagugguggcaugcuuggauuaaaacccacauuaucuaugcacuuauucuuaaaccaacauguuugcgcugagugccuaagaggugugaacucucccuaccaggguccuugagguagcaaauuuuaaguuaucaaguuauuuuucuuacuauaaccacccacuuuucuuccaaaauuaaagcagaaaucucugaaugugggagaauaaggaaauagccaggucuucacuacccuaguuagaaacucuuaccaaguaugauucccucucugccucagagaccuccaugauuaauccugauauuaaaugauuagauuucuuauaaauuauggaaagggcaauuuuccagauagaauucucucuguuacucauucaguauucacauccacagaugaggccugaaaagaagcguuucaaaugaccuaaccgcuuuuuuaacugacuaagaacaaaacccacaucaaacuugucuuuaugugacucuauguguucccguuuauuuguugguagagucagcaacuacgugaucauugagcuaaaaauccccucuacuauucauauaucgcauuaguguagcucucagauccuucuuguuuaaagucuauuuauucauuucaauaacauuuauccgugguuaccaaguguagguucugugcucucaaggaauucacaggcuaguaggaaaagauguguacuuaagcagauugcucccugccagucugcuaugcccucuaaaagaccaggggccugacccuuauccaguagugaaagaucacaugguuguuuaguagaggaguggucaucuccaguugacuuagggaugggggagucaugugcaacucaccccacacaccuguccuccacagcaucccuucagaguccugcaggugggggauguggaacccauuucagaaaucaccaauaaaaguggaucuuugcccaguuuuccucuuuucaguaacaauuuuuguuuuacuuuggauuaaaugcagucuaucaaaagagcauuccuuaggaaaagugguaucuuuuuauuuaacugacauuauauacaugagaacuuuuaccucuuagggcuucauaggacaaacaacuucaguuaguuuuccuuguauaguuaagagcucagaccacugaauuuuagauucuaaaaguacccuggaaaucagcccauugcccuucuuugaagacuaaggccuaggaaggggaagugaccaaaccauggguacucacuaguagaauuagaaaccagacaaaagaggcuggacacgguggcucaccccuguaaucccagcaauuuaggaggccgaggcggguggaucacucgaggucaggaguucgaggccagccuggccaacauggugaaacccugucucuaccaaaaauacaaaaauuagccgggcaugguggugcacaccuguaaucccagcuacucaggaggcugaggcaggagaauugcuugaacucuggaggcacagguugcagugagccaagauugugccacugcacuccagccugggugacagagagacccugccacacacacaaaaaaggaaaccagacaaaacagcaagcagaccagcacuccuugugcuauauccuacacugcucagccgacuuccucuuuacccuaauaccauaaccauuucaaaacugugagugguagaaauuagaaaccauucuguuacucugacuuaacuaaugaaauccaagaaaacucuguaguuggcccuaggcugccugcaaugaguugcuauuuagcucuaccaguaauauuuggcaaaaagagaggguagugggcauugaugugauguggcaguuauugguacauagucaugggagcagcaggagucagaagauucuguuucuaugugggccucuucaacaaagauaugaucaacagaggcaucagcaucuucaguugauaaaguugauaaaauagaaaacuauuuucuaaauagccuguuacagaauuucagcgaagcuauugguggucagcaucaucuuuuaauagcuacuaucuuguuuuucuuuaaauuaggauauuugccuucucuaguguucugucaucucuccuaaucuccacaacuaucagguauuucggagagcagauuaguaaccucaacugaaaguuuugaucuuuaucaauuuaucaguugcuccucuugggcuuucacagguuuugauuccauaaaguucugugucuauuugagugcauacuucauuucuaagcaguuauucccauggacucucagggaauuuaagagauuaucucuacugaaaucucccuacagauuuccugccaagcagucaacaagucuugaucagccuccuuccuucaagggugacuagcuccaaaugcccacaaaguccauuuucaucaaauauuugaaaguucuuccuagguccagcccaaauuugcuuuuuucuacaguccuuauguuucugcccaauagaauugcccacaaaucaaguccaacaagcacuugagaaacucaguuauuugaagacagucugcugaguguuuuuucccucuagacgaaacaucacuaucuucaaauauuuaaccugaaaaaaaguuuggacucccugucaugaacuccauugcuucccagugcauucucccuaguuuagcaaggaugccuuuuucuccacaagaaccuuuuaguguguggaaccgcaaacugaacacagugcuuaagaaaggaucaaguggacuaggguggaucuaucuccucccccauucaguaccuuguaucuucauuaaggccaccuaacaauauccuguuuugcuauguuugaugcuuucauuguccugcugacauauauucaauuuguaaucaacugaaauccauaagccaccuaucuccccagucucauuguguacuuuuuguugugucuguacaaaacuucaugaaaccccauugaauguuauguuguagccucagucugauuccuguuuaaugguuucccugaagcccucauucagucacauacucugccaucucuguugcuggcaaaugugaugggugugacuaaugcccacaucaaagccaccaauacaauauuuucaggggaggggauugaccagaaggccaugaggcucaguguuacagacauucuuucuacacgagugcugucuucuauccuuugaguuuaaucucagcugguucugucucccuccuuauacaccguauggcccaccuuugcucauuuuguccguagcguugucacagaagccgggcaugcagcacucacugugaagcaggaaaugaggcuuguccagaaugccuugcucugguggaaccaaacugaguuugagaggccauuccuguguuucagagcacuuucaaaacuauuuucuaaauacccuguuacagaauuucacccaagcuauugguggucaacaucaucuuucaauagcuacuaucuuguuuuucuuuaaauuaggauauuugccuucucuaguguucugucaucucuccuaaucuccacaacuaucaaguauuucggagagcagauuagcaaccucaaccgaaaguuuugaacuuuaucaauaucauacuuuauuuuuuuaaaacugaaaaaaaaaaggacagaaagguaaaagaacuugaagaaauucuuuuagccauggaugagugauaacagcugagaauccuugagcuuaccauuugauauuucuauauuaauuuaaagaaaagucaaaagauuuugaaaacagcaauagaaguaagauccuuuaagcucuauucagcagccccuaagaaaagugaugaggacacugugcaugcccauaugugaacaugguuggccaccuuagguauuuccccuucucuccacaugaauacauauuuuacucaaauucagacucuaugauguugaaacagucuggcauuggauguuuaccucaaaacccugcucucucugcaccuaggacaaacaaauccuaguucucugguguuuagcaucuuggagccaugaauuuuaaauaaaucaaagacaaaaaccuugucuuucccaguuuuaaaauauaaaagauacacacacacacacacacacacacacacacguguauuuaaaauagacccuauaaccucaucauauucuuacauccuuacaugguuuucuucuuaaauuguggaggaaaaggcaggcagacacauuuaauagcacagugaucaucauuuuuuaaaugaacuguuacagggacauaaucuuaaacuauccauaauuuggaauaggcacaacugugcauuuaaaaaaaugcaauauuacccuuauuuucucaggaaagcagauuuucuggagggaaaaguauauauuguauauauuagaaaauauacauauguucauucacucuuucugcaucugcugugcuucagaugcuuuuggggaugcauaaacguguaaaagaaaguaucugaucuuacaggccuuuuauccugguagagugauaauacaaauaugggucuaacuauaaugcaagguagaauuaugaaaugaccuaaggagcaauucagaccgcuaggaaaagcuucccggagaagaugccauugagcucauauucgaguccacauagaauuucaacaauuagagacaggauagaaaaggcguuucagagccauauaauaaacaugauuuaaaaccaaaaacagaaaauaaaggcucaugcaccuaaauggaaguaagaaaacugccugaugauaccaguccuugcagcuugccagccagggcugcauugggugaaaagccccuccacagcacggcagcuccagcaguuggcucgaauauuucacaugagaguccacaggaagagcgagcuuucauguauauuuuuuacauccaaauuaaguuaacucauggaauuuuccacccuuaggaauuaaaguagcaacucaugaaguaauucaguuaugucauucauaccaaaacagaaaauacuggagcaacuuggcacuguuuaaaagccaagauuaggccuuggccauuuuauauuuuuucacauuccauggccguuguguuauuuuaacuuuuauuauggcuguaaauuuuucaaaucaaaaguaucuuaauugcuuagaaaacagaaguugaaaauggguucauaguaagaagaggguuuaggcaaagcagcuuuaggagugagaacugaaaaaaagcuguagcauuacauuuucuguaaugcgaggguucuaccuauuugguugacauucacaguugugcauaauuauagcuuccucuauauccauaaaucaucuuagaacuauaaaguugaguuuaaccaaaagaucuguccaauauuagugaaaugacaucuuuagggaagcauuguccugauacaauagccacauucauuuuaaagcaguuaauuggacacauugucaaaaaccacgguauugaguuuccacauuuuaauuucacauuugccuucucccuggcuucugcacacggacgggucucuuuuggagcugaaagugugugaaaguuauuggagaaugguagucucuggguaauguuucuguaagcugcccaaaauuuucccccuguagucuagaugggaaacagcugguauuuguuuaaaaagcuguuuugcaaaaugucuaaaccuugagauauagaacugaggucaccauuaaagcaggugcuuaagagcaagugagaaagacuucagaggccgacuggcucuggaaucuucugcagggcacuuccuauuagaagaaaaaguguugaaguuugcuccuuuauuuaggacacggcuauaaguauuaauaaguaagugcacuagcaauacuacuagaaauugaguauuuuugaacauagccagcccucaagugaauaauuagcucaguaugaaaggaacuaaaauggucauuuuucucacagggcuucaagauacaagagcccaaggcgcucuagucuccuuuggguguuugaauuuccucuuuaaacacaccaacaguaaaagaacuacuauuucaaauaagcaguaccauaacugacuauaucuuccaagguuuuggaugcaaucuaagggaaagggggaaaagagacccgacuuggcaagacccguaccgaagcagucuggaaaaaaagcaaagcaaaaaacauguggaaccacuaaaggccagugcacgucagguauccaccagucugaagaugaaaggaaguaagccuccuccccugggagcuggagguuauuagcagcuguuuauccagucgggaauagagauuaacauuguacuuuuuuuuuaagaacuagaagaaaauuuguuugggaaguuggcuuuucauaucaagucacugugcuuugccaaaaaaaacuuccuuucucagaacucauguacuagcauugagcaauguuaugauucucugagaaacucugaauuaccaaaaagucuuucuccauuaaauagaacagaaaaggacagagaaaugggugaacguuugccauugacacauugcaguuguacucuuuaccaugugaaauuugccguuuggucuauuaccuguucuccaaccugacucuaaaugggacacucugcccucuaccccucacacguacccucacaacuuaaucauugccacucuaaggugcacacaauggguucugcagauaccuacugcuugcaaaaagaccuuucaugagauauuggggaaacugccuaguacucugggugcuuuauucucaaaaaacaaacaaacaaacaaacaaaaaacgaguuggauauagguauuuuuccccugauuuaaugcuacucuuaaugucauuuucuuuuauuaaauccuuucuucugcuuuugaucuuauuuauagcagagccacuggucauauggaaacuauuacuguauagcugcgagaugaaagacuucauggcaauuaaauaagagugaaucauuugggccaauaauacacacauacagugagguaccauuuguguccaaaaugcccuguguuguucacuuuguagcaaagccauugagcuuuacaaagggcuuuacaaaaaucugcuuuuugucagaaauauguagucugacaauaugaaaacacauguuaacacacaguccuuagcugcuugcuucuucacacauacacaguaucuaaaucaugccacuuauugauauaaaaugaaauuuucacuuaaauuugggauauuauuuaguuguguuaagcgucagcucuuuaaaaauauauuuggauaaucuauaucaaaauucgacccaucacucaaaaccugccuaaaaugucauguucuucuuaaaguagucccugguuuccuaaacggguaugacuucaucauuuuuuaaaacccuacaugaccuuguacuccuuuaugacauucaucguauuuugccuuguauaguaauauuaucccaucauuaaaauaucagugccugggcuaggcgcggugguucaggccuguaaucccagcacuuugggaagccaaggcgggaggaucacaaguucaggaguucgagaccagccuagccaacauggugaaaccccgucucuacuaaaaauacaaaaauuagcugggcguaaaggugcacgccuguaaucccagcuacuggggaggcugaggcaggagaaucgcuugaacccgggaggcggagguugcagugagccaagaucaugccacugcacuccuuucugggcaacaaagcaacacuccaucuuaaaaaaaaaaaaaaaaaucagugccugcaaagucauagacguguuuauuuuuccuugcaaaugcccauguagugccuugcauauaguacacuuucauaaggcgcuugucaaauuaagugaaauguuuauuugauagaaacaugcuaaauguauauuuggcaauaucaaacaauuaaauuucagacauagucucacagauccauagcauuugugucaucauuugcuaagcaucuaacugcacauuguacuauuacacucccgugcagugaccugugcaguuccuguccuugggaugggaugcccacaaauggagacaaguauaggcuuuacgaauggcagcaaaacaaacuuauugaaguuuaugcccugcaccauucaacaaugaccuugaauguguuuuaaggguggugucuguaaugcauagugagcucgugaggugacaagaaaguggagauuucuggagauccacucagcccugaagggucagagagugaggggaucugugaggcuaauaaaagagaagcaguuggugaguuaggaggaaaaaacuagcccagcagacagagcagggagggcuuugcucaagccuuagugaugugggcguuaacccagcagaugagaggccaugcguagguaauugaacauugauagugaggaauuuaaaaauaggagggaacugcauugguccugggagucuaggugaaggaugcaucagcacaagguggaccucuuagacuggauccauacagcaagcaagagccaggcugaagccuuaauauugcaucaacugauggagagagaauauugcauuuaaaagaugaguauuuggaaagugauggggaagaaaugguucauucguuuaggugagcuucuuuauacuucuacucucuuuucaaauauauuacaguaagcauguguuacuugaauaacaagaaaagcauuuaagaaauaaaggccaauggguaaugguaaaucccuagggauccuuagggaugggccaccuggacuggcuaaaaacuguguggaggucagcagcaugacugugcacucucacagguaugcuugcacuucaggcauucagaauuccaaguguaaaucaaguguccaguugucuuuuccuuuaaacaaaagcuguuuacacauaauugcuagacuucaccauauucucugugcuagauauguuugguucacuaggauggauuaacuuuaguuccauaccaucuacuuacuagccugcuauguggagcaaggaagagauagaggaaugggcucuguuaaucugccaguguccccgcuaggugagcucucuccaguuaugguuuccacuguauaggaaaaugaugucgagaauugagggugugggacacagaagagagaaaugaaacaguuuuaauagauggaacguaugaguuaguacaagaaagaugaacugaggucggcucacauccguuugcauuucuugaacuauaucauagaaucauucauuuaaccauuuuggugaacauccaggggaguuucagcccagcugaucauaugauagacaagcacugccaaggucaggaucauuuagaucauguuuaaauccucuugaaaauuacuuuauuaucuggagaaucaauauuaaauaaaucuccaagaauugcacaauaaggaauuaccuuacauuucauacagaacauaagagaagcugugauguuucuggaaaacaauguagguguucucaagacaguuaugaaaucuucucccgacauacauguuaagaaucaaguaaaaauccaaacaaaagaauugaauccagaucugauguuaaugaaaagucucuuaaagguuuaaucacauguacuaaagaaaaaucaucugauaauuuuuuaaacugagaaauauggaaauuauguuugugguuggagugucccagauguuagcucuuucucccacaacaggugguuauuagagguaggucuuguuuucugcagagccucugugccucuaguguuguuccucacaguaucuaucuacugcugccauuccaugaacuuccuaauucccaucugugagccauuaaaaaaguuugcaugaccgcuucccaccucuuuaaaagaugcacuuuuguacuaaaugguguuuugcacauuugagaaaauaaguuugcuuuccucuaauaugacagaggucuggcaagauaauugaaacugaaaucuaguacucuacaacugucauguauaauugauauuucauggggagauuacaguucagacaccaaaacuguuuucuguaucaauggguuucuaauuacagugaaaacccaucagcuuuucuuuuguguuaauggaaaaacaacagagaaaaguaacaguaaguugcaguuaccaggacuucugucuuugucccauuuuguuguuguucuucuuucuaaaaaccaaaaaaaucuauguccaaaauuggaaaccagaugccauuaauagcaaacuuuaauuuugauguaccaaaauguuuauaauaguauauccaguuuugugucauuaucacuuggucuagaaacugaugacaaguuuccuaaaguucccauuguauacucuuuuagaaggauuaugguagaauagaagugacugaggucugaaagccuguuuugaagcaguuaucucuggagauaacauuaacuaggauugaauaacugccaaaugaaauuuaauacauuuucccauccaugaaauaggccucuuaaauacaacagaauaauuacuuucacaauacucccuggaaacaaagagagcaaaaauauugaaugucuuuuuuguuugugguguuuguuguuagcuagaggauaaggacaaggauauuuaccacaaugcugaaugcaucuccauauaaaaacagccuugccaacagccaccuaauuugaaucugcaugucuuuuaaaucuguuuauguuggagggaucguggcaaauauuaaauuuuauaauuuaguuagacaucuuggccuuggccugaguuaaugaacuaugauuuucccccugcaauaaagaaaaaggaaaugauuuuccucuaucuauauauguacguauauauauguauguuauaugcuuguaccuagguguguguauacauguauggacacacacacacacuguuuuaaaacaaaagcucugggaaauaaacgcaucuugcccccuaacucuccuccccucuccuauauaauuguucaguguuguaaguuuucugaguucaaaaucuguuuuagaucuccaacuaagcaucgaaaguuggaucuuaagucacuucaccauucuuggccuuagcuuucuuuguaaaaugaagaguuugaccuaacugauauauaaccaagguccuccaagcccucgacgucuaaguucugugauuuaaaaguguuucuaucaguuugucaagcccuuucuuggaaacuaagguuauuuaaaauuauauggugcuuacgugauucaaaauaauuauugcauaucuaaugacauuuaauuauuuccauugacaaauucacacaggagaauucaaauagcuguguuggaauuugaauauaauuugaccuaagauacaauguaacucagacauuuacaccuacauguaccagucaauauguggacgggacaggccaagccgccuguguuuggacuacaugaucuuauccccccuuccucguuuguagcucucuggaccgggaaaaugccugucauuaagguggcccauucauaguaugaccuaugucugcuucaaaaugagcugggccauccagugaucuuggcauucugagcuuagaaauacaaagacaaagaggaaauuagcaggagguacagaaccagaaagaaugcaccaagagguaucaugaagaaagaguccaaucugucaucaugagagggcagaagccagagagaagcagagguccccccagagagaggagagaggcugaauagcccagcagaggcgaggaguggcauucgguucccaagagcucucugaguccaaaaccuaagcuacagaaaacuauuuaugauaaaucuuuuauuugaacaaacucaaauagguuucucuuccuuacuauuaaaacuaccccacuaaauugaucagcauacaaaaauccccccaagaaucauuaugaguuccacaaaaaccaggaccacaucugaguuauuucucauucuauccccagugucucccaaagugacaggcaugagcuagauuagaaaauguuuguuaaauuaguaaaugcauucucugaucaaucaaugaauaaucauugaauaauuuuuaaauuucacuucuaucuucuauuuuuagcauagauaucacuaaaacugcauuauacgugacuaugggaagauucacauuuacaaugaguauuaauaaaauuuucauaagcuggcuuuuaacuuuagacuauuguuaucucuaugaaaagguuaucaaaauagagcuuuaacgaaguauggauuuucuaaaaauagggacgaaaugucaugcuuagaauugacuugugggaaucuccuuucuccuagucacauuaugacguauuuaaguucagaaugccaagaucauuggaugccccagcucauuuugaagcagacaugggucauucuaugaaugggccgccuuaaugccagugggcaaaucccugacccuuguauauacagagaacagugugaguuucuccaucuauuucuguguuauucuagcgauggauuugugccgacaguccacuguguuucuucccuugucucuuaugugaccagaaauaauguuucugaaagagaagaaaacaggguuagaauaugccaucuguggccaaggaaacaagcaaagccaagccaauuauucaaauuggaauacucuuccacagccacaggcaauggaguugauccuauccuggagaaucaagcucauuauuacauggcucuggaccuaucagagggcauucacaugaccuggaauagacacaaggggagucuuaaaacaucacgacaaauuagccggcgugguggugggcgccuguaauuccaguuacuugggaggcugaaacaggagaauugcuugaaccugggaggcagagguugcagugaacggagauugcaccccugcacuccagccugggugacagagcaagacucugucuccaaaaaaaaaaaaaaaaaaagucagaacaacuuugucucuaacauucuuuauggaaaaugauugauauuauuuaagaugaucuauagaaaauagauggaguuagguaacauaugggccuaaaauccaaacaaaaauguaguuggaacaacuauauccucagauauauuuauaauauuuaagaguuuacagucauuguauaggggaaagauuuaaaauuaaauggauuuuaacaaaauagagacaaagaucaccguaacugaagauagcuugaguuuugaggggguucuugaacuacacaggcuauuauuucuauauaacaugcaaguauuuucagucaaaacacaugauucugucugcaguuauuauguaccuauuacauaccaguugucauguacgauugcauggguucucuuuuucucuuuugagaacuuaccucaaugugaucuagagggaaaaaauuucaggagcaguaacugaauauauuuuaaguaaaaagcaaaacauuacucuuaaguuaugucacagaugcuugcaaagaaaucuugagaguguuaaugauucugaaauaggaguacacuucuccucuaugcucaaaucugugguuaccuucagugauuuugacuuagagucauccuuuguagaaauucaagaaauuagauccauugggaauacaaauaaauaugaaucagcacgaagaauuauuuagguuuauauugauugacagacauaaagagccaccauuugaucaaggccuguaaaaauucaugcuuacaaguugacaucuuagauugaaaggauaaucauugauugaauccguuuucuaaugcaugaauauaaaaauagcaaaucaaaaccucaauggaaaauagcuaucaugcuucugaauaaaaauuaaaauauauaagagagugaguuacaaaugguugcuggagcaggugggcguggucugccuauaagagagcagacuucagucacagaggaaaggagugguguggcaggcaacaggguugaauauguuuaaaaaaaaaaaaagguuuguacuuaacgccacagagcucuagaagcugaaacuagaaucagugagugaaaucuacaaagaggccaauuugugguaaaaauggaaugggcuucuuugggagauaucagucucaguacauuugaagcaccccacagaggccaaauaaccaccauucagaaaguucuguguugcgacacaggcaccggggagcagugcuggacuuccuacaucucucugcugaaacauucauuuauacuuccugaggcucauaagccucaaguguugucuuauucuugcuguauuuugaauccaaacaauuaauaugauuuaugugaucaucuccacccaaaauuuaaaaaaaaguuggagugcauacacacacacacacacacacacacaugcacacaugaauauaaaaauggcauacuucaggaucaauuacuuaaauauauuuucaguaaaaagcaaaauauuauaggugauacuuaauacauggcugccuuuaaauagcaugugcuuauuagguccugugaauuuguuguugguucagauacuuauuguugaugcauucuuuggaaauacccuuuuaaaauauauugguaacacaagagugaugauucuccuuucugguuucauauuuuugacuggaaaaaaaaauaaaccugauucauagcaguauaaauguaugguuaauuuuuuguguuuuagacccaccguccuguguaaaugcucacuuaaccauaggcuaagaaaauacuuggaaauagaaaagaaaaugugaacuacugauuguccucuuaguugacaaaugcuucauguuuucgcuugaaggcaugugcuaugaaguaggcaguugcugucucagugccacaaguucaaugucucuggaccccagagucgauaguaguaguuaauaaaaagcucagcaguauuuuuuuaaugaaguaaucaugcuguacucuauaauuuuauucuuggaagcauaaagaguauuuacaauauggugucuuucuagggucagaauagugaggaaaaaaauggaaaaauguccaaacauccuuccuugcauggcaaugauggcauuacugguguguuuaauaaaaccuuuauugguacauuuuccggugugguggcauuggcagaaaccaucccccuuuggauuuggaacucagcagcugaugaaauacaguaaacauuaauuuggaaugggcugccaguuuuggaaagccaggugacauuuuauuauauuuguaccaagcagaggcugugucccauacugcuguagcuuccgcugucagaggcuuagcuggcauuauggaaaaaaaaaaauggcaggccugagaaucuuauccccugaaaugaaagucgaaugccaaauugaaauuccuguaggauuuccgauagcaaugggggaauugagaagcucacaauuaagcauaugggcauuaagauaauugucagaucuguuggcggacaugauagaagacagauggguacgaaucagugcgcuccacugcagcacccugggaggcaauuugacguuuuaccugccugagcuacucugccauauuugucacugaauguacagcacggcaucuuacugaguguuaaguguuuucgccgggaacuauaggugcaugugcgguccuucagcgcccucuagugaaacgcguuugggaguaugguuuuugaaaagccagccuucaucagguccucuuggccucuggaaauagcugucgcaccuccgguuccugcucaccucucugguuccucucgcccuuucagguggggacccaucgugaagauggcguggcccugagaggcagccauucucuucugccaaaccagguuccgguuccacagcuuccuguccagucugcgacuuccccugaccugaacccaccccaggacccuuacagagguagguuggccucaccagggcacuucugaccucacuuucacaauaggaccaguguugauacccagccucuugguguucaucccucaagaagcacuggcagaaacccaggaaucaaauugggcacaaaaaugguaaggaaauggcaaaguauuuagaacuucgcccgcuaauuguguuucuccagggacuguuuuccucaaacauccucugaaauccugguccuauaucagcagggaaugaggccacagacugaugagaggaaauuuuauuuuagcuauuuccacauuuuucucauucagguccucuaaugugguuaguuguggccugaaaaugauauuuccaaaugaauaggaaggaaggaaauuguuuuuguuguuuaagauggaaggaaauauaggugcauuuaaaaaauggagcuugguugcaugauuuucgcucuugagucaucuagcccucuaaugauugccucauaccggugauuacgagcggcuuuucaugaccccaggaaguugggcuauugcuggccagcugacuaggagucgcuuagauaacaucuucucagucccuucacauuuaauauaaaaaugauaacauugccacaggaauacaugugggcauuuuuucagcuguucaacauuguacagaucugagugucaauuauauguauggguaugucugcccauuuuuuaugaauaauaaucauuuuauggacuuuuuuuuuuuuuuuuuuugacagagccucacucugucgcccaggcuggaguacaguggugcgaucucagcucacugcaaccuccaccucccagguucaagcgauucuccugccucagccucccaggggguagcuaggauuacagacaugcaucaccaugccuggcuauuuuucguauuuuuaguagagacaggguuucaccacauuagccaggcuggucuugaauuccugaccucaagugaugcacccgccucagccucccgaagugcugggauuacaggugugaaccaccacaacuggccaggaccuuucuuaucaggaggcuuuggauuuugcccucuuuguccuaaaccugugcuucucaaacugcacauaagcacaaccugagcaucuuguuaaaaugcagauuccacuucuguaggucugggauuguccauuucuaaugggcucacagaugaugaggccgcauggaccaaaguuugaguggcaagguucuagaauacacagauuacaaauaaagaggaauacuugacagauaugcuucuaccuuuaaaaaaauuacuacauuagggucguguuuuaaaaugcagugugacuuggaaaguugagcaaugauaaagcuagaaauuucuaaaaugaguagcaaacugccuuccauauguaccauuuuaaaaugcugauuacuucuugagaauaagagaagccuaauuucagaauaucauuaggguaccuauugaagucuugacugcacauauuuagcauacucccugggaauuauauuuuaaggacauuuuucuauuaaaucauugcauauggaagaaacucaauauaauagcugauauuuacuuggguucuuaaucagaacauuggcugugugauuuucaugauuaugauuuucauugcaauuaaguugauguuuuguagacagugaaauuaccaucuacuccaaaagauugcaaaauagaauuuaaccuuagagccaaugcagggaaaacuuguuucugcaggugcauuuuuugaaacuucaacagauagcagggggaaaaaaaagugacagaaggaucacaguucagcaguaugaauugucugcuggcagccuugcaaucuggugugcaggcagugagauugugguguacaugucaccugauuucucuuuuucggcaggcaugccaccaggacuacaggggcagagugucuccucuggcagcucugagaucaaauccgaugacgagggugaugagaaccugcaagacacgaaaucuucggaggacaagaaauuagaugacgacaagaaggauaucaaaucaauuacuaggucaagaucuagguaacaguauauaauacugucgcuucauuuaauuccuuuauuggacuuugaugaagugaacagaacgggaagaaacuauucaguuuuuuccuggcagguaaauuuacagcugaaaagaaaauuaaaggccuacucuagaaguacuaaaaguaucguuucagauaccuguacucuauuggagccuaaacuguuuuggcauuuaugaaucuggacccaaugcuaaugacacacagugaaaaaauuugucucugauucaaguacaguuuauuuguaaaacuauacuuauucuacaaauuuggucagaaauguugugucuauaauauuucuaaaaagagauuguagccauguuaaaaacucaacugauguaugugccaacuauaacucuuuucuuaccucuaaaguaagaaaauaauuuccuagauuuauccuaaacaugcugauguauauaagaguaauaccuuaauuguuuaugguuuuucuuccuggacacucuuuucuacagaaaacacaacugcaggaaaauagcuucugucugguuuucuuaaauaucugcuaucuuuaaauucaaaucuauaucuccuugaacuuuaaucugguaaucagaugguuuuugaauaccaacacccguguacuuugccucaauucccugagguuguuuuuauucacaaauucaaccaauuguccuaagacuacagcuuuccuucuaaaggcugugguucucaagguucuaucuggaaucuuuugugaauuaagaacaugcugccucuuuauguugcuguuguaauuauugagauaaauuccgugucuugccacaaguuuaaaaaugccgaauacuucuagauaaccccuuuccuuccuuguugucuuuuucugauucuuggccacuuuggcaagaaaucccaaggaggggauuucauaccuuuagcagcuucuguguuagaccagucaguucuugguaauuuaacuuauuguggccaaacuuaugcauguuaauggauucuuugaaguuuuggaacaacauuuucauucgcuguugagaaccuucuuauuuaaaaaggucacucuuaugacauuuacuuauguaugccuccaaaacuguauuauaaggcagugcuuuuucaaaucuaggcaguuuuauuugcauaacuaguuuauuuguaagugaauaaccaauucuaauuggucguuagccugaaaaucuuuggaagaaaaguuccuauuuuccagucuccuuuguguaagguguagcauuuguuggauguauaaaaauaucacccaaaugcucagcuuccggacaggccuggcagagacuguuuucauuugcuuuuuacagccuauuugcauaguagaauauaggagugaauuaaucauuacugauuuccuuggcacuggcagcaguugggggugagggcagaggagggauccgcagaaggcagagaaagagggccuuuuccaguggacucaguugacuuccauguuuaccauacacaccuguggcagacagugccaucuggaaaggcgcuuacgcuauggagagagaggagccuggucuuacagcauccuucuguggugucauccuccuugccccuaacuuuucuccuucacccaaguguucuugacuuacgugcauuaucuuuauguguaacguauacuugcaaccgaagaauaccacucccacuuuugauugauuggagcuucucaaguguaauugguccuuauugccacuuggaaguuacccagagauucuccaaaauggaacaucagagucauauauuuuaaaccagcauucauuaaauauacauuuaauugaguagauaauuucccacaucuuccaacuccgaaauguugugauuaaucaucuuuauucugugaacauuuccaaugugugaaauuacccuuuagguuaauuguuagucacuuccauggaguuucuugugauggggagucuacugauguucagugaaguuuguuucauuuucugugucucucauaagccccccaaaaguccucacucauguuuauucacaauagucauucagagcuuuauagcacgugcugcucugccuucuugagacaagacgucgugcacacuucucuuuuuuacaugacagcccuuggaauauuugaacccugcugcugugacgacuuccucauaugauaugcuuuccagguggcucaucauccucuuugccuuccauucaaaaguuucuaauuugucacuguaacacucagaaauggacagaaccgaucuuaucuuuucagacuauucugggcccggccaugcauuuguuaugaaucauggaauauuuugguuuucacaauuagaaauuaccuuuuggcuuuuuuuuuuuuuuuuuuuuguaagagacagagucuggcuguguugcccaggcuggagugcaguggccugaucacaucucacuguagccuccaccuccuagauucaagugagccucccaccucagccuccugaguagcugagaccgcaggugugcaucacugugcccagcuaauuuuuuuuuauuuuuuguagagacgaggucucacuauaucguccaggcugggguuauaggcaugagccacugcacccagcuuucuggcuucauuuuugacucacaaugaggucauggucauucauaagcugcagguguuugguuuguugaaucguuuugcaugacugauaucaguucagguuucccaaacuuguucuguggaucauaaacaucuauaagauuaaagaccauggaagucauguuuuuguaacuuuuuguuuaauacauagagaaaaugagacucacauaguggguugaccaggccuucaaagcaagguaauggggacaccugaauaaaagccucacugucuucacucccauugcucuggugucuuacauauaggccuuucuucuuacuccuguuaagcugccuuguauuuuuuugaccuaucaaaaucauuuuucaauuacuuguuuccccuagauuucagaugucacgguaugaaagguuuuauauauauuuaaaaaauaaaguauaaacauaaagucuuuuugaagcgugguuaugcaacauaugcuaggcguaaguuggugaaugccugcuuugcagaguguaaccccauugaauaaaaaaagcuuuguuuucccuuucugccccccuguaucaguaugggcacacccugcacucuaacuuuaaucuacgucacccucaccuguuugguuuggguuuaaugucugcgagaaaaccaaauaucuuguguauugugaacugucaaagccaucuaaaccaaucccaaggucaaguggauauaaaaauucugccaaaaacauggcauaagauggaaaaguucccugaaaacucuggaagaaaacaaaguaauguagacaccuucuuuuuccccacaccauuagaaaauguugcaucccuuuugucccacagcaauaaugacgaugaggaccugacaccagagcagaaggcagagcgugagaaggagcggaggauggccaacaaugcccgagagcgucugcggguccgugacaucaacgaggcuuucaaagagcucggccgcauggugcagcuccaccucaagagugacaagccccagaccaagcuccugauccuccaccaggcgguggccgucauccucagucuggagcagcaaguccgaggucagugcaggccagccuccuugcagagcucgugaggagcuuguggcaggcacaagcugagaugggcacgccagucuugagcaguggcagacaguagacuuucaagcaucauuccaaagaauuguuuccauugcagacugugucuaaauccauaaggcagcaucccuuucuccuguaauuaaguugugggauucucuuauaacuaagauuauauugcaacuuucccuauauccuuucaguaauuugagcuuaguuuauuugcuuuaccaaccuuugcuuacuguaaaguggcuguacacacucacaugcaguucaccuuuuacuagugacugaccaaauggauugccacaguacuuaguaacuguuccuuuuguucuguaauauaaacacugagaaaaaggucagacacgcaagaagagugcauugcugcccucugccagaagccucagcauuaaacaaagguucugugcuuuaauccuccacagaaaggaaucugaauccgaaagcugcgugucugaaaagaagggaggaagagaagguguccucagagccucccccucucuccuuggccggcccacacccuggaaugggagacgcaucgaaucacaugggacagauguaaaagggcaaguuuguuuucagccauuucugagaucgaucauucaaaacucucaucaguguaucagccauaaaagugaauuucacccaaauugacagauauuuucuuucauggaaaaagaauuuuuuuuaaaaaaagcauacuuuuucuguuacaaauauauuaaugaauuuuuucucucuuuuuuccuuucucagguccaaguugccacauugcuucauuaaaacaagagaccacuuccuuaacagcuguauuaucuuaaacccacauaaacacuucuccuuaacccccauuuuuguaauauaagacaagucugaguaguuaugaaucgcagacgcaagagguuucagcauucccaauuaucaaaaaacagaaaaacaaaaaaaagaaagaaaaaagugcaacuugagggacgacuuucuuuaacauaucauucagaaugugcaaagcaguauguacaggcugagacacagcccagagacugaacggcaaucuuuccacacuguggaacaaugcauuugugccuaaacuucuuuuggaaaaaaaaaauauaauuaauuuguaagucugaaaaaaaaauauuuaauuuaaaaaaaauuguaaacuugcaauaaugaaaaaguguacuucugaagaaaacuacaugaacguuuuuguugguauucaagucagcuaguguuuauaauuacuggauauugaauuaggggaagcucggcugcccuaguaacaaaaccagcaaacguccugaugacaacgaagugaugacauuagccauuccuuaggguaggaggaacagauggaucuuauagaccuaugacaaauauauauauaaauauauauauaaauauauauuaaaaauuuagugacuaugguaagcuuuuguucauuuguuucagacuuuuuucuccuguaaaaaaauaguacugauuaacuuuuuuaaaagaaagauuuuacuguaaauauggauuuuuuuuuuuuuggucuuauuucugucccuuucccugguuuguuaucguaaccuguagugccaacucugcuuccagagggguagugcaggaugaaaugcugacccugauguugcuucucauucauaaauaaguagaaaguuguuucuccagucuuuugggaacacaggacuuaaaagucacaucauguguagauauuacaagcagcauuaccaagacauggcaaaaagaguuugucugaauuguaauguugcguuugugaaccuauucugggauuuucagagguacaagguuagaaugcuacaauguuaccacugugccuuccaauguuuauaucaucggaaacauaacauaaucaaaguggcugugauuuaacaaaaugauuaaaguguuaccuaccuguguagccgaaguagugugcagugaggcguuucugaauacauggucagauuuuuggaaaaaaacaaaaacaaaaaaaacaaguaaaguucaaaaaccgucaaaugagaaaauugcaaguagugugacagagcugauugauuuuguugcuuucuugauuuuuuuuuucaaaauggguuuacuaaaauguagaugacuuaacugccuccuccuucgucugaaaaaugccaauauucaaucaucaugcagcauuauaacaagccuuauaaguccuaaagcauuaaguugcacuuuuuugaggagggguagugcaguauuucucuggccaguaugaaugaaguuuauacuuaccauauuugauagaaacauagaucaagcuauggcacagcgacucaucagauagcuagcuuugacgucugggcacaauugaaccaacuuccaucgugaaucuuuauaaugauugacuuugguguauagugcaguaaacaaauagugcuccuaguuaaguauuugucagcauccuuuugucucuaacuuguuucuauuuuuacagccacacaauucuuggcauguauuaagaaaaaaaaaaaucccuguucaaguaguuuuuccaccuaucagcacugaguaaaugccauaaauccauugaaauggucuaaauguuccaucuguucuccuguuuugccaguuauauaguaaugaaauacauuuguaaauuuuaugcaacaaauggcaaacguaucauuauuuugaaauuguguauguaaaaguuauauuuuuacauguagacucuuguuauuauguguuuuaauacauuguaucaguuuuuguuuuuuuuuaaaaacugugguuuaaaaagaagucucauuuaaaugaaauagcuacaagaaucagaauuuuauguucauuucugaaaauguaagaacaaauaagauaguuaccacguggucaucuuuuacaaacccauaaacauuuugauuagcuguguguguguugaaaaacuguaaauauguucaguagcgauaaaacuaaaauaacuuugauuuguugauaaguuccuaaaauguggagguggauuaaaaccuuaggagaauagcagaaaucaaacuucaugaaaaguuauuuuggggcuuuccugugaaauguaugaacaaagaggcucagagaaggacauggaagacaauaauguauacucucuccuccucccugaauaaugaaaaccauguguauuuguucccuccguauguuaaagauuuccuuuuagugguacauucugcacucauuuuguauagucuaccaaggcggguaucccuaggaacaauauuauauaggaagcagguauacucugaucacauucaggauaaguguacagaagaaaauacgguguuuacucuuuagggaacuggaaacacucccugcauugauguacauuuuaagaauggcacuuuugauacauguuaucauaaaggugcuuaauagagcugaauuaaaguuuuucaaaucuguaaacaaagcaaaaaaguaaauuguagucauuugauuauuuuuuaaauuggugcuuuauauuuuguucucacucagaguaaaagcugcaauuuauuguucaccagcuuugauguauucauuacucaguaaugcaauaccucuauuguugaauucccuuuggaaauaagugaaaauucuaacggccacugaaagcugcucgcuagguuuugcuugguggagaaacauaaucugcaccuauccauauuaauuggguuguauccccauuaaaaaagaaaaaaagggaauguggccuuuuuaguguguuuuuuauuguuguuguuuuguaauuaucaaacccagguaagauauugguauccugcacuggauuuucaaaugaaguucagcagaagacaguuaagauuaaaguacuauacaaaaauuucaaaaggguccauacuacgcuaucuguaugacgacacuuaggcuggggaucucuuucagaaacucggacuuuaaaagcaacuuggagcaguugauccaccuccacauucaaguaauuuaugaauaugcagaauagggaucuguucaucuagaaauuuuuaccauuugucuucuguguagcugcaaggaacacuaauguuuauacaacugucaguccacccaguggugcaacugguucugauucagucuuccgauuccuuuuuauuuuucacuuuuuccuauuucugaauuuuuuuuuuuauuugugaucuugauuuugaugagggguuggggaguggggagggagucgaaccaagacuuggaguuaagaggauuuucaucuuuugcauccaacaggcagaauaugaucuguguccaaaagugaacuugagucaggaaugaaucaauuucagcauaaacaagcacaaaaauuuagucugcuggcugacuggaagcaaaaaagucaagauggaauaugaugaauuccaacacaauggggcaccaaggccuuuaggccucucuuuuuauuuugcuuugguuuuguuuguuuuucuuuagagacaugcucuuucucaugggacuugaaguggacucaucuuugugcagugcugguuuugccauacucauuucaaguauuauagacauauguaauggugaaaauauaugaacuguggccuuuuucauucuuguuacuugugaugcaauuaagugaagauaagaaaaaaaaaaaaaaagcagagauuuaccauguaucagugccuggcuuuuuguuauaaagcuuuguuugucuagugcucuuuugcuauaaaauagacuguaguacacccuaguaggaaaaaaaaaaaacuaaauuuaaaaauaaaaaauauauuuggcuuauuuuucgcaggagcaauccuuuuauaccaugaauauuacaaaaaaauugucagauucugaauauuucuucuuuguagauuuuuggaaucauuaugaguaaaaguuuguuacuuuauuuuacuauuuaaaagauguuauuuuaccauguguuaccaagaugaaacuguauggguagcuuuuuuguuuguuuuuuguuuuguuuuuguuuuuguuuuuguuuuuaguuguaggucgcagcggggaaauuuuuugcgacuguacacauagcugcagcauuaaaaacuuaaaaaaauuguuaaaaaaaaaaaaagggaaaacauuucaaaaaaaaaaaaaaagauaaacaguuacaccuuguuuucaauguguggcugagugccucgauuuuuucauguuuuugguguauuucugauuuguagaaguguccaaacagguugugugcuggaguuccuucaagacaaaaacaaacccagcuuggucaaggccauuaccuguuucccaucuguaguuauucgaugaagucauguacaugaccguucuguagcaauaaaugugccauuuuuauaaacuguuucugacacuuguuucauuucauuuugcauuguccauauagcuaugauucucuucuguaaguaaaacgcaucuauauuucauuuuccaaguguuggagguauugacagcuuaacaaacaaaacauacaaaaaaaaucacaaaaacaaauugaaaagcaaagcacaugauugaucaaggaagagaugcccuuaaugaaaauggaacgggaugcaugcaaaacaaaaagaaaacugucuagaggauuaacuaauugaaggaauauaauuaauguguguguaacacugaagcuaugcauuugaagagcucugaacugcaccaguguuuucgguugugcugcagguugcuaagucaagucagccuuaaccuuuugcaccaguuggucggcuguuuggcagaacauucucagaucuuuucagucaaaaaucuaagaugauuuauuuuguaucacuuuguuaaaagcugaauauuguuaacuacaguuaauauuaacacuguauuuauacuuucucaaacuacauccgccccaccacuucugguugccucuguugacuauuaauccagauguaaacaaccagauguuuuuuucuaacuuguacaaacugacgugugucaacuaucauggaaggaaaaaaauguacagauuaaaauuauucaguguuauguacuguaaguuaauauuuuuguagaauggacaucaaucuacuuugcaaaauuuggaggcuauuucaacauugcacuguagaaauguaaaguaauguaugcaauguaaaggaaagcccgcgguagcugagcgcuucauaacagaauguucuaaucaaguacgugguauuuggggaugucuccaauauugcucuuguauucuuucuaauuggguuuagugacuaguugaaggaaaauguuauaacgccauuugguucacaugugaagugcccuccauagccaaauguugggauuuuuuuuuuuuucguuuuugguuggacuguuugcagauauuuaaauuuuaugaaauuuccaaagauuuugguugauaacccccuuuuaccuucuaaaugauuugagauguucuuauguucuuacuguguguuuuaaauauauauaaaagagccacaagcauuu

SEQ ID NO: 6325 - RNA, 367484 nt, Homo sapiens; identical to SEQ ID NO: 6324

SEQ ID NO: 6326 - RNA, 366299 nt, Homo sapiens; identical to SEQ ID NO: 6321

SEQ ID NO: 6327 - RNA, 413663 nt, Homo sapiens
gugcagcauuccuuuucgaacagugcccauucucuugaugucuacaguaucaccuuucuuguagauuggcacuuaugcggccaaaggaacaacaccauguuuucuaaaaggcuggagaaaauagcacaggugccucuccucuuucccuucaucuucaucauuuugacaaauuacucaaagauggagggugcaguugaaagccagccaucauuuuuuaaaacuucucaggacauuguaacaugcacuuggguugagaacugcuacucgagcuucuccaggaggcccuuggagguaggaaccagcauuugggcuacuuuagcaucuuaguagaaacugaaaccaaaaaugaucucccauggccaccauggccaaacauaacgguaguuucuagcucucuaaccucucucccugacaucuccacagcacuuggccugcccucuugagagucuuuucuuuuuuucuuuuucuuuucuuuuuuuuuuuuugagacagggccucacucugucucacaggcuggagugcaauggcacauucuuggcucacugcagccucugccucccggguucuagcaauucucaugccucagccucccaaguagcugagauuacaggcaugcaccacaaugcccggcuaacuucuguauuuuuaguagagacaggguuuugccauguugguugggcuggccucgaauuccugacuucaagugaucuguccaucucggccucccaaagugcugggauuacaggcaugagccaccacgcauggcccugccuucuugagauucuugcugagacuguacaaggcguugacucuugucuaaucuuuugcacugcuccucugucuccuuucccaucaacauucuaaaguuggcugcuucucaguauucauaauccaugguuccucuuucucuccaagaacucugccagcauguacauuuauaaaaccacaucuccagcccuaaccacucucauguguuuuuucucuaauacaccuccauuuggaugucaugcuggcaucucaaauucaauauaucuaaaaaggaacucauaauuucugcauaaaacagcacccccuuacgacuuccuuuaucaaucuagcugccauuuucaggaucauuuuugguucuuccuucaacagucuauuuccaguguucaguuggacuuuucugugcaauaucacuucuacguaauuaacaucuuucaaguucagauccuaacaauuuccugucuagauuauugaaucagccucuugcucaauaucccucacuuuguuacucccuaccacaaggucauaaauacaccauugucaguuuaauauaggauaaaauugcaaucaugugacucacaacuuauugcucaaaacccaucaccaaaguacaaagcccguggcauccaaugcccuucaguauggcccaaacuaucuuucugaccaugcuugcaccuauuccuccacacuagaugggauguuuuuucuuuuugaaauggaaagaacauaaacuuugaaucagacagauuugguuuuaaauucccugcuacuucuaacuuggauaaguuucuaaaacaacaugagccucaguuuucacaacuaaaaaaacagaaacaaauauguaaaauauuauaaauuaguaaaagaaaaaaggugaauaaaacagagacauuaauagcuaauagaacuguuucauauaaauucuaguuuuuuuuuuuguuuuuguuuuuguuuuuuuugagacggagucucacucuguugccccaggcuggagugcaguggcacaaucuuggcucacugcaaccuccaccuccugggcucaagccauucuccugucucagccucccauguagcugggauuacaggccccugccaccacgcguggcuaauuuuuguauuuuuaguagagacgggguuucaucauguuggccaggcuggucuugaacuccugaccucaggugacccgcccgccuuggccuccccaaguucugggauuacaggugugagccacugcgcccagccuaaauuauaguauuauguuuuuuguuagauccuaaacuucccugcugcaccuggacuucguuguuguuguuguuguuguuguuguuguuguuuugugccuuuuuuguuuugguuugguuuuuagccuuuguauacagcuguuucuccuggcuaugcucuauaucaaggguugacaaacuauagcccacagaccuacuuugggcuuaaccgagacauaccuauucauuuaaguauugucauuaaguaugcuacaacagcaaaggugaauuauugugacagagaccauauggccugcaaugcuuaaaaaauuugcuaucuggcccuuuacagaaaaaguuugcccaccccugcucuagccucucuuucuuuacucaugcuauaguaucuccccagguauucuggguuuaaaauauguccacaaauccuccaacaaaacuaacuucaaaagguggagcccccauccccuugaauauaggcuggaauucgugacuugcuugcaacaaauaggacauggcagaggugucagugugugacuucuuaaacuaggucauaaagggcacuguggcuuccacuuugcucuuuuuagaucacuaauucuggaagaagccaacccccauaucauaaagacacucaagcagacuguggcgagucccacauggagagaagcugaggccuccugccaacagccagcaccaacuugccaggcaugugggagccaccuuagaagcugauacugcaggcuuggucaauccuuuagaggaacuugcugacuugcaggcccaguccacaucuuggcucaaaccucagaacagaccguaagccagaacuaucuggcuaagccacauuccaaauacccaacccauagaaacugugaggauaauaaauacuuaauguuguuuuaagccacuaagcuucagguuaauuucuuauacagcaauugauaacuaauacauaagaaaaccuucauuuaccauccacugaccaaagacucaaauauacaaccacagccuggaccucuccuaugaccucauaccuucauauauaacuaccuauuccacaucuguuccuagagaucucaaaggcaucuaaaacccaacaugugugagacuuuggucucuuucccucagacaggaucuuccuccaauauucccuaucccaguuaauggcauaaugagcuuaauccauaaacuacaacucuggccuucugugauacuucuuuguccuucacacccuauauucaauccauuaucaauuucagccaaauuaacuaauauguaguuuuuaaaucaggauguuacccuccagcaguacuauagagaugcucuuucauugucucuggcaucugcugaucaugagaagucuucuguaagagcaucauucuuugaagguaaucuaucuuuccuucugauagccuuugauguuuucugaauaaccuugagccuaaaccuggguuugcuuuuauucauccuaccuaagacuuggugugaucuuuacaaucugaagacauauagcucuucaacucucaaaaaacuccaucgucucccugaauauugccuuuugauucuugucucuauucccuguauaacaguuaggguccagucagacacaccaguuauguuaguagacaaaaauuaaccuaaagaacuguuggccgggcgcggugguucaugccuguaaucccagcacuuugggaggccgaggcgagugaaucacgaggucaggagauggagaccguccuggcuaacauggugaaaccccgucucuacuaaaaauacaaaaaauuagcaggaugugguugcaggcgccuguagucccagcuagucgggaggcugaggcaggagaauggccugaacccgggaggcggagcuugcagcaagccgagaucgugccacugcacuccagccugggccacagagcgagacuacguuucaaaacaaaacaaaacaaaaacaacaacaacaacaaaaagaacuguuaaucagggcaaaaagagggcauugaggcauggaaggaacugcagaaggaugcuaccccacuaggguuaagggacuaaaaggaugagauuagaauuacuaacauuuagaaacuuggaggaagggcccugcagaauuggaauuaauaccuuugagcagagucugcuggccuguugguacuagcguuucugagggaugcaacgagguugguuaugcaaguuuuggaacaacugcaaaucgaaauaacugcugcuaccaggaugaauuccacuaccaagacaggcauuaaacaucauuccuaaggcacucaccuacucucagaacucaauagacugaaucuucaacuugcaacaauggcuuuguuuuugacaugcgucaauuucccuuuugcuuuccagcucagcuauauauuuuaagugugucuauguauuugcagcagauagaagugauuccuuucaccagcuuagucauuugucaagaguuucugugcacuugucuucaucccuguagggcauuacccuaacccaaaacauuaucauuucuuccccagacuaccaguaccaucuucuaacuugucuaccugccuucauucuaacauguccaccaucuuuucuccacccugcagcaaauguuuuguaaacaccaaucuaagaacauuaucucuuggacgggcaugguggcucacaccuguaaucccagcacuuugggaggccaagguagguggaucaccugaggucagguguucaagacagccuggccaacaugaugaaauccugucucuacuaaaaacacagaaauuagcuggguaugguggcaugugccuguagucccaacuacucaagaggcugaggcaggagaauugcuugaacccaggaggcagagguugcagugagucgagaucaugccacugcacugcaaccugggugacagagugagauucuauuucaaaaaaaaaaaaaaaacccauugcucuuacaauaaagauaaacauguugcauauguccaacaaggccuuguauguacugacccagugccaucuugcauugugcuccuucuuuucuguguuuccuggccacucuggccuccuuugcuauuuucaaauaggacaaagccuuugcauaugcugaugcuccuaucugcaucaguccucuucccaauucuguccauuuaaucaccacucauccuacagaaaacaagucaaauuccuccaagaagccuuccuugccaucaaacuaggucagcacucuauuuauauggucucauagucuuagauuucuuuuacacacuguguuauggauuauuugguaaagccuccucuuugggguuauaaacuccaaaagaaaagaggcauagcaugcuaugcuccuagcaagaguuucugccacacaauaaacauuuaauagcucuuuauagaaugaauaaaugagccauauugaauguugauuaaauuucaacaagcuuuccagaaaucagccuauaaugauuaucccuuucaguggacuucugacacuuguaauucaucugacauauuuccuuucuuuucugccaugggcuugguagucucaguuagcauaucauugauuaaggucaggggccuuuauguuauuuuugaauucccagugucuagcacagugccauugaaauaguaugcaaucaacacauuuuuauuuuucaugauaaugauuaagaacuuagugccauuauaguuaauguaguaaaauuuugugaauucaauaaugccccuaaguaguauacaacuuugaaagcacgcucuucucaaguaauuaaauguuauaauuaucuaacacauuauuauucuauauaaaauuucagagauguuaguucauuauuuucagcccuuuauauuuuaaauuaaugauauaguaauuuuuaaaaaacaaaccuuugcuuuacuuuagcugaagacacaaaugucuucagauggugcucaaaaugguuuaaauuacacagaugagguaaacauacagugaaaucuuagaaaggccccaaagaauucccuacgaaugauacaugagccaagggcaugacauucaccuuggaggaucuuucucccuuugaauaaguuugauaaaaugccuuuuuuuuuccacuuugaccuuaagcacuuagaaaucauuuguuuuacaaaagccccgugguccaagauuauagcaaccagaauagugaugucugucuuacauuucaauugugcaugguucaagacuuuaguuuaagagagugauuuuacauaaaaguuuuuagauagauuucacuccugugccuuuguuggucucuucuguacuucuacgaagaacagcuuuguaguuucuacgcuggcuucaagcacaauacuauagcuccacaaccuuguccaacuguuagaaucauccaguuuuauagcagcugcacacaggcguucacucacccggguucugaguuucagcaaucuucuuaucuuugccauuuuuaugaaauaaguuuguuguauuuuagcacccaagccccauaguaucuuauaccuuacuuucaggaagaggcugucaaacaucuccugguauuauguuuaugaucuuugccaccagguuuuuaggcuuguuggagcaugauuuacacugcagaccucccuaaauuuaguuaacuuucauucgucaucaccauccagauauuuuaauuugguauauccaggaggcauaauagccaaugcuuugccagagagcuauaaauauugguaugaauuuuacauuuccacuugacaguaggagugucucaauugauagugaucuuaggacuucuugucagcauaccaaauauaucaacaggccuugucaugaauuuuccagacauuuguagaaucaugaaaguuuuuuucacauugaaauaagaaaguaucacacacacaaaauauuauuuuuuauaagauuguuauguaaaauauaagauugugaauuuugcauugcauacaauauuuauuacaugggaacuuugugcauuuaugaaauuauuuacuacuuauuuauaaauguauaaagaaauauuuagcaacaauuguguucucaauucuuuugaagucugucgacuuaugucuauuuuucuagaggauuauuccuuguuucugucuagucuggcauuuuacuacauaugcacucuuuucauagaacuagugauguccguuugucagccucaaaugcauacaaauugcuaucuuaaaccagaugaguguuuuugcaaaacaaagacauacaaaauaaugguucuuuuguagaaauugaucgaaauauuuuaaagcuuccuucaagggugugaaguuuugguuaauucuggccuagaaaaauauuuugcacaucaaccuagggcaugaucauacuuauuuuauauaacaucaugccuacagaauguguuuuccaaugaccaucacuaauggacauuaucugguauuuuaauuuuuuuccaaggcuuuucuguguauaaugaaagacaggaggcccacuaaacacaacauuuaaaaauaaguuaacucuauauuagugaaaaaaagauuauuaaaaagauuaagugguacaucaauuaaaaaacuuuuuaaaaaguuuuuuuaaaaagaauuaaauucugucaaauucagccugaaauuugaacacagaaauaagaacagcaggauuuucauuggaagaugcaucauugugauguuaguggccaaaccagaugccaggaaagcagugccucucucaaauucccauauguacacaugagaguucagccuuccuucuuaaugucauccaguuccuagagaaguuuugcuaguguuccuucugaauauacggggcaagagaggaagucaaggucacuaucaccaccaaguccugaagccagguaguugucagccuugaaaugauccucauuaaaaacuaguggcuugaauguccucuaugaagcuguucuuuguuuguuuguuuguuuuuuagacagucucgcucugucgcacaggcuggagugcaguggcgcgaucauggcucacugcaagcuccgccucccggguucacgccauucuucucccucagucucccgaguagcugggacuacaggcgccugccaccacgcccugcuaauuuuuuguauuuuuaguagagacaggguuucaccguguuggccaggaugguaucgaucuccuaaccucgugauccgcccgccucggccucccaaagugcugggauuacaggcgugagccacugcacccggccuuguuuuguuuuuugagauggagucucacucugucacccaggcuggaaugcaguggcaugaucucggcucacugcaacugccaccuccuggguucaagcaauuguccugccucagccuuccgaguagcugggauuacaggcaccugccaccacucccagcaaauuuuuguauuuucaguaaagacggggguuucaccauguugggcaggcuggucucgaacuccugaccucaagugauccacccgccuuggccucccaaagugcugagauuacaggugugagccacugcgcccagccuaugaagccuuucuugacucuucugaauacacguggccacugucuuccugcauugccauuguacccuguggaagccauuauugggacaucuaugagacuuuuuuucauguauguauauauuggucuguuuccucuacugcaccauaaugccugcauucccaggaauucuauggcuuuucucucuaucacuccacacaauaucuagcacucagucaaugcucaauauguuuguugacaaaaacauucuucuggacauguucauagaaugaacacacagccuucagcagcaguacacucagcaaguaacugugaaaagggagccauuggaguuaccaaauuagaaccacucauuuugagcaaaaaaucucugacucaauuugaggcagggcugcaaaaguugaacagcaacauuaaccauucacccagcaccucaagccuucacacuguaaucacaucgauuagcugaacauuggcaccaaagaaagggucaguauauuuuuuguucaagcuuuuguccauauacagaagcuggugcccgauuauuucaguguuuagugauuuuaauuuucugugaaauuugccuacacaauuugugcuucucccaguuuaugugcucuguacugucaaauaugauacagucagaaagcacauuccuuuaucauuuuccucuuacaaaaaagaaaacuggaaaaauuauauuauuugccuuuaaguggaaagacauuucauuuuccagauggaugcugguacuucaggaaauauuagagauaucuuguugaaauuuuuagaagugauccuguuaucguaccuuuuacacuccuggucaagcugucaucacuaccaaagcauuuccauaacuaccuacauaugcccauuucuuugagaaagaagaaacagagugaugcuaacuuuccugaaguuucauacacguuugaauuuuuauaugucaagucucagauugucaaaaauugaagcauggaaguuugcuccuggaacaccaaacauauauaaaauuccaccugugauguccucaacuuuuuaacagcucuaacuacuucaccaaccucuaggaacuuuuuuucaacaggauauaguauucacagacaagaaaugaaggcgagauuguuucuagauaaauuuagcuggggaauauggaaaauaugaucuaauaaaggaaaccuccagguaaguucaagauagugaauauaugggaauuggaaaaccgauugcccagauucuuccuuuaaguagugguugugauaaaauacauuuugauuucuauuucuaaugaaaaugugaaacagacaucuauuuuuccaucccaacugggcuuccuccaaauaugcugccuucucccuaaugaguuggaauagugugcaccauaaaauaguacaacacauccugaaaugcugacauuucauuuuuaauugaaaucaaauagaaauaguuccacugggaaacaagaaaguaaagcaggcuuuugauagaaauuaauaggaaagggacggaaauacuauucucugucauaaaguaguccacuauggaaggcugccaguccacuugccugaaucugaguuuaucuccaggauuacauucagugaaaagaacacaucuuaugaagguggaacgagaaaucguauuuggauggauauaucaaaggaaagaaauaaaaaauacuuccuuucuucuauuuuuuaaaaaucauaggaauguagaggucaaggaaaacuguugaauuuuacugcaaaaacaaugauagcaaaacaaaagacuucauaucaucaacaaaaauauuuacaaaaauauaucagaaaauacauucuuugggagguaaaauaaacuuacauugcugggacuaaaauucucucaucggugggacaacuuucuuuuaaaaacaguuuuauggcaauacuuuuaacagugguacuuuuaagaguuguagcuuggcugggcacaguggcucacgcuugcaaucccagcacuuugggaggccaaggcggguggaccacaaggucaggaaaucgagaccauccuggccaauauggugaaaccccgucucuacuaaacauacaaaaauuagcugggcaugguggugugcgccuguagucccagcuacucaggaggcugaggcaggaggaucacuugaacccaggaggcagagguugcagugagccgagaucaggccacugcacuccagccugggcgacaaagcaaguucccaucucaaaaaaaaaaaaaaaaguuguagcuugagcagcaacaauaacauuaauaaagauuaacauuuguauaacuguauauggauuaugaaauauuuguauaagauuuuuaauaauugauacuccaaacuauuaugaaaauuccucaacuuucaaaaaacaauucuuuauucucuaaaauaccagacuuugaauauagaaagccaugauuuuuaugaaaauauuuaucucuauggucauaauuucuagaaacaaucuguaguacuuuguaccaaaaaaaagucggcuauuuuuauaggagucauuccaagacauuauugagugaggacugguacuaggaugaggaagggucaggcauuugacacugaagaguuuguggcauguugcagagagguacuuaaaaagauaaaugccaaaaugguacgauuaauaccuacuauaccugacauagggacaaagugcuuuuuagauggcuaucucaaggaguuggguaguaaaugaaacgaaggauguaagaacauagcuagagggagagcugccuggagaaaggguugguuuguuuucagaauguagaaacuugcacagguugacaaguggagucaaagaagagaaggaaaguuugagcuucaggagaaaaaagggauaagcgauggauacauauggcuauucuuuuuuuuuuuuuuuuuaaucugggucuuuccacaacuucucccuggugacuuugacugauuucuugggcuagcucagacauaagaauucauguuuauuaaaacugaucaaaauaauaugugauauguuuuaaggacugaagcccagauguuccuacucuuccagaacacuugaacaugcacugacuuccugagggccaccaggcauuuagggagaugcccagugagaggaaggcagccuugugucccuuauaaugagacccuucucugaaauuauuaaauaaucuaccuugcaguaaaaacugcugauucuucguggaggucucuucaaauacaaugaucugugaaaauucugccuacagaauuuuaagaaaaaccaagaguaccaauuaacuaaaaaauuuauauaaaauuaaugaugaaaacaaugaccauuaacaaacacaaaaauaaaaaccccuuuauugcucacucuaucuaauacuaaaacuucacaaaauuaaugucuaaguuaccugaugaaagcaauuuaauaaauccuuuggauaauucuaauaaaaauaagaaauguauuaucucauucucaaauuugccacaauuaaagagaaacucucuuuugaauugggagguuucucucuaaagaauuuuccucuucuaauaaaggauauugcaauauccucugaauagauguuuaaaaucucucucauaaguucuggaaaucucucucauugaaauagucccagcuugacagcccugcaauaaccauuaaauauuaaaauaacauuaaaaagcaacugcucagcucauggaucuagcugcaaaacuccaauucacacuaaugggacucacauagcuaaauccccaugugcuguaccgaaaauuuaugcccaaggauccaaggaucaggcguguuaaagaaaaugauggauucacuuucaaaaaaaaauaucgauccacuaccaaacaaauuaucauuauucaugcaauuucagucacauaauuauucuaaaaaccagacugucuaagauuaaacagcauccaauuuugcauucacauaguauucauuugugauguaauaaaauucauacuuccauugcaagaugauuugaauguuguaaaaacauauauacaguuuaaaaaaugugucuuauuuacaaacauauccuaaagccaaaaucuaauucuagauacauuuucuguuuauuauuucuguagacacuacgaucauaaugcuaaagcuuuaagaacuauuuuuguuguucuugagguauguuaaauauaaaagggaaaaagaaaguauaaauaacuaauaguguuaauauuuaaaguuguguggugaucuaaacuucucaaagaauuucuuuaaagaaauuauagaaauuuugacauagugaccacacauuauuauaaucauccaugguaacuauccaagaaguuacacacuauuaaaaaacaaaagacaguguguuuaauggaaaguauuucagaccaaaauuuaacuuacucaaauuccaaacuaagacaagucacuuaaauuuccaaauucacaauuuuauuagcuauaaaaugagugagauggacuugggaaucucuugucugccacucuaugguuuucuguuguaauaacuaauuugguuuacauugugucugguuagauuuucccauuucccccacucccaccaucuccacaacacacacacacacacacacacagaguggagaaagaaguuuuuaaaucugauagagaacucucgugcaaaugcauguauaauauucugugaaauuccuauuugucaaucaaaguauuugccggaacugaaagaggccuagagaaugagaaagagagguaacauuguuguguggaaagagcaucuggauggaaaaucuggagacccaguuucaucagcaaccaacuuuaugacuuugggcggaucacuugcuuucucuaaauugcaauuucauucaaagcaggaauuagauaagauagucacuaagugcauguccaacucugaaaauggaugccuacaauuagaauaucacuauuaugauaaacuaaacaaagcaguuacuuuuuuuuuuuuuuuuuuuuuuaagauugagucucgcucuguugccaggcugaagugcagugaugugaucucggcucacugcaaccucugccucggguucaagcgacucuccugcgucagccucccgaguagcugggaccacgggcauacaccaccacgcccagcuaauuuuuuguauuuuaguagagacgggguuucacccuguugggcaggauggucucgaucuccugaccucgugaucugcccaccuuggccucccaaagugcugggauuacaggcaugguccaccacucccggccacaguuacucuuaagucuacauaaaagaaaagaagagggugugugugugagugcguguguguguguguguguguguaaucuugaaggaugagggcuaaggauaaagugaauguagaccauuuuggacauuaaauaauaguguguauauauauauuauauauacaguguauauauauuauauauaguguauauauaauauauaguguauauaauauauauaguguauauauaauauauaguguauauauaauauauaauauauaguguauauauaauauauauaguguauauauaguauauaguguauauauaauauauaguguauauauaauauauaauguauauauuauauauaguguauauauaauauaauacauacauuguauauaguguauauauauuauauaauauaauauauaauauaacauauaauauauaauauauauuauauuauauauuauauguuauaauuauaauuauaaauacaauuguauaauuauaaauauaauuauauauuauauaauauauauuauauaauauaauauauaauguauauuauauaauguauauuauauaauguauauuauauaauauauauauuauauauaauauuauauaauguacauaauauauaauauaauauauauauuauauaauauuauauaauguacauaauauauaauauaauauauauauuauauaauauuauauaauauauauauaauguacauuauauaauauauauuauauuuuuauauauauuauauauuauauauauuauauauauauuuuuauauauuauauauaauauauauaucaggcaguaccccauauaccaggcaguaccccauaaguuuaaagaaaguaucuuuuuuauuacuuaaaaagaaaaagauauguuaaauauuuucuaaucuuuuugagcauuuacugugcauuaggccugaaucuaauagcacugcagauacuauuucauuuauuccucacuaugaacccuaugaggaguugcuauaauuauccccauuuucuagaugaaaaaaugaaggccuagagaccugugucccacagcuaguguaacuauaugaagaaauguaagauagagucuggguuauguuccauaaagagucguaaccuuuuagaaucaacauuauagauaacuaagcucugauuucuuuauuuuuauaaggauuucugguauuacuaccagaucacaauagcugauugugcauacuauuggcccacucuaucaacaauaauauuuuucuuucagccacuacaaaagugguauuauaauuuucuaaggaaaaucacauugucugguacauaaauguuuguugcaagaaggaaagaaacccuguucccaaccaagaugaagaguauggacuggauuuauccagccaccugcaagaaccaaaaaaaaaaaaaagaacuggacaaaauauaugagauaauaauuucacuuugcugggcaauggacgacaaagaauacugaucauuaaaagauaagaaacaagcaaggggaguccuaugauugcccagccuaauagcuuaaggcaguuucagaucugcagugcaggaagauaaaaccuaagcagaacucaguaggcucucugaguugagacagaguugaaaguggggaagaccaaagccaccugaguucguagaacagagaaucagaccaaaagguauuuagcaaaguacugaggaacacauguaaugaaacaaccuaugguccaggaaugaaccauuugaaaggauuagaaggaacauuacucaguacucucacaagaccaggaauagugucuauaaccaccagccagucuaaagaaaccucauaauuuagaggacgaugggcagaguauucauaagggucuugcauuguuagucggaaauauuagcucucaauuaagcacagauuuggucccacuuaacaaauuuuaaaaguuagguccuuguauuagaacauuucacacugcuauaaagaacugcccaagacugggugacuuauaaaggaaagaaguuuaauugacucauaguucagcauggcuggggaggccucaggaacccuacaaucaugguggaaggugaaggggaagcaaagcaccuucuucacaagguggcaggaagaagaaugaaugcaggaagaacuaccaaacauuuauaaaaugauuagaucucaugagaacucacucacugucacgagaacagcauggaggaaaccacccccacaguucaauugcuuucaccuggucucucccuuggcacguggggauuauggggauuacaauucaaggugagauuuggguggggacacaaagccuaaccauaugaauccuccaggaucaaacaguuuccaaaugauguaaccacacuccagggaaggaaaaaagcuuaagaaggucuauagguauacaaaaacauccagcacccagcuaaguaaaauucaagaugccugaaauggaaacaaacaugacuggguaugucaaaaaggaagaaaauauaacaaguaauuaggaaugaaaaaaauuaaguaauugaaacugauucagaagugacauagaugauagaauuauaauacaaggacauuaaggcacuuuuuaaaacuauaucccauuucuucuaaaaguuaggcaaagacauagaagggauauguauauauuuucaaagaaccaaaucaaacuuuuagagcugaaaacaacaaugucugaaauuaaugguagauuagacauuguaaaagaaaagauuuaugaacuugaauauacugaaauagaaacuauccaaaauagagcauacaaagacagaauaaaagccacaaauuaccaguaucaggaauaagagaaugacagcacuacguauuccauaaauauuaaaaggaaaauaagcuaauaugauuagcaauuuugugccaauaauuuuggcaaguuagaggaaauggguuaggauuucucaaaaguuacaaaugaccaaugcuuccuaagaagaaauagauaagaugaucugaacaccccuguauauauuaaagaaagagcauuuguacuuuaaaaccuccuuaaucucaccaccaaaacaaacaaacaaacaaacaaacauaaaacaacccaaaacaaaacccaaaaccacaggaccacaaauccagauagcuuugcuagugaauucuacuaaacauuuaaaugauauaggaaggaauaaccuuaaucucauucuaugaauccagcacugcucugauaccaaaaccagacaaagacauuacaagaaaaaaaaagaacaaacuaagcccaaaauuagcagaaggaagaaaaccuuaaagauuagaccagaaauaaacaaaauaaagaauagaggucaggcaaggcaacucacaccuguaaacccagcacuuuaggaaguugaggcaggaggauagccugagcccaggagucugagaccagcuugggcaacauggcaagacucugucucuacaaaaaaaaaaaaaaauuaauuagccagccauggugucaugugccuguggucccaguuaguuaugacgcugaggugggaagaucacuucagccuaggaggucaaggcugcaaugagcugugcucaugccacugcacuuuauccugggucauagagggagaaccugucucaaaaaaacaaacaaaaaaaaaagagaaaagaaaaauuguagaaaaauaccaaugaaauugaguugauguuuuaaaaagauaaaauugacaaacccuuagauagacuaacaaaaaagagagaaaacucaaauaaagucagaaauuaaagaggaaacauuacaacugauacaaagagauaagaaaaaucauaaaagacaauuaugaacaaguauauaucaacaaauuggauaaucuuuaagaaauggauagauucuuagaaauguaaagaucacacacuaagaccaaaugagauuuaucccugggaugcaaggauggcucaacauauguaaaucaauuaaugugauagaucacacuaagaaugaugaauuuuaaaaucacaucaucauuucaauagaugaagaagaaguauuugaugaaauucaaaacuuuuguaauauaaugaacgcuauaauuauacucucaaaaagcuaaguauagaaggaauuugccacaacauaauaaaggccacauaugacaagcccauagcuaacauuguacucaauggcgaauaacugaaaacuuuuccucuaagauuaggacuaagaaaggaugcccacucuuaccaguucuauucaacacgguacuggaaguucuagacaaagcaauuauacaagagcaggaaauaaaaggcauccaagcuggaaaggaagaaguaaaauuuuuucugguuucagaugauaugaucuuacauguagaaaacucuaaagacuacacacacacacacacacacacacacacacacacacacaguuagaauuaaugaauucacuaaaguuucaggauacaaaagcagcauuaaagagccgguuguguuucuauacaguaacaaacuaccaaaaaaagaaaacuaagaaaacaauccaauuuauaauagcaucaaaaagaauaaaauagaaauaaacauaaccaaggaagugacagacuuguauacugaaaacuacacaauguugaugagagaaauugaagaugacacaaauaaaugaaaagcuaucccauauucauggauuggaagacaauauugcuuaaauguucauaguacucaaagugaccuacagauucaaaggaaccccuauaaaaauuccaauggcauuuucuuuacagaaauggaaaaaaaaauccuagaauucuuauguaaccacaaaagaucucaaauagccaaagaaaucuugagaaagaacaaaguuggaggcaucacacuuucugauuucaaaauauauuacaaagcaacaguaauuaaaacaguaugguacugguauaaaaaagaucuauagaccaauagaacagagaaccuggaaauaaagguaugcauauacagucaacugaucuuuaacaagggugccaacaaaacacaguggggaaaggucaaucucuucaacaaaugaugucgagaaaacugcauauacccacacaaaagaaugacauuggaccauuaccuuacacaggaaaauuugagauuuaaauguaauuuuucagccccuaaaauuuuacaaauucauaaacuguaaaaugccuagaagaaaacauuggggaaaaacuucacaauauuggucuuggcaaugauuuauuagauaugacagcaaaacacaagcagcaaaagcaaaaauggacaaguagaacuacauaaaacuaaaaaguuucugcacagcuaagaaaacaacaaaaugaaaaagcaaccuaccaaaugguauaaaaugucugcaaaccauauaucugauagaagguuaauauaaaaaguauauagggaacuccugcaacacaauagcaagaaaaaguacuuuuaaugggcaaaagacuggauggacauuucucaaaaagagacauauaaauggacaacagguauaugaaagaugcucaacaugacuagucaucaagagaaugcaaaugagauaucaccucacaccuguuaggauggcaauuauuaaaaaaagaaaagauaaauguuggugaggaugugaagaaauuggaacccuugugcacuguuggugggaugguaaaauggugcagcugcuauggaaaacaguauacagacuccuuaaagaauuaaaaauagaaacaccauaugauccaguaaucccacuucugguauauauccaaaagaacugaaaucaggaucucaaauugauauucaaucuccuguuuauugcagcauuauucacauagccaacacauccaaacaaucuuaaucucuaucaauggaugaacagauaaagagaauguggcauauacaccauggaauauuacucaaccuuaaaaaaauccugucaugugugaccacauggaugaaccuggaggacauuaugcuagugaaauaagccagucacagaaggacaaauacuucauaacucaacuuauauaaaguauguaaaaugguuacauucauagaagcagagaguagaaugaugguugccagcggcugggaaggaaaguaauggggaacugaugcucaaugggugcaaagauucaguuaugcaagaugaacaaguucuagagaucuguuguacagcauugaguuuauaguucacaauacucuaugugcacugaaaaacuucuuuaauuagaggguagguuuuaugugaaguuuucuuaacacaauaaaaaaacaaaacuaaagaccaauaugcuucaugaacacagauauaaaaguucuaaacaaaauuuuagcauaucaaauucaacauuacauaaaauggacaauauaucaugauccaguggaauuaauuccaggaauucaaggcugguuuuaacaauugaaaaucagucaguauaauucaccauauuaaaaccaaaauuuuaaagaaaauucauuugauguugacaauuccaacaucuauuccuaacuaaacuccccagcaaacuaaaaauagaagaagacuuccacaaucugauaaagguuauugauggaagucuacaacuaacaucacacuuaauagugaaagacugagugcuuucccucuaaaaucaggaaggagguaaagauggucuugcuauuuuuauucaacauugcauuuaagguuauagccaauguaauaaggcaaggaaaggaauaaaaggcaucaagauuggaaaugaaggaguagaauuguuuuguucuaaagacaugaucaccuauguagcaaaucugguggaaucuuaaaaaaaaaagcaaguuugaguuuagccagguucaggauacaagauaacuuaugcaaaaauugguuacauuucuauauacuaagaacaauuagaaauuuaaauuuaauaaaguguacauguauagauacaucuaacaaaaaugugcaaguguuguacacugaaaacuagaaaucauugcugagaaaaauuagagaucuaauuaaaugaagagauauagccuguucauucaucaaagaccuguuaacaugucaauucuccccaaauuaaucuauagauucaacauggucccaaugaaaaucuuagaaggcuauguagaaauugacaaaauauuucuaauuuauuaucaagucacugagguauuuaccacaaugcagacaaagaacagaguuggggguccaaaaauagaugcacacauaaagaaaacucacuuuuuuccaccaaugauggauauccuuaagcaaaaucauaauaauaaaaauaauaacuuugauucauacuuuggaacauauauaaaaauuaacucagaaugggucacagacuuaaguggaaaagcuaaauugacagaauaucuaggagaaaaucugugugaccuuugauuaggcaaagauuuauuggauaccauaccaaaagcaugauccaaaacagaauaaauuaguacaauggacuucaucaaaauuaaaaucugcuguucaaagaacaugguuaagagaauaaaaagauaagucacagacugcuagaaaauacuuccagauuauauguauuauaaaagaacuguguccagaauauauacaguacuuuuaaaacucaaaaaaaauuuuaagaacccaauuuuaaaagagaaaaugauuugaacagaccuuuauacugaugccaaauaaucauaugaaaagauccaacaauauuagucaaugaggaaaugcaaauuaaaaccacagugaaacacuacuacacaccuauuacaauuguuaaaauuaaaaugaucauccauaucuuaugcuuuagggauguggaggaauuagaacucuuacacacuacacacuacuuauacugccagugggaauuuaaaaugguacaaccacuuuggaaaacagugagacaauuuccuaagacacacaccuaaccauauauagcacucauucuacuccuagauauguaacuaagugaaaagaaggcacauguucauacaaagacucguguacaaauguucacagcagcuuuauucguaauagucccacacugggucuaguggcuuaugcuuguaguccccgcacauuggaaggcuaaggcgggaggcucacuugagaauaggaguucaagaccagucugagcaauacagugagacccucgucucuacaaaaaaauuaaaaauuagcuggaugcagugguaugugauugggaggcuaagaccagaggauuacuugagcccaggccgcagugagcuaugaucaugacacugcuguccagccugagugacagccugaauaaguaaauaaauaauagccuaaaacuggaaacaacccaaaugaccauuaacagguaaauggauaaacaaauuguggcauacaugcagugaaauaugcuaugguuugacgcuguaucccgacccaaaucucaugucaaauuuuaauucccaauguuguaggagagauuuggugggaggcguuuggaucauggggcagauuucucaccuugcuguucgugugauaguucuugugagaucuagcuguucagaaguguguaacacuucccccuuugcucuugcucuccugcugaccaugugaagaagguacuugcuuccccuuugcuuucugccauaacuguaaguuucuugacgccucccagccauguggaacugagucaauuaaaccucuuuucuuuauaaauuacccagucucauuuagcucuuuauagcagugugagaacagacuaauacagaaaauacuacccagcaauaaaaaggaauggacuauggacaccugaaacaacauggaugaaucauaaaauaauuauucugaguuuaaaaagccagaccaaaagaauaaaacaaaaaauauacacuguaugauuccauauguauaaaauuccaaaaaaaaucccaacuauucaugguggcagaaagcagacuauugguugccuggggauugagaugggaggcaaggaaaguggaaggcaggauugggaaggagggauaacauaggggcaugaggaagcuuuuggggugacaugugcauuuucuuauucaugggcauauauauauauaucaaagcauauuaaauuguacacuuaaauaugugcaguuuauugaaugucaaauauauuugacacuuauacaccucaacagagcuacuuuuuaagaauaugaaauaagguaggaggggcaugagcaaugagauauuacuuaauugguacaaaguacacuauuggggugauggugacauugaaaccuagacuucaguacuaaacaauauauauauauuuuuugagacagagucuugcucuguugcccaggcuggagugcaguggcaugaucucggcucacugcaaccucugccuccugaauucaagcgauucucgugccucggccucccuaguagcugggauuacaggcacgcaccaccacgcccaaguaauuuuuguauuuucaguagagaugggauuucaccauguuggccagucuggucuugaacuccucaccucaggugauccgccggccucagccucccauagcgcugggauuaccgggccuggcuaacuauauauucuuguaucgaaacugcaccuguaccuccuaaauguauacaauuuaaaaaaauaaaacagccaaauugucacaaaauaaauuauuaauaguguggaguguuucacuuucccauguuuuuuuuucauuacaacaauacagugagcuacauaucaugauuauuuuuaucauauuauuguuuuacauuauuauuguucccauguaaucuaugauaaaacugaggcucaacauauuacuuugcucaaugucagauaagcuuuggcaacaaacacgauauggaauuccuuaaaagcaaauaaaauaaaagauagaccucacuucauuacguugguccucaagcauuuccauuccugcuuucucacucuccccccucauaucccgaagcaacucucacucaauucaagagugcccaucauucccaauucccaaucccccuagaaaugugagguaacaccucagucugcccuguccaaugcaguaggcucuagccaucugugcuacugagcaguagaaauguggcucauccaaauugagaagugguauuauaagauacagcccaguuucugaagauguaaauagcucauuaauaauuuguacauuggccgggugcaguggcuugcaccuguaaucccagcacuuugggaggccaaggcggguggauuaccugaggucaggaguuugagaccagccuggccaacaugcugaaaucccaucucuacuaaaaauacaaaaaaaugagcugggcauggugacgagugccuguauucccagcuacuugggaggcugaggcaagagaaucgcuugaauucgagaggcagagguugcagugacccaagauugugccacugcacuccagccuggguaacagagcaacacuccgucucaaaaaauaaauaaauaaauaaaaauauuuuuacauugauuuuauguugaaauuauaauauuucgcauauacuauguucaauaaaauauauuaucaaauuaauuuuacuugcuuauuuuuacuuuuucaauguaauuccuagaagauuucaaauuauacacgugucuuguauuaucuuucugucagaaagcacugauuuaaauccuacuggggaaagcaauguuaugcuuuuuguuaugacaacuucggaaaaucauuaacuuguguuauaaucauggugcuauauagcuuugguuuuguaaaaggguggaaggcucuagguagggugucauggauagaaucuuguggugauaguugaagaaaaauuggccuuggcaggguagcagauggugauuaggaagaaaaaggagccgaucaugaacucauaguagagugguagaaaaacuuugaucccaacucugagaucaguuuuguaagucaaaccaguucuugugccuuaggguacaagcauauuuugagguacaaugcuaguguugugaucugucacacuccugcagcuguuuguggcagucauguaagauggagccagcccagaguagucugggcccaaucagcugcuuaucuugcaacuauuaccaaagcaagauuuggagcagcagccgcagcuuuugacucuguggauuaaaaucucaaucuccccaaagccuugccucaugccaaacuccugugcaccauaaugcucucucuucugcucuuauuucucagucagcuaguguugugccacacuguuugaaauugguaagugucaaugaaucuuggaagcuuuucuugggcccacugucuaacucuucaccauaagaaaagaaggggcaucaguaccuacuguacuggcaaaauugcugcguuucaguacaugguagguaguguuccauuuucaucaauuauauuaaauccagcucauguaaaaugcuguugaaauugcaaagcaaaacaaaugucacaaaaggcagagccaaguuuugcgguuaaauuguacucucccagacucuucccucugcaaugucuugggcugccaugugaaccacuucccuggguguaaucuuuccaucuugauggauaucuuccuguuguagcuguuaaguaguuaauauauaacaucccuuuuuaucaucuucugaauuuggaaucaauggaaaaacagauccaggagucagacagauggugagagaauguggcuuuugauuaguggcccagaaaucucccuaauacuucacucaucaaugaaacacucaccaagucaccaacagagcuggacagcaaaggucuacuccaaacugagugcaggaacaaaaggaucagagccuccauguccuguggcauccuccaaagacaaaggaguccaacaaggcacugaaaaugcucagaaaugccaaccaaacucaaaccaaauuaacccgcaggaguaaggcauagggaaaaggucgguuacccuggcagaagucccucugcaugaaaacauuaggccagggaaauggauauuccuccugaccucugcaccuauauaaaugcauucaucugcauguuuaugauggguuuuuacaaacacguuugucaggguuuggcauguagaccuauaaaaucuacuuuucuggauccaaguucuauucauucacucauuccaaaaauauuuggccagugccuguuacaggcuaggcacaggucuaggugcuacuaggugaagaaacagacaaaaacccugccuucauggagauuauauuuuuggcagagaagacuaaaaaaaaaaauaagcaaauaaguaaaacauaugguacuacagauggugaaaagugcuauugagaaaaagaaaacaaacagggggugaguguggaaguugugauaucaaacaaaguaacuagggaagccucucugggaagguaacauuagaagaaaggcccaacagagguaggaaaaggagcccugcagauauuuagggaaaaagugcaccaagcagagcgaacagcaagugcaaaggcccugaggaaggaugcuuguuaugcuagggaaaaugcagagucuaaaguggcuggaacagaaugagugagccaaguucacauaucaucugugucuucaggguuaugacauguucaugucaugauacuccugccuuuuuuguuuguguuuuaaaauucagacucagcaauuuuacugcaacucuggugcucacagcuaucacguuccucuguacacacaagccauaagcacacccguuucaguaguucugaggcugccucaccuuugcucagagccugaaaacugcuggugggaacagcaucucucuucauuacauuucucugaauucaucaggcacccagcaaaugccauucagaaagcaaauucugaauauguguguggugaaggacacuccuagacuauugccucaaggauuuucaugaaaaaccugccccccguaugagucuucccagcagcaguggcuucauugagaauauauggcugaccacuggcauauuuaguucauacuuagcacagccuucuccgaccaucuuaccuugggcugcuguaacaaaugucuacagaacaguuggcuuaaacgacaaacaucuuuuucucacaguucugugggcugggaaguccaagaguaagguauggacagaucugaugucugguaagagcccagcccacuuccugguuugcagguggcugucuucucauuguaucuucauauagcagagaacagagagaaagagccugugucucuuccucuuuauauaagggcauuaauuccauuccugagugcucuaccuuccugaccucguuaccuccucaccuccaaaugccaucacauuggggauuagccuucaacacaugaauuuugaggugauacaagcauuuaguccaaaguacccaccuuuuuccaauuuagcuacuggcauuuguauacauuaauguccauaccuccuaccgcccacuccaccccaccauuuauucauugguuucacaacuauuuauugaggguguauuauaggcucucaaugaauaaaauagacuccugcccuugggagcuuauauucaaaaggauaauaccuucuuugaaggcgggacgcugucuuagucaccauuauucccacggcccauagcacagugcuuucuuugccuaacaugcucuauaaaaauaugcaaaucuugagacaagucacaaagcagaauuuuguggaaccaaaaauaaaugugcucaucucuuuuauucuuuaaauggcucauacagacuaauuggaauggagaugcguauuuaacucaaugccuuccucuaaaacauacucaagguccauuuauuuccaagauggcauuuugaccugugacaacuaaagccccauauugcaaaaaaaaaaaaaaaaaaaaauacuguggcaagaugcuagaucggucuaauuuucucccugcauuauaaaucuuuaaagcuauugggagugggaguuuaagaugguugaccauuuaacgugacuguuuaauaaauugcauugcuaguaagccauaguacuuaaccccucaaaauaucaguauauuaaaaucuucuauaauguuaucaaggagaagaaaauaaauuuugagaauuuuccuaaagugcuugaauuaauauuaucuuuuuguggucuaggaaauucugcuaacagcccugcugcuuuuccauuaagguuacagugagacgaagcauguggcacgcagcuuccauuuguagaucaacagugaaggagacagauuuguaguuuuuaucagcauuagcagggcaaagcacauuuguucacagguguuaggagucaccacuugaaugaaaagcugggcagggaaauuguauuugucuagugaaaauguaacugaagcauaaacacagcccacaccuuugaguguggcauucuacagucugcacugcuguuaacucacauugaaaaaaucuuggcauuuucuuuccuugaauucauuccuuaaauggaauuagcacauuuuaaauccuuaugauuaucauuauugacggaaugauagcauuuggauccgcaacaaccuuuucauuguuaauugagugcugagaaugggagaugauauaguuauucugauuuuuaaaaacuagaaaauggaacgugugaacaguggcauaugaagcucuuugacagaccuagggcuaggacucaaggcauguaauuccaaaaucuuuguuuagucccuuaggaaauagcuucuccugaguuuuguccuguugauuguuuggcaguucccuuaggagacuaaauuugcugaagaaaggcagccuggagcaggguuaacaguagaaauuaucauuuuuuggauccacuggccuuguaacaugggagaaaucuccacuccaccuuauacacaccuuuuucucauaauuuguuggaaaauuuaucuuaaaauucagcaucaaauucaauugaucguuugaccuacugacuuuuaagaacaacacauuuuuaucagaugcuuuguuagacacugucagauaaucaaaaguacuuccacugguuuacagguuccucgagaagaugggaguauauucugaugugccaugaauuuauuuuuuuagaaaagcguaagagaaaauacaauacuuggaaaauaaauaaaaucugaacguaacuuuuaucacaucccccaacaaugaagagaugaggcaugaacaugcucaccucuacccauugugccuacugugcuguagguauugccgaacauauggugccuggugucacccacuguucucauucccccuucccucugagaugugcagaccagaccccaucagcauuucuagggaggauaauauaaugauaucaaguuaccagauuuugaugugugaaaaaugaacuagguagcacuuuccuagccaugggaguauaugcaaacaauguuauugagcaaauauuaugaauuaauuuaauauaaucauuacaauagagaaauauucuccaucauuucaauugucauucaguugucaccaggagaacaaguauuacugaauaaauacgauuuucaucaggaucaagucugauuauugguuuauuuuaaucuaguuuuuguuuuguuuuguuuugccuggaaaaauauuuacccugcuuaaguuauagauauuaccuguuguuugaaaugaaauuucuaccuuuaucugccccaaacuuuggguugacaaaauaauuccacagaugaaaacauugcugaguuauaaauccauauuauuacuuucacaaaaaucuagccuguguccaggauaaaaugacaauggcacuuugaaagaaaguagauagcuucaaauuaugucuuugaguuaugguucugggcugugaauuaggcucagaacagagaagaagagaaacauuuccguuaauauucccacaguggaagaacagaaagggguaaaagagcaaucaucacauuuucacacucucaaaaguaaugggauaaagauguuccccguaacuuuagaccaaauguguagacaaaggaagaaaguguguguuauuuuacucucaucuucucucaucuccuugguuagaaaugugucgcucaagcaacuacuuauucaaauaguaagugcuugaggguaguuaccguuauugaaucucauacuguauuagggacuggaauggggaagcacccuaacugcagaagcauaaucucacuuuucagagcagugauuuucaaacuugagcauucaucagaagcaccacgaggacuuguuaaauagauugcugggcccaccccggaguuucugaucaggagguaugggugggacccaaggauuugcauuucuaauaaguucacagcugauacugacacaauuggucugagaaccacuuuuugggaaccacugcucuugaaagcagcacagcaaaagugaaacauauuuuggaaugcaaaaccuguuucagcuguggcuccaccgcuucuuagguuauuugccucuguugccccuauuugcucauguacaaaaugcggaguacuaauaucugccucaucagguuuuggaguaugugugaaacuauaugugauuguagccgcaucuuuauguaaguguaugaaaaaugcauaugcaacugguaugauuuccuucaucaacuuggaguacuaaugcaaguccgucuuuuuuauguuuccaguuaaucauuccuaccuccacuuguccaauguagauagauguucaaugucugccucuugagaccaccuccuucccccaaaacauauaucucaggaguuuacucaguuugaagaacaguccaccuuccaacucuagaagagagaaccucagagucuaaucagcccacugaccuuuauuucugcuccaccacacaaugucaccauuugaaacucagcucacaccaucggauggaauuuuucaucuguacaaugcucuugcuagaccaaguuucguuacaggccacaguggugccccaaacuuaggauccaagauugcggcucuuucagcucacacacauacgcuguuauuucccuaaaaugugccacuguacagggcaauuggguaugauggguuuucagucuaggccacaugcugugcuaaugccagcacccacugcuaccuggcccaaccuccagaccauguuauggugccaggguuaccagucuugacucccccuuuucuugagaugaaugcucuugugugacuuagggugcccauucugcaaucucaguucuccucaacaggaccccagugagguguuccagcuguccucccugggucugugcuuguacaucugaaaucuucuaauaaccuaaaaagggaaaagggcuggaauuucaauuguuuuauuucaagauugguccucaaugcuuaugucagcuuaccucccucaauggccugccuucagugauuuugccgaccauccccacuucuucccauuccccuggcucuacuggaaaagucguagcaaguaggaggcugucccuaacuaguagccauuaccaaugaccaccaaccuucuuauaacuccacucugcucucccaggugaugacauggggcucuugcaacugaggauacugcugauccuuuacagaaguugguuuuucaucuauccauuacuugagauguggagguuuuccuuguccccuuuccuagugagauccggucuugccacacacucugccauuugcucaccaugcagaaucccugcaacauuucacucuuugcaacugggugggcaaugcgcuaaaagcaaagauccucuuuguccucucuguuaaaagcugaaccagagccaguuccaagcaggccucuugcacucccuccuuucuuaacccuuccguaacuuuccaacagaaggcacagcaaggcccaucucacccccaccagaggaagaaaaaagaggaagacaaggaaaggaaggaaacuugccccaacccaaaccaaaaacuuccuaguguguguccuugacacacaauggagcaguuucuccaaggauucuggggugggggugggagaauggcagaaaaagggaagaaucggcuuuuuuuaaaaaaaaacaaaaaacugaugaaguggcagaguuaaaacuuucccucaauauuugugugcagaaucuauaucuagugcuuuuaaaaaaucauuguuguuaagauauagcaaaauaauaauuacccagucauucaauaaaaauguguccaacgcuuguucugaguaaggacuguucuaugugccagugacaguuaugggaagaauggcgcaaggaauccaccccauggaugcuuugggucaaguagggagcuccaaagacacgacauugaugacgugaggaucugucacagcaguucaagguucugaaugaugagccccauaggaggaccauagagcuauucaacccagagcucggagaaauuguuuucuccucaggaggaauuguucccaugcugugccaugaucuccuggccuccuaacaaaugagacaugcucucugugguguuuuucucugcucacagggacaguaagcaucuauucuauauauucuguguacauguuuucccuugggguugauagcagcucucuucuaaauggguuaaccagcagcagagaugcagccugugguuaugaaauggagucauuuuuacuauuaguuuauggacaauagugaggaguuugugucgccuguuccaccuguuauuaacuauuuuaacaaucucucuuagaaguaugcacagaaauacauucuggguuugacaauucuauauuucagaucauaucuggcauucuucaaaauagaaugagcucaauaaauaauaauaauaauaccuaacuuaauucuuaaguaacaauucauaauuuauaaaacugguacgaauacaugagcucuuuauaauaacucuaugaagcaaauaaaauaaucuucaucguuauggauaaacuguaccucugagaaguucagagcuuugccuagaucucagccagggugacuaauuacugagggacguuuggcaauaucugggagcauuuuugguugccucaacuugaggggcacagagggugacuacgggcauuugguggguagaagccagguaugcuguuaaacauacuguauguaauggccaggauauacuuccacgucaaagaauuuuccagccugaaauaucaauagugccaagguuaagaaaagcugcucuagggucacaaagcugguaaaaucugaacccagguauauuacucuaaaucuaguaucuuucuaugucccccaacuguaaagcuuucaucuugaauugaauggggaagcaucaccuauuacauuuuacauuauguucauuuugguuucccuuuuuccugagcucuggggaaggggcggaaauuuugccuuuaguagacaaugaaauguugcuauaauauaaaaucauaccuagugauucuggaaaaucuuucagcauaauuuccaccucuuugcaacuuuaucaaacucuguugugucugcaauuacaauuuuuuggacuacaaagggugauaaauuuuccuguguuucucaauucuaagacuaagauagacaacaucuaaaaccauguaagagagaugggaagcaggaguaaaugauugauuagcauguguguguguucucaauuauugaugguaauggcccguggauguaaugugaacuugccaaugcugcugauaaucgaaaagucauuuuuauugagauuuggaauaugaaacacuuuuuaaaaggagagucaucuaucuaauaaucacuuuaauuuugagguaagcuacuauagcaguuauuuuuaauucccuaaauacacaucacugugaggcaggagaggcauccaagaaugugcuagucaguggcggaugccaacaaagauuaaaaauuggaacaagauuaguaaaggaauggcuaaaaaagcugugguauaggcaucuccuagccaagggcaggagaguugagggcguggauaccagagccagacagccgggguucugacccugacccugaaagcuuacuaauguuaugaucuugagcaaguuacuuaauugagcaaguuacuuaauuucucucugccucaguuuccucaacuauaaaaugggaguguauauaauaccuaccauauaggguggugcugagaacuaaauguaucuuaaaaugugccugccacauaguaagugugauagugcuauauauuuucuauauuuuguaggcauuaacgugaauccggcaaaccuauguauagugaugugaaaacauggcaugacaucccguuaagugagaaaaagaaaaagaaacgaaagaaaaucacagagccauaauuaucacacuggcgcauuuauauuuuaaaaaucccuaaugacuagacaggugacuuauaaguugcacagugaggaagaacuugaagccuuuuuauuccaugagagaaguuuacaaucacuuuccgguuugggaguaggugaauacuugucaccuugaagccgaccuucuuuuuuucuuuuuuaagacagagucucacucugauggcccagacuggagugcaguggcaugaucucggcucacugcaaccucugccugccggguuuaagugauucuccugccucagccucccaaguaguugggauuacaggugcccaccaccgcacccagcuaauuuuuguauuuucaguagagacaggguuucaccauguuggucaggcuggucuuaaacuccugaccucaagugaucugcccgccuuggccucccaaagugcugggauuacaggcgugagccaccgcacccagcuugaaucagacuuuccuuuccuuuuuuuuuuuuuuucucaguuauggaauguaaaaucagaaguccaguugggccucagggaaagggcacagaaagaccuuuuaaguuccuucaaaggccaccucucccaagauccuuuggaaugugaaucuggucacuugggaagaggugggcagauggugcagggguucaaggagcccucuggaaggacaggcaucuuguugguuacuauacaauacuccacuguagauuauaugauuuaucuacucaauugucccucaaauuuagguuuucccaguuuuggcuauuaugagcacagcugcuuugaacauucuauauauguauuuuuguggauacagcacuuauuucuuuugaguguguaacgugguuagaaccugucuacuguauuaacauggucaugucugaggucuauuggaaagaauauacaggcauuucucuguaucugagggugauuguucugggccuuccugcggauaucagacuccacaggugcucaagucccugauauaaaauggcacaguaucugcauauaaccagugccauccccccauauacuuuaaaucaucuccagauuacuaguaauaccuaaugcaauguaaauucuuuguaaauacuuguuacacucuauugcguaggaaauaauggccaaaaaauagucuuauauguucaauacagaauuuuuuugaauacaguauuuuugaucuguggcugguugaauccacagauguuggaacccccaaauaaggacagucaacugcacuccaauggucccaaagaggaaugccaccagaggguagaagaaccuaucuggguggcaaagccuguauacuguggccuaggaguacaugagggugaccacuucugguccagguguagcugagguggaaagcacauuugaacaaccuuccuuugcccagaguucacacccgugagaauggacaaaguggauaauauuggaguccauguguacgguuccacugucccuguguagaacacaauauuagacauuggaacaaugaagcacucuaggacaguacuggcccuuuagagguuuagagucuaauugaggaggcagcagcaauauauaaaucuauacaucauaauaauuuauauuagaagcaauauguucaucucauacauugcugguaugauugcaaauugguaaagccacuuuggaaaacaguuugcuggugucuacuaaaacuaaaaugugccuaucugugaccuagcaauucuaggcauguaauagguguauccuagguacauauucaaaagaaacaagugcuguauccacaaaaauauguauauagaauguucaaggcagcucuacucauaguaaccaaaaccuggaaaaccuaaauuuuggggaaaauugaguagacaaauuguuguauaucuacaauggaguauuacacagcaauaaaaaaaaacagccuucuccuacaggcaaccacauggacaaaucucacagauacaaugagugacagaagccacauggaguugaauauacacuggaugauauauuccacuggaugauguuccaaguucaagaacaggcaaaacuaaucaguggcaacagaaguucaaugggauggguauucacuaugaagcagaaggaggaagccuucuggguuguuggaaauguuucauaucuugaucuggguagugguuacacugauguauauauaaguaaaaauuuaucgagcuguacaguuuuucacuuuuuaucauacauauauuguaccacaguuuuuuguuuugcgauaagacucucacucugucacccaggcuggagugcaguggcacgaucucggcucaccgcaaucccugccuccuggguucaagugauucuccugccuuagacucccuuguagcuggggcuacaggugcccaccaccacacccagcuaauuuuuguauuuuuaguagagacgggguuucaccauguuggccaggcuggucuugaacuccuggccucaagugaucugcccgccucggccucccaaagugcugggauuacaggcaugagccauugcacccagucugcagcuuucuuuuuuucucaaguuuuuguguuaaguauaauaaguaaaugaguucagagcacugagugaugggugaaggucaagaagucagagcagacuucagaggggagggaagaauugagguggauuugauggaaggcuggaaccugcacagggaaacugcaagagggaaguuggaucauggaaggaaauaucugagaacaaaugcauuguagcacagaugccaagaaagcuuggaaaaucuugagcuuucucuucaacacucaucuucccuccccaccaguugagaagccuuggguauuauguaggauaaucuucacucagcuccaaggguaggcuuugauagauuugagucucagcaacauaauuacuuagggaugaauguaaaccagucaugacauaauuugagucaaaggcaaguauauuccuaaaaugguccagucucaccucagcugaggcuuuaguuucaagguucagggggcaccaacagcuaucuccgucuagaggcaaacaaaagagugauugcuuccauuuuuacugguagccaucuugguaucaugagggaguuagccugacauaaaauugggcugaguugagagaaaaguagagaaaugaagcuggagcuguauuugauggcucuaaaccuuuuuggauuugcaagcccuuuaucauuuaagccaguuugaauugauuuuucuauugcuucgcaacccugauggcuuuucugcuaaucuauacacagcauuucuugaaugcucguuuucauggccauagccacagcccuauuucagaaucucauaagcaguaguuaagugaacugcaguagcuuucuaacuggucucugccuucaguuucuuuuuaccuuaauucauccuccauguugccuccagaauguucuucucaggcacaucuuaucacugccaccaugugaucauccuaaugguuccaugcauugugaaaaaaggccaauggcacauguauaccuauguaacaaaccugcgcguucugugcauguaucccagaacuuaaaguauaauaaaaaaauaaaaaauacaaaauagaaaaaaggccaauggauccaaauuugcuggguuuuaacaguuuagucuuuugguucuucucacaaacccuaacaagauccuuacucucuagccuucucaucuuugccagaguuaaugcuucagcccaggacauucuuuucucucuaucugcuucaugggaauaccacuuuucuuuccagauucaacucuagucucaucucuucuaagaagccuucuaagaucucuccagcugauagcaaugacuccuugcauuauaguuuuacggcaugauuuuaccacuugauaacucucuauauaguuugucagggguuugggugauuuauucuugucuagccuacccauuagcauguaaaggcugggaaguuaagggccccaguuuuucaucuugaaugaauucuucauugccccuugcauagugcuuuucauagacaaacugcucaaugucuuguguccucaaugucauguguccuaugcuuaacugacuagagcaaagacuuccuuuaggagaggauauggaaauaaaguuggaaaaguuagguggggaggggguuggagggcagcuuuuggaggauuuuaaaauccagauuagauauauuaagugcaauuauuuuacugcacuuuggaauaggcaaaagauuaucuguuuuccaaaauuucuuucauuccuucuauauuauuuacucuuuuuaaacuuuuaccuuuuuuuuuuugagacagagucuugcuuugucacccaggcuggagugcagugcugcaaucuuggcucacugcaaccuccgcuucccagguucaagugauucucgugccuuggccuccugaguagcuggggauacaggcacacaccaccacacccagcuaauuuguguauuuuuuuaguaaagacaggcuuucaccauguuggccaggcuggucuugaacuucugaccucaggugauccgcccaccucagccuuuuuaaccaucuccuuuucuuugggggagagggaagggggaaagcagcucucggguuugaaauaucaugcaguuugagaagaaauagaaugcaaagaugauuagcuuucuuuucuccucuccauuauaaucccauaauagacuucaugaauacccuugcuagcaaagcaaugagggccauugcauuagacuguucucacauugcuauaagaaacuaccuaagacuggguaauuuaugaagaaaagaaguuuaauugacucacaguuccacaggcuguacaggaugcauggcuggggaggccucaggaaaccuauagucacagcagacaaaggggaagcaggcacaucuucacauggcacagcaggagagagagagcgaaggggaaggguuacauacguuuaaacagccagaucucaugagaagucacucacuauuaugagaacagcaaggggaguccgcccccaugauucaaucaccucccaucaggccccuccuccaacacugaggauuacaauuugacaugagauuuggguggggacacagagacaaaccauaucacccaucuacuugagcaguggcuauaaacuuuuuuuuuuaugauaaccuaguaugcauguacuauacuguauauuauacagcugaaacaagacuuuuguaaaucagcaauacucuuguuaugaugcaaguuaguauuuuccguuaugccauuucacuucaaacaaacaaaaacaaaaaguugaucuaaaucaauuucaugaccauuaaagaaacguguucuucucaggcacaucugaucacuguugucacaugcacgauucuaaagguuccacacauugugaaaaaaagcuaauggauccaaacuuccugaguuuuaacacuuuagucgacauaugaaaaauguggcauuaaagcauauguauccuaauuacuagguuacaacuguugaaugagcuaagugcuuuugccaguauuuuauauuuaauuugauauaauaauuuuaugacagagcauuauacccuuuuaauagaugagaaaagagaggcuuagagguacagauccaagguuacacagcugcauauggcagagcugagauuuaaacaaaaguagaccaagcuucugcuuacagcucagugacaugugccauagcuuuaagugacagccaaugcaaugaagauuuccaugugcugauuuuuuuccagauggagucucauucugucauccagaccggagugcaguggcaccaucucagcucacugcaaccuccaccucccagguucaagcuauccuccugccucagccuccugaguacccgggauaggcgugagucaucacucgaggcuaauuuuuguauuuuuaguagagacgggguuucaccacguuggccaggcuggucacgaacuccugaccucaagugauccacccaccucggucucucaaagugcugggauuacagaggcgagccacuguaccuggccugcauaugcugauuuuuaaacuuucagcacaugcaagggaaaacgagaccaccgacguacagacaaaaugcucuccagccuacaacuucauuucuucucuggaucucuauucuggcccuagaaaucugcaaguccuccaaaaaaaaugacaaaacccuuaaaauagaauagucaggcugcaauagaaaaaacaguuuuaugauuaggaggaaacuucuagaaggcuaguacuaaaucuuuuucagucuucuuuaaauuaccaaaauuccauggacacucagaaugaaagauuguugaaauuuuauuuuuuuccuuuuccuuuuccuaaacucccaaaccaucuaaaagcaggcaaaaucuaaauucuacucuguauaugucuaggucuaguaaggaagguuuauuaucuuaaacaucaaucuguuauguaugacuugauuucuaaaauugcuuaauuuucugggucauuccuggaggaauacuuaugcacuacgcaguguguugggucuuaaggauacaaagaccugcuccucaccuuuaaagggggaacaugcacugaaaacagagaacauaauaaaccaauaauugugcacagugggacccaugcagaaauaaugguacaagguguugaggaaagacagugaauugaaucguaauccugccaaggcagaauuuugauuuuuccuacuuuuagguguuuugaggguuugggaaaggaaaagggaaaaacgcaucuuugacaaucuuucauucuuaguguccaugaaguuacauuaauuuaaauaagacucaaaagauuuaguggcagccucagagaaggcuccuucuaaucauaaaacuguuuucucuguugcagucugaguguucuauuuuaaggguuuugucauuuuuuggaggacuugcagagugggagacuagggcaggaauggagauccagagaagaaaugagguugucagcuagagaguauuuugucuguaccugggugguccugccuucccuuguguaugcugcaaguuuaaaguucagcgcaugcagaucuucccugcaguuguccaugaccuaaagccauggcacaugucacugagcuguaaggagaagcauggucuaccuauguuuaaaucucagcucugccauaugcggcugcgucagucuccuccucuguaaaauguuaaaauguuauaauagugaagcaguacgaugacagcaccuuguauuguauuaaaaauaaugaagacacuguccccauggcuugguaaaguaaggcaauuauuguacuuacaucuuuagggucuagagcuuaagcgacaggagucaguagccugcuggaaaucaaacucaccagcaacauuuacuaacaaugaaaucaagcuaaaaugaaaccccaagaaaaacuggaaaaaauaugaaagcugcacuuuuuaggguaaagugugcaucuugaggguacagacagauucuucauucauuuauuuaacauauaguuauugaauacuuuauaugugccaggcacugcauggguguagagacauggaguggacaagauucauguacucuggcaucauggagucuacagucugaugagggagcuggucaauguaaaaggaaaugcaucaacaugaggaucccauuugggcacaguggcccuaagcuaauguuauggcagagaauaauacgauugaguacuuacuuuagacagaauaguuaggaaggucuguaggaggaggugauguuuaagcugagaccagaaggauggaugacagggaguuagccuugugaacagugacggaaagaauuaagagaccagcauaugcaaaggcccugggguguguagaggacugugugugucauaaaucucuggacuucuuucacacaaacuggcugaagcucuccccaucccuguugccagcugccuuucugacucagacuuacagugugaguagggcuccagauugagguccuagcugguuaguuauacccauuugacuuaucaaccuaaaaauaugcugggauagucuucccuuucuacacauuugccacaggcuauaucuugcuuacugugaguuagccauucaaucaagacugcccuugacauuuauuucauucugauuuuuuuuuuccuacauuuuugccucagguccugagagaauggcugcugacacaagguagaugcucaaaaauuacuugcugcaucuuuggaugaauuucauuagagcaucagagaggaaauuuuuguuguuguuuguggcgcuauuugcuuguuuauuuuaacacaggugggacucggggagaacaaacuggauggaauuugaaggagaaugguagggcauucuggauuaccagagggcugccuggcuaugccgcuccuuaacgacaugaccuuggcccagucaucccacuugagcccugacauucucaacuacaaaugagggcuuuagaccaaguacccuucaacauauaauguuuuuugucuaugaauccaguggcaaauaugggguaucaauauuugccacuccuuccauacuacugugaaagaagcauuaucuuuaggcauuaauucagcucaugcaauaaugaugccuuauauuugauagaaauuugucauuuacaaagcaccuucauuuacauuaucucauuugauuuuaaccagucauguaagguauuuaagauaguuauaauuuuuuuuuuuuacaucugacauaaugugaaacuugcccaaggucacaaagagacagaaaagggaaugaaugacacuugucugugcuguucugaguauagguggcacaaugaaucagauaggaucucuaucaugugugagugaagcaaauuuuuuuaguuuacccccuagaauagcggucacuacuuuagaaaaaaauguuaaugacaguguugacaauguugaaauguaaauaaucuuuuuuguauuaaguucuuuaguaguaaggaucagaaaaguacuuagguuagcucaccuggggaaggggaacauugcaggaauuagcaaucucauggacagggaauacuggacuccucauaguaauugggaaagaaucucuaggacuuaauuguuugucugcuuuucuuggaacucccaagaccguucucucuuaucugaagagcaguuuccucugcuuacucaugguucuuguuucccuauaaccauggcucucacauggcuuagcuugcugggaccaggucuggcccacugacuacaagaugggcgugauccaucacucaccauaggcuacggucaaucucuuccucuucgcuccugggguccaaucugcuggggcugguggggcuggggcaagaaggagucauguggcacccccaucaaguucuaccuugcuaugaacugaauguuugugucuccuccaaaauucaguugaaacccuaauucccaaugugcuaguauuaggagguggggucuuugggagauaacuaggguuagcugagaucaugaagggggagccuccaugauggcauuaguguucucauaagaagaggaagaaagaccaaagcucucucuuucuccacuaugugagaauucagugagaagguaaucauuugcaagccaggaagagagcccucuccagaacuugaccaugacggcacccugaugucagacuuuguagccuccaggggugugaaaaacaaaugucugcuguugaagucacccagucugugguauuuuggccagccugaauugacuaagacauacuucuauaugaggauuuaugaacagguuccuaggcaagggagucugcaaauugaagaggcaucccaaaacaugccuacuaccccuccuuuuuuauuuaaguuucacaggacccucuugguucuccuuuucuuaggugccuccaaucuucuaaguauaacauucugugacaauucugugacagaauaaguauuuauucucugauaauuaaggaaaaacaaaaacaaaaagaagacaaaacacccacauuugucccugaaauuuaaaauacgaaggguuguucccugguuuucugauuguagggucaaaaaacgaagaagcaacgagacuagcaauuggauaccuuuagaucccaaacuucauccuaucauugguuucuggauagauuauuuauugcccuugaaauucagcagaagggggcugggugcaguggcucacaccuguaauuccaguacuuugggaggccgaggugggcagaccaccugaggucagggguuugagaccacccugaugaacauggagaaaucccaucucuacuaaaaauacaaaauuagccgaguggggugacgcaugccuguaaucccagcuacuugggaggcugaggcaggagaaucgcuugaaccugggagguggagguugcagugagccaagaucgugccauugcacuccagccugggcaacaagagugaaacuccaucucaaaacaaaacaaaacaaacaaacaaaaaaagaaauucagcggaaugaggagucuuaaaaaccuaaaagcuagaagggguuuuauuggauuaucuaaucuaaccucuggauuuuacagcaaaagacauugacauugggccuuaguucaaagaaugacuagagguagagccaguggaauuucuccuaacccaacguuugugaucuuuucauuacaucaucuaagcagaaccuguagggguuaacucugagaauuggggaugaugcuugugauaaugcagcaaaaaguaaugucuaaauguaagauauuauuuugagaugagaacaccgaauggggauggaagacaggaaucuucaccaugugugaauguacaggaaacaaccaauaaaugccuuaauucuuguucuguaaaaacuuacauguaaguaaaagaucgccgaaauugaucugaacucuguuacugccacaaacuuuuaucagcaaauggagauuaggauguucccacugccagaugguauauaggaauaugguugaauguggacuguuaucacagacugucugguuucaaaggugggcucugucacucaauauaguugugugacuuaguuaaguuuguaccacuuacaaaacuucuuccuugggucaagcuacucaauuuuacuugcuucuguugcccaauauacaaauuacaguaguaauacauacuccauaggguuauucuuaggcuuaaaguagccaguauuugugaaguuauaggaacacuguuuagcauauaguaaacacauguguuaucugucauuauuauuacuugcuuuucuguugcaaagacuaaaagcuauuguuuuggaguagggaaauuuccauuuaaaauuccauuggcuagguuagcgguaucaguugauuuagcaaggaauuaagagaugaaaaggaauuauuucuuucgugguggcuucaucuuuaucuguauccacuauaaaauucguaaagugggcguuauuugcuuuacacagaccagaaaacaggcuacagaagguaacugcuuggccagaaauggguugagucagucguggcuuauggcacaaacuacauuugagucuacaaagcaauagaugaaggucuucgccaagugaagacuuuuuggacuuggaaaguucacacacuuccagcgcucuauaagaagauagggugggggaguuggaggagaggacccacaucccucuuccagccuaggaccaacuuggcccagaggccuuuucccaugccgcccaaggcucgcugagaaaucuggcuccacacagugggagaacccagggucaggcuuacugugagugaggccggcccagucuuucccgagccuuccucagggagaccuggggguaucucacuucccugcggaagucuguggaguuuaauuuguaaauuugugccgaaacuacacuuuugugucaaagagcaaggacggccaagaagcggcaacacgaauaagagcgcagggaaauggggccugcgaacgaccucggccucgggaacucccacagugccgccccacgcgcgacgccuacccgagaacagccacccgccuccgcucccggaggaggcguggucgaccagcaccgccaucuuggccgccucucuaggcgcucuguuuaccacucuauggucgccugcucccgccccgccccuucccagucauugucuggaggagcagccgcggccgcagcuccuucucuuuauaagcccgcaguucccggaugugaauggauuacaauguaucuuucagggaaaccuauuauuaucaaugugacuccacgggggaguccauggugaugaugaugaggaggaggaugaugaugaugagacaccucuaaacuuggaacaaguuuaagacuuuaugagagaagaaaaaaaaucaccaacaagaauuguuugaggaaaaauuauaacuauccuguguucauuuuuuuuuuuauaaacaauaagaaaaaguuguuggauuuuuuuuuaaugauuucuuuuuugggggagggaauuuuguugcaguuuuaugguggaaaaugcaaaaaccagagccaggugcauaaucuuguaaucuguggauaucccuggagcaggacugaguaccaguuaaaauacuuuuuggggauacacaugugagauacuaaguacuugcagaagauuuuugucucucuuuuuaaagucucuuuccuuggaauauugugagaauauuuguggccauuuaagguaacguuucaauuugccgucagaguaaacuguuuguaauugaauuuaauuuuuaaaaugucgaucccgauguuuuauuaaaacaaaagggacaaccuauuaaauaauugccaaugggaaaaagugugugcaugcauuuuguguauguacucgcacaucuagcaauaccaggauuuguagaauguguguuuuuuuuuucaaacacacguuaaaauagcuuauguugcauauaccggauaaagcacgcuuguuauuacgaaacgauagaauuaugaagcuuaaauuuuauccuaaaaagugaugugaaaaaguauguuuuaagagcaugcagggccuauaaugguaaauguugaauuaaaaacuuacagugcuggcgaacagggacuuagcgugccuaggaacucaagugcaaaaacaaaacaacauccacccccaaaaauugcccuuuuuuuuuuucgaaguuugcaguuauacuauucugugacuuaaaagggaggggaaagaaaguaugcaauucagauuucgcccccaacgcaaaacuaccgaaacgaaaaucuccccaggaaaauguggcuugauuuauagacgaaaaagaaaaauauuguuccucuuggcaaagucuuuuugcaucacguguauuugcagccuaguauaaacuugcuuugccguguguggaugugugagugagagggaacgagaguaagagaaagaaagaagugaggggauguaaacucgaauaaauuucaaagugccuccgagggaugcaacgggcaaaaacugaacuguucaggcuucagauuguaacugacgaucugaggaaaaaugaggugcucgaugaauuuucguuuguauuuuuuggcgaggcgggggagguguugagauuuuuuuuuuuuccccucggggugggugcgagggggaugcauccuagccugcccgacccggagcaagucgcgucuccccgccggagcccccccacccauuucuuugcugaacuugcaauuccgugcgccucggcguguuucccccuccccccuucccuccguccccuccccuccccggagaagagaguugguguuaagagucagggaucuuggcugugugucugcggaucuguaguggcggcggcggcggcggcggcggggaggcagcaggcgcgggagcgggcgcaggagcaggcggcggcgguggcggcggcgguuagacaugaacgccgccucggcgccggcggugcacggagagccccuucucgcgcgcgggcgguagguaccggcgccugcggggcucggcggggcggaggcgcccggcggcgcgggguucgggcucggcggccccgcacgcggcuccgcgccucccgcgccgcgggcucccggcgcccggcgcucccagaagagacaccccuuccccucccgccgcuucccucccccucgccgccagcccccccgccccuccccuugaugcccccucggagggaccgaggacuuugccaggggccugacuuuaauuuuuauaaccccuuucuuucacaaauuagggugcuggacaauuagaggacccgacccuccacuccgcuccccccaacccugucaccccaccccucccccuuuggacguguuuucacuccagagacgcucaucuuuaauuucuugauagcuacuuugaaaagcggaggggaguggugugugcgagugugugugcgugugcgagugugagugugcgagggggguggggugcaggguggggggaaaguugagaucggaucguucucaguaguuucucuuuucucugugauccauucauuucucgcucuaccuccuguugcauaaaaugaugcgcugaagagcggcuuuuuuuuuuucuuucccugauuugguuuuauaguggauguuaccaguuugaucgucucuuuggaaauacaauaucgcuuuuuuuuuuuuuuuuuuuuuuuuuuuuuuuuuuuuugcuauugcugccuauuccaucuuaaaaaaacaaaaccaaacccaacccaacaacaagucucccaucccuuccuccuuuccaccuuaaucccacccgcccccacguccccacccccaaccccccagucuccaaaaauccgauuguguuuucuccaaggauugggacuggauuuucugauugcgguuauuuccauguuucuagguuugugugauuuugcuaaaaugcaucaccaacagcgaauggcugccuuagggacggacaaagagcugagugauuuacuggauuucagugcgguaagaaagaacgguggaaacuaacaacagcugugaaaaaaacaaaacaaaaacccaaacacuucagcuagaaaccaguaggaaucuaaaggacaguaauaauuuuuaauuggcugaauccuugguaaauaugaaggucuuuuugacaaguuuuuaacuauaauuuuguggugugauggaagauucaggcuuuuuuuuuuuuuugaguuuuauuacuggccuucaauucccuacccacugauuaccccaaauaauggaaucucaccccaguggaaagcaaaaauagacaccccuaaaacuaaaccaccccuaaaacuuggccaugucugaacacugagacuacuaauacuuugcacacuacucuucguuuuauuuauuguuuuuggaaauggaaaauagaaaauaggagacccaguugucucuuuaaaguuuuaagcuaaugaugcuuuggauugguaggaccuguuccuuacaucuuaccuccuaguuacaucuuuuccuaggauucuuaaaacuaguauggauaugcugagcauacauucuuuagaaccuuuuggacuguuuugguaaauuucguagucguaggaucagcacaaagcggaacuugacacacuuguggaguuuuacggcuguacuugguccuucuccaucccuuugcuuccuuuuccuaaaccaagucccagacaugucaggagaaugaauucauuuuuaaugccagaugaguuugguguaagaugcauuuguaaagcaaaauaaaaagaauccacaaaacacacaaauaaaauccaaaccgccuuccaaguggggcucuuucaugcugcugcugcugcugcugcugcugcugcugcugcugcugcugcugcugcugcugcugcugcugcugcugcugcuccuccuccuccuccuccuucuccuccuccuccuccucuucuagaccuucuuuuggagaaauggcuuucggaaguuuugccaggaaacguagcccuaggcaggcagcuuugcagcccccuuucugcuuguugcacuuucuccauucguuccuuugcuuuuugcaggcucugacucagggaaggugugcauuauccacuagauacgucgaagaagagggaaaccaauuagggucgaaauaaaugcuggagagagagggagugaaagagagagugagagugagagagagagagagucuugcuucaaauugcucuccuguuagagacgaaaugagaauuuagugcagguggcacuuuuauuuuuauuuggguucacauaugacaggcaaauccuauacgagauggaaauggacauugccacguuuauggccaagguuuucaauauaaaacaaaacaacuuuuuucuucuccuuggugaaacuaguguuuuucuagagaggcugcuggccuccaaccugaaucuugauaacauuauggggacuguguuuguuccaaauguagcaguaguacugcuuggccaucuaaugaaccugaggaaaaagaaagaacagagugauaaugggggcuggggugggaucuguaauguuguuucucuuuuaguuuuaaguuggauggugauguauuuuacuaaauaaacccuuagcauaaacucuaagcuguuugguaacaguaugaaagaucuuugaggagcucugaaggcacaagugucuucuuuucaacuguaauauuucuuuguuucuuuuagauguuuucaccuccugugagcagugggaaaaauggaccaacuucuuuggcaaguggacauuuuacuggcucaaguauguaaauucuuuucuuaguguuaaguuaaauguucugggcuguuuauuuacucaauuguauguuuuuggcucuguugaagaguucugaaaaagucauugaauuuuagccuguaaucauacgguuauugcauuacccaucagugguauaacuuacacaaaauguuaucuugugcgauuaaaauuaggucuuuuuuuuuaagucaaggaaacucucucaaaauuccaucacuuaauuuaagagcaauuuucuaauacaguuguaaucaaacacaugaagauaagaccaguguuaacauggggaauaaauuaauguuuucuauuugaaaauaaggggaaaaaaucucuaacauucauaaaaugggaaaaucccuuguaaauaauaucauuuauuagguacuguauacaauuaacccuuuuaaagaaaugaacacuuaauucugcaaaugaaugcuauguaguaaaccauagcuguaaauagccucuugcuaaucuuagaggcuaaauaugaauucauuuauauuuaaaauacccuuuuugaugcuuuagcuguuuuuuuuucccuaacgauuuacuugugcaaugaauuuuuacuguauuuaaaguugcaaaucuggaaggacuuuuacguuuuauaaaugaaagaucuuugggugaugcuuaaaaaagaugcuagcacuauucacaaaggaaucugugugcacagugauuaucuggaaucuaaggagggguuuauuacagggcuauucgaauaucucuuauuaaaagugcagagugaaaauauucauuuaaaauguauuuuuuuuaauccaaugaauuucaaauaagaaaaaguuauacauuguugccugcuauccuuuaaguccguggcuuaaguccauuuaugcuuguuaaacagcugcaguauuuuaggaguucuggcaaugguauauaacaguacauuaggccaaguacuauucuuaagucagacugguaaauguugacaucuuuuaacugugagaugccaguggaauugucugucaacuaugaauauaauuuaacaucuuuuaauauucauuuggugcuauagcaaugaaagaaguuuguucacuuaugugauuuguauaauugguauauuuuuauaaaacuaauggcuuuaaaaguugcucauuuccaaauaaguuccuucuccuucuauugccugccuaaguuuagggaauuugugucucgauaacuuguuuuaaaaaaugugagaugcuucuuguauuuuuauuuuaguuuucuggugcacauugauuaaaaggaccauugacagacaauauguuuguguuuuacuauccuggaccugguuauguuuuccacuuagggauuugggauaguuuuuauauuaguauuauaucuuuaaauuucuguaugguauccucuaugcaacuuuuaagauggaaaauauuaauaugcauguuugauguaaagguaaggacaaguaucuuuugugggcaaauuaauuuuucauguuagacaagaucaaaacuaacuguuuuugacaguaauuuuuuuaugacuuaacuuaaaaauguguauucaguuucaaucuaaaaguagcuuaugucagacagacacagagauagacuacuuuuaaagucaaugcuaaaaaacuaguuugcaauguugugaaaauaugcauuuagaauaacuuaaguauauuacauuagauauuuaauaaaguaagguguuuagaaauaugagauuguguuacauuuaaaaagacaacuguaugucugauccauuuucuauguucacauuuaaauaaaguucuugcugugauguuuaaauguuuauagagaguacaggcuuaauaaguugaauauguauuaaugcauuuugguaagugaugauauaucaacacuuacacaguucugaagacaauaacacacacacauacacacauacacacauacacauacacacauauguucaugcaugcaaaccuggagagagacuucacucuuaauaagucauguuacacugcuucuaaugcauacacagugauuauuuugaagguguggaacuuuaaguuacguuguaccagaaaugguguuuucaggaccaaauguuuacuuguaaggguaaaaaguguaaugguccuuuuauucuggcagccugaaugagaaugcaggguauucauuucauguaguaugauggugauuauaauauguaggguacagauuggaguguucaguuuuccucuaucaagauaguauuugaacacagggcuguuaguuaagaaaacggguuguauuuccacuuaaaagaguuaaaucuuuuaaaaagcguaauacauuuuaaaaaucaugaauacugcauuuugcccuuuaauuggaaggaucaacuaggaaacuuuggagagagaaauaauuuucuaaauuuaccucaaguuaauauccauugucuugaguggacucagaugucccuuucauggauugcuuugaaacuuggauuuaggaaagaucuaaacuauaaguagacuguuccuauuugaaaaaucagcuaugguuuuucaaagugaggcaugguaauaauucaugcuuaaaguucccaauagcuuuugauuccauuaauauaggaugcuccauagugauuugcaaugugagaauaaaaauaaaguguggccauauucccuuuaaucuuucauuucacaaacaugguuuuuccuaccaccuuaagaaauggugaggcugcuagggagaauggaauguaaccugagcuacagccugacauucccagggagcauuuuucacaugaaaggcuuuugucaacccaggaaaggacuagcaguuuuuguuugauguuugcagguguucagcagaaagcacuaaaacaauucagccaugaugguucagagcuucgaugaccuuaacagggaaaauuggugggcucuggaauuauuuuuaagaaauaguuauaaccuauaugguaacuuaaacaaagggauuuaauauccguuauaucauugaucuuaaaacaaacuaaaagcauccacaugccuggaugauuggaaaauuauucucauugaaaaguaggauaccuaaguuaccaaaaaaagaaaaucaucuaaagagucuauaauuuauugaugaguauggacuuaauuuucugauauagcagaaggacaguuuauuugguuacuuuugacucuugugaggaaaagauaaacauccuagcuuugacaucuuuuuaaaaagucguuuuaaaguugggccacuaaaaugauacauucuaaagaacuuguuagaucaggucuggucacaucuguuacauguauuuacugcuggucuaugacagauacuacaucuuucucccuuaguuuaaaaguugagcuuuuuccccugugacuguuuaguuuuacugagguguucagguauuguuaaaagauugucaaaugaacgaguguuugaacaauuaagagcagcguuaaaacacaccacaucucuguugugggucauuuuuggaagaggaaaguauugccugaaauuuaccuaaguuagcuaaccuauauccacaugacaccaacauaauaugccaauuuagugaauucauugaggcggaaaaaaaucaguccgguggguaguuuuguaugauacagaaaauuaacguggucacauccugaauuaguuuugaguucauagugauggcaugaaaaaaaaauugguuuccccuuaaagauauuuguugaggagagcugcuuaauauuguguguguguguauaagugagugaaaacacccuuaaaaucguaaaugguauaauucauaaggguucuguggcuuuuuguaaagggcagaguaauuuaacagguuaaaagaaguacaguggcguuaaacccauuauguuagaaucacagaauuuuggguauagaaacccauuagaaauguugcccagugccuucauuauacaggcaaagaaaacugaggcccaagauaaggaguuccaaacugugcuuucuuauuuguuauuuuaaaaaacaaguuuuuauuugcuaauucucuauggcccugcaaauccuuuauuggaaauaaccuuggucucacugcugucuuucuguccuuuguacugcguaauggggcuugaggauuagugugcugauauuugugcauguaaaugcuucuguauaugcaugugccuucugaaaacuuuuuuagguuuggagcugaauuuuggauuauugaucauucucuuuugccuggucuucccugugacuguuuugcaugauguuggguaaaauaauagugugggugagcaugucacagugcuucucaguguguuagagaggugugcuguguaccuuauaccuguuguauuuuuuaaauccuaacaagaaccuaaugagaugcaaggauuacuacuauccuguauucauagcugaggaaacagagacagauguuaaacaacuggaucuuaaggcagccaauaaugaaauuagguuuuaaccucagguuugucuagcucaaaguccugaguucuauacacacacacacacacacacacacacacacacacacaucagacagcucauuuuugcaagauuauauaggcaaacagugugauauugaggcuucgcacgaaaugcuaucugugaucuuuaggguagauagcauuuuuaaaaaugugucuaauguuguaaugaugucaaccauauccauuauuuuucccgccuuuguauccaaauaaacuacccuuccaauuuaugacagauaucaaugugacuaaauaugucuuucucauaucuuuauuaguuuuacuaagaaaauacaguagauauuuuaaaaguugugcuuucauucuguuguaaguugauagucuacauggaugccaaugaaaacauguuuuuauguagcuaaucaauucagaauuugagguaaccaagccugauguauuaauauguaaaaaaauaaggaucuccugucuuuaaauauaaaaaaguuuugcaguucguuguuagaucuuugaaacuuaauauucaagaacaauacccucaauucuaucugcaucacuaaaauaagcaguuuugaagguuugauaugucuguuaccagacaugugcuuaaaauguuacauuuucuaaauucagaaggcagaagcaguacucuauuugacacugacuuaaguaaauaaaaugcauuaaacaagcguggggauccaagaacuguugaaacugaaaugcuuaacauuuuugacagcaucagcaaauuauccuuacccuacuauuguaaugaggaaaucacuuaaauaacagaugaacagccaagucacauaaacauauauaauagaacuauguaaugaaaguuuaugcuguuaauugcucgaaucugucuuaaaugcuuagaaucauggagcaguaaagacugucauauaaacaguuuuguuuugagcuuaaaauuauuccuuuuugcuuucaucugcuaugauaaacaaaguaauuuuguaagcuuuaaagaucaaacauuuacuccuaaugguaaacuacauuuuauauuggaaguuugcaaccucguccaagucauagaguugaguccugguggccccaggccugugauuuucaacguuuaguauuaugaugcuauuuagaucuguucccauaagccaagauaacagaucuuaaguugccuaauaaggaacaugguguguuuugaaauguucuucaguuuacaagucuuaaaccaaaauguucuuggccaaaccuuuagaaucuauauguaaguugaauaagucagauuuuauacagacauagcaugaaaaugaagcuaaguaggaacagaaaaaucugcccuuucuuuauuauuuuuuuuuuuguauuuuaugagcuauuuuuuauggccagguguuuguucuuccaaguuaauuagauagugcuaaguauuagaaaauguaaaauacauuacagauuuuuuaaaagguuauuuuuguuacugguuucuuauuacucuggguaaaauuuucacaacugaccaccagguuuauuagcuuauaugugagcuacccauuuuguacauucgugagccaauugacuaggaauaagguaugcacauggguuuuauguggauacuuuugacccauaucucucuuaauacuuaggagagagauauaagagaaauaauaauuuaaucuuuggagaagauuaacacuuuguuauaaguuauauauagguaaauauauauauauauauuuauauuagacuugcaggaauagugaaaauguugaaaagguugucauguuuacuuucauuucaaagauaaaggcccaguuaaucagcauaucaaauacccagguguguuuaaaaucaguuuaugugggugaauuucagggcuguaagaaaguauuuuauuuaaaggugcagccacacgauugauuguucaaaugggugcuuuuguacuuuugugugacaauuaacauuuaaugaaugacuuucuggacuggcauuggugguaauuacuauauguaguuuauuaacugcaauccauuguuggaugugccuuuauugauuuguuuugcaaacaccccuucacaugugcggcaguauuugugcagccguauuuguacguuacuuuuuaaagaaccuguuucacuugcugaugcugacauugccucuaaaaauguuaguuuauaaauucucaugugccagaaugucucuuugauccaaguaauuuuagcugaaauacaaaauccgucaacuuuucugcuauaaaaaguuugcauucaaauccucagggaaucccaaaguaaugacacaauauuguuuuucaaguaaauaauuuauggaaauuuacauuuauaagagacuuuagagaugcucuauuuuuuagguaaggagccaagguucgggaggguuaaaagucuuuugcccaaaucaugcaguugguuauuggcuguaauaggacacaaauacacauguccugacccucuggucaaagaccucaugcugcuuuuaauuaaggcuuggacucaauucgaugguaccaacuguauauuucuuaagaagggaaaaauguguauaaucuaccauuucugaaaaaauuauuaaaaauugagauugugaaagauggacguuguaauccagcccacuugucaucacguguucuaauuuggccaaggcaguugacaaauaacuguuaaaauguauuguguuauuaaaaauaacaaaguaagacccaugauuaaauaucagggcuguaauuuaaucuugggggaucuggugcuguucauaaaccauuuggcuuuuuucuguaacggaugacgucaaaauccagcuugauugaauuaugacccuggguuacagcagcaccugcuggugccuuuuuacuucauggccugucagcauuuccauuacaaacuuuuuucucugacauuuuaaacuucaaauaguuaaacuggacugaugguuggcauauaaacuuucugcuccuugggaaaagaccacuugcucaauaaaaacagagaagguggugacaaagccccauuacaggauaccccuuagaauguucugcuuugcuuuaaucuuccauucauuuaaacauucuuuugggggguacuuagcugaauugcaaggcauccaaauggaagguuuuuaaucucaaauuucccaugugaagacuuaaguaugggguguuuacaggacugguaaagugcaaaaagaccuagcaucuaugcagguuauugaaacucuggacaauccaguuuucauacaguguguaaaaugcugaggagcaagccaugaaaaacaugcaaauuggcauaccuugucaguaauugcuuuuauauucacuuaagaugaguaaaaauugauaaugauuaugguuagaaaaguaucuuuauuuauauuuauaucuggagacugguagcauagcuucaguuuguccccuuggguuuuaauauguugggaauggagaugggauguuguuugcaucuagcuagucagcuuuucaucuaucuagucuaauucugauugauggaucaucauauauauauauguauauauacacauauauguauaaauauguauauacauauauaaauauauaaacguauauauacauuuauauaaauauauaaauguauauauacauuuauaaauauauaaauguauauauacauauauaaauauauaaauguauauauaaauauauaaauguauauauacauauauaaauauauaaauguauauauaauauauauauauauuuaguaccugcuauucucauaucuccauguuagcaauuagaggacauagagggcuuuauggaagagagaaccuucucucagagggcauauauucuaacacagggguguccaauauuuuggcuucccugggcuacacuggaagaagaagaaucaucuugggccacacauaaaauacacuaacgauaguugaugagcugaaaaacuuuugcaaaaaaaccucauguuuuaagaaaguucacgaguuuguguuaggcuguagguuggacaagcuucuucuaacaggagaaaauagaaaaguaaaaaugugauuaacaucuagcauugggaagacacaauaaugugggaguuuagagaaaugaaaacuuauuucuuucauggggaaauuaauaaugaaggguucauggaaaacucaauucuaauccuugaaggaaugguagaauuuugacaaguagguagugagacugagcgugcauaucaggaucacugugaaccaagcacagaugaaagaaacuggaaaggguagauuaaagagagcucccagaaagagaaguuucuuggcucuaaaguggagucaacucuggucuagacacaugggaugauuuccaggcaaaaaccccugucuugguugccguuuauuuucuugacugaguuugcguuucacucggggguguuaccgauuauaauccaguuccauccaaaaguauauguuuuuaaugguagugucgggauggaaauugaagauuuugugucccuacuucccaaaauucuuccuauaauaucacucagcaguggaaacuuucuugagccaaaugaagcugcuuuggagaaaauuguucauguagccaaauucuggaaaucuagguucuuuugcaauguuugcugguaaguagcuguuucauauugaggaagugguagaaucuuaaaggcugcaccucaaaacuaaacaaaaucgaaacucaccaguacaauucaagagggguuuucacauuuuuuaaaaaggaauacugcuguauuuaaaacauuuuaagauugcaaaaauucaucauuauaauuuuuauuaucaucacuggcaucaccaugaccagugucacauuguuuggucaaaagcuggaauggaaaugugauaguuaucuuugccauauuauauauugagaaaugcguuuaaaacuuuuccggagauaccgugaucuuagcaaaaacuaauguaauauuuguaaaaacauugugaaguggccagauauaccuuuuaaugaaacugaccagaaguacaucacaaauagaaaaauacacguguguguguauguguauaccaucccuucccccaaauauuguucagauuaaagugucuuucucucugugaccugcaaguaucuuaacuuagcauguguguccaauuuccauagugaagccaaaaauucaaaugaugguugauauuggcuuaggaagaauuuauuaaugaaugacugugcuugguauagaguaaaaaaaaaaauuuaugacaaagaggauauucuagacucauguaaaagauuucaguuaagaaccuaugaauuccucaaccuuuuucuucacuuuucaaaaaguaaaggauuuauauuggaaauauuuugcaacccuacaaccugaaacucaaagcuuuggucagcaggugguaauaauauuuccagguugaauauccaauuucauacauaacccaauuuguaaguuugaaaagaaauauuaaacgaugucaguuuuaaugcuuguuugaauaauuguucuuuguuaugugcccucuuggacauuauuguccacuagugccccaaaccauugaaugcuuuucuguucucuuauggccacugugauucuucaaucuaguuacuucuaacugcaagauuaauuuucuucugacaucuaauuuuccccugauuuuauuaacaucuuauuauucuuuuucuggcucauuuugaacaauuucucuuuuauaugggguguauauuuguagugucccacuuguaagggaauucuacacuuuaauccuuaguaauuuugguagaauugggauaagaugagagauaguccauaauuguuuaaggcuugauuguuuaaagaagguugaaagcuucagaaaaguggaaguggaugaaugcaugccauguucuuauuauuuuuucagugugaguguguuucacuggaguaacgauagaguuauuaggaauuauuaccuuuaauuuacuuaugugcacauucauucguccacucauucauucauucauucauucagugaaaguuuuuuuuuuuuugagagccaagauacaaguuauagugcuagaaauuauggugcuacaaagaacaacaaauuucaacuucagcacugggacauuauguugcaguuguuaaauaaaaguucuacaguaauucaaagaagguacuuuugaaauaaaugauguuggccaggcuggguggcucaugccuauaaucccggcacuuugggaggccaaggcaggcggaucauuugaagucaggaguuugagaccagccuggccaacaugauuuaauuauuuuguagaaaucccguuucuacuaaaaauacaaaaauuagcugggcgugguggcaggugccuguaaucucagcuacucgggaggcugaggcaggagaauggcuugaauccaggagguggaguuuguggugagcugaaauugcgccacugcccuccaguauuggcgacagagcaagacucugucucaaaaauaaaauaaaauaaaauauguugaaauaugcaaguauacuuuuucaaaggacacuuuucaaauauaaccaaguacagacuucacauuucuaacugaaacggaaauccuaaaaucucuguauauguguacauguucuaugugaauauaaaggaaggcgaauggauuugaaugcuuauggaaauuggcccuugaaguguaguguuaggaauguacucugaaauuuagugucagagguugucugggaggcaaugagaauuaaguuccauucguccuuuuugagcagaaauuaaaauuuuggauguguagaugguacucauuuacuucuaggacacuagauauacaugcuuaucuuuuuuauccccacacuugaauuauguuaauauuuguguuuaaauugauacacaguaaaauauucuuuuaaaauuaaguagaugauuauugagcaucuaccaugugucagguaauacuuuggcagcucuauauaaaaugaugagcaagacaggcauguuucugauguugccuacauggaggacacagacauuaauggauaaucagccaaagaaggucaaguacuacauuugagagguguguggccugagaagaguuugcaauagggauaucugaucaaggggagcagucaggaagggcucagagaucagcccaggugaacuguggucuuacagaugaggaggaguuaaguggauggagguugcuuggcugacagguagggcaugauuccagccgcuguggcugguggggguugguaggugucagaucccgcaagacugagccacagggagccuugacagugugcugcuaaucagauuugugucugggacauggacccaaaggggagucacuguggguggcccacaccaguugugaaguuuuugcagaaguuuaggugagagacaggguugcugguucuacagugugggugguaaaguuggagaauuaacuuuguagacuuuauuugaaaucuguaccuuuaggucauuggggagcauucauaguggcuacuuguuuuuuuuuuuuuuuuuggugaaacuuccuauaacuuucuaauacuugaaaaucuaccauacuuuauacauuccgacaguaauuaugagaccuaauucagcugugugauagccacugccuuuuuagcaaccaagcacuaacuagagaagugcucuuuuauuuucugagaaaaguuagauugaguuugcaauucugcgaggguacagggguggaagugggucuuauugaauggucuucaguaccauuuuggcuuuuuuuuuuugagacggaguuaagcucucauugcccaggcuggagugcaauggcgcggucucagcucacugcaaccucugccucccgaguucaagugauucuccugccucagcuuccccaguaguugaaauuacaagcaugugccaccacaccuggcuaauuuuguauuuuuaguagagacaggguuucuccguguuggucagacuggucucgaacucccgaccucaggugaucugcccaccucggccucccaaagugcugggauuacaggcgugagccaccgagccuagcccuguuuaggcuuuuuauagccuauguucuuaugagcaguaaacauuaugaugguuuaguuagaccuguugaauugaauucacuucuccugccuguggucagguaucagguagcacagccacagaaguuacugaaugucuuuguugguggacuuuaggagagugguuuaauuuaugugguauucuaucugggauugcagcaguauuguuagauugcauuuugucacagggaggaaauuaccugguaacuccugauuaggaacaaaaugaagcuuccccuuuuuacaaauccuggcuaacauuccauuuggcucucuucuguugaccaccucucucucuccccucccuccucacuccauuuucucaguuauuuuauuguuuacuauuggaagucaccucccaacucaggauacuuguuaguccauuuuaggaaaaauaucaccauucuuucacuauuauucucuguugaaguugaagaacagaauauuacuuuuuuucuuuccauuauugguuacaccagcuaguuagagacuugggguaauacugugggcauggguuggauccugauaucugugucaguuagugagaguugguucuaugacccuagagcucuuuguguccuucaaacgagggugcugaaacaagacgaacauagaacugucuauaccaagcaaaaaacuccugaaagcacaugcccacugcaggugaauugguagcauaguguggagauaagugggcagugcuugguccuguuucugccuccuagagaguaccucucagcauccagggaugcuuuaguaacucuuaguuaaaacgaaaugaacuauaauuaauuaccuuucuuuugggagggacacagagaguuucaacagcaucuacaaugcuuuuuuuuuuuuuuugaaaagaaaauaugauagaauauuaagauugacagagcuggggauggguuggaggcugaauuaugauguguguuuucuuuaugcuugaauuauuucauaauuaaaaacaaaacauauaauaacaaaaaaaaaaacacccucuaccucucauucacauuccccucuggccauagccucuuucuugacuuccuuccuagcaagacuuuuguuaaguguuuucuacacaggcugcuacugcaugcuucaaaauuuaaccccaagcaaauauuagaaaacauauuuuaucuuauaauacuugauaccuacagaauaaucuguguaacaaauguaaguugugaagcuuaauaauggagugaacaucuaugaacccaccaccaacauaaguacuggagcaaugucagauccauuggccggccuguggguuuguucccuguccaccuuccccuaucuuuccugccagagagaaacauucucaugcccuuuuuaaaguaguauugugacuggcauauguaucccuaaacaauacuguauguuguuugguuuugcuuguuuuggaggauuauaaaacugauagauuguuuugugcuacuugcuuuuucacuugguauguuauuguccauguuguugcaugugguguauguuaauuuucucugcugaugaauagguuguaguuuauuuaugcauguuccaguugaugaaccuuuguguuccucuuuuuuggaacuacaaacuuucuuguauguuucucuugaugcacauguguaagacuuucucugugggguauaugaguggauaucuaugaguagaauuguugguuuguagaguuacaugaaaguccagcauggcaggauaguguccaguuguuuuuuaaagauucuuacugaucugcacucccaccuguagcauaaaggauuacuauuggugcagucuacugguauaaaauagaaaauguaucccauuauagucuuuuuuuuuuuuuuuuuuugaggcagggucucacaucucacucuguugcucaggcuuggagggcaguuuugcaaccucggcucacugucuggucucgacuuucugggcucaaguuauccucuugccucagccucccggguagcaggaccacaggcacacacaucucacccagcuaauuuuuguauuuuuuguagagaagggguuucaccauguugcccgggcuggucucgaacuucugagcucaagcaauuugccuuccuuggcuucccaaagugcugagauuauaggcaugagccaccacacagggccgcauuguggucuuaauuugcauuuccuugauaauucgguuaaacaacuuuguauauauuuauuucagaucauucauguccacucuguggaaucuaccccgcccccauuuucuauuggguuauuuguuuuuucuuauugauuucuagguguucuugauauauuuuuggaugauaauuauuagucauacaugcugcaaauaccuucucuuauuuugugacuuuuacucucucuaugguagcucuugauaaaguccuuaaauuuaagauagucacguaauuauuuugaaggguuggaaaagccuucuuaccccaagguuguacauauauucucuuguauguuuccucugaaaaggauuugauaauuuugccuaucacauuuaaguuuuccaugcaguugggauugauuuuguguggaaauccauucacacguacugaaaaguccauccuuucuccagucauucacaauacuauuucugugauauuuuuaguuccuguauuuguggggucuuuccuucugggccuuuuauucuacuugguuaguuuggcuaccuugccucgguaucacauuauaauaaauguuauaacuguauuuuguuguuuguuagguaaagcccuuccuccccacuuuucgugucccauauguacacauuugacuuugggcuauuguggagccugaguucuucuacgugaauuuaaaauucagcuugucaaggucuuugagaacccuuugaggcauuuuuauugaaguugcauggaaacuaaagaucaauuuugggagaauuauuaugcauuuaaugauuaucucuacucauuuauaucuccauuguuuuaggugucugauaucucaaaacaauucuuuauaauuuuuuagcuguaauuucguaauuauaguuuuauaauuuucuccaugaaguuuuacauuuucugaugauuuauucuucaguaccuuauuuuucuguuucuauuauuaccaguauauuuuuuuaauuauucaaauuauuuguuacuuguauauagaaagucuuuuuuaaaauuuuuauuuauuuuuuauuuuuagagauggaaucucacucuguugcccgggcuggagugcaguggcgugaucuuagcucacugcaaccucugccuccuggguucaagugauucucuugccucagccucccaaguagcugggacuacaguugcccggcaccacaccuggcauucaauugauuuuuguauaucaauuuucauauucagccauguugcugagcucucuuauuaguucuaaaaaugucuuuguguuuuccuuagaguuuuuucuguagaucugucacaucaugugugacucaagacaauuuuauuguuuuuuccuuucaaaccccaauacuuggccuuuuuuuuuuuuugucuuuacugugcuauauaugaccuuaaguacacuguuaaauaggaauggcaauacugauuaucuugucuuauuccugauuuucaccaugaauagugauguugauguugauagauacuugauuaagaaaguuucauucuauucauauuucaugaagaguuuuuaucaugaacagguauugaauuuuaucaaauacuuuuucuacauaaaauuaaaugaugacuucuuuauuuccuuuaaucuguuaaugucgugagugacauccguauauuuuccugugguaagccaccuuugcauuuuguggaugaaauuaaugauguagcuucauuacucuuuuaaaaauauuguccuggacucaauuucaaauauuuucuucaguauuuuuacaucuaugcuuacaaguaagauuggcauauaauauuuuuuuccuccuacuuucuaagucuaguuuugucuacaaaguuagaauaaggaaguguucucacucuguauucucuggaauagucuuaaauaaggaugaaacaaucuguucuuugaaauuaggucaaacuuaucuguaaaauugguccuaguauaagaagauuuuaagccacugauauaauuuuuaaauauaauaauauugagagugagagcuuuacuuuuucugcagauacuuuaacaauuaaauauauauauaaacuuauauggauguguguguguauagauguguguguuguauacauauauauguaauauaugucaguuuucucucuauuucauuuacauuuuaaaauuuauuaccauaaaguuauacaaagguauucucuuagcuuuuuaaucucugcugacuccauaauuuucauuuuucauucauaacuuuauuuauguauuccuucuuuuuuucaugaucaagcuaauuugaaguuuuucuuauuuauuacucuuuucaaaccaacuuuuggcuuuguggauuauuuuucuuguguguuuucuacuucauuaauuuuuaaucuuuguuauuuccugcuuucuauguacuuaggcuuauuauucuguuuuuuuuuuuuucuaaauagaguugacuacuuagugcacuaauuuaucauaauuucuuuuuauaauauaagaauuuaaggcaauauaauacccucugaugacuguggugacuguauuacauagguuuuaauuuauuacauuuucaucaucuuauaaguauuuuaauauuuacaguaugauuucuucuuugauacuugcaauauuuuuuggugccuucaaaauuuuacaaaugaauguauuacuuaucuuuuuauuauugaccucuauuacaauuuaauuguugucagagaacuauucuguauggcaacaguucuuugauauuuguugaggcuugcuuuguugccaauuuugugaaucaguuuuaaaaguuccauugugugcuucagaagaauguguacucuaugaauucagggaucuauauguguccagaaauuaaagcuuguugauuguguccuuuuuuuuuuuugagauggagucucgcucugucucccaggcuggagugcaguggcgcgaucucggcucacugcaaccucagccuccuggguucaugcaauucuccuuccucagccucccaaguagcugggauuacaggcgugugccaacacacccagcuaauuuuuguauuuucaguagagacuggguuucaccauguuggccaggcuggucuugaacuccugaccucaagugauccacccaccucuguugauugugucuuaaagucaucucuacauuugcuaauauucgaaaucugccugacauauuuguuauugagaaaaguagauugaaauaauuugcuaugaugaugaauuuauaaauuuuucccuguauuucuauuuugacuuuauacauauugaaauuauauuauuacaugcauucauuuuaagaauuacuauauuuuccugguuaauuaaacccuuuauucaguuuguauguggcuauucucuuucugcccuuuuaucuuaaacucuguuuugucugauauugguauaauuauugcacuucccuuuuguguaguauuugucuauauaucuguuuuuuaauuuuuuguuuucaguuauuccauguugcuauguuuuaaauaugcagaguggcauuuuauuuuucuuaguauucugaugguuuuauucuacuguuuucugaauuucccuguggcucauaagaaguucaguaucuuucugauugccauucuuuucuaguagaucuacccuuuucccugacuguuuuuuggcauuuagcaguuuuacuguaauguaucuauuugugaauuuuaaaauucuauuuggucuacauuguucuucaugcaucuguggcuucaugucucccuccaauucagaaaaauuaucagcuuuuauuuccuuaaauauucugacuccuuuauucauucuguucucuucuuuggggauuccgauuacaugugugcuugaccuucuuuucuguccuucauucucuuaacuuuucucucauauuuucaguccccuuguaucugcugcauucuggguaauuucuuuagacccaucuuccaguuuacaaauucucccuucagguuucucuaacguguuaucuaaugcaaugauuaauuuuuuuuauuucauugcuuacuuuuucauuucuaaaaguuccauuugguucucucuaaauuaugccuacuaauuuuuaaauacuuucuuauuucuuguucauuuuugugauucugucuuuaaguucuucuuguauuuaugacaguuuuuguauuauauguauuuauuuauguguauaaauuuauaggguacaaguacaaaacgugacaugcauagauugugcaguggucaagucaggacuacauuguacccauuaaguaauuucuuagccacccgccuccugccccucuaccuuuccggaucuccguugucucucugcccacugauagacuacauccaugucuauacauuuuuauuuuuauuuuauuuuuauuuauuuuuuaguuuuugaggcagaaucucgcucugucgcccaggcuggagugcaguggcaugaucuuggcucacugcaugcuccgccucccugguucacaccauucuccugccucagccucccgaguagcugggacuacaggcacccgucaccacgccgggcuaauuuuuuuuuuuuuuuuuuuguauuuuuaguagagaugggguuucacuguguuagccaggauggucucgaucuccugaccucgugaucgccugccucagccucccaaacugcugugauuacaggcgugagccaccguaucuggccauccaugucuauacauuuuuuagcacccacuuaugagugagaacauguaauauuugccuuucuaugucugguuuguuucaccuaagauagugaccuccaguuucauccauguuacuacaaaagacaucauuuuauucugguuuuuuuuuuggcuucauaguauuccauuguguauauaugcuacauuuucuuuaauaauuguaaaauagacuaugcaauuuuauagauauuuucuaacaaauccaaugcuuaaauuccaugggcuugagguagucuuguuauuucuacuaacccucacuuaagcuucuuuguuuugcuuuugugagaugcuuaugaauucacaucugguggguauugaaucuaugaaaaucugggagucuaaagugagaauacuuucuccagagaggaauugcuuuugcuucauagucucuuuccuacucugggaguccuagucuucuuaucacagugcugauacuggcauuugcucucagagcaucccugcuucuugugccuaccuuucaguauugaaaacucaaguuuuguuuuauuuuuuggugcuuucaagauuuccuuauuucuugcauuuauacuuuuggagaauuuuuuuuuuuuuuaauguugaacauugguuguuuuguagugugagaggccuuggguguauugucauacuuuuggaagcagaauucugauuuacucuuuaacccuuuucagucugacuucugucaccauuuauuccaaugaaacuaguugugcuaagauuaccuauaacucccauucuucccagcaacuuuagagaaaauguucuuuuuaaaaaaauggaaacucugugcuucuagauucugcacaacacaguuuccucuccuaguguucuuucugccucucuuuuguuggaagaggaaauguuggggaucuuaccugggcuuucuuuuucucuucuauugagaggcaguuuggugcagugccucaaucuggaaucagacugaguuguuaucaucugguuauuagcaauaugaccuuguuuucucacuguaaaauggauagaaauaggguuguugggagaauucauuaacauaacacuugccaugcacucagcccauuucuaacacauaguaggcauccaguacaugucuacuuuuauucucugguacauuaucuucuuaagucaucucuuguuuccaagaugacagcucacguauauauugcuccaguaugaucugugcaucucagagucaguuuguagagccaucuguauguuauauuugauuuucuucugucuccuuaauguauaccuucccuaggcuucugcauauaggaaaugacacugccaugcaccuagaugauuaaaccaguuccggacacuuugaccuuaucauuuguguuaccaucucacaugauaauugugaguugugcucuccacaucugcuuucaccaguugaguucaagacaccaucauuucuugccuggucuacucuaguagccuccuaaguacuuucugcacuuugacuucuucccuguugaauccauauuucacagcaaccagagugauuuuuuaaauaagaaagucaaacagagcaugcuuucucccagcuucaauguuuuucucauagugccuagaauaacuucuguucuccuuaauauggacuugagguaccucuacaaccucauuugguuuccuucugcugcuguauacuguuuggcuacauugggauucuucuaggcuuuggacuuugucaagcuuuuucuugauucagggccuuugcacaugcaguagaacacaucuucucucacucugcguggcugauuccauucagagcucaucugaaaugccacuuucucacggcgacuuucuuuuauuuccuaguuuaaucaagacucuuugguucagugcgugcugaauuugcuuaauaaaugauuccauaaacauacauauuuugaauagaaucugcugauuaauaggaaugauaguucugugagaucaugcucauuuuaaauuuagucauagugucauuggaaaccacuacaugucuuuucuauucauuuaaugaauuuucaaggucauaaaaauuucugaugauauuauaauuuuugcauuugcaaauacacuuugcauaguauuuauugcuggauaaaauauuggcccaaaucagggguuggagaacugacauucacugagcaccauaugucacguucucuuaccuuaauaucguauguuaggcccugaaaucuaguuauccccgagucacugaagaggagcugagauucagagauuccccuaggcuggccaaggccauaccuuguggagggcacagccuaaguuuaguccaggaguuugaacucuaaggagagaacucuuuccauaucugcugccuuauuucuucucuaagcaaacuccuuaaguucacaaaguucuuucauguguauuacucauaauauguaugucaaguucuagagagugcagggcauuuuugacauuuuauuuuggaucaagcuuucauucacuaauuuuuuauuuuucugagcaucccuuugagguccuugaauucacggaugagaaaaauuaaacaaucagugauuaaguggacucucugugaaguuacacaauggaauauuaaauuguugauggauauuuuuuauuagccagagaaagaaaaaacgcagacuuuuuuuuuuuuuuuuuuuuugagacagggucucacucuguugccugggauggagugcaguggugugaucacggcucacugaggccucaaucuccuggucucaggugauccucccaccucaaccucccaacuagcuggaaccacaggagugcaccaccacagcuggcugauuuuuguauuauuguaaagacaggguuucagcauguugcccaggcugguccguaacucguaggcucaagugaucugccugccucggccucccaaaguguuggaauuacaggugugagcuacugugucuggcccaaagcauuuuuuauuccaguaguugugucagucuguuuucuuucuauguauguauguauaauuuauguaucuauguaucugccugucuaucuaccuaucucugguuaaauauguuuuagaaaaaauguaacuagcacaacuaggccuggacuuauagauauuauuuaugguagaaggcuaaguuguuuauuuuuuuaaguuaauuauuuauaaagaaaaauauuaaccauauacaaguacauuuaguacuuaguuauggcaaaaaucaagaaggugaaauagauauggaaaaugugauugggugaguugguuuuauuggacugguagggugugcccuuggccaaaccaaaggccagaggguacaaggaagucagggggacacacugcuggggagauagagagggggcugcccaguugugaggggaacuaacuucuuguccagaacuucccuagggccuucccuggcucuugccuucuuugcuguauauuuugguuacuggcaggacacugguucaaauauacauuuccgugguuugauuuuauaaagcuaaaaaagccucaugcuaauauucagucucuuauguuaugaauguuaccauuuuaccucuuagcuauauagguaucuauaaaggacauuuuuuaaaaaugaaaaucauccuuccucaguaaagaacuagagaauaaacauguuucugaaaguagaaugauguggacuagagcaggggucggcaaacuuucucugagaggggccaaaugguaaaucuuucuggcuuuguaaccacagacucucuguugcaaauacuaaauucugcuguuguagcaugaagccaguuauagacagcaaagaaaccaaugagcauuacuguauuuuaauaaaacuuuauuugcaaaacagacaguaguuguauuuugcccaggggacuguaguuuguagaccccuagaugaaagaaauguaucuuagggccuccccucuuagcccuuuccaucaucagcaaugugaucuuggacaauauacuuuaagucuuaaugaauuuauucauuugaaaaacugacauuuuauuuuagaucaggcuuuucauucacuaauuuuuuauugcucuggacaucacuuugagguccuggaauuuacagaugagaaaaauuaaacaaugaaugaggacaguuuucuuguaugagggauuuuuguuuucuucauauuuuuaauguguuuaauauacuggagugagcaugucuuauucuuguuaacagacaagcuaucuaaaaauuaaaacacaaacuaaaaguagaggaagauuguuaugagaaacaugucauguaugugaaauacauuuuauaaggaauagauuagauucuuuauggaaccaggauggguauaaauacaucacuagauaaauauuaaguaggaagaucauuauggacaaagauuguuucuuaggaauuuugcaucguauagcacuguguuagacagaguccuuaacugauuauuuuuguagcauuuguuuacacauucacuuauuaauuaauuuugccaauguauugagccaucuauggagauguguggaggucuguguugaaagcuugagauagaaaaaaugagaaauaaaauaguuuuggaucucgaggcacucacauugaaggagauaaacauguauauaaaauauuauccuauuguaugauaaguucucaauuagaagcauguauguauagggcaccacuaggaaaucuguaucauuggaguagagggaagcuaggcaagagaccugcacagaguuugagcaguugggucuugaaggaugaguagggauucuuagacaaaagaagauugaaaggcagcuugagcugagggaaaugucugugcaauugugaacuuuacaaaucauagguaguucuguaagauuauaacuggagucaugaagacaggugaaggaugggauacucaaaguuuggcuagggccaugcaaugaaagccagggaauuugaacauauucagaaccauggaaugcuuugggaaucuaaugaaagauaugauacauuucuauaggaaaaucaucuuacauaaaaauuucaauauuuugcuacaguuuuaggaauaaggauguagugaucacuuuaugaacaguacagacuuuuuauaugguucccuucugaaaaaaaaaaggaguucacagauagacacauacuucaucauccugcuugaugguggcagcaaaugcucuggaugcacuuaugugaaguuuaucaugacuuuauuacuuaagagccugggaguauaugagauugugccauacuguuauuuauaauuuccucaaagagauggcuaggcaugaucagagaagccuucuuacugguagauguccacauaugucaguugccuaggcaugaucagagaagccuucuuacugguagauguccacauaugucaguugccuaaaugcuggagaagucacguggcuucggauagaauuuccucauuuguaagauggugcuccucaaaggaccuaccugccauuagagugguaaggauugaauuaacucuucugaugacagcacugagcccuaaauuuagcacauacuaagagcucaauaaauguuagcaguuaauacccuuauuagaauuaugaaaagucgguaauuucauucauguauguucauauauggagugcucacaaauacuugaauucuuuuauugaacaugugaguuagucuugcauuacgcacugcauauauguccauguauuucuggaucaucaugggucauuuguuuggaauaaaacuucauuuacggaaaucgucuguacagcccugguuaauuuuuucucugugauggguugcauuacauauuuucuauauaaaacagcaauggugaagauaaguuaacuaaugaauauauauuauuaugugcuuuuauuuuacagcuucuaauauucaguggggaaauuuuucuuguuaagagacaauggcaaggccaguuggccuaaaauuagauccagcagcuguguuuugaaucaaggccccacaugugcacuuuauacuccccacccccugcgcugggcuugucugcuucuuuuucuugcuucaggaggcagcauuuuugggugaauguuaacauucauguuuuuccuaguacaaccagaaaggugcuucuguuuaauuguaaggcagguuuauuuacauuuacggaauggaaaaaaagauuuauuuaauuauuaauuuuacaaaaccacccuuuagcaccaagcauaaaacuuuggagcccaaaucaaggcacuaggucacuuauaauuugauuucuaccaaaauaaguuuuuuuuuuuuuaaagaaaaaacccuaugauaauuuuuaacauuuuugacagcuacaaguaauuuaaguuguguuuuaucaguuuauauucagaagccaauguuaacugguguuaauuuuauagguccuaguuucuuuguauuucuugcccuacuguuugguuaauaaaccuuuuuuaaagaauauauucauguacacacaacauuaucaugauucgguuuaaguauccguguuuauaagugcacuucauuucaccuaauuauguuauuuauucauuuacacauuagcaacguacuacauauuccacuuuuacaggaacuuauuuuaauuauaccuacaguucuguucugcuccauuauaucauagaucaagcugaauaauagcagucuuaaaaggcauaugcuaaaagugauuaugggucauuaaggccaaauuaagguaacauuucugauagccacaagcagaagucuaacuuacaauuacuuuuuuuuuuuuuuuuuugcuuuggggaacguguucuaguuggcuuugauguugacggucucaugguugaaugccuaguggguguauggauugauccuugaucagacugauuuuuuuuuuuuuuuuuaggggggagauauauacaaaccauacuuuuuauuuauccagaaaucuguauuuauccagaaauagucuauucaaugacuuuacugccauauuucucaaaauguaugcuuuuucuuuagcccucucucuuccugccugccauuaagagucacacaggcaaccaaucuccccaucuaggaaagugaguacuagaaugcauuaaagucacuuuuuuauugaucauuagcauaaagccucauugugccauuggagagugaccuaaauaaguauaucacauccuuucaaagagaaaugccccauggaaaccauaccuaaaaacgauaacaauaacuaacagaaucugcguuuuaaugaguugauuuuuaauucuuguuucgauuggcccaauguaaucuauuaagaaauuaaagggcaucuuucaagcuuauccauauacuuuuauaaucaggaugugugacucuaguguuguuaauuuuauuuuugagaaauacuuagauuuuguaugggcauaaguaauucaaaauuauuuuguugauuuuauagacauuuuacuagggagauccauuguuguuacuuauuuucuaguuucauaauugcugauuaaaauuaauaagauucaaaugggaaaaugacaguagaaauauuccaauuuagaguucuuaguagguuggcuuacuuuuugcuggauuuaugaugauuuuccuacauacucagauuuggaagauacagcaucauaaaauaaacuguaguuuauauggaaccucuacauuuugguuggagauacaaguuucuacuggcucagaaauuuuuucuuuuaguuuuugauuuuuuuuagagacagucucacccuguugccagacuggaguacaguaguaggauccuagcucacugcagccucgaacuccugggcucaagugauccuccuaccgccgccugcugaguaucugggaauacagguguaugccaccaugcccagcuaguuuuucauuuuuaaacuuuuuguagaaauugaaucaaacuauguugcccaggcuggucuggaacuccuggccucaagugauccucccaccuuggucuccccaaguucuggcauuuaaagaacucagcccagcucauguaauuuuuaaauauucccacuccaugugauuacuucagucuggacaugucagacugaacugucauuucaguuuacaugucaauuugucuuucauguaaaaagggggaaaauaggaauauaugcuuauauuuuguuguaucugcauuuaaaaaaacacaagaaaccaaagugguuaccugaguagggguggggaaggcaguaaagaauagugugauggggaugagacuuccaaauagauaacuuuuuguauuauuuugacccuugaaccaugugaauguauuuucucuaaauauauuuagauuuguuuuugaacaagaaaaaaauugauagcagcuaugaacauuuuuuucuuuuuuucauuuuccuccuugauauaaguuacauuuuaauugucuuuuggauuguuuucuucagaauuuuaaucauaaaauaaaugaaauaaauaaaugcaaucaucauuccauuccuaucaguaauuucuauuaguguggcuuuuucuguguuuguuuuugucauuuagagauggcaucucccuauauuacccaggcuggacuccagcuccagggcuccagugauccucuugugucagcuuccugaguagcugagacuacagguguacacuacugcucccuacuuugugugugugugucugugucugugucugugugucugugugucuguguguuugcauuaguuuaugggcaacuagaacacguuagaugcuuuuaagcaucgauuuggauaaagaagcaguauuaaaaauccaacugaugccauacuucauggaagaaaaucauugcauuaaacaggaauuacacauaccgauaugaauuaguugauccaaugguccuuugaaauggaaguuacauuuuuaggagauggguauagcaaaagcagagguguuuuuggaugaugagcaauaaauaggggguuguuccuagauucccagagacuuacauaaaguugggaaugggagaaguaagugauggggacaagcuaaauuuuaaauuacucuuaaaguacuuuguuuagauuauauuaaccugucaaugugacuaaaaugucaacagaauucucuuaaguuuuacagauuuguagaugcuaaaugcucaugaacugaacugaauaacaguaaugagguaugaugauuugguaauuuuauuuuaauuagcaacaugaguaacuuuaaccuuuauuuaagaaaauaaagguaauauacacauguguauuuauuauacaaugggaaaaguucccuuugaaauucuccaugugguuugguguauuggcuuaugccuguaauuccaguacuuugggaggccaaggcagguggauagcuugagcccaggaguuugagaccagccugggugacauggugaaaccccaucucuauuuuaaaaagaaagaaagaaagaaauucucagugcaacagucuuuaaaucaugaaacuguucaguuggagaauuugcauuugcuuauugauagcugcauaucuacuauugugaauuuaauaucuuauuuauuuacauuuaugaauauaauacuauugagaaauuaggcucuauucuuuuuacaguggcauuuuuacugauugaucuagucucaucaaauauaacugagauguggaagccauuaucauaguucuuaaacacuauugcucuugagcaggggaugugagauacagagcauuguggaaaaaaaugcuauucuggaaaaccacucacuccuuugaaagucaaagagaauaaacaauguggaauuugaaaaaaaaaucacacugaaagauaaagguauauaagcucacuuaacuauuaaugauacaaauuaaucugcaaagaauuaaaagcagcuuuguuaauggcagaagacacaugcaguuaauaaggacauuacuucucauuugggguuagauuggcuucuccuuuauuaauaucuguuuaaacuacaaauagaaagaacuccauucuuaccagacuucuugucacaagacccagucucuaaagagaaauaucauugauaggaaaccagaaagacuaaauagauguauuuggucucacaggcaguccauuaauuugcucaaauuaaauauuaucuuuaaauauugaaagguuaaauguacaccgauaauggauuuagacagcuauuaagcuguaauugcuuucuaaugcaguuacuaaaagacauuugauauaacauauugagaaggaaggauuagagacuucucuaccucaguuuuaacugagaguuuuauggcuuuaauucuggcaguuguaggaauuggauaacaacaguuuuuaugagaacgcacacaauaugcauaaaauauucagugggcagauuguugagggaaugcauuauguacaguguauuuauguucauaguuuuugcaaaucuguaccagcaguacuaucagaucaacuauucacccuaaauauuuuucuauuagaucuaaaagucguauuucugaaaauguuaccauuuuaugguuucgaccccucuaagcugaauuaauguguuuugugcccuggauauaugguuacaguagugaccaaauuaauuugaaaacuucucagucuguuggagagucacaucuaguucagguagucaaacugauggcuuucccugccuggguaggcagcuuucuuuuuaguauucgcauuguuugaauuuguaguaugagauuuucacauuuuuacagguugcauuuugugaguugagugucuagcugugacaaauuauuguuaaccuaagaacauaugcugauugauacagucagccacuugccuccagaguucaauggaaggacaaaaaauuuuuggaaaagaaauaugaaugagagcuaggcucuucaaaacauauuuuccuggugaauuauuuaaacauaaucuaaguaugaguaugggucaggaaaaaaaauuaccugcaguuaagauaucaagccaaaguauuuuuugaauugaauaaagaaagggaaggaaaaagccugcuguugaucccugucacucauguuuuuguauuaauaggcagcaucugcuauuuguucuauuaauguuuuauauuaacauuuucauuuaguuuccuuuuuaaaauggugaaguuacagaauucacuuugguuucacaaaccuuuauggagaaauaaaugcauaugaagaucuguucuggggccuggggaagauguuuaaauuccaggugaugccagggccacugcauggcacccccugggguuguacaugcacauuguauauggcagccgcuugcuuccuucaaagaagagugugauaauaucugugcuuucuguugaacuuucagaguacuuccacagauauguuuuuaauacuuuuaaauccucagaaauaauuugauuauuucaguuuuauacaugagaagucauguucagaggaguacacacgaauauaaggcagaaaauaaaaaauauaagaauuucauggauuacaaagaaauaaaccacuacuuccauucacuguaaaccagagaagaauauauagggaaguuagaauucaguguguacccuuauuaauaaaacuaguguuuuauuaauaaacuauaauaaacuaguguuuauuaauaaauuaaauuuuuucaaauuuuuucugcuuucucaauagaugcucuauuuucuccccuccuccuauuccacccuaaaauuaaaagagaaaauacauuucuaaauuuuacugagauaguuaagcacagaauggaauggcauuacccauaagagucuaauauauaauguuuauaauccuuuaaaaguagaauuaggguucugucaucucaauauacuaugcugacuuugagauuucuuuuagucauuaaaucuguucugcaaaucuuuuuuaaaaaaauuaugagugacuuuauguuuuguuuuagauaauuuuaucacuaccaucuaacuaauuuuucuuuauguauuuucaaaaauuuaauaaugaauaugauugcaauaugcuuugagaccaggauagaugcuugcuuguuuuuuucuuuuccuuuagacuaucaucuuuuacauaccuuucucuuucucuuaaaguaaguggaaaaauuggauucauugaauuggucuugauacuaucuaggguuauaacauccuaauauucugugagucuuauuuuaggacuugcauauuuaauacaguuuuuaagucuuugaucuccuaaauaugcuuauagcagccgcuaccuucaccacacccaaauccuugaauguuaugauacaucauacuacucaugcuggauauuuacugaucugcuguguucaagacagacugcugagcuucguaaacuuuaccacccaaacuaaagacagagaguaaauacauaaacacagggaguuggggacuuggcugaaaauugccacccaaagcuugaaauuuauuugcaugcuggaacaaagaauauccaugaacuugaaacucaggaugacguauguuugauguuuauccuguaucauuauguauucuagggcaccacuucuguauacccagauggaaaucccaauuuuaaagcaaugcucuuggguauugagggguauauuugcgaagucacagucaucauuuauuccauguucccuugccuucuuuucugucaaguacucugagagucuugauguugaggauuuauuggaagcaaacguuguuaccuaaaugaagucuagugaacaaaaccaccaaaagaggacaugaagugacugcuauguauguauauaugauauauuuuuccucagaauuaucuaagugcuuugguugguugcaaauguggaauuuugcuguuugucucuaagucacucuuauagaaaugaucugugugugugauaccauaggaugugcuuccacugggcuccugagcagugggaauauauaccugaaacaguaugugacacuucugugcuuuuucucccucugugguuucuguucuuccuauaauguacgcaagugcaaauaugagcagugagcgaguagagagaaaacccuguaaguuuugugcucuacuuuagguguaugugauugcuucucuugcugugccauucauuucugauuuaaaugucuaaugacucucaucaaacaacauuuaaacuuucuaugagauccuguaaauguuccuuuagaucauauuaugaguaacaauggaugaaacgagcuuuaauggggaggcugcgguucaguccggggguucugcagcuguuggugauggcagaacacgucaauugaacugcagccaugcguucaguggcauuuugcccauuaagcgauguauaaaaacaguauuccugguacaguuacauuucauuucugcagcguuuucacagucagcacuggugugucccguggccuggccuuuucuccucuuggcgacugaaaaaauaaaagcccagugcuuuaaggugguguugcuuaagcaugaaugaaaucacucaaaaaaugucuucuuagcauugaaaaaauuggucacaagucaguaauuaauucauuuuagaguaaguucaucuuggggcugacaaagagguguaguagcuaauuuuaaaagaugaguguaacaucuuucccaugucauacaugucaagauuaaacuuaaauuauguauuauauauuaaugaccuuaauuuuauucauaaacuacuguaaguacaacagaaaucaauuuaguucuauuucagccaucauuucugggugugaacuucuaguuucuauaaggaauaaagagauaggcaugaacuaguaccugaccucaugaagcauacacuguaguuggagacguauagaccaaaagcaauccuagauggaaugggauauuugaaugagcuaaauagaggauugcuuugcacuuagagaaccuucaguaaaugaguguugaaagaaaguguguucaagaguuaccuuugaauuuuagauauuuauaugucacuguggacuuccugggagcugacugaaaauggugauugucauugucauuugacauuuuuuagucuaccagucuggggccuaauucagcauugaaaauaguuuuuccuguuuuaccagaaaaaguagaagccaggaguuuguuuuucucucuuuuccuugugcucuuuuaaaucuuauuucccucacaguugagcaggaggaggaaaaaaaaaguccuauuuccuucaucuuauuuuccacuaggcuuuugaggaggacgagauauucugaagcauauuugaaauaaauugaggaccguaacuuggcaaguaugaggugcaggaauaauccaugugcaggagagacggugaaagauuacucagagguacagagccauggagagucggaaggaacacuggaaguuucucguggagauggaaaccugagaacuugacugugguuaggacagguuggaggaguccuggguggugcugaagaggcucgguuccggagucaggccguugagguugaagccuggcucugccauucgcuaacauugugaccuuggaaaagcuuaccuaccucucugagucucaguuugcucaucuguaaaauggcaagaguguccacuucauggauuugcgaggaguaaauaagcuaguccguguaaagugaugcauacagaaagcaccagaaguauuagcugugauugauugcaggagccacagcaugcagcaggagaaugauuuuugagguguuugaagaauaauauguaaagagggcugggugauaugacucacgccuguaaucccagcacuuugggaggcugaggugggcagaucacuugaggccaggaguuggagaccagucuggauaacauggcgaaaaugccaucucuacuaaaaguacaaaaauuagccaggcuuggugcugggugccuguaaucccagcuacucgggaggcugaggcaggagaauugcuugaaccugggagacggagguugcagugagccaagaucgcgccacugcacuccagccugggcuacagagugagacuucgugucauagaaaaaaaaaaagaauaacaugaggauguguuugguguuggcauuuuggucacauugaagcagggagggaauggacauuucuuucagaaccaugcagcccuaaacguuaaacagagagguuuuuggggauaaguguuaagauuuugauguggauauuuuagaagguugggcguaacagcugauucaacccuuuuuuaucaccaucaaugaaaagggcuacauaaagauuuaagaagaggaggacauucuuuucuccacagcuggucaugcgcccaguguaguuggcaggaaaacggauuguuuggaaugugucccuaaaauccuguaauuuaauuuucauuauuuauauaacgcaguccguauauguggcgcuguacuacaugcacacaagaccaaauuucuggccaguguaauuuuaccaaagaagagacuguaacugaaauauuuguaccuacuaaauuaucugcagcuugguaacucaccguuagggaguccaugugaucccaaucagcaacagggauuggaggaacgcauuguuggcagugaaauaaggggucaggaacuagaauaaauagugcugggaugguaaacgggcccauguuauacuaaauguaauauaaagucacugacuuugaggaguccagaaaaauaaguuuguaaauauugacauuaaaguagcaaccaguuugcaugcuacuauguaaaaggaaacuauuaaaauaauuauuauacguaguuuuuugcuugcagcacuuguuucauucuguucacuuuuagaaacacaaauuagaaaggagugagucucuugaugugugucuaagagaaguuagaguaagauuucuagaaaucacgagauauauaacuuggauaguuuauaguuuucuacaaguguuucauguuaaaaguuccuacauuaaugguccuucaaugaauaguauuuaccucuggaauccaggagauauauccacaguuaccguauuggucaugcuaggcaagggcaugauuuauuggacuugauauuaucuguauauaguucuugcuuuucaaaacagucaucuggaccgggaguaagcuaauaaggccaugcacugcauaauggcguuucggucagugguggacugcauguaccacuuuggucccauaagacuauaauggagcugaaaaauuccuaucuauauuucuuaucauuauuuagaguguacucauucuacuuccaggaaaaaaaaaaaguuaacuguaaacagccucaggcagguccuucaggagggauuccagaagaaggcuuuguuaucauaggagaugacagcaccaugcuguuguugccccugacagcgccaugcuguuguuguccagugagacaagguguggaagacugauauugaugacccagacccuauguaggccuagacuaauguaugcauuugcaucuuuguuugugacaagaaguuuaaaaaauaguaaaaaaagcuuauaaaauaaggauguaaagaaaaauguuuugugcagcuauauaguauguuuuguuuucagcuaaguguuauuacaaaagagucaaaaaguuuuacaagaguuaagaagcuuauaagguaaaaaaguuagaguaagcuaaggucaauuuuuuuuuuuuuauuaaagcaagaaaaaucuuuuuucuguuuuugagacagggucacucugucacccaggcuggagugcaguggugcgaucuuggcuuacugcagccuccgccuccugggcucaggugaucuuccucccucagccuucugaguagcuggaaccacaggugcgugccaucacgugcagcuaauuuuugcauuuuuuguggugacgggguuuugccguguuacucaagcuggucuuagacuccugagcucaagugauccaccugccuugaccuccuaaagugcugagauuacaggugugaaccaccaugccuguccaaagaaagaaaaauaagaaaaaaaaaauucaauguauccuuaauguacaauguugauaaagucuacgguaguguacaagaauguccuaggccuuugcauucacucaccauucacucaugacucaccuaaagcaacuucuuguccugcaagcuccauucauggcaagugcccuauauagguguacaaucuuuuaucuuuuauacuauauuuuaaauguaccuuuuuguauguuuggauaugcucagauacacaaauaccauugugauacccuugccuguggcuauuuaguacaauaacaugcugugcagguuuguagccuuggagcaauaggcuaugccauauagccuagguguauagcaggcuacaccaucuagguuuguguagguacacucuauaauguucucacaaugacgaaaucaccuaauguauuucucagaauguauccacaucaguaaguaacacauaacuaauuuauugcaaggggcagaauguaaaccauugguuuaguaguuuuagauugaguuaaaaaaaaaagauauccuugagguuagugagaggaaucaaaaucaggggacaguguaggcauuuggggucaaaauuuauucagcauaugcuagcaugccaccaggaaccagaaggaauaaauuauucugacuccauucuuggcaagaucuguguggcuacagaacguaauuauuuugcaaaucauuuaaguugcugaccacagcuaggagauuaccaccuaagugaagauuaccaccuagauggagugugauuccucccugggauucccuuucagaauugucagaaaacaaagcaguaaauccacauguuaaucauuaaaauaaacgaagugcaauaugcccagcaaaucauuucacacauuuucuauuucaaggaauugggauucaaaucuuaaccuaaauuuuacauauucacauuuuaaagcaucacucagacuuguucagauuacugagcggaguaaggguuucaucugaacacauagaagcuggcugcguucuugaaauggggaggaugggguuggugaggucacaaaacuucuuuucagcucccugguugcaaagaauaugagugcuaugacauuagaugggaauucaaguucuggucuaaauugauaaaauagaguuguuauuuuauggccucaucuuuguuuuuauauaucacagaaucacugcgaaaauggcaguuuguuuucuaaagaggccugagaccagagcagcaggucacaaagcgagcauuuuacagcguugucagucagccuauuuggcugaacugaauuucccagggcaaaaguuuucuuacaacguuucaaacaauucaucaaaaagauggccuaggaaguauuaaaugucuuacaauguaaauauagacaaggcuuuauuaggaaagugugcaccuguuuauuuauugacuuauuuauuauaauagccuuucaaguaguuuucuugauccuuacacucuucacacaaugaguguaaauagacaccagucauaguuguagguggugagcuacagagcucuguauugauuagaucuucaggcugucaaaacaacuagaaauuuuaauaaauguuuucaaacaagugaccaguuccaucuaacccaucagaauguuuuauuguaaauauaacauggcugucaguuugacagaaauugucuucccagaauaauuuauagugugauuucaaaaugcauccagucacaggcuuuuaggaauccugucauagaauauuauuuuaugccaucauguuuuaaaaagacacagugauaacauugaauaggaauagugcaaugacacugaagugcaguuuuagaugggaggggaagucuuccuugcuucagcaaaucagguguuugaaguuuaaaaacugcuuaaguggauuuguaguaaagcucugucuguuuuaaaguacuggugacucaacagcuguggggaaucugucuggaaucggcgcggaacuuuggagaauguuuucuccucaggagcuggaacucaacucuuccucagcccacacaaugcaggaucugugguuuucugucccuguuucuuuuucuccauuuuucuccccuucacuuacucugauugauggaaacacgugcugggagcuuucccugacauucuuuccaaagacugaaaguaagaaauguuaugguggugcuaugucuauuuuugaaaguaagucuguuaacguaaagccuguguugauauauugggaugaauuauaauggugauauuauuacagccuucaaagcugaaaauuuauuauuuuucucaccuacuuuugguugcugauacuugaucauaggaacaugcugugcaucugguuaauuuuggggaacccauuuguagauuuucaaaaguuaaacuuuauccuucuuuauaucuucuccaggcccucuuuuguuauugaaaaacaaauagaaauacaauccacuacaacuucggugcuucugcuuuucuggucacucucauuauuaaugcuuauaaugaagauauuuuuggaaacacugacuuaucauugguuuugcaaauacaguaaaaauaauauuguuuguuggaacucuucauuaugauucuuuuacuuuuaaauauuuaauucauaauuauucuuguuucuacaucuguauuuuaauuuuuauuuguuuuuauuuaguuuuaaagacagggucucucucuguugcccaggcuggagugcagaggcaucaucauagcucacugcagccugaaauuuccagguucaagccauccucccaccucagccuccugagucgcugggacuacaggcccgugccaccaagacuggcugauuuaaaaaauuuuuuuuguggagacgaggucucacuuuguuacggaggcuggucucuuacuccugggcucaaaucauucuccugccucggccucccaaagugcugagauuuacaggcaugagccacuggacccugcacuuacgucucuauuuucaaauguuaaaugucuuuauguauaggaggucauguuggauuuuaaaagucaacagaaauugauaggaagcagugugcagcccugaaugaaacucuuaaguuaugggggaaaaaaauaccagaaccuaugagugaaauuauuuuuuaaaaucucgucuugcugguagacagguuuuuuagagacagggaccgcaucuucuuuaaucuuugcuguaucccuuguucccagcauauugucuggcacagaguauuuaauacauuaagugggugaauaaaaaagugaauggcgccgggcguggugucucacgccuguaaucccagcacuuugggaggccgaggcaggcagauuaccugaggucaggaguucaagaccagccuggccaacauggcaaaacccugucucuacugaaaaauacaaaaauuagccaggugugguggugggcaccuguaaucccagcuacuugggaggcugagguaggagaauugcuugaacccgggaggcagagguugcagugagcugagaucccgccacugcacuccagccugaguaacauggugagacagugucucaaaaaaacaaaaacaaaacaaaacaaaaaaaaccccagaccaaacaauaacaaccaaaacaagugaaugggauaacuuggugcugaguuuaagagccaagguucauuuccuugguaccuguugcuugacuagaagacaaaucugucguaaaugaucaaaaaaauguuuacauagacggauguggaggagaauuuuauguaugcauacacacagaauacuaaguggcauuuuuuaugugacagauucauuuccaugcauauuccauauuguaagucagucuucacaacuguuuugugaaguagcagaucccuguuuugcagaugaggcaacugaugcauacauagguuagguucacuuuuccaaaguccuagaguuuuuauuuggcugagccaggauuugaaugucagcacuuuagucucuuucuagaguuucugugugcaaucacuacugucuauuaccucuagcaguuuaucacaugcacaauuguucguaacaccuggcugugcaugauguacaucuacagguagacacuucauguacuugcugugguaguacucuagaaacacugguaaguucacauguuaucaaagaaacuccuguauccgcucuccgagugcugaucuggucauuuucugcuugaugacgccagucuuuugaguuaacucguaggugugcauguugguuucuuuaaaguguuagauuaugaaccauagggcagcaggugauuaauuucugcaucauaagaauucagcuacuguuuuuaggaauuugcuuacaaaccaucaaguuugcuuauucuuacagaguuuugucuuuauuugugguauuguaauauauaauaguuaguaucugaccccaagagccuuacaaugaggccacgaagacaaacagaauuucgagaagucagaaugaagaaugguccucaaaagagaaaggauagaaucuugggguuuuauucuugugagggauguuagaaaugaucuuaucucuaaguaauggggagagaacuuagcaaaauccuuaaagagcaggggaguccacuuuagugugaguuauuuaacuucucugugauuuguuuaccuuucuucaaaaauggaaugauaaugauacucagcccccuaguauguugugaggauugaaugagggaauaaacauacauggaguacuuaaaacagcucuugcacacaggaagugcauaacaaauauuaucauugaaauuaucauuuuacaauugaggaaauugaaucccagagaaauuaaauuacuuacucaaggcuaauccagcuagcuaaugacugagccagggcuggaaucuugacauacaugucgucagcacucuuguaauauucaacagaauuacuguaaagcaauccucuauuugacaaguaauaauacauaaucucugcauuuacuugggaugcugaauauauacugaacuucuugcuguucuuuauuuuuucuucugggaacuauauauugggugauucuuuuaaaaaaugugguuauaugccaacauuaugggaaaggaaaaaaaaacuuaccagacuuuucuuccauacauaauccaaauuucaaauguauuaauuuugccgaaugccauggcaacauacauaucuguuuuucaguucaugaaagguauuuugggaauuauuggcucaugcaugcuugagcguuuucgucuuucagcuauagaaauacacuauguauccucuucauuuuguguuugugcuucuauucaagaugagaauaaaagcaguuaguuucuggguuguaauauucuucagugaacgguggcuuucuaaaacaguuacaccuugacugaaaugaaaacucugcuguaucauaaaagauauucuaauuacugcaucuaguuaaaaggagaauaaaucacugggagauuauuuuaagugccuuaaauauaauaaaaaagaauaauggacguugaacagcuugacagguuugaugaaugcagacuauggcugauuucugcugcuuucuaauggaaaaggagagcauuuuacuuucuagguguauugucaaagcaaauuuuuguuagggaagauaaggagaagccuuaucuuuguugagcacuugccuuguaccaggcauuagccaaggcaguguauuaucucauuuaauuucauuuaauccuccccaaccuuguagauaauguuauccccauuuugcaucuaagaaaaaugaggcucagagaauuugaauaacuugccucaggguauauagcugcaaaguaggauccagacuagguucuuucucuuuauuucauuaccccaguaggguugugaugaugauguaaauauaaauguaaauauaauugucuccacuguuacaaagauacuaauuucaucccauuuaauuuagaaugguuguguccaaacaauuuuaacuucuuugagccucuguaaaaugggaacagucaggucacugugaucuaaaaggagaauauaugugcaaaccucuuugcuuagugcuugacaguaaauggggagugccugggagauuuguuuuccauaucaucaacagacaaauggguguucccaacugauucuaaguuaagaguuuuagauguuuaauuaauagacucauaaauugugccuguaaauuuaaaacgguaucuguugaguuuuucuaaauguauuuuacagauuagauggugauagacuuucuuaaaauguuguguuuuccauuggauuuugccuucauaaauguaugaaaauauauuuaguuaguguggacaugauugcagugcuaauacauggcagauuguguguacauauauguguguguguguuggcuauuguucuaucuguaggaggguaaaaaucuaaauggugggcaaauaaaaucagaagaaaauguugguuaauuuuuggauuauguugucucuauaagagaauguuauuacugguaaguauuuugcaaaguuuuucauccauguagugaauaugaaacaugucuucuugguugacucauuuguaucuuuuacaguacauuuugggugccaguuuauagauucuuuuccuaaaaucugcaaaguaauagaagaguuagaauucaguaccuaagauacagagauucuauuacuccaacccccuugccauaugaagaucuguguuuaaaugagucaagaaaauuaacuuuuaagauucuauguggauguaugaauuuauucauauuccaacauucaguugauggcauuuaugggaacuauacucauggaaacucagaaacaaagaaacuuuuauuugccacuauauucacacacuuuaguaguucuuuccuaaaucucuuuugaaguaaagaauacuauaacaucauauaguuuuguguucacaguuuuacaccuaauuuuacacauucacauuuauagauaugcacaauuacuggacuuacucuuugcuuguguucaaauauaaaagcuuauagaaucuuguaccagcuaucaacacauucauccaaauguauuccggguuucuccauugcugcugugguaguaaauauaaaucuacauucucagugguauuaguuguucuuagucaagcaugagaggaacuguauaugagugucauuaucuaauaauuuuucuaacuguguuaaauaacgucguauucucccuuccuuugccaugcugaaucagcugaagagacaaauaaguacagaagggaugaguguggcuucauaaucagggaugaauguguuaugauccaucuugauccaauaagcagaugaauauuucacaacugcauuauuuuguaagugaggauacugucaguuuuguagcaaagguucugguagauaagauugucuuucuugaucuuuuauaaguaaauuuuuauuguaaauuauuuaacugcauucucugaaaaauguacuuuuguaucagagaaauaugcuuaggauauauauguguaagaauuuaaaggacagguuuaguuaugggccaaaaucuaauguuguagcaucaacaugauuuuuauuaagaaaagagaauuugauguugagaguuuucaguucacauacagaauaaguaaaccuuauccuauaaacuacacuuauuauugguauccguguuuuuaaauguuuuauguguaccucaucaaaaugagaucaugaucuccuaauuuauagugauugugauuauuuaaaacuagcugaacuaggauaacauaaauaguguaaaaagggaauccuacaauugugauuacuacauuaaaaaugcaauuugcaguauaaaaugccaugugaagguuaaaugauguuaaagauaauaauguguauaaugaaaucaagaauagagcauuuaacaggaauguaucacuuuaugggcauagaaggcaagagagaucuuuacacugucauuauuacguacaugguaguauuuucuaauucaguggucuucaaauuguauacuauggaacucacuauaugaaagagauaauuuuuuuacaugggcacaaacacacaauuaccuuagcaauggcugaagucuuauucuuaaaauauauucuuuguuuuguuguauauuuuucucuaaaauaaaauaauuugaacaaaauaaauauaggacuauccuuuucaaaguaauagucagcgauugaauuuuugaaguggaaagacugaaugaaggccuguggauaaagacgaaauccugaaauaucaaaaaacaauaguuuauucacaaaauagauguuugugaaauaaaaguuaugcccuuugcuuucucaauugugugauauuuauaugucuuaguguuaaugcuuguggaguagggacuuaauauuuguuaacugaauaaaacugccuaauucuaugaagaauacuaaguuuauaugccaggaauuucucuuauuuuuugcaaauauguaauaauaauguuuuuuauaacuccucagauauuaugauuuacucuugauuaggcaaacugugggaggaguaucagauuauacaacaugccaaaaaacauuaauuauauuucucuguaaugaagaccugcaaauaaguaaagauguuuguaagcagucaaaguagaugucaucaaguucauguguuaaauuuguuuugggcagauagugaacagucauuuacucuauuagacaaaauaucauaauuagugaaaacaauauucuguuuuuuuuguuuugagauauucccuuuguuuuggggguucugcagauuuccugugauaugucugcaucugauuuuguuuauuuagucugcuucuucaaugugcugacuucauaccuugcaaaaauucugaaaucuucucaacuaguauuuguguauugccucuuccuuacuccuccucuguuuuuuuaaugaaacuccucuaagaagguuuuggacaauucucauucuauauuaugucuauuuaugucuauuuaauauagucuacuuuuuuuuuugcaucucuguuucauucacuagaauauaagcucucugaggaccauagucuguuuuguucaauaacguauauugagcauuugaaagagugacucagaauggauguccggugcgcaaguggaagcauuuuuugaauaaaugaacgauuucuguguaauuuauucugaucuguuuuucacuuuaccuagcuuucauuggucucguguauuguauaauucaagcucuguuucaauggcuguauuuuuaauuuauugguguucuauuugauucccauucaaacuuaucuuuucauuaugauguacauuauuuuugucuguauuaacacuuuaaauaugaucauuuaaaaaaucucuuucaaauuacucuauuugucaagaucuugggggcacuaauccuccuuugugugucuacugacuuguccacaguggauaaguuuguguguguuucuaauuuuugauugugagcucaucuucaucugggauguuugucuccuuuggaaguuugugcucuggguuaugggacaguucuuacaaagugguuuucuguuaguuucugccaauuucucaggaauuucauugguuuggcauuaguuuuuacauuaauuuuauggcuugugguucccaaacuaagcaaauaguauaaauuuagauucugcaacugcauauggaaaaguuuucaggguuggauuacucauaggcaacucuuucuuugcccaccaaagcccuugccagacauguuuucuggccauuucccugaaucagugacauaagaaucaguagccuuuccaaaucucuggcuuugugcaggggucuuaggaccugugccucuguggguuuaaaaacuccagccccuaucccuuagggcccauagaucugcuaauguuuccaguucuguguuuuuuguucuggcuguaaauucccucucagaauuccauuucuuuugaguuuggguauguauuuaacuuuuuucucaucauguuuuauccaggcuuuuuuuuuuuaaauggagugugugugcgcgcacgugugugagaguguguuuggaggaguguauuauuugaaccaucauauugcugagacuagaaauccccucucauuucuaagaucaauuauuauguggauauuugcuuucuuuuucugaguguaauauuaaauacgaaauggacucgugaaccuggagaaugucugucagaaauaccgaaccuuccuucuuucauuuucgccuguaaaaucuuacaauuuuuuuaaagauagauauacagccaucuagagaauacacagaagagugauuugguguucaucuuuguguuugcuguuugcugaaggaucacucgcuaagauacgucuaacauugcuauaauuguucuguuucccuuugaauugaauauuuaggguaaggcacugauaugucaguaggaugaccaacacuaaaaguccaguauccugggaaaccucugucuuugguagaccuggauugucaccuuagucuuggauuccuuccggagacugaagaaauccuuuaaaaacuuuccugcuguggagucuucuggcucaggccccaacuacaguguuacauucagacuucuuuguuagaacaaaguuuuacauauauucaaauaguaaggauaaauauuaaucuguuuagaaagagagccuugaaaggauccuagucuuuuugcauaggaaaaauguccccaaucaaugagaaagucuaggagcaugaucaagacuuauuuuauauaguuugucuuuuaggggguacugguggauuauacuuuuagaguuacauucaguauuauuguggcuggacuaaaaaccccucaagaauacauuucacauugauuuuauuauagacaucugucaagcaaagcagaggcaaaugauagcauacucauuuaccaguaaugcaaaucaaaugagcuaguggcaacaaaaucacuccugacaccuuugcccuuuuucucuugauuugaacuaaugacgugugugugugugugugugugugugugugugugugugugugcgcgcgcgcagacuagcaaaauccagacuagcaaacaaaggccaaugacaggauaacuuucauaccuucaugccugggucacucaccauguacgauaggagcagugcauucucuugugaauuaaaaaucuauuuauccuuccugggugcauaagucccauagaaggcugggaggggaaguggaacucuuuauauaggaggggcuuagaccucaauagccugucccuuugaaugacaaaaugcccaccagccuugccacaaauagcuucugaaauaugagaaccuuuuuuaauucuuaagauccuugaccacugcaacuaauguaaagacacacuccgcaacaaacuuauacacacacacguacacacacauuuuauucuguuuuauaggaauggcagucuuuagcagugcauaauuuuuuuauuauuauuuuguuugagacugggucucacucucacucaggcuggagugcaguggcaugaucauggcucacugcagccuugacccccuccugggcucaagugauccucccacuucagcguuuugaguaguugggaucacaggcacgugccaccacgccuugguaguuuuuguguuuuuuguagagaugguguuucgccauguugcccaggcuguucuugaacuccugagcucaagcaaucugcccaccuuggucugggauuacaggcgugagccacugugcccggccaacauuccaucauuuuaaaagcugggcaaaaagggaaggaacuaguugagaaaggaagguucuauggccagaacaucagaaugcuuguuuuuaguuuuugcaaacauuggugaaauaauaguuggcuuuuuuguaaagccuuuccaguuggaaacugcaaguacuuuuuuuuuuuuuuuuuuuccgagacggagucucgcucuguugcccaggcuggagugcaguggugugaucuuugcucacugccagcucugccucccagguucaugccauucuccugccucagccucuccaguagcugggacuacaggcgcccgccaccacacccggcuaauuuucuguauuuuuaguagagaugggguuucaccauguuagccaggauguucucgaucuccugaccucgugaucugcccuccucggccucccaaagugcugggauuacaggcgugagccaccacacccggccagaaacuggaaguacuuuuaaaaguaugauggaagauacauacuuuguaauauacauacauacaaaauuuguucuuugagcaaauuuauucaguuuuacuggcaaugaaacucauaauguuuacuccucagaaauuuuaaaacauuuguuuguugaauguauuuauuguuucuaucggcagucuuuggaaaucugucuugugauaguucuaauaauaugguuugaauacagcauugucauaugucuuauauguuggggcaacauucuaauaacuauacauuuuuuaucuuccgauacguuuuucugaauaacucuuuguguugacugcaaguauguuuuugcagagucaccaaguucugaaaguaugcuuuuaggauggcacuagguuacuguguuuguauuaaguauaauuguguucuuuuguagauuuguuccuauagagcuaugguuucauggucugaagcugaaagagguuuaaagaggucaucacaguuccuccucccacccuuacuguuguuaaauaugaauguacguuugacuauuggaggaauuuuguuucuagaacuuucaagaguaauuguuuucuguaauuuauaguaggaaaauauugauuuauuaauaguuaaaauguucuuugggaugcuugaagaccaugaugugaaaaacuuaaaaaaauuagcauugauguuguuucuauauauuugccaaugggaguacuauaacuuugaaauguaggggauuguuugaaacaugaauugugaaaaauaacgcaacuuuaguuauuuuauauuggguccaggcuaguccgcugaagaguaugaaguacaguuuuauguaaaauauaucucagauugagaauguggaaacacuguucuuuaaaaaaauaaaaucuucaguaagauccuuuuaugaauuuacugguuuguucucauuugucaucggacuguuuccagauguaaaauauuacuuucuugaaauugcuguugagucuacuaucaagaccaggugcauguuguuuuacagcuauuuuacuucugauuuuuaaugcugaaacucauagaaugccuugaacugauaauuuguuuaacucucuaccuacuaauuggaccaagaaauaacuuuguaucuuuaucucuuuuccauuucauguuuuauuucuguuucaauuagugugugccuuuggcaaaaaggagaugauuuugcuuucuguuuuaggauuugccuccaagaaaaaauauauuuuauugccacauuuucucaauugauccaguagaguucacagacaaugaaaagaguaagaaaacuaauuuuuaaagcuugguaguguuauaauuuucuuccuuauaauaaucagaaaaagaauuuguauaacuuuuguuucuaauauagcaguucugaaaaucuaggcuuacacauuuuccuucccauuacugcuguuuauacuuaaguaaaacaaaaauggucgcugcagguuuuuuucucauuuuagugcagaguuugaauucuucaaagacugcuaagguuuucccaccuuaacaauuuaugacagacccuuauaucuucauaggcugaguccgcugcuaagaguuugcuaacucaugacuuuaauacaccaguagagaucacacuggaguuaaaacaaagagagcacgaacccugaaaugauuuaagacuguucuuagcugacuacuggaacacagugucucacgugguguuauugguaaccuuaaugcagauuauaauucuguaguuuaaccaggauguguuggcuaugguaaagugccuuuauaaggaauugugaaagggcacaaggaauggaaacagaaccucaguuuucucaguguaaaugaugaugacaagaauucccugugcacauuuguuguugugagaaagggugagauagaauagauuggacacauaguaggugcucacuguuaguuuuucucauucauucauuacugugucauucuauuggcaugcucacagucauguaguggaauaugaaguuacaucgugauauuuuucauucauucaccacugugucauucuguugacauguucacaggcauguaguggaauauaaaguuacaucaugauauuuuaaaagcuaccgaugugguagauuucacagucuugaaaagggguuuuuuuuaagcugaauuuucaguuucacuugagaagaguccugauuugcuuguacaaagagcaguaggguugcagagaaggaaagaaggcaacucuuuuaagucccagccgcuacucugcugugucuuauucucuaaaacagugaagaagucuggguggacauucuaguggucagaagccuaagcuuugucuuuugaugagugcagacaggggagggagcaacugacgagggaguagaggggcuuggagccccuucccaagucuaccaucccucacuuaugugucucuuccucaguaaagcacccccagugcccuuauuugcuguauuuuucuucauggaacuuacugucuaugggaccuauuugugcauucauuuauggugugucucugcauugcuuucccuuucacuacccauguaaguuccaugaaggcccagucuuaagcauuacagguugagcgucccuaaucugaaaugcuccaaauuccaaaaccuuugaacacugacaugagauagugacaccuuugcuuuuucuguuguuccaaaguacgcaaacuguuuuaugcacaaaauuaucaaaaauauuuuguaaaauuaccuuuagcccauguguguaagguauacaugaagcugcauaugaaacauaaaauacauuucauguugaaacuugguucucaccccaaaguugccucauguauaugcaaauauucaaaaaucccaaaaaauuagacauccaaaacacuucugauccuaagccuuugagauaagggauacuuaaccuguacuggguccucagugccuggcacaggguggaugcucaguaaguauuuucuuaaaagaaagaacaagggaaagguagaugagacgauaagagguggagguacagggaagaagaacacagaaacauggugaugaaaagaacagucugauaccuuauuugggccccagaaaaugauugguacugaagggauuuuauuaguggucauuuaagaaacuuguguuguacuguuuuuguguauuggaaggaggcuagacauuguuacauggaaauucacaguuacauuuucacuaaauguuucauugugaaaaacgucaagaaagguuggagaaggucuaggaaaacuuaucuuugaagauacugucuuaugaauuuccagcucagacuugcagcuuuugggagcugaggcuaugaggugaucuugagagcagcugaggaggcucuaauggguuccagcugugugcccagagaacccacccucucaggauaacauuaaccagguagacccugcccugacugacuuccucugggcuuuauggguccccguggucuguugcauugaucuugcauuuucagguuuuauagcaauucuaaacaugugaggguacauauuugcucuuugaugugcccuuugauagaagccagagugcuuuaccugagccugccuguaauaaugggggaagguggguugcaugcccugcagccauacgcucccugggaggcugguuuuauugcgguuguugauuggcagacuuuaaucagggguguuucuuguuguauuuuugaacaugaaguauauuaaggauaguuaaacauguaguccugcugguguuuuguuuuguuuugaaccacauuuuguuccauugugccacuugauagaaaggagggcagaauggaaacauauggggagcagaaauaguaacacuuaugucauauaacuacacuguguuggugauuuuuuguuuuuuuccauguuuuauaauaccuuuauguacaucccuauuaagaaggcagcuauugugucuccauuucacagagagguaaguuaaggaauguggaauuuggaaacaugcuugccgguuaguguggauggaaccuaaauuagaauucagagcucuuauuacuagauaggagaccaaucccaggcagucauggcauuucugugaacucuuucgaagaguaaagggacaggaauugccuuuucagaguagaacucagugcauaucaguggaauuauagaacuuuaggguuagaagggccuuugaugggaccauccuuuaagcuagaacugccucuugaaguuugcagugugcaugaccugcagcuccauuguuuauauuccaaaucuaugaaacuagugagagaauaggacacaucuuuguauguuuagguuugacaguacuuaucagaaguggucauauuacgguuuucuaucuuccuuugguggcuuuucagcuuuccuugguaccagccuuccaaaagaaauuagcucccuugugcccucacuuuaauuuggaagagauugguuuggaagagccaccaagggcccacuagacagcuccuuagaaguugcugugacuuggcagauggcaccugagguuuaaggauuggggaucuagccauggcguguugaugaugaugaugaugaggauggcaaugacuauuaacuccuuaauccauauuuaaucauaucaccagaacugaugguuguucauugaagauucacuucaugaaguacaagcuaggugauuccuuuuugaaaauaacacugugggccuaagauauauggaccuuauguggcuuaaaaugacccacuucucugugcuuacuccuaauuaccuucuuauuucuuugaauuuaguaaugggaguaaauccgacuuuaaagccauuugugguggcaaacccuaacuauucaaugaaauacaaauuugguacauuugcauccuaugcaaguuuuauauuuuugacagcuauuuuuguauuuaagcaagaagccgaaauaaaaauuucuaaacagauaugccagauuauauucaccauguuugaguauaguauugauuggucauggcugauguuuaucagacuaagcaaagugugucuguauuaguugucucaagagggucuuuauucuuaaaugcuuaugaauuccauaauaagucuuggaaaguggaacauacccaagcacaauuuauaacuuuucuaggcuuuauugguauucugagccauccagugaggacuggagucauucacaugauagaauaacacagauaccauuuauuaaucugcugaauauugaucacauuuagcaaauugcugaauauuaguagugaaauacuauuccucuacaaaauaguaguagccauaguaguagcaaaauuauccucauguguccaugcaugauuuauauguauguguguguuuauauauauacaguguauacauccauaucucuauauuucuauuuugcuaucuuuguugggauuuauaagguaacuuuuaauuauuuuccuucccccauucucuacuuagcgauccuuucuuuauaccaaucaucaugguaaacacugggaauauaaagauuaauaagucacaguaccuauccuuagagcuggaagcaaauacuuuuuauccagcauaaugaguguuacgagagaugguauagaaaaugcucugguaggccuggugugguggcucaugacuguaaucccagcaguuugggaggcugaggcagguggaucacuugaggucaggaguuggagaccagccucgccaacauggugaaaccccaucucuacuaaaaauacaaaaaaauuagcugggugugguggugggcaccuguacucccagcuacucgagaggcugaggcaggagaaucgcuugaacccgggaggcggaaguugcacugagccgagauuacaccacugcacucccgccuggaugacagaacaagacuccgucucaauuaaaaaaaaaaaaugcaaaaagaaaaugcucugguaucccagaaaaugccuacucuguuucaggaaugcaauucagaaagguguaccagagugucauuugcagucuagugguaguuucauagaaugucuguuucaagaggacccuucucuauagaucuguaguuuuuauuaguuauaauuucuucacacuucugucagaaauguuugcuguuaauuuugaacacuguuuuucaugugaauauauuuuuuaaguggauaucuuuuucauuuuguuuuuuuccuccuggcuuuuaaauauauauuuaaaauauuuuuauccauaucuaauuuuugcaacuuucaaaaaaacuuucuaagcagucaccuccugacccucuuuuucccccuuagcuguuucccccccccuuuucagggccaccuccccuccuucagagcccccgcauaaugcuauuccuuuaccguccagccaucugccuguuuuagccucuucuucacucucucuguuucuucuauauagauuuccccauaugucugcuucuuccuuuauccacaaguccagacacuccuccauagcuuucuuaccaccccauccuggugucccgucuguucauaaauaacucuuucauccgccuugaaucccaacccccuacucuuucuaaaaagagugugcaaauaaaccuaaagugcacggagccaagaugcauagcauaguuuugauucagaauagacuuucuccuuccaaucaccuguuuuaguccccauuuuuuguugcuuggcuucuuuguacagauccacaauugccguucaauuuuuguaugaaaguggaugcaaaguuauuuaaugucuucaugacaaaguuuuugccucuuacuggcagguuauuuugcccuaaucaguuacacagucuugugcagccuagugguugcuauuuuggaguagucagguuugaaccuuuuguucuucagaaauuaacguauuaucucagaaacagcagucucugcuugcgugcuuggcaacacaaaacugcguuagguccuuuucuaagucugaguucuaggacaugugccaugaaaggaguguuaacugaaucaccugcagaaauggccacaaggagggcuuuguaauguucuagauauuuaaaauguugguguccuccuccuagcauggugugcuagugacaggcuccuuucucccuggucaagaguaaacauuggcaauuuacuucccuuuagaaauguguuacuguagccaucgcggaguugccaguguuuuuccuuccuaaugucagugauaauuuuacucacagauucccugcagagauuuuagcucagcaggaaguaaaucuagguaagauugccuugaaaacugaucuaaaacaauaaaugcuaacuguaucauuccuuuuuauuuaaaaaaaauuggaggcauaacuaacuugauuauuuguaacuggugagaucuaauaaucgugguuaagaccccauucguucauacauucucucguucucucucucacugcuucuuugccuauagaaaaauaaaagucagagauugaaaugauucacacuauauuuuuuaaggaugaaauaucauaguagaaaugaaagguagaacuguuuacucaugagaugcugagaaaaucuaaacuguagcuuuccuagaguuuaggaagcuaaauauuuuauugguaucaaaaucagaaauaucuaaagaauaagauauuuaguuuuaaauguuucauacuuucuaaaaagaguuuuugcuuuguuuuguuuuguuuuuguuuuuugagacgagucuggcuguuaccacccgggcugaagugcaauggcacgaucuuggcucacugcaaccuccaccuccuggguucuaguaauucuccugcuucgaccuccugaguagcugagauuacaggcaccugccaccaugcccggcuaauuuuuguauauuuaguggagaugggguuucaccauauuggccaggcuggucuugaaguacugaccucaggugacccacgcaccuuggccucccgaaguacugggauuauaggcaugagccacuguguccagccaaggucuuuuguuguuguuguuguugauagucaagaaugagauuuuacugaaacaaggacaucagaauaaaaagaaauguaaaaaaugggaaagacacugaaaauuacaacaacccauauuacucauucagauucuuuuuggaauuucaaauagucaauaaugaagagacauaaauuccuuggagaaacguagcuuagggucagcuuuccuuuaaugacacuagugcuauagucacuuauauguaguauuuuugguguuguccaauuucuguggauucugaacauuagcuguacacagauccaagucuguggcuuuagcauauuuuugcuuuuacaucuugucaaaaauauacuguuagaauaucuuagacucgagaagauuuuagaaaucacuaauaauguaacaacuguuauugguuaugaaugaacaaagguucaguuaaagaguauuuccagguaaggcuguacauauccacaguauauuauagagacuucuggguuaugcacuggauauuaaugguuuggauuauggugauguuucugaaugugugaagggugaaguucuagacuucauuuuuauuaaaugaaauugauuuucuuacccccaccaaauuacuuaccaaacauuagauaccuaagaucuuaaacauagccauccucuaaauuauuuguucuuuaaguguccagagaauaucgugcagcuuccagaucauggagaaaccaguucugugcucuugaaguugcagugguaggagaaauagcagucuucuaugacagauuuuucaacuuuaacccucucacucucugcuaauuagaaucauacggucauacacuuuugguuuuuuuuguguguaacaaauuuuuucuaaagauucaacaaaagaguuucaagguuaccuucaaguagguacaaauaucuuagcucuggcuucuuuuucucccaaauuggcuguggacuguaggagcuuaauuaguucaggcucagugcaauugguuugcuccuagggugugucuauacuuaaaacauuuuuuuauaacagaaaauacguuuuugaccacuuuucauaacuuccucuuguuguuuaccaguuuuaauuuuaucuuggcaauugaaaaucuugggggaggccaaucuaaaaaaaauucuuggauuuucaaguuggauauacaucgguuuccuaaaaagaacucucuuuuucaauaacuuugauaucucauucauucagccuguauuuauugagagcuuaucaugcacgugguguuaugcuuuuuaauugcugguaccuugaauauuuagagaaaaaauaccucgugcauuuugucucuguguguuugacaugucaccuuguugaaucugcaccaagaaaaugaugaauuccaaugaucuaugguaguuacaaggccuuagaagaaccagggaugugaauuuuuggucugcuuccuccguauuuccuauucauugagaaacgugcuuguaugcauauaaacaauuccuuacuauuuuucuuucuggagaggaaacaguaauggguggauuuuaucacaggacaaagacucuuccagauagcuguuacagucccucccucugcucaccugauuuagaugaaccucucuuugacccaccacgauggugguaagucugccguugcaguuuuguagacauguaugugaaggcgauguuuguuauggggucaguguugccuuaaggaugcgggcuagagugaggggaccuuuguggugggcuuugcagacuucuuggcagagggaagcacagaugcgugagguuacuauuuucaccuaucuccuccuuucuuuauuguuuacaggaacacuugucuaaguggugcacaauuuugccuugcuuacgcuucuagagugaaaaauaucuguccagacucccugggauagguugguucuaacaucuugguggauugagccuggaccaggaguuuugacuuagaauucauggagagaggugucuguaaauguauauauaccccuuuauguuugggagaaagcaucuguggagcuuaucuggguagcaagaggauuuugugacccagcaaagguuaaggcacacugccuggaaaaaucaauuaggauccaguugaggguuagaucuggccauagacuuugccugguguugguaaauaaucugaaagccuuaaagcaucucagaguaaugaaaggggcccaaggguucacagugccuuuucucaggauugcugcaaggauucuggauuaaaaauccuucugcugucuguggaacagaacauuuccugggaucaauccuugagccuuccauagacaaagaauuucccaaaacuaaucuugccccauguggugucagagguaaaauaagugccaagcaugagaagccagaguaaccuuuacuggaguaaccucugcuagaucucuuguuaucuauguacucuuagaauaucuuagacucgagaagauguuagaaaucaccaauaauguaagaacuguuauugguuaugaaugaacaaagguucaauuaaagaguauuuccagauaaggcuauacauauccauaguauauuauagagaccucuggguuaugcacuggauauuaaugguuuggauuauggugauguuucugaaugugugaagggugaaguucuaaacccuuuuuagauaggcaagugugaugugagcaguagaguacauuuuuuguuuuuguuuccugaaguggggcacauuucucuccccuuugugguucuguaaauacauuguugaguccaguggaacuucaaagauggcacauagcuacugaugacacacacaaauauuguaaguugauaaggaugucugaaauguuauaaguggcuaccugaugccugaugucaaugcugguaucuguaaagcacacacacuaagaauagagacuggcagcucaaggguguugaugguaauuuuauuguaucuucaagaaaguguguuuccagagaauuauuaucaguaauaaugacuaccaccuuguuuucuuuugccucauuucucuuucuucuuccaugaaacugggguaagccuuauuguagagagaagcccacauggauauccagcaccuagguuccgccgagggcaaggcggaaaugaacugaguuauuccauuucuguguaaaucggcgucauuugcuacaugugcaaguuuugggccagagguguggaaauuggguucacuguuaaucuaacuagugauagccuuuuuaaucauguauuuuaauaggaagguagcacaguugagggaccucuuuugccucuugugccuaagacagcuggguuugaaacucaguuuuuaaugaauuauuuaacuuuacugugucucauuuucaaaucuauaaaaugggguuaauuguauuuugcaggauuauacuggagaagaugauaguacauuucagauuucuaccacaaauauggcccucgaauuuacuuuucucuacuacuaagcaacaaaauaaaauugaggaaaugggagucucucuaccuggucuuugauuuagagugugguauuucuucauuauggguagaagaguauuuuucuuuauagagagucauuaaccuucaggaaaaaaaaaucaaucaaagguuacguggaaugaagaagcgaugucauguaauugagauuuuuuuuuuuuugauucaaaauguaaacucacuugauuuagaauugauuggaacauggcaugugaaaaaaacacaggagacauuuaaaacuguaccuaaaucugauauaguaguuaagaaagcuagcuuuauaggaaauuaaagggggcugauuagaguaagauaggagagagagggggaaaggggauaugguggguagcuagaagaaaggcauacacaugcuuagaaguaggaagccagagauggaggaagaccuaggaugggcuuggaaaacuucugaagccuuaaugaacugaucuugucacacacagcuguucauuugaguugugggccucagaguauuauuccuuuuuaucacugucuuuugaaaugcuaauuagauaauugaccauuguucccaguucuuugguuacuuuuuauucuuaaacuucuagagacuaggccuugaaugggauacucagagcagcacaccagaugggaaauuauucucuggccuucaguugccaaaugaccaccacaguagugcuugggauguauaaaauccagcugagaggcagaacuagccuaaggggugguuagcauacuucuugggauaguccuucaucaauagauuuuuauuuuguaaugaugaaggggacugccuuuguauuuuuauacagauuuaucagauuuacuuaaucaauaacuuaaucaauauugauuacuuaaucaauaaucauggucuucuugaccaugaaaggcucauuuaaagaaaagaacacuugaagaauaucugaaaaugauuagcaagauaccuuugguuuuucaugaaacaccauuauaagucuaauguuugaagaauguuuuuauucuacuucugaccuaguuaacucauaguuuuuuuuuuaaauugaauuagauaauguguaugaaagcaucuugaagaauauacacucagcacaaauguaagauuugauuaauaaggugguuauuaaugaauaccauauaguaacaauauaucugagucuugcagaaaaacauucuugaccaacaggacgugaucuaguagaagagcugccuguucuacauauuuuauaaagagaacuaaucauuuuucuucuguauacucaauccgauaucaggaaaccucauuuaggucuauucacacuguagaggcagcaaaauaacaugccugaccuuuucuauguaaauauuaaaaauuauuaaaucugcauguuggaaagauugauuucggcaauaccuucuaaauuuucagugaauauuuaaguguaaguuugcagauaguuucaugaaaauaauugacuuuuaguuuugguacuagaacaauuggaauauuggugguauuuuucauuuuaaaucugugugaacuaaaauuuucuuauuugucuggcaugaacaucacagaaaaauccuuucccuucaagcuauuuuuuuaaaaaaauuguaaaggagauacuauguauugcagaacauuuagcaaauagugaaaaaauaaaaagggaaagucaaaaauucccucuuauuaguucaguacuguaacagucgauuguauugccugggcuauuuuuuuaaaaaaauuguaaaagagauacuauguauugcagaacauuuagcaaauagugaaaaaauaaaaagggaaagucaaaaauucccucuuauuaguuaaguacuguaacaguugauuguauugccuggugguagucuuuauaucuguacacauauacauacaauuuaaaauauguaugcaauuuuagauuauuuaaauaaauucauacuuauuguuauauauuuuucuuuuucuuuuuuuguauuugcauuuuuaaaaaacugauaagaccugccaggguuaugugugcuguaguguuuccugaauuuauuuaacuacuaugguuuuucuguuuucuaauuuauuaauucauuaaacauuuguuauuccuuuguuuucuugggucaguuuuauagaagucauuuuccuuaaauugacuguugaguuaaauuauuucacucuuauguuccagaucaugaauuuguauuguguaaaaauuuggcugcauuccauaaguuuuguugauaauguaauauucucuguguuacuaguuucugaaguuauuuuggcaguuuuuuccuuuuaauacaauagcuaacuugaacucucauuuaaauuucaaagagauuaucaaguuuagcuuuuaaaauuuucauaacuguuuucuaguuuuauuaaaguguggccaguaaagaaacaguguauuuucugugucuuaaaauuucuuauacucuuagugucccaacaaaugauauuuuaggaauuucucaguauuucagaugagauuuauuuuuauauuuguaauaguuggaaauguggcuuauuuucuguaguguacauuuuaauuugcuuuucaguuuuuaaaguuuuuucuuaacuagaucucuuuugaaccuagaaagauguguuaaacacucccacaaaauaauacauguuucucaugcauaagcgauucaugaugacuguguguuuaugguagauauuuucaucuuugaucuucaguacucccucuuuuauuauuaucucuuuuuuuccauguauuauuguaagagaacuuuucaaguuugucgucuacaucagugacaauuuuucuacaauuuuaugcaaauuuuaauuuuguuaaugcauuuuuaguuuucuuacaauauuuccuauuacauccaucugcuuuuacaucucuucacaaaucuuuuguguugacaccuauuuuauagaaauauucuauuuuauauaacugucaaaugugauguuuucuagacuccacuuguauuuuuuauagggugaaaauguuuuucaaaguauaauuucccucugaauuaugaguacauauuucccuauauuuuauugugcagauuuuuuucucacuacacaguuuuuaacauguuaaacuuuaggacgcugcaaaucugccuuucuuaauauauucugugauguugaggcuaacuacauauauuuuguaaagagguaugcuggucuccaugucagccucuaccaauaggaggcgcuggagggagaguagaaggcuagaggaggaagaacuuggccuuuccuguucuuguuaucaucacucugguaacaucagucuuuuccaguuuuuaguuuugucuacauuccuaaaauuaaccuccuuggagauaacagccccagucugcuggugucucuuccucaucacgucucucugagcuuacaggcucuggaaacccaaccgcuucccuguuuccccagccguggggaugguagcuguuuccauccgacuguucaugggugcuucuucucaagucuaaagccagaggacuguaaauguauguuguuuaagccacacauccaaccauacugguucaggaaggcagcggucuuccaguaguuaguuagcuuucuaaaaacucccuuuaaaaaugagacuuuagaaagaggaugacaaauccugaggacucgugucuuaagcaaauuuucugucuagauauuuauuauaaaccuaauugcaucugauaagugcuguguaugucauacucuaucaaagguaaaaggguuauuaaaguaaccugcacuuuuuagagcaaugguggauggccuugcagaaggcacauggccuuuaucagucaacucacuguggggaagcuggagaaauaaaguucaggugagaguaagccgacaguucuggugugauuuucuugggaggauaacguauaauguagguagcaaacacaugggagaaagaagguuuugcauuaugagauuugacuuaauguguacaguuugcuuuugguguuguaaagcaguaaagaggcuuauugacaucucuauugaaggucauugcagugcaugaaauguaaaucaaaguguuauucuuuauuagaagcuagaagauaacauuuacauaacaugcuuuuaagguaaugaguuaaguucauuauuuuuuauuacuauaacuguuugaagaaaguuauuuucaugcuaaaaauacuccuacuugaauccgauuugucauaauuuuugcaugauguauaaucuauuguuaggaaacgauaauuccauuuauuuuuguuucugggggaaaauuguuagacagcuguuucagucuuuccaaauaaacucgcuuccagaauuccuaguaaguagcaaugcugguugauaggaaugucaccauuuuucugaccccccucagccuuaucacaaagacauagugcagaagccauauaagaaauuugagaaaaggaaaagauaccaaggccuagguauuucacaaacuggauaauuagacucugaauugcgacgaauaggcugaaagaaaaaaaugucacaagccuauaguggcuuaaggaacacugauuucacagugaaaucuuucuacauaaauuuuaugguuaacugguaauaggaauaaaacuguggagcaaugucagacaauucuguuaugauuccugccuaaugaauggcaggcuuucccuugguauuuucuccuuaaccugcccauugcccuuucuguaugaucacauuuucuuuaaccaguucuuugcucauaaauaaagccguguguuccgguucaaaaguugcaucuucauuuauaaauucacagaauauguuuuucagggaaaaauguaacucaaucagcuuugcaugguuuacauaaugugauagucucauauuuacuaugugguuaacaagaaauaacuguuaccaacaaaaaucagagaauuuaaaaacaacgaacauuuugcuugggagccuauguauaucucuauauaaauacauauagacaucuauaaacaucaucgauccuucccaugugcacaugccauauauauguggaugugggaugauacuuguuuuuauauauacauaucuauauuuauauagcugaagaagugaaacauauugcuuuuuauuuaagugacucaaugcguuuauagacaagcuuuauuuuacaguacuuuaucaaugccgagaugauaagauacugcuuugauuuggucuucuaaaggucaaaauuugaaagaauaaauugauuccuagagacauucuuaugcuaucauuggccuuauauugaacagagaauuucuaggaaaauuauuauuccucaauggaaauaaaaauucauuuuagguagcuuaaucaauuugaauuauucauuuauggcauugcuuucaauuguugaugaguguauuuguguacuggguguggggaggucuucaggggaugggaagguggagggaugagaagauucuuauagcacuaaacugaauuuucaauucccugcuaaagugugaagaaagaagugaagugcuucauuuucuucuuuuuagaaucauuuagcaaccacaguucguacuuuauauuuuuuauggaguacuuucaacaacuugcuuuugcaguugggaaaugacacuuaccuggauuuucuuggguucuuuauucaugacaucaaugaagacuacugcuaaugaaccauagaugaaguuacacauaugcuaagcagggaaaugcaggaagaaugugaagguccuagaguaucucaauucagcauguaagugaguugugugcacaguagcacaguucugucuuauggcuggucaaugcuccauauuaugaauuuacauaggcuuuauuuuaggcucugaaauaauuauuuuuauuauauuucucaaauuugccaaaguaucucugagagagauucagaucccaucuguuugacagcugaggaaauggggacaguugguacaaugguuucucaacauuagaacacaucuuuuuuuuuuuuuuucuuuuuuugagacggggucucacucuguugcccaugcugaagugcagugguaccaucagggcacacugcagccuugaccugccuggcuuaagcaauccuccuaccucagccuccugaguagcugggaauacaggugugggccaccaugcauggcuaauuuuuguauuuuuuuguagagacaugguuucacaauguugcccaggcuggucucgaacucccaggcucaagugaucugcaugccuugggccucccaaaguuuugggauuaaggcaugagccagcacgccuggccagaacaugucuuaacuuuuuaagauucaugauccuguugggagucuuauguuguugcuaauguugcuuauguaauuuacuuucauaauguccuguuuccaccuauuuuucccucuuugugcugaagacuauugaagagcauugacuagugacauucagauaauagucuggugaguuuggguugaauguucuuuuuuguguggcaugcuuggauauguguaaauauguaagaauauagggaacuaaaucuuacuuuucaagaugcuaucgugacaccucugcuuguuaaaauguuggauaauugugagaaaacacacaaaaaaauacaaggaccccgucacacuucuuuauucucuuucagauuuuauacacuuaaacagauuuacagcaaaaaauccuccaaugacuuuuuaaaaacacuguuauguuacugauaaacugauuuuugucugugucccuucguauauauucacacaauuuucauauuucuggguuauucauccuugcuucacauguguuaucucacgguuaaaaaaauuuuuguuggaugaucaaaagcaauuaaaacauucuuauucagugcuuacauacuuuuguguucuuuuucugugucauuuuuucauauacagaauauguuuuccaauaguuuacauucugaauuuuuuaaugaccaguguuaaacuguuagacuuaccaucauuuacuuaagucucuccuacauauuuggugauuuugguuauuucuguaucuuugcacacguuuuuucauuuuuguuucuauuuucuaauaugcaguuuuuauagcuucuugauagagucuuugaaauuuuguuucugugaaauuguguaguuucauagaacuaaauuugcucuacuuaacuguaccugaugaauucauauuagcuauaaauauuuaaacauuuuauauaacagacagcaaaucaucauauugcugggaauguaaggaagauaaacuccaugcauucuagaagucauuagagauuuugcauauaaagaccacagcuaguuucaagaucuaaaucuugaagcaggcauucaagguguuucaauaaguacuuaacgguaggccauuaauucauguaaucauuuaggauaaaugaugggcagaaaaguuacugugcaaaaaguauuauuuggagaauaauggauauaugaaaacuuacauaaaugauuauuuauuguaauuuuuguuacuuucaauuucuuggucauggcaaaaauugaaaugcaaggucaaacagaagagagauggagaaagcucuaaccagcaagggccuggacucucacacuucccugauuggagcugcugugugugucugaggagucaccauugcuuuacugcuuauaccuaaacagaaguauauguagcuuugcuugcacugaggauguuuauaaauccucuggguuuuacauuugauuuacuuucuuccucagccuucccaucucauuugaagacaccuuuaguuuuuucauuucucagacuuaaccucuagggaauuauucauaucuccauuuucucuuauauuguacauuuaaagucuuccuaaauguuguuagcuuauauuuauuaucuaucgcugcauagcaaacauuccccaaacuuagugauuuaaaacaauaaccauuuuauuggcacacaaaucuguauguaguuuaccugcuuggacugagcucagccaguugguucucuuguugaugucaaugguggucacucaugaggauacagucugauggcggguggacaggagggccugguugguuuagggagccaucaacugaauuggcucacuucuguuccaugugguuuaggccuccagaggauagcucaggguucuucacaucaugguagaaaaucacccagccgcacaaaagagcaagaucaaaugaguaagcacuuuuuaagucucugcuuacaucaugcuugcagauacuccauuggucaaagcgugucauguggcauaguccaguaucagggugcuaagaaacuccacaaaaucaugggugaaggaugguguuauucauuaggagcucuuauuauaaccguuucccacaagguucugacuuuuaagaauucaaccacuuuuccuaaccucuguugcuaggacuuuguagcacucugguaauagucugcuaacuggacugccugcuuuagcccuugaccuuagucuguuuuuuaauggagcagugaucuuuaaaacauaauucagauguuauuccuccucuucucagaacacuucauugaccuuacaccuuauuuaguuaaagccaaagaccuuaaaaugguauguggcuucccugguaccucugugauaucauuugcuuucucucccacucuacaccagccacacucuuucuuaguguucugcaaaugcaccaugcaagcucccaccucagggucuucacauuuguuauccuuucuguuaggaacacuugacucagguucuccauaguuggguccuucaucucucucuucacucaaaugucauaucagaaagccuucccugaccacacucuugaagauuacagucauuuccucuucuaaugcucaccaucguguuuccuacuuaguuuuucuccauccaggccuccggaucacucuccauccugcucugugucucaagaggcuaaccuucuacaguugcauaaucagacugccuuucucucguucucucagucuucugguuggguucaccuaaugggaagcuguagcuuucccuucauuuugcuuauaaaccuuuaaaaaaaaacccaaaaaaccagacaguauauuauuuuagauuuagauaagaccaaacuaagauuuagugagcauuuuccaugaaccaauuucugugcuuucagauaugucauagaaaaaguuaagugaacugucaucccuguuuaagagucagggauacugagguugagguuaaaugacuuguucaagguaacaguuagaaaauaaacaaacaagacuuccaaacucacguccagucaucuuuuccaucuacagcccugucuccguaagucaucacugaaugaucgcuguuacacacaccuuuggaauuugucuuuuaucacauacacaccaccaccaccauuuucuggaaacuucuuuuaaacccaaucugacuuuuuaaucaagucuauauuugcuagucucaauagcuguuaccuucauccucuuacaucuaagggcauguucaccaggagucuuucuccggaaucaccaaccuccucuucucuccugacucuucagcauuuuaauaugcucauuucuccuaucuuaaaauuaaagauggauuuuuaaauuuaaagaugaauuuaaauacgcccaccccccuccaaauuuugagacuaacuuuucucuucauuuuguucuguccuuuucaagccaaguuuucucacacgacauucuguauauaaugugccaugaucuggcuucuuuccacaacacucucugaagauuccaccucaaaacgucaucaguagcaugugugauuggcuuugaccuuucuacugcuuuaccucuuugaagcguuggacuuuggaacacagccuucuucuauaccuccuacucucuuucaaaacucagcucaugucuaccucuucaugggaguuuuucuuaacacagaagacugaucugauugucccuccagcuuguccucuuguaugcuggggcauaugccagcaaucacagcugcugagaugcuuagucuuccugacggaacuguaguuuuuggaguggucaggaucaugucuucagaacuugcaccccagccaugugucugcacguaguucagugaccagaacauagucaacacucaguacaugccugaugaaugaacaaaugagugugaccauacuuaacuuggugaggccauuuuuuuccgugaguuuuauacucuggguuguuuuccuaccuuggauucucugacuuuuuucucucucaucuacuugccugacuuucuuaggucuuuuaacuuuguuucuccaucuuuacauuaaguguugggauacagggcugaacaagaacagguaacugucuuauggcuuuacguuuauguguuuuccucugaaauuaggcaaauuuccuaaucuugcugaaguuauuuucauccuuaagaaaguaauauuauaggucuuuauagaguggggcaggaucaaaugagcauguuuauuaauugcuuagcauuaugccuggcacaaauucaauuaccauuauaugguaauaauuuuaauaguaauaaaccauauauuacacauguauuauucauaaucagaugauguaugcauuauauaaaaauuguacuauucuauaaauauuguaaaaaaagaguaaauaauauacaucaauugcuuugugcauccauauauuuuuacgugugcuccuuuuauuaaaucauauguuuuuccucaguuuauugguugcuuuuuacuuaccaaaagcuucuguccaaaaaaaaucaaaugcugcggcugcccugagcagaguucaccuuggaagaggcuuuaauugugaugaaccuguaagaacaaaguuuaagaauugagauaaucagcagcuguguauuucuuuaaauuuuuauauuuaaugauuuauuugaauuaacuguuaccacguuuacaucuucuagauuaguuuuuaggccuuuacuuuuccuuggcuguggguacugaccagcauggugguagguaugauuggggugugugugugugugugugugugugugugugugugugugugcauggauagauguguguguaugcucauggaugugcaugugcaugcaugaaugcauaauauuucaaacacaugcucagugauugagucacugucaggaaguaaacuuggagaccauguugcucgaugccacaauaguccuguuauugcauugucaccacaggaugccauuaaaauagguaugaagaaugucaguguucauuaauuugguucucuucagagaacauuagccauggggaaaagauacaguagaaaucugagaagagauggaagauaggagagaaaccuggcuuuugaagaaugaucuuugaucuuucagaagaggaauacaugucaagagcuuaucuaugugaaagaauuuacaugcaaagcaaaucaagaacauagauuuugcuuaucuuuauagauuauaguuucaucuuagauggcaaagaaaagccaggcuucucuauacaaagggauuugcauguuuaugauaacucaauuagccuuaacagagacuaccaguauaugcuggcugucuggccucaaacuuuaaugcauauguauuuucaaagagaacuaaaagauuuugggauuguaacacagagaaagaagagauagagaauuaucaaacauuggggaucagcuuuaaaauuauaaaacaaauuauauauguucugaaaaauuacuucaggaauaagcagcuuuuuuuuaaauaugagaaagcaaaaucauauccuguaugccauuaaagguuauugcguuuuccaaauuuauaguugcaagugauggaaauuuucuuuaacaaacugaaggaugcauuuguagucuaaaugguagcuuugagaguaguuagauauuuauggaaaaauuauaagaagcaaugugcuuuuaaaauuuuuuuuucaaaaauagauauugguuaggaaaacuacacucuuucacuauuugguaaugcauauucugacucauucacacagucauuguggcaccuaaaguguugcaaaauuagacauuuauauggagaugggcuauugauguaaaaaaaaaaaaaaaagcugagggcuaggaaugauaagacaugaguagaggguuuuaaaaaugagcucuuuguuuuccacucuucaucaugccuagaucucagagagguuuuguccagugagaauaaagaacccaugggaauuaugcagaaaucacuguccaguaaaaggaauaguuuuccuucagugaccaagggugggaccugaagucagcacuagucagugacgcuguuuuaucgucuucaugccaggugaagauuugcauaggugaaaugcccacuuauuaggagaauuacacccugacagaaauccaaaagauggugccccuuuaucuucuaucaggggauuucaucuaauacuagaaggagcaguaagauaccaugaguuuguuaccaguuauucacuggccugauccugaaggucauugccuuucuucaguguuauuugcucaguauccugccugcuacccuuaagcacuuacuuugccuauugaaaucuuacuagcuauucauucagaaguaccaguauuucuuucaagguugaucuuaugaugcuacuguauuuuuucuugccuuuuaauuauuuuuuuaacuuuuuauuuugaaaaauuuuuaaacacaugcaauguauacacaguaguagaauaaucuucugugucaccaucauacaguuucaauauuuaccagcauucugccuucuuggcucaucuauauauaccacucccacucgauuuugauaaauucuuaauaauagacuaugagauccuugaaauuugaaacuauaauuaaauaucugucuauagacaccauacacauauauauacagcuauauaugcacauacacacauauaugcauagacacacacaccuaccccuuuauuuuauuuuuuauuaaaauguaacguauccucauuguggagauagccaauguuaauauuuugauuacuguguagauucuaucuuccauugguuuuuaaaaacauaacaugaaauuuguuuauugcuuuuaaacuucauauuuuaccaugaauauuuuccaauguccuugaauguuuugaaagugugauuuuuaaaggcagcguaauauuccaucacauggaucuuccauaauuuauuuuaagaguuugcaacuguugaccacaucuuaaacuccuugcacauaaacacuugucugcauuugcaaggauguuauuaggauaguuuccuagggaauuauuaggugaaaggcucuuuauguaucuugccaaguugcuaucuaggaaggcugugccaauuuguauuauuuuuaucuuauuaacgugguagucgacauaguaucugguuguguucuuuuagaaauuggcauuuucuggauuaaugacacugaacguuuuucauguucaugauucuuauuacauguguaaaauaagguguuaucuggaauuguagugaaugguacaugccauuuaguuuagcuccaaaucuagugcuuugcagcaaugauuaauuauuuuuaguauuucacaaaucaguuuuugcugucuuuggaccagaaugucugccuaagugcaaguuacauuaguugagaguuggucuuauuuuacuuuuugaguauuauuuuaaaaaauugucacuguguauaauuuucucccuuuaugucauguaacuuuauugagaaaugcaauucaaucaggaauaauuuaguuuagguaaaacuucuuuguccaagaaauauacugucagguccaaauacauuuuaaguuuugaaaaaaauauuuauuuagauaaaaauuuguaaucacucaggguauuugacuggauuugaagcauaauuuacuuccagaaugaauuuagaacucuguuguuaaaguacuugguacaauuuguauauccaguaaaauaaaaguugccauuuuugcaagucaguguuuuaaugcugauuugguacuuuugcuaugugaaauuccccauacuccaguauaggaacugaaugaaaacauauaccuuauuaaaauaguagagguaaguauuuucagcuuccuaaacagcagagaaugcuuuuuuuuuuuuuuuuuuuaaacuuuuggaauuacucuauuaccuacaucuaaguugcaaauccaaaaauaaaacuaggauuuuauuaacauauucugcccuucauugcuuccgguuauacuuugcugaacuguguucgaguauguugaaaaauaauuccguguauuguguguugaaaaugauauuaaaaguauauguguuauguggaagaaacaaucaaaacagaccuacucagacaucaacaggauauuauuaccccaaagaaaugacgacaguuugccagcuugaugcguaaaggaaggaaauuuacaaacaucuccaagagaggcauguugaacgguugaaggaaaugaggcacguccugcuuuuauugugcuuauugcagugggauucccagaagacugaacaaggcuguccugagaccucuguuuggcagagaucuuguugauucauauuuuauuuuuguuucagaaaaggucugcuauuguucaaauuucuaauguagcucauaaacacacagccaguaucauuuccccuucuacugacugauauauacaaauaaauuaaaaucuacggucaucauuaacucauguucuguuuccauggagcacaggagaguaacaaggaaggccccuuaaaagaaaggccuuuuaaaguggaggucucaguucacaaacuuuaaaaguuuacgaaguaguauuuuagaauuuuaaucaccagauauauugggggaauuuauuacuuccuauucauauggaagaggacagcagagguaaauauuuauguaacuuguauuuuaaaagcuuacucuugauuaaaauguuugaucuaucgacuucuguauccuuagaaguuugaauugcuggacauauuugacugggguuuuuacaaaggcuucuagguugaaaugcaugguucaggauuuugguuucaaauuucugucagguuggacacauauaaaugagaaaguaauguggaauauuauaaacauuucugcuuuuuuaagcucuaacuuuuuuuugcuaucucuaccaaaaugccugaaaaugucaugacucuuuagacggagaaauagaggaauggaaaccauucuggauccucugcugugacucagucagucuaaggggcagacugagcgcuauaucuggaguuuuacuuuaugaaugugcaccuuuaaccuugagucagaaaaugugguuacugucagucuuacucaguaaguggugcugcauagaacaucagggggagacuuggccuugguuuaguagaaacuugaaggagacaaacaugaaaagcagugucagaaaauggaagaccaguguuaaaaaucuuugguuuugcuuucauuucucuugguuauuucuuaggauuauugcuuuagaucauuuucccaggcauuuucauggaugaagaauuccaaagaaaguuauuauuucaacucuugaaagcuacgcuucagggugaagguagggcuugauuaucaaaggaauuucccuggcugcaguccuaacaguuuaacuuccugugauuuccccccgccccuuucccuuuauuuuuggcucagaacuucaguaaugucuggauugauggaauuccucugggaggcagauuugagggucuaaaggugcuucucaauaaagauuuugaggaaugauauuaacuuauuagaggcaacccucuauuguuuuaguauaaaggggaugagauuugggggaaucauuuuggaugucacauuaagccacuagccauuuuacucuugaugaccuuaguugccuuuaaacuguauuuuuaguggggaucauucuuucaacaguccauucuuuuuuaaacgcaauuugguuuauaauucugggggcugccucuacaugcuguacugucaagagagacaucaaauauuuucugaguaguuuucaacacagugaauuaaagcugaaaaaacaaguagcgauacuaccagcaucuuaacugaguaugugguggugguguuugaguguuugugugugugugugugugugucugucugugugaguguuuuauguugcuguaccuacuugcuuuuagguagcuacaguuuuaccagagaagagaauaacuuagauuauaucaaaguuuuuuuuuauauaaugguuuaaaaaccugcccugugucuaguacuccuuuacgaaguccgcaagacuuggggauaacaguggacaauaauguuccuuaaggacuuacagaaauaagacacacacagauauauuuaaauuccaauuaaucugauuuuuaguguggauuauugaagggcuaggaacuuagacucagaaauggaguauuuuuccuguuuaaaauguaaagagauuuaauaacauacaggagucuugcuaugauuuuugagaggagauuuacucuaauguuucagauaaucuguuuaacaguuaauaaaaauacgauuuacauuuuguuuggauuuuuuaaagucagcacauaauuucuaaaaguaagcaaauuucuugcagggauggugaaaugaaaccuuguagcauuuagcguguauugcgguuuuguuauuugcaguuuguuauuaaguguuccuaggaauaaaaggaggugcacagcaacaauguuuacugugccgauuucugguauuuuauaauuaaagagcaagugugagcugggaagggugggcuggaaagcauggauucuggcucuaaaucucagcucgaccacuuacuaccuguaaccuggggcaacacaguuauuuaauuucucuguaaaaugaggauaauacaagucccugcuucauugggcuaugggaauuaaaugagugaaugcaucuaacauugagaacaguguucagcccauaguaacugcucagugaguauuuuuaagcuauuagcaugaucaaauuuagagaggagaaauauaauggagcaguuucucaguucuuguuagaaauaaucauuacauuugaaaauccaacaaaauauuaacauucaaaacccauuuucagaagugguggugguagaauugcuauaacggaggaaaauuuaggaauggcagccugguuaaaagaaagggcggguagaccuggaguagguuauagaucaauuuaaagcagcaaaguuuucuaaaggugcuucuaguuuuacuuuaaaugaguuugcaguugcacauaucaaauaauaagguguuauuugccagaggcauuuuguugguggggggugggagaaaguuuugggguauauuguguguguuggggguacauuuccccggcugccuuuuuccacugcugcugguccucuggucaggaagccucccugucccgcacugguucuguuauuuguucuuggauagcaucaacuugaggaugagacuuuauaggcaacacauuagccucagugucuccuccugguuguagucauuucccgguuacaugggucaguuucuccaccuuacuugagugaaugccuagaaaggcuauuucagccuagagaauuuuuaggggaauggagaagcugaggguaacuccucagcaccaacacuugaacccaaucaauacuugauagauuacucccagcacacacaauacacccagaaaucuucuccccaauccacacccaauuaaguuucagccaagguuagaauucagugguucccucuguguguguccccuuagcuguugcuguucaggugcaaagguguucauuucuuugucuacccauguguaguugccugauauccaacuaaacugcaucaaaauauggaaccccuagguaggcaaaaaagauaauuagaauacaguaguccccccgccccccuuaucuguaguuucauuuucucuaguuuuaguuacuguccaucagcugugguccaaaaauauuaaauggaaaauuccagaaauaacuccuaaguucuaaauugcucgccauuugaugaaaucugcacuguccuuugccaucucauccgggacaugaauccuuacuuuguccagcagauucacacuccagacacucccugccuauaagucaccucuagguuuucagauugacuguuacuauggcagugcucagguucuagucacccuuuuuugacuuaacuauggccccaaagcacaaaaguagugaaucuggcaauucagauaugccaaaagaaagccaugaagugcauccuauaaguuacaagggcaaaguuccccacuuaagaaaaggccaggccugguggcucaugccuguaaucccagcacuuugggaggccaaggcgggcggaucaccugaggucaagagaucgagaccagccuggccaacauggugaaaccccaucucuacuaaaaauacaaaaauuagccagacguggugguggacgccuguaaucccagcuacuugggaggcugaggcaggagaauugcuugagucugagaggcggagguugcagugagccaagauugugccacugcacuccagccucagugacagagcaagccuccaucucaaaaaaaaaaaaagaaaaaaaaaagaaagaucauaugcugagguugcaguauauuauaauuguucuauguuacucuuaguuauuguugucagucucucacugugccugauuuaugaacuaacuuuaucauagguauauaugcauaggaaaaaucauagcguauauagaauuuugugcuaucugagguuucaggcaucugcuggagaucuuaaaaccuaucccucucuuagagugaguacugugauuauguuuaaauaaaugaaugcaugcuugcuuguggaaauauuuuugugugugggguauguauauguguguguguguguguugcauguggacauuuuaauguguguguauuauccuagcugaugguuuuccuuuggacauuuggguucauuuuguagaaagaaaaugcaguuuuagaaucaggaagcugauuggaugauuccaucugaauauauguguguguauaaauaaaauauauuaucaaaagccugacuugacuugggaacugggaaguagcagccucagguccuccuagguuuauuggaguuacacuuauuaguaaguagccuaauccucucugcaaagagaggaaguacaguuuuaugauagaaucacgugggaugaggaucauugaaccagagagaaacugcugcuguuugauuuccacugcaggucaucaguauuucuugaucuagaacaaugauaaaaaguguucuggucuuuaagcaaaacucagauuuaggcuuuauccuuagaaucugaucuuuaaaacuggaagcacaagcuuuccagcuuugaauucacuccauuucagagaugaagaaaccauuucucaaagaggugucucuguugagguuucacagugaacaagucaggucagcugaauccaggucuaguguuauuuccugcaaauacauuuuauuuuucauuuuugcaguaaucuuuagauuaaacccacuccuauacuguuggauuaguuaggcacauggacuggguguauguuucccagauuugaagguugguucuccaugucauaguuauuuguucugguugcuuuuuuuuuuuuuuuuuuuugagacggagucucgcucuguggcccaggcuggagugcaguggcgggaucucggcucacugcaagcuccgccucccggguucacgccauucuccugccucagccccccaaguagcugggacuacaggcgcccgccacuacgcccggcuaauuuuuuguauuuuuaguagagacgggguuucaccguuuuagccgggauggucucgaucuccugaccucgugauccgcccgccucggccuuccaaagugcugggauuacaggcgugagccaccgcgcccggcccgguugcuauuuuuucucaguuuucuuaucuguacaguggcgguaguuauuucauagaaucauacugaggacuaaauaaguuauuucuuguaaauuacuuacaugaguacccagcauaaguguuagcuauaauaauuauuauguuauuaaugauuaugucauuauuauguauuguugauaguaauauaauaauauauugcuuuuuagacacuuuaguuagcuauccagcauaugacaauaaaaagguggcucuauugaagagaaggauuccauaauuuucuugugaaauuagcgccauaaaucauugaacaucuugcuucaguuuugugugaauuauuuggauugacuaaguacucuugguacugggcugaguuaccaucugcuguguuuugcuuccauaggucaggcuuauucuccuagggaauggugagguggaaaaaaaugccaauaaccuaaccccaaaauguauccuaacugucuuguucacauuuauaggacaguuuuauugcuguagguaagacggauaacugggcacuauuccagcaucuuggcaguuuuccuuuuuucaagguacuaauauuaggauuagcauguuguuuuaaagccauugccuuucugcaccuuauaauugcuuguucuugggggaggcuuggaacauuugaauuacgguuuuucugccaaauaugggagagguugucuguuuuguuuuaauacuucgauugguuuuuaaaguugguacuacaguccauuuugccaacagacaacacaaauuagaggcagugugggcacacuguguauggggcagaugcagagaggggcagcgaauaugcaugagcgagaauguuauagcucugucaguuuuuguaugugugccucaguuuauuuuugguauugauaccaauguucggcaauacagugauuugccuccucuauuuuguuucuaaaucaaagccuuggcagauuaaaaugacuaggaaaagauuaaauuguuaaugguauaaucauauuuuucucuaaagcauugaagaauuacagugucuauacuuauuagcaugugauaacuuuagugauugaaauguuuagcuaguuuuacucaaauauuaguaggauuucuaauuuucauaggagagccuagugccacaaaaguuacugguaacuagcacucuucaguuuucaucuucauguaacuguugugagcauucaaggaaggagcugggaaaugguuuagucuucauagaugcucaacagaugugaguucucuuuucucccauguauacguuucuuaucuuuuuguagaguucaugggagcagcauuuauggauucagacuuauauuguugacaauguccuugcuaccugauagaugaucaguaaguguugcagaacgaauacauaugagagcagcagagauaggaguacauuagggcaauuagaauagauuccuuuuuuuguuuguuuuuugagacagagucuguugcccaggcuggagugagguggaucggucucacugcaacuucugccuccuggguucaagcgauucuugugccucagccuccucaguagcgggacuacaggcaugugccaccacaccuggcuaauuuuuauauuuuuaguagagauggaguuucaucacguuggccaggcuggucucgaauuccuggccucaagugauccguccaccucggccucccaaagugcugggauuacagguaugagccacagugcccggccauuagaauagauuucaaagaaaaguugacugugccaaucucugcucccuccuguauguuguuaagucuacagggccauauugccuaaagaaacggaguuccccaagaauguguuaggaauaacaaaaauucuguacuuugaccugaaaauugcgguucuugagcugguuauuuuucuagguauuguuggaaguuaugagucagaguuagguacuuauucguggauaacacaaggacuucugucagagaucuggaugcugucaguagaaucucuguuuacccucuugggcucaguuuauucaucuauucuaugaggaggaguaugccuguuuggccuuccucuuagguugcuuuugagaaugaaugaaauaauaugugaaaauucuguucauaaguguagaagauggcuagugaugaugaugaugaugaugaugaaauugaugaugcccaaaauauggagaaucuagacugaauuuauggcuuucuaacuucgaauuuucggcuuucuaacuucgaauuuucaggaaugcaugaugauagaauguuuuuauuucugauauccacugcauuguuucuauagaccuucaaaguuugacacaaauaacuaaauuauuuuguuuuguuggugaggaucacuuuuauuuuagcgguguauccuguuaaaauaaccuugcaugaggauucucaaaguuauacuaauguugcacuaguaacuaaggcaguuccaaaaagagacauuuagaaugaauaaggauaaaucaaaaguaauucauauccauugguaaggagguggcacauaccaagugucaacuguagauauuuuagaaauugaaguguuaccauggaaucaaaguauuccacuguaagguugaauaucucaggauaccuacuuuaagucgucgauuaagaugaaguuaauauucauuuuacauauccugcuugaaaccucuuaugcugugaaauuuuccugucuauuaagaauaguuuuagaaaaaugaauuagcuaauuccuuaacuuguauguaacuugaauauaaguuccuuuccuuaacuugugugaaaaucaguucuccuuugugaagagcaugagagauaccucaauaaaauaguaauuuuauauugacaucgguugcaguuucaaagucagaguuuuacacuuaugugccccuauauugucuagcuuuguaauccccacuuuaaaaggcaucccaaaauagcaacagaagaauaaauugugacuuggguguauuagauuuguaugaucuuguuuauugagcugcuuuguuauguaguuaccaaggaugauguaagcuucucauccaaguuuuccuuuacuaugcugcauuguccuuuaaaugucaugagaauacaaauauuuucaagguagcagugaggaacaaucuagaugagaugaccaaaaggaccucucauaugaaacugcagugagcaaagguuuauuggucuuuggaucucuaaauagagugacuuuagauaucuaaauuuagugaaaaccagaauucagugacuuuagauuucagaccauaagggguuguaacaccuacuccuuuucucuguaaugaagaaaaaugaccacaacaaugugguggauaucagaaauagaaacuuuucaucgucaugcauuccuggaaauuccagguuagaaaggcauaaaagagagagaaaaccugucauaguuaguauaucuaccuugguuaguguuuuucacuuaggggauugcaaauucauaugagaauugcugagagaaacaauuaauuuagaacaaauauucuccuuccauuguuacagccuguaaaauguuacuucugaguugcuacuuaucuaucaccauuucucuuucuccacuucauuguuaguguuuguaugauuagggugggcgggggucuucuggaugggguugcucacacuccacaaagccuuuucccucuucuguugaaagaagacacagcugaaaucagucucuuugccuuuucaugauauggggaugcgguggaaucaaagcaggcaggaugaaagcccaaaagcuuccuguuuccagcuguuuucuucagcgaagguuuuuuuuuuuucucccaaagaugaugcuuccuuucaagggguuuuuaaucugcuaacuguuuccucaguuuauuucacuacaguaaaauguguucccuuuaggucauaucugucucuuuuaaaacccaaccuguccuuuucagccguguuaguugcuacucaaaagaacaaacgugauuuauaaaaguccuuuuaaugagguacaaagaccaauaaaccuuugccacuagaguuucaucuuuucaguugcuuuauuuucauuuaugaaaaauuugagaugucaaaaagccauugagaacacuauugauuugaccauuuaauauuuguaaacaaagccguuaaaaauaaaauauauuguuauggccuuaagguugguugugguuuuuuuuucccuuccgaaugcaguauaaucauauguaauuuguuuaauguaaauucuuuaaaauuaaggcacuggaaacugcauaaaugcuaaaaugaauacuaagaguggcuugauuuauuaagugauaaugugcaugaaaauauggcuuuuuugcacugauguuuauugcuucacuuuuugcauugauguuguuuuggaauuuacauuucuaaauucugcauccucuagggauaaaugaaauauaaaaaugaauucuuuuaaucacucauuaaacauuaacuagaccuuucacccauuuccuagaucuuccaggguucucaguaauaaucaucaucauuauacauugauuuauaaaggaauaucagagugagucagaauuuuucuguuucuuuaucacuugucuuuccccaaauauccauacugaccuaaacguaggagaauuuaucagcaagaagguucacauugcugcccuguuauuugagcucauucuuugugauauaaugaagccaguggcauaugggggagaaccaccucauuucauuuucacuuuaaugcuaacucuaacauaugcuuuugaauugaaguggggucccaaaugccaauauauguuaaaagaauuaaacacuuugaaaaaagagaaaguuuucccuuauuuacuccuguugcccacucucuugagggugagaggcugauagcgcuuaaaaacaugagcaugccuauuuuaucuguacuguuuaauagagagcuaugaaaaaaauggcaauuaacauauucagacagaaaaucauccuggcugaaugacucauuaaauagucguauaaacaggaugugccgaaaugaacugguucagaauuuaguuccauuggucuuuucagcacacacugcucauuaucagcacuuuaagaagcagacuugugggugcuuagaggacacuuaaauuucuuuucucuuuauuuuuuucuuaaauacuucuccccuccuccacuccuuuccccugcuauuccuaauucuuugcaggcuaagauuacucgucuaaacaugaaacauucuguuggcaaucgaguuagggguaagagcuucugacuuucauccaggucggugguccuaaccccagaugacaaucaaaauguauuugaagauuuuuuuuuuuggagacaaagucucccucugucgcccaggcuggagugcaauggcacaaucuuggcucacuguagccucagccucccagguucaagcaauucuccugccucagccuccgaguagcugggauuacaggcguauaccaccaugccuggcuaauuuuuguauuuuuaguagagaugggguuucaccauguuggccaggcuggucucaaacuccugaccuugugugauccgccugccucagccucccaaagugcugggauuacaggcgugagccacugugccuggccauguuuuuaaaauaugcagacauugcugaaccucauuuuuuugggcuucccauucaguaggucuagaggcaaggccugguaguccguauuuuaauaaaagcucccaguaggauucagauagccagccgggcuuggaaacuauucacugauuuguguccccucacaguaaaaaugcucuuuccccagguacaggauauauggccaucuggccuggauaucagugguuugcagaccuggcugcaaauuagaaucacuuggggagcuuggagaauaaauacugauguuugaccccacccccaauuaaauuguugguggggggaguaguuaaaaccuccccaguugauucuaauguacagucaaguuagaguacuucuguccuacauaaacagauggagcuagguuuagcugaaaaagucuaguuuucuuuuagaauaugcuuuacccugugcuaaaacuccucuguuacugugccucccuagccacacacacagagcuuaaacguauugccucuacuaaggcuuucacauuuauugguacccuguucucaggugggaguagaaugcuaggcucucacguuguaucagauuccuguuucuuccuaccugaguaucacaucugugaugugcagauguguugguauagcaugagcaccccacaaaggcuaaguaauaaggaugaagaacaaaauugcaguuuagcaaaggaaggagcauccaucuuuugagucccuguauacuccaagaaaaauucugaguaaacaaguuucuucuuuagcaaguugugauauuaaaugggugccuuucauuacauuggcuaacauuugcauuucuuggaccuguucuggaaaagggucugagaugaacccaucguugaagaucuaaaaaacaaaaacuuucaccaugucaagggaaagaggaaagauuuccauaaguguaaucuuguauucuggaugguacaugaaaacucuacuuccuaacugcccacagggauuuaagggguauuuuaagggguacuuacaaauaaaaggaagaagauacauuacaucacauucucauuaccaaggagaaacucauccucucuaggaaagguuucucuccugucuuacgugugacuuuccaccugcuaaguccccuugaaguuacugagcaaagacacucuuacaacacuaagccauuggugcuagaaguggaaguagacggagccccugagguucaggugccagguccuuguaucucugauggcgugggaaacaaaagucagcagccauuucucuucacuagagacucagaggagguaaaaaggggggauucacgaagucaucuugauuuuuccguaucuuauggcgaagucuugugguagaccccagaacccugaugguuggucucacgcucguaaguuuacauaaggcuuucucaagaaacugacauccagagcgcuugccuuagagaagacagcugaccauggucaugacacuggcagguguuaggacuggcuggucuacucugguauggcagaaacccugggccccugaauaagggaggugauuaugcuuuaaagucuaggcuuaccauguguagggcugugggacucacugucaggguuguguaaggcgagggccaucgcuugcagaagucugagugugugagcacccccuuaaauauugcccccaggugcuguacuugcuuaaccccggacccagcccuggcagggagcaacagcaggagggaaaaccauugguaauuuaggucuucacaucuuaugcuucauuuaaugugguugauaaagagccuccuuguaaaaauaucuugguguagacucccagggaaggaaacacuugugugacugacaagcuggcagugcccauggccacgugugucacccugguggaggauaaucguccuauuauuuuuugucaguagguauaacaaguggguagugcuuuguguauuccacugugaugaauuaauuuuguguucauuguaguagcacugaucauaaugaauuaauuugguauucauguggaugucagagguuuuuuuuuccccuuccaauuucauguagcuuuaguuaauggauacuuuaaaguacaguacaucugaucugauuucuguucucucauucacuucucauaauuuuccccccgcuggauauugugaggucuucuguuuuuaaaacauuuaacuugaucuuuaaauaauuaauguuuuaauagcuuuacaugaacucaaacauuccuccugcuuuuaauuuauaaaauaaggaaaauaagguaaauaguuauaacaaauauaacugcuagguugaaugauauacuuaauaacuuguauauuuuaguuugguuuaaaaagaucugaacuaaucauuuguaauuuguagccuuauugaagacaaauauuguauccccuuaugcaaauaugaaauaaugaaaacugcaugccguauauaauaguuugcucuucuuuuaauuucuucucucuuucccucauagacaagauugauaaauguaugugcauauauuauuuaucuguucauauaaggacauguaauugacuauuagauaugguaauugcauaaauauaucuuauucaagcucauuuccuuuucuguuuauaaaauaaauguuuuuguuaaauuggaauauguacugaaauagaagugccuaauuuaggauucagaaacuagguacacaaacaaaaaucaaacaaaauucugggaaccuuugacaaacuuguucuuuaaccuauauguguuuaaaaaauuuguucaucauguuugcugauuauugaagauauuuauaauagaauaaggguuuccuucaucacuaacacaccugcucggcugauuugcucccaguggaaauaugguugaaccuuuagaaagaacgauguuuuuuugccuuacgaguaucaggaugccauuuuuggucuuucuuuaaauuuaaacuuggaaaugguauccuccauauauucucuuguggcuuuaaacuuuuuuuuuuuuuuuuuuuguaauuuuacagcucuuguucaguuugauucucagcagcagcuguauuccauuguagacugcuguguuucagcaauugauggauccuguauauauucuacuauuuagaguauauaaagaaguugggacucuugcaaguggcaaggacuauauaacuggguuacuauggcuuucauuauuuuuguuauuauugugacagauuguacaguaauaugcuaacaaagauuuauggcaucaugcagcaguaggaaauguugggauggaggagaaaacucauguuaaaacaaaugucuauaauaauaagaggaaaacaaaacuucaaaaaagcugagaauuguuucuaguauaaauauuuuuauuaacauuuguuaugguugaagaucuugagaggaacuguucaugcauuucugcaguuuagauuaugcuguaugccuauuugugcaucaucguucuuaggagauuguucuuucuucugguuuuuuuuuuuuuuaguuuuuuuguuuuacuggaacacauagguauugaauaugcaaugaacagaaaauuuauggagggcagaguuaugaguaucugaggaaaguuuaauuacuuuuauaauuuagauaagcuucauaauuuauuguaacacgcuguacuuuggcacaauuuguaacaauuauaaagcacuugaauuuagguucuuuacuuggcagcuaucaacagaguuagcuguaugaaaacuuuaagcauuuacuuuccuuccuccgccuugcauuacaggcuuacgcuguaguaguuuuguugcucccacuuucauuugccacaucucuggguuuuauguaucacaguauaguaggcuuguggcuauacacuaggaagcagacgaagagagaaccugaagauaccuccugaugcccaaaccuaggaaagggaaaaaugcagaagaacucagacgacucuuggaaaugauucuugccucaauuaaaaagaccucaccacucaccuccauguaaaggacaggucgugaauuauucaaaugauucagaaaucaacauuuaaaaaaaugaacauaaauuccuuuucauaauuaaagagcgguggaaaauggcucuuuucuuaggucuagauuauauugcuguuaaaggaauugcugccuaguauacaauuuuuugacauuguuuucuacaacaucaaucuuauuuguuguccuuuuuugucacgccuguuaaauguguauuuuucuguguugauauugaaacuaauguacaaagugugacaucuccaaaaacugauuugguuguuccuaaaaacauugguccuuaaaaguauauuuauuugcagcccaggaauuuuuagcuucacauuuuucuuuuaauaacuaaacuguagaacagaauuagcucucauaaaaccuuguacuugcugaacaacucucauaauuaaaugaauauaaugauuuuaugugacacuuugaacuucuaaaguucuuucacaucuauguauguuuaggacaagauuuaaaaguuaaauuauucuacaguuggaguagaaauaaguggccaaguauccaacuuuuguaucucaaauaccuucuuuuuuuuuuuuuuucccaaauaccuucuuauauucuccaccgacuuuuugggcuggcuaagugugacagaaaugggaacuuuaguucuggcuuuugauucucucauguuaauguagguuuuugauaagucacuuggugcaaaacacugaaacaacuuaucuauuggcuuaaaugagucaacagucugaaucaaacagguugugaauugguuaaaauaauaaaccaguaacccugugguugagcucuugaugauuaaagaaccagaccuaagaaugcauuuauagucuuuuaaaagagaguaaagacucccacuucuuugagcuguguuucuuuguguagauuucuuuuuuuuuuuuuuuaaagaaaggcuucauuaucuguuucagaucuuuauagauguugcaauaagguacuccuuucuauuaguauaggauugaaaggaucaaaguuaauaacuugaacugagaugcuuuaaaauaacaaaauaguuuauuaucucuuuccuuuucaagauuuauguucuuacaaggguacaauguucaugauugaaugugguccuacugguaaggcuuccauguaauagaagaguaauucccuugucuagcauucucuggguuguuuuaauguugcaggugaauguguucugcugugcaaauaaauguaguucucuuauucacauuccugaugacuugcauccuuaaacccuuuuggucaggguauuauuguccuuuauccugaaaaaugucugugauuguagugcccuaauacuauaaaucaauggggacugaauucagcgccugcuaaguagagugaggcaacccuuuaaaugcaaaugcaucagggcuaguuuuaauguaauuuuaauaaggcugaaaccauuuugaaguagacuuaaaucauaauacuaaucuuaaaagacucucuauuuagcugagaagucccuuuauucucacuggccauuuuuccucugugugcauccaaaccaccuuucaugugauuccacaguuuuucauuucuuuuuuuuuuuuucucaaauagaauauauguacaguuugugguuacuuuauuaguuggagaagagcuuguauugacuaaaauugcuucacuucuuuuucuuccugguuguacaugccugacuaaucuguguguguguguguguguguguguccauaauauuucaaucacauugcuguguuuuggucagagaaguaaaaaucuagcugucaaugccaacuggaguaguuauuuaagaauauaauauuuaaguaggggaguauaugcaaaguaauauaaaaaugaggaaaacauuuacaaaaucaaaugugaccucaaguccaauauuuuucaaucuucuaagucuguugguuucaccaccucacauuauuucaauguaugugaaauauaucuugcuguuuauauuuggguugaugggacaggugcaggaucuuugaccuggggaaauaaauuggauuaaggacuagcuuaacuagucuacagaaacuguagacuacaaaaacugaaggcaagaaccuacugucacaucuuuugcagagagacaaaggcauuuugguauuuggauauuuuacuugggauauguauuuuguguauuuguguaauuuuguauuaauuuacacaaacuuaaguaaacaauauauuaauaagauucaucaaguaauuuauaaauuaacuuucccacauuuuucuguguucaagaauuaucaaggagauguguaaauauugaagccuauacuauauuccauuauuugcuuuuaauguauuucauauaauucagaaaacaguaauuuaucauuuacauuacuucccuuuuccuauugagccuucugaaagaauaauguagaccagcauuuuaaaaaaaagcuuguuucaagacauguuaauagaaauuuuauuuucaguccauucugcauuaaauauuguaaaacaccccuagagagugauauuauuuguaaugauucccaaauugcuuugaccagagaacuccuuuuuucaugaaauaccucccauguggaacauucugcagaagaguuuugugaaaugcuaacucagcccaaaagguuuuuuaaauuaaggccuuucaaguugguaaugguauuuaguuucuuguuuuuuaaaauagacuuuguuuaggacaguuuucuagggucacugugccacucaugcugacuguccugucgucuugaaaaauacuacugguaacaugugaacagauauggagguccucuacccgaguauuuuaauaccaaauaauagcuauaucuucucagauauugguagcuaugucaauggagaugugaaauuggcucuaucgauggcuuuuguccauucuccaagagaggccugucuuuguggguggagguguugguggauauguguaugugucuccuucucuuacccucuuaacaguuuggucacaguggugaccagugaguauagagcagagccuugacaaugcaccugacuuugggcuuuagccagauaguaugaaugagugaagcagauguuaaggagaggugaguuuagggcaacuggggcauucgugcccccucauucauucaguuaacauuuccaagaauccugugcagggcaaauaagaucuaucucaggaccagcaauaucucauccuugguaugaagauaagaagucaggagacuugagcuguagguuugguugucuccuugccuggcaggcuugccuaauuuacagcaaguagaaaauaaucugugucuuguucaaaucuaaauaacaaugcuuuaaagguaguguagaauauuuguuaaaaagaacauauuaauuauguuuuuagaagcuucuguaaggaagaaagaaguuugaccccccaacuuuucucuuuucuagaacugcaaauuacugcuauuuuaaauagacuuuguuguuuaacuguacauccaggaaaaucuaggaaauuaaagaagcaugcauauaaaugauuguguagcagaacaugaacauuaaauucauacagugaagaaauuaaaguuagaaauacucucaaacauaagaagguucuagaaucaauccuuuaagcacagucugagacaugguauaucuuugcacuuacuuggaccuugguuucuauuccugugaugauuauuggauuugaugccaucugauguccuguuccucagauucuaugaagcugagucugagauuaacuuaggucugagauugacauaaaggggaaccggucccuagauuuccucagggcugagaaguuauugauuucucaaguauaauaggacugcacagacgcacaauuugcaccaaucggaacaaaauguuuaacaaguucugaguauagaaaacacuuugcaauuugaauuucuaugauuccaaaauucaaaaaagcuccuuuuugauuaaaugcacugcccucaaccacacaugcucauuuucucugucuacugcuuugucauucuguuuauuuaacuuuacuuggcauaccagaguuuuaacgcugagauuuuaaaguacauaugcaaaauuggaaugugucagagaaccuaggaacagauucaucaaaggagucaugaggcacauugcacaugcuuuaacaucaagguguaaacggagcccauuaaacuauuaguuaaguggugaucaggagcaagagccugauuagauuacaaaaucuucugugugugagcgcgguaugugaaaacauaacacuugauccucaccauagugccaggaagauucaauuagagaacugguaugugcccagauuuggggacauaaagggcaacuggauuuugaaggaaagaugguaaggaaacaccugcaaaaaucugcuucucugugcaacagacuggguaauugcauaugcagauggauaguuagggauauaauugcuugauuugugaacauaaaugcccuuucgauugugucaguguugaauuuugcagugacaggugccugcggauugcuguguguguauccuuugcaccccuguuuaaauauuuggccuggaguaugucuuccauucauugugaauggaaccaccgccgucccgcccccaugauggucuggggguauuguuauagcucuuaaugucucuccaacuuuuucucauaaauaauaaccuuaauuugaaaccuuaacuaaaagaaggacugcauagaggcauguggugaagggcuuacgaauuaugcacagaauucauuuuuuaaagcugcuggauguaacucauuaguuuucauuguuuucucaaaauaaggaaaacuauuaaccaacacugcagacuaauagccuggauuuuuuuucccccauaaucaacugaaguuuaauggaaaaucaucuuuugaaagacuuccuuuuuucuccuugcuuuuucuuaaccuuuccauuaauacuguuccaauaucuucucuaaucucucucaacuaaauagcauucucagucauuccuuuucuaugucaacauuucuauaccgcacugaagauguuuguaaaaauacuggugcaguccaaaugggauuuauuuuuaaauugaagaauuuguuaagcacuuacuuauguggaauggucaggucaucuccguauuccuuucucuggccuuauggagaaaguggaggaaauggugucugccuuuaaugagguugcuaacgugccugaacuacacaauaaguuauuaagucauauuuuaugugauuauucaguuucuuuuuuuuuuugcuccauucuaaaucaaacuaucuaaauuauuuuugucaaauaaagguuaauuucagcaguuguugauaauaaacacuugcauguacuauucauaucaacguguaugauacucugcuaaguauaguacaucaguaaucucauuuaaucugucaaacaguauauauuauucccauuucacagaugagcaaacugagcuauaagauuaaguauauuacuccugccauauaguuaauaaauagaaagggauuggaguucagaaauaugugccucucuagcccacguuuguugcuguuuuggcaucuaauuugcaaauauaaauaaauauaucuaaauaaauaaaaaauaucuugaaucugccuuuuuaaaggagccugccaaagagaggcaaaauaaccgcagaaaucccauuuugacuggcuuugauaugaagacuucacacaacucuuauuuuaauuucuugguauuuccuuaugcuuugcugcucuucugaggcacauuuucucaguaagauauucuuuaugcuuuuuaacuaaaaauguggggauuaaauuuuacccacaaaaagguuugaaaccguucuuucuaauucuucaugugucauuaaaaaaguauccgcauguauuuuggugcguguggagaaggagcuggcacugugugcucaaauaaugcucagaaccaccugcuuugaauguggucugauugaaucaaaugacgacugcuuuucaucaccgagccgggauugggaugugggggaaguguuuuguuuugauauuucacaugugcuuagguguucgugguuucagguuguuuaagaacagacucucauugaguguuggugaguccugugggggagauuugaaagcaacguugaggauuucuaggucuguuucaaaauuacauccucuuguguggugcauuuauuuguguucaggaugcagauugccuuguggaaaauggcaaaucauuuucccucauaaaagguuucuuuuguuuuuuuguuuguuuggucuucagcuauuuuuuuugguaguuuccccuccugaguucagauuaucaguacuuucaucauuuauaccacucgguucucuggaguucuuggugcacuguggguccacuuuucuuguuuggggugaugacuaacaucugcccugauacucgccugguacuugaggcucugaacuuuauuaucuucucuucaacugcagcucguggcacuuguaggcaacgugccucccaaagagccugaaagagauuacagcucacuuccugccaucagacaguauguggggaggucaaggggugggcagaggagaggcuuggugaaauucagacuuuugggccccaucuagaagaaucugcuucaguaucucuuggagcuacccaggaauauguauuuucaacagugcuccagaucugagggacaguuggaauuaggaaaacuguggcucuaacugaugccccaguacuucucaaagugggugcccccacauccugauaugcuggauguguuuuguaacugcagauuccugggcuccacugggagugguggcccuggaccagccucugucauguguccccaaccacacucuugggauucguauuuguaugaacuuuagagaaugaacugccacagagauucuaggugacaggaaauugugggguaaauuggaggauuacagaucaugcuucuaauaucagcacagguacacacaaucgucaaaauaggggacagguguguuuggaaagcuuguuuuguaaagaaagucuuuucucccuuugacuucucuucuuuacguggaagcuacacuucugaauuacaaagagacagagaaaaaagagaacaauaacaacaaaagguuccugaggcauaccuaagcugcaggagccaagggagugucccuuguuuuacuuggugauggcuguuugaacagccguuugcuuucuccuuccuguccucugaugugaggaugcaggauuggaaucauuagaaacccuagguuaguagcaucaggcucccugcccuguguagucucugggaggacagagcugcagcuuaaguugugcuuuugucuuggcaagcaccuuucaauuuuuauccuagcucaguugcuuuguuuggcauuuuacuggccaauacuccuuuuuuuuucccucucuucuccaucuccuaauucucaaccucuucuggggccaaaaacuuggaggaaagacuuuaaaaaaaccaauuucacuccuguuuauguaaucguuucuauauuacagaaggcuaugguauguuuuaaaauguauacaucucuuugcuuuucucccuugugacugaauuuuugaaaaaugcuugaaauacggacaccaaaacggaauguaugugugucacauuuaaacggaaaacccuguuuguuuuguauauuagacuauagccaaugaaaacccagggaguaaggauuuucaugaccacaacugaauauagaaccucauagguuucuguuauaaguauaaauauugagaauaguuuuguuuguuuaugccagugcaguuuuauagcaaauccuuucaaauggggugcaaagccauccauggauauuuguaaaggcuuugcaaaaucauacauaaaauaaauuguccauuugauuugaacaaguuuugcaauuauuuguggcuuuaacaggggcuuuugaagggcacuguauauaucuaccagcugguucuacuuuuuuuuuuuuaagaaaauggagagcuuuguauacaaucccuuggguaaaccaguaauaaacuauauaucagguagucaagucaugccauuucaaaucuguuuuacauuuuaaagggguaauaauuugugaauuucaucucauagaaauuuuuaugcuucaaaucaaguuguuaucccauccuugucuauuuuuuuuuuaucgauccccucacucaguguuuuagagaaauaaagcauacaauggaaucucuugcugggaaaaaauacuuucuuacuuauuauauuguaucuuguaauaauauauuucuaucaccauuuaaaaaacauucuuuuaguuauugaugauuauuuugucaaauuauaugaauuugguucuguuuucuuuuugugacaaagauucugaauuuucauguuuaauaaaugcacuucuucacaugacaaauguucauugagcccuuagccaggcauuggugucaacccugguucauaggugcccagaguuccuguccuucugaagcuugcauccugguggggaucaauaaacaaagauaccaaccaacaaauauaaauauauguauguauguaauugauugauugauaucugugugugaguguuuccucaauggcauuaugcauuuauuuauucauucuucaugcauuuguugugugggaaagaauguuuuccagguugaggaaagacacgagacucgacagccagggauauauuagguaacggugaggagucuggugugauugaggcacagaaggaagugccaguguaaaguaacaugagaagaaaguacacacagauccugagcaccuuaaaugcuagccuaaggaauuuuaaguuuauacccaaagcaauagggagccacugaagauuuuuguauggagaagugacaguugucaguggcucauaguagauuggagugggcaccuuugcugaaguuagggaaccuguuuucagguccuuauuaugagacgugcuaguuaaaagaggaaaggaggggaggggguuggcaaaggcugcaguuaguuacauugagugaggucaaguaaaauguuuugaagcauuucuauggagaagucccagaucuucuuaccuuucaugacuuuguuagacucacucuucagugaaauaagacuggucuugauuuuuccaugcgucuugaguuaaagcguuacccuuugcuaccugggcucuacgauuucaccuguucucuggccacaccuuggaauucacuucuuugugcucuccaauauuugauuuccuucuugucuucuuuucuuuguuguuguuuuuuguuuuugauacaagagucucacucugucacccacgcuggagugcaguggugugauguuggcucauugcaaccuucgccucccggguucaagcgauuuuccugccucagccuccugaguggcugggauuacaggugugcgccaccacgcccggcuaauuuuuguauuuuuaguagagauggaauuucaccauguuggccaggcaggucuccaacuucuggccccaagccaucugcccaccucagccucccaaagugcugggauuacaggcagcauggccaccaugcccggcuuuccuucuugccuuuucuuaagaguccugcuucaaggaaacuuccgucuccuuuucaaaaacuauuucaguaacaaucccuugguguuuauuuaccauuuguagcuuaaacuuaaaacuuuuucccuguauuaguuauuuuucaaauauacuuuuugucucuucaacuaaauuuugagcucaggauucauaauuuauuugaagagguacaaacagaaagguucugucccauauuucuaaguaguaggauuuauuuuuccuucuauugaaaugaaaauauaaauggccuuugaggcuccaggagagcccacaaaauuuuauuuaguccaaaauaccguaaaacuucaguauuauuaauacuuaaagaugguuugccucaagcaagaaauaugaagcucuggggaacacauucugugugugugacacauccagacagugugguuugccaaaugguagcugauccagagugagguucuuaaccuucaucaagucagggacugcuuugaaaauccaaugcaagcuguagacugucuucccagaaaaaugcguauagcuaaauacaugaggaaaauucugcaguccuuagucuguguauguagcauguguguagguaugauauugguaaauccaaaagaaaaaaugcuuuuuaguuaccuuuuguagccauuaacguuaccugugcuaagugcucauuaggcauuugcuggcugauucuauucaugugagggccacagggaccaggagaggugagagcaaagaugcaugcacagaucagagaaggguuaaauggggaauuaugcagcauguaacuuauacauuuccugaaaaugaugcuucuguggacuuagacaaaaaugaguggccaggagaggauugccguuggauagaugaagucuagauuuauccagaguugguauuucuuguuaaagaaccucagugagcaguaaguucauaaaccuacuggggugcugguggagggggagaucuacuguuuauuuuaggauguuuucagcugcaacaaaagaaaacccugacucaaauggacuuaaacauagggaaaugucuuacauuacguuaccuauuccaaaaucucuggugguuuccuuccuccguguacugccuucauccuaggaaugauaaggaaauuccugcuuugguucugggcaucacauccaaacagaaaaaucaucaaagaggauaaguggucgucuacugaugugucucuuuccuuggaguagggagauauuuccaagaacccaguagaggcugcaccuuugugucuuagugcucauuuugaaaccaguaucuggccuggggaaggcaaggggugugauuggcuguaggacuuggggguuucccucuggaacuggaaaugaggucaccuguuccugauccacuaggaggagugguggcuaugugaacaaauagcaauuauaccaaaaacugcugcacguucuacuaagaaggaagaagagaaaaauagauauuggaccaacagaacuaacagugucauuguaucuucugauaaacucacauucugaauaaaaaaggaagucauguuuguauuuuuaaaauuuaucuaaaucuguuguuauuuucucuaccacaacacaugggguacagucauaugcuuaaguccaugugagugagcuuuuauaauagauguucuguccacacaaggacugguuuccaaggcccgcacucaguuuacuuaugggccccacugccaugcacaauuaagaaaaagacgagauuuuagcaacuuggacugaacuauagacuuugccuaaacucauuauuuacagcagcacuuuucuucauaggugaauuguuaauagguuugauuacuuauucuugccuuggagaauuuucagguauggcuuacaaagugauaugaauugucaucucucaaaugcaucuuuaauuuaaacauauucucuauguuucuggguagaggaagaggaaaaaagucuaugaaaaugaauuuaaaaugcuucucagagucaguauuaauuuaaaccguugcgguuuucuguggggcauauuuaacccaaaagaaaagcccuuauaauuaggaaauugggauucugaauaauuaauuugaaagaggaaauauaacuuuuucuacagagaacaucuuucauccaaauuuggaguuccaguuucugcagaugucacuucucucucauaacauaagaaaauagguaagaggcaguuuggaaagagguugaaaggagaaauuauagguucuccucccagcuuuuccaauaacuugccuugaggacuuggaccaagcccugacuuucucugauguauaaaguuguaaaggaagaugaaauacugugcacgaaagugcuuugaaaaauugaaagcaguaaacugcucuaggauauuuauuguuaguguggugguucugguuauuauaaaugaagcagaacuuuaaauauuaaugguacucuuguucaucaauggggaaguuauaggggaaagguuuuccaaaaaaugcugagcuauaacugccauccaaguaagugacgcagaaugccuaacccaauuuguaucuugcuaucaccugaucacagaaagcuguuucacuguagagguaacaguuguuuucuccucuguccugaggccaaugauuauauaauauguaucaaaucacuagggugcauaucaaagugagcauaaagaggcaaauauuucccuuuacaaugaccauauaagagauuauuucugucaggggauaaggcauacaugaagucugacuguuucacugcauuuuuacuauagaaaucacugagcuugagacuuguacauuaacuccaucuggucaugugacuggcaagugaaguguuucaauguguuaagaggacugaucugcauauuucuugcugaaucuuaaucuguacuugcauauuugugaaacgaaugaguauuuaaauuauggagaaaagauguauugugccaaacuaaccuuuauagcauaccugugguuguaguuucucuagcuaacaguggacaagaugaaaacucauuauacauuuucaucauguuagguauucuucucaaagucacaggagcacugcagaaugguucguaacuuuaugaauucagcuggcauuuuggauauauggacggccccuuugaggggcuaaagacacagccauccauuucaccaagagucgccgagggugccuuauugccccuaccccgugcuggguacugagggugggauagaaggcaaaccagacacaucccuuguguuuaugcagcuuuuucuucagugggcaagacauuacuugagaauccuaaaaauauaaaauuacgucuaugacaaguccaaugaaggagaaggacaagacacuugauugaggaggacauuuauugcuagucaggggggacaaggaaagcugacccaaggaaaugaugauucagcugaguugauagaggagugaaauagucauaguaggaaaguggaguggugggaguugggaggaaaguacuguauuugaagaaccacguguucaaguucugcagcagaagggccaaugaaguacuugaguguugucaaaggcaaucaagguaacuggaagagagaacacgagggcgugaggguauguuaucaggaugaccuugauguucacaauuaagaaaguugcucuaauccugacaucaauaggaagacugaaguaucugaaggagggaguuugcaugucuguucacaaagaccucuuaagcaauacacuguacacuauuaauaugccagugguucuuggggcgcugucuccaaccugugguugucucacuacuguauacucuacuccuuccccagugugugcuaucugugugauuugugugggaucacuacaucccugguggacuacugugacuggacuaaaacaaucaagguaauccuaucccucucaucacggugauuaauucgggucauccaggccuaagcaaauccaugcaugguauuuuuuggcuuuagggauuguuccaugauggucccaaucaggacaaaguucagcaggaauuuugcucuuuuauagacugaacuugcugccauugaaagucaaugaggaagcaaguagaucuggaauccuaugaccaugagagaagccugcuuuagggugaaguugacauggaagugucagaggugagggguacaaagaaccauuuuguccuugcuaauauaguagauccacuguaucucagauugcaccugauaccuguugaaguuuucaggcuuuucucaccccuaggcccuucuccaauccugaugcuagcuguugacaacagucauuauuaaauaaauaucagaaaccucaucugaauucaaggaaucucccagcucuuucuaaacccauacuugcucauuguaacuguagcucaggccaagauggaauagacuaccuuggugaggacagguguaugaagaaucacugauuuaaagauuguucauaacguaucgcagucauuaggcauaagucuauuucuugagacauuguaagggauuauucuuggaaggacauagguccaaaauguugaauuggacgucuaggagucagggugguaaaaaugaaguauauauugauuaaguggagaguuacaugaguagagaagcaaaaugaagccgaguagaaaauuaaagguuuugggaggaguacugccugaauuuagauguuuuuaaaguacagcuuucugucuucaugggaauaucuuuucgauauacugagaaaaagaaauccagguguucuucacuuuuguaagcauccugguuuuucgugcagggagcacagacaacaggauuucuugccaaucaguuaccauugugaggccugauuuuucaucuguaaaaugaggauaauacagucuaccugaguaauggcugugaaaguuaaaugaagcaauuugaguacaaauaccucacaaugaaugauuguuuucauugauguggugguaaauguuuaauaaccucuuuuucaaagaauaaaagccguuauuggucauuuuugccaauuuccaugguguaaauacuuccaacauugugccaguuccgaguuaccaguguguuacaaaauugaaauggaguuagagaaauacacauauaaugccggagagcucaccaggaugccacugcuuucuuuccuucuuuccaaauuacauacaucccagauuuuuuuuuuuuuuuuuuuuuuuuuugagauggagucuugcucuguugcccagguuggagugcaguggcacagucuuggcucacugcagccuccgccuuccauguucaagugauucuccugccucagccucccaaguagcuaggauuacaggugccugccaccacgcccagcaauuuuuuguauuuuuaguagagacagaguuuuaccauauugccuaggcuggucucaaacuccuggccucaagugauacacccuccucagccucccgaaguguugggauuacaggcgugagccacugcacccggcccauaagccaccacgccuggccuaugccagauuuuguacaaaguaaaaucaauccuugucccccaccacugugauacuaggguuuguuugauuuuagugacaucuguauuaggguugacacagaauuaauaacugaaucaauaaagagaccgggaacagggccacgccuuacacaaggugacaugaaaaauguugagguguagcaguuuauucccuuagguuaaucaugaaccuuucuguuaggccccuuugaaauuuaguaucacucuguccuaaaucaccaguaccuugcaaguguugauucuagcccauauaacucaccuuucucaaaaauucugcuauguuuguuuuaguaaccaaauacuguauuuuauuuucguaagauuuucuucccaaucuagauuauauauuucagagagaaagcguccuauuuuauguacauuuuguauccuuuuggugucaaauaucaugcuaugaccauaacaguaaguguaauacacauaauauccuccccccgcccccccgcuuuuuuuuuuuuuuuuuuuuggaguuccuacuguguuccagguuccaugguaacauuuuccuuguuaucuguaaucaucacaacaguacuggaggguaaauacggucauucccauuuuacagaugaggauacauucaaugugagauguuaaagauguucuucagaauuucccagguagcaggcagcucaugguauucaaaagguaaugguuaagagaaagaauggauaaugaauaucuugugucuauuuucuugagacagacgagacugagcagccugagaacauuuggugcucagagggaggaaaugcuaagaggggaaaacaagucugaaagggaaagaaggauaguucaaagaccaguuuccccugcuucagaauucugacuggugccagcucuaacugcguauguuugcuuuacuuggaagauagaaucauagugccagaauucacggaagucuguuuuggaagaugcauuagucaggguaugcuaauugcuggaacaaacaauccccaaacuucaguagcuuaacacugcagaggguuauuacccuccggugucacagagcaacgugggugggcucugguccuagccuggcuucuuccauggcucaggucugcuauccccuaggaccuuggaguucacuagauauuggcaucaggcugaucaaagaggaaaaggagaguggugcauagacgauuacaugggaaauuuuaagggccaggucuggacaaggcaaguauuacuucugcucacauuuuauuggccaaauccuagucauaugaucccaugacugcaaaggaagauggggaauuucagauuccuagguggucacgggcagaaagagauggggauuggugaaaacauagccuggcuuuagccacagaggguuacaccagaggccugcaaguuuggugaccacuaguuuucagagguauuggguauuugauaaaauccagugucuuccagagguugagcaugagccacauauaaauaacuuucccagugacgggccaucagcaguccaaugaagacauugggucuucaugucuucauuggacugcugauggccugucauuggggaaguuauuuaccuucucugaggagaaaauaauaacuugcauuucagagugguuugggacacuaaaggaaaucagaagauggaacugauuuguuaacuagaaauggacauaaguauugguuacagguuuaaaaugaaacuugcaauguuugaggaagaaagggaaaauguuaaugcaaaaacaaaaaagguaaagaaauggugggaaguagauuauuggcacuuuuucuuuggaaacccauugccauauuucauguaauuaaacuucauuccuuuuaaugaaacaauucuucuaaauaauacagagauuucccaccaauauaauauuuaacauuuauaauuuucaccuuaaaguuugaacauuuuuaauuuuaaaacuguuuguugcaguuuaaaucuccuuaugccacagaacuguggacuuucucugguugcaaaauucuuuacagugucuugaauugaaaagggcuuaaguaaaaaaagcugggggaagugggggccuuuuacaaacaaauuacaacucauuugguacaauaaggauaauucauuuugucuuguuuugcauggcuguauauuguuuugaauucauucugcauuucggaagcuugcaguauuucuuuucuguagguuucuuacuuguaacugcagauuucgcgguuucuuuuguguaccacuugccucccagaauuuggcccaacaguuuugaguagcugaacaauuuaucggggacagaucagcugaaauguggcucaacuugaguaaagcagaaggaaugacauaagguuaggugacugaugugugaguuuuugaauuugauuugguuuuacauggaaagguugaagcaaugauccauguauucuaauaaaaaucaucaguacaaaucaaauaaaaucuggcuuaguggcuauuuucccacuguaucacucauggcuagccugugcuguuacagaccacauuuggcaggcacggcuuuuuccuacaacaaaucuuaaaguaacauugcaaucuuugcuguguuaaaaaggcaucuuuucuaaucaaacugucugcuaaucucaucagauaaaucauuauucucuacugacagcuccggcuuucccggaaccccuucccugcuucuuguuuucucucaagaugucugguuaucgucauucuucaggucuuugccucuaucuccuuucacacuaaugacauaucuuccauuccugaggaagaguuacagcuuuuuaccauuccacuuacugaauugguaagaccaguaccucagagcagcucaucucuuucugaccgguauuccacuaguuaucagaugggcaaaaggcaggaugcauccaaguugcagaccuacuagaaccaaaaaugccuauucccaggaauuugaugugauuaaaccuaagaaaucaucaguugaugcguucucaucucuuucagcuggacuaguaaaguaaggcagauguauuuucacuacuucaguagugaacauguuuuauagaaccugaaagugaaaguaagggaagcagcaugguuuagaggaaaccuugguccauuuuuccgucauagaccuguccugcuagcaaaguccugggcguuucuuaaacugauggcaacugcgugugcccugguggugaaaugguguugcaguaugccugggcacugcccugugaaaaaggacacacagaggggagacucacaguuuuguuuucauugcugacaugguuuaaaaauguacguugcuagcugugaaaacucagucauuauaacaccguacaccuuucuucuuucagcaaguauuccuugugaacauuagcaaguauucuauucucuguuagaauuaaacagguaaucguaauagcaugaaagggugaaaguaugucuuaugcaaaauagccucuuuuauauagggcaucuaccaauuuucuugugauuuuuguuuuuuccucuuuugaaaaaugauuuuagucugcucguguuuagguagguaacuucucuugaucccaauuuuauacuuuaaaugaucccagauauugcauuuuaaaugagaugaguauauaaaaaauaggaagcagaaagcauaauuaaaaauugugguuacauuaucgugagaccaaaugaccagucagacuccucugaccaauuucauagaaaauaaggagguaucauuugaacaaguuguaacauaugggaacuguuuuaaacaccaucauugauaucaagaaacuauuaggaaaugcaaguuuguguaucguguguguguguaugcugauuuuacacacacaggcacaugcacacacaugcacacacacauuuauaagcccaaguaagagaaaccuuugccaaugucugccaggcauuuggcugaaguggaauugugaggaacauuuucucagccuuuauaaaucacaguugaaauaugucagcacuguucaguuuauaaaaugacaagggcuguaggcugggcaugguggcucacgccuauaaucccagcauuuugggaggcugaggugggaggauugccugagcccaggagucggagaucaaccugagcaacauagugagacccugucucuacaaaaaauucacugggugugguggugugugccuguggucccagcuacucaggagggugaggugggaggauugcuugagucugggagguugagguugcagcgagcccugaucgcaccacugcacuacauauacccuagaugaagagcaggaccccaucucaaaaaaaaacaaaaacaaaaaacaaaaaacaaaaaaacaacgagggcuucaucuaaagguuaaagggacuguuucuaccuuauauugauuauaacaaguuaacucacucaauauuguaugguaugcuuaugcuguauugaauggcaaaguuccucucacagucuuuuuuggggucacccuucacucuucacuuugugagguggcuaguucauuuguauaccugcucucuaaaugugggaauauauucuuuuaaaaguggcaacucaacuuaucucccccuucuaaaauauuuuagauguuuccaauuuuuuuuuuuguacgucagcccauggaaaccacacuaaauuuuucugugucaugaguaugcuugucucugcauuugaauuuaauugggaagugccucugaaauggcaggucuccuuuuuacacagugguuuacagaauguggugggaggaggcaccaaauagccuguuaggauagcauggcuccaaaacugauucuuuaacuugccuuuauacauugcauuaauucacaaguggaucaguccaucuugucuucaucuuggccaaauuccuucaaaauuaauaguaaaauaugccuaaauauauucuuguuccugcccuccccacucccaccuaggucacagggcuacaacuaaucauugucuccauugaaaugucacuagaugaucaacgauugaagaauauuucuuaccaauucaaauagaacagaaacuucagucaaguuuagcauuuauugcccuacauuucugcggcugucaaaaccaguugaucagagacgugaagauauguaaggaaauaggaagcugugauggguuaucgcuugucuaagagugguacaagugagacuugagggcauuaucacuuuuuaccuuauacauuuuuguauuuuaauuuuuuucaauaagcacauacuuaaaaauuaguuugaauguucuuaacgaaucuuuccauagguuacugauuaguucaacagggacaaauuauaaucauacauugcagaauuugcaugccacuuugaccaggugaucaaaauuggcauagcacaugaggggcagaccaacaugccaucaaggggcucuggaagugauguccugggaaggacaccagaccacuauuguaguauuauauccacuggaauauaaucaugaggaagcaucugauccucccaaauugagaaacauuuccauaaaauaacuggccuguauucuuccaaaauucuaauaucacagaaggaaaaggcugaggaauuaugucugauucaaauggauaaaagagauagacaauucagugcagugcaugauccuggacuuugucuucuaccggagagggaggaaguucccuauuggaauauggauuauggauuggaucuaaguacccacaguauauuuucugauuuugauaauaguacuguuuuuguucuuaggaagugcacacagaaguacuaaggugcaaaaggauauaauugaugcaacuuacacaugguucagaagcaacauauuauauaauuauaacugcacuguaauugaaaacuuuuaaaauuagccugguguggcagucccagcuacuugggaggcugaauugggaggaucuccuaagccuaggagguugcggcuguggugagcuguguuugugccacuggacuccagccugugugacagaacgagacccugucucaaaaacaaacaaacaaaacaaacaaaaaccccaaaacuuaaaaaaaauaaaaauguaaaauaugggaagaaugaaaaaauuauacauuuuccuugacuucaacccuugaucuuuucuugaucaguucccaggugggguuaggauaucuguguuuuuuaugagguuccuuggaguauuuggguggucagccaccauuuggagaucaccauguagugccuagauuauaaauuauccuuuuagaaagaguugcuggaaucauuucaagauuggucagguaccaauaaauaaguaauagaaacacccucaaaauuggaauugaaagaguggaaauuuauuuuauuuaguuuggggauaugaacaugguauaauauugucgcauuuuuucuggaguuuagaugaauaagagcagccuacaguugaccggaugacuuaauauuuuuuucguaccacaaaaauuaaaugcuuuacuaaaacuuucauucucuuacaauucugaugaacaagguuguacuguaugguuaaguaucacacuguaaauuuaggcaauacauguccuauugagcccauggaguaaaauagauuuucccgugauccaagcuauuacaauuucagauguguaaaguauuucaaauucauuuuaauagacugcuucccuucaaauacauguggagguagauuuauacaacuguaaacaguuuaugcauuuuuacagauuuucauuauauguguuugauacuaauuuaccucuuuuuaauuguaggagagauaaagaauuaguaguuuaaaacaguaggaacugcguguucugcugugaucaaggaauuagauaaucuggcuuguuugcuuaaggggucuguaucuugagacuuuuauagggcaguauuaaagcucugagccuccuuauuaugccaguacccagaagauugcuuuaaugagaaguaaagggccuuuuuccaauuacaagggaauaacugcauuaaguuccuguguuaugucaaccugcuuugauuugauuacuaugaaagaaauggauuuaucugucaguguuacuuaauuaagccuucucauugauguuuugcagaguaauauagugugguuugcacauuugagccuaaguacagagaaaauuggccuaaaacuaagacaugaccccugaagauaacaugcaagauugaucauuugucauugccaggucauaggcugcaguguuaaacauagguggaaggauugccauguugaaaggguaaaaugaaaaucaguuuaugggagugaguauuuuaagcaaaagggguugugguggaaaacuggauuuuagggaggaguuuugaauauguaaaacuauugacuucaccaauauuagucaagcaucuggaauaggaaaugacaauaaaacaaacaggagaaguagauuuuguuaaaguauaaaaggaaauagaagaaaaaggagaaagcaagaggaaagaaugccguuugggagaaguagaccauugugguuaggcagagcaauuacagccuacagauauuucaauuaagccagccuccccuucucagaaccucacaaauggcacccucgggagaaaagagguaucaggaaagaaaagaagaaaagaggaaacaguuccauguuucauguuggcuaaccucucccaagaauaaauucaauaaauuauuuaccaaauaggcauuuuaaauaccaguuuguauaucugaagucauuacaauauuauggauuuugcacuauaaauauuacauguaugguuugaaaaauacacacguaauuacauguagacauuaucagagguauauauucaguuuuauuaggaaaugaagcauauucuuaaauguauuccuuaguuguuuaacacuuuguuuucuaaaguaucuaccuuuuauuucuugcacucugugauauaucuuuagaaggugauaugucuuuaggaggugccaaacaccuacuuaaaaacuuccuugcaauauuuucacauuuauuuaaguacuuugaaacuuaucuguguaauguugaaguuagaugguacuuugauuuuuuuuucaaagucuucagauaugguaacuuacuuccaauuguuauucucacgcaauucacaauguuuacucuccaagaaaacugucuuaguuaagacugauuuuuaagugcuuuuagauuggucacauuucgaaaagucaaagaagguauauauaguucacguuauacucuugcuugaguuauucauggcucuuauuuguaggauauugcuuuaaaagguaggauccccaaacgacuaacuucucuucaagaggaagaccccagcuagccagucccauacacuugaaagguugcuaaauggcacucaucucucagcauuucacauuauauauucaagcuaggguauaauucaaguuagaugaucguugacaccuccaaauauauaaauuaauauaaaggcuucaauguacguuugguucaguugcauaauguaacuguuuaccaccuugagcuucaaaaagauuucugaguuucaauauaaggaacaccacugacauauuuguaacauaacaguuacccacuucauuuuguuacuuucucauuaucugaauuuuauguuauaggaagaugcuuucccuguuuaugacagcacacaauggaauuaacuccauaucuuaagcagcagaaauguaguguucauuuuugaaaaacagguuauuuugaacuuaaggaaaauaauacuguuuuaaaggacuuauuaauggaaguuuaaguuggauguuaauuaaggcuaaaauauugcaguaauugucugcgaacacuuuuuuccuacuauacuuucucaccagcauaucuacccuuuaacuuuucuuaucauaugaaaaauacucuaagaugaucucaugcuugaccuuugaguuucagauuuauuugguuaggaaauccauuagcucugagaaagccaggguugacagcagucaucugaaaauggaaagcccaggucuguauucuuuauauuugacuuaucuuuuuuuuuuuuuuuugagacagagucuugcucagucaccgaggcuggagugcaguggcacaaucuuggaucacugcagccuccaucuucuggguucaugugauucuagugccucagccucuugaguagcugggacuacaagugugcaccaccaugcccagcuaauuuuuguguuuuuaguagagauggguuuuaccauguugcccaggcugaucucgaacucuuggccucacuuuuucuagucugauaguuuugauugcuguccacauaagcaaaguagagcuuugaguaaucaaaucauaauccaccugccucggcuucccaaagugcugggauuauaggcgugagccaucgcaccuggccugacacaucuuaacauuugugugggaagcauugacacaacccucauccuuugcuuagucagauuugggaagugcuggaagcuucuugucgaguuucuuguuagugcccagaucacucauucugaagcaccauuucuuaugucuaauagaaaacagaaacaaucaugcuuguguggacaucaucugucaauauuugaaucuccucaacucuuccuaugucuguaauaguacucaaauuugacuucaaauuacucuacuuagagcucuuauuauacugggugcuaaugaaaaugugcacauccuuaacacgcucuuugcugaugaaauauuuugaacucuaaauucaucuggcacugacggagagcauaugccaucucaguuugugugagggcucagccaaggguucuuccuggacuaggaaauuaguaggagccacagauguacgcagucugugagucuccauaaugguguagaggauauuuaauagugucuguuguugcaggaagaagguuuugaggcaguguagacuucauuguguuucagaaugauuaucuuuccuggaagaacuugacauccuaucucugaacgcauucugaauguguugaaauuuuuauuaagaaaucaauauauuuccacaagagcaggaaucuguagacuuagagcaaugcaaaauaccauuucaggcauuuuucuaauuucauaaaacucuaggguccugggugauuggcauguuguaggcucagaguauagaaaggacaacuacacagcucuacgucaaaucaaucuagguaacuuucauacuuguuuauuucaaaucaagcugaaaguuacaugguauuuagucuguguucuuagcuugggacucugaucagcauacauaacuucugacaacaugucauuuguguauuacacauagaaguacacugagauauaaagagaauacucuaaugguaaacuaagccacugaauaaaucuaaugcuuacugaauucuuacucugauaguguuauacagggucacggagaagguaggauuguuuaaccuaaacguuuuggguguuucuaagauccaggagaguauuuaaaaaucacugaccuguuuagcagaacaaggagucauaaaaauguaaggcucagauuuucuuagauauuggaggguauuauuaaauuaggcacucaugauaaauacuggugacuaugguagauauuuacuacggaucaaguacuuuccuaaguguuuaacaaauguuaguuaauucauuuacuuuaacaauaacuccuuaaucuugcaaauacuaucauccccuuaucuucuguuagaauacugacuuugggguaugucuuggguuuucacuucuguucuccuugacucaagaggccauuacauuuucaaggcugacagauguccccagggcaaaaaauguguuuucuucuucccuggguuccagccuucacuuugauuuuggcucccugauuccuuguuaucuugucugcucaguauuuuaaaauuuuucaaaaaacuguuauccaucauuuuuaguuuucugugggagaguuguccaaauauacuagccugcccuauuuccaagaauggaaaucaaacuugcuuauuucguaguucacaaaaaugaguacggagaggccagugacuugcucagaccagagaacuggucacugcagagucccugcugaaauccagcucuuuaucccaacucccagugcuguguuuucuaaaguuugucuagucugucugauaguuuugaucuugcugaccacaagagcaaaguggagcuuugaguaaucggauuacaaguguaaugaauguggaugggaaaucgcagaagguaagaauuaugucugaacaucuuuccccuaaauagaguguuuggucauaguucugcccaaacuguuguguuuuggcacugaucugucaaauacuuuauuuauuauuuuuuuuuuugagacagucucgcucugucacccaggcuggaguacaguggcucgaucuuggcucgcggcaaccuccaccuccuggguucaagcaguucuccugccucagccuccugaguagcugggauuacaggcguccaccaccaggcccagcuaauuuuuguauguucaguagagauggggucucaccauuuuggccaggcuggcuucaaacuccugaccucagcugaucugcccgccucggcaucucaaagugcugggauuacaggcaugagccauugcacccgaccaaugugucagacacuguagaggggacucaugcagaaugaaucaaauaagaugaaaauuuguggauuuucagauugccuccuaaagcagccagcaaucccauggaagaguuacuaaaucuaucuugguuuaggguaaaauaagaaauuagaaaaaucuugaacugagcccauuucagucuuuuggaacaggaauuucuaucaucuacuugcuuucuuccuuucuuuuugcccgggguaauaucuuucucuuuauucucccaucuuggaaaaaggguggcaauagaacaaggggggggggggcgagaacuaaauagauucagcagcuucaucccaggcaguuuuucauuugucacuauguugccuuaauggauuucacacaucuauuuccuguauauuguuuagucucaccucuagauguaaacacuucucauaccacaauauuaucuuacuuuucacuuucugcuguuuuaacucauuucaauaaagaacuaaugagcccaccauuguacaguaccacacaagauguuauuugugucaaguauguuucuuuccuauaauaaacguacaucacaguuggguaugauauaaguauauagcucuauagcuguauauauauucacaugguuauuuggauaauaaauucuguguacuugcugaacuaucguauugagccagccauacaaguuuuaucauugugccuacuguugauacuaugggcugcuaugggauauucuguccucuguguugggagcucacagauauuuucugucuggcuuaauaccaggauuagguaugcuucuccuggacacuuuguguguuuuuaucugaugguuauugucaaucuuguuucccucucugcuuugucuacuuaauagcuucuaaaguuuugacccacuucuagcaaauagccaguccuucacugugugcauuuugauaaacucaucauaccucuggccuuacuguucugcuacuuuuauuuugcagucacuuggguccuucaaauauugauuucguauauuuuguguuguauguguuucuguaaucuuuuguggacacaagaguuggguauaaacucccaaauaaauauauucacucugcguggggagaagugacaggagggaacguucagcugguuagacagagaugugacauucuuacuggggagucuuuacagcagugggcagagcuucagccuccuuuuguguccaagcucugccauuuccugaucccuugggcaaguuuucuaacccaucugagccucaguucagauauauaaaaccagaauacuaguaaggcauuugagaguuuagcgcagugucugacauacauucaagcucaccacaugugagcuguuacucuuucuuugagaggugaggaacaguuuaggcagaaggaauagcaguuacaaaaacauggugguauaaaagaccgugcaguguccugguacccuagcaggaguaaggaauggccagguguaggcccugugcaagguuuacaugaaaaugagucuggacaagaacuucuuggaugcucaugugauggagguguauagugaaugcugcugaaaccagcaacccagacagcaauuuuaagauauggagugagagaggcugcuguuggugguguggggcaugcauuugucuuguguuacaguggaguaguccugugguucucaaacuccugugugcauaaaaguuaccuggggaccuguuaaaaacaguuuucucagccccacccccagaguuucagacugaguagauaugagacggacccuaauaagccaauuuaaaaaugggcauacaggugauucagguggcggauacacuuugaaaugcacuugguggugcacuggaauaguuauugaggaaaugcuaacuaaggggcaggccugacaaaguucaaggagagggaagauggaagaaaaugacuucaaaguaacauguuuacauucauuaugaauuaccauugcgcaugcuauggaaacacuaguuuauagugucuucuauggauauggauaaaugagcaccgguccuauagauuuuuuucaaagguaaaauauaauuagaauucauaugauuauucuauuuauuagguuugggagagcuagugauuuguccucauccuugagauccagcaggagaccaagggaaggggaagccuguucaacagagagcaaucaaagaaagaaaggugcagcagcgugaggucaggaagugggaaagauggaaaugggaaaggguggaaaaagagcagucagauccgauuggucaggaaucuauuugugaaggaacccagccaguauuuaaccugcuuugaaaaagcuagacuuccagcauuuuuaauuaguggauugcucgcuuuugaaauugcccaguugggaauacucaaguguugauguguuuuaucugccugcuaauuagcaggcugcuugguugaccauuacuuuuccuuuuuucuguggacagaagauguauaugaaggucucuugguacauuccagcucaagucuagcuuaaagugcauaagaaaaacuguguauuuaauaagaguucuuacuaaauuauaaaucaaauuuuaauacaucuuuucuccaacuugauuccuuuugcucuagcacagggcuucucaaucucaacacaauuuuuauuuggggucagaacaccaaaaauauauauauauauuuuuagggacagggucucacucaguugccuagguuggagugcaguggcacaaucguaguucacuguaaccuugaacuccugggcucaagggaucuuccugccucggccccuccaauuagcuaggacuacaggcaaguuccaccacacuuggcuaauuuuaaaaauuuuuguagcgacagaaucuugccguguuucccaggcuggucucaaacuccuggccucaagcaauccuucugcuucagccucccaacgugcugguaucacaggugugagcugcugugcccugcacaggguauuucuuacuguggagagcuguuuugugcaauuaugagauauuuaauagcaacucuuggccucugugugaucaaugccacuagcaacacccaaauugugacaaccaaaacugucuccuggguggcuuugccaaauguccuuugggaugcaaaagccccacugaccuggcaguagcguccucuuuccuccaagucucugccuacuuuucauguuuaaaauccucuuuuaaaauugaaaagauaaaaugaguccaaacaauuugaaaucuuaugguacuuauagggauucaaaucuguuccuccauuacuuuuuggccaaauucaagaggagaaaucucucaaaugaauccaagcuggcuguuauaggugaaaagaaagucaagaugcgccagacuuuuaaaagcuugcagugguugagagauuuuguuauuuauacacuuuuuauuuuggcugaaaauauuugguuuuuguuuaagaauuaagagaaccguguaggcuacaaaauuuauuuaugugcgaaucccagaggguuguaaguagcuucuuugugugcuucaguucaacauauacaggauaggccagcauguuggauuguuaaacagcagaucuggggaagguuuuacaccuuuucucuaggcuuggugcagucccgagagcuuucuugacaugccuugaagcucacagugcacugauuuaaacuguccauaggggacaucuguuugcaguuuguguuaucugcugaagcaccaacuaaaaggaagugaaauaauauuugucauuaaaaaaaaaaagagaaguuaauuuaaugguaauaacuuaguuguuguugcuuuucuaucucuuaagauauucugaaacaccauguacucuacuguaucccaaaauaaauaaauuaauuauacuaugauuacuucugcugauaauaaaauagcaguaauaauaaaaggaaugacaguagagcauuaagagaauaaacaguaucacugaaaugugaggaaacacaauaaaugggauugugucuccugaaccuuaguuucacacuuccuccuccacuucugucagaggguguuugugauggccgucuguuaucagccgugaucaaaauaauauaacagugaaacuuuuuauacuuaugaaggcccuuucaucaaaaaucucacagccauuucuaaauauagagcaacugaucuuuaaaacacuuuuauguuuuaagcaauuaauaugguaacuuagcuguuagacuuuccauccugcguauuugccauuuggagcguggauggaacauuucguaaucuacucagcauuaaaacuuugcugguauugaguuuagaauuccaacuuuucgaugguucauguaggucuuuucacugucaucuaucaaaacaaaacauugcuuuauaauggaauaaccacauucauuuccacauaucaaaacccagauuaaggauuauagaccaaaugguaugucuaguuuaaaaaaaaaaggaaagacagagacaguauugucuuaaccuaaaaaaaaguuuuguuucaguccuaauaucccuguaaugugcugguggaaauagacuacugaauacuuucucagucucauuuucuguugcaugucuggugucuucugugauaagccugggcuauggaacaaaaaggauccaagagcauuauggcgaggaugcuaaagguguuaguguggauauuuaccuuaauuuaacuuuuuuugcauuaaaguuauguuagugcauuuuuaaacuuauuuuauccaaaagauuguaauaaaacuuuaaguacaguuucacaucuauaaagacugaggcuaucaaacacugugaaggauggaaguaauuuuuauguuuauaccucugguuccugaggguccaguucauuucuacugugaauuuaaaugaguuaauuuaaguagaugggucagaagccacuaucaucaugguagcccggugccugguucuuaauuaaaggcaacaggagauuaauuugaaacauuaauuugaaagugcauauacaaaaagaaaaaauuacugcaagaaagccuaaagaacuuuucucuugucccuagauguagaagacagaaguagcucaggguccugggggaauggaggacauccaagcccguccaggguaaguauaucuaaucuuuucucccacaaccagacaucccacauauguaaauugacaaacagaagguguguuucucucucucucucucucucucucucacacacacacacacacacacacacacacagaggcaugggcaugcacacgcacacaaacacacacgcauauaugugcauacuaaguuuaaugaggaucagcuugacuuuggaauuuuuuucccccauucucuuauuggaugcuguuauucaauuugacaccuguuccacuucugcuaaccagaagaaaauuccuucguuacauguuuggucuuucuuuugucaguuauugauccauauuacauaaugcuguuuguuguagauggaaaaacuuaaaaaaauuccuaauaucccuauaagguauuggugugaauagacuacugaauaaucccaaagauacacuaugaaguucuauccuaccaguauaaucuacguacugaaucugaguugauuucgcuauguagacauguuaucauuccaccaguagggacuuugaucacuagauggaucauucauuuauuugcccucaacuuuuugcuauucuucuccacaguuuuccuacaugcauugguuguuucuuggggaagacccaaggaauauaauguaauaggaauguaauaggaagaccauggaauaagaguugggugggugguuaagcaauacguguuucuuguauguauaugaucuugggcaugucauuucaccucuuggguccucauuuucuuauuuugcaaaaugaggaaguagauccagaggaucaucuguguuucuuccaguuuaaauauucaugauuuuguaugaaauuucuuuaacugaaucauugcuaggcccucuaaaauccaugucaguuuuuaugauguacauacaaugccccagauuaaaaguacacuucguguacaugguaaaaccagcaugucuuccuuucccaaccagcuauauauauauagaugaagcauucugcagggaggguaacauuuuacuguaaguguucacacaaauuuggguugggggaagguuccauuuuggcauaagaggcagggaagguaaucaagcugucaaaaugagggcauuucagcaagucagagcuagacauuuccaccuguccuuggcauugugauccuuagucuaguguucaggguacagcaggaucucuaagcuuaccaguaacuuugugagcccuuacaccagcugucgagcuugacauucuaaugcuuuauauggauggguugaggaaaucuuuccuccuccucauguuacagucugcacuugcagaaauaaauccauuccccuugacagcaaguggagaucauagaacuccccucaauuguuuaguucauccagauuuucacaauuucuuaugauuuauccauucaguacacaugguacuuuuaauuguguuucagaaaacaaggucuguuuagaaucaucuuaauuuaggauuaaaacuaacuagcuuuugguuuuuguuagcuguccugccauuuuucucaaggaauauauuggugaauaauuucaaaccaauuuuguguaauuuauauuuucuaaauccagaaguuugcaugagacaaaucauuuguggcagauuuauacccaggcguacuuucaaggucucucuuuuuucaucuuaacauggggauagugucuaccuuacagcacugugcugaggauuaaauuagauaauauauauuaagcuuuuaguacacuaucuaggaugaggacacuuaauaagugauaauuagcauuaugcaaugccugguauagagugagugaguguacuaugauggguauuuaaaauguagccucuuuuuauagauggacauguuggcagaauuagauuacaguaucaggcaaguuaauuguuauacacgaggaaaggugauugagaacgggguaguuuuccuuaagguugaggggaugugucuuuuccuuguucaugcagcagcccucucuuuugugugggcagauuuugcccuuuggcucacaugcaaccgauaccucugaguaaauuugacuuagacuuucaugggcaguuccaccagcugagcagaaugacuuuuuccccccuuuuuggucacuuuaugcacuuuaguagacugaaaguugaaccauguaguauagaugauuuuaacucuuuccuauugcguuaucaaauuuccccauuaaaauuaaguaacuggacagcuuaagaacauuguuuuaauuuuaaauuccccuuaaaacaauaagcugauuguaauaaugaaauauuucugucaaaauuugucugccuuacaacugguuguuuuuugugacaugcuuuguccaacuccagaaaugcuaauuuaugcuaauguuuugauguucauauccuaguuaaacccuaauauucuuaacuuucuuauguguuaauuacuuaugugacaaucuaguucucuuacaaccacaauaccacaauaguaacuauaauaaaacauugaaacuucaguauccuaacaccaaauguuauuguuugaauggcucuaucuuggucuuugaaaagcaauucauugcaugcuaugccuaauuuucccuuguggcacaauuuugcuuuaauguggccuuauuaaaauaauaauuuuuaacauaagcaauauacuuuguaugugucuggugucuuacauacacuauuuuauuuaaucaugucaacaacuccaugcaguugauaccauuauuauuauuccuaagauuucucagcuauuaugaggaaaauuuggacuucguagacucuagagcuuucuuuuagccacuauaccugugaaagugcagauuccuucuagugaaguuccagggagggaauaguggacuccaauuucuuuggaggggagaaguuuugguaguggagcuauguuuguuuaugugcuguuuauuaauauaaaauaauaacuuacacugucauuuuauuuacagaacuauggagaugggacucccuaugaccacaugaccagcagggaccuugggucacaugacaaucucucuccaccuuuugucaauuccagaauacaaaguaagacccauuuuaaauuaacuuacacuuuuugaaugcucaaguuuuacuauagaagguaaaaccauguccuagacagagguucugcuuuuagaaacuuggauauuuagucaguucacuuguaauaaucuuaaauugcagagaggauuggcagucuguguuugguaauagugcauuaaggauuaaguuuuacaagcauauggaaugaaaugcuuuuagugauacugaaucuauguggaaauuuuguuuuccuuagaccuaaagcacggaccacaguuucaauguuguaucaguaguuuccuaaguuaagguagaugaagucaaaguggugaauauuuagaauaaaaauaucacugggcuuguugguuggcagugauauauagucaguguuaacugugauuucugcuaaagggguuaugaaaauaaaugguguuaaugggcuuagugugcuuaaaucagaguagugcauucaaguugaauuguaaaaucugauuguauauuuaucaaggcaugaacuuuagugcuaauggccuaggcagaccccauccugcuuuauuaaagcaaguuaccuguuaguuugaggcugucugugaaucuccggcaugccauucauccuggcauccucagcauguuuuucugcuuuuggcuacccuguagggauguuuguuuaacagcaguaacuugagcaaugaaaagaugauuccuaauggcuuaaaaggucccaauagcuggcuacuuuaguuuugauugaaaaaaaaaaagaucuuuguucuaguaaacaugaguucuuaacaauauuaguaaaucucucaaccuggccaaauucucuugagaaucugucaauaagugaaguuaaauuucuugguacaaucuguuggacaacacuccaaggaaacacacacagcgaugauuauauuuuucugagaccauaacugcaaaugcuucuaaagaaugucaugauuuuaagcuuuggaagcuauaccaguuacuucagguccuugaaucucaggcauucuuugaaaaaucaccaucaaauccaucuaaauggauuucagauauuuaacacaaaauagucaaagcagauaaauacuagcaacuuauuuuuaauggguaacaucauauguucgugccuuugaguaucuuaccaacuuugagaaccacaaaguugguuuuggucauagaauguucuuauuuuugugcuauuuuugccuucaaaguaguaaauuucauauuuacguuuuaacauuguaacucaagcaggaaucccaguucuuuaucaguuguugauagaaaggugcauuguuucuuguucucaggauauguagauacaggugaccagauauauuuaucaacuuagauuuuaaaaggcagcuuuugacucuucagugucaauaguuaugauuuuauuucuaacacccuugcuucucuauucaucuccacacaaccacuuagaauaaaagauucacuugaaaauguagucuugagaaguagcaccuaaauaauauacuaacuuccuuggauccuaaaaugauccuccaaugagcuacaguaagaaaaauagaauaaauaaauacucauagggagacgcuuauguuaucuaugugaaaaaaguuuuaacucuaaagaacaacuugauaaauuaauauuacagaauacaccaagcaguacaaacagauuaaaugauuguucuguucauguuuccucaugggcaacugcuuuacaaaucaaauuaguuuuucaacccaaauaguauuuaaaauauaaguggccugacagucuagagcggagagagcugauucuuuucacuuaguuguuguuuaggcugcaaauccaugucagcuuugcucuuuuauccugucugcccuccuucccauuaaacucuuaaauauggagaccaagacagucuccugcauugugauaggaaaugcuacuauguccacgaggcccccacccacuguucccagugaaaggacuucucuguuagauaagcugucugguuugaaacauggcucuuuauuguuuacaaacugcuacauuuuccaccucgagcagauuuuugcacagaaaagaauugugcuugggcuaaaugguuuaucugacauuaacggcgcagugucagacuggggucagggaagucacccucagagcgagaggguauugcgcgguaugcaaaaaaaauggaaaagggagaaaaagacauugaaacaaguaugaaauaccuuacauuuuuaguuuagagaagaauaauuuuuuuaagagaauugacucuuaugcugcauuaaaaacuucccaucgcuauaauuucucacacacccgaugccuucuugauuggcuugcguaucugaaggcuagauucggggaacaaagauucucauugauuuugcccaagcugcuguuuauuuaaaaugaaaccacuuuucagaugagccauauuugguguuauguuacagcuuuacaaagaaaagauagaucauuuucaagaaauuaacgacaauuaauuuacaaaugauaauaaaaacaaaguaagaucuauugguguaggggacaguuugaacucauagcauauaugcuguguucuaaaccgcacuuuguguccagacccagagcccauguugugaccuuuguggauauuuuccuucuaccaaaagaagguaguagacuuuagcauaaguguuugacaacacuccagucuccacuuucagaauguuuaacugguuuuuguuaaaacuacaaaguauuuguuucugucucaaaggcuuaauucugcugugaugucgcaucaggguaaaagcuauagcaucagaaauaaaucagccacuuuauuggagcagauucucuauugucaaaucaaucaagccugugacugaauuaggcgucugcuacagaaauaagugacacuaauuuuauaggaaagaguuauuaacugcagaugaccugauuuuuuuuuuuccuuuuuuuggugaacuguucauuuaguaagguuuuauuuuauugcaaagaaagaaaaaaguacuggacuacucuuuccuuuugagaguggauuaucauuaauuauguauuuuguucuuuauggcaguauacaauuuuagggaaaugauaacaggcauugcuaguauauuuguuuauaaccucuaugguaaugaaacccauuauuacaacucugaacuucuugauuucacaugaaugguuuugcauuuuacagauuuuuaaacauaauacuucuauuuggcacugaaauuccaaaacuuaguucauuugugucucuauuucacauuuaugcaaagugggauauaaauuauaagaguaauaaaguguuuuagccuaggcaacauggugaaaccucaucucuaccaaaaauacaaaaacuuagccaggcgugguggcacacuucuguggucccaacuacuugggaggccaaggagggaggaucucuugagcucagggggcggagguugcagugggcugacaucaugccauugcaccccaaccugggcaauaagugagaucccaucucaaaaaaaaguaauaaaauguuuguuuuaauuuauucuuuuagaaauaaucuuguguguguggaaaaaugcacuauuugauaguuugugaaucccuaaaguaaauaaaacacccaugugugguuauacaugcaugcacacacauguacacccauacacacaauguauguaucaugcuagaagacuuaaugacguuucuugguuuauaagauuguucuguauuccugucugugguuauaguugucauacaggguuuuagugguugauacuuguaaguguuuuaaagaagaaccuaacuaacagaaacaaaaagcaagcuccuaaauuuuuuuuaaauaggugugaauagccuuuguguuuguuuugauguuggcaggguugagagaugucaguacugacugccuacauugaccaauucauauacuuuuaccugacauuuacuaagaacucacucguugcuuucauuguguagauacaugccagguugcauuuugccuuaguugaaauuccaugcauuguuuuauaucuggagaaaauaaaucauuucuuccuugugacugccuaucauuauuaaugauuauaauguacacuggaccuauuggagacuucuucauugcaguuuuuaaacaauuugaugaaaccuuccuaggugguccauuggauaccuuucagaguaugcuaaugguagaaagggucgaugagucuaauuccucuguuuuuuuaagaggguuauuuauaugcuauggaauaguuugagaauccuggcaagaaguguauggaaagaauauggacauuaaaaaaaacuuuuuuuuccuuugucaagcacuaaacuuuugcagguaauuguccagauauuuuuacaaugguagacaauauauuuucuagcuaaaacuguuugcuccaaggaaggagcuaagcauuccauuuuccuuuuauuauuccagagcaucgauugaaagcuagauugaggauaagugagcaaguugccccauaaaauuacauacaugcauuugugacugaagggugugaaaagcgauacuuuuguacauuuggcuacagcuuaguucagcaucggggcuaugcuuucacauggcccauuuugaaugguucaguuuccuuacugugguauuugguucuaguccuacucaugguacucucccagagcauuaaauaauuuaccgccauaggguagcuggguucuaaccuagcucagcagaacauuuuucugcuggauuagauugagguuucaggcagaacugaagaaagcugcuggcuuacaggaugaccuuugaaucucaucuggguuagcgguugauauuuugauuugguuacuguggucauauugugacagcugcuagcucauuauaauucgguuccaccgcuccguuugccuagcaggaauauuuagguuuguauuacuucagaguguuuauggcuacccugaguuuagcccagcauaaaggugaaguguugugaguguuuucaaaucccaguggcagaagcaggugccacagucuucuuguaaaacagcaaaugugaguacaugcuaauacagggaguuuuacucuucauuguaaaacagagaauaaccaaugaaucagcuuuuacuaggaaaaguguuuuuggaagccuuaauguacaaaggaaaagcaugacuacaaagaaacauaauuuuucaaagcacgaaugagauguuaccugacuucaugguuagauauuuuguucuuugcagaagugugaguauuagaaaauaguaaaaccuguacaauaauggcaaucauuugauguuugaaaguuccaaaggucaaauaaucuuuaguaacuucauaagaacggaacugugaauauagaugucagcucuagaaauuuuaguucacuuuuuaaaugcagcgaaauuagguagugauacaagcaggccccuuugcuaguucauuaguuagggacaucuuggugugcuucuuuuuuuuuuuuuuuuuuccaauaacaccuuucagcuugauguuaucucgacaucaacucuuaaguguuggacuuauaauguggcacaaguaauuucugagaaaggaaauuauuaauuguggucuuauuugauuuuacuuugggaauuuucauuucuuuaauguuaaauuuaaaaugcccuccugaaauauuaacaaguaugacucguuugagccucaucgcugguguuuuuagcaaucuugauuguugagcuaaggcugguagucaggagucaggagaacucaguuuuucuuucuucuacuucuuccuuucuucuucuacuucuccuucuucuuuuucuuuucuuuuuuuuuuuuuuuuuuuuuuuugagacagagucucucucuguugcccagacuggaguucaguaggaugaucucugaagccucaacuuccugggcucaggugagccucccaccuuagccugcugagcagcugggacgacagguguacaccaccacaucuggcuaauuuuuauauuuuuaguagagaugggguuuuaccauguuagccaggcuggucuugaacuccugaccugaagugaucugccugcuucagucucccaaagcccugggauuacaggcgugagccaccacgcccagccaagaauugaguuuucuauucuguuuugcuacagcugccuguggguccucuggucaggucguuuucacaucuuuagguugagggaggaacagcucuuuaggugaucucugagauaauuuuauuaucuaaugguccauugaucuuucugauaugucauuuuauccuuauacuauauuuucucuuuggagauguuuuauuguucuuucuaauccauucaucucuauuuuaugaauaccuucaagugacuuugccagugauguguuuuccaaauguaauucuuuaaagccuaacuaaaauagauauuccuuuuauaucucagcugauuccagaucuauagcuaaggaauuggauugguuggggauaaauaaaauaauaacucauuaaguugagucaccaggagaaaaguucugugcauagaucaguauuuagcauagagguuguaggaccucaauaaaugacugucgagugaaucagggaauuagauagauaggguuuaaacguugaaugaaaagcccauacauuaaaguuaggccuauaccuuacuguaccaagaagaagacccuaaaccagagccagucauauagaaauucacauuuuguucuauaggacuauauccuugacugggcaaaauauucugccaagauaggaaacgggccauauuacaguguggccuguuucaguuuucaguacaccacagauuauuuuauauauaagcggaaauaaguaaaaucaauaauauuuugggucgggcauagugccucaugccuguaauccuagcacuuugggaggccaagguggaaggauugcucgagcccaaguguuugagaccagccugggcaacauagcgagauccuguuucuacagauaauaaaaaaauuagcugggugugguuuuaugcacuaguggucccagacauucaggaggcugagguggaaggacuacuggaggcugggagguugaggucacuacagugagcugugauugugccacugcacuugcacuccagccugggugacagagagagaccccauugcuaauaauaauaauacuuauuacuauauuuauauuuuuguaauuauauaauaauaauaauuacuauuauuauuauaaauaauuugaaaggccauugaaaaaaguugcguuucugguauugagcuaagauaacugauuuccuuuuguccagucagaggacauuuccauucuucucucauuggucuuguuuccuuuccggccuacucugugauauagcacagcuaaugcugugguccucaaacacuuuuagaguccaacuagguuuacuaauccaagucguauaacauuuagaagaauuucuaaacagaaaaauguuacuugaaaacuauggccaacagagauguauagaccuucuaaauaccaggggaagauuucucacauagaaaguuauugacccaaagagaagauaaaucauuuaagcuucacauaaaaguaaaaagcaauuuguaucagguaggaaugcuuuugcuucgaaguaauggaaaaugugacuaaugauggcuuaagaauaauuuuucucauucuagaaaucuggugguaggucccugcuggaagugguuugcagcucagugaugucagggcugguggcucugugauucuuuuguccuuccccucauugucuaaagaugggggucacagcuucuugugucaaguucagguuugaugcagaaagaaggggaagggugaguugaguggugucuccccaccacacugcuuccccauaacccaggccaucuccagcugcagagguuggggcagggcugggaaugcagccugggaaauagacaggagagaagcaaguuugggacucauacugggcuuacuaacuugcaguguucaauucacacuuuaauuuuuuaaagagaaaaauauauaauuuucuauuuaauaauuuugaaaauuaagaacaaggccuuaacuuucauguaauaaaaauauauaaaaagaugucucagcucuaauuucuggucagcaaauuagagaggaagauggaguaggaaaaaagauacuguaaagaggaagauggagaaaguacaggcaugagcgucuugcaugggaaggagcgugaggucugcuguuugcaucucaccuucaaggccugugucuucauuguccuaagcccuugagcaaggcagcaaccagccaaagccagcucuccuuaccuuugcuuuccccaggaccuucucuuuuaggucucuggcuugacuuucugccagccuguccagggcacccuugucacgcaacaggccuguagcuccagccaccaaccacucuuuucuccaguccccuggguggucuuuggcagagccaaaggccaggcuuuacucccagugucuccugcugcacccauccagagcaggccuggcacccuggagcacgucccugggacaugcugcuacaagugacagacaaagaucuuucuccuggaccauugcccaaacaguuuccagggaacuuaccuccagcaaccugccaugucaccaugaaacagucagacaagaaugccuacugccuaggggagaaaacccucuauuuucuuuuaauauguacacaauugcaguuguugauuuuuaauguggaggauuaggugcagccaaaagacauuuaguuuuagacaacaugccaagacuggaugaaauggugagagcuggauccaacuuuuguccagaaguuucccaacccuauugaacagucucaugucaugaaucagacccauuggaacagaggcagggggaaggaccaucuaucauuaaagguaaccaggaugugaaauaaacagugcugcuuuuauuuaguagaaaaaguuuuucucuagguuuuuacauuuuuauuuauuuucauguuuuuauuuacuuacuuucuuuuuagacacagaaucucacucugucacccaggcuggaguacagugacaugauuauagcucacugcaucuucaaacaccuaggcucaagugauccucccgcuuuagccucccaaaguucugggauuacaggugugagccacugugcccagccaauucucuaagucuuuccuugggaagaugguuucucugaauuuugcauaagcccuauacuuaaaaugugucugugacaguauuaaccaguacccuacuucuggacuggaucuuggguggcgggguugcgauuaaacacuuuguguuucucaaaccucucauuacuccauggcuucaggagaauaacaucaguauaguuagggaauccugaaccucacauccuugaaacuucuguguccaccuuaagugcuguauucauccucaauaaaaauaagacugcuuucuuuguucacauuauauauucuuagaaccaaagaagcaaaggagcuguuuugagcagugcacaucuuacagggugucaugggacaguggauucuaggucuucaggggucacuucagcauaauucuuggcuuuucacuuccuagugaugggugaugggacauugggcaaauuuccucagagcccccguuuucugguuucccaggugaggacagggaugccagccuggcccaccccucccaggcucacugagaaagauguggugaugugauacacuuuguaaucacugugcucugcuguguaacuguuagggcauugcaaggcuaaccacuggucaucugucauuuucgucuggguaaugaauggaaaaaucuauagacuuugggguuuugggugguagcaauuuuaaaauaccuauaccuucuaaagagauuggaacagaaggcaggagcagguggagguaguauagaauguucacuucuguaaacaucaagaccaaaaugaaaaggcuucuuuuuuagccaguccacaaaacaguaauccuauaaaauaaguaccucuuuggggacagcuguguuggauucagaugcucccuuuugugaaauauuugccuacagccauguuucucuccauuuuaaauguucucaaguuucaucuuuaaacacaaggccaagaacacccuggugugguguuugaguggugagacuagggagaacccacugacaaaugcagauuucuuugccuguguuguaggucaucugaauaauggagucacuacaagguaccaugguuuucaucaaggagauaguuuuacaaauaccuuccauauucuugggaauguuuuggagacaguccuauuccacuucauuucuuucuucuccacagaugcuugguauagaauguugccucuguauaugggauuauucucucauucccuuuacuccacagacgcuugguauagaauguugccucuguauuggauuauucucucauuccccuuacucuuaagaguuuuugaauccgaaggaaacauguuuuguuuugaguaaaaggagguguucaguggaucucauuuucuuuucuuuugcggaauaugaggccuaggaacuaacaauugcaaaauauauggagcauagguugagauuaaauuaaauuuauuucuaagugguuaauagacacagcucgaacauuuuucaucuucuugaugauugcuuauuaaucacuccuuaauuccuugacacauuuauuaauaggaaaaauugcaaggaagcaucauuugaaaguaguauaaaauacagcugguuauauuguuuauguuuaagauaaaacauuuaaagcuuucacguagguugaaaaugccacaagagaacuaacaugggggaagugguggaugguggaccuagcagagcacuguggucagcugggcauugcugugagcaccagcucaccacucuccaguucugugaccuugggcaaguuucuuuagcacugugaugaaauuucucaucuaaguaguugcccuguguuuaaaagaaauaacguaaagccaccuggcccuaaaauucaguuaaugcaaauuauuauuacaccuacuauuauguuaucuagucuguuuuucuguucauuggguccgaucagcuuggcaaaagugauaugcuaacuugagcaucauguagugaauucuggcagaacguggaagugauuaauuaaaugccacccccucgugggccauauuaaagcugaaugaaaauagaaaguguguaauaucugauaacauuugguggagaagggggagacagaaaaauugaaggauaagagaaaaggagacacauauaaagcuaauuuuagagcgauagaucacaaaguaagauuuucuagcuuuguauuaucagcauuggcuuggcuuucugagucucgaaauuacuagguuacugacuggccgugccuuuuccucaccuuggcuauucagaccaagcuguacucuuaacagcucaguagccaaaucugaaugcuucaaauauaagcauaaacucuuuauguguaacugauugcacuuaauugggcaauaccaaaucauggaagaaaauuuauuagugacccugucuccuucagaacuuucagaguaauuggaaaugagccuaauauccguguuuuugaaagcuuuaacaauuggucuacugacaggauuaaauucauacuuuauaugguguguauguuuuuucaugcuuaaguuuuuuuccuuauuuauugauggucuuacaaauauuauuuggaaauugagaugcagugagcacagaucuuaaauaucuuggcagaccgccucaguagcuguggaugaucccuguuagcuagagaaaaaccaggaaaaaaaaacccaaccugguacacaauaguuuacgaaaugaucuuugugugauuuugaacaagcuguuuuucauuuuaaucucaguuuccuugcuucuguuacugaccuaacucauggagauguggccaggagagggugggagagcucucugaauuuuuuuguuucuccugaaauaaaacaguucuaaauagacauacuuuugugugauuacauuuuccauuuuucgcaaagucguagguauaguuugaacaccaauugagaauaaaagaagcugccuucucccagucuuuucaagacauuuuaauaguuaaugagauuuugccccuuacccucaugaguuucauuugguucugaaauaaaaauuuacggcuguucucucagcugagcugauacuaguuuaagaguggaauugaguucacaccugcucuggcauaaaaagccucuaugugacuucuuugaaauauucacagagcagaauaagagagaguacucacuaucucuacaacuguaguaacuacacgguaauguugcuugcaagcacuuuagagaagcugcucuauaaacugacucuaaucugcugauauuguccacagauagaugccuccccuaagucaccuguguuccucaagguggaaugugguuguggaaaugcaguugguuuguguaggcagugggucuacauuaacacuguaaaguguacauaugggaaaaucuuugcauuugcuaggccauuuagccguucaagacaugguccguuagucaggcaacguacaauggauuuucugaguguucuaguuaaagagcaggauguguaaaguaguauacauuuaggcggauaauuaauaauugguguaggcuuguaaggcuguaauagaauauauaaauuucagcaccuguuaaaguuuuaucagagcagaucaccuuuccuuacugugagggaauauucccgccuguagaaaaauaaagugcucccacuacacgugaaaaaccuuuaugaugaaaggaggacugguuuuuauaacaaauauuauuuuccauggucacugugauuaggugacauuuuagcagucacauuuagagagcguuccuagacaauaguauuuuguauggguuugacuguagguggcaaaacacugcauagaaacaauauuuuagugcauucuaauauucagauacaguuuacuugucaaagaagccaccuccccccccauaucauccccccacaaaacaauaggguuguucauuuuauaaguucaucacaaguaaauauucagagcgaaagccuuuucuaguggcuacguuggaagggguagagaagaugaaacauagaucccaaguucaguuuuuggcuuugguuguaucauaagcaguuuuuacacuucauaucuuagcugucuucauuuucagacauagaggaagugcucccuuacagcagugagggaaagggcaaaugauauauuugugaaagcaaagcagacuaucuuacugcuuuaaaaguuucauuggcugcuugauaaauaaaauuaacauguuaucgauaugucugcaaucauaugguccucaguauauguauuuuuuaaagccauuuauauaaauuccauuuauucuagaagcugcccaaaaugauaaacuucaauacucaaaugagucuuugguucguacagucauucacccagcaaguacuuuugggaagcuggugaucugcaagcccuauguuagguacuagauaguggcaugcuacuuuucuugcuuucaacuuggcccacauccuaauaaaagaaucagguagauaucagauaauuacaauucagagaguuggggaaauaauccauguguucccaggguguuguugcauacauaucagggauacuccaccaucagcuuccucauaauaaugucuaauuuuuuuuuuuuuuuugagacggucucaccccguccuucaggcuggagugcaggggugcuuacugcagcuucaaacuucugggcuuaagaucuucccuccuuggccuccugguggcagggacugugggcacgugccaccacaccuggcuaauuuuuucuauuuuuauuuuuuguagagacaaggucucgcucuguugcacaggcuacucuggaaccucuagccucaagcagucauccugccuuagccucccaaagauuacaagugugagccacuguguccagcuuggcuaagauuuuuuuuucuuuuuuuccuuuuuuuuuuuuuuuugagacagagucucgcucuguccccaggcuagcaugcaguggcgcgaucuccgcucacugcuagcuccaccuccuggguucacgccauucuccugccuuagccuccugaguaucugggacuacaggcaucuaccaccacgcccagcuaauuuuuuguguguuuuuaguagagacaggguuucaccguguuagccaggauggucuccaucuccugaccuagugauccgccugccucggccucccaaaguacugggauuacaggcgugagucaccgcgccuggccuggcuaagauuuuuggguacucacuguguaccaggcacuugcuaaguacuuuacacauauuauccugcuugcuccuuauaauaaacuucuuuguuagacauugucauuaccauuuuacaaaggaggcaauugagaaucagagagauuagguuauuugcccaguguuguguagcugguaaguggcagaauccagauuugaagcaagaucugcugaacucuaaagccuuguccuuacccaccacugcauugccuccuuuguagagaauuuagaaagaauucccagagguggaauagcagcuaaacauggguucagcugcaacuaauagaauaccugauaacaaugguagguuaguaaaacaaagggguuuuuccccuucauuuuaggaggugucuggaggcaggagguugccugugugaguucagcaaaucaauguuucuuucuucccauucugcccuccuuagcaugcugauuuucauucuucagcuuuuuccucuccucuugcauuucuuucuugcaagcuggcucuugagccucacacagcacauuagaguccccuaaaggaggcaggggaggcagagguuaggguaacauuuauccuuacauauauccuauuccauccaggaagggggaaaaacauuaccagaaucugguggccuugagcaggauucugcuaacaacuuauuggcuaaaccucuagcagacaucuacucauagcugcaagggaagcuuggaaugugaacucuuagagccaugguugggucucugacucaagagacaggcaagggaggagggaguuaggaauggcuauuguauggaucaacaugaauuuucuuaauaauauacgugguaaugccugagcuucaucuuaaaggugaguugguuagaacuauccugauggaaagaaaauuaccaguugguagagaugcuugagcagagccuugggagcuggaagacguaauaggaauacuggaacugaagucauucugugagaugacuaugagauguaguaccacagaggaagggaugacagguugauauggcuuggcugugucccacccaaaucucaucuugaauuguagcucucauaauccccacauauugugggaaggaccuggugggaggcaauugaaucaugggggguggguuuuucccaugcuguucuugugauagugaauacaucucacgagaucugaugguuuuauaaaggccaguucgccugcacaugcuaucuugccucccaccauguaggacgugcuuuugcuucuucuucgccuuccaccaugauugugaggcuuccccagccaugugaaacuaugaguucauuaaacccccuuuucuuuauaaauuauaauuauuuauaaauuauaauuaaaaucuauaaauuguaccaucuccgguauuucuucauagcaguauaaaaaugcucuaauacacaggugaagcuggaauacaauccuggccccagagaaaugaagggucucuuguguuuaggaguggaagaugucagauuuucaaugaagcgugugguaaacuacucaaggauugauuuuaaauagugagauaccaugauaugauuuaugauuuaggacacucaagcaacugugaauaggaggcaacuugagggcaaggagauuacucaggaggugauuaaggcaauuccaagaggaaaugaugagauugagcugaacugggaacaaugaagaugaagaggaggauggauuugagugauauuaaaaugauggaaaugguuggacuugguaacugaugggcaaggcaggggucguccuuggcuucuuggugucuggcuugggccacuuggugguuggcagugccauuuguuaagauguagaauauaugaggagaaguaggucaugggggauuaagguggucaguucaguuuuggaaauaaugaauuuuugacaugucuguggguggacagauuugugauucuggguuugggauugcagauuuggcacacaauauuaauauuucauaguugaagucaugggaguagauaaguuccccagagagagacaugaaccaccaccaacaaggcaauuuguugcauugugacagcucuaacuuuuagaaaguucucaauucuguagcugucagccugaaauacucauuuuucccucugaagcuaacuaguauuguguauugucucucuuuccacauguuuugaaggaugcuaaucuuggcuuccuucaaaagcgcaacuggaaaacuuucaacacauuguagaacaugguuuaaucacaccuuguauucccggucaccauccucugcuguguucuaguucaucucuuuuucccuccaaguggugaauccaagucuuacccuaguauuccagaucugguuugaucaauaguggaucugcucucauuuuuaguguuaaugcagucuaagauuccauguauacauucauauuuuaacauugacugaaaauggagcuugugguccacuaaaaucauuaaguguuuuuaacauuaauugcuuuacauccagggcuuccacaucuuuguguagaaugggacuuaauacguauccucgucugauuucuucauguugguuuuggucugcaaaugugcaauaauucuguccuuucacucuguugauauaggaagugagauggugugaugcuuaggaaugcaaacucuuggauuuauauccuggcucugcccacccuuuacuaccugggugacaucuaaguugcuuucucugagucacaguuuccucaucucuguguugaagauauuauaaaauccaucuguugggauuguugggugaaguaaaugagguaaugcauguauaaugcauagaggaauccccagaacaucaucaacacucaguaauuuuucccuguuacuauuguagggcauauaaggaguuaauggcgcuauuuuugugauuguggauccuuucucucaguauucuuucuggaauacuuucaguaucucuuucuggagagaaaguuuaaggcaagugguucaucugugacgaauggaagaaggaaaugugguucuugauuuugaguugugugaugaacccaaauuuaccaggcaauagauaggauaugaugauuacuaaauuugccauugacugauaguuaacuggcuaccuuguugggucucuugagaaaagaacuaaaacaagaacaacaacaacaaaagcuuaaaauuaccugaaaauaugucucuuuaccuacaccuaauuuuaaggcagaaaauuccaaagugagccagcuacucaauacaggugcugaagguuaugugaaaauucggguuaacacuaaugauagauugagagguaacuguuugcuuuacaaaccgcuugccaaggaaugcccauauuagacuaugaaaauuagacucauggcaaauuuucaggaacaugauucuugugauaaacaagcuaucuggagggugaugugugagcucacaggggaguuuuaagaacagguuuccauuguuggacaguaaccugacagcuaggcauacucagaggaagggcauagauuaguauccaacaaccuguuuuaaaaccaagcaaugggaccccauacaagguccagguugacccgaaccaagguuagaugaaccugacuuguuuuuauaguaaacgucacaauggugacaagccagcagggucaucagcacacuuugcagcuacagacuucccacuggacaaaccauuuucagcuuccucuguuuggucacacccacaagaaguacgaaugguauauuuaaaaagcuaguccaucuugguucauuuauaccaguguguaggauuucuguagacucugggcugguuacaaccuagagcugcagaagggugcagagcuucauguguucauucuguacugugauaaaguucuuugcacguuuguggaaaugcaaaaguucuucuaugcaccuggcuucuguuccggucauuuccuuguauauggguuuugauccggugugacggaagagggaagcuaugcauucugagaucucagauuucauuguauccaauuauuuauaagaccugagaggugcuuuauuaguuaggaagcacugcagauuuucucuguagcuuuuaaaaaucauccugacuuccuauguguuauuuuuugcauuggcacccauugccaaugcuaugucucagaagagccgagacuuguggccaauaauccuuagaaacugauggggcuguagaauuuauuucucugucacccuuuuugaaaauaaaauaaaguuauauuuuucauuuacauggauggacaaauuggggucuuuaaaauaaaaccuacuuccccuuuucauucuuuuucugaucauuuguagcaaaagcuuagugguuuucuguagaacugcuuuguuuuaaaaaucaaauugaagaccaacuugauucugccugcagagcaaagcuaucugccuuuuuagaaaaucuggaugguuaaauuggaagcacauucugcacaugguuuagcaguuaguagccuggaaaaugacccaauagccaagauaguuuuuuuguuuguuuguuuuuuguuuuuuuaaucuucauuguaagugcuuguuuaaaguguaagcuuguaauggacuauuuugcacauuguucauuguuaauucuuuucaggcuauuauaguucuguaaauacauugccugcuaaguugugucaguggagaaacauuagugcuauaagaaaauccagugaaaugugcuuaaaagcauuaccaauuagcgcaugggacuggaucaccgcgauuucuuagugauccuagagaagucaguuucaguugacuucccauuuauuuaaaauggguaugacaacguucuuuuuggagaauagggcagcacacaaaugcacacuaugcuguggccugcugaagaguuuccacugauuugugacuauauuacucaauauugcuuuguagcacccuuagucuaauccacauugaaggagcaaaauccuucuguaucuuacuuauuauacgauuauguaauacauauguuacuuuauauauaauauguaguaguacuuauuuuacuauuuuuauucauuauaaugaaaauaacaaauuuacugggugguaucuaccaucuagcucaagcuguucuauuuuguauuguuuaaauuugagaaaagcuaauauugguuaauaauuaaagguuacaaaaauuguagugggaaaggaguuaaauucugucucucagauaguaaagacugccagaacauggacauaaucaugggaaauaauaggguggauagaaugugauuuaucugcguauguuaaagaaagaaaaauagugaucgugaauguacugaauauagcuuaaacuauuuaucauuauguacaaauggaaacuuacauaaaaccccuguugauuaaguuuuaucugaaacaaaggauaugauuggaaguggagaaugggagaguauuuuaagagcaugugauaauccagcuagaagcuucagcaagucuguggucaaacaagagaagagaaagaaagagcaaggaagcuugauuugguuaugcaaauuuggagcacacauaugaguugggaccuaauggauuguugcacuggauuuggucaucaaaugaugcuuuucauagcaaauauuaucugagccauuaauucaaacacugagaaaugcaggccauguguaggcagaaccacagccuuuuuaucccucaaaacaaaauguaaaaguuggccuugaugguuagaccuuauaaagaagaauaaggggggaagggggaaaggagcaaguagugaaggaaaaagcacccagaauggaaacaggcaugcguauucagacauaaauccaauaaacagacaccccaaaguuaugcuguguaagaauagacacacaguaagaaauuuccagcuaucaggcuaacaggauggaaaacuggagagcacagagcaauuacuuacgaagaaagaggcacaguugacaucaaguguuauagaggagacuggcaugauuacaggaagauguugagaauaucagaaaacauccccaaauuaagagugccaaaaagaagaaagauuaccgaugagaucaugauaaauaauaaugagcuguuucucaaaguaccugaagaaggggccugaaaagugguuugucaagccuggaagacagagaaaggguaauguauugacggacgauggagacacugcuaaaaaauaaaugaaauuuucaccccaguguucacaaaggaggaggugguuggggacagaugucagacacagacacaaauuucccaggggagaaugaagaaauacaaaagaaaucaggauccugcuaaaacaggugaucaaggggugagaagaagaaaaugaauaaaaccccaaaaaccccaaagcuuagcgguagucaccuaaaaaucuucaagaagugagaacaaagaagcuaacaagaagaggaaaaacauacccgcaucacuuagaaaggcuggaaauauuuucauguguguguguuuuuaucuaguuaauuuguuagacuagcccuuuugaaacuuguccuuaaaggaaguaagauagaauacuuaaagaaaaaugauuguggcugggcgugguggcucaccacccagaguggaaacaggcaugcguauucagacauaaauccaauaaacagacaccccaaaguuaugcuguguaagaauagacacacaguaagaaauuuccagcuaucaggcuaacaggccuguaaucucagcucuuugggaggccgaggagggcagaucauuugaagccaggaguucgagaccaaccuggccaacauggugaaaccccgugucuacuaaaaauacaaaaaauuagccaggcgugguggcacgugccuguagucccagcuagucgggaggcugaggcaggagaacugauugaacccaggaggcggcgguugcagugagcugagaucaugccguuauacucuugccucggugacagagugagacuccgucucaaaaaagaaaaaagaaaaaugaucguuuaaguggccuugaauaaccaagacaucuuuccugcuaaguucuuuucgaguuacccauuaugcccagcguugaauguuuacugugcuuauuaaggaugauuuuuguguccuaggugaucacugaguccuugauugggccaguauuuacuggauggaugcuucuuagugccagggagugcgcuagauccuggacuacugggauggaaaagcuagauacuuucugaggguuuuugaagucacuucuuccucacucauauaagcaaccccaccucuuuccaggcauugauuucaguguguucaucaucccuggucuugcuuuuaaccagcuacuugaugggcaaaggucuggagaggggcagccuccuuuguugcuggcucagugugcugugcuguccucagcguggugccugcuuuuugcccuuauccucagauguggaucccucucuucccaagcucuccuccauccccugugcugcaaacaaaacuccuuguuuguugcuccccaccaguggccacgaaggaauuugcaaaccccucaaccuccuacuguuuuggaauucaugaaguuuuugcccugagcaagaggcuauacuuucaaaaguacuuuuuccuuucuucauuuucccacccccugccuuucaaccacugccccgcccuggugcacacaccuccaucccaggcugauaacucccaucucuauuugaaccacccacucccuucucuuggccucugucaauuuuagggcucagcaaaacugggcuuacuaaaaacaccuuucaauuucuguucucagcauuaaucugucuuugcuuaguguucaaagaauacuuuaagauacucauuaaugcaaacacuguuaugaggagggagcuucacuucggucccuucuucucaccuucagauacuacuguaacagcugugugggacuggaguauggaauguuucagagaagcugcuucugaguguguaggagagggcugaagaaacuuucauccaguacacaguuuuguccuguaguccuuguucccauggccaaaagucuucugguaaaauuaaucuccagugcuaccuuuccuaccaggacugcagguggugucuuuuaguugaaacagacucccguggucccuugauucucauauguaauguuccauguucaggugucucugaaagcuguuagacuucauccaauggagaaggguccauugagcuacaucacuuucuuuuuucacauuugcguuucuuuauguagagugaguugcaguuugguuggcuuuuuuucugggaauagaucacucuucuggggacugucagacuuggucccugcccugggugaguuugccaucuuauugaggggguacuaacaugugcgagacaacuauaaucauagcaauaccaaccccaccucaauggcugagugacuaaugagaggagagagugaggggcugagcagaggccucuaggaagcagcuguggucaaucuuagccuacauuuacuuuuuuuuuuuuuuuuuuugagacgaagucucacuccgucacucaggcuggagugcagugguaugaucucugcucacugcaaccuccaccucccagguucaagcaauucuccugucucagccuccugaguagcugggauuacaggcaugcaccaccacacccaguuaauuuuuguauuuuuaguagagaugggguuucaccauguuggccaggcuggucucaaacuccugaccucaagugauccgcccaccuuggccuccgaaagugcugggauuagaggcgugagccgcugugccuggccuaaaccuauauuuacuuugaauuucacuauagucuaccauuuccugaugccuuauauaucugacauauaucugaugagugacauucuugagaugucugcccaggacuccugaaccccaugagaaauaagauugcacuuugcaguucuucaaccuugcugugcaucugaguaacauguggcccauucauacacugcagaugccugggcuccgucugugagauucuguguuuagaggccugggcugggaucuaggcuucuguuauuuaaacaggaauuucugaccuacacauugcuucaaaaaauugucaauuuuguuuucaaaauuguuauuuuuucuugaacucaauacuuauuuuuaaauccuuuuucacucaggaaaagugaaucaucaccuacuuagcaccuaauuauuuaccacuaagauauuugugugcaaaaaauuaauaauuuuuagaucaaagaaaauggauaacuucuaauauguuaaaaucgugcauauuuccauugagagagagaaugggcugaaauuaucccucuuuuauauuuuaauuguucaucaaauugauagauuuaaucuacuggcccuaaagauuugcuucuauaauaauguugugaaugaaaccuucauugcuguagauucacaauucaacaucauacguaugugguaggugugauuuuucuuguauuaaaggaaaaaggguuagcagauuuuuaccaauuuagaaaaaaggcaagccaaauuagagggaagucagcauuauaaauauuucgaaaagaacccccauucauuauuuuuuguaauguguagcuaagaccaagcaacagugaagugggaaucuuugccuuaugcaaaaugguuagggaaauagcuaaggaugcuaagaaauuagcuucaauauugguuguaggcaugaauguuuuucucagggacuugggugauuuuguuacacuuucuaauauuaucucugcuaucuucuaggacuuauuuugugcagucaaagacuuuuuaaggcugucuguucuguaaaagaaauacaaacuccaaguuguuugauuuuaugaguuuuguuguuguuguuguugcuguucagucuguaaaauagugacguggauaauaaagauauuuaguuguauguccagugaccuuuggaauaauaaaacuguuuuugucuguguggguuuuucacauacagguaauguuuuguucacauucuggauacagaccugaccucaggcugcucagcacugcaauuucauaggcuccuaugagguccccggcuaacauuuugacuguggugguagaccuucaccucuuagauuucauauaucuuucauuuugcuucuuuugugcuucuguugaauucuguauauuuaagaaaauuaagaugcagagagaaaauugguuaaugucuccucugugucuuguaauauguggcccaaacagaaagaaaauguauggaauuuagaaauuuuauuuacuuguuuucuuacaucauagaauaccauuuuaccauugaaauuauuaaaaccugcuuuuauugagaauuuuggggaaguugaaaauguaaccuuuacggggaauuaaagcuguuuuauuuuaaugaauaaaguaguuaaauuauuaaucauauaaaauuauuucucuggauguuaauaaccauuucuuuacccaggaacuuuuuucuaaucacagaaucuugauuggugguuuauuugaaggcauaucucacuauuaaugguucaagaauacccauaacuuuuggaaagacucaaaacauauugcauaauuggauuuuaaguuauguuguuuguaagcuuauuugacuuguaucauguagugauuacuaucaguuuuucuggauguagguaggugcuucuuaugauucuuucauagauaguauugagucauucauuaagucuauuccucagaugcuuauugagcaucagacuugugucacauacuugcacagcuugguguuggagauacacccuuuaucaccacauacuuggaguugcuuuuugucugcuguaagacacaggauguagugaacaggccaagagaaauauaggguccugugggagcuccuuacagggagggacauagcacagagaaacucaggguaguugacauuuaaguucagaucugagugaucaggaaaacagccagccagagggagcuggcaugggaauggauggaggcguguuugagucauggcagccagaucuaaagaaggcuacaaguagagagaggacugugcauuucuccuucccaucacuggaagaggaaggguaugaggaguaggcucuacaugaacaugagagccagcucaugaagggcuguacaagccauguuucaguguuuaucauucauucugcaaauacauacucagcacuaugugucagguacuuggcuucaggaaacaaggcagaaaauaaugccugcccuuguggagauuuuauucaaauggggaagagacaaacaguaaacauggcacuagugguuuugaaaaugggucagaaguauguguaguccaaaugguuacagacucagcauuugccaauaucauggagccaaaucuaagacuauuuaauaaaaauaaguuugcaaucauuuccaguccucagcugauaacuacagauagacuuauucuuaacucaacauauuuacagguaaaguugaagguuaccuaucauuuauauuuauugcucacucacauugcaucaggcauugggcuaagcaagcaagcaaaccacauuugagagaaggugcuacaguuuagugcaaucaguauuucaaguucaccagaguagaacuuaagaguagaagguuuauuuguuaaauaagaauacuugaccuuaauggcuaccaaaaaagaguuggaagaaugaauaagaucuaguauuugauggcacaacagggugauuauaaucaauaauaauuuaauaguacauuuaaaaauaacuggaagaguauaauuguauuguuuguaacauaaaggauaaaugcuugaguugauggguacuccauuuacccauauaugauuauuacacauuauaagccuauaugaaaauaucucauauaccucauauauacccacuauguaccuacaaaaauuaaaauacacacacacacacacacacacacacacacacacgaauacuugagaggugaucagaauguccuguauuccuggccgggcacgguggcucacgccuguaaucccagcacuuugggaggccaaggcgggcagaucaugaggucaggagacugagaccauccuggcuaacagggugaaaccccgucucuacuaaaaauacaaaaaaaaaaaaaauuagccgggcgugguggcgggugccuguagucccagcuacuugggaggcugaggcaggagaauggcgugaaccugggaggcggagcuugcagugagccgagaucgcgccacugcacucuagccucggcaacacagcgagacuccaucucaaaaaaaaaaaaaaaaaagaauguccuguauugcuguuugaaaacacauuaccagaaccagaauucuuccuugaaguuuugaacaauaucacaauaacagaaacaucucaagauuuuaucaugcagccagcaaacaaaaaaauucuacauagugauugaaguagacauuugcuugucacucaagaugaauuauuguaaauaaggaguuuuuauuacaaugaacacuuuuuuuggcagaauuaauaaagagcagaggauacuagaagucagugcauagaagcaaaaggagaaauguaguugagcauagugaauagagaagauuugcuuucguuuauuugcccuauacauuaagaccauugaaugagacuauuuuguguaugacaagcauuugaaaaaauuguuuuacucuggcaaucuuaggcugauuuguuuuauuuccuuuagaauaaaaguugcaaguggguaggaauuaugccuuaaaguguuagccuacaaaggacuggaaaacuacucaaggguaacagcugaagaggaaauggcucugucagugucgugcgcauggaugauugggcacauaagggacacaagcagggagaaaggugcagagagaagagcucauaaaaccaaggaggcuugcuuggaacuaaaauagaauagcaaaagugaaaagccuggggagccacuaaugugauauaguuucccucguaacauaaugcaaauauguaaaguugaaaacgugugccgccucuugcauagacauugcugucaucagcagcacacacaguuggguauauuuggcgaggcauuuaaucuccuggcucucuggucucucaguccauaucaccagaggcauguauuuucaaaacaguccagaucaaugucuggucuuuguaucugugguacaaauauaaagcuuacuuguccacauaacagcaaaguaaauccgugguccauuaacgcuaaauuguaaauagugauagucacuuuuguccaacagugucuguaauguuuauugcuaaagcccauacauguuuauugauauuauccuaaucugggaacaguagcugcuaguuaucuaugugccaaacacugugcugcuguuugcaaauuuuaucuaauagcaacuguuugugaggagcauuuguuaucugcauuuuacccauaaggaagguaggagggacagaaagguuaaaauaauccagauggaggacccacucuuggucacugguauguuuugggcuuagcacacaguucugccagacucugcaacauguguucuuaaccaucagacuuuauuucucuggugggcaacacagguagaugugacagguuagaaguauuagauauaaauauaaguuaucgagaugauaugacuaccgaauucacuacugcacuuuuuuuacuuuuuuaaaaacauguauuucagcacacugcuaaaccacagcaagaaucuuuuuaaaaagaccuuacaagaagcaugauuacaggucacaaaaucaagggaaaauauugucaucauuauuuuuuaauaagugauaagugaggcugaugaguguagaccuguugcuuuauuaauagaaauaugugcaucuggugaggacuuguauuugccaagcacacugcuggccuggaauuagacuccucuguggaauucaggucaguguuuacacccauaguaguuuacaaucuuucauaaauuugagcaaaauauuaggaaagcacuuagaagcaauuuagagaaucagaauuaaaguagaaucgguguagcauguauguucaguggagaggggcgaguagaggagugaguuucucugacagaugaugaaucuaguuuguuuacuuuuugggagacccuguuuccacacucacugacaugugaguuugcauccuggcucaagcacuuaaacuccccagucucccuuucugugugugugggauggagauaacaaggccaaccuuacaagguuguauaggguaaagugcccaguguaagauuugaagcacaguaagucuucaguggggcuagguuuucuccuuccucccugcuacuuacuucaugaagaggaugaauaaguacaaaucucuguucagcgcugcaaaggaagauuaucauauuuauuuauuuauuuauuuuugagacagagucucacucugucgcccaggcuggaaugcaguggcaugaucuuggcccacugcagccuccgccuccuggguucaagugauucugcugccucagccacccaaguggcugggacuacaggcgugugccaccaggcccagcuaauuuuuguauauuuuaguagagacaggguuucgccauguuuaccaggcuggucucgaacuccugacuucaagugauccauccaccuuggccucccaaagugcugggauuacaggcaugagccaccuugcccagcccagauuaucauuuuuaaaugcugaaaaccuaaauuucccauugcacugugcuauuacuuucacaguguugacuuucagagauauccgugcaccgccuuuugguagcucccuauguccucuugcuucucuaguugccauuucuuuggaagacccccccgacauuaguuaucucauuuuccaugagugauuuugaaacccaguuugugccacaguaaaauuuauugaaauagaagaaacacuggaucuugagagauaccaccagcaccugcagucuuaacgcuucaucuccucuccugaccuggguccaacucaucuuuuuuucucaucaccgccugcugccaucuuguuuacuccaagucuucaccguucagucagaaauacaaagcccugcaugggucagguaguccucagagaaggagagaaguaagaaagaaaguggaggccggccacggugguucacaacuguaaucccagcacuuuuggaggcugaggugggcggaucaccugaggucaggaguccaagaccagcuuggccaacguggugaaaccccgucucuacuaaaaauacaaaaauuagcugggcuugguggcaggugccuguaaucccagcuacucgggaggcugaggcgagagaauugcuugaacccggaaggcggagguugcagugagccgagaucgccccauugcacucuagccuggacaacaagagcaaaacuccgucugaaaaaacaaaaaacaagaaagaagguggaaucaaagggauguagggguuccacaaauuuagaugagaugucagguuucucagauguguuccuugauuugagguaggugaucuuagaagagcugcaacuaaacuccaacuggcuccuuuuucccccaugucuuagaagaaaaugugcuucguuuuuauucucuugacaacccucugcauuugcaucuuucagcuucuucuaacuugugucuccugggaccuuucuuuucauaacucuauuuucuuucaucaucugucuuuccccugacuccuuuucccuuugcuucaaaaugugcaaauggauccucucuucucuggcagugauuaucaaagugugguuucucggcgaaaugugaucacuuacuucaaaucuccugggaugaugugaaaguugggacccacuucaggccuaugugucaauaccucaguaugauauauuccagcaacuuucccaaaaaacuacuuaguuuccaaggcaguuuggcaucuccuagaguggcacagcaaauuccaugauuuuuuucuagcccuguucguuuugucuuuuaaaaccugucucccucaacauccacaauguuaaaaacgucuaacuugccuucuguuucgcucacuacucuuuuuuuuuuuccugcuuucugcuucugucuucauaagugcaggcaugggaagagcugggaauuuggagucccaguaggguuugauuccuuaaugucauugcucaguagcugcgugaucuugggucacccauguaucuucaguagggcaucugcuuuggagguuuguguggcuugcaagugucauuuuuaaauugggagcccaaaugcaauuguuugugcucuaaaaaucugccucuuccaguuugcuguuggaaaacuuggaaauuauuggcuuugccaggguuguggccucuggaugagagcuaaaaggugaacagccuuuuauccauucugcuuccccccacuuacucaggguccuuuccuguuacaaaucauaguuuguauggcauggcaaguacuggaagggagaaauucucuccagugagccagaaaaugcaacgggaucuguuugugauugauagagauaagagugccugaucuacuuuucccucugccagaaaaguauuuuucccugacagcuggagacaucaaaggucugaagcugugaauacagagagaugaauguucuaauauuaauauuauauuuaaaaauauaccacguaacauuuaacaucaacaugucuaguuuccucugucugguaacccccagucguccauaugcaaaaagaggaauuccaaucacagagguccucacuccaaggagacaggcaaccauuacgugucugugaauagcugaguaagccaaacugugauaguuucugauagaucaugucaagaccuaaauaguggaaucuucaggauuuggagguggggagcaagucaccuggauugaugaggacucacugaugaacugaccaaauuguuuuuuuuuuuuuuuuuuuuuuuuugagauggagucuugcucugucccccaagcuggagugagugcaguggugccaucuuggcucaucgcaagcuccgccucccggguucacgccauucuccugccucagccucccgaguagcugggaccacaggcgcccaccaccaugcccggcuaauuuuuuguauuuuuaguagagaugggguuucaccguguuagccagauggucuugaucuccugaccuugugauccgcuggucuuggccucccaaagugcugggauuacaggcgugagccaucgugcucggccccaaaugggcuuuuuaggaguucucauggaagagauggaaguuucuucuugagugagagcaaucccagagucugauauuucaccuaguacaugggaagggaacauguuuuguccuaagccaggugugaaguauagucauucauguugggcaaaaacguggcaggacuuggaacuucuguggggacccacaaaggagaauagaggagaagacuccaugaaauuucugguccugguguuguguggauggcccagggcccuggccagagagauucaacuacuaggugagguuuuuuucacuuuagacaacccugcuaaggcuucauuucacuuauaugccgucugugggccuuugaugguucuuuuuuccuauauuugcuauggauauauuuaugcauuuaaaaaauuugcaucauuguaacuuuucauugacaaaauauauuuaauaugcucgguuuuuacaguuuugcuuaauuaguuuuuuucccacuuauauuuauuuucuguaacuuuucucuuuuuuguugucuguuuugcucuauuaagauguuauauaucuucuccuccuucuccagaguagaccucucaucaguucaccaaaaucucucuccaguaagagucaggaagcuuaccgugugacaaccccuucaaggcaauaaggcuccaacuaagggauuaagauuguuuuuugacaccaaacauuguuuauccucuuaauuuugagcuauguagccugaaauccaugcucugugaugaaauggaggugguuuaucugagcuuuaauacucuuaaaaaugaagauaaugauagagcauaguaaugaaaauuaaauaagaugcaugcaucuagcagagaagcuaagaaauaggagauucuuaacaaauguaaccucauuucuucuuuaguuucuguaaaaccccaggaauguuagaaaauaucuaggucgaaaggagaagaucaugaguuugguguuaauuuugagguaccuuuaaccagucaagugaagacaugaaguagacaguugaauuuaagggugugcagaucagagaugucugaguggagagucugcaguugaagagcuguuuguagagaugccaguugaugguaugagauugcuuauggagucuugaguaacaggugggccuugagccuagcaguagaaggauuuucaagauuuaaagacauucaauugagaacaaaagagcaugccagggacugggagagaagggaaaugugauguuauagaagcuaugcuaagcauaguuuuuuaagaaggaggggaugggugugucuuuuuuggucaucaaggaagaugaguacucaacagugucucuuggcuuuaaccacuuuaguggucacuguugacauuuucagagaguuuucuugguggaaucauggaauaggaacugacuuuccaucccucagaguugaguugucuuucaucugacuuggcaaaguauuucuuuuauguacuucuaaugugauuuuucucuauuguuuauaguuguuugcacuuuucauucacguaauaaauuaucaguuuccugaagacagaggucaugcaaaaucccauguaaauuacaccuaguuaaguauuuagucuuagaaucauugguucucaugaugaacaaaacacauuucuuggucuguucauuuauucauucauucgcugaacaguuuuucauuuaccaauuccauacaaauagcagguacuauuuuagguuaugugaauauaguggugaacauaagauacucccuuuucuguaaacuuucauuguagguggagacagaugagaaggaaugaauacaaauguugagggcguucagugucuucacuuauuuguuccucacaacaauagcaugauguagauguuauuccuaguccuauuucauugaugagaagauggaggcaucaagauauuuaguaacuugccaggguucucaguucauuggaaacagggaugauguuuggagcuaggauucaaacccaggcgguuugacucucagauccacuuugcuaaucaucucacuacacugcaaaguguuuggcacggggaaaaucauuauucuuauuauuaauguaguuaauaguaacuauuucucaagggagcugaggaaucauuuacucuaauucagaugagaaaauggacacucauacagcuagcuauuggcagaacugaaauuuagaagccauauuuccaggcuccccuuccaauguuuuccccucauccaguaccucuucuuuaaggaauggaguauggaaaagggaaaagaagcuggaagaaugaaggaaugggcaaggagaaggaaggguguguagaagagauauaggaaauaauuaaaccuguuggauuugggguuuuugaugcuauugaacugucugguuuuuaaaguuuuuuucccccuuauauucucaagagguagauauccuugaaaugauaucuucaugcaaaauaguguuuuauuucaucuaugaccaaaaaauaauucaggagcuaggaaaccuuagcuccuuaaaaguaaaagacuguauuuugggaaagaacauuguuacuggaauuuauacugugaugacacugguugguagacacacuagaagcuuugaggagugugugugugugucuuugugugucuguguuugugucuuugugugucuguguuuguauauguuuguauauuaguaugauauauauagaaguacauauuuauuuuauaaaauacugguaguguuuaauuugugcauacucuuuaggggagaggguauugaaauauuuuucuggguuggaaaaguuuuuguacuuacaugcaaggcugcucuaaaaucaagcaccauauugaaacaucacaaauauacacuaagcaagggacagaugcacaaggaauuuaagcagaguuuuucuaaauggcaaauaauuagaggggaacagaugccuaugggcagcaaaggaugaaaugagguaccaggaauuuuaaaagggagauggaaauacaaauguagaaugcaguugcucucaaggauguuuaagccuagagggugugcuugcccaaaguucacucuuuuuguggguauugacuuaaauuugguucucucuucaccugucuuccccaaagaaguagaugaugcuaaucauucugaaguggaacagauuuucuguggaaccucaguuuuggaugaucuguggcugcaucucuuucuucugccucccuagggucuuguccuuuuauaggacugccaggauaugacauuucacaaccaugucaguucucacuuauuuauuauuuauaccccauauccuuccaaaaggguuuuuagguagccuaccaauaaaagacacguaugaaaauauauguguguguguguguguauauauauauauauauauaaaauuuuuugucuugguuuguguuuuaggauggacaugucccuucuuuagaaacaagucugcuguaaaauggguuguauccaucucagagcuauucugcguagucuugauguggaaaaggaaacaaaucuccaagaauaaaguagagcacuaggcauuucccaucuuccuguagagugguaguuuaaacagcaggggcacugagcagagcgauugagccacccagcaaagcugagcuguagcaccugaucauuaucccucagguuuaagauuuaccuguugugcucauuguaacaaaagaaaugaaaucucuguaauuauauuggaagggggaggagaucguguuuuaguuccuuugaucuugagcuagaauaggcucugcuuuuggaaauuuaauuugaaagagcccaacguacacaucugcuuuuuguacugcaauuucuauugagcuugaaaauagaaauuuauuaaugcaaauguguagagucuguuccuugaggaaaagauauacucauucaaaacacaaggugaucccuuccuacauagcuauggaagauguuaauauguuuucuguuuuuuuuuuuccuugacuucagauaugagguuccuugcuaacaaggacuaagcauaaaaauuauaggauccauuggggaauggaaagauucauucaauacuuaaaaguuuccaaaggacaaauucauuggugaagagcugggggaagcauacugaauccucaaaagaaaaaaaaaaagccaaaaacaagugcaucaucaaaccauucugaaaauauguuugaauugaugauagggcccaugcuaagagacaaagcuuucauuucaacgaauccaaucugccuaguguuguguaaaauugccuuugccuguaaauggaauggcaugcagauuuuagguaggacacuuucucacccaacuuagccuguacucuauuucauuuuuuccaccauuacaugaagcuucacauaaaugacaacuugacuuaauccuuaaaguggcuggauuguguggucuauuuugauuaaacuuuuucuuguucuuaguguaaauuuucaguaaugccuaaaaugucaugagcauuuugggacauaaauccuuuaagcuauuuugcagucauauaguuguucuuuggaggguuugagugcuuuccuaaacuccuucucaucucuaaauaggcaaaauaaauuauaaauugucgagaacauucaaucacucuucggaugagcaggcaucuccuaaagcuggggaaaguauccauuuucaauauuuugaguaaauauaguugauucuuuauaauauuuguacuguaucaaaagaucucaaaaacuguuauaaauuaccuagacuuaaggaagaagacaugauuaaauaauucauuggaucaauaaaaccaaucugcuuuuuucugauguggugugaugaaguuuuuuuucaaaugggguaggugggccucagugcuguguauuauccuuuugauucuauugguuacugucuuucucugcuccccccuuaguuguuguuugauauuuuugugcuuuuuguuuguuuuguuuuaaagaaaggaaagcugcaagccauagaaaguuaggcugugaguuaggaauucugaguuuaaagcagggagccugucccuaacuuuguguuuaaguugguguuucaguuauguugccaguguaagcuugugacccuuacaaauguacaauuucauuuggguucagugauuccuggaugaguuugugauauaggaugccaaaggcuguggaauuucuuuaagacacaaaaucuugagacagagcugauuccuuggaagcuuguggguaacuagagucucauguuaacuaaucuggagggggcuaagaaaagucuuccuacccacuuccaauuaauuaauuucuaacauuuccaucuaaucaugacuuugucgagugacacacaucuuuuuuccucacaggcaagaaacucacacacaaaauuucuauuucuaauggcagacaguuggggugccgcagccaagcagucacccuuaaaaauuaaugagcguaaugaugguuagaaaagcgauucugauggugguuggagagggaggggccauggggauggcagaaggaggaagaccggacuccucauaagugacaaugaugugagccccuguccucaucuccccucccauccccccuuccgcccagucaccaccccuuccauccuccucucuuuacaggagccaaagcagauagaaagacagggcgauuaugaagacgucaguuggaguguaggcaggcgagaggggcgcagcgccccagaugagguccggggggagcugaggagggucacucauggacgaccgugugugugugucugacagacugugaaauggugcguuguugcacggcugcgcugcaccugggcccuucaucugugauugauugguuuggucauguguaauggucccaucugcucuguguuguuuuucuuuuuuuacuuauaaacaccguucccagaggcugagagaggaugagcuauguuuugucaucuucacuuacacuuuagcucaaaaaaguggucaaguagguaagcucuaaagucuguccaaguaauguaguaggaaaguacgguuuuuccccuuugcuugauugugugugugugugugugugugugugugcgcgcgcgcgugugccucuccugcgcacgcgugugugcguggaguuuuaaugcugccuguuaauaucugaauaguucgugaaccacggaagaccaaaauaucgcagaaaugauuugcacaacucuguguauugugacucuuacugcagugaggauuuuuuuuuguaacggagccaauacuuaauuaaaaccgcugacaucaugguguuauaauuaagcguggcauuaauuaagcuggaauaacgauuuuuuuuuauuaagaacugcuucuauuguauaagaccauuaucgccuaaaaacaaaauaauuuuaaggcaaaaauaaauuugcuuuaaccuagcccuuuucaacuucccccaaaguccggccucaggacugucaucaucagggcuccgagucugugugugcgugugugugugagcaugugcguguguguguguguguuuggugguguuggguugggggagaguggaagugaaauuuguuuuuuuucacccaaaaaugcugaucggcuccuggcauucugauggcuaauuaugcaucggagagcuucgacagcugcauucaucaucauaaaauguaauaauuaaugacauuccaacaaagaaaaauaugcaaaugaggacucauuagcauuuucauauucagcuuugauaaugcuuuugcugacaagguuguaauuaaugaaaauucaugucgcagucaggagauuggaucgguuucauuccgcucacaauucccaaaugcuugcauuauggaaaaucggcggcucugccaacuuuucagggaagaaaaaaacacacacacacacuaaaagcaccagaugcaaauuaaugguagggagucuuuaacucuuuaaaccaccccccuaaauuuccaucauaggaaacaugugaugaguguuagccuaagaacuagauucucuuuuuuuuaauaauaggaaaguacuuuuauuugugacccaaguaugagaauuucuggcaaacuuuuuuuuuaauauuaaaaaaaaccccccaaacccuccaccuuuucccuucuuuccuuuucccuuucaagacuauuuaaauguacauaguaaaacauguuaggacagccaagccccagcauguuguguucuguccucuggcuggcagauucacgccacaacaguuuauucauccacaugcuuuuuggcgacucuucaucacguauuugggcuuagaucuucuggugccucccucggcgugcuacccauaaggucgaaagaaaagcaaguauucgauuucucuauucaggguggguuuuuuuuuuuuuuuuuuuuuuuggaugauagugguuuuuuuuuuuuugugcuuuuucuuuuuaaucuauucccuuugugguuuaguguaagaguuugagaaugugcccauaauucucucacucaacacuucugguuuaguguuguucuucaaauguaauuuuaggagacacucugcaaucaaaauggaaacccagaaaccccagagcagagauaucgacaaauauuuaacacagagagcuguuaauuuaugaaagccucuguguguugcuuucaaaauguggaacuuuagguuggcaaauguacacuugaugccaaccugguaccauguuugacagacaagccugaaguuaaacugaaaguucuaucuggcccucaagguuagaaagaaaaacuuaaacagagucugacuucauuuucuauuugaucuuuagguuaaaaaaugaugauuauuaaaacuggucuuuuugcugaggcagauguuuuaauaaaagguuuguauaaugauuaagaaaaagggaaaauagaaguguacuucuuuauaaauuauaacguuuauaagcauuuucacucucagaugaauaaaaugacuucugggaguuccuaagaugcaguuuccuguuuauuuaaaguuaaauuguaauucccaaaguugcuagcccagcauaaauaaagauuauaauacgccuuguuaagggaagagagaaacuuugauaugcggggccuuauuuuuuagaguauuucaguaaaacagaaagaaucaucaguuauuucacgaaaauuuuaaaauaaaucuuuuuucccuuguaugugauuaagaaugacuggguuucauuccuuguuaaacucuugggguuccaagaaacagaauuuuauuucaaucucuugcuucuuccaacuuuuauuuugucacaguuuguacaugaaccuguguguguguacacaggcauguguguaaauguguguguguccaugucuaaagauuaugguggcucuguccucucuccuguaaaaucuauugugguaaaauagcaggcaaaagaagguuuuacuuuuuuuuuuuccuuuuaguuuauuucuuuuuuugugugggcaaacugcccauccagaugguagaauuucaccuguaagcaaucugaaacgauagguuaauucugacauuuuauagagcuuuuuuuauuuucuuuucacacaguacaacuaagugcagaauaacugcucaagauaauguuucuuuuuuuuuuuuuuuucuuuuaaagcgcuuucugcugugauugguucuuuuuucccccaaaucugaauuuggggcucauuuaaaaaucuguggcuuuaggcacuuugcuguuauugucaaaaccacaucuaaugaaaucuuugaccagcuucuaauauguguaaaugaggaagugauggcagaagugaaaaagcagguuagucgccgagaagcagauccuuguaauuuuauaacgcugaacguuccacuggcuuugauaaauuuacuguuaguuuucuccucccaccaaauucacagauguauaccaacucauaacuucccaaguaaugccuagcaugguauuagcccccggaauccugggacuugcuuuuguugucagugugguuagccucugguggcuuaugugacugaguaaacuggagaaaaacuucagggugauucguugucccgugaucaaggaaucccauuauuuccaaaagcggguuagaagauguuuuuggaguagaguguggaagggaaagggaguauuggagauuguuuuuacacauaaucaugguaaucaugcuguguugacaaguuaguuuugaaugugccaccuucuuguuuuuauuucuagaaaaccuucauuuucaugaauuauuucuugagcugaugauaaagaugacuuuagagacaucuucuccccugguguauuccuuuagggaaacguuuuugaaaguguuucccuuuauuauaccuguaaggcuugggaccuuugucauggcauuguuuguuguuuuuuccguuuccuguuuugcacguguuaauuccugugggcauuuucuuuuuaaagugaugggauuuccacuguccagcagcaagccacauuuacuggaguuauugaacucuguaauaggaaaccugugggugaucaguuuuacccucccuagaagauacugcuucagucaaugagaauuacagccccaugacugagaauuuuaaagaagggguuccacuaagacacccagauguuuuguuucagguguugcaacaaaaucaacauuuguuugugggcagcgaagccaguguuccugccaguauucccguucagucgcuucucauauuucccuugcaaacuuucccauugguuggggucuguggagagauuucaguggcuggcugguggaaauguuugggagaacauuugcguaucaaagcaaccuaaauauuugcaaaaauguuugcuugagaaaaaagaauccacuuaggauuaggaaguaacugcuuaaacauuuuaaaagcauuugugauuucccuaaguauauuacucaugagccacugccuaaccugaauuucaggggucacucuggaaucuguauauuuaaaaacccuauaagauaauaaagguuuugcuuuaugauuaagaucugaauccauacauuaaaaugaaaaaacacuugacaagacaaaauauauuuuaagaauuguuuaucauuuagugaaccugcaaaacaaaagguguaaagaaagggccucaugaaaugguuggauguugaauaccucuaacgucauucuuucccucuacuguagauuuuuuguugguaaaacccaauuguauugcuaugauaugacauuccuucuguuggaguccauaagcuuucuuccagugguaaugauuugaaugucagaucuuuuucuugaguuuaauguaggcauuuucuguccacauuauuaaaguuucagcuacauuuuacugaugguuuggaaacaguauguguaaaacucaguguaggccaauuuuuccaauuuguuaacaagguaggaguugagcauugacaauuacuguacuuaaaagccccucggaucagguguuauuuuaccaucuggacauuuuaauuaguaauaaaaguguggaucuggauacacagaaauaggaucuacaguacacaauggcccaaugcacucuguuggugcugagguguauguggcuacauuuuauaaauauguauguaugugugugugugggcaaguguaauuaugugccagguguguccuuuuucaaacugggcacuaacacaacaccaaagaauuuggcuacuuuucuuagauaaaaaguaaaaauguauaaucuauaaacuugcacauaaguaaaacuguaucuuuuuaaugcuccuacuuccucaaguauggcaugacaaaauauaaugcugacauuuagguaggccugggcaaaagaugugacucuucucuuucauagcugugugcucuaaggcaaauaaauuaaccaccaaguaucccuuuuuucucauauucagaaugaaaguauaaaugauaauuguuaugguaucuaccuaacaggauuaugaggaagcucauuugagcauguauguugaaaagcacuuaaugaaauauaaggagucauaacaguucuuaacaauugauuguuaauacaggaugcagaugaccaauucauaccccacauaccaucuuuuauaauucaguaaaucaucucauauuuaaaaauaagggagaugcaaauauaauguuacauuagauuauuaacaaaugauaaguuuaagaccaccagaaaaaaauguguucauaaguuucaacauaaagcaaaaugacucauucuuauaaaguauauacaggcucauugacgcaauguuauccuuaauuaaggcaaaagcgaugcauuugagggaaauagugacccucuggagaaauagagaaugaaaauaguuuagggaaaugaaucuuaacaucuucucuuuuggaaaaauucaugcauguuucucuuaaucauuaugaauuucauguuugcaaaccagugugaauacuuaaacgauaaucauuauuguuuagaaucuaccuauuacuacacacacagauacacacacacacacacacacacacacacacacacacacacauuugcucaagaaaaucauccucaggaaguaaaggaguugauaaaauuaccauuggagcagaugaguuuggauacuucuacugaaagcuguuucaguuuuuauuauagguacaguucucccccgagaauucuuugggagaaauaaaaacauuuguuuuuaauuuaaaugagugguaacaugcuguagcauaauauuaacuauuucagugauuuuaucaauuuuaucuuccucugccuuaauguaauaaaugcauaucuugauuaaguacaaaucuuuacauuacguugucccuaaugacaaauauuauuuuaggcaacuuaguuuuaaucaucagagugucuuagggagcuuauaaaacuugucucugggacaugguauuagcaggauguacagaguuccuuuuuggugccaugcuaggaggagagacugacagagucaguccaguccauucauucauuugauagauaauaaguaaaccacagaagaaacgagaauaugucaguucugacuguacagguuuuaagauuuuuuagacuuaauauugaaaacuaguuuuacuuaauguucuaucaguuucauuuaaaugcccuaauccaaugaucacuuucauuuaaauauccuaaucuagugagcagauagggcuuacauagcauuugucuugaagacguuuuaaaaaugcagcugcagguccucaucuuugaaacuccauuugguaaaaauggccaugucuaccuuuaccuguagauuuaaguguccacagucgcgggaugagaaaagaaauugugacacuucuugaaaaauggucucaucaaagggauucaguugaaaaugugagggacugcauuuaaacuuugauaaaaaaaauaaguaauucuaaguaaagucuguagccaaacuccuuaauugugaugcauuugcugaguuccccucuuccgucgucgggccugcucugaugccauauggccuaccauggaacauuuaacuugucagauauaauggauuguccuggaagcagauuuuugcuuugagcacucggcuccuuucuugcauuucacucucagcuccaggcugcaggaugaaggauugugguagaagugcaaagaagagacacacaguugauuccccuuaagagagugaccuauaugccacaaaauuuuacccacguaaagaggcauuauccccgucacuggccuuagcaggcugcaugucaaagucauuuaaauuucccuggacuuaacagauuguguaaacauuucagaacugagagcuuaggaauaaugaaacaucgucauuuuaacuuaggcaaaaauggugcagccauauuggccaaaggaggcauauuauuuauugugaccuacauguaacguagaccaccugguuuuuagauucuauaaauuaaguucucucaaguuuaugaaggaugcuaaaaaauauauauauuaugauggaaauguuacuuggcuuuauuguuuuuguuucgugaauagagaggugagguugaaaugaucauuuaggaaucgcuucuuagccuuuuggcuaagaucaagugaaaugaucauuuagguggagggacaguggcagcuaauuauccuaccaggcuuucuagcuugaaacuuaggggcagaccuuccauucauucuaaccuauuugaaauuagagauuggauguguuauggacuauuuaauuuuuaucuguaaaaguaaauaauguagucuuuguucauuuuaauuuggugcuuuuaugaguuaauuuuuuuuucaauuugugcuauuguuucaacaagcuuggaaaacaguaggaacaauuugugacuuuugcaucuguaggaaaacuucuuuaaaagaauaaacagugcccuaccuauauguguguguacauacauagcugugagguacucuucugguauaaccuacuguaaaccccaaagcaaauauugugauauagagacacagaauagacaauuuacaaguaaucaaucaagcacaaaccagugggaaaauaaggaacuuauguaucucaauuuauucuuuaaaugcuacauauuugauugcuuuaggguugcaaaaguuaauuaauagauuuguauaagacacacagaaauauacauacacuaaaagagacuuugcuaaguguaauucaauauacucacaaaaauauguguuaauuauguuagaaauuuaauauuuaauuuaauuccauaaauccuugcauuacaaauaaguccucauacaggucagauagggcaauaaaaacuacuguggccuugaaaacugacagaagcucacuucuguacaaaucuuuuuaaugaacaacuuuccaucgagcagcuaagaaauaucuguuaaagucaguauuuaauacuaaaguguacuuauguauguuucuuacugauccuaaauugagcacguuaguuuuaucaaugccacucaucggcugacuguaccccuccucccccauacagauuuggugagacuuaguacuaaauaaguuuggggagugccuggccauagccggcucuuguuggggcaugugcgcccucugcuggcugcucacauaggaacugacuggugugugagguucuuucuuucuuuuacuuuucaagguuggguuuuuuuuguuuuuuguuuuguuucaauuuauuuuuauacaacugaucagauauuuaccaugauuauaaaguuguagcuuaauacugaguauggccguuaauuuguuuuuauuuggaaauaaaggugagguuuuguuuuggguguguuuuugguaaauagauaguccugauaguucaaauaacaugcaauguguguaauacucuugaguuuuuuaagugguugauuguauaucacgauuaaccauauuuucauugcuuucauauuccccuugccuugauuguauuugagaaguauucuuguuggacuaaguugggaauagaacuuaaaaggggauagauaagucauugaaauuuugaaauaugauuauuugucuguaauggaugugguagguaaucccuaguagaaaaauuccuguuaugguugguugauaguuuucacuugcuuugccaaggaaaaugaguauauuuacaucauaauacuuuauaaaagcauuuuugguuuccuugcaaaccaaauuaagcugugcucacuggcagacauugagaaugguaguuugaguaaaauauuuuuuguuuuguuuugcuuuugcaguugcuguuuauagaguaugagauguuaaaggaacaaaucacugauggucucuuuacucccaggacacaggacuaaacuauacaagggcaguuacagaggaagagugucagccucucuaccauugccuggguggagagcauccuuggguccugguagugaaggccagggcucuguguaaugagugugucuuuuaaaaauagcaacaauuuuuguugacaaggcuccaucaaagucuuuauaauaauuuaguuuguauaagugauuucuguguaucucugaaauuaaaugacuugauggagucaguuugguauuuguuguacagagaaggcaguuuagauuuuuauaguucuuuugucuuacauugcaaauuuuucuaauuuguaagcaaaagccauaaaaacuuccaaaccaaccguggagugaucaaagaacuuagagcuguggaagggcagaaaugucaucuacguuuuuuuuuucuuuucuuuucuuucaguuuuuccccuuugcaauuuuagguuccaguuaccuuaaaauuuguuuuggauaaaugauauaaauuuuuacuuaauagucuuuacuuacuuugauuuaacauugucaaauaacuaagaauugcauucuaacaaauauuaaguccuuauuaccucuguuagaaugucaucuugcaugaaaucucacauacaugucucuccuguuaccaccuugucuucaaugagguuguauugggugcucuuucuuggugcuucucuggguucccauuauaucccuuacugguggauagcauuguguuacuccugguauuuagucaucuaaacucuuaccuccuugagaauaaugugcauuguugacucucuugcauccagcacauguuacacagaaagcacccaacaaauauuaaauucccuauauuguguuuuuuaggccucauucaccacuauucagaugauaauuuuugcaaguuucaggauuaaaaauuguggucuguaaacauaguauauguaaugcauuuuauuuucuugcauacuuuuuauaggaugaggucauucuucuggcuacuccuugucugcuuucuuuuuucucuuuuuccucccucucauccuucccucugccucuccucuuccuuccugugcuccccaccuuccucucuugauugagucaugcuccuagauucagucauugagaggcuucucuuaaacacugcagcaugggaccauucaucuaccaaccuuccccuuccuugaacaauaacuagugcugcaggcugguuggacucuggggaguguggcccugcguaucuggcaguuugguuauuauuaugggcccauucucuugaaguugaucuugaagagcaggcuuggcuggaaaacaucauucuucuauaaauauaaugguuagcaaucuuccuacucuuugucuuccuuggaauguguuuucaauucugggcuguuccucccacuccccuccaguuucucucaguagugcauguuuaggggauauaggucaauuguauucagugcuaaggcuagagaaaugaucauuuaauauauuacagauacguauacaaauggcaguuggauuaucuucugucugggguuaaaaaugucacuuauauauguguguuuauguauguauuauacauaucuauauaccguauauaacauugucauguccccccccauucuuuugauguaguuuugaguaucauauccaauguguauaguuuaagagaugaacauuguuauauucuuguucacuguaaacuuagcuugaaaguuaaggccaucaccuguguaccauggugcuaaaauacauaauuuuucuauauagacaacuaagugccuauguagacuacucuauaacaaacaaaccuuuuccucucuuuuccaucucacuguggcuuauuuagaguuguaucauuuuuaucuuuuacauugacuguugcuaagacucugguggaacauucaguuaagugagcagcauauaauuuaugauuaaaagugauuuguguggugaaaugcggcugcugauuuccuucauauuuuccaauaaauuccaaaauauuuagccaggcaccaaagucuugcccagaugauguugucucuauuacauucagccagaaaugucacccaucuccuccaaugaaagggaaaggaccggauuuucucccucacuguggacuugucaugccuccacagaacguggacagagaagggguagaaggacccuuuuaaaugaacgaaccaggucagguucacuagaguuggauccuggauucuaaaggugacauccacucuugagauagaagagagaugcuuucagagcagcgggccagugggucugaucaaugaggagcaaccuuaacaaaacuccgggauucucauauuuugggauacuguuguuuauuaggggaaucgauuuggcaauguaaaaucgauuucuuaaaaaaaaaaaaaacagccuucauuauuggagaugagcacauuuaaaggccuagcacgcugccagagaaagguuucucuaacccaugaaauguaacugucugaaaugaccuuggggaucaacaaguccuugucuuuuaaaaaacucugcguaaauaggugagugcuaguaguaaucuacuuuuuguuaucuaccauguuaccaggucuauuggaguuuuagcuaauguaaccuauagagcugugccuaucacuuaaauugguugcuugucucccuagcuggucagaauaaccaguggaauuuuauuugcaagaaaaaaaaaucuguugggcaugguggcucaugccuguaauccuagcacuuugggaggcugaggcagguagaucacuugaggucgggaguucaagaccagccugaccaacauggugaaaccccaucucuacuaaaaauacaaaaauuagucggaugugguggcacaugcguguaaucccagcuacucgggaggcugaggcaggagaauugcuugaauccaagagauggagguugcagugagcugagacugcaugccacuguacuccagccugggcaacagagugagacucugucuuaaaaagaaaaaaauaaaaauaaaaagagagaaugccagacucuaccgaauucacguaccauggagaagagaacccaggaaucuguuuuuaggaaaagucuugcugauaauucuccugaucagcaagguuucuuagccaugaauugaauuugaggaaauugcuuuucuccacacucaccaucucaucacaagucuuccuucugccuaagaacauagugaaaauauuuuauuucugcgugcuuuugacaccuuuagcauguauugcaagaugagcuuuuuuucauuuuuauaugaaaaacuauuauguucuuuugaauaaaaaauaagcuuucaaaugcauaugcuguuuuuucuaagaccacacaaguccuuaauugccuugguuauauccaauuaucauagacucaaacugcaguaaaaauauaagauaggguaggcaucacugugaagauguuauucacauaaagccaaugguaaguuacucauuagaaguaaguugagugauuucaggguugcccuuaguccuucaggucucuaggggacccuuguacaaauugcugauucagaaaaucauuacuuuggugguucaagugguacuuuaguggccuuaaagaguuauuugacacaccuccccaaacagcuaaguuauccccaugauuauguugauuaauugcacacucuguggaauuaguguuauuuucaaugaaagauuuuccugcguucggaaaaucaagcauaaaacucaugugcuuuaauuugauaauguguguacuucuccuaagcaggaugccaagugaggggcugauuuugguuguuguugucugggccaugugaaaucaucuaggacaauauuuuuauucugcacugaaaagguaguuuuugauggacuguaggauguucacucaaaaugcuuaucgauucggacauuuucauccaucauggaacuugagaacucuuugacuuuaugaauugaguuuaaauuauuuggggagaggauuacgguagugagaaggcaaugguuguugcuacaguaggcacuaauaaugauacaucuagaaaacuccaaacggagguggcauauugugggaaagccuugguacuggaacuggaggucugugugcuaacuucaccacuucauaucugugcagccuuuuuaacuauaugagcugguuacccuuaauuuuagugacuucgucuauaaaaacauggacuaaaaugcccauuuaaugagcuuuuaggguguguugccuuaaauaauguaaguuaaauuugcaugcgagauagugcauuacaaauauaagugcucuauggagaauugaauauagaaucugaaauucuucacuuaggcagagcccugaagugaagacuuuugguggcaccuuaagauacuaucugggguuucaguacccacacuguguuaaaggcagcacaaugccuagaugagaugaggggaaucagugaugaaaugcagccaaaacuccccaauuuccagugggaucagagcuauaggccauuacugaguauucuauuuuuaggacuaaaagaacaucagcggaagagagaguuaaugccagucuuuuccagaaaaaaaugguuuacugcccauuuuucauuaucccuugauacauacaagcuaugugccuaguuaguuaccuuuucccccauuugucuuuauaggauuuccuagguuguuggaugacuaguuuauuugcuggaauggaguuguaauucuuuuagcacaaauuuauuuuacauuuagauuuuuaaaugacuguggaugaaggcagaguugucccuguaucguaagauucuguaggagagaaccaguacucuucucugaaauguuggaaauugaaagaauaaugucagcuucugcuuuuuuguaaacccagagucucaccuccaaacugggaucaggaguaaaguugacuagcuagucagaacaaugaagcuauaccugcauggccacagauuaccguaagacauauaagccaauagaaaccagcaaauuaaauagucaaaauguuuucauaucaauuuaaauaaaauaaaaauuuaauuuuugaaccuacaucauuuaucugauagaaaacuacaaauauauaguaaccugauauauucuuaguguuaaguuguaaauaauaguaguucugaaaggucaucagcucuuguauuaauagacacaaaaaagauggggacgggcauguaugcucaagucaguuuaggaaacauuguauaaaacuaaauugaaagccaaguacagugucucaugucugugaucccagcuccucuggagagcagugcagaagaauccuugagcauaggaguuagagagcaccuuggguaacauagugagaccccaucucauuaaaaaaaaagaaaacccugaauuaaaugucuuaacugcaguacuucucaagagucuuuaacaugcuagauacaauguaaaucuguuggggggcagggcaauagcuuguaacaguucguagauucuuuuaauuagucucccuuuugguuuuuggagcccguugugggaucacuauucuauagaugacacugagugaugcuggguuguccuguauuauaauuauauuuuuacuuuuacucuucuguacaucuuaauacaaagacauagucuucacauagagguguagaaaugcaguuuucugccauguuuuuguuaauuaguugcuuuguguuaaugugcggagaugguggcaguuuauuguaagaugucacagaauccauguguaucauuugugcagcuauaaaguaccuagagaccuuuuaggaauaaaacaccauguaaauguaaauuaucauugccuauaagacacuuucauuaauuucauaucaaauucaugaguguuuugagcucugggauuugagagucuucagugucgggccucuaguuuauuuauacuuuuuuuuuuuucccccagaguuuaaacaccagcagcauagcauagugcuaagagcacagucugggcaaacaaacugccaggguuugaauccuggcucugucacuuguaccuguguggcugugggcaauuuucuagaucucaguuuccucaucugcaaaaugguguuucuauuaccugccuuaugggguugugcagauugaaugaaucauuuuauguagagcuuugagcagugguuaauacaugauaaggacacagcuauucuuauuuggacagggaaggaaaaggcaggcauggaaacgaugaaggacuguaaauaauaaccucauguauguguucagaacuacuaaaaaguucaguuguuguuuaaugaacuaguccuuucuacauauauauagauucacaggguaaucagagauggaugggacuggggauggggacagaaauuuauucugagucaaacauguuuaugaugaguucccuagucugaugccagggaacaaaaggcucauucuucaguucccagaaugaggauuaacagugaaacagccuugcuugguguuguccugcagcaucagauaauuuuucaucaaggcguuucacgggaugauauauucucccauauagaugaaucuauuucagcggugggugaaacaccuaccauuuauauauaauuuuuaaaguggcauuuuacaaaugaaaggcuacacaaccaaacaugacccuguuauuauccuacuggucaaccacaagagggaucaucucuguuagagcuuaucucuagaaaucauuuuauugauaaguugcucgucugucucuagcucuuucuaggugguuuagaacugucauguguauccaggggcaguaaucuaccaaaggugauccuucuuagaaguaucccuaugaguggaauggauuuaugagaucauuuuuuucccuucauguaauauuuucauugucacccaguucccuuacaauaggauaccauggauguaucggaagaaaaauuggaagucaaauggcugauaauacaagaauauaaaaauauucaauuugaaauucuauagacauuuguuaaccauaucacccucaaauaaaaagcaaauuuuccugcuccuucuugggacagcaagauaaaagauuguugaauagaucagcaaaacauugacuuuuuuuuuuuuuuuuuuauauggaaguugcuugccuuuccugcucauauuaguuuuucugggccaggggaagcaagugaauccuuuauugauugccauuuggugccauuuuuaauaaucaaauuuaaauauaggcuuuagcagcggacggguucgauuuggacagaacacauguugacuuccuggacuguuugcucacuggagaugccgacuuguucuguagacggggcugcauguugaucuccuuugucuccagaaggauugauugacggauguugugucugcucauuuacagcguuuuccuuguuuaauuuaaaaaauugugacauaguauuacauguucccuuguauacaucauuuuugcagaagaaaguuguuuagccaauaugucgacuuaguuuaugaaauccucucuauagcuuucauucagcccuucguguacuccauuaggucauauucauuucaugcacggcaaaucgucaccagcagcaaaauuuaacauuugguccuuuuagguauaaaaaugaaucaaaugccugacaagauuuguuucugguauauauuucagaaucuccccccgccccccgcaccaaccccaucuuuaugggcauacaacaaauguuacuaacggguacuuuuaguuuuaaaaauauggacaacaguacuccaugcaguaaaagacuugagcgauuaaugcuacccuuaugccucuuuugaguaguuuuagccauggggcuuggcacugccaccauugucuuugugccaaaaaauauccgcagcggcugucgcauucuaguaccggaggguugucucgaaaauuccgcagugaacgcgccggguuuguucaucacugcuaucucuuuuaaauauuggaaaaauagaaucuuuagcucuuucaaagccccguugugguuguggggauggggggaggcggguggugaagaauggagaaaggaggaaagaggcuguccgcgccagccaguugguauaagugacaaaaauccaugccugacauagaguaaacacagauauuuaagagcuuuuguguucaugagcacagauaguuacuuaaggauccuacucaaacauguuaucagcgcucuugaaaauuuuauuaucugaaacaaauguuccaagugaauuuuaagcagaaaaucaacaucaagaccauagcuaauuuuuaauggauaauuuacacaaaagauaguuucuuuucuagaaacugagguguccuuuuaaaauggcugcuuuuagucuuuaaaaaaaaugauaggaaucgcgauuuuauguuugagaaggugcgugggcuuuauccacagugccugauuauuuugcucccaaacagggguucuggcucugagggcagauuuauaguugaauuggggaacaaaaagauguaauaaaguuaaaagcuuacacuaucagaaugaaauguguuuguucaugaucucuggaccgaucuauuugaugguaaaaguggaugcuacagaugaaaucuuuacaaggagcauaauccuuaaaaaaaaaaaaaaaaaaaaaaaguccaccucccagccuccugcuggcugugcugccucuuugguaccucgcagacuucgacagagcccuggacgggugcccauugaugucauggaaacacucaaauuacugagaaugauucaugucuaugcuggucucuuauccucccccacacaaacaggaguagauuuuuaacccugacaacuuguaauuugcaguggguuuauuuuuguaucuggauaaauauuuuuuaacaagcaaaauuaagauuaagcagucuguaucugauaugauaguaaagaaugcuggguuccauguagccaagaguacuuuggggacucugcagcgugaauucauauucuucuccuccuccucucccuccugccucuuucuuuuccuaccucuugcucuuugcauuccacucuuccucucuuuguuuuucuccuacuuauucucucucuccuuuuaaaauccugcccuuuuaucuuuaaaauaauggaaggaguagcccaacuuauaucuauaagugaggcaaauccuggcagaaagauuccucccuccuguucuguguguuggagucaaguugggaaauaaugcugaguggugaaauucuacaggggauagcuucaggaauuccuucuagagaaaaaaauagaugcuuuuucuuccuuaaacuguauuuuacaauuuggauuuuuagaaauuaccaaaacaggacacuagauguucaguuucuuaggaagucagagcagauucuacuuuauccaucuuucugucuuucugccugccuccuuaccugcccagcuuccugccugccuaucuaccuguuaaacaagugaauauuacaucaaaguaagugauguaauggugauauugaagcauucuuagaugcaagagcuuaaggaaggacacgcguccuuugauagcucaugaaggucgagccuuuucuguuaguaauauuuauagagagaaguuaaaggguauaaguagcuuaaauuugauguacacagaugaguaaauaugucuuugugaccauucacacugcugauacaaguauaaauuuaucuuuucuucagugcaaaauccucauacaauggaaguuauucuguuagaucuucuaagacugacagucugugcgauggugucuuguuucacugaaauugaaacugauauggggcauugauuuuauacuuugcgcugagcgcuagaccagaaauggggcggagguguuuucccaacuuuaagauucauuaaaaucaguagaaaaguuaauacugggaaacgggguuaauuuuaagacuuagguuuggcuuucuuugaaaaccaccauccauuuuauauauguaaugacuuggauacaggauacccuuuugaccacauagaaaaauuuauggauauaaauguaucaaagauacauucuuuguguggggucaggaaggcauacucuaauaacauugccauugccauugaccuaaaagauaaaaagacuacuguuacuuuuagcauucguguugaguugagaggggaaaacuuggggguuguaaacuucagaaggaaaucuauucagccucucaaaauacaaguuuagaguuuuccuguuggaaaaaggaauacuguaguccuauguaucaaguacaauuacuguaaagcuccagucuugacgaaagaaguauccuuuagacuugcgugggguggggucuuaggcaccugccugccucuuuuagccccuuuuaauguucugguauggacagauuucuacaaugauucuccacaugucacuaucuggacucuacugcuuagaucucuuguaaugugauuucauuauccucccuaaugauuauugggguuaaacuuuaaaaagaaacaaaugaacacccuugauuuuauucuuagauguggccgaauagcaucgaagggucuauagaucucuguagagcagucuacagauaaaaauuggguuguuagaauuggaacaagacauucacauuccaugaucccuuguccugcugggucuauugguggaaucugaacuuggguucagaguaggcaauuuuucaaaagcccuguuucccaaauguaaauuccaucaucaucuugaucaugaugggguucacuccugggaaagggaguuuuuaaaaaagagagagagagagagacucagaauuuugaauaguuucuuugcuaaauucaccaucuggagagccugugauugauuaguuuuggccucacuauuaagugucaauauaaucaaugggaauuacuaggcuagggucauuacauagauaauuugccugcuguguaaauaaaaaugaaauuguuuaaauuuugugcaagagaaagugaaaauaaggaguuacgauuuguuuguuagagaaaguggaggccauuggaaugacaguuuuuggaaguguggagcaguuuggcuaagaauaggaaugaaggauauuuuuuuccaguuuaucauagccagagugaggaaguguuauucccucucuugcuugcauacauugccaguagugccuacuuuacguauguaaacaucggggaagagcaguagaugucuguuaccuggaggagauuuuuuuuuaaggaaaaacacaauuuacacuuuuuugucguuucucuuggcagguaaaacagaaaggggcucauacucaucuuaugggagagaaucaaacuuacaggguugccaccagguaagugagaaucucuguugcggaaggguugagaggauuaaccugguaaaucaguuuguuuucuaaauuagaugaugcauuuuaaacugugacaccaaagaugcaccggcaagucagaugauggcucucucuuuaaguaaugaaauaacacagagcuuagaacuaauaaacaccucaucuuuagaucgcugcuguaucagaacuacauucaugggcuuguuuuuauuuuuuaauccaucagccgguaccaguggcacuguuugcaaaccagcaaugucggugaaagugguucuauuaaaagaguuuauuugcaauuaagaacuuaagaauuucuuacgcaggaaauacuucgcggagucaugugucagacccuggguuucggguggcuauugcccuaaauuauaguuuucauaggggcuguaugauguugugugaaaacaggguuguauugagggauaaaaaugucugugaaaauaugauuuguugucccuuuuuguuucugaauuguuuuuggcuggaagucaaggccagcaggcuaacagcaaagccgucucaagggaagcaugcgugagcuagaaaaauaagaguacuuuaauuaaauaauaaaaugccaguguaauacaaagguauagcauguguguguuugugucucugggcacuuugcauuuguauacuuuaaacucuccagagagagccuauuucuaaaaauacugucaauagcuaaaaguauaagcuuuguuucaagacaacugaguuuuuauagaugcuuucuuuuucaguucaguaucaguauuaaucauguauuuaaaaucuuuuuuaaaaauuuauacuuccuuuuuauaagugcauugguuucuuacuuuggaaaacucuugauggaauuuaauaauccucuuuaauauucagagcucucuacuguuuuuauuauucacgcaaacaaaauguacuuuuuuuuuuucaaaugcuggaaaggggaugcuuacucucuugaacucucucacccucugauguucuugaugggggaaaaaaaucuauuuuaauuuuauuuuaaacagcccauuuaauauaccccugaaaaauguaagcaaaguuuuguuuuuguaauuaaaucgagccuaugaggaaaguuuccuuuacguaccagacauaggaagguacgacuucugguggguugguguguuuguuuuuucccuguauauauuugcauuuuuaaaguuuacucccuuggcccagccaccaauucagucauauucggcaucugaaagauuuguugcauugaggugaacagugcuugguuaagagcuccugccggagugcaguucauggcaguuuguuuggaaagaauucugcaggaaagaaauuuacagccauuccagcgcaacggaaacaucuuuggaaugugagugcaaauguucgggcuagauagccugggcgacaagccucugagugcugugucucugguguaaagcucucaguuccugcagaagaccguguuccugugggucugguuucugagggucaaggcggaggucauuagaguuuuggggagaagaaaguugacaacauccuuccuuucugcagauggucauggcagaggucucuguuuucgcugggccccuuuuucuggucauugagagaauaggcuuccucaccccuguauccuuucuuacuaauaggaauuggcgugauuccucacagacacaaagauuuccucugcugaguaagcgugaggccccuuaacuugugaaagcaucauccagaccgugugagucugucuguguaugugcagaacacagacccuccuuucuccguuuguggggaauacuucccucgggugaaacugaaguuaauuuuuuuuuuuuuccaaacacaaggugagaaguggaaaggggcagaggguggaagagagguggauggauuggcaugugauggcugaauuucugggccuugggagguucguuuugaggcauuaauguccaggaaaauucuuuuguauauagcacuaugacugcauaugcuuuucuuaaaaagccuucguaauguagccguggaguguggagauuccuucauucuuaauuugugcuucaugguugugagucuugcaagagucuacuaucucugugcuuagcguggucgcagcaaucuccauaaacagugugauuacuuagggauaaauaaaagugaaauuuuggaaauuugcugacagagggaaaauagggacugaagaugaaaaauguacagaguaugaauuucugcuuucugugaaauuugagaauagaacagaccauagugugucuuccagugaaucaguuucucuugugccguauuguuauuugaaucccugucuacaacaucagcuaugcaaaccaaagagaaaggcaaaaucucaguaucuugggcuucaagucuaaauagcagaucacagcugaaaugauuccccacugugugacaaggugagugacucguggaggggaggcuuuuguuuucuucuguuuacuacaugauugagauacggaauaggaaaccuucagauggugugcccuaaggagcuccaaaagcugcuuuaucguauuauaacaguguauccuauggacuuaaaggggugagcagugcuauauggaaacaugcuucuuccagucucaauagccuuuuguuugguguagagacagaguggugguaagcaacagguagcaaagcgcuguccuggaggaauacauuauuauugugagacguguguuguuucagaaauauaucaaguuaaaaauagauauauauuuuagauuucuccuaaggauuuaacacuaauacugauggacauaugacgcuuuuuuaaauggauauauuuuagcagaagaaugaaagccggcagguucuuuauuagcaauuaaguuguuuucauuaaaaauaguaaugagauauuauuucauuaaugcauuuccaccugaaguuaucagaaauaaacauggugacuuuuugagacuuuuaaaauuguguugaaaaugaaucaauagauaagcaaaaguagccaaacgaacuuuuuugaguucuuacuaaauaugacaaaacuaauuuaaaucaaauugggguacagaaaucacacccagcuuaacauguucuugccaaaugguaaccucauacuccuuuuaacuggcagagaaaaugaaauuuauaauggaaagucugacagaaacgaaaaugagugggaauaaaguuuuuugcaagcuaguccaaccuuaauacuauaauagccaauaacuaaaacuuaaugggcaucauugcaaaugccagaagggaaaaaaugucauuuguuuugguuucuuuuugcugcuuugaauagaauguugggugauuugcaaacuuuuaaauuuugcuaaaaucuauuuuuuuaaugagaugaugauaucaaaacaaauacuuguuauuacuucuccccuuaaauggaaguuuagaguugauuaucaggaauuguuuguauuuucuuucugggauauagcccaggucuaaagccaugguuucauuuuuaguauugugugugugugugugugugugugugugugugugugugugugugugagagagagagagagagagagagagagauggggagagagagagagagagagaaagaaagcugccuaucugagaccaaucaaauuagaaucuugugagcugggccugugcuuuucugacaacuccccagguuauucuaaugugcagcuagguuuuaucauuuccuagaauguucuguagaaauauacccuguauuaaugacuuguguucaacauaugaccuugaaaaugcuuuuaggcuuuuugcauuaauuugauuauucaaggcauggaaauauauugcauaugaacuucauuuaaaaggcagugaaaauuagugauauagugaaaaucuucaaaucuuuauauagaauuccacaacugaaugucccagcccauaucuuguuuucucuagugaaguccaaggcuuuaaccucauccaaauucuuuuucuucuucagcaagugaucaaauaggacuuugcugauacaguuauuuaauguuuacaucuuaaaaugacuaauggaauuuaagaauuagaccuaaucuaggagguuguuguuaauuuccagaaacuuggagaccagggaggaaacauauuuucuuaguuugcccauaggcuugcucauuuuugguucaucgaaauuaagcauguaguugauuccaaaaugaauuucacauuucagaauugauuucuuugucuuguuauuuuuacuuuugauucaauagguauuacaaaugacuuaauucuaaacuuuuggccucuuuuaguuuuucuuaucuaaagucaaaauagaaaggauguaagugaaaaccguacaaaauuauuuuguuuauuacgaaauuggcaauugaggccaauuaggccuugcgcaagcagaaauacacaucgcuuuuuaauuuacuaagaugccuaaguguuuauccugaguguucagcacauccaucgaggucuuaugcauccuuccugggaagcucucccuugcagggccuuagcaccugucuucaucgugcuuuuuaaaauuugccaucauuuuuauguguuuguugcaugcugauuuccacaggauucuguaaacuccuggagggcagggaccaugucugcuuuauccugaauguguaccaugugccuagcagggcaaaaauugcaaugaccuaguguuucuuuccucagcaucacuuuuggaagccauuuugagggaguaaggucugaauagcaauguacaugaaccauauugugagcaucuuuuucaugccuacgaaaaccagaaaacugcacucucccaaaaaaguccuuuggaagcucuuccuucuaacaugcugugcaggcucuggaaggacaccaaagucauaccguggagagacacccacucugacuuuuugggggguugaaucgucucauucaccuggugacuucacuguucuaggccuguauaucuggaaaggccugaaugagggaauuauagaugaucugugguucuggcagagguguuguuggaaccaaaggucagcauccugguccgaacauugaaauguagcagugugaaugguaggacaggauauuuuaaauugugacaguuucagacaucacagggccugaguuugcaguauauaugucaucgcagcugugucccugagcgguauuuuucgggcagcggcuuauucauuuugggggauuguuauggguauauacccuucuuucaaaagucagccgguacuuaucaaaggggagaauggguccauucuuucauugcauugguuaagaaauacuuauugacccuguagugguguguuagauacucaggagaaaaaccaagggaucuuguauaccuucccuucuauccccaccagcagcuuccuggauguuaacggggaaaaucgagcucuauuuauuuauuuuuauuuuuaaccuuacauagcauaaauuuuugagcauccagaacaguugaaaaaauaauaaaaugaaugccacauaccugcuauuuagguuaaacaguuguuuguauuuguuauacaguauuuucuuguguguauguauaauauguauaagaauacauauuuuucagugaaccaaccauuuuaaguugcagauuuaauaagaaugcacccauagauuuuucaguacaugucucuuaaaaauaagacauuugccuaacuaacauacuguuauuaucccuaaagagauuaacaguaguuucuuaaucucaguccauauucagauuucuucaguuguccucaugcaaaugucuucaguagcuuucuuaaaaaaggcaacuaaaaugccauuuacgcgugucauuugauuucuaugucucuuuauaauuucuuuuaaacuagagcuguuccucuauuuguauucuuuuuuaaauuguguaauuuauuuuuuagggaugggguaucgcuauguugccaaggcuggacucaaacuucugggcuugggauuuucccaaguaauuuuuuuguugguuuguuugaaugauagugacuuuaaagagaccaggccaacuguccuauaaaacauuccccuuucuagaauuauuagauuucguuuccuuguggugcuguuuaauuuuguucaucacuuguuuugccuacaaauuuaaaauuaguucuaaagguuuaugcagguucagguuaaacauuuucggcuggaguacuucauugggggugcuguguauaucaaauuacauuccaacagaauauugagcuaugcugcuguugguaaugcuaacuuuaaucacuuggcaaaaguggugaccacuggauuguuccauuguaaaggaaucuuuccccaucugcaauuaacaaauagucuuuguauugauacuuuagcaauggacagauaccccuuuuucccaacaaccuuugaccuaauaguuuuagcacacauugaugacccuugccugaaucaguuauuucaacugaagacuucaaacuggugauucuuuuaaaauuccaucauuccuuccacauuuauagcuaguauucuucuauaaaagggcaguuucuuucaucauucauuuuaacacuaucaguuucauguuucauauuuuauauaagugucauaacaauuacuguuucuaauguuuccuuaccuggaggauguuggaagcauuaaaguauucuugaaaucucuuaagguauauugauaagaaaaguaguuauggcucaggcugauggucagagaggcuuuaauuguaagaggagggagguaauuguaggcauguuuccuuguaaacuaaacuucaguauucuuuuggugaaauuuggaaccuugcaacaaccucugugccccuagcuguguuucucugauucucauauugccacucuauaauugcuaguaaacaucucacaagguugaucaucaguaguugacuggccgacucgaggggguugcuguggugcucugugaagcugcgcuaucagggaucagcuaauaaucccugccucaguccuugcacaauccagacaugguugauagugaaugucaaaaugagugaauuucuaaaagauaguuugggcuuaaucuaaaggaagccugaguaacuaguauuaggugccaauauaaaucucugaguugguuaauauuauugucccuuaauaauuaagaaagggaugcucagagaaguaaagcaaguagaccucaaaucauuugcuucaaguaaguuucagagccagacucugaacucuaagauguuuuguuucaaagccagugcuuuccaacuuggguucccugcuacuuaagcccaugaaggaguuuuuaggcucagaaguccauauuaguucucaucuagaaaacccugucuggucgauuccaggcccacugggggaucugggccugacacaguaucuacaacagaguagcugcacucagcuccguucaggguuagcuagaacucugaacagucaguagggaaaggcauagcggagggcagaucgcaucguuccugacugcccagccuuaagggggggaaaaaaagauuauaugaauaaucuauucaguaacauccucagaauuagcaugugcaauuuccuuaaaaccaaugaggauuuccugugaaaaggcugggguggaauaugccaauucacauuuuagcaacagcgugaacacuuucuuaaaaauguauagauuauguuuuggcuuugcuuuuugugcaauguaggcagaauaugguuugcuauuauauaaauuuggauucauuauagaucacauuauuguuccaaaaacacaagagcuacauacagcgagauucugaaacaauaccuuuagcagguucuuaaauaugccccaauaauuuuucgauuauggcauuuagcccucaaguaaaauauaugaaacaacagaauaugugcuaggagcauaggcaaguuuuauacaacaacaguucaggcaguuagugcauaaaaagccauugaaauugcuuugagaugauuuaugagacaccgaagaaauggacuccuaguauccaaauugaaauuucaccagaaucaugggauuaacuucucuuuucuuaugaaaaccauuaagcguuuuuaaaauagcuucuagcaauuaggacuacaguucuucaucuuuauguuucugauagguguaaagacaaaggggaaaaaucaauuaaugacuaaagaaauaauugauuuaaugcugagguguaucugauauaauuuaauguugaaacguaucuacauaucauguagagaucaguguagcucuauagccuccuucuguaagaaaggcaguauacucaaaauucaacaucaggauaguguuucaaugugaaaugacagaaauauuuauugaacgucaugcuugauauuauuuuauuguugagagcuuuuuacugaaacucuuuaaaacugaacccccaaauuaaaauauuggcaacacugaaagauagcaacagaagccuguaaucugaaguaauggacuuauuaaggacuucagaaaaaaagacuuuagaaaagaagcauauaucguugagucugcugccgugccugauagugauaaccugcuuagaauugaagcaccccauucuuugaaaaauugugugcgcucuguggauauugacguggguuuguuuacaugugcuuucacucacagaucaacugagcuuccuaaagcauggaccuuucauguucagcguguuguuuucuaaucucauagaaguaguuucauagggaggagaaaacagaaaccgacaagaauauuucuuugcauuugccuuagcauuuccaacaugcaaauguugcuuuuuucauaguauggcacuuauuuuugucagacauuucuuguacuuaacaaagggcaaaguuacauuuuggcgggagagcgacuuucgcccggcacuucaccagaucucguugaauagaauauauuaucacuguuagcauucuuaggguucuuaaugaaagcuacauacccuuuaucuccauuuuccucuccuuuuagaagacaucuuccaaugaacaauuucuaugacuugaauaccagauauauguuauuuucaagcuaccucaaagccauguuuauaugcauuugcgacaauaacaauuccgugcuucggaauaauuauguaggaguaucauugagguuauuaggcaggacccacccucuagaguucuguacaugggggggucucuguguguugggguuuuacugugcaagcacacagaauauccugagcucauuuguaccaugauaaugaacagcagggcacugaaucuuuuuaguuuuauuggcauuguauacaguaaguuauuaaauuucaucucuguaauauaccugcaguaaaauaacaaaauauuggugcacuuaaagaacauguguguguggaacaaugcccuccccaucauuucagcccccugcaaacagcugcuuacagauuucaagauccauuguauguauucccucgagcccaccucuaauaaucgagacacaucugccauugcaguauuauaggcauauguaguuuuauugaaaacuauaccuguaaaaaaauuaaauaacuccugccucaauuaaauuggcaagcuaccuuuugcaaagaucauauugcagaccucuugagacccaagugaguucauuuuauucuuacauuacaaaucacuaaauauguuauuuuuauuuagcugaguagcuagcuuuccucguacuuugaugguaaguuacuuucauccauucucacuuuuguuuuccuucuccccucaucuuuacauauuaaaaaaauuaugcaaauugcaugaagcaaacauuuugagaaucugaacagaauaaaaucaaagggaaaggacccuaacaugcagcuuuaacucugaagugauuauuaaauaaauacaugcaaagguuacaaaauuggggucaaauuuauaacucacguuguggcuugugauuuuuacaaacuucuuugagauccauuugaucaucauaaugguagaauaggaaguaauaugaagaggaaaugaguuaguaggccauacaaagcauaugcagaugaauuccuauuggauuaaauaacuuaacacuuacucuuaagaaaauaauagauacgagaucucacucuaucacccaggcuggagugcaguggugcagucauagcucacugcaaccuugaacuccugggcucaagcaauccucccuccucagccuccugaguagcuaggacugcaggcauauaccaccauggcugguuaacuuuuuuauguuuuguagagccagggucucacguuguuguccaggcugucucaaauuccugacuucaagccauccuucuaccuagacuuuccaaaaugcugugauuauaggcaugagccacugcacccagccaacagucuuaauacuuguugaagauugagucaguaauagaugucugcaaaauaguuuuuuauccaaagaaggaauaagaguaaaauauuuaccgauauaaaaaugugagccuaaacuuauuuuaaguuauguaagguaucuguauaggucuucaugugaguuaaucaugccaauauauagugauuuaaccaagaagaauuuuuuugcuuuauauuuucauagaaaaaauccaaaaagacaaguugcccacuauaugggaaacauauauguguauauaucguauauaucugaauuauguaugucuauauauaugaaacacacacacacacuguuauaagacaguaagcagguuccuuaucuauaguuucuuaguuaaaaaaacaaaacaaaacaacauuuugugcuauucagaugaacuguguauaacuggaccgagggagugguuagaggugaauacugucccaaagugaacauagagucagaggaaagacucuguugaaagucagaaaguagaugauuucauaggaucaagucacggauaaauaugaggugaugacuguuauagagaagguagaaaaucgaaaaucaagcagugauauucuuuuuuuuuuuuuuuuuuugugggguuguuggggauugggucucuauguuguccaggugggacucaaaccccugggcugaaucagucuucccaccucagcccucugaguaguugggacuguagguacacaccaccaugccuggcuuguaguagcaguauugacaaccagucaggauagaaaauaguuacauguuuaaauaaagaauuuccuucuuugggccgggcaugauggcucaugccuguaaucccagcacuuugggaggccgagguggguggaucacuugaggacaggaguucgagaccagccugacgaacauggcgaaaugccaucucuacugaaaauacaaaaaguuagcuaggugugguggugcaugccuguaaucccagcuacucaggaggcugaggcacaagaauugcuugaaccugggaggcggagguugcagugagcccagaucacgccacugcacugcagccugggugacagagcgagacucugucucaaaaaaaaaaaaaaaaaaaaaaaaaagauuuuuuuuuuuucuuuuagaugaagucucacucugucgcccaggcugcagugcaguggcacaaucucugcucacugcaaccucugccuccuggguucaagcgaugcuccuguuucacccucccgaguaguugggauuacaggcgugugccaccugggcuggcuaaguuuuuuuuuaauauuuuuguagagacaggguuucaccauguuggccagacuggucucaaacuccugaccucaagugauccgcccaccucggccucccaaagugcugggauuacaggcaugaaccaccgcgccuggcagaauguucuucuuuuuugauaggaauguugauucaagucagugaguggucguuugguuccacuugggcuuaccugggcccaggagacucugcucacucuguguucucccaggguauuuugugccccacugcugguucacagagaugccagguuucacggaauggagggcugaguccuagagagggucaucacuuacaaguaagauaucaaacccuaagggaaucagaauuuaaagucuuagaaggguuucaguuuugucauauagaaaaauauugaaaauuaaaaaauauauauauuaugaauuguaaacaaacuuuuugaucaaaacucaugaaaguuggggaauacaccuuaacuugcacccugccacugcuuugaagucccaucccugggaugugguucacuccuguggaaauauauauuaucuauuacauuugaacugugaauuguguuugucacacugagcuaagcagcucagaacugucauguguagagugacugguacaauacaacaucaguggugguaaaagauuuguauggacaaugacauguggcaaagaagaaugucaacagcugccacugcuaugacaucgucccucaaggagucuuucugcaucucugccauguaacugucucagccaaagagaaggcacuaacaugaacuucuuccccagaaugcuacucccaacuagcgaccacguaagacucgcuugagucuuuuuugagggugcaaguccugggugccauuugucaccggaaagaacauuuaaguuuggaguuuuauguauagagggagggauuauucuuugauuuauuucgaaagaacauguucuuaauguccuuuugcagauaauacacacacccuaucaguuuuuggacuccagacugucuccauccauaugucauuaugaagcagguuuuuaucuuauuaugauuuagguaauuguacuagccucuaaaauuuuauaauguaccuuucagaagcucauagaugccaagaucagaggcuccuuuggaguuccaucuaauauaucuuccuuagccaacugguacagauaauuuuaucuuuccucuagauaguuacacauauagcucuagaaauaaaauguaguuauccuaaaucagcuguauagagccuuaaccagcaaucagaccauuuagaacauucaacaauaauacauucuaccaaacucugacuuucuguguucaguagauauuuauuaggaaacucacccugugucccacugaagauccucacaugcucucuagguagaugacuucagcuaauaguauaguaaccaugaggccuuaguauuuaugacuuuucuuuucuuucuuucuuuuuuuuuuuuuuuuuuuuuuuuaagagucaggguccugcuguguugcccaggcuggucuugaacucccggccagagugauccucccaccuuggccucccaaagugcugggauuauaggugugagccaccacaucuggaaguauuuaucacuuuccaaauucguauucuuacauguguuuggauuuauuuuucaagaagccagaguaaaauuuggcaauuaccaaauugugaguugagaaaaauagauaauucaccuuugguauugugcuuuugaauuugaauuccauugauuggauuucaguccgucgggauuaguucuuccaucugugucccuuggugugaugacugacucccagccaccaucugagacugcucggucucccucaucuccaaaaguccucaguuuccagaucucaucaauucugcuugcaagauaccaauaaaucugcugcugccuccuagacccccagucaccaccguggcugcccgugcugcucugaucccucuacccaccuucucccucacaugccuccuguccacugcugcuggagugacagucuccacaaaacauuguuccuuggcuuuggggccuguccuuagcauggugguauccuggccccuguuucugccugcagccucagccuucguacucaccauucacaucucauguuccagcccuacugagcugcuugcaguucccucaagaguucuuucacgguucucucugucuuuauaagaaccugaaauaccuuugccuugccuccccuucuucuugccuuacaucuguucuaccagcuaacucaccugcuuuguucaagauucagggacccuggauguuauaaccagggcagagcgagcugccucucuucugugcucaggaagccuuuggagcacuucuuuuuccucacagucaucacacugucuacagccagagaagggcaaaggcuaggggcaagggcuaggcuugccgucucuaucugcagugucuaacaggggcacccaggaagugcuuguuccagagucacaggauggaugagugaaugaaugaaugaacuagcaauaguaagaaauuguaugugagcauguaacuuacuauauuuaaauacuuccaugcaaauuucuugacuuaaauuaaccaugccaaugaccccugaggcuggauuuauuuauuuauuuauuuuuugagauggagucucgcucugucacccaggcugaagugcaguggugugaucucggcucacugcaaucccugccucccggguucaugccauucuucugccucagucucccgaguagcugggaccacaggcgcccaccaccaugcccggcuaauuuuuuuuuguauuuuuaguagagaugggguuucaccguguuagccaggauggucucaaucuccugaccucgugauccacccgccucggccucccaaagugcugagauuacagcugugagccacugugcccagccgaggcugggauuauuuuuaauccaguuuuauugauaaagaaacugagauuuagagagauuuguuuucacucugaaggcagagaugggacuggggaacaaacuccuuuggauccagauuuggcauuuucuuugucacuucuuuagcacuggauaaaguugguguagcuuugugucauagcaaguagcccacagagucuuuucauagaugguuccagcucucuauucauuauuaacuuagggaucauucauggaggcacuuaccuaguuaccaggcugagaccucugucugccaaugagaaaaaaugugcauuucuaaagaggauaugaagaaccuagcaaucuguauaucaggagcauugucuuuacauagacaaaaaagaauauuuugaauguuuccuguaaguaaguaccaguugcaauagcguggugcguaccgcccaugcuaucuauugcccaucagugguaccucuacucucugguuguggugaaaaggaccaugguccuccuggaaauuucuggcccugaagcucaggggagaagugcaacaccagccacaucucaucccccaaguuucauucuccuucacucucccugguacaacuuggcagaggauggggagaacugggaagaaguggaugcauugaguagaucaagcuuuuccucuucauguuuacuuuauaugauuuuaauuuuguaaccuuguuguaggacauaaaaaaugaaugacaguggacuuagcuuuuauuuauaacauugaaauccuuaaagauagaauguuagagucagaaaggaccuagacaucaucuggcauccagugccgcuuuguagcaaguggaaaacuaaagcucagagauguugagguuggucgucaucacacagcaagcagaccuugcucagacacagccacacaauacaaguaaaauuccuagccuguaacacggaaguuuuccuuugaugucuuuguacccgcuuucuuccaaagagcaaaaggucaccuagaccaugaaguaauagccagcagcagccggaaacacauccugaggaaauuucuagacgauugucccuuuguuaagcuaccauugaaucauacugucacagagccagagggugucguuugcuuguaaauacugaguuuuugaaaugucacuguaacacuggaaaaauguugucucugaagguugccaaagugacagaaucccgacauuguaaauaccagccaacacaagugcuuauaaaugacaggaauaaaauauacuugacuaaauccauaauaaucacugauaacacuguuuacccucagugaccaggagcugugaacuuggauaaaaagcacaugugugcagauaucauuaauaugucugagccucuagccauuccagaauauuuugauggaaaagcucccuaaauauguaaaagcuuugcaauaacuaagaagcuaguguguaagguagggugucagucgucccugaugaaacuagagagagccuugacuaucuucagcccccagaggacugauaaggccucccuuguucugguuagacccaaacucugagccaggcuacuagggcaggcaaugcuguauuuucaguagaugugauucucagaaggcccauuugccagaagcaugagcccacaccuauaucauguuccauggagaaaauguggaaugaacuuagagauuaaaaacuuuggagccauaagugggaggaucccaugaacuacccuuugacuuucaaaggguggauggguggucagaccuuuccacaguccuaauacucuauagcccaggcuuuuucuuaauaauaacuuccuccucucuagaaaugauucucucccucuuuuuucuguucuaguguaaaaauggugccuguguguauccgagucuuuaagaggaaauggacacauuggcaaaccagugccuccuuuggcucugugauguggcugcuguuacuacucaacuggagcaccccuuauauuccagucuccccagaaaugcucaggaacaguggagacucaaugacagaggguugagcccuccugguuuuucaacuggugaaagagaaauucagaugguuaaggagauagcagaguagccagcacuccgggagcugcucuuaucucugcuaugaggcugugcauggggaagaguagggcugcuuggaaugaccuccuuacuuuucauauauugaaacauauuucuuuuuccuugauaugcuccuguauuguuugaauuuuauuuuauuuuauuuuuugugguaagcauuguuuucuuaauuaacaaugaaagguuguagucaauaaacuaguacuugaugagauuugagaaaaacuacaaaacuguagauugcaaguuggcauuugaccaagaaauuaugauugugcuccuuggauuuuuaugcuuaggaaagagugcacaagagggaaaaagcuuucggucagaagauacccauucuaguacuagcuggaauggugguaaagaauacgaaauggucugaauguccauggcugugugauauuggcguauuuugcuguccaugggucuaaguggaugguauuauagcuuugaaagagucauggcaaaggagggaacaggugugucccaaacccuaaugaacucagcagauuggccuggcauucuggcaauguagucauucagcggagccguggggacucccuggguggggacccagcaugcuucuggagguaccugggaggcgcugggaguagggccugcuguacugguuugacuaaugugguguagguguugauguuggagaguugguggccagucucaggcucuguucuggcacuacuccagcuuguuggucaugaaugcagauugagauugaauggcuccuuacauuucccuugaagaaaggcagcuuugucuuccaggaaugagcugauggcaguggccguguggacauucugcagcuuuggcacccaguagcgauggccugauugccuugaaacugggagccucuagggcccugagaacuugagcagggcuggacaagccuuggagcagaacuuugcugugaauucuuucauugacucgcaaaagaugaaggacucuaaucccugauaucuaccuuuccacuugaccuuuuuagucuucaguggucuuuuagaaguaauuuuaccuggccgcgguggcucaugccuauaauccuagaacuuugggaggccuaggcgggcagaucaccugaggccaggaguucgagaccggccuggccagcauagugaaaccccaucucuacuaaaaauacaaaauuagcagggugugguggcucacgccuauaauccuaguuacucgggaugcugaggcaggagaaucacuugaaccugggaggcagaggcugaagugagccaagaucgugcauugcacuccagccugggugacaagagagaaaccaucuaacaaaaaaaguuauuuuaugaaaaacauuuggagguuuucuuuuggguauggcaggcagauuggccucuuauuuggcauaggugaagaagaagaguugaauaaaaguaguuggggcauagaauggccaugcaaguucccaacuaaaucagggucaaguuuaaauguauuuguauuuuguucaaauucaucuuuaucuaaaacaggcugaugcuguuuugucucugugcugcagguggauagccacaaauuugacucuauaguuaccaguuaucccccugccaccccuuguuuuucuuccugauuucucuacuuccaaucagcugcucuuuuagaaaccaauagagaagugagacggggugggggcagaggaagagagaaaggggguaagggggagggagaaagaggaaagagagguuguuuuuugucauuagugaguaaaaaucugucgggcucggguaguuucuuagugaauucagcauuuagugauuagauuagagggguauauuugagcugaagauuuugggaacucaccuuucugcucuacagaaucccuagguuucuccuuuagcucuacuuucugauucauuccauccccauccacugaccccaccgccaauauugagguacuugugaaagcucagaaucuccaguguccucaaggagcuagccccaaagugcccccugguggcuagaggagaaaaagacaagauggaggaugggaaaaaggucagguggauggauaacuuuggcucuucuuuuggcucuucuuuucugauaguauuuuuguuaacagcaucuaauggguugucuucuuucaguaucaaugugaaccagcucugaauagguuaguguaucaauguauuucccuuuuugggugauuuugcugcagggauuucuuucccuaugccaguuuuuguuggucugauuuuuguuucuaggcauauugcauugaccugagccuucucacaguacugaugacacuggggguagggagaacaggagcaguugaagacgacacaugcugucaccucaugugcuggugugaguggcgcagggaagggcugugauuuuuuauaggcacacugauuagccaagcacuugucaccuccacugccgcucauuggccuacugagugugagcgugccaucuaauugacagcugucuguugucagagggccaucuuuucuccuuuucaguuugagugaacacaacagagacaucugcagagcucucugcagcucugacaagguugcccugccugccaacccucagacuucuaggcagcauaauugaagagaucagaaaagaauauuaacccguugaccaucuugggcugagguguaaugaccaaaaagucacuuuuuaaggugacugugagucuuucuuaguagaggaagacaugagauucucugucagaagagucaggccaguaggaagugcuauuucuugguagugauuguucgugggguuucaguucaucugagcacuuggaagaggaugagaaguucauuuucaagguagacccaguguuucauggugggguuacacugaagccugaaugcugggucacaucauucaugucugauuuggcuuguguaaugacaguagugcuuuggauguguguaguuuggaugaggguuacucuuuuucuuuuaccgccaggccugacacugcccuuuuagcguaagauuccagaaucucuuaugcaguagcauggaauguauggccaaccccguaguaacguggacugccucuuugggacauuuccuguaagccagagauaucaagguggacuuugugauggguagauuguuuauuauacagauaucagcuugggaauuugaauguuuaauuauuugccuugucguagugucuucaaaugaagcucuauuugagcaucuacugggauugguacaauaugcagacaagcuggcuuugugugggucgagucaccugugcuugcaggaugggggugcuugcuauauuuggaagugauuuagugguauccuagguuuaucaggaggaaaauacaucuuugcauuuauuugaacauuugauuuagaaagggacaguguguggguauuggauaaauugcuuuuacucuuucuuugcuuugcauuguucuccccucugaugauuugcaacuuagcaagccuucaucauugaaccugggugaaaaagaagaucugagaagccuugaguaauuuguuucagacuguuuauacucuaguguuuuacagaugugggcuuauuugaggaauaguauuggcgaaagguagcgucauuaaacugguuggagaaauuucaggcaaguagauagagaaauuucaggcaacuccuuuuccaaguuguugcucacagauuauaauagaugaauucagcagaauguucugaccuccuagacuaggucagauaacugaguucuuguccuaacucaaauccuaaguagcuguuucuuaaagcucuguucugccucugcagaaugaaggcuuggccuauauaguguaugagauuccuucuagcuucaggguuuuguaacuaucagaauagguaaugaggaaggagacuaugcccugguagccuuuagccauaucacaaauauuuaacauacucccaaaauagcacauacaagacagaaauucuuuguacuugaagggaauaauaaauacagaaagcauuugagaaguacacauuuaauuucuguuaacucuuuuuuucuuauuuauguuuauuauuagaugauaaaugacuuccuuuuuuuuaguauuaaaacaaggugaucaggauagugagaggauugggucaggugaaacacaugacucaccugcgugcuuaugauuccccuuggaagaugguuuuggguaacauucugggaaaacuauggauaaagucauaggcuuccauauuuaauuaauucuaagacuuuuuuuucacauuucaacaucucagaaauuuaugguaugccaauucaauuggcaacuuuuuuccucucuugguaggaaauagauaaugauguuuuugacauucaguggcaucuuauaggugaugaaauacaauucugaggggaggaagcaagauuuuuuuuuuuuuaacugagaaaggcuacgugacuaagugacuucuuuguuucaaugcugacuaaagcugugauguccuuuuuaaucacuuugaaagauucaaauugcuuuaggaagacaauucaugcauggagcucacccucccagaacuccacacuuaaugcccacugaggaaggagagaaaugcaugcaaauauauaucccaauauagaaggaauauucuaguucaguaacuuccacuccugagcuuuuaucaaauuuuucucuauagaauuauuuuuguuuuauuguauccaaaaugucagauaucuuuuucaaggaaggucaagggacuuugccauuuucuaagccagaaguauucucaccuaguccaguacuagucaaaguuuuuaguaaaucacuuagaauuuccuuuuuuaaaaaaaaaaaaaaacccuucuagaguuuguugauaccuuaaagaucaucaaauccagcuccuuauuucacaaaugaguaaaaagaagacauaaguugcuuguucagaguucagcuaggaacuagauagaaccuggguagccugacgcucccauucuugcugcuaaauuccaugcaauguaaugaaagcgggauugaguauaaaaccgauacucuacacaucuuuuguugauauuucugagggagaaacuugaauuucuguaagugcacauagcugguuucccuuugcuuuguauuucugaaugcuacacuugucuucugccuacuacacuuaaauucauaggugauuucacaaggcacagaagcccaacuugucacaugugguuuaauauaugccacacuuuaugcugcaguagcaccauuuggucauauuuagugaacucugugguuguugagaaugccaaagcagcaggcucagcuauugcagcauaggccuguacuuaguuagcaagcuuagcuuaaaagcugucagugcagcuaauguuacaguggcuuacugagaccuuggccugguugugauaguucuccaaaccuggguguuuucaccuuugaaauaugaaucuggauuuagcuuuuucuuagaaaacagcaacaacaacaaaauggugaaaucuuuaagcucguuaaugugaaugcaguaagaauguaaauuuaauacauauucacuuauuauuaaaugcuguuguaaauaacauuuuuagauuuaauaaugauuucccaagacauuucgugcuauucuuuacuuugaaacugauggggugagaagagaguugaaucuuaauuauuauuuuuuaguuaauuaacaugugauuuaaaaaaaucgagauauauuuuguguuagacccuaauuagaaaagaugucaagaauaacauaaugcuaacuuaauuuuaaaauugauaaaugagggcaagaugauuggaaaguauccucuagaucacacaggaaacggguuaauauucaaaugaauagcucugaaacgcuacuuuccuaccagcuccugaagcaauuuaguuuuuaagaccuaaaacugacucacaaucugugguaugaaggauagauguuaauaguuuaaauauuuaggcauugcgugggcuguuuguuaaaccauugguagcuugagauugaccacagugggaguguuuucaccaugcgaaugagcaucccugcucacaguggggcaugagcauagcacugcaggauacggaacugacauuuauuacauaccugacauuuccguuacucuuuuauuuaucguuuugggcugcuuguuuguguccuauccccacuccccaaauucauauguugaaaccuuaauccccagugggaugguguuaggaggugaagccuuugggagaugauugggugaugaggguggaccuccgaugaaggaauuaauguccuuauaagaagaggaagacacacuggggccugucagcggugggggacgaggggaggguuagcauuaggagaaauaccggauguagaugacggguugaugggugcagcaaaacaccauggcacguguauacccauguaacaaaccugcacauucugcacauguaucccagaacuuuaaaguauaauuuaaaaaaaaaaagaaaaguaaaggaagagagcuagccagccuucucucuucuccaugugaggauaccacgagaagauggucaucuguaaaucagaaagaggacccucgugguggcucacaccuguaauccaagcacuuugggagguugagguaggaggaucaguugagcccaggaguuucgagaccagccugagcaacacgaugaaacccugucucuacugaaaaaaagaaaacaaaauuagccagauguggugacacauaccucuguaguccuagugacccaggagguuaaggugagaggaucagcugagcccggaaagucgaggcugcagugagccaugaucaugccacugcacuccagccugggcaauagacugagacccucucucuccccaaccccuccagaaagaggaucuugucuggaauccagccauucugguccugaucuuagaauucuagccuccggaacuguuagaaguaaaugcuuguuguuuaggcuacccagucuuucguauuuuguuauagcagcuaaauugacuuagacaucauuaauuauguauuuuaaguccuguguuuuagcauucuggaaugagagcauugaaaaugaucaucaagccgaguaaauuaacugaauuaacuauuccaccaaaaaaaaccccaaaaacugaaauguucguuguuccuggggaauggcuaugcacuuggaggcugguccccuuccucccuccucuucuuccuggugaauccccugacuuuucucaaucaggcuuucugauguggaggcuuccucugcuucccagggacacacucccuucccagggcuccuggagcugcugcaucucugcuacccugagauguaauucuugccugagauuucagcuccuccccuacacuucagaggcuucaguggacuauuucuuauucaucugugcaggcacauuguccaauguacaaccugcucaaugggcuuguugaguuaauaaacuacucuguguucuguauuauguggauuuagauguuuugcuucuuuuucagccuuccuuucgcacccuccaccuacccgaccccugcuaagaugcuaccuuuuaaagaaaagaaauaaguucuucacacuuuucuacauuuauaauucaauauaaauaacugcuacugguauacuuaaucacaauuagauuaaauauguucuuugaaacagggaggucaucuaaugaauagaagugaaauaugucagaaaaugucacauaacugagagugugacaucuuuaguaaauagaauguugagaugauuuuagugcuaggcuaguuuuguaagagacaucuuauuugacaccuuuguucaaacaacuuuugugguucucaaacuagccucuauugaaaagaccaaguucccuacgucuucucuuugaacacuuucuucuuugcauuaaccuguucuugcuagugcguccaaguguggaaagcaaagauuaguuuuaaaucuuccgggucaaaacuguuuuggcuuuuuucuagagcugauaauaaguaguauaguuuucuguguaccauguguaagagaagagaaaaggucugacuuuauguuagauaauccauaauucgguugcucugucccacuauauggagaccaaagucacacuaaauggaugccuuggguaggggagaaggauguagccuuucaaucagacuucuuagcugcacuagucacauggcuagccuggggcagguauuuaaacuugcuauaccuaagucuccucaucuauuaauugacauuaauaucagcaccuucuucauaggguuuguaaggauugaauaauuuaauguauguaagacacuuagaagagugucuuaaauaaugugagcaccuucuucauuaacauuagcacauauuucauaugauuuugugaggauuaaauaauuuaauguauguaagacacuuauaagaguguguuaaauuacagacugugcucaguaaauguugucuaauauuauuuuuaaacugaugguuauuagccaagcuauaccauaucuucaacuuugggugcacaagagugggcaguaucuuugaagaggucguuguuucucaaucugugggucaaguauucuuagggaaacuuuucauuuugguccaacucauaacuuuagugacauuagucuuugcaauuuccugcugagaagagaagguagccuuucuauuuuuuuuaaguuuucaaagccuaauuuuauauuaaaagaaaacaagguauuaaaaccacguauuucuuuuaacuuauuaaaaggaaauaacacaguaacauuaauaaaaaguuacaaaauggcacaguaacauuaauaaaauguuacauugucuuuuuauucuauagcgugaauggaagaaauaaaguaacuuuucuagagcuacaaaguaguuaaugguggcaaagauucacucucuggcaaugugucuuguuucacaaaguaauacaaguucaacacaguauagaauugccuuugauuucaaaugguaacagcauuuauuggauuauuuuuguagauguucaaugccacaaguaaaaugaaguuuucucuuuaaaaggaugauagauguggcagacccaucacugggucccuggacagugguaacaugaugggguuuaaaguccuuuuugaaauagccagguuaaucugcauaaaggcuauggugcuucauuaagcuuuuugaaaacuuucugggguaggccaaguggcuauuuguaucaguuaaacguaaguacaacuacuuaaaauaacauuucuucccacuugugcuugagucugggucuauauuuuuccugauaauaacaggauaaaaugaaucauuugauuccauauuccaagaaaaacguguccauuagguagaggaagcucuuagaaauuaucuccaagaguggcuuguuuuguaccugucauauuuauuauaagguaaagggagauguagacuggugggggugaugguaguaaauugaaaugaguugccagcuguguugcccaggcuggucuugaacuccugggcucaagccaucccaccagagaagguucuuaaaccuuuugcuuuccauugggcaucuuuaucuacauuuuaccucaucaagcucaucaagugaaucagacgcuuugacucagucauaacauguugauggagagucacuuaguuggaaaauauagacaagaagaugggcucugggaagaacugguagguaggcaauggcucugaaaguguggggcccugguuuacaguguaaugacacccaccauuuagugccucagccauuauucaagugugcugugccuuuccuacuggccacguuaaugagaggguggagauagcaaguuccugcugaaauuuucacaggaaagcuaagcccuuaaaugauguuuugaaggaaugguuucucuaccaucuguaaaaaaggcuugauuaauuauuuugguggcagaaacuauaugcugugcuucagguuaaacagcaggaacauauugagguucuugggaagaguuuuccuacagccaucaaauagguguccacacagguuaaccggacugugcaauaagaaugugggacauuggcaugccagugugaagucuggaaaagucggaugugauauaugcaaguggaagagaacugaaacuaugaagagucauuuggaaagccccaguugugaguuugugauaguugagaaauggcaccuccucuuugcauacuuagguuugagcaggaaacaaagaagugacuugaagucauguuaugaaaagaagaauuggguuggaggucagacucuggauucuagaccugauucugaguuaacuaacauuuuagccuaguuucaggcacuccccaguggcccaaugagccaccccuucuugcaggccucaaaaugcacugugauaaaacugcauaguauuuucuuuuccuuauuuucauguucuaagaaauauuauuguccgggcacgguggcuuacaccuguaaucccagcacuuuaggaggccgaggcaggcagaucucuucagcccaagaguucaagaccagccugggcaacauggugagacccugucucuaauaaaaauagaaaaagacaaaacccugguguggugaugcaugccuguggucugagcuacucaggaggcugaagugggaggaucccuugagcccuggggguggagguugcagugagcugagaucccgccgcugcauucaagacugagugacagagugaaacccugucuaaaaaaaaaaaaaaaaaaaaaaggagaagaaaauauaauaaaaauaauacauggauacuuucuuaaaauaucagacacuugagaauguugaguaaaauauaaaaggacuuaaucuggagaucauugccuuaguuauaacauagaaccuuucuacuuaggagaauuucccucucuccuacucccuauuuguaaaaauuuucuuuuguggcuucagucaaguuucauacuuuuaaauguuuuuguuaauuuuauucuuuguguuuuuuuccuaaacuguauuuuuguuccauuaugauuuuuucauugguuagcugagguauaggaaaguugucuuuuuuauugucuguuaaucuuauaacccguaacuccagaacuuucuuacuagccucugguaguuuuuuuuaguuguuuaagauuuuuuaggaagaaaaucauuggcaaauauugggaguguugucucuuaaagugucuuucuguuauauuuuccuugugcuaguacauuggcaaagacuuacaggagaguguuaagagaauaguggaauacaggucagcuucgcauuuuguugacuugagcaaagaaucuucuaguguuucauuauuaaauaaguuuucuguaggcaucuaguagauuaagaaaacuuucuuaugauccaccacuucuuaaaaugaauguguguguucaaacuaaagagauauauguauauaguagaaauauauguguaugcuugugugcauguguguguauaaacuuuaaaucauccucucaaaauuccugaaguaaaagucuauuuuguuguuuuauguggaauuuuauuuuauuuaaauuuuuauauuuauauauuuuauuuaaaauuuucaugaaauggccaagcaggguuuaauauaaaauggaaacaggguuuaucucagaaauuugguggcuaaauuccuuguaucccgucuuaucuagggauguuguuuguuucaagguucuaccuugagaggagccugucauuuucuuuuuugugugcugcuuugccuaguugacaucuuggcuuuaugugcuccuguugaaugcauugggaaauuuucuuucuucuuucuauguccugaaauagcuuauauaagaggggaauuuuugauauuugggggaaauugcaugggacuuuuuuuuuuuuuuuuuuuuuuuuagacagggccucacucuauccucaaaacuggaauggagugcaguggugugaucauggcucacugcagucucuaccaccugaguagcugagacuauaggcacaugccaccaaucccacuaauuuuuguauuuuuuuguggaggcggaguuucgccauguugcucaugcuggucuugaacuccuggacuuagccaucugccugccuuagccucccaaacugcugggauuacaaaugugagccaccgcgccuggcaagacuaguacuucagaacuggauuuuuuacuaauuuuuccauuucuguuucuuuguguuucaauugugauaguuuuuguuauccuagaaaacauccauuuuccagacuuuaaaauuugcuacauaaaauuauacauacuuucucuuguuuuaaaaaacuccuuaucuauuuagcaaauauauuuuguaauuauguugauuucuguuuucucucuucuuguuuuuccuuacacuugccagagguuuguguguuuucuuugguuuuuuuuuucaaguaccuucuuuugguuucauugauaaucuacauuuuguuuuaucuaaauuuaguaaauuuuaaauuuuauuaauucaucauauuuaaauauguugcacuuuuucuagcuuuuuauauuguauguuuuguucauuuaauuuuuauuuuuacaucuugcaauuuaaggccauuauuuuucauugguuacagcuuuggcugcaucccuuagauuuucuuauauacagcuaucacuaucauuuauuuguguauuguuuuaaauguuauuuugcauucuuguguaguucaagaguuacuuaaaacacuguuuucacagucccacuuuaauaaaauguuuuucauguuggcagugcuacuguuuuguuuuuacuauuuaauuuuauugcauucugaguggggaaauggcauggauauuuccuacuuuggggguaaucuaguaggauuuuuaaaaaugcuuaguuuuuuuuaagcauuucauaugcauuugaaaauaaugaauacuauuucccuauuuuauuauuauuauuauuauuuuugagauggagucucacucugucacucagguuggaguguaguggcacgaucucagcucagugcaaccuccggcucccgguuucaagcaaucuucccaccucagccucccaaguagcugggaucacaagcaugugccaccaaccuggcuacauuuuguuuuuuuuaguagagauggaguuucaucauuuuggccagccuggucuugaauuccugaccucaacugaucuucccaccucagccucccaaacugcugggauuacaggcgugagccacugcacccggccuauuuucccuauuuuaauauauuaaaccuuuuauuacuuauuguccuucuaauugauuuaaauuucugagagauauuuguucuagucuucuacuuugauuauggauuuaccaaccgcucaggguauuuauauuuuaaaaaauauaucucaaagcuguaucauaaaugauuagaaguucaggaauauuuuauauuuuugguggacuauagguuucaucaguaugaaauauccaacuuuuuucuuuuuuuacauuuuugccuuagauuggcuuucaauguauaguaauguucucuacaugcuuuauuuuuguagauuuuauauuacauauuuuuuauauauuuuuauuuuucauagucucuguguuuuauuuuugaugguuuguuauacacagcauuuagcuuuacauuuuucuagccuaaugugacagccacuguaacuuaguugaggaauauaauauccaaauaaacauaguuuaauuuucuuuuuuuccuuggcuugaucacauuuccuuuguuuuauauuuuuugcugcuuaaaaaaaggucuuuuuuuuucuaauggugcaggaauuauacaucuuauuucuugugaaaguuauucuugccuuucuaacucacauauuucaaauuauauaucucuauuaaagucuaaaucuguuuggugucuguaucuuuccuaaaaaagaugacggagaguguuagcacauuuuuaauuacugaguuucucccuuuguuccuccccuuuaccucucauguugagguugauauguuuccuuuuugacguuuuaaauugcaucaacagucacauagagucuacuagcguuuccuugccccaucuugcuaauuuuuguggaccauguuguucuggguuuuuuuggguugauuugucauuauacaguuauauauccuuauguaauuuuuuucagaaguguggggguauaaauuuucagagucuuugcauuuucuaaauugccuguaguuagcucaccuuuuugaaggcaaguuuggcuacauauaaaauuugaguuuuaaagucuuguauccccuuuuucugucacauuuuuguucuggcuugccuugcagcucuaaauguagcaccccaauuaaucacccgauuauugcaucacacuccacuccagcuccauguauguauugacccugggauuggagcauccuagauuuagcuguuucuuugcagucuucuugauuggcugcugcuuuuuggcuugugauuuauuuauuuuuccucuguagagcaaauccaucuacuuuuaucuuuaagaauaauucaaaauuguuauuccaccgaagcuacucuuccuuauuuucuggcacuauuuggcauguauaucucuucuaaauucacacacacacauacacacacacccaguaucauuuaugacauaugagguuagaggaaaaguagaagcuuauguuuaaucuaccaucccaagccaaccccuuuauauggaacuuuacacauucuaaaugcuuucaaauacaguaccuuauaaggaaggagaugcuauuauucuccuuuuauaaauuagaaaacugagagguuauaagucauuuuauuuauuuauucuuucauuuauuucuccauuaauccauuggcuaaauuugcaucaucugcuauguauaagcagcccucagugccagagacacaaaaccccagcuuccaggaccucacagcugagaguggaagcaaguggguaacaauagagacuugugacaauaauuucagcauaggguggauuucaguuccaugcauguuugagacacgugcuaggugcagaggaaccuggggagaggcgucucuaugucagacuucccaguggaaguguugaggaguguuucccagcggaaguguugucauugauuaaaauccaugcuguaaauguaggcaugaguugacugcugugcucuugguaucuaguaaaguuccuggucccugguuggcacuuaaaaaaaaauaagugaaugaacaaacaaagcuuccuuggcucucaccgaagcacuccuuuuguacuaacauaugugauagucuccacaggcaugauuucuuuauuucuccaagcaucucuuugaguagguacagugaaugucuccuguccacaaaugaaggggccaaggcuguggggaguuaagugucuugucuaaggaggcuuggaucccagguuccucugacucccgacaggcaagacuccuacuggcccuauggcccccucauccagauuauuuuagccucuuuuuucaaacucuuuccugcccucugaucauguuucuaccaagaccaaguaucacaaacuaaugaagagguauaacuggcugccuccuggaggagguauuaagaagcauacaguggccaaaguggaggaggaauaaaaauaccuccagagaccucaauaauaccaaaauagcuagucacaccauauaugucuaagcuuugauacagccuuucuacaugacauguucauuuggaauuauauuagacauucagguuugaaucagggcaggucacuugaaaugucucaauucaaugcaaaaguuauaagaaaaauaacauuuccccccacacaaguauauagcauaguauaaaacauucucaaaaacuuuguaaaggaaacacauuuuacaguuuaacucauaccuacuucacuuccuucucccucuccuguucucuguucauuauuucccuacuuacuaacuggcucuuaguuaauauuuucguggccucacccccacaccuuuuuaguuggucucuuuuuugugcaaauugauuuuauuccuaucuaaggagaugcuuucauccuuuuuuucaugcuuugaggccucauuagaucacugcacucuaauuuugggggggagaguugucauuugcacuauauguacagucugagcauccuaaaguucuuguucugagaaaaacaucgccauggugagcggcccauuuugaauuaggaggacuggcuaaggugcucacuuaagcucuuuguaguuuuguucagucaauugaguguuucuauguuacaucuaucugucuauaugucugucuaucuaucuaucuaucuaucuaucuaucuaucuaucuaucuaucuaucaucugucuaucuaucuacauaccuaccuaccuaccuauguacugagcccaggcuggagcaguggugcaaucagagcuuaccguccccuugaccucccagacucaagugauccucucaccucagccuccuaaguagcugggaccacaggugugcaccaccauaccuggcuaauuuuuuuucuauuuuauuuucuguagagacugagucuugcugugcugcuuaggcugcuuucaaacuccugggcucaagcgauccuccugccucagccccgcaaagugccgggauuacaggcaugagccauugcgcccggccuucucuuuuuaacguaauauugagauuggggucagacugugcugguuguggguaaagcuauugcagccuuccagcuaugaaggccugcccuccacgaugggauggccaggcugguaccugagacuaguguuggaggcaguggcagcuucccuuugaucuauugcagaaugcauuuucaaacacacacacacacacacacacaaauaaaacucugauguucacuuuuuaauugaaagcuaaaaaugcccagcuccuuucugcagauugacaagcugauauuucagcaguagcuaaagaacccgguuuaguaagcuacugaauuuugacguuuauaaacauuuaaugaauacauuuuuauuuaugucagcuuaaaaaauacagcugcugauaucugcgccccccaacaacuuuuuuugucuuaaugccaaaauuagaauauuuaaauauuuuaaaauuuccugaugagcaccugugcaggugugagggcagcaugaauucacagggagaguguaugaaguugguuaucuugaugugcuuguggggaauguguauuuccuugcaaggacugucaugugcuaccugauccucuuucauggaccucagccacuuucgccucuaacuugaaaaggaaacuggcauuguggcacaggggccaaagggacacauuuguagccuuguccucaaaucaagugggacuucugguucuuucucugaccaucugcuugaccuucagucuggugucuccaaggagugugucucuauggcaguuuaaaaaauucuguuacacugagaaagagacaaaauguaaaucuuaaaggaaucaguagauuuuuaaccccacugcugguguugagaagacaguuugagucuuaaucucuuuccuuaaguuucaaaacauguaggauuuauguuauugacaugucaaacuuuuuguacuuauucauuagggaagguuucaauacacacaaaaauagaguauuauaagaugcgcuacuauguauucauuauccaguuucaacagacgucaccauuuucccagucuuuuguuauauaguauccccuucacuuuauguuccugaaauauuuuaaggcaaagccuugacagcauauuauuucaccuauaaauauuucagaagcaucucuaacaaauaagcccccuccuuuguuuuacauagccauggugccauaucacagcuagcaagacuauuaggaauucuuaauagcauuaagaacugacguuccucaguugucucacaaaugccuuuuuacagcuggcauguuugaaucagaauccaaaccagguucacacguugcauuugauuaucaugacuuugaagucuucuuaaaaucuacaacauggccagucucccucuuuuuaaauauuuaaacuggguccauuuuccuguagaaagcccacauuauggauuuggcuuauugcuucuuuguggugucauacaccauguucaucuguucuccauacuuccuguaagcugauacuugcauuuagggcaagcuugucuaacccauggcccacaggacacaugcggcccaacacaaauuugaaaacuuucuuaaaacacuguguuuuuuguuuuuuuguuuuuuuuaagaagaccaaguuuguuugcaguguaugaaugucuaggugaggcuggguuaauggggagaaugagacuaacauaacaucuauaacucucaugacuuuuuguuauuguuguuguuuguuuuguuuuuggagacagagccucccucugucacccaggcuggagugcaguggcgcaaucucagcucacugcaaccuccgccuccuggguucaagugauucuccugucucagccucccaaguagcugggauuacaggcacgugccaccaugcuaauuuuuguauuuuuaguagagucgggguuucuccauguuggccaggcuggucucgaauuccugaccucaggugacccacccgccuuggccucccacagugcugggauuacaggcaugagccaccgcgcccggcugaaaacacuaugagguuuuuucauggguaaucuuggauauguuauuugcuucauucaagaaguaguauguggccauucauuucucaagaugcuuagauuguucagugaguucaugugcugcccaccagaucucccuaauacagaguuuuacauugucuuucaccuguuuguuuuaggaucuauugaugauuauuucauuggagguugcaaaauagccauaaguaaauugguuuaaugaagcuucuucucccuacuaaaucuuaucuagaguuuaacuaucuauuaaucauucauuuuugcacauuuuuacagcuuuugugggguauuuuacauucuuucuucuguuugaauauagagggugccuugcaaacuucacucauuucacuagaagaggcaacuguuuaaauccuacucuucuaauauauuuccugguucauguuuuccugcacauucauaaaugaggaggacguugauuugucaguuaucuucagugcuuagaauaguugcugaaaugugacaagaauguuuauggaagaaauuaccuuauagguuguacauguccucuaaagacaucauaggcacuccuacauugcauuggugaaggggccaccaaacagcagaauccugcaacuugguugaacuaugaaaauguucuugauacauuauaauuuccucaaccccuuuagccaguauuggccauucaggcaaaggaauagaauuuccaagacuuguacuguauguuugcagaaggagggaggauggcagauagguuuguguguguugggauggagaaaguaugcaaauaagcuaauuaauaucaauuguuuuuauaucuauauuacacauacacacacucgcauacacauaagcacacauaauuaaucacacccaugagcacauguacacagcuggucuacaccagauugcccugacaauuuuagagcugugugcugaaaaauuuuagaggaauuuggcuuugaaugugcaacacguauuacagagcaaagaucaccuuggguccuaagggagaugacuuucaucucuaccaugugaguaaaaccugggugauugaaccauaaauuauuuuggguauauagaacuuucuucaaauaacacuuaaaauuaaauguccagguaagugauuuucaaaucagaacaaccaaaauuguuaauaguuaugaucaugcuuauauacguauggaaauguauauguauauggaaauauggaaauuuguguauaagcaugcucugcaguaaaucaaaaaaugaccauggagcaaacauaugaaaaugcucaccagcaaugaaaaaaaugacccuauggcaaacaauaaaguaaaaugcuacacugucuuccuguagaggaccuacuagguuuggacaaacuggcugugcucaaauacaugugccaaaauugagcaggcugggugcaaauauucuaagggaauugaaagacacuuuuucgugaaauagguuuagguguugacauuaucucuaaaaguaauuaaaagaugauugauguaguaaauuuucuuuuaagccaugccuuuaagcacauuguaggaaaaggacuguuaaacaccacauuuucuuauuuagaacccuuggggccauagguauuucacaauuuaagaaucauuugcauuuuaugaaguuaauaugguguauauaacauguccuguguaacucuccagugaagucugaaacagccgcaauguauauauagauuauuauuucuauagcaaaacauaugaauagauacaccuaguaagacaaaaacaaaaauuauagauacguagauauucucacauuaguucagguuuugucacaaaguacagcuuucaaaccuucuggaauuuuucaauugagggaaagauugugaaccuucaaaugaacaaauaaauaaauaucuaccuuuucugaagaaaaacaaaagccaaauaacaaauaaaucaagaaucacuuuucaugguuuuuaaaccccucaaauaaaugucuuccuucuuucaguucauagaagauuuagaauuauaaaauaaagaaggccuauccacauggucuauauaugucuuauauaucuauaucuauaucuauaucuauaucuauaucuauaucuauaucuauaucuauaucuauaaacaauuuuagaauuagcucgucccacacaaaaauaguuuuuuuguuguuguuguuuuuuguuuugcuuuuuuugggauggaguuuugcucuuguuguccaggcuggagugcaauggcacuaucucagcucagugcaaccucugccuuccgaguucaagcgauucuccugccucacccuccucaguagcuggaauaacaggcgugcaucauuaauuuuuuuauauuuuuaguagagaugggguuucacuauguuggccaggcuggucuugaacuccugaccucaggugguccacucaccuuggccucccaaagugcugggaucauaggcaugagccacugugcccagccaaaacuuuagauuuuuauccuguuugugccucaaagccuauucaguugaaaggcugaugggcucgcucugagguccauuguuggcugggggagagcauuagggagcugacuuuuggcagaugaggaaaacagcaugaucacugcuuuugccacucugcuuuguggaauugacccacucugaaguuguucucacucgacagcaaugcaggcauuuauccagugcuucuacaagaaauaauuugggcaaaagcaguaaggaaguaagccuuaacagaaaagugggacccagcaauaggagaaucuacacaucugcuaagcccagccaucauauauauauguguguguguguguauauauauauauauauacacacacauauauauacacacacacacacacauauauauacacacacacacacacacauauauauauauauauauauauauauauauauauauuuuggagauggagucucacacuguugccuaggcugaagugcaguggcaugaucucggcucacugcaaccuccaccucccgaguucaagcaauucuccucccucagccucuugaguagguggcacuacaggugcaugccaccacaccguuaauuuuuuguauuuuuaguagagacagaguuucaccguauuaggauggucucgaucuccugaccuugugaucugccugccucaguucccaaagugcugggauuagaggcaugagccaccaugcccagcccuuauauauuuuuaaugugcauuaguaaauuauaaauaaugacagucuccauguggaaaaugaaaaucaacuuagcuuauacauuuuuaaaaaucagucaaguggucuugucucauauacauagaccuugaaagauuuguuuucaguacauucuguagaaggcucuugaauaucugauagacuccccuggcagcuuucaccuggugugugcaugcacagauauaaucaccuuagucuuuauccugcaguaaacaaaguucaagagagauuucugaaaugaagauaaucuucauucugccuuuugccgcuaccuaaaguucccuuggaggacucugugaaguuacucagguuauauuuuuuauaacaaauauaaaccacagaauuugccagaaugagaaauauucugaugaacaucaugauuugacugaggauggaggaauuguagggaaugguuaaacuugaagauacuuuuuagaaaaacaggucaugugcuacagaagcuacuuuuaaaaacaugcuuuuucauuaaauguaaauuuaccacauuauuuuauauaucuucauuaauuuaauaaaacuccugcuaggcuuuuguaaauuuucacagauauaauguuaccauaggcaucuaugcacauguauuuuuguacacuuguccaauauuauccauagaguuaaaauuuuuaacuugaaacuucuaagucagaaggcauaugcuuuuaauauucugcaguacauuuuaacuugccuuccagaaaguuuauaccagauuacauucccauuagcuauauaugaaagugaacuuccucacuggcaguugaaaauuugucuuauuuuaauuugccagauagcuugucauauauuuauugccaaauuucaaauucauuccuuuuauaaaggaaugguucauguucuuccccagucuauuuaguuuuauucuuauuacaauguaagagcuuuucauuuauuaggaguaucuucucauuaaauauuuguuaagaaagauuuuuguucaacuuuguaugguuuggauaauguuuucauuuauuuuuauuuauuuauuuauuuauuuagagacagagugucgcucuguuucccaggcuggagugcaguggcaagaucuugguucacugcaaacuucgccucccagguucaggcgauucuucugccucagccucucuaauagcugggauuacaggugugcacuaccacgccugguuaauuuuuguauuuuuaguagagacaugggguuucgccguguuggccaggauggucuucaacuccuaaccucaaaugauccaccugccucggccucccaaagugcugagauuacaggcaugagcuacuacgcccagcuggguaauguuuugaaaaacgaguauguagucugggucccaauauguucuaauuuuucuagcucuaaugucauagcuaacaaaggccaucucuacuuaauugcuuguacuuuauucucaggcuuuuauguuuuaaccuuugcauuuaaacauauuuuaguaugaagugugaagcaaaaacguaaauuuuuccccuuaaaugcuaaacaaacuuuaguuaccauuuauugaauaauuuaucauuuucucauugauuuuuuuuucaaugacagccucgccauaaaucuuucuguaauauuuccugaucuggcagcagccgcacauugcuuuaauuuacuuuguuuaaaauguauauauucucaacuuacaucuuuguaaaaauuuucuuaacuauuaucaugcauuaauauuccagauaagcuuuagaauuugugucuucucuacccuauccauuuuucucucuuuggaauuuguuugaauuugcauuaaagucuccuuuaauuuugagucauccaaucacauuuaugcaaauacuuuccugggaaauauuugugugaaaagauuuucuuuuaaaaauugauauacaagauuauuucggucuuuuagaaguguuuauacugcugaauccuuucaugauuuuuguuaaacuggcuugugaacuaguucagcaagucagugucguaugcugaauaucuaaauauauuuauaaugagaaauauaagaaaacauaauaagaauauuucugucuuacauccguggagagaaaauagaauauuuauaaaugcaaaugcucuacaauuacucuaaggaaacuuaaagaucacaguccuauucuaacucuguaaaguuauuugcuuguuuguuauuuuaacagcaucuuucucauaagcauuuaaggcugguuauaauguuuugugugugaauauugaguaaaccaaaugauuggaggcccguuauuuuuacaaagauuuuauggaauaagcaaguucggaauggauuucgaaaaagagacagucccuguuucaguguggaagggacauuggaguccaaaggucagggucagauacauguuuucuucuuuuuuuuuuuccuuccuuccuuccuuccuuccuuccuuccuuccuuccuucuuuccuuccuuccuuccuuccuuccuuccuuccuuccuuccuuccuuccuuccucuuuuuuuuuuguuuuuguuuuuggagacaaagucucauucuguugcccaggcuggagugcaguggugcgaucauaacucaccgcagccuccaacuccugaacucuugggcucaagugauucucccaccuuggccucugaaaaugcugggauuacaggcaugagccauuacaccuggccauuuucuuuugacuagagcugaaguucugaaacuagcagucauuggagauaagacaggagaagacaguugggaggcuccaagcaugugauuucaggaaaagcaugaguugauuauugagaauuucagaugugagauuuccaggaacagugugaguccagaagauguaagaaagaucaguggaauucacacaguuugguuauucaugcaucuucgaauauuuuucagauaaucucggguggauacuucaguuauuucugccucagcccaccuuauuuguaaagcaguauuaguagaauccccuccuugagggguucuucauauuaaauaaguugcauagccaacagccugaggcauaccaaacacuguauagauauuugcuguuauuuguaugauugcugccuuuuacugaguggcauccugggcuggugcuugggacucaacagugaggacauucccucccacaucugccuguaaugccaaggccuugugauagggaguggccugaagcccgggguagaggaguggaccuccccagcauagcuggggaaggagucucaaggagaugacauuugaccaguccucaugguuguuugcaaguggcuucucugcuguggaaugggaagaaagggucuuccaggaagagggguuagccuuuguaaaagugcagagaaacguuuguaugagcaagagaguaauuagggaaccgugagcaauuccaugugacucugacuauagguaggcugcagggaagggaagagacagaugaggacugucuuccuagugccuagaacaguggcuggcccauaguagguauucggugcaucuuaguggagaaaugugugaaagaggaaagagagggcugggagguagacuacuacuagauuggcuauggguggagcugggggcucagcauuuucaagcucugaaguuuggucuccuugaaggaacaggagcagcucuggauuuuagaaggccaauucuguccacagugcaccaguguucuaggugagguuggaugauggggagagggaagucugaagauagcauccauaaaucucaugacauuucuaucccagcagugcaaucaaauguugagaauauguccuguagcuuucuuuuagaaaagggguuagcaggccaggugugguggcucaggccuguaaucccagcacuuugggaggccagcgcggguggaucacgaggucaagagauugaaaucaucauggccaacauggugaaacccuaucucaacuaaaaauacaaaaauuagcugggcaugguggcaugcaccuguagcccagcuacucgggaggcugaggcaggagagucgcuugaaccugggaguuggagguugcagugagccaagauugcgccacugcacuccagccugguggcagagugagacuucucucaaaaaaaaaaaaaaaaggguggggggcgggcaaauuauggcuuaaggccaaauccaaccaacagcuucuuuuuauaaauaaaauuuuacuggaacacugucugaccuguuuauuuacauauuauguaugguugauuuagcguaacaauggcagaguuggguguuuucaacagagaccacauggccagcaaugacuaaaauauuuucuaucugguccuucaagaaaaauguuuggugaccucaguguuagaagauuguuuuuagguauuuaauggugccauucuggaaaaguuggcauuguuggaagaguucaaauugaugcauguguagccuaagaaaaauggggccauaucacuuccuaugaagaaacacaccaaaauuuuaauucaauucuuaaguuguugucuugauuaucuaaguucugucucuagucuccuauggcuauuuuuguggcuuugacccuagcugacccagccuauugucaguaguuaagaagguagauuccaagugcucaaugucauguuaagacuuccuugcuaccuacuaagggaagucauuuuuuuagccagcuguuuuaaguucuccuaaccuauuucauaugcuauguucccacaauaaccauucccuucucuugccauuucuuuguccucucuccugcaauguuucuucuacugaaagaauacggcacuacugaaucuguuucuccugggcagggcuugcauuaucccaccuguuccaaauucuuuuuagaaccgggcccuuugggugaaugaugaaccauuuaauagccccauguacuauagaaauuuaaccauuuucaaccaaaccugucauagauaagaacaaagguaagccaucaugugucuagaaaaacauacaacugauuuccucacagacauuacaaguucuuacucuucaaauguacuuuaaaggacugagaguguaauuaggaaucagcagaaguuuuguggaaaagaggcauugagccuuuugcauauuaaggaucaaauuuuauguuuuguaugaagcauucaugaggugauguucuuaaaaaccacuccagaggcacaggaggaacgcugaggacaagacugaauauagagauggaggaauuacgugucuacuggguagagauggagaaggcauauuuauacuagggaugguugaaaucaugcaagcaucuuccauagcuaauaaauuauuuuauccaguuggccuuuacugagggcauacuguguaccggggcccacccuguuggaugccaggaauacaaagaugaucagaguucacuuucugcgcuugaggaucccacagauuagaaaggaggaaaaagaguuacuuuccauacaaggcuauaaauguuacaacaguugaauuuuucagaugaaguggaaggaaacgucuagaaggaagaggacugaaaugaaagaagacugggggaaaagaaauaauaauaaacaaaaagaaaaauaauuugaaacuuuuuagagaagaugauugaccccauuguggagaucaagauuaaagaugaauggcaggcagcuguggagagcagagguggagauauugggaggaucagacuaaagaacugaaauuucaguuguccaagcgggcaugcuguucuacagccucacaugucuugggccuauuagaaauauauauaaucuaucuaugcaugacuuauauaccauacaucacaucauuucuuccaaacuuacauuauaauauaacacauucuguauuaguauauaguaagauuuuaaaauguacaacauauuuaaauauacuccuuacaauuaagccucaguaagugcuaggaacuuugcuaagcacuuuguauuaucuaacugaauucuuaccauggguaggcacucuuauacaacauuucccaggcaaggaguuuugcccaccaagguuagacagauuguccaggauuauccaggggguaaguggcacucacaccagggcuugucugacccuacuuaauuagaugggcuccuaugaaguaaauuuuaggauaagcucuugacuuaaaaaugagccuucuaaugguugugggagagggagaaaaaacaaguuuacagaagauagcgggugaguguggagcagagaacuagcauaggcuuugaagucaagccuaacugaauucccagcuuggcuccacugcuugccagccacauggcauuggucaggucacauaaccacucugaauguccccaucuguacauugggguuuguagcaucugccuuguuagcauguaaaggaucugcaccugugccuggcacuuagcagacacugugacuuguagcugcugcugcuccugcuauaccuaccguccuugccacucuucuuauauucacauccacccauccuccuccucauacuacuauuacuaccuaugcuaauacuauggugguuaugaugagcagcaguaguaguuggaaugccucaaagauaagauuuaugcuaaaaaacagaagcacaguaguuauuuaagaccucgauuugaucaauagcauuaguucugcauuuacuucaauauuuagugagcaugugccauggcaggucucugcgccaggcacuguagaaaguuaaaacaugaagaagucauuuccucuuuuagcugccauauccucuaguuugaccuuuacgccauauacucuuggucagauauucaagaaagaaucuugggagggaaagaguuagugcucaucgagugcagacuggcuugaagcugugcauagcuuuggaaggaaugucaggacuuaaauaauuucaggaugaguugaagauuacauugagcauuuacuacuucuccagauaaucucaauuuccgcccaucaugugauggaggugucaccuuauuuacagguucagauuguuagcgggacacuuuguuauagugauaucuuacagaguuggccauuaggcuauaauugagccuuuauguggggugcuggguaggccacaugacccugguuccuguuuccagggaggccaaccuacauaaaaauggcugucauauaucguugcucagaggggcagauauuuacaacaaccuugaaauggaacuuccacccaauaugaugaagacugacuugugacaguuugauaugccuuuauuuugcuaaaauagcaaccuggccaaauauauuuuucagcacauuuauuauagcuacuuguuuauauuuauagcaaaaguguugcuaauucccuaguauguuaacaggucauauucaaauuguucuauuuuuacuuuggcacaaaauugcugaaggaaacauuuuuaaggcaaguagugauuauagcauaucaacucacuacauagugaauuauauauuaaaugaacuuccugaacugagaaggagcuuaaacugacaaagaagauaguuuucuuaaauucuguauuguuuacauaagauuucuucaaauccauuuuuuauuauagguuacugauugucucaauguuuucuuuuugcuaaauuucuaccuucccgccaacaaauauaaucccccuuuuaauauauaauagaugaccugggauuccagaauggauuuucagaaaccaucaaaaaaccuccucgcuuuaguguauacaauaaauaauauauucuuuuuuaaaaauaugagagucaaauagguauaugcguaaaccuggccaacccuugggcaguuguaauuuccauaccaaaaugcaugagucuuuacuugacuguuacucuguuauacauuaaguacuaguuaccauggcaaccuuugcaucacauuaugacauuuaaauauaaggugguguguuuccuuauaaggaaagacaauguauuugaauuuuugaguguuuggugaaauacaaucacuacuaaaauaaauaauuuuguuuaaggcaauugauuucuuugggaauuacguacauuuccaaccaaaccuauggagugcauucauuuauuuuuauuuuuuugugaugucauggagaaguaaaagauuuuuuuuaaaacaacgcuugauaaguauaacauaauaauucauuaaaugccuauaauuacccucguaaguggcaaaacacaaaauugaaccauauuugagguuauuuaucagugaccaauacuguagcaagaguucgaauguaacaucacaagauuuaugaaauucuaucgcauauaacacauuucuuauuuuuguauaucuaguugguuaacuguaacuaguuuugaucuuaccuauaguugaauuaacaguagcaguuugcucaugcgugcaaaagcaaaauuaaaggagccacugaacucauccuuguggcauuuccaggaacauggccacuuaaauuuaauuaugaagauuguugggcaauuucuuuauuaaauauggaaaaaaccuagucauuucuuguugccaguguagcucuaggccauaaggcuaucaucuuuguuauguagacucccauauauaacucauuuuuaacuuuuuauaguaacuuuuccaaauuauuaucacagcuuguacuuuuuaaucugaaaauagagaaucuaaugaucacucauaacuuuuggugcaucuuuucaauaauaaucaguggauuguaauaugggacuguuuugugugggacauaagaaagagguaagcucugugcuggacccuggcucugcggaacauuuuacauauguuguuucaucuauuccugauaacccuaugauagagcucuuauuagucccuuuuuacacgggaagaaaguaugguuuagagcaguugcauaacucacccccaaauacauugucuguauuucuuugagcuaagguucaaccagauuggucugaccuuaaagcccucccucuuuccuuaauagauuugacuucuacuucugacuuguuacagacacaaugugcaugauauguuuaauguagaaauaaaaaacacugacaaaaaaccuuuaaaaauguuugcuaaauaauaauuucaguaauuuguauuucucugcagcacagcaguuuuuuaagucccugauuugcaagauaucuuggucuuuguaaguuacccaaguccucuuuuguugaaaccaagcauaggacagaaauaaaaauaaauuauaaagguguacucuuggaccuucaggaaucaggaaagaagacuguccaaagacugaccuucaauuuugagcuuugaaguucaaaaguggacagguggaaauacuguguucuucauugcccuuuggugcgagauauauucuagguugcagaguaagugccaacagcagcaaaauuaucgccccccuccugcuacuguaguaagucagcaauggcccuucuguggucagaauggcacauucagcagcaacuauucgacagggauuuacagaaacuuccccauggcuguuaggaaucuuauucagcagugucuuugaaaacccgauucugugcagaauuagcuauguagaaaugaccuagguugugauaaaagguauuuuaaacaaaucuaacuuguaauuucacucaauguguauuuugcauuuaaugccacaaagucugguagauaccuacacauauauuuugcauucauaaguuuuauagugguucagaauuuuuuuccauauuaacauuuuaaaaaauccuggcuuuauagagucaguucaccauacaaagccacuauacaucacuuagguuugugaugaaagaauggaauugcagcugugugaguacuagaauacccaaacaugaauuagacucacaagcauuuggcaauaguucagaaaaagagcuuaaucugguuucaucugagacugcuuuucucuguucugcaacauccccccaagauguugugucugauaccggaucacaacguaaugggagugacgcagaaucgagaaagcccugagaaaccaggggcacauuugcuuuucuccagagauuuucuuucuccuacuucuuuuuuccccucuuccaguuuccaacucugaaauucaaggucauucaccuauuagaugcauuaauuauaagccaaaaaagcaguauucaucguacucugaucucagucauaucuauaauuaaguguaaauauaaucuuccuuuuuagaaauguaccacccacccauuacauuuaaagugcugacugaaaugaaauaauaguucagagcaagaugauuuuaguuuaacuagaaaaaaguugauaauuuaagcuucaagcagugaguucuauuuuugauuaccauucaguuauaaaucuaauuugagauauaugcugcuuuucuguuacucaaguuuaauucaugguuugcuuucuugguuguauaagcaaaguucagugguugaucaaggcuguuaagaagcuccccugaaaaggaaugggggcaggguugagaauguguucgaaagacauucugagaccuauaucugauguaaaacaaacaaauccgauguaaaacaaacaacaaaauuuuaauugaaaaagacacucacagagugcuguauuuggggauuugaauggccaaguuaggaauggccauuugcaggggaauuggcugcagagggugaaccccaaaacauuccaaccugguugauaaagucaguguguuuuauucuuugguuacaguauuuuaggucuuuugggaaaaaaaauuaggagcgaguaaggggaagggcuugucucaucacacuguggacaguuaagcaaaaugcuaaacuauggguuuaagauuuacagguuagcucugccagaugccacaucugccuccaguguuuccuggcagauucgggcagccuacuacugggacccagcauaaccgcagaacaugagcuugcacaaugugaaaaaccuaaaaccauuauaauccuauuuaaggccaggaugaauuugcccauuuugaaaguagauguaguuuucaagcuuaacuuuuauuaagcagaaacuugucuucagagcuauaucuauauaugcagguaaauucauaauauaaacaaauaccuuauccauuuugugcaaaauuuaauuuacuuuaaaucaaacgccauucacuuuuuaaaauucauaaacucagguuuuucagccaguggaaaauuuaucuuucucauugcuacagagaguuaaguaucugacguaaaggccagacaauaguaaauggucauuguucgcuuuauaaguauacucuacaauaagaacacauauauuuuuaucuucauuuucccuaaggagguguuuagggcccccuuaaaugugaggaaauguuuauuuuuguugcuuuagaagaaugauucuauuguccaagugagaaagaaauaggaacaaacaggucuaaggagaaagaaacaggaaugugcuuugugaaaaaaauaaagauuaacaggaaccacuaaagguuuguaagugcuaucugguccuagugcuauguuacugcacauaguccuugcgccugcauauguaagaguuggaugcgugauuuauuaugacuggcccaugaaauuauuuucuuuuaaguuaacaacaauaaggucaaccacagccuguagcuguuuuguaguuauuuuauauuuuucacagcucuauugugaaugcugcuaaaagacaguauagcaaguguguguuuuuagguugaccccuugaaugcauuuaauuucuugagagugaaaaccuuugccaccaggaccaagaggaauuaaccaaugguuaaacucauuuaaaaacacaagcaagcauuucaacauauuugcuuagccguuuucugaauauuuaauauacuucuagagaaagaaaaaugaagaaauaggggugauuugugucuagaauacaaaguuauuuucaaacuccucuuuccaaugaaaugaagacucauucguagauuuaccaaacuguaaggagguugugauuucaaaucauucacagcuuuauugauggaaauuucaaagaaaacuuggacacagacuucacuguaacuuucuuuguuaauaagaaaugcgaagagugaaauuuagguugagauucaaaaacuuuugaaugccacuccuaaaugauaaauuauuuguuacuagauuucugauuuaugcaaaacuuuauuauaauaagccuuauguuuuaguuugucauuguguaguguuuuaauaugucucauaaguucaaaagaggcaauaguugagcaugcagaugucagauuuuuaucugauaaaucugguuuuaucagguauuuaugugguaaacauuaagauacuagcaaugaguuuauuacucaaaaugugcuuucaaucugaaaucucauccuugaaguuguauuuugaaguaauguuuauuacauaucucuugaaaaagucuuaaacuggaaucaguaaaggcgagcuugucaguagcugauuaguccuuuauauaugacucauccaacacucagaaaaaccccuuggaauagagagguucucuuuaugauauuuagcuauauggcgguggaaaggggagguuugaauuuuugauuuuccagcuuaugggucauauuugaccaacugcuuucacuagaagacaugccacuuuguugagcuauuuaggaaucaaaaagacugucuuaauuuaaaacaaggacccuuuguuuuaguuggugacugccuugugaaauuuuucaguucucagcggguuaaccagggaacaggggcagagucauaauuggccuauuuagaguauuuugcaugugaauaguguguuagugaagcaucccuaagucuguugugagugacauggugauuagaauuuagauuagggaaaacacauucuguacuuuaucaaggacaguaauuaguucagucaguaaaaguugauuacaaguaacgauaaaguuagauuuuuaguacuuaauuuuaaaauuucuuuauuaaauaguaaauuuguucuuaauauaaaugguacuaucuacucuuguuuuauugcauaucagaauaauuaaaagaacaauguguucaaugcagaguauaaucaagcgauuuauauauuauggguaaguuucuauguaguuuuuagaaaauguaauauuauauaaucuuucugaugucaucauuuuuagaaguuuaauaauugucacacugugauagguuauuguggaaguuuucuaguguucagguaaauguuuaaucugugggaugugucuuagcuuccgauagaccucaagagggcauucugaaguccuuuguggcuguuagcuuggaauaucugcuauuucuguaauuuugagaguuagugugaggauuugaauuuccucuugguucaguuggcauuuucucuucugugggugcuaugucaguucguggagaaucaugauaugcgguacagagaggcaggguucucagucgaguucauaggcuacacuuacccccaguguaugcagccaggggaaguugugugcguucacaaaaugagguucuucuuguuaaggaaggggaugaauaguucccagauaugagccucagucuagagaaaggaaacauuagucuuauauaaaugccauuuguuuugugaaaugaaaacgugagucaucuuaaaagacuuaaaaaaauauuguuuaaagggaaucaucuacuuuccuccuaaaaguaaagaauuaaaaauucacaaacuuugugauagcuucuuagacugccuuucuuuuggguuuuuguuuuguuuuaauugucucagcuuagcagaugcuguuugcuuuauugcauugguuuaaguacuaacaaucaguugggagguggugaaaguaaaaaauuaaccuuauauguuuguuuucccuuuuuaaccuuuuagcagagucuccuuggaggugacauggauaugggcaacccaggaacccuuucgcccaccaaaccugguucccaguacuaucaguauucuagcaauaauccccgaaggaggccucuucacaguagugccauggguaagguauuccuuuguuugaaugccugagggaugauuaugccuuuuucuuuuuuucuuucuuucuuuaaaauaucgcccccccauccuaccucccaccccaagaaaaccauaaaauuuggcucaguugucagccuggagacuuccccccuaguacacugaguagguacguuaacagcuuaugguagcagaacuuuuuuggugucugcuuaugucuaguuuucucuuagcugcacccauaaggaagcuauuaaaagaucaaaguagcaaaaaguuaaauaucuucauuuuuaugaacaaagcagaauuugauuucugcuagaaucgaaugugaucgugguaacuacaguuugcuaagguaaugauuuaaggaaaugugguaucaucuagaagucuuugugguuuaaccuaucuuaguuaggaaaaugggcauuugggagcugaaagcaucuucauuuucuuucagagguacagacaaagaaaguucgaaaaguuccuccagguuugccaucuucaguaaguacugcuuguuucugcuuuguauauugcuuauuuuguucuguuuuguauugaugggaaggagauagaaguaaaugaguuuccaugcgcccagagcagcacguuuaucuagaagguggaugagguagaaaugaccugcacauccagccaccugacccacauuggagugauuaauugcacauccuggaagacugggugguuauguugauauucagcagguuaagcucuaaagagagccuugaaaaggugccugaaguuugaggaguuuuaccuguacagggcuugcaagagaaugaguauuaguuucauguguugguuaaauucuuugucaguauuaugaugauuuauggauuugcaugcgaaaggagauuuguggagaggauuuaggaaaaauuuacauggguuucagcccagagugcaggaagaaugucucuauuuucuggagagguugcugaauaaaggcugcaaagguagcugcaucaguagccauuugugucuuuacuaccaggugacaacuagaaguagucagcuguaaccaagagcauucugggucuuuuuaacagcuggagcucuaugcagaaguugcugauaucccccacccacccccaggucccuaguacagcaaaaguugguugugaucacaacucaauacaugauaucauauuuugaauucuuacguuccuagauaauuguauuuaauuuuauuuaggacuaguccauuucuaguaauuuucuccucauauaaaaugaaaacauaguuuccucucuucuuucuuuguuucuuuauccuuccuccuuuuuuucauucuuccuugcugugauauaaaguuuugauuuaauucuguagaguacuaguauucuuugaaaagaaugcugagacuuauuguuuuuauacuuuaauauaaaaucauauuuagauuucuuaaaguauauuaccaaucaaugcuugcauauuaguuucauuucauuuuuaauguauuagaagaauaauaggucuugcaaaugugcuaagauuagauuaacccaaacaccuguguauuugacuugauuucaguucagcucauccaaacaauuauuaaaugaauauaucagaauaagucuuaucaggaaaaagaguaaauuuuguaugcugauuaucauagaguuggugauguugaagaagcaucacaaaauuauucauaaauauagaaaaauauuguguaaauaagauugccaaugguguauagucacuuucaacuagcaauaagucacuuaaaauuguacucaguuguuuauuguuugaauuucuguguuguauugaaauugacuaauaugcccaaaggauuuuauaagcauauuuuaagcuugaaguuagggguggauuuaauguugaugaaacuuuagcuuuuaauagguuuuaugacaacuucaaaugauacaguccuaacagcuguuuacauuuuaaacaugccugaacuuaauauggacaauauuaaaugcauuugguggaccuuugaauguucugaaacaauggaauaacuguccuauaaaagccauaaaaaacuuaaagcuaucauacccuccuuaugcuucauauucaaauuaacuuguuuuauccaaugcuaagauuaggcagaaaucuagacaauuucuaaggagugcauugguguggcauuggaugguauguaucugcuuaaucacugucaacaacaauuuucauaauucguuguaaauguuuaaguauuucccuauagcuaacuggccccuuuagaaaauuuuacugguacaguguuuucuuugcuguuaagacaauuuagguguugcugcuaugucgugauacauucagaaauauaaaaauaauuuuccuuucuuucccaauaaacaaaacuugggaauuaggaauuuaguuuuauucuauuuaauuuucuguuuuuaguggucaguuuaggauuuacucuucuuagaagauuuaucuugacuaaauguuuucaugguccuuaugaaacauuuugaugaauagccuuuuuucugaaauauaaggaggaagaaaauacaauucaaaaugaaauuuuuauugcaauuuuuugagcaagaagaacaaguuuagguaauuuuauaauuuaaucauccauuuacucauuaccuaaaaaaaucccagcucuauuuucauagcaauuuaacuuaguuuauguaagcuuuguuguaaauaucaauugcuuauuacuuacaacaagauccacauggcuuaccaccacacaaaauauuuauuuuaacuugauuccaaaaaaggucugcaguagacauggucacacuuuucuaguagcagaucuguauuucuauauuuuuagaccucugccaugcuuuuuuuaaagcucaaauaaaauuaugacuauuugauaagagauacuucuuaaauuguuucaguauguaugaguauuuguauaacagauacuaaaagauuggagauaauaaaagguuuccuuuggagugauuaugacuacauaagacacuuauauguuuucuuugauacauauuuaccaugacaaauaguaauaaaucugucacaaucuguuguggcaacucacuuuaccccccauuuugaagugggcccucucuuucccuuauaauaaaaggaagaaaacuuaaacggugacacugcaucaucagguauuauuugugacacgccugugguacagagacuggacuucugccgccauuaggcugggucuuccucccaggcaaucaggagagagaggggauugccuagcccuguuuugaaaacacugcagcaucugugggagagagaaaacguaggccuggccagacaucaugccauggaucuggcaggauccacgaauguguguuuguacugugugcugcaccuagagaccucacgucacuguggaaguaugacacgauggugggauaacagaagacccaccaggcagggucuacaggacaagcacagcgugucggggggaagccugucccucuagugcacauagaccaguacuugcuaaggugauuuuuuuuuuaaaggaaagccugugugaaagacagcuaucuaauugcccacgagagcucugcuuauuacugcaguacauuuuuaucuucucgguucguauuuuaguauguugcucuuuuuagucacgucccaauuucucguagcccucguuuuuugcgaagaccuuaguaauaaaguguugucuuuuguugaugucagaauuuauuuugcaugucuaagcucuugaaucuacaugagaacaucuuguuuugcuagauuucuacauuuugguuuuccauuucaaaccauauuucaucuuaaacucaauauuuugcaacuuuacugcucauuucaacaaauuuguuuuauauaaccuaauaaucauacacauugaaucaugaauucauacacagaaaaauguacuauaguaaauuaaaguuggaaaaaaaugauuuaugauucuuaacagaaauuaacaugaaaguacuaaaaucuagaaaguagcaaaaaauuuuauauugugcuguuuuaagauacuuucaucaaacacagaaacaaagcaaaggcauuaucuuuuggaaacuuuauucugcccaucaacauguaaacauguaaaacuuuuaucuuagaauuugaaauauuucaaaauuauauacguuuuaucagaaacuguuaacaacuacaaacuuucuacuucagacuuugguggaauuugucuccacuuguaauccgauuugcaucuuuaaugauggucucaccaugaccccaguuggaaucucuugaacaucagauuuuucuggaaauaggauauuuuauccuuagaaauaguuuaugaccucucaucuccagugaucuuuccuaaagcuguacuucucaguaaagucuuuuuucuacguuaaaguacagagggguuuugugugucuguuuuguuuuaaaacucaggaggaccuggcaaacuuuaaguggucagagauaauuugggacacauggaucccaagauaaacaauuucuacuacuauaaagauucuaaaauaagguuuggacgcuucaagaauauuugugacauuaguuaaucaguagguagguuugaaaaauaaaaacaauguguauuagauauuagguucaccaauuuucauaaggaaagaauucuuaaauaaaaugaaauauuuaaguauggauuagaguuuccuuuacagaagcaauuauuagggguaucaagaaaaaugaguaaugcuaauggccuuaaauguccuauguauuuuguguuauauaaaaacuuuccuauuugaagauuucaaacaugauguugaauccauaucuugagcuauuuagggaaaaccccuuuuaucccaggugcuugaagaaaucacaaacaauuuaaaagagauauugguaaacuguuuuuuccuuauuagugggcuggaaauuauguaugauuuaaaaaaucaguacugaacucagaaauauauaauuuccuacaucacuuuugaaauugaucauagggaaaucagaacgaugcuuuuucaugucaacaaauuuuaacaaguaauaauacaauuuucuuuaagaugaaaguuuuauugaaauaugauaucgaucacaagugaacgaaauaucagccaucugggcucuauccuuuuuaggaaagucuggaaguagccgauugugugguaagacguaaaaggaggaaacucuucaagguucaucccugcagggauagauacuuugugaagaaguauaauuguuaaguguuuaaaauauuaagauagcucucaguauucacuuuuaaacuuagugugcccauuuucuaauuaaagauauuggaauaugagguuuggauauuaaaauugugcuuauuaauguuuaggcaagaaggagguuaagaguggcacaauuaagucaucucaaauaggacaaaacuauucacacaauuuacacggcauauauaacaugacaauggggaacagugaaagcugagaaaauauucaugacagagaaaguauuuuugugugugugcaguuaaugcugaauuugcuaaaccagacuucuaguucagcaugugcguuuuuuuuuuuuugugaaaaccaaucuuaucuucucuauuacacauugagacuauagaguuuaugauuuuuaugaauugcugauauaugaaaaaauauaggagaaucuuuauauuuguuuugauuggaggcuuuuguuccauuaaaaauuuuucagaaagcacacaagaggcuugcacauacucaacauacauacuauuaggcauucuaauaucccagaaguuugcucaaggauuucugaauuuuuguuuggaauuuuggaauaaugagcuccuucauccacuauccuccucuucucugccuugaagcccaauccugcacccuuuaagaaagaaggcuucuggugugcauauuuuagauagaaagagagaagaaauauaaaggaaaagacaagcaugaagguuaacuguggaugaaagguuuguguauuuuugagcuauuccugcuuuaucuuuacaaacaaaaagguuguaugccccaaacacucaaacaaaacaccaccaguucauuccuucccccagaaagaagccuuccuggccagcagcaccccauuuuucuacucagugaucucuucuaaggaguggugccugauguaucuuccuacucuccaauguguuuuuauuuuuaaucaaguauucaaaauaguauuuugcaugcuaagauuuaucaggacuuucguuaagauguuagcagcugcuaacauaaacaauaauagcauuuaguguaaaacuggacuuguugagaaaagagaaauacauuucugggaacugcuauuuugaacuuuaucauuuucacugaagaguauauuuuggugugaaguuuuggacucgagagugguuuaaauuacugagaaguguaggaaaccacugcagggcugcuuuacccagagagaauuauaacagggcuugcauguauuuugaaaauaaaaccuuuuucuauggcauccagcuuaacugugaauuuauauuuacgaaauaauguagauaaaugccuugauaauuugauugaauaccauuuuuuaacuuuuaaaauuuaauugauugaaauaguuuuauuugcuaacauagcaaaauguucuccuuuuuuccagaucacugacaauuucugcauuuucuauguuuucuugguuuugaauaauucuaaagguuuucauugaaaguaaugaaucaggaauuggagggcuaaauaagauucucuuagaagauguggcaguaauccuaaaagaauaaggagucucuucaagaauugucaaaguuguauuuucuuaaggcagaauccauacuugucaggcuguugacagacacuugcuuugucuuggcuuuuguuugauuuuuuacauaacugcacuggauuauuaaacugaacauaaaauugcaccucaaagcaauagcacaggauuuucagccuugaucaauuucuacuauccccggaugugugugugcacgcgugugugugugcacccauguguaugagugugcuucuuuuaaaggaauaggagcuuuuauacaauguggugcaaaacuuauaguuuuaaauacuuaauuauuuuaucuggaaacagcagcaugugagugauucuuuuuuaaguugcagcugcugcauagguguagagcuauuugaggaguuugaugcuuuacuugagcauauacucccucuucagagaaguuaagguagugcagaaguuucugcauuuuguaaaauuucaggguugaaaauaaagaugcuuuaugauuuggugagauggauagauuucacuucugaaagaaugugcaaguuguauuuugaaaggaacauuuuaagaauucuacuuaagugguuuagugacacccacucuugucucuugucugacuuugucaucugaggaauuaaucauaaauaagccacuagggaugaaacuugauauauaagugcuuacuuccagaguaauaagaagaggaacuguguguguguuaaauuucacuaaauuuauuuugauuauuccguagagcaggaaauaggaacauuucguagugaagcucucuucauagcaaacuguaaagaaaauuucucaguguguugccauauguuggcagugauuaaagggcauuuccuuugugaaacauggagccauauuagaaagacuuauauuuucucauaaaaaugaccuuugcaaguacauuuaaucaugaaaacuggugucauucgucacauacacauacaaaaagugucacuguuaccauuagggauuuuaggaaaaugcuacuuuggaacaauuauuuugauggcaucugagaaagaauaccuaagugucuacaggagccuccucccuccauggcccauaucauucuaaauaugccuccugaauuacgcuuauaauaauauuguaaugucuuucauucuaccgauuggcacaguauaucauuauaucauuagcugcuaugagaaagcaguuucaaguagguggcagauucuuagcauuaauguuuucaaguaacccuguuuggagaauuggguuguuucacaggugcucagguacauuaacacaguacaauaauauuuucuggcuugcuuuuuaugaaacgaacuugaaguacaaaauaauuuaauaacaaguggaguauaaaaacuggagcucuagcuuaagaaaguuuaauaacucaagacguuaaaggauaagaaaaaaauugucuaaggaggcagcaguguuuagcucauuuugcguuacuacuaaagcugaaauuuauuaggagaauguuuauggccugauuauuuagacuuguugaguuaguuuaaauuuuuuaaacgauuuggucaaguagaaaagcacaguucuguaucuauuguacuauuugaaaguauuguuacauaaaauaaauucgaaauucugccauuuaauacucaggcauaugauucaggagugaaauugcauugccagaaccuuggggucccucauguaucuuaauaugaauuuuauuuuuagagguguauaagacauuggcacauauaaucuguggcuuaauugauaacagcaaagaaaauggaauuaaaaauauuuauuauuaacagauacaguugggauuacaaaauucaaacugcagucaguaauuauuuuacaaauaaaugcuauuucauuuucccuuuaguaaauauaucaguaacuucacccaauauugauguaagugaaacccgacaguaacaagcugggagugcccagguagaaggggaaaaaagcauguucauuuauucauucauuccuuucuccguuuauacuuauucaaagaguauuuuucauugcagcuaaaaacuagacacaccauguaacauggaacaugucuuuuucuucuauguauucuuauuuaaaucguggagcuuuucaacugagauucuucacguuuaaugaaauuugcagucuugugucacuugcgucacaauuuguaggaauaaccuuagcauuuuaaagaguauaccguguagccuuuugagaaagucaugcauuugaaaaauaaaauaacccacaaaguguaacacauggacuuuugucccuuaagcugauugcccuuacucacuugucaccaccuuuacgagagugagggauauguuuuagauacauuuuuuuuuguccuauagaaaccagacucacugcuuuacuuaugcguauuacucugaaauauauuuccagugaaugaauauaguaguaaaagugguguagcaagguagaaaaaacacugcacuagacauaaaaagaccuuucaaguauaacgucugacagccucuacuuacacacccaguggccuugguuaggucacaaaccugcuucucugucuacaaagcagguauaaaauagugccugcauaauaagguggugucaauauacugauaacaaaccuuuaucaaaguacuuauuccaugccagaguacuuauuccauguucuaagugguacacuauuacaucauuugcaucuauugaaucauuuauuccuauaaaaauccugugagauggguacuacuguuuauucaagagacuuaaaaaugagacacagagaggugaagaaacaugucugcggucacacauaguaaguggcagagcugggagugagaccugggcagccugucucuaaaguuucuguguucuuaaccauagugcugucuaugcugccuagcguuucagacacucuguagaccaaaaagcucucuacagcaagguugucauuaaguuagcaaguauuugacuaucuacaauaaauuaauauucagaaauuucauuucacuguagagugaucaucaguaucucuguauagucauguccuauaacuuuugcccaagcaaaucaguaugccaggcaguccaggggagcaucuguguaaacaaagacaguauaauauagugguuagaguaugaaaucugaucaacuggguuuuuagggggcuaugucacuuccuagcuacacaguuauuuguaaaauaaguacucauugggguuugaaugcauuuauguaauauccuugaauguuacauacuauuguuacacauaauaaaaagcacugucaugcuauuaucaguaacaagguaacuaccuuucauuuggcauuugagaaacaaaucuaacauggcagccuacuuaggaguaguuagcaguagaauagaaacuaagaccagggucucagcuauguucaaaagaauuuuaccuaacagaggucacuugcuuuuucugaaauuauguaauauugcuuuuuuuuuuuuuuuuuuuugagauggggucuugcucugucaccuagguuggaguacaguggugcaaucauaguucacugcagucucaaacucccaggcucaagcgguccucccaccucaggcuccugaguagcuggguacacagguucacaaccaccacaccuggcuaauuuuuuucuuuuuuuuugguagagacagggucucccuguguuucccaggcucugcaaacccaucucuaucaaaccaagacacguagucagcccuuuuaaucauuagaccuaguggucugcaaaguuuguguuggaaauacuuuaucuucucucuuuugaacugguacaucggcugugaugcccggagcugcuuauacugugguucccuuggccaauaauuuguuuaugccuaaaucagccuugccucuaagugauaaggagauacgugcuuuuucuuuuguuuugugucagugguauucucuaauaggccgggaacgggucugcccaagugaugcacagccccuugguggggcuggcuauagauccccccgcaaaacugaagguuaggccuaagauauuagcuuugccuggcaagaugaagauguguggacuagguagaccuguguggcagucuguuucuuuuauaaaguaaacagaguucaguuuguuuaggacugcuuagguagauuucuuacacugagcaggaauauuuguacagauguuuuaagguaaagucaaagaauggcuagauuguagccuuugacgcauuauaauguaucuuuucucagugccccuguugaauucacaaaagaaaagguauuuuugaucaucggcuaugagaaacuuaaaacacuuuuuuuuauauauaaaggcugauuuaguuaacucuucuugcauuuaaagaaaaaaacaucugcugaaaguagggaggggggaggugugagcggaagcguggucuccacauuccacaaugaaugucuuuucccagccaauuuuaauuugcagaaaaaccaggcacugaguuagauuccucgggaaaagucccuguuggcugaugagcccugaacuucuuccguguacacccugaacagggacugaugcuucaguucacagagauaauuuuucucuggaaagccgauagauccgauuuagccaccccucauuuguagucauugccaccuuguggauuacaaaggauauugguuuucaucaaacuuccauuucgauuuggcuuuuuauggcaaguacacguuggcaguggauugccguguuccucaccaaaaggauccugguuuguucagcaacaccucacuucuccacucacaguucauuuaugauucugaugagaguguuuuuucaggaaacacacauuucacuuuuugaccuaggagcaucuguuagaauuuuuuuuuaauacuacuuuggcauucugaaaguguuaaugucuuucauaucuguuuaaugcuauuuagggauauuuaugaucaccucuugguuacucaggguaaagugugucgcaauuuuuuuuaaacagacaggaaagcauucacaugaggaaacagauugcuuuaaacaugugcuuccugugacaguaaaaagaacaaauuagauuuaacacuguguaaugaaugcauaaauguguacauuuaagcuuuuaaaagcuuuauguucaguucuggucacaacaaaaauugagucaccuguaaaaauuaaagaugcccaggguacucucagacuuuugaaaugcccagcaauugcaguccucaccugacgaugccucguuggaauuauaaaaagcaugaucuauuagugcuggagagaacuagaacauuacaaggcacauucagagguuaaaccagguuacagucagauuccguacauuuagcaaauaaaucagaauuuguugugggggggagaauacuucacucucaucuuccucccuaagaaucaaugaaaaaaucaauuuucgggaaccccauauauuccucugucuuucaugaaagaaaaagaaggaaaccugauguuuacuuacuagcauuuacuacaauuuaauuauauaagaaaaugacucuuuuucuuauguaauucaguuuguguuuuguaugcuggcagggagugaauagaaucugaguuaauauuuccaguuagacuagaguguggaauuggagggccugaauccucuccccggaagaagaggcacucauggccauuucugucugagccugcggauagugccucuccguccccugugcuuucaaagcuaaggauuuguggcacgcuugccaucucucuggccaaggagggccaggagagagucccucgggggagggcacauaguuugaggacaucugacucucuucuaucacauacugagguacuaauaucaaaacagacugcuugucgucgcacgguggggcagugcuuuuuuuggcugccguggucgaaaugaaaugggcaagcuguaguccgcuuggcaucagaaugggcuaagggaagcagggaaaucagagucagacugugaaugcaagucacagccaaugguuaacuuccuuuuugugugucacuuggcagcagcgagacugauggugauuuuuuuuuuuaacaugggugagaguucagugcccuaggaagagccguagaugcuguuauugugcuuccucauacaguugacuuguguugauuucuugaggccaguacagcuguuccaagagccagcuccaggagcuuuguguguauguacauggccaucggacgucggaugaaaaagguaaacagaugagaggugauccauacaaaaucucacugcugaucacuaggcagucuuaggggaaucagguucuggcauaaggcaauaauaccaaagaauaauauauagugcacuugaagggauacucccuuguauacagacacccaaagauauuuuuaaauuaucaccacuccgcaccccucaucucacauacaggauucaaaucaauuuuggacugucuggaaaauguaggacuaaaauagccagauugaauucagauaaaauuaccuucugcuuuuuugggagguuguugcuuuuugguuagccacauuauuuucuuugaagauucauuuggaagagaguuugguagaauuucuagccucucucaagauuuuccucccauuucucuguuugcaaagagcuguuccccaaaggcaaaaagagcgaguugccaucuugagcgaauuguauguuuagugaacaccaaauggucucagaguuacccuaaauuuucauuauaucugguugcuuucaaauacuauuuauuccccucaaaacuccuaaccauuuauauaagauaucaguaagaugaccaacuucugacaacccaaaagcagggaaggaagcuuagaaauagaauaccauuugucugguaauuagaguguaucucuuaagaguucgagagaauucugauuaaccuuucuguucccacauucucacguaaaauuagcacaccuuuuaaauuauuaucuaguauuuaaacacauauuuuugagucuucuuaaugcaacagguucuggggacacuaaaaguguguuauaguuuucuaaaaaacuucauuuuucuuacauuuuaaauguucuguuugugcaaaauuucgagaaucaccauaagggcuucuuugcauuuuuaauuuaguaacuaacauaugaauaaauuugcauauuaauuaguugcagauuaaaucaugcauacauaauugccuccuuacuguguuuaauguuugucaaaaucuccagccugguuugauggaugucguaugaaagauuacaauuugauguacccuuggaaguauuuacaccaauaaugcaagauucuuaauagcagaauuuucuaguuauauacaguuacuaauaaacauguaagauagguacaugucccuuugacuaaaauuuuuuucuuugcaccaaaucauuuacuauucauaaucauuaaugcaucuccuaauuauacagcauaugucuguuaacccuuucauugcuggccuucaaaugguagcuucuuucuuuuucuugcccccuaaagaaagcaaaauuguuugauaauacucugaaauuacucgauugccuuuuauuuauuucucuccuaguauauggacaaaccucauuugccauuuauuuuaacauacaauagauaauuauaugaucauuuuguauuuucuaguuaaagaucauaaaaugacccacgugcacaugguuaguagcugaugggcuuuugccuuucuuuuaccaaugcugaaaaaaauugaaauauuucagauacuucauauaguaguaaaaaaaaauguauacacagacauacucucuauuuaggaggguaauuguagaauaaguaaaaguauuaaaauuauauuuaaauucauuuugaauauugaaaugcauuuaauguaucaugaucaaacauaggauggaaaugugauuuuuuuuauuagaauugagaucucugaaguagaaacugacaagagaauagaugcucuugauuugacauaauuuuaaaaugccaauaaauguuuucucaaauuucuucagguauuuaauuuuuuaaguuuuaucuuacucauauaaaaaguagaccaacuggcuuuuuuuuuuccuuuuuacuauuuugaugucuaagcugcuuaucacacuguauuacccugcauuaaugaguauuccuacugugcaaaauucuaucaaaaaugauggugugaaugucauuuuuaauuggaaguuuauacagucaaauuuauaguacacaacaaaaaauauguauguaguucugcuccaagccuuuuuuuaggcuuuugaucuuuuuaguuuaaguauacauuuuuauuaaucuaagugucauuugaaaaucuacacaaauaugacuacauuuuuuauuaauaccauuguauuauggaagagagggaaacuaaggcauagaguaauuauaaugucuguaaacuguaagaagaacaaauacaagaaugaccaagaauagauuuucaggggucuuuuuuagacaugaaaacuugcugaccgguucuguauguuucacauaagucagacuguaugauuucugucuucuuuauuuuugaaugccugcauuuauaugccuaguaaaaaggcaaagguuaaaaugaguugaaagcauaaacagcugauuucccuucuuugauucuuucauaggagaaauaaugucuccuggucaccuaccucaggagcauuuauuugcuuaucacaggacacaaugaacuauuuauugauuuaacacaacauucuuuuacaacacgcaauauuacauuaaauuauuuagcaaugugaaaaaugaaaugaaagcugcaaaacuuauaaaaggaagcaaacagucagaccugaaacauauuuauccacagccauugugccuagguaauucagggcauaugguauguaaaugauauuuggagauccuugccaaaucuacacacgacgggauaaauuaaggacagguuucccugggugugagucccaugauuguggccggcacacuuccugcuugaauguguguguucuguucuugucuuucagcaagagcgucacagagcauucaguggccaaaucugguccucagcugacuucuaagacauuauuugcaauucccaagaauugauuuuaugauuaaauuuaaaacauaguaccaauuugccaaacuuucccuuugcucucacauuugaaaaguaagaucugaauaauuugucaggauauguuuagauauuaagccauuuaaauggguaucuuugacauuagaaauugagugccucugagcuucuuagucacugaagaaagguguuccugagcagugacuuuucucuaagcuaggauuaagauguuuccuagaacagacuaugaauuauuuugaacgauugauaauuuugguuccagguuggcccaguaauaauuuauuaauucaacuugacaacccaaauuacugguaucacuuauuuuauuuuugaauuauuauuuugaagcauauacucucauuucuagaaaggugaaggcacugacuccuauuuagaauaaauuuuaaguagguaagagguuaugcuguuuucuuuuuuuuugaaaggaaugucuuuucuaagcugggggucuuagcucagaguuuuuaaugcuuuaaauuaagguucauuuuuaucuuggaauuaugcaauuggagauuuugauuagaaacuauggcagaauuuuuucuccuauaauuuauuggacuauaccuaaagagugcauuuacugugcacacuuaauuauaaauacaagacuuauauguuauuuauaaaaguuauuucgggguauuuuaagacauguagaguauggcuuaggauguuuuauuguuuuuacuauuaagaauaaugcuuuuacuaaauaaaacuguguuucuuuuauaaaagauaaugcucuuaauauuaugguuuuauuugaauuagcaguuuagucuguguccccacauuccauuucauuuauggaaugcaaauaacacuaguuacugcauagaaaaugaaauuaggcugaguccuuguucauugcuguguaaauuggguaaaaaucagagaaaaaaaaauacccuugagaucaauguaaaucaauacuacuugagacagauccagcuaaaaauucaugaaaggggucacaguucuggaggaguuuauauaauuaucauguagccuauaguuugugaacucagggcaaaguucugagcugguuguucugggaccauuccuugguucauugaaacuacuuugcacagcugugcuucaaacucaacaacagagagcaaaaacaauauucacuauaaaauaaaccucguccugccuuucaacuucacugugaacuugcagucuugaaaacaacaaaagggauaaucgcaauugagauuacagaauccagauuagauguaauacacaguagggugguauggcccaauuuuacuuacauggggcaaguggaagugcugugaaugccaacauguuaagcaucauagccacuuauuaagauguuagcuuuaaaugucagucuuuggaccccauuugaaaugaagcaccugcauuuuauucaaagaaauuaagauauauuggggaaugcggaggugaguugaggguuuuuuuuguuuguuuuucuguuuuguuuuguuuuuuuuuucuggugggagaaagugccauagacaauagagauaaaauaucucaaguauuaaaagucuauuuuuauacacuguaugauucaaaaugacugagcaguuuugaaauuuuguagaaagaaaggaauauaaggagaauaagaaaugauauuugcaucuuuacagacaacucuguauagcacauuuaagauucuggcaauuuccuuacaaguaucugaaaauuaggaauuaugaaggaaacccagacagauacuuaacuauagcauugcuaccaggugucucuuugauaucaaugaguuaggaaaccuuaagaaaaaaagguuaaaacauccagaaugauaacuuauuuuagaauaugcuuucagacaaaauauuucuuuguuaagaauguugaaagguuuuauuuaauuguucacauauauuuaguaaauuuuuugguagacuugaccgauuaggcuuguuucauaaaagaugugggcuucuguguauuuagaucuuaaguuuauuucaaauuggccuuuauaaaacuuuagugccuuucucuuagaauucuagucaacaaaauuauauucaucaaguguauacaucacagaaguaacuggugauacagaguauaauuccuaccauauugucaaauggagucuauaucuccucaaagggaaagaaacacugacgugagucagaaguuuucacucacuuggcacugaaucagcuuaaaguucgagguugaaaaauucacaaauauuuauagcacaccuacuaagugccacgccuccuggaagguggacagcaauggccaauguuucugccauuggaaagauuugcaccgaaguguguauggccacauguaguuguacaaaucagaguucauuuuguaaugcuuuauaagggucugguaccacugauucuccuugcagacuaauaaacacagagcuuauaugacucuuaaaaauacagugauagcaagugcauccuaaauuauguaaucaugugguccaugauaacaguguaauauaugauauacagauggaaucagccaccuggcuuacuguaauuguuguugagguccuuuguuaugaacauauauuucuguuaacaaugcaacaaaauaauuuuuuaagcuguuuuuuuuuuucuguacugccucaaaucuagauaaacggaauguguuggaaaggacaacaaauaagaaguuaaauauguggaaaugacauggaaagcaccuguuucuucccuuuguuuucuucuacgucaucaggaaauaauauuuaaccauagaauauggugucccucuaagaaaauguuuauaauugaauguucaaaguagaauauagauuaaauaaguaaagaugacuugccaaaaaaaauuaaagaacauuugaaacaaacagaagucugcaucacacauaauaaguggcauaacaguaucaccucucaaaagugacaauagauguguccaucuuuaugccuuuagcauguuguuggcauuauuaguuauuguauugagagaguagccacgcuauacaagagaaaggaagguaaauuagaucccucacgcccccuucuucugugaauuguauauguuuuugaauacacucucugccaggacagcaaauaaaauuugguucaucccugauccucagcagauuauaaucuagguaaaggacagaccagguucaugaaaucaaaaauaauaauuagaacauuuggaaacuaggggaacagguccucauauugugugcauguuuuaucagucuaaaguagauauagcucuauugaaaauuguuggcuaguaauaugcucauuuucccauuucaugaagacuuauucucaaauggaaguuacagcuggcuaucguguuuuuccgacaaacucucuucucuguggacaugaugauuucuguuguuguggaaaggaaggaaauaaaucucuuuuuguuccucauucacucaaugagcaaagugugauugagcuccuauugugugcagauuauauuguuggagcacaggacaaagaaagcuaaauuaucaucuuuguuuagaaauuuaagauauuugggagcagcaagguagaugccuaugccuaguuuauuuaacaaggcacugaacuuugcuggagaauccuauauucuagaauauaguccuuaucuggaagugacuacagaaccugauucuggaucacagagagcugcagaucuggugugauuaagacaguggccacagauacuccacugagcuucugucuugcagcuucugucugucucuucccugaaaaucacagggaccacagauacuccacugagcuucugucuagcagcuucugucugucucuucccugaaaaucucagggaccguguggaguuuugcuuggucaacuggagaaacaacuuuugauuguuuuuauguuuuucagagauuuauuugccagagauauuacauuauaauaaaaacauaaacacagaaguuagggauuggaacaaagguuauauggucacaauuuaacucauaguuauuugaaaauuauugguuuauaaggaaacagauuuagacaaagcuagaacuuaugcagguaaguuacaaagcuagaacuuacucaggcaguugcucacgucuguaauucuagcacuuugggaggccggggcgggcggaucacgaggucaggaguucaagaccauccuggccaacauggugaaacccugucucuacuaaaaauacaaaaauuagccaggcgugguaguggugcaugcugguaaucccagccacucaggaggcugaggcaagagaauugcuugaaccugggaggcagagguggcagugagccaagaucacaccacugcacuccagccuggugacagagcgagacuccgucucaaaaaaaaagaaaauguaguggacacaauacauuuagauuuuuaauaaaguagacauauguuuauugcagaacauaugagcaguugauuaguuaaagauauccaacaugccaggcgugguggcuaacacuuguaaucccagcacuuugggaggccgaggcaggcggaucacgaggucaagagaucgagaccauccuggccaacguagcgaaaccccaucucuacuaaaaauacaaaaacuaucugggcaugguggcacacaccuguacuccuagcuacucaggagcugaggcaggauaauugcuugaacccgggagguagagguugcagugagccgagaucgugccacugcacuccagccuggcaacagagugagacuacaucucaaaaaaaaaaaaaaaaaaaaaaauccaacauugcuggcaaguuugaaggucacagcccauguacaaaauugguauaucuugaggaacucuugucuuuaucauauguucuguaccauuuccuugcacacaacacaguuacuauaugaugguacuaaguagauacagguccagaccccauaaagaauguggcauucaguucuugaacagauguuagagaacacaacccacucggcaguaagggauaucuucaacuagagggaagggugagaguugaccuguuuguccuuuugacucauauuuagaaaugcuaaaguuguuuuauguucaaaaugcauuugauaaucaugccugaagaggucaaagugcugacauuguugaaaacaaauaccccugucaaacaaauagagacaauuuucaugucuuugguugguaagcaccauaauuuggccuuuggcauugcugucaguaaagcuaguugaugacuuuuacaucaauuuuuggcccaaccauaaaugaaggaaauaagaccaauacugccacaguacuuuuucucacucaucacccauaccugauucagcuggguuaauguuaaaagccaaaauuuaucaauaucaauuuuuuucccaaaucauucuuauuuuaguacuguuuaugcucaauaaaaguuuaugaauuucuuucacuguuauuuaaugaaaacccagaauuuuuuaaaauugcacauuaucucuuuaaaaaaagucuuuuagauuacucgugggauuuacucuaaguuguugucuuuuaauagaagaugaugcaaaacuugucucaccuguuccuuccuggucgugucuguguuuaugugugggguggguauauaagugcuuuugauuaacagaaugaagagagugcuuauuuugaaaacucagucguuaaaauucaaguuuauuuugaguuaaagaacaccauauuuagauuaggaauggaccaaugaccugcuuaagcuuuaggcuaucgauuggccuugagggaacuuagaucugcuaaacacgaacuugaaaaggcacuucagugauggauguacguuggaugcucucacuguauggucauucacuugcauuuuaaaauuuauguuuuguuuuuccuuuauaccuacucuuuucauuccguuugucagagguggccauuuaaaguauuugacaauuguuuguucucugccuagcaaguuguccuauugcuccaugaugugaaagaacaaagguaaucaacaguuagaaaccucaggaaauugcuagaaucuucacccccaaagaggguuaauaaacccuagauaauuaguucauuuagaaugaaaaccauuuucauuguaauaaucacauuuccccucugauuaucgagcaaugcauugggaagccugauauuuauucacaaauuuuuuaaaauugagaacauccugugcugagauuccagucagcuucauccauccauuuuuuguuaaaaguuucucaacuaucauccuucauccagacaaauaaacauaaccaggauuuccccucuaacuuuuugggaauucauuuacacguguaccauuuugagggaaaaaaacaauuguccucgaauuucauuugacucaggugauugugguaagcucgcuaaccagcuucaucuaggaagugcagcaaucugagucaacuuccuccaucucuguuuuuacauuguccagugugaugcuuccucauuguaccaaaauagaaaugguuuguuuuuguaucaaacuuggagacuggcuauggauuacacuggguuaggauaaggguuuguuauuuuuuuuuuuuuaagaacauuccacuuaucccaagggaaaaagauugacggccuggggaaaaauaagaggcauaaugaagucuuuucuccuuaaauaaaaaucacaucuagucuucagaugugucaauugcacuauguuugccuaauuucauuuaauauuugagagauuuaguaguaaauuuaugacuuuugcaguuacuuugcaaaaaauugaggaaggaagaagugaauuucacuuugagucaaauguguagguuccaguguaauuaaaccuaaaaaucuauauauucuggucuugcuacuugguauuacacuuugccauaucacauaaugcuauuagcuacauuuuaccuuguuugcagggugaugccauuuuguaucucugguuuguugaauuuccuagaagauguuauguucauguagauaauggcauacucauugaauucuuuaccucagacaugaaaauauguggaaaaguggggaaaugaaucugaucagauuucacuguauacugaaauuugagaaucugguuuuugcaucuauuuugcaugcugcugucucuccaaaccauauaugucugugugaguuuuuauaaugccacauaaagcaaaaugagaagucucuucuuucuucuaaagggaaauagugccacagaaagguagaagucaaauauuuacuuauggaucaaaaaucuaguuaaaaaacaacccauugcuuaccuuaguaaucaaugugaauuacuuuauaaucaauaugaauacaagcuaucugaccagucacucagaaaauaaauauuugaucaugugauaaaccauuugaaugucuacauaugaacccaggccauauaaaaauaaccaauucaagauaacauaggaagucacuaaaaaagacacaaauaaaauuagauuucacaguuuacgcugauauuuugauacuuuucugugauaaaagcaucuuccaaacuaaauguguccauauuugaaccauguaaauaguuaaaaguauuuuaccugagaauaucuaaaugaugccaagaaaauaaguucaugccacuaaaaagauugagaugauuugugcuuuaucugacuucuugguguaauauggauuuacuucagauaaguauauuuucuacuuauccgauaaguguguuuaucugagauaaauauuuucuccagauacguguguauauugaaaaaaaauuuaaaauaauuaggaucccaauugaaaaaguaaaaaucuuaauugcuuaauaagaaaacaguuauuucauagucuuaagauuucaauacaaagaaauaugggaauauacacguaagagguuuguugguguucauuauuaaauugcaaggcugucucaaguuauugucaucagaauaaauucugugugugugugucugucugucugcguccuccuguuaguaauuagaucuuuuaugaaguuguacucauaccuauuagggauuuuugucauugcaguuuuaaguugaauaugacacauggauccuuuguugggucuaagcuaucaccauuuauuacaauuuuuuauaacauuccauauauaugcaucuacuaacuaaacaucagccuuaauuuagcuuaugaauuaaauuuuuuguuaggagugacuccugcuggagagcaaaaaauaccaauuaguuuagcuucuaaauaaacuauacuccuuuuuucaauggacaaggguaaccuccuauuccuuggcuuggcaacauuuacuauuccucuaaguuuaaagaugagaacauagauuugaguacuaacacaucagcagaaauuauauuuuuaaguacauacauaauucucaggccagucguguuuggugcuccaaaaagauuugugauugaauaucuuugcuccauugggaagaguuuagcauggugcuguauuuuuauaauucuuuuuuccauuuuagcagacuucaccuaagucuauuuuagguggagauuuuuuuuuuuuuuuuuuuuuuuuuuuuuugcugcugcucuuuaaggcacucuugcauagaggaaacagcagaggagacacaaggaaaugcacucuccuuuauaacaugcugcugauucucugaacuagguguccucucauuuaagccucaaaagaagcuguguauuaacuagaugaaggaacuaacacucaaaccugugauacagcuuggccagagucacacugcuggggagcagcaagguuacucaucaagaugugucugacccucaaguuuaagugcucugauuuaauaacuuugcucacacccugauuccagugucuuaguagcuuuugaucuauaaaaugucaucuaaggaucuuugagccuuaauucuuugucuuuaaagugggaaugauaauaccugccacagaguacuaguuauggagauuaaauaagugaaggcaauuauuauauguucuuuaaauugugugucacuguacugugcauguauuaagugucguuuuauuagcaaauaucuuuuugauggguagauguuuaccugaggugguuauuuaauuuauaggcuggcuuguucacacuauguuauguaaucauuguauauuaaugaauaucacuauuuuccuuaggauaugauguuuagcuaauucagccaugcuaggcaaaagaggucagcauuguagaaauaagcaaugucuuauacugaaaaaaagaaagacaacaacaacaaaacaacaacaacaaaaaacaacuuuccguguucagugacuuaaacagaaacauggaguuguucaaauucuaccaaguuauauucgggaggagaaaaaugggaauuccuuccauaugaccauucuucauucauucauuuauucagcuucuauuuguugaguugccugccuuacacugcaauaugcagggcaguuuguguguguguagauguucauuagguuuauuugcacuuugcaguaaccauguaauauuaucauuauucagaaauaaagguagaaucuacucuaaugagcucuguggucgaguggauaguucagcucuuuacccuguaauaguuuguuaucuaauuguuuaauguaugugcgauugccuucacaauuaaagcauuauucuuuagucauauuuucucucuuuucucaauuuucucaggaagaaaauugacaugucugugaacccugugcauguccccaaauggagcuuaacccaaaguugggaaucacuaaauaauuguucaugaaaugguugaauauagcucuucauucaagugauguagauucugaauauuuacuuauucuuuaaugcaguuauucauucauucggcaaguuuuuauugaacaucuaccuuguagguaauacuaugccaaugcauuggggguuuuaggucaaauauuucccaguuucuuauaacaaauguauguguguguugucaguucugcuucaccucaaauauaucugucaaagacuuuuuggaaaauuacaaaagaacuguaaacuuuagauucuagaagaaaauaagaaucguguggguuucauuuaaguggucaacacuucuagacaguuugcugguaagaauuuuuuuccccaaaaguggcagaaaaagacaacuggguucauugccuacccccaguguccucaauagugcuuugucuaagcaccagagagggaugguggcuuucuguauaguguggcuaaccaucauuccccaucauuucagcgauaacaaggcugggcauggggggugggggugguaccaaguagguaaccaaguuaccuacugcuggcaagguaacuuguccaguuauacacuacugugaaaacugugucugugaaacaagcaguagacuaguucaggguccuguaaaaauuggcugcuuaagauuaagacuucuuuaaaauuauucugaaacacauggauuuaugcauauagcuucaguuguucuuauacuucuguucuaacuccccacgcaucacacuaaaaauuuaucauggaugauauuucugucacaaagaaaacuucaaaggcugagaucgcagaaaugucucaguugacaagccacugacuugaguucugugauugaaauguacuccaaggucagcaaaccaaaaccaaacaucacuggaugauaauacguucagugucucacuggcuauaauucguagaucaccuuucaaagcauuauaucuuuauuaaucauuguaaauuugugcuuuugaaaucuuagacucguuuccauuaggcaaugaagcccagaagcuuaauguucuagucucauuuuaauuuuuucagucuuaugugcugaauugucaggguuuaaaaaucgauuucaccucaucagauuaaaaauauuuauuuaugcacauguuaacaauauauuaaaagaaaugagagcuucaauuuuaaaaauaggaauuguagcucauuaagccaugacaauuugguuuauauuuacauaauuaauaggaaggcauuuauauguuugcaaaauagguaagaaaagguauuuaacguagaugaagcagaaugauuguuuaucaaaagaguuuagagaucuuucuagcagucuacccauggaaaguuaggaucuagaaaagccuucucaauaagggaagaaacaacaaagaaacaacaaccaggaaacuccccaacuuaucucuuuaaauuccagccucuuuucuaaguggugguuuuuacauacuguccucugguagguggguacccuggccuuguguauuaagcagugagggugguuuaaagguuacaaaugugauccugucagauugacaacuaacuguucuaaugaggaaaaaauccucaaagcaugaaauuugaaugaaaugugugauuauaauucaaguacuguuuacacaaaccucuggggaccuuccgaauaaaugcagagcaagugaguuagacaaaccucugggccuucgauacguguguguggaugugcgguguguguguguuuauuuuagagaguggggaaacuuuccaccauuagcccgggcuuugcuccucggaaccaacaccacuauuccuccuuguuuauuaauacuguauguguuuuguuagcauauugaguuguaaggaaauaggugcuuugaauuauuaaaguugauucuugagaauagauguaugcucggguggcauuugcuucggcauaugcaaaugauuuaguuucauuugggaucaauucccagaggcccuccuuuccugugaugcucugaauuuggcaagcucaagucagcccaucuccucuccccacaucccucccuuucuuucuuuccuuuuuuuguaccuccccccgccuuuuuguugauugguauaauauuuuuaaaagacaauaaauaaauauaucaacuugcuugugagaaaccuugccaucuauaaggauucuauuguucaguugugaucaauaaaggugaacaaagguuuucacguucuuaaaguuuagcaaaaucgaaguuuaguaaaaaugugcaugagauguuugcuaaaauauuuauacagauacugggcugcggggaugcugcaaaacucugaaaauguggucucaggggugccuuuggggaaacugacagcuguaagauauucgucgguucgaagguaccaauaaacuugcuuuagagcccagcaaauagcgugaaguugcaguagauugucuaaagcuacagugaaagcacccaacuccagaguggagaacgugcgcccuuggggcgcccagcgccagcgaggggagcagcgccccagccccuccguaggcucugggcccaugcggcugucugcggcggggcgaggugaaguucaugggcggccgcgcuucccaccagcuccggggaggccggggcccgcggagcccggggcgggccgcacugcuacucuguuucauuccgcaaccccguuuuguagguuguugaccaagcagucagaaaacacugcccccucucuccuuuugagcgaggucagagacgugguguuuuuuuuuuuuuuuuuuuuuuuuucuucccuccccuuucccuccccuuucuccgagucgaguucucaggcagcugcguacaaugcugggagcuagccagcagcagagacagauggcagaguuauuagaugugcaucauacgauucccuuccugccacucgcuuuuuaaucaaauuaaaacaaaaaagaaagagagggagagagagagagggggagucaauuaacugcauuuguauucugcucaauaauggacccuguuccacuuuuacccuaaggcaguugaguggaaauuuuagagaagaaaagggugccuagaacaaaacaaaacaaaaaaaaaaaaaaaaaggaaaaaaaaaaagaaaagaaaaagaaaaaagugaagacugcagaaauuuguaagaaucggcauuauucgaggaacuaauaaaaaccccucggaaaaguugaaucgaucucgcguaugcauuaggauuucgagcuccaucagggccgggcugccuuccagcuccgcugcgcaaaguugagcgucugacagcagcgccgcggccucccccgcccgccaggaauggucucuuccugcuuugcauauucaccacgcuuggcccggccauaugggaaaaugcaacugaaggaauuguugugaaaaaagggacagcgaguuugaaauaaaaguuguuagagugguacugaggagaaaaaagaauccgagaccauguacugcgcauacacaaucccgggcaugggcggcaacucuuugauguacuacuauaaugggaaagcgguaagcgaaugcgggcugcgagggggauuuuugacaaguuuuauugucgcagggaugagcauccuagguggugaucauuguuugcaaaguugugcaggacugccgcaccuuccugggugccaugaaauauuuaucauuugccaauccuaagaucuucuucuugccuacuucuucuccuucgucuuuuuuuccccccacuccucccccagaguagaaaaauagaugcuuucagagcuuuagagaguggauccuagagcgaaaguuugcagucagguaaaguugagaggugguaugauuuuuuuuuuuuaaagaguuuuggaaaauucuuauuccuuccaaaugacuguuagaaaggaaaagcagauaugagaagcagaauugagaaagcccaaguuaggcugagaggaaauuugggguaaguuucucccuggauugagguuuugugauaucuaaagucuuacuaaguuggaagcuugagugcaguggauagaguggagagaaccugaaagguuaaaauagagcaaacacauaaaacugagagaucaaauuaaggaguagauuauauaagcuuagauauauauuuaaagccaaaauggggaaggaaaaacaaacggguucauucaugcauauaacaguauugucauaaguuauuugugcuguguggcuucuucccucaauuucccccccuuccaacagaaacgcuuuauuuaagaaaaaaaugugucugguauuuugugcauaaccccagcagaagguuuauacuugccaucuggagguuuauuuuuuuuuuccuucgucugggcccacugaaggaaaaggauuucaauauuuucaaaucgguauguggggcucucgggaagaguuguugggugauagaggagcaaaaauuuauuguuuuaaaauagaaaagaagaaugagagaaaagugaaaagcagccauuuauaaacuguucucuuuguguacuuugaacuuccauuuggauugaucuuaaucagggauaguugggccaaaggggacagaucagagcuuucaggaaggcccaguucagcuguagcaauuggcgcaaacgaauuaaacauguguaugugcugcuauaugccugugaguguauauacauacagaugcaugcauaacgguuauuucuagaugagcauauucuguaauacauacauauacacaacuguuugaaggugcaguuucagaagauuaauaauuucauuuaagaagccaguuuuaugaaugggcaacuugaaauaauaucguuuacuuuuauuuugaaaaguacgaguaaaucaucaaaaguucauagcgcuauccuauuuuuaucuuuuuuaaaaaagagcacgguguaauuaaaauaguuaagugugguaagggaaauauaauuuuaaaacaaaugguuuucguugugauuugaucaaaguguuuaaaucuguaaacauaaauauugggauuauguaacaucuuuuuuuuuuuuuaacaaguacaugauuugcaauugguaguuacucauauauagauaagacuuuugccuauuaucuuuuagauguucucauacauaacuuauucagcaccuuucauuuuaaagcacuuuuaaugaaaauuuugugaaugaugccaucguagucaguaagcaaaagugucucugaagcagauucagggauuagauagcccuuauccguaaugaaagacuuacauuauaaaagaauauaaguuuccaugguuuuuaucuuucaggauuaccaaugaugugacuuuuacauguuaauuguuaauuuugcaucuuaaauaucugaacugacaaaauuuuaauuuaaguuuuguaccuuuuaacucccuuuuggccaaaaggaauuuucaaaaauauguauuccauucccacagcuugccaguugccuccaccguaagaaaaugcugaauaugacaucauaucacuaauaugcccucucaguugccaaauauuuugguuguuagauuuuuuuuuuuuuugagaggaugguacucauaaaaucaagaucgcucugucacaggaaauguauuuauaggaacuguuuuaaggcguuuauuaaaaacaaaucuggugauguguaucucuauugauucaaacacuagaaagaggcaaauuguacacacauuauaguuagaaaaaaaauagccauuuggaacaccagcagaaagcuuuugaaacugcggauggcuaccaguuguccaucuuagcuuuaugaaacagacagcaaaguccaguugugugugucccaaggaaggggccaauucuauaccauuuuuuaaaaugcccucaugcauacacugaggaagcagauuuuuguuuauucuacaguguguauucugcuggcucuaauucugcauugaguggcuuuugauuuggugccagacauguuguggagauuguauauaccaugcguuaauuguucaaaaugccuaucgaagagacuuuacauuucuugaguuuuacuuaucguuuggagguugaauaucuaugcuuuuuuguguguaugugcaugucuaaccaauguguguuugaaccugaauuguugaaguuaaguguggucagcuauuuguugcacaaguuuuccucugaagagaacacagcacugaauuccuucuuuuuucccagugacaagucaauuacuuguuuaaauucaguuugaacucccugaacugagagaggccagaggaagcagguuuucccugugaauaaacaaaagaagaaaaauggaaaaucauuccaaaacacagugauuuuagcuugugggaagaauauaauuaagcauuacaagaauuaugguuucuucuuuuaugaacuggcaacuauaggguuuguaaaaucaguuguccucuaacuuucuagcagaaauauaaucaaugauauuuuaggacaaacgaaaaaaacgugaauuuuuuuacuaccuuaaguuaugaaguguuuccauguccauaucccacaaaaaaauuuuuccuuguuucugugaacaacuguaccuguccagaaguguggacucugaaaaaaauacuuaacaaaaaaucguaacacaagagcuaucaaagaauaaauuuuggauauaaaccagaauguauuuuuaaaaaucaguuucuccucaggugagaguuucaugaacuugauaaaauaauuuuugugauuuuuuuuuccucuaugcauuagagguuuaaauacuaacggauccaaaucuaagcuuaaaaaaaauuaaagcaccacuucugaacuacgaaacagauuuuuuuuugcagagaaaaucaguagcuuauuuuguguuggaaauacaagcuuguaucaaagugugccaaugugucuguccuuauuaaggcuauaagaaguauuaggcauuaccugcucuccaauaaguguaguucuagcucuaaauuuugaucuuuauggcuucuugcauguucauugaagaagaauuuuaauaagugauuauuuggucaaauuucacauaucuaauauuauagcauauccacgaagauaaaauuauggcaaauaaaacugaaaacaaaaguggcgaaauguccucguaaugguaauugaagaucacaucaucagcucucgccagcaugugcauguguuaaaccguagagagaaaccuguaauuauuguaauugcucuuuuugcuuuauacuaacaagcuucaaaccauguuucaaaguaguuguuuugaaauaguuauuugucaaaucaucaaaucucggaaaguaaaugguaaugagcuuuuuauguuuauauucugacuguuggucauauuaugcagcuuuucaaguccauaaaguucagagaugaaacuggauguuaauuauuucugauaucaaggccaaagaauaaaauaauguuacgaguccugcuuaaggugaaaaauuaggaauauuugaauaucagaaucucucaauugggaaacucucuauucuuagaagaaaguuuuccuguaaauaagugacaauaucagucagcaaccuaaauuuuuuaaagcugaaaauugggguaugaagaguguagcuuuuucucauuuaucacaggaagugcuaagauaaaaagaucaauauuuaaaugacgccacuaauaacauuuuucaguacauuuuacauauggcucuuuuuuuuccccccaaaccucacaguugguuggaacagccacacauaggacauagguagccacuggguuuuaaaguuuccaguagagugucaacuaugcaaauuacauuuggcauuuuaaaaauauauuucuuauacuuacuauuuucagaaccaugauuauaaaugaaagcagccaguauaaaugcuuuuauuuuuuuuaauugcuguuuacuugcuauuacacagcaaaaauuugcuuaggccacaaaguaaucaaauuuuuaaauuccccacugguucaauaaaauaaaacauaucaaagagaaagcauguaggaaaaacugcuuuuuugugagcuuauuuuuuaaauauaguuggcacuuuaauuuacccauuuaaaaauaacaaugaaauuuuuuuuuaugcuucauuacuuuaaaacaaaauuauguugauuuuguucuuuauguuuaagcugauaaaaauucaccagacacuuaaucuugacauuguggcuacaucuugccuuccugccucugauuaaauuuucaaaaucccugcaugagauucacagauaccaguuugaacguuucugugaggcuaauuucucagggaaaaaauauggaucaguuacaucuuugguuaauuuuaucuaguuccuaauuucugcuaggucuaagcauuuuaaauauaguguugguaaagcauccuucugucgcugggugauggcauuauugcaggcagaauuaggagaaaggacauuggcauaggagaaagaggguuggggagaaaaguggucaggaaaaaagaucuaauaguugaugcagucuuuuaaauaccuuuccaacugaucuacaggaaauugugcugaagaaucauuuguuuccuguuccacuauaaaugugguuugcauuacauccccuguucggcuuuuuuuguuguuguuuuguuucuacuaaauuguaguaccacgauggaggcuugagaauaagugaugucuuccuuuauaacuuaucuuuuaauggcuugaucauaguuggauuuuagacacugucauauuucauuauaugaauuuuguauguguguguuuccaagccuacuugaaacuucuauuacugcucugccacuaagaaaaacaaugcugcagucuaaguucuuuagaaucacuauuguaggucaaauacauggucuacaugcugccaucagggaucuauuaaaugaaucucuuguuuacucauucagaaaauuuagagauuuuagaugugguucuggcaauuguaaaaguuguuagaauucagauuuacuuuugccuuaagaagaaaauacaguggagacauauauuugcucugcacagcugaccuaaaugcaugccuuguaccugugagaauuucaguaugcggacacauaaaagauuacugggccuuuuuucccccuccaauauuaucagaguuacaaaauaaauaaucuuucacagucaacauaguuuaaaaguaauuuuaguuuuaagcuuuuucaaguuuuuauauguuuaauugcacuuuauuagcccuuaauacuucaaacauaacucuaagaugacacaggcuaaaguuguauaugauaaacauuauugauuacuuaaaaaaaagggauaucuguauauucauaaaacauuuauaaucuauuuaggaaaucaucauaguccuaaaaaaaaagcaguuguuuguauaccaggaaaaagagaucaguagugacaaaaguggaaaagauacuuguauaaaauugucuccuuuagugugaagugaucuacugaaaguuauacuuggaauuuucagaaaauguccauaguuguaggcuuuauaacauuucaaauucuguaauaaacuauuuggcacauuaucauaucauuuuagguauauagauaccauggcauuuuauuaagcaaaacaauuuuuuucuucugaagaauacuuaaggugaaauuuacugguuuugagcuugaaagugguuugagaauuauacaugaacuccacuuaaacuuuggagacuuuccuuuuugcagugcuaaagauccaugacuugguuccaaacuacaaccuuuuauuugcagauguauuuauggcacaguaccacauucugauuagaauuuaagaguucacauuucugauauuucugucucuaaaugcuguguugcuucuguuuaccuaguuuucuuccuauucuuccuaauuucuuaaagaaaucugcacauauucauugagguauuuaauccaaaaagauuuaaaagagacacuacgccucuaacauucuguuuaggagaguauacuacuuuaaacuccguucuccccaccuaaaaaaggggggcuaaagaguggguuugaacaccugagaagucagaggugggaacaguguagaugauggucuaauuucaggcucaaccaaaaaaaaugcaggcuuuggcuggcauccuccagggaccuagcucugugcuuuccuagagaccaaauuacacucaucuugagagagggcauguugagguaauuggugggagagaguggggagaguugaauuccagcugcuuccauuguagcuguccugaaaaugaauaggggauguuaacaauggaggcuaacauuugacuuggcuuuuucaccuccacaaaccuaagggugagaauuauagaguacugaaugacugcaccaauaaugauccuguuuaagugggaauugcuauguugggaaaaacucacaccauuuuaaaaauaguugaugcauuuaccaaccacaguccuauuacuguagcccaauaaaguuuauccacaguauggaaacacuccuuuuuuuuauugucagccaucuaguguguguauuggaucuucaccucuuugguuaccauuuuaaaaugcuccuacugaaagacauuuggaaggcaccagaaucccaucuccaagaagggaagcaagauacaagugcccuguacucccuuucuccuagaauguguggucuuuuuuuuuuuuuaaggagaauaaauacuguaugacucaauagcuuuucuaacgaauaaaacaaauuaaauugauguuacaugcguauuuaaacccuauccaguuaaguacugaugugauuaaaauaaucaaauguauuacuuaaaaaauuaaaaaggauaaauucugcaccccauuauuuuauugacuuuuaaauauaaauugcagaaauguuuacauuccuaauggcauuauuaagcuaaacugacaaaucagaggaaaaaguugauuggccagcacauuauuauuucugcaccuguuauuacagaaguggaggcucagcauuaaaggagcuggauggaugcuguuuucuuaggcuuccuuugugugauguggggguugggauaaauguguaacaaguguaguuucacuuuguagugccuuuuuguguguugaugugauuaaaagacuacaguguuuuucaugucgcuuugaaauuaauaugcaaauaauaugggauauuagggcuucccucuaccugcugcacuaagcuucccuaagccaaaugggguggggauuggugucaacuuuuuucauacaaguuguuuaguugcaaauaucgccaacguuuuaucucuacucugugaauuuguaagggggggagggaaaugucaaacucauugaaguaggauugaagaucugggaugaaaauacuuuaaauuuuuauuuucuacuuauauaucagccaggauguuaggagaccuugaaaacauuuugaaaaaguuguguaacauuaccaaggcuuugguauaagauuauacuuuucuucugguugaguucuuccuuguauuaaucaugcaauaucauuucucagacacuugagcccggcucuccccuggagcauagguggcaauaauuguuuguuauuauaauucuagaauuucuuggguguucauuguccguaauucauuucacacagagaaaucuaaacuuucuucagccaguagaauaaauaaugccuucccuguccuuuccuuuucuuuuuuaaauuuugaguucuuuaggaaugucauuauagucuuugaaacguaaugacauuaaauuuggauugaaggggaagggagaggaacuuuuauuucaugccauccaguggcuaguuugaguuugcaaagaaauagauacaaugccauuauuuucugcaagauacuaguuaacacuauucucauaucaguuuagacuuuguccuguguaauaauuuaaauuccuagauuuuaauaacacuuaauauguagcauggaucccacuuaaucuccccccggcuucacaacaaaauguuuacauaaaugaacucucaauuuugauaucaacuauuuaacucacucuuuccugaguuaauacuuccauaauuaaacauguuccacaguugccauaggaguguaucuuaaaaaugauguucuucucuguucuuuugagccaucuguuugcuaggucaguaaagaaaugggagccugauuuuauuuuaaagccaauaaguuauuacucuacuauuguauuagacauucagcuucagagggaguaaaagauaaaauuccaucacauuuccacuuucuuacauuugcagcagaaacuuguaugcucaaauugguuauuuucaacucaugacagcugugauauuuaaaaugaucacagcuguugugacuuaaaauugauuuuucuauuaacaccugagaaaaagaccugugccguauuaaaaacuuaaauaagguaacuguaaaauuagauguguugaugugaaucugguaauccuacuucccagagguugcaaagugcagcacaccucuugcaugcuuccagggaaugagcuaaaacugcuagaaauagaugcaugauuguuaaaagcguuuacauuuuaaaggauuccuguaauagcagauccucuuggcccaacuuuacagugucacuuuugcugauaaaaucauuuaggauucaguuuccuuaauuaaccccaagaaagaugacuuacaugaaucauuaugauauccuaaccucuagacuagagaagcugcuuuaccuuucagauaugacauugaaaaaugcaaaaccauacggaauuguuucuuaugaaggaaguuuugguuuuauggugcuuuuccuccauuaucuuuagaugacgaaaaaggaaaaacagaugagaaaggacaaauagaucauggcuaaguagcuuuaggcuagcacuuguuuuuggaaucuuuaauacauuuuuaaucuucauguugaagauccauuuaaccuguuuuaaaguuagauggugauuccuggguucaguuggucuguuuaaauguuuaccuuuucaggauaauccguauuagaaucuugcaucucucaauagauuaccuauuuaacaaaguaaccaauuuaagaaaaccuaaacacauuuauacauuaagauauuuuccuguuucgaguuagaugauguaguauauaaaauauauggcuggccugauguggaauuauguauagacaacagugucuucacagaugcauugccaauagggagcuauguagauuaaacucuuuggccaguccuaggcuuuuuaccuguguaacucaaucagaauugaaagcaugacagguuuuaugaugaugaauguauggcuggauuggagaaaguaugguuggguggguagauagauggauagauuucauaacuagacaguaauagauaaugccaauuauuuauuacucaaacuuguuuauuccucagaaauuuuucugcagaguauuauuuugauuauugcauguaguucagaacauuuaguugaaaaugauaaaauauuugcugucacauaaucaagacugcuauagaguugguucuaaaaguuccagagugaacauacauuaccugugucaaaguuagaggcuaagacuauggagggccauaagaucacaaagucagacuaucacauacuaagugaucaugggugucaauggcuauuuccuuguuuaguugaaagaagauacuccucgagauggacauuguuuauaugaagauuuaagaaaaucaaaguggauauuuguugcugacagacuaagauuacaaacauauaucuuuagaacaggguguuccccaggggacauacggcaauaucuggaaacgcuuuugauugucacaacugugggggucaggcaggagcuugcuacuggcaucuagggcuggaggccagggaugcuacuaaacaucuuaacagcgugcaagacagacccucagaagugcugagguugggaaguccugcuugcaaagugauauaucuggaccuuaagaauuaaauaaugucauaauaaguuccauaauuaaaucuuggcauugugaggcauuuauagaggauaacauuuuuuuguuuuuuuucuuucccuuucuauuucccuuuuccuuuucuuuucuuuccuuuuuucuuuuguuuccaaaacauuguuuuuuguuuguuuguuuuggcauagcacacuauagcauugcccagguauuucuacguuuuaccaugaaaacgugagauuuuauaguguauuaaauauuguacauuauuugugaaccaacuggaauggcuucaaagcagcuguuagaauauguugagucaguaacacaacaugucugcauacccuaaacauauauuugucuuaccuuuuaaaauguuuagaacccucuaucaguguaacuauugguuugucuugaaucauccuaaaugaggaaguguauuaccauuuuuucccuacaggacauaaaguggaaagaagaaauuagcauaaagaaacuaauuaauaauuauguuuuaaguuuuuuggcauuacggacauuguuuacaucaucauuaacaucauaacaucauaucgucuguuaucaagaaaagauuaaaauuuaaagccaacauugaagauguucuuuccagcuuucccaauaaugcaacuccuuuaccuccucacaacuggggaccucucucccugccacugcugcgcuucuccucaauguggauaauucuuggccaugauacggaagugauuuugaaaccucaguugccuucuguagcacccuguggaggaagguggcaggaucugguggcugagucuuacaucugccaacuucuagaccucacuccuuaggugccacauuuuggagcuaguugccaagccucacaguaacuugagccacucuucaauuuccuccccaugauauacaaaguucuccaagguuuaaugagaguagauauggaggcugggcacgggaauggcagcucugauuugcaguauaucuuugguguacagauaugcuuucauuuauugcuuagcccauuagcuaauggaauuucaauuccuucccacaggcauucucagacccugcacuucacucuuccuguuucccuguccagcuugguacaacacauucuaguaaaaucacacugauguguuuagguuuacuuuguacaucacaucuguaaccaucuauaaguuugcccuaaacuggcauuuauuuugaacugucuuccaccuuuuauuguacagcguugucuguacucaaagugagcaacugaaaagaaaauuuuaacauucuuuuugugugccagacaaguaauaaagauuacuauuuuuaugguaauuuuuuuauuugaauauuucuguuucuggaagaugguaauuuuuuuaaaucaugaauuuccuguaagugaaacuauuugagggaguauugaccuuuuuuugaucaaucauugauuaucuguguugcacucucaguauuucucuuauaguccauaugucccucugaauaauuguagaacaauaacuugcuuacacaguguuuuuagaauaugcuucaggaagcuugccugugugguauuuaacucagacauuuauggaguauaaaaccaaucuuacugugacuuuuaauuauuaggaaaguggcuuacaguuaaaauaaagcuuacagaaaauauuguagcaauaauuaauauccaguaaaauacaguuguaagcuucgguucuuucagacauuuucucaacccaguucuaauuugaucguuacugcaccucaguaagauaggugaugcaggagucaucaucccauuucacaggcaaagccuggccuguucagugagguagccacuggccccauguggcuauuaacauucaaaugaaggccaggcacaguggcuuaugccuguaaucccagcacuuugggaagcugaagcgggaggauugccuaagcccaggaguucaagaucaacaugaucaacauugggacacccugucucuagaaaaaguuaaaaaaaaaaaaaaaauuagccaggcaugguagcgcucaucuauagucccagcuacuuaggagauugaggcaggaggaucauugagcccaggaagcugaggcugcagcaagcugugaucaugccacugugcuccagccugggcagcagagcaagacccugucucuaaaauuaaaaauaaugauaauaauaauaauaauaaauaaaugaugucagucaaugagaauuaaauaaaacuuuaaaaagaucacuuccuugguugcacuagccaaguuucaauuacugaguuuucauauaugaucaguggcuacuguauuagcacagauacagaauauuuguaucauuguagaaaguuccauggggaggugcuggccugggaaauggaagcauugagggauuaaaacuugcugaagaucaugugggucaugacagaauagagucauugcugcuauauauuccaauaggauauuuuuacauuuuucuuagcuuuauugucaaauaucugauguaagaauugacauuuuaaugcuaccuuguagcacuuuacugaaugcuuaucucaacugaauuuaaauuuagagcuugaguuacacaaacuuuucaaaggauacagcccuuugccugucugcacacaauggggaccuugaauuuccagccagugauacccuccagaagggaccaugucuuaaugcaucuuuguagaccuuuuggcauauuguagacaaccaagaaauguuuaugcagccuaaugaaugugucacauccaccauacgggcauauguccauacauacaguuagacaagaccuuuggguagaaugcucccgagagagcuggugucugccaaauuuuacagagcucaugccucugcucuugcuguuuuaguaaaaaguaguauuuuaucaaaaguuaaauuggguucaauauucaccauuuggguaauggguacauuagaagcccaguccccagcagcaugcaauauuccauguaacaacaagcacguauaccccuuggaucuaaaauuuuuuaaaaauauguauuuacucacauaauccaaauauuuuucauaguaaaugaaaacgucuguccaucuuguccuuagcagucauuuagucccuaaccugacuuuguguuguuauaaaguugugucacuuaaguaguacuuaaguaaguacauaccuacauccauacuaucuuuccauuuccugcaucacugaguuggacaaaugugcccaguuagcguugguagugcugaagaccauguucauucauacaugcacucaaaaucauauuaauuacuuuucagugauaaccauagguggcaacagaugaaugggcuagcccuaggcuauuauuaagcacugggaaugagauuguuggugccuuguaccugugcuacuuuaacaggugagacaauuccagagcuuuccccaucauccucucguugcuacagucuagacauugggagcacuggaagccuauggugacacagacuggcagaugccuugggcuucuaaugguguauauguaagccaucauuuuguuuguaauaauuaugguguugagaagcauuugugugcugugcacucuuucagcuugugccacguuuaguuccuguuaugcaaauaccacuuuaaacuuagaaauuccaauuugcauuaauauuuugguuucauagagcuaacuauugcauuucacaaacaagugcauuuuaaugaguaccggcagaaugauuuaaaaauguuauuuauuaaauacuauuguagaaaaugcagucuuugguugccagaaacuauuaagacgaaauauaauguguguugaggccacagaguacaccucuucaagaguauuugacccuuauggcuuucagugauacaacagccaaugcucuucaugcaggcuuggagggcagagguaauuaauauaaaauagaagccagcguaccauugacguuuggguuuacuuuuaaaauguaaacauauuuuuacuauuugacauuugucauaagaccauaggucauuuaccucugaguuaaggugaaggacuuuaccagucauaaacacccaaguuuuaaagcaguguuuucuuauaucuuacaucuugauguuaaauccugaaauggaguuuguugcugcuuuauaauuuuuuucccucuuccuaaaagccuuuuuuuaaaucagaauuguggauaaaaaaauuuugauguacaaugugugggaaaauaaaaauuuugcaacuggauuuucagaaaugaacuauuuuaacacauggacuuugaaugcugcugucaugguugucauagcuugugguuccuaauuauaaugagcuuuuuuggugguguuauugcaguuguuuuauucccccugcccccacccagucuucaacucacuuuucccagaaggagaguuccaagccuuugaaaauucucaugauuuugcaaauccacucuauuuuugucuagaauacaggaaaguuaaaacuguggcugguaugaugccauguuuugaauccaauuuuaaagcaacccuuugcaacccagggaguaaagcugacaucuuuguaucuguaaugaagauaauuauaccugcaaggugacaucacuagcaaaguaacaaauacccuugaaaacggaguuccuggucuucucugaauucuguagaccacauuuggcauuuaacaccagacaccucuuucaugccugucguuugagaaguugcuuucagaugaauuuacuaaagcugacugacacaggguuaaauuaauucuuuucuuuauuacucaaagugauacagaccuuucuuggacuaauguagcuuaauuaguggucaauuaaaacugaacauugcugaauugaaguucuuugaucaaacucccuggcaugggcuugcuuucuuuaacuagccaccaucuugaauucauuuggaaucaguaguauaaacaaguuaaaaacugguucuuuuauaagaaagucagcaggcuuguauagcugugguuucuuuuuuuacuucuguaggcggcaauucaaaggcaugcuaaaugaaaacaguacuacacccugaaaaaauuacauuuuuaaaaguaacacuaagcagucagaaaacagucaacacccuuaccuguuuauucuagauacauuuaucuucuauguagaacaaauaauuaauaauucacuucccaauuucagugguugauuuuguuguuacauggaaggugaaaacuccccacccucccuugcaaagucuauaguuauaacaaaaagugaagcaaacaaaauccaaccugguuguugggaguagagucggaaggggcacgguaaaugaaggugugcccaguugcuccuaaauucauucuuugucacucuugggaaaauaguucaccucuguaucuuuggagugggagugacacacuacuucauuuacuuauugauuucaucauuuauuuugaagggcauuauccuaucaguauggaaacugauaauagcauauauuucauaugaaucacuugauuaaaaauacacauugcuuuuguuagaauuugggugaaguuacaaaaaaagagaauuaggggagcugaaaacuggggcagaggaaaucguaagcauugguaauaagaucacccaccuccauuuauccaguuacaugucuuaauauuuaaaguguauauaccauucuugucuaaacauaaauugauaccauuccguaauccuaguuuuugaaagcuuaacaaccaaaaacauacauccuagcuggcauucaguuagugcugugcauucuggaguauuaauugaaacugguacuuuuguacuggaaauaaaaguaauagauuagguuuaaauagauaauuugcuuaguucauagugauuucuucugguuuuuggaaauuuucacagagaaagaguuaaaggaaauuuggaagugaccauguacaguguucccccuguaagugacagaauuuuugugguuuucauuacuuagaucgaaaaauuguaguuauaaucaauaauuaaaauuaaaaauuuuaccaguugacagaaagagaaauuguuuauagucaaugugccuuucagccuucucucuugccuucucccuaaaaggcugauuaggauguaauaauuggggaugauagcgggaggaagacgacaauuccauuuaauuaaagauaauuuauuuuacuucaaauuggugaugucccacaugaauaagaguagcuuuagcagauagauuuauuaauggguacugacaucucaguugacagaaaaagcaaacauuuucuuuccucauuguuuuuauugugucccgucaccugaaacugcugucaccaugcuuccuuugcugcuugacagagcuguagacuuuuccaccaaauaugcaauuauugguuuaucauugaaacaaaguugauccucuucugaguuaaaaacuaggccaggagcuugaaaggcgguucaggcuuucagagcuaaugcuacaaaugcucucuucuuaaaucacauuuucucaacugauccuucccauaucuaguucaugaguagauugaaccuuuugaauaaggaccaaagauuuccuuuggucuugggugaggugcuugcaugaauauuccuuuaauaccuugaaugucuuggauaaugaaaugugccccaaaaaacuaccauuugcauuacuuagguucauuccugacaaggaauucugcccucgugugauauguucguuguugucucaugcaaucguaaauggaucuuggaaguugggacaguuuuuuuuaauuaggaaguagauucaagaaaugcaugauauuguuuuucauauaaucuccucagucuauagugguuguaaaggugugcuguuuagcauaccuuuagcaaaacuguauuuauaauucuauguaucuuaaggcacuuuuuaaaugcuucugacaaacugcauucuguuuuuccaaugucuauuugaucucuguuacauuaggcuuauuugucuuacucucacaucgaauuccuauauuuuuguuuauguuuucugguguucagucauuucuguaugcuugccuaguauguuucuuucauaccgucuucuucacugaaugaaaugcagaccaccuuggccacuuccuuccuucugggcuucuuuuccuauucacaacuuccgccauucacacugacccucuagcuuuacuuauaucuauugcuccugcugcuuuguugcucuaauuuucauauauauuuccuuuaugcuaauauccuuuccuuaacucuuuggauuucacugguuugucuuuccagcuuuauuuagaaaauuaggccauauaacuaauguuuacaccguagaaaggaaaaugagauucuuucuuucuuuuuuggaagugaagaggugagaagguugugguagagguuuucuuuuauuuuaaaccagauggauuuauuuuguccugcuuugcuauuucacuauuucaaauugauuuuaaaucagugaugguguuuucaaggauuaauuuuuauuaaaucuugauuuucaugucguguuaaccuuuuccuuccccucagccaaagggucuucuuccuuuuuucuguccauuucacuuguuuguuuuaauaaccugaucucuccagccauuauuuuauccucaaauccugccacuuuuauccaucuuuuuuuauugcacuguuguccuuacuucaccuuauaucuuuucuucuucuguaauuauuacagaauccaugauaccuucuccaaaauucuaacaaagaauucuggaaaaggagaaauugggaaagagaaaaauugcaaguaauguucuuugcugagcccuaggaagucugcuuggauuuuuauauucgacugauauuccucccuagaguugcagucaugauucuauguaguagggacacgaaggcaaaaguuuaaauagacuaacacugacccuuaauuggaggugauaauccuacauauaaacuuucaggagggaaagcgauccugcauuuuacaucagguaaacucaguugcacccauugccaguagcugggucagguguguagggguguguguguguguguguguguguguguguguguguguguguacguacugggagccagguuggaaguaggaagagaaggagguucuucuuuccucucccacuugcaagcuauuuucuuucuuuucugucuguuuucauuauuucuauggcaaguuuacuugccacgucuuaaacaccuucaaccuuuuugucucuuccuuuacuuuuuugcuuuacugcuaucaaagaguuaaggaaguccauuaaauuggaggccauuccucaccauaagagaaaucuggaugggaugcuuuugacaacugggcucucuuuaguagcuucucucuacuugggaaaaugucagauauuuugagaaauaaaugcauugccccaaacugaaaacaccacuuuuauucuguaaaagaggcauucagggaaggagaccuccucuauucccaggaggucacaggaacugggaguggcaagaaggaagcugcuaaacgggcuccagaugcagcuuuauccaggggacgccucaugccuggucauuuggguggcugggcuugucccaccuccccuucuucaugcccuccucccggucucauccuaggcccucccaccccuaggccagccacaggccucacagcggacaucugcgggucugaguuucauauauccagcaugaaguucccucucucccucccauuaugaauucugggcugugguccugcuugcuccuugugugucagauugaaguucugaugcugucagccaugucugaccaaucagcaaacaacaccacaggaugaaauuuaaacaaugcagaugcucagauacagggcuauguugccuggaccacgaagggaaagcagagguaaggucagagucuccccaaaguggucuauccugagccugccugacuugacaccucuugggcugcacugugcugcuuugacuuguauguuacccauuugcuuugcacuacuucugucuucccuggcauucaccagaacuuucauuuuaauucgcucugcccggguuacuuuaccaccuucaucugcucacguccuuuucuuuuggauuggugcugacugucauuacgaauguuccuggauugccucguggccgaggguccuuggcaagugccaccuuguucaggucuuuuguggccagacuuuuaggaauagaggacugcugaggaucagggcaaacggacggaguuaauaggccuuauuaauuuucccucugcaggacaguggaauuuaucauucgguuacaaccacgguuuuguuucuuaccauugugauguauugaauuguaaauugagcuuaaaucaucuuuuuuucucagaaacgguuuacuuagaaaagauauaaauagauacaaccuaaacgaggaugaaucagcucaucuuccaagaguuuuggagggggagaaagggaauugauaacucucccccacccgaauccccccccacuuuuuuuuuuuuuuuuuuuuuuuuacaguuuuugguguuagcucacuagauuacuguuugcaaaagaagaaucucaucaucauccucuucuguuuuaaguguuuacuuggcccuuuuauaauuuaaaguguuuacacgguucugugcucccuaggcccaucuggaaaauauuuaaacuucauaagaucuauaagacuagaauaucacauauaaugggauagggggaaggaagaaaaauuagagccguugcguguguuuagaauaaguuaguuguuuguucagaagcggcugcuggaggaauuggaacaaauagcugugugcggugaacgauuggguccagagcuguacauuucaccacagaaugagccuugguuugugaaacugacauucuguugugacuucuaaauccaaacaaaucucugcaaauuucugcccgaucgaguuaauaagaaaauauauacaugcagaggcgagagccguaugcuacuuguacuucugucaguguugguggaaauaagagacggauuuuaccuacuguauuacauucaaccagcaauuggcagaacccccagcucagcggguuuucuugacuuuuuuuucugcugugagaacaaugggaugcaaaagggcuucagaaaaggagagcagcagauacgggauuggggucacuuuucuucuaauugccuuguaauuggggagugguuuccacuuucccacuaucucacuggugggaggggaggaagacagauguggcuuagcgguaacgagcuuucuccaggccggaugugcugagggaccaggggggucauucccugcucugggccugugaucugcuucacaccugugcucauuuucccccaugaucgaugaccuuguauuaacccagagugaccuuuugccuucgccuguucucugggacgagcucuuggcuaguggacccuccuuucucucugauuuacaggugguuacuggagccacauacacuuguuuuucauggugcacugugcacuuagcagcccggcaagaccugcaauuucaucccucucaaggggccaagcaggggauuggaaggugggagggaggagggugccgcgagagugguugcuguuugcaugugcuuuucuauuuuguggcucauaugguaucaauuaccauuugauggcaacgccaggccugaggcccuucgcauguuuguccugugagaaagaucuggaagaaccgacauaugguuuugauugcagcaauugcagguugauagaaugaacgcaggggugagguggguggguuuuccuuccggcccuuuccacucuggguugcuaaugugcuucgcuuguggaacuggucuuuucaucauccagccccucccccacuuaccccucccccacccccaacucccugccacuuugcauucccugccccugccuuccaaaugaccgccaggaacauguggcccacauuaaggaccuucaauuaaaacaaacaaaaaauuguccacucuucuguucagucccagagcaggucaguccaucaagaugguuggaaguguaccacaguuaagaaacaaaugguuggcauagggggcagauucccuccagaagcuugggacauguuuuaaaauggcuguuaguucagauuguuaaacaucgaaaugaugcugaaaaauagcagcaauagagauuaaugugggguguguguguguguguguguguguguauaucuguauguguguguauuucauuuaagacaccucuuggaaucugugcaucugcugcauagggacaggaagaugaugauaauggauaggaguucuuugggguuccaucuuucuguacaucccaggccauaagaugauggaaaagcaagugaggcaugugugucucuaugagcauuucccuucagaaggaagauguuggagacucaucucccaugcacagugacuucucucuuacuaaauuugugaugguaggggguacuccucauuacuguggcucagcagggauugcaucugugaauaugccaagggagggucuacuauuggggaauggugagaggcaaagaggagaaaagaacauuauaggcacuuugaauguuacccagcaacauuuuuuuuguuguuucaaaguaacaucuuucuauaaugcuuucaaauuuaccugucugguaaucuguucuaagaugggcagcccaugagguuuugacuuuuuucacuuuggcuauugcauuucaaaauauuacucacaauuaggaauuuauaccauuugaaacaauaaugugguaucucaugaguaaaugcugccauuaacaucuuccuucuuuuaaacugaaaacaagcaaaccagacccaaaaaaaaaaaaaaaaaagcagaaacaugcucccccaagaaagcuuguuuuuuucuuugagauggagucucgcucuguugcccagguuggagugcaauggugcgaucucgacucacugcaaccuccaccucccagguucaagcgauucuccugucucagccucccaaguagcuaggauuacagguguccaccaccacaccuggcuaauuuuuuguauuuuuaguagagaugagguuucaccauguuggccaggcugguuucaaacuccugaccucaagugauccgcccaccucggccucccaaagugcugggauuauaggcgugagccaccacaccuggccaagaaaguuuuuuaaaugugagaugaauuuuuaguuuugaaggccagcuauugaaaccuaaucacacugcuugacauacuucuucauauuuaucuuuauauuagagcugaucuuuaucaaaagguaguagaaacuaaaaaacuuaaguuauugaccuaaauuguagggaaaugucugucugaucgacucuagagagaaaauuggccguaucuuuauaaugguuacugaauguauaucuucaugaggcuacaguuuuuuuuucuuugcuccaacuuucuccuuaugauguagagauugguguauuaaauaaucacuuuuucaacagucuugaugacaauuuuauuuugcuauuucauaaucuucauacaaugggauaaguguuuucagagauacguuugaauucagagcaacuggcaauuaagugauuugcucuagucacauguuuuaguaguagcuauuugguuauuugccugauauuuaaugcacacauauguacccuuaaaucaucauucagugugauagcuuaagacaacauuucuguuugcugcucaugccacuauuagcuacguuugaagagugauauacugagaaguuuaauuugcugggguuuuuuucuaaaaacauugcuuuccugaaauauauaguauugggggcucauagcaaaaaaaccguaguauauggguugugagccugucuucgaacauggugggucacuuaacagcagcugugcuggagagauauuugauuugagaagacuguuuugaaucuucucagcccuaacaccauucugguuuugaaaugggaaaauggaaaagaguuuuagggaauagagauaucucagccuugaaaggaagcauagguagaaaucuuucaguucucacucagaugaaccagcauuccuaaucuggcuacccucacagaggacaaagagucugcugggaaauguggguuuauauuuguagagacacacuucagaggcaugagauaguguuagauaccgacuggaugcuucgugcccaacaucaauuugguuugcagauugaaauuuaggaaagcuugcagaggagccaaucuuuuuuauauacagcaccuuuaaaaaaaagacuguccacuacuauuaaaaucugauucagucuucuaaaauauuacuacauucaagacaacuuuuaaaaugaucaaauuuagauagacaucaaugauguuaaaagauaaaagcccuccuacauguaauauauagugucuuaaaccuuauuuuuuaaaaaagggauaccacuuuugccaaaaguuucaauguagggauacucaaacuguccuuggaaguccuaaaaauugcuaguuuuuuuuuuguuugcuucuuuuuuuguuguuuuuguuuuuuguuuguaguuauucacaaauggagaaauauuuauaaaauuauauuauaauuuguaaugcacgcaaacaaccaucagaccacacuugaaucagagaguuacaguuauaaauugaggaaagaggaugccagcacaaugccuaauggagugaaaaauugugcuuauuuucacaggacucucuuggagaggagcuaacuacuuuccucucucuuaauacccagacccucucccucagcccugacagcacguuacagaaugcauucacuuagugugugaagagcuagcucaccaccucccuuuaagaucuauucuuguuauucauacauugcaaauuuguacuuuuguauccacaaggaagacauuacuaacuucaagaaaggcagugucaaugaggagcaggaaaauacaguaugauacaagccugccaaugaaagaauuauacucagacucuaugcgcucuguuaaacaaaauuugaaccuuugaggaaaaaauauuggggauucugaugaguguuuuuacucuuucuuuccuuuuuuuuuuuuuuucuauuuggaaaucauggcuuccugauccuaagggauaaaaaaaaaaaaaaaaaaaaaaaccucaaagaaaagacucaacaggcuuucuggacaucaaauaguuccuacaaaacaacauucugaugacuugcauguaaagaaaucagaaacauaugaauuaagcuucucucgaaauacauauggguugaaaaauagagagaagugcugagaaaauguguuuuggguuuugcugagcccaugacguuugaaaaauaguaugagacauugaacaaacacaaagcauggcuuggcucacccauuccuaauauuagccuucuaguucaacggcaaaucaguuuaccaugugccuaaaugugagccaccuuggugcacucccccacacuuaauuauaugcaguuuaaauuuuuucaauuaggagcucaaaaauaacauugcauuucaaggaaaugcaaaucuuagcauuuucuuaccugguuuguucaccucagaccauuuuagaaaacaccacagauuauuucaccuuaggagcagucacacugauguggcccucuuugauguggcuggcauauaacagaagaaacguaucauuuuuaagaaacuggcuccaaagacaauauugcuauuaaauugaagccaaaaaccacugcagguaaaacaugaugaagaugaaggacgcccucucuuagccauauaguagaagcccgaucauagacucucacccuuacaccaugacuugaguuccugcucauuuuuaucccugagcucugcagacuucuaagcaguggaaguuuucauucucuuucccacauugcacucaagagagcuaacaugagagauucuaaauccugggauuccucugcaucuggcuuuaaguacaggagcagaacacagggaauuuaaggaacaaaaauagccagagcuucaggcuucuuccacugaugguaagucauugacaugcacuuggaugaaauccuguaucuguucuuuggacuagcacuaucgccugagauuaucaguuucagagaguuacagagaggcaguagauuucaucuuuccuauuucaggaggaguuauuuugguuguuuaaaaaaaaaaaaaacacuuuaauguacuuuuccuaacuccuucacucagaugguggcaagaaguuugacagaauaaaguaauucagcuaauauuuaucaaaugccuacuaugagugagcuguuagaauauaacccugaacaagacaagcaugagauaggcaaacagacuauuaaaaccuagacugauaaugcauugauugggguguacaggcuccuuaagguagauauacaaaggacaacuaguccacauuuggccuuagaggaagugaagugcaaggaugaaugggaauuaagcuggcaaaaugcaaggguuauaacuggaagcaggggugagcauggcauauccggugacccagaaguaguucagaaugccagaagcuuaugguacaaaaggauaacauaaaagaugagacugaaaagguaaacaguggccugaucaaaaagcgacuugugagcccuauuaaggaguugagauuuuaucaugaaugugacgaggagccuuucaaauggguaugccugagaaguaauugaauuuaaaagucaagacggauaggaggaccuggaaaacuuagagucagagaagccaagggaggcagaucugaccagaaggaggaaauugucaacagugucagauguugcugaaagauagaagugacauuuggcugcagcauccaggaggucuugagcaguuucauugaaguagugaguguggaaggaagguaaagaaguggagaacaggcauugcaagauaauuuuccaucaucgucaucaucaucguccucaucaccggaaaaugagcaucaauuaucuuaucuaccagacauagagagugaccagguaaggaaugacacaccugcagccugggagauuucagaaaacagaucauaaauauaaaacagaagacagcaacacaugguacaacacaugcaaagggcaaaaugagcaguguaggccaacgggaugaagaacagaaagaauuagggggcaggugaaaugggagaguuuuucaagcagucagugcgcuugagguuugcauucuggauugugccuccuuauaagucaguccaaccuguuuuugauucuccauccaguggaaauaggaaacaccaucaaagaugaugcauagucuuaacuugccugugacuucugauuauguuuccgaauuuugggaggaagauuaaagucauaaacugacucuugguuuguuauaauuucuugcaacuguuauuuuaaaaauccggacacaggccaaggcaggaggauucucugaggccaggaguuugagaccagccugggcaacauagugagacccugucccuacaauaauaaaaguaaaauaaaaagaaaaucuggaugcagaaacugagguguagauaaauauagcaagucagagauauucguaaauucuacaucgaugaguuucuugagaaauucugcacacccagugcuggacaacuguggaauugcagcgugauaccuuucacaucugggucaucuccauaugauaucuucuuccugguacaaggccagaaguucaccccacgcacaacaccuauggaagccacuuacgauucaaaggacaguuuuucugaaaaagggugcaugauguauacuucccuucaacacuaaaauucugcugcuuaaacuuuguaagugaaggaaaggacugguucucuucuacuuuggcugucuuccuuguuuccuauuuauugggugcuugcuuugggcaacccauuguauuggaugugcucuaaaccacaaucuuugcuccuaaggaguccguaguauuuaucgggggauacgaccuggauaauucauauaagauaugaauuucuuucuuuuucuuuuuuuucuuuuuuuuugagacagauucucacucugucgcccaggcuggagugcaguggcgcgaucacggcucacugcaaccuccgucuccuggguucaagcaauucucaugccucagccccccaaguagcugggauuacaggcacccaccaccauacucagcuaauuuuuguauuuuuaguagagauggaguuucaccguguuggccaggcuggucuugaauuccugaccucaagugauccgcccaccucggccucccaaaguccugggauuacaggcgugaaccacaaugccuggccaagauaugaauucuaaaaaaaaaaaaaaaaaaaaaaaaaaaaaaaaguccuuggaaaguuuagaagaugaaauacauuuaaugaaaauugagcucauucuuccccaauauuuguuccauauuccucuccauauuauacuauuaguacacaauccuguuuggacuuacuggaaaaaagagcugaauagcuuauccacaugucaagaaacuuucuguuuaagaacacugagguucaucaacaucaaaaaauauuuucagcaucauucaggcacuggacaugcucuacaaauuaaauaccuuagggccccuacuauuucaguguuuucucagugucuuguugcaguggcaaaugcuaugaacuacauuuuucaaaugaauauugaagauugagaaagagguuaagaaccucuaucuauuaacgauagaaccaaaucuagaaagaugucuccugcucuguagagcacauuagggaucauuauuuauagccauuuggcucucuuaagacauuuuggcaaugagggaaaaaucauagguugauuuucuugguggaaugaagaacauugaguuugcuaacaaagagagcaugagugacuuugguaagagagcaguuuuuauuucaguggaaaggcagccuccucuccuaauaauagcuacauuauuuaccuaaauguuccauguagcaacugauaacaaggcuuacugcuuaagaaauuuggccaucaucuuguccucucuacuagaauuccaucugccuacagaugggcccuugcuaauauuuuuuuucugaaggacaacauguaacuuaagggcccacuacuguguguuauuuuguuuuuuuaauugaggugaaagucacauaauguaaaauuaaccauuuugaaguaaaccauucaguaauauuuaguacauucacaauguugagcagucaccacaucugucuaguucuaaaacauuuuccccagcccagaaggaaacucuguauccauuaagcaguuccuuccuaucccccuacuucuaggcuuuauaaaccuuuaauuuuaauguuauauacacacacaggcauacacauacauauaugcuauacacacauauguauguauauauguauaauguguguaaauaauguguaaauauagacguauaaagauguauaauguggguaaauaaauggauguguguauguguauauacauauauguacauguauacauauauacguauauauguauacauauauguaucuacgcacauguauauacguguauacacacacacacacacauucaugucuauuuauagauuaggaaguuccaaacagaggaccuaauauuuccuaauuauguaaacaaagaacuaucuacuuuaaugaauguuucuccaccaggaaaaagaaaaauaggaaacauuccuugcuucuuuuaaccugucuguauauuucucuuaaauucucacuagaugcuaauuuaucaaggaagacaaaaaagacagaaauaauccugagccuuuuguuguguaaaacugcugcucuucuuguaaagacauuuucucauuaauuucaucaacacugagaauuuuaaacugcuucucaauuuuaagcaauuguauggguuuuacauuucuauuuuugaaaauccaaaauuauugaacaaaguaauuuaguuagcaaaguuuacauuucuuggaaagaaauaugaaagggucauucuuacuauaauuuuuauuguuaaagaaauugcuguuguucacauguauuuaugcccuccucauuccggaagaauauuugagguagccaguagcacauuuuuuugaauuaagaaaaaauuagaucaaaugaaaaaauaccuaaaauuuaaauauuuagagaaagccaacucaauuauauuuuaaauaugccugaagucgugaacuaacuaauguugaucauuuagucuucugguccuaucucaggaauauuauugcccuucuuaauucaucuuucaccuccuuuaagaaguauuucugaauaacccuauaggauaacuuccuuuacauuucuuuagcucauaugguuuauacaaaaggcuacucacuuuaucacauuuucuaguugcuuauuguacuucauaaaucucccaacuaguuccuagugaaaauucugcccuucuaauuuuuuguauguaauuuaccaaagcaccuagcuuugugcuagcuaaaagcucugcucugaguuaaauuagugaaauauugcugguugauuucaccuaaaaguuugccccgggcaggagggaagagggugggcauuugaauggguaacagacagagaagcagcugauuggacauagauguugacaacuugcauacuuauuuuuuucauuucaaucugugccacagagucauacauuugguaauuauuucaugcuuuuguuuucaguugaaaguaguuagggccauauguuuugacagaaaaaagauaauucguacuuuuuuucagcuuuaugaaagggaagaugggguaacaauuuuacaguguaccauggcagugauuccuguucaaaacuuuaccagauuggaaacucacuguucauaacaauucucuugguaagcagaagaugaaggcaucuguuuaaagcacccagaguuaaguuugaugcuucaaagcacagcagaguucauuuauaacucuacuuagcacuauuagauaucuuuaacaaauaugaaaaguuguccaccagauuccuuagacuguaggugauuuggaaggauauucuggucaagugcuaacuucugacugaggauuucaaaugaaaagaccuagguuauaaccccauuccugcccuuacucugucuugugacucauggaaaaggaaggcacuuaacccgcuccaagcuuauguuccugaauguauaagauggguagcaugguugaccacuuagacagauaauccaucucaaaaugaugauuaaagaagauaauggaugagaaaaguccuuuugauuuaaaauacuaugaagaugugaacuuuuaauaaugacuaaugauagaauuuugucaaauuugcuuuacguaauuaaguucaagaucaaagaauauaucuagagaaguaccuauguauuuugugaaauguuucuuugaguauuauuauuaucauuuuaugucuguuagaaucuuggccucacugucuuuucauucuugcuugaaugucgacucuucaaagugugacuuucugcuugugucugaugcaacuuucuuccugaucgcucuugcuuccugagaaggaauagguacuuaggaaugauggcuuuuuggcugucugugcuuauuagguacaaacacagcacuaaagacauuugggacuggagaaauaagaagagcgccuuuaggguuguaugcaaaaggucaaacuauaauguaguuagcauuuuucuuuguacugcuuucccuucuuguaacaaccucucaauacccucauaccuucucugcuuuccagaaaugcuuucuaaaaauugauuauugggaaaagaucugagaccucauugcccugaaguguaauuacugcugacaaacugugacagcauuucccaaagacagggagugauuggagaugugaugaaaaguggguuugugacuguggaaacucuuucagggauguaggcuuuuaccccucuugguaauguaccuugacaaaagucugcagcaaugaaauuaacuuguucacuccaaucgcaucuaaaguuauuugagcuuaaguccuuucuuaaggaugucagcuuuaggcuucaggcaucaaccuguggacuagaauucaaagggaaaaggguagggaauggugcucuuaaaaucuuuaggaccauuauagguaauuccauauccuaaagaaagcucagcccuaaacacauuagagaaguggaaugcacuaaaauauauuuuggcagaaccaaugaauguuuaucuuucucuguguuaugauguuauucuuaguuugacguguaucccaugugugguguguuuauucauucaugcaugcaugcacuuaguaaaguuuugagccuauucugugcccggcauuacaugcacacacacauauguccaagcacaccugcacauuuuuuuuuuuuugguaaugccuuuuuuaccuuauuguuucugcaacuggcuauccuuagcaggccuucuuaauguacaauaggguauagaagaaauaacaaucaacauuggaguaaaccuaaaauuaauuucugucuuuauuguagagucauagaauuuguuuuccucuggaagaugugcugcccucauuuaauugauaaaacagugcuuucagaggucacaaagcuauuuuuuggcagauauaaccaaaccuauuuugauguuccagcaccuccuaaugaagcaguagucgucaucuaaaacaaaaagcagucgguugcuaaaggaggagaaaguguugagaugugagaugaucuguuagacauaauugacaaucaugaauuugauaugauagguguaaacagagauagaaauaauuuaguuacaucuguuuaagauuuaagauaaccagaagcaauaauguuuaauugaaauaauauaucagguucuccuuaacauuaccuugaauuucuucacaugcacaucaaugcauuugguaaauaaaaguuuggaaacaacuuaguuaaguguuuagaacauauuagaguugugaugugcuuagcauccgcagucuuuuaucugugccaacccugagccugguaaugaagccaacucccacaugaauaaguaacauaaggaguguaaccaggaagaagucaggguuucaccuggaccaaauuuuaggcaauuaaguguuucaagagaucuuuagccagguguaacuuaaucaguuuaaggcacucucagcuagggccaagguacucauaauguuggcagugggcauucgucugauacaccacguugaaaguaauaggaaacauagagugucugcucaguuauugccaagagcaagagaaaugcagguguaaaaauauaaagaaguauuuggagccagaggcuaguacacauagacaagacuguauuuacacuuggcuuuaauaguucagauaauaacauggugguuuuuaaucaguuuagugugcugauauuuagucgugggucugguuucaccacuaaacccuaguguaacucucagccgguuacuuagccucucucugucucuaguaauauuaaacaaguguauuaauaccugcugcaucuuagcucaacuucaugucuggaagacagaugaaugguccugcuucuugcaguaacacacaagaaccuccuuugugcugcccugacugagaugaucuuguguucuucucuacgggcaaaacagcccuaggcugcuaaauggccaggcaguauaggggacuuaggacucuacaaagcuggguuuugguaggaguccaugagcaccgcggagagaauucuuaguuaucaggagauacgguuguaguacuuaaaaacucaaacuccaaaacaagacuacgugguuuugaaucucaguuuugccaguuuauuagcugugugacuuuaagcaaguugcuuaaccucucugugccucagaucccuuagccauaaaauugggaugaucaugcaacaauaggauuaguauguaagcaaaaugaguauauguacaguuuggcugcaauagagcugauagguguaaacagauauaaauaaugacuucuuuucugaaaaugacuucuuuucuguuuuucucguuggugaucccugcuuaugucacugggauggcugcgggaauucaguaggauaauauuggaaaauagcuuaaaucucaaauguucuauagcuaugauaacaucacuaugacgucauagcagagugaguccacucacaucucuccuggcaguuuugcugccucagaguuggaauaauaacucacugaaaauacuuccaaaauagugagccacucugcagauuuaauuuguaauauuauucuuucuaauuauuaguggcucugucuuaaguuccuuuguuuuaauugaagcaggguuuuuuuucccccuuguaaauuucuauacaugucaaaggcuaccaacucauuuuuauuuagaguuugaaauuugauuugaaaaauauacugcagccagcuauaugaaaaacauaagaggauauuguugacuuuugaugaagggaagaaagaacaagguagagcugccuagccaugaagaacgccaggguuuuuguaaccccuggugugcuuugcacgcagaaggcacacacuuaaauuggcauggcucacuuuuuuuacugugccuuugcugagcuugcugcaggcugagugcacugguagaggagugcagggcuguguucuggccaucccugccugcucaggccucuccugcuccuuuguggaucgcccaggucucugcugcuuccuggugccgucuccuggauccucuugacauuuuuccguucuguaauuugauugacaguuacagacaaggaaggggacugaaauucuuaccguuuugugacuuccuaaaacgggaaaggaaauuuggugaaugagaaggggaaaacgccucuuggcugaaauuauuuacaggauuuagccccagguuuaauguacucaugaaugaauaaugacucagcugauauuuagaagccgggaaaauuaugcgauuuuugugaugggguguauagauauggauguauacuugaagugguuuguguucuaaauauauuaacaugcucagggaauuucuuuuuggggaaauacauauauucuuuuucauagauuuuuguggugcauucugguagacggaagaugggucauugcucaguuaguaaaaaugaaauaugaauaucauacacauaagugguacauuuuacacuuuuugauaguugugaaauacucuuuuuuuuucagacuaccaauaaagagaauuugaggaguaaaacucuucuuaccaugaauuguuuuggggcacuuagaacuauuuaguuaauucuuuuaaauacuccaacugauuuagauagaauaaaagugucacaauuuuaacagcuuacaccagugaaauguuuccacuuauaagaaauacccucuuauuugucagcauacugaagacauauauguguuauuucuaagcacauuuccuauuuaugugauaauggagaucgcccuuuaaccaucacuuggacgugaaggaggauucuucuuccuccauuaguaaauauuccuugacuugauaauacugaaaauaugugaggugaaugagcuuuaauccugugguuugguuugguuuuugguuguuugcagucuuggacuguucaccugcacugucuugugccuuugaguaugauuaacugccuugacgccuuacagugcauuacacaacucuacuucuuccauuucuugacuaaucucucaugcuguuugacugcccauuggaaucuuuaaguuagcuacuuaggaaagacuuuaggaaggagaaugcuaagagaacuggcagagaagucaggagccugggcucuguccaggcccuggcguaaguccuuucaccucuuccuuugacuccuuuacaaaaugaaguugaacucauucgagcuuuaaaaagaugacgccaagaggcaagacagagggcaguagaugugaaaguaacaugaaagagaaaggaacaucugaaaaaaaaaaaaagguagaaaaagauuuugacaaauaguacuaaaaacaaagaauauagaauagagagacccaauuauacugauaauuacaauuaucaguauuguaaaaacuacagcaaaaaagcuaaaaacauauucagcuuuuauuguccauaaaaagugaucacaccaugucuaacuguaauucguuugucaaaaacacuagaggccaaggacuaaauugcggauuaagaguuucuuccuuuuauuuccugcauauccagaaaccuggggucauagauacucuuccaugguguguuguuuggcacaacuugcaaguauuuuggcagaugguuagaaaaaaagacuuuaagaaauaugcaauaguacucaggacucuaaauauaauaaauaaagcuaagauaccaguauccugccauucauuacaaucaacauuuauugaacagcaguuauaugccagguagcagggauaccuagaacuugccccucccacuagcacuccagaagaguuccugcuuucccagccuaaagcaacagcaagucuuacaugagcuaggcuuacugugauagcuguccugacggcgaguggcaaacauggcccagugccuuccucauggaugaacaugacucuacacugggacuccccgguagaccuuuuugugaugaugagaaaguccuguguuggugauguucaguaugguaacuagugacuguaugugcuguugagaacuugaaauauggcuacugugacugagggacagaacauuuaauuuuauuuaacuuugguugaguuuaauucaaauaacuacauauuacuaauggcuacugauuggacagcagcuuucuagacccauuguuaaaaauaauuauaagcaaugaguaccucuuaugagauagaauuaauaaucccauuuauugagggcccaugacagauuaagaauuauguuugacauauauuaucccuaauccucacaagaaugguucauuugacaaauaagauaacugaaguucugagagauaaauugcuuuguuauguccucgcaaggaauugugagagcuggaauuugaaccuaauuggucagacuccagagcugggugauuucuaguaaucugccaaaucuguguauguacuguccggaugcugugucuucugaguacaucuucuccuugcuuuauggauuaguuagcaaugucuuuaucuuggucacauaggacaguuacaggguccaucuuaucucuucugaauauggacguaucacugcacuggaaccauucauuuuucuuacugaggccuauguccuucaaaaaauauuaagaguugaggguccaacccagcuucuugaguaguaagcuaaucaccuacaaguauauuuccccaguagaugcugagagaagcaucaaaguacauggguaguucuguggacaucaguggcacucaguaaacucuuggcauuugaguguuuaacugucacaguugaggauaucugugaacucucccaaggccugagucacugaaugagcccagccaguacuugggcgucuguggcuccauucugcuuugcuguuuucugcuuuccauggaacauacaguaacucucuugaagggucugaaagccucaauuacaacguuucagugauucugaacugauuuuucuuuggaaaguauauaugcagaugguacuugcagaaucaccaggggguaguaacguggaggagugguaaaggucuacuggacaaucagguggcuaccacccaaccacacauggugaugugauaugaagccacuuuucuuuauuccuucagauuuaagguuuccccuucaggaagcagguuacuuaacaaguacuugauuucaccauaacaugcauuaugacauuaucuuuuuuucuuuuuucuuuuuuuuuuuugagacggaaucuugcccugucgcccaggcuggagugcaauggcacgaucucggcucacugcaaccuccuucucccagguucaagcaauucuccugccucagccuccugaguagcugggauuacaggugcaugccgccacaccuggcuaauuuuuuguaucuuugguggagaugggguuucaccauguuggccaggcuggucucgaacuccugacuucguuauccacccaccucaaccucccaaagugcugggauuacacgcaugagccaccguuccuggccgauauuuuauuuucuuaaaaggucauuaucagaugccacaagaguauuucuauaaacuaugacccaaguauagccuaauguuaauagcuuaaaauagguuuuauuuaccuuuuuugcccuuuaaaagcaaggaauuauuuuuuaauggaaagaacauagacuuugaugaucaguucacauccuugcuuuaccccuugaaaaaugugcaaccuggaaagacagcuuaacauuccugagucacauuuguccaaauaauacaaacaauggcaacaagacuucagcacuaaugucugauguuuuuuguaugauuaaucugugccagguuccauucuaguuucuuuacacacauuauaccaucuaauucucacaacaacuuugcauagcaggcauugucauuuccacuuuacaagcaggaaucugaggaccagaguuaaaaguaacugguccaagauugccuaguuaauaaaugguggaauuugcagucagacccaagcugguuugggccaauacacuugaccuucuuaugauacgucagccuugugaaauagggcagauacuauuaauaauauccaccuugugugaucauuaugaagguuagauauaauguauguggaacucuugccaccaaagugguuccacaagaggcccuaaacaaaugaguaaucauuauuauuuuaaaauguccguaagugaaaccgauaugccaagaccaguaaaaaugagagcuucuuaaggaaaagaguaggaggcauaccuuuguuucauuuuguuuguugguuucugugcuugcuuuuuguucuuuucuguuaggcacagguuuuauuuagaauaaauuaaauuuuuuuuucuuugaugagugcagaaauaauaguuggaaacauugaauggaacagcuaauguaccauaguaauacuucuuggauuaccaaaaaaaaaaaaaauuaaaucuguaaaaugaaaacauuuuuguuuacuuuggucaguucaagguucaguguuaucuagagauuuuuguuaaacucaggauuucuauauguaugauugucugcuaaauucagaauuagaagagaagagauaauggcgcuaacuuugcauguuaaauauacuguguuacuaguuuuccaugaaguuuuuacucaacaaauagguuacuaaaagagcugugaccuaugaguuucaccaagucuuuccauuuccaauucggcaacaaaaguuucacacuucucaauuacucuugugggaggaaucagaaugccaacagucaccuugaucuaagcguauuauuggagaaaaauucaaggauagauauuuguuucucauuagauuuuccucauauuuuaucauuggggucacucuaguacaugguacuagaauuugggauuuuuauuucauuuuagauuggacugauuuucugguguuagucauuaaaaauaauuccaacucuuugaagagaucugggauguuuguuauuauucuauugauuaaauaaagcuauuuuauuuaacaauuguguuguuaaacuuucuauauacuuagaauaauaauacuaaaaacugaauggguaugagcuuuucuuauugaauuuaaugucaguauuaaauaccuuauugaaacccauacuuugaaagcuugauugagaaauuggcaaaagaguugacugaaguaaaaguaaugaagcaguucacuggucauccagguuaugaaaaauuaaaccauuagagauaaacugaacugugaaaauuaugaucaugguguuuucauaaauaccaucuaugucuccgccaccauucuaaaaaaaaguacccuaucaaauggugaaaaauaagagugauguuucugugaccauuucauuauucaguuuucuuauauuugaaaugugggagguugaacuaaaauuuguugguucccuucuuuaaaaaaguauaguuauaugugauauuuauuuauuuauauaaacaaaaauauagagaucuuaccuugaaaauaacuuuugagguaagaaugauaaaguaucuaaauggaagaugaauaacauuguaucugauuuguaaauuaugauauaaagaaaauguauaaaauauguagaaauugucuguauaaaaaacuauaaacagugguccguugccuauuaacaaagaguuucauguuaucuaaaaagucuucaauuggcuaaaacagcagaaaaauagaaauuacauacuauaauauauccuaaaaacauuucaauuccauagauacucuucuccaugcagccaauauuuaugaauuuggaguaagugaccuacucuuagauauuugagcuugauuauaauucauagucaaaguagccuccuuguaaauaaccaaaauuaaccaaagauuuuuccuuaucuuccaaaagcaaugccaaguaauucuauccaaauuggaaaaaaaaaaagaaaaaggauaaaccuuauuaggugucaucaaaugguguugacauaaugauauauauguuuaaggauaauguaauagaauauguaauuaaaauuaaaguauauaugaaaagaauugauuuuaauuguuuuaaaacauaagaugauuuaauaauaugggucggagauucuuuuuaguuuuauaauaaauauauugauuucugaaauuuggguauauuccauaguacacuuagcuuauguuaauacugaggccagauugcugucaggcuaauagcguguagauauauuauagucacacuacaaucauuccgucaguuuucaguuucccuuuuuccugugauguuucuuucaucuuguuagauuauucucaagaccuucucuaaauaccuucaguaguaauucacaaacucuuuguuaguuaauaguucucaagaaaauucugagaugugguugacagaacuuagaucauugguuuguuuuuggauuccuagccaaaguuuuauucuuuguuucuuaaaaauacucaaaaaaguuuuuuuuccuuauuguaagcccucuggaaauagaagcaaaucacuguuuauacauuuaaaaugugaugaaaauuacaaaauaaaguccagugaaauauagggcuuguauccauuagugccuuaagaaaaaucccuguuuucugaagugcgagugggcuuuucugguuuguuuuuguuuuguuaaagcuccaggaccucccaauuuucaagggcacuuuggggcauguguagcauuuauuugauguauggauguagaugcauauuuucccacaucugucucuguggaccuauccuuugugaaauccuaaaccuuguauuaaugcuuaguuuaugauucaugguguucugagagcaauuauauaauuuuucugggguguuuauucgaugugcacuguaaaaaaaaaugagaguuauuuuuugguaacccugcacuugccuuuuuauuggugaauuucuuuuccuuuuacugugaccugugaauaucacuguaggcucacugccaauuuugugagccgcugccugcuucaaaauggaggcaggaagguauccauuuucaucaagaggaugacaguguuucagucuuucugaccaucuggagagaggaacuuugagagcaaaagaaaauggggauuaaaaaaaauuauauuuagcagaaaaggcaagggggaaaaccaauuaaaguuaaacuauaccuuaugaauuugugcuuuucuacuaugcuguccuguuuaaaaaaaacauaaacaagaaaauacacaggcuauuuguauaaagaauugguuucccaagucucaugaguauuaguaaaugaauguaaguaaauuagguuuuuggcacacuuuuuaaguuuauuguacacacaaauauaauaagcaugaaaaaggagggcucccuccucccgcuuccuaugcacacacugauuguugguggucuuauguagauccaggcuuuuaauggccuuuuucaugcaucucugcaaaaagcugacacuaugggaauuuaauauucuaagauauauuuaucacuuucugugguuuggauaguucauuuguguucucucugucuccccccucccuaccuccucucuguaaaagugaaaauuuuaauugaaagguagaguuuuuacucuaccauuugaaagagguuugaugcaugucuuucuguuuuuaccauuuucacaugcuuaugggccaucuguguuuagaagaaaaagaaagaagugcuuagacucacaggauuacccuaugggcauuauacaguguauuuacaacuagacaugguuuacaucaacuggaauauaacacaccugguuauuuucuguucgcacaaauacaccgagcuuuuguuucguuuuguuguguuuguuuuaguguguucggaaagggcacuguuucuaggguuuguucagauuuaaacuggaaaggguagaaauguagcacuuucugccuacuucuuauauaagaauggagcuugggcugcuguggucaaugcaaaaagcaaaacucaguugguucuuucuccucaggucuaugcuccaucagcaagcacugccgacuacaauagggacucgccaggcuauccuuccuccaaaccagcaaccagcacuuucccuagcuccuucuucaugcaagguaagaugcugcugcuucugagggaaaggccacuggauagcauuuuccugggucacuuaaugucacagauggggcagaagaaauggaauaguaggcaaguguagaauuuuugaagucaugcucuucuuaggaauugaauuccuuaaaaauugauguauuaauuaaaacuguacuaagucuuucuuuacaauuaaaccccuuuaagcaguaauggguuaagauuagauugaucugcuucacuuagagccgaugcuuaugauggucuuccacucaugaccaaccauuucagcaucuucaccauccccaagacgauguagcuguuuguuuagaagugguucagcuccauguauguuuugaacauccuggauuuagccaacugggaacaaguuggccuaauguauaaccuuauguaaaauuuucacccacuuacuaauuuguagguaagaacaaggguccaagaugaaguaaccuaccacagacuggaauauuacauggugaaagcucugucccaacauaguaacugguuuaggauaaaaggcccaacuuuugggggagaagacaaauauaggaaauuauggaauuguccaguauguuuaaauacauggaugugugcccccacccugagcuuguagucuugcuacugauagcguauaccuuucugcugcucaaaaaagaccaagauguggccgagugcgguggcucacgccuguaaucccaacacuugggaggccaaggcaggcaaaucacaaggucaggauaucaagaccauccuggccaauauggugaaacccugucuguacuaaaaauacaaaaaauuagccaggcgugguggugggcaccuguagucccagcuacucgggaggcugaggcagaagaauggcaugaaccugggaggcagagcuuacagugagcugagauugcaccacugcacuccagccugggcaacagagcgagacuccaucucaaaauaaauaaauaaauaaauaaacaaacaaauaaauaaaugaauuuuuuaaaaagaccaagauguuugaaaugauagcagcuacuucaagaaugaaccacuuggaggaugccccuaagggcuccauccugauauguguguggcacuuauuuucuaauguaauuaucuuguuaccaaguuaaugcccugaauuuagauguggaauuuaccaagaaccccugugugcaaaauguuaacucuuuuugcccaggugugaaaaccuuauuuguauaagccuugucuacgggccaugggguuuccuucuuuaugcaucucuaggaagggccaugucacaggaaggggagcacauuuggggcaaagaguaccagggaagcagccugauauaguggacacacucaaaaucauucucauuaaaagauacuaaucuuccuucccuucaguguguuagcucuuuuaguuuguuaguucacgugugaaauuccauggaaaucuauaaaauuggauggaauggcucuguuaggaauagagagaauuuguuccacgcauaauagagcccgugugucagaaguccuuuaacuuugugacccguccuagguguaacucaaagggacacagcaggcuaugucaccugggugcguuuugugccgugacaaaaagcuaaucaccuucaguuauaaacaguagcuaccucagcaucaguccccuguuuugugagcagugggagauauuguccuacaggagcuuacagagauuggcaacucaaggauccaucacucaaaacagauuucgauugaaaacauugacggaaggauauauuuuuucuaucugcccaggaaaguggcuuucuggaagggugcacauugcaggagaggccagguagauuauaucaguaggcuccuuucccuagcagaccacacaaaauauggggaacaaauuuguuuaucugcauaugcauacccgaaaagcaaaaaaaaaaaaaaaaaauugaguugacauuuuugaugagcacaauuaauuugcacacaucuaauucuauucuuucuuucaaaagaacauuaugccaagaucaugggaugugauaaauauuaauuuacugugaaaagcauaauuuauguaaaauauguauuuuuauaagucugcaucaagcagaguacucuguguuaacaguccuaaacgcauugccacccaggguaucacauugucaggagacucuuguuuagugauauauguuuucaauuuauuugucauaugugccaucuauuuaaaauguuagugaucuugaacuucauauuugaauuuaaggugacauuuaaaccucuguaaucuaaggacuaaagcucaaguacaugaaugauaacuuuaaaaaaaaucauguguuuucacaugauggccacagaaacaguugcaucaugguccugucccacaucagcuuccuuucaguagagggguacuuggugcccugagaauucaagacuugaaggaauaugcaauuaaggugaaagauguucagaaacugucuggggcauauuguaaacucacuacuguggccucuuauuuguaacuucaauuuccaucuucuaguuaaaacucugaaguugucaaaaucacagacaugauuuugcuugcaugguucuuaaagagaggaaucugcaaacuauuccucccaauaugaaaugaguccaguuacaaaauucuaacuuccggauuuaagaacucaaugaaaaagagcuucacgaaauacagugucagauuuaacuuuucuauugccuaacuuuuuaauaggccuuuacuauauaaaauguuauggugaaaauaaucuuauuuucaaggaagcaauaucugcuauacauuuaacagccagcugauggccuaguguauaccuaguacucaauacuuuuuguuaaacuauugaaacaaagaaaaaaugaaugaauuuagcaguaauguagaucaucuuuucccuuaggcuugggaaaccaaaccuaaacauuagcaaucauuaauaauaaccuguaggccaauaggcccagagaaugaaaaaauccguagggauguuuuuaauaagaauguuaacaaaagguuaaccuuauguugaaagauacuuuauauaauuuuaaaccucuauaauucauaaaucguuuuauaaaauccagagacucucaaaaauaucuguaauauaauagcuaccuagggcauguuuguacccuuuggauugcuacugaagguuuaagauagcuauauaccuauacaccaaaaaauaaaaauaaaauauccuaagaacuauauauuugagauucaucuucucugcaugccguaauauaauuauaauuccaacuuuaauucuauuuauuguauauguuaaaaaugaaauuaaacauuuucaaucugagauuuuuuaaaauuaauacuucuuuacaugcuuuuaaaacuugucaacuuuguaauuucucaaguacuuuucaccccaaaguuuaggaacaauuuaacuuuuuaguugguuuucauagaaaaaacaguuagaagacuucuaagaaauguuuccuuuagcaguaauuaccuugcgacuugacauaauucaugguagaaauauacucuguuguucuuuuacaguucaauuuuuaccaagaacacuuuaacuuuuuuaaguguuuauauuuguuugacaauauagagccacuugggaagaaaugaugacugucuucugauguaaucagcuaaccaacacaaagaugaauaacacaacaggcagucauuuucaaguauaugaaaaaacccuauucuauaaggcaaggcugaaugccucagaaagucaugguugucuuuguccuuuacagauggccaucacagcagugacccuuggagcuccuccagugggaugaaucagccuggcuaugcaggaauguugggcaacucuucucauauuccacaguccagcagcuacuguagccugcauccacaugaacguuugguaaggcagacauacacgguaacgggaaugucacagcuaguugauuaaaccucguccucugucuuuccaugcauauacacaaggacucugcaaauaagugcaaaaauggcacacacccauuauucuuaaguuguauuguuucugugaucaaagacauaacagguucaaaucaccuuuguaaauucuuccagauucucucuggcauuguucuuuuguuuauuguguuuugcucugugccuucuuuaucacaaugucagcuuccuuggguacauaaauagauaccuauuuaaguuguagaaucuuaacauggugguuccugguuuuuuuuuuuuuuuuuuuuuuucuaucuguaguuucaaaagauguacugcagagggcagagugacagucgguagauuauaugcaucacccaggagcauuucauuucccauugacuggccuaugucagcuuuggccuguugugauguauccaaaagaaggaguuuguauuuucuguagacuuccaucaguaagagaaaccaugagguuucuacauagaucagauucccauuuuucaguauuuuaacuuuaauucccaucccagccugccacucauacuguguuuugcgucacuccaggugaaaacuggugggcucuagaauguuaggucuuucauuacuaaacauuuccacucuguccaucaccuacauucaucuaucauaguaugucucuuuauccuggaggaaacaacucagcugacuuucuucuagccuuaaauaucaccacagcccagaauccacuguugaacuuaagucugucauuaaagagaggaaagagccuagaucuugagugagauuugggaugcagauaagaugaaacuugaaucccuugugcaagaacauagcuuaaacaauauguggaccucacauccuacaaaugcgaaagcauaugggaaauccagugaucccaggugauacuuacaucacuacuauucaucuugcauuugccccuuuuucuucuucucauaucuacacuuagguuucuuucucuguucugauaaaggaaaucauucuggauucauguggucuuugcucucuuuugcucaaccaguacagauaagaaacaggaucugaucuccuacuccaauaaucaaaaaaauuccagaaguuaagauuucugauauccuugaaaauccguauuuaguugguccuagugguagagaugcuaaguagucaauuagccuauacauuccugagaggcagacaguggaaaugguauuggccuuuuuguaucaccucccaagauugaauguguaaaucacaaacuaucucacauuucagcacauuuccaguaaauagcagaugacuuauuuucaaauuuucucuuuucccaccuccuauuuggagauauuagagugaaagcuuagagaaauaucaacuauaucaacuauuauuaugcuagaauccguuuuggcuaaaauuuucauuucugcaccaucauuuuccacuucugugggaacucauggucaaaacuguauguguccuaugagcaaggaaaguuuugauuacaaauaaaaguuuuaggcacuauaccgcauguuggaauuucaguucuuuuaagaguugcccauuugacauuaauuuuucuucccuucuguguuucuuucuuucuucuccuaucaugcucaagaguuuugaguuaggcgauuugauuuuauccuaguccaguucacugcaugggaaguagcuuuaaaaugugcuuccaugcacaaaaaguauaauuucaaaauggaaaccaacuauauuccuuuuagaaaaaauuuuacagaaccaaaacaauauuaugaacuagagagaaaauaucauuuugaaguaguaacccaguaggcuauaucagaagccauauuugcaaugccauuuaccuaucacgaaacacaggauuuucauuuuucaucugaacaguuaacagauuucagagaguagaguuuuuguuuuaaaggagacaugaauaagcuaucuugcaauguauacuaaugaauuuucccacuguuagugaaacuauugaauuauuauaucuaguugucauuguacuuucaguauuuaaccaugugaaaaucuuuuacugaagugacuuagaagaaucugacacugacaauacuuugaauauauaguagcaguugguguccuuucaguugaaaauaaugguaguuccuuauaauuuuauucuuagcaucuggcuagccccauacugaacaaagggauaguuuaagaaaaagcuaagcgcuguuccuggauuauuugggguauaauuuggccaaguugauauuaucuguaaagauaaaauauuuuaaaaacaucauugccuucaucacuuuaugccauguuauaacagaauguguaauuauaaagcuuaagauccacauauuucaguagcgacugucaaguuacugauguuuagucuuuaaauccccuuuacaguuuuagccuguccaacagaaucccacagcuaaucauuacuguguuacacauacccacacaaaaucacucagaugaauggaguuugcgguuaaaguuuggaauggguuguuguagaugauuuuauguuuggaaugacuuggcagaguucuuuuuaagaacaggauagaguccucacugucuggcaugauuuaggcauggucuuugcacuacagggcgaaacaguccuaggagucuggaauuuuccuuuaaaggaaguucuguuuucuuuuauuuuuuuguaacauaaacccuuacuucaguaauucucaacugauggcaguuuuucccuucagggaacguuuggugaugucuggggacauuuucauuguuacaacuaggggcuagaugcuacuggaauccagugcguagaggcuaggggugcugguaaacaugacgucauguaugggagagccuccacagcaaagaauugucuggcacaaaagaucaguagugcuaagguugugaaauccugcccaaacccaaagcaugauuuuauucuuauuuaugugcaccaguuauuauauuuuucuaauguuugaauuaucaaccaguauaucaguaauggaaacauuuccaacaauuacucuguuaauagacacgaaauacaggacucuugggcaucauaaguuaaaaugaacgaauagugggcauguaaagccucgcacuuugucacacuccucauguccuuuguagcaagcaggaaagacaguaauagcuggaguaagagacuaagaggaccucuuauaguuuaucccuaaauccucuaaaagagacauuauucucugugguguauuuauuacaucucugaaugacaguaguuuucaagauaguuuuuaauguaaaauaaucuaguuauaaaucucguuaguuuauuucaacaacuaauuuucuaugagucucuaaaaauaacugauuuacauggauuccauugguucacuccuuuauaaucuauggggauuaauuuuucuuuuuauucugugaacucagcguuaacccuuugucaaaucccaaauuacugcccauuuuacauaaaguuaaaagggcccaaagauucucaccgaugugauuaucuguuuuguuucaucuucugauuauuauaguuaguuaaauauuuauaauucuucuccucuuuuuuugauuuuugcacauuucaggcagauuuguaguucgucuguucuucagaaauuccacauggaauaggacuguguagaagugagguuaaaguuagucaucucuuuuuuuguucuuuuuuccacauucuguuucuuuuccuccauuuuguuauagugcuuaccucuauagcagaaauaccucuaucccugcuaagcuuucagaauagcuguacuauggaaugggcccacuauauuuuucauuggagaaaauuccauggacuaccuuggguguucauuagguggcaaguagaaaugaguuuaacagguggccuaaggaauuuuggggucaaggaaagaaagagguccauggaauuuaaaaauuugaaaggcauucucaggaacuuggaaagauuuaaaggcaucaucucaacuuuuuuacggaagucuuuuaaguugggcuauuuuggucauacagagguaauauuuucaaaaacauucaugcgucuuugaaaauccuaccucuaauacguagauucauuuccuuagacuaguuggcucucaaauaaguuauacuucaauccacuguuuauuaaauucugacugauaaccaauuguucauugagcguauaguauaauuauguguucaguaguuagccacaaguugugggaugcagaacuauaagcucuauuccuuuaaagaguuuacaauacaggugaaaauacauuagaaaaagcaagaaaugaaaggccaaauauaauuaaguguuaaagacaauagugcagaauguaagugcauuagggaccuagagagaagagaugguggaagaguuggagguagucagggacucuucaagaaagagguagaauucaagacggaucucacagaguaaacagggcaacacucaagagacuaugguuucauuccucgugagcaaaugcuuggguuuuaaauacccgugacuaucagcaucauauucaaucucuuauuuugaaauaaacaauuuuuaacagcauuuccaauaaugauauaauaaagacucauaauccauuaauauauugcauaugaagaaaaaguguauuuuagcuuuaauauauugccuuuacauaacacauucagaugccuaugagaauaacuuuugaagcugcuuuuuaucuugaaaauagcucagcacuuuuuuguaaauuacuauguccauuuuagugagcuguucauucccaagcagauggguggauugcaacuaauuugccaccuuacaggcacuguggcauacccaagaaacacagcuuauuuggaaaacuaauauaauaauuaaacucaaagcagagucuuaaaccaagugauucuguaaagauguuguucuuucauugccagcuaugugaggauugcuuguagguggggcauggaaagaaaguacucaaaccaaaauaagucaugugguccuaauuuaauucaguauagucaauaguuacauauugaugaguaagagagauauuuaaccauuagugcuuuuuaaauuuuuuauuuacuaaauuuuauuguugcugggguucaaaaaaauuuaauuugggaggaagaagauuugagacugguuagucuuugccauuuaguuucaagaagaucaggaugaaauguaauauaagcccuguggaucauaauguuguuuuauucauuauauaguggaaucuuuuucacuugaucaauaggccacacaaaaaaauuaauaguagaguggucuuuuauguugccgaaacccuggagaugauuuuaagcaguaaucuguagauuucgagauugugaucauuucucaaugucccucauugccauuauaucccuccacaguugaugcaaacccaagcuauguuucuguauaacuuauuauuugaaaaaugaaagcugucagaucuaaacaagauauauucuuggcuauuuugaaauucuaaaagcugucuccauuguaaaauagagaguugugagaaaaguauuugaaaauaacucacuaaauaccuuaugauuaaauauggccaccuuuuucugcuucuugcuauagagcuauccaucacacuccucagcagacaucaauuccagucuuccuccgauguccacuuuccaucguagugguacaaaccauuacagcaccucuuccuguacgccuccugccaacgggacagacaguauaaugggugagucacagaaaugccaauucugauaccaacaauuggugucagaguuuaaucaucaaggaccucuuuuucccuuucauaacugaauagcaauuaggcacuaaauauuagucacaugacagaaugaacacacaaauguaccaaacagaaguaaaaucacuggcuugagcauaaccauauuuuucgucacaagacacugaaauuuagcuacguucuacguugcaagucauuagauugaacaaggguucaaacagaccaaaacuaucuuguuccucacauucaaaaagagugaacaaagucauaagaugagccaucagugacuagugagcuacaaagcagaauagcucuuaaugguaguuauugaccacuucccaaaauuccagucauugugcuaggcucuuauccaugaugugccacugucuuccgaggacugguuaaugugaaauucucaggugacugcuaauaacuacaugagguuaaucuccuggagaaugugacacuguggagucccucagaggggaagaaguauuuguucacuuaugagagaggagaugcgugggcaucaguuggccagaaauuauuugcugcuuuuuuaaauuaauuaauuaauuaauuuuuaccaaggacauuuacuaaugaguuaagguccaagaagaaugcuguucccaugaacugagccaucauccucucauuucuugugauguucacuguagucuuuuccauaggugguuccccagucaguauucccacuuugaggaaugaacugggcuggauguccagcugccccuggagggaagagguggaguugguggggagauagcuaccugcuucugaaccagcuuugacaccuuguuguucagaugagcagcacagcuuagugccccagggucuuauuaaaaccucagacuucucagguagucacuuucugcgguuauagcucaaacuaacuccuugcuuggccugaaugucacugucagagcgucgguggggagaauacucaguguaugucuuugagagaagauggcgcaacagaauaaugcugcuguugaguccucuuagcucuuugcacuuguuuucuuuagagaguguguagaauuuggggaaguggcgugaaucacuuauguaggaaaguuuuugauguuggaggagagauguguuuugaaauguuggaaauauaauuucugccucaauaaugcccucccugcguauucaauaauauaucucacacuugagaugagcuaucucgcagccucuccacuccgcuauccugucuaagaagcaaauugaggagagaguuuccauuuuuuuuaacuuuuccuaaccaagcuucuacaaauauguugcaucaguuugaccuuggagagcuacagacagaggucacauggggaaguuuguuagcuaucaaugcaguuuuggcagauuugaaaaacaagaagaaagaaagcagugcagaacugaaagagugagaaaagcauauuucacuucagugugguuugacaaauggaaagccccuuucugcagucaugaggucugguuauaaagaaggaugaccggucauucauccuuuuacaagacagauuuccugucuacuugugguuugaguaauuuucuuuuuuaggaagguaugaagguggagcagaaccuugaguugaggaaaacauacuuaggcucuguuugaaaaaaaacuuuuucugauugauuugcaaaacaguccucuugagagagaggcacuaugacuuggaagggacauaucaggaaauagggugguuaucuccaugagcuguagacagcuuagccacagcucucagugggaaugaguuuugcuugguuuuagcuggucaucuucauuaguuuguggaugaacaggagaaucuacuuguuggucuagccagaguggagcaauaggugacuucuauaugcugagaauagacuuaacuuguuaaaaaccauagggccuuauuuaagggucuugacaauaauaaaggagcuauaauuuaaaaacaaaaguaugagauuuuuagaacccagaaaagggcuuuuuagaaauuuauuucauacauuauuuuacaauaauggaugcacuugucaaaauccacuagcggaaugagaaaaagaugcauaaucuuuaaggaaauagguagacaugguaauucagcauuuuggaggagcaaaccuuuauuauuaugcauagauacagauauuacuuuaagguuacuuuaagggagaacauucuagaauguuuuucuuuaaaauaauauguucaccaauugcguacgugaaaaugcagaggaaaauuuaagcauaauaagccuuaguauugcgugaugucugaguggcccauguuuuuucacacuuaaguucucuuaggcuuugguuugauuuuuugagugugguagaagucagugauggcagcgugucuguauaacaagaagagaagcuuucucuucugauguuagugauacuacccuaacaaacaguauggauuaauaggauacaucugcagacuuuugaaaauauuuggcauauacucacucauucugaaacgcaggaaguaaagaaauauuacguugccuguaucucaaagaacaaacagagcuaauuaaauaauuggcaaauagggaacacauagccugacacauguuugagauuacacacgauucuguagaaaaugacuguaagcaauacuaaugccuuaagaaugggguucgagcacuaacacauggacaucacauuuuucacguuuuccugguaaaaaguugcaagacagugcagucuuuucauacaugguguugaugucuuaggaagcugcuuuuucaguucagaagagggcugcugcccuucgucucagugucauguuauaauaugucuuucugguggucagcaguuguccugaacugacacuagaacaacgcagugcauguggggugagauacaagcucuagaacucucggaagggaaccucucuguaaccacauucccuuucuucuucuguucucugcaucucaaagguggaagaugcccacugagguuugcuguuuguuuggcuugggggagugaccagguguuucuuguuuuguuuucuuuugcccuauaauacccaauaucauuuuuugagaaauccauaagaaggauaaagcuuacuuggauuacauuaaugagagauuuuuuuuuuuucaugacacauucauccauggauuuucaagagaauuguagaacaagguauuuuacucauugcauacaguccacuacuuuucucaagccuugcuggcaaacucuggagaucauauuagaccuuucugaauugaaaaggucaucuaauuagcccuccaauuagaggaauauaauguaugggacacagcauggauucacaguaguucagcugguggcgcacccaguuaaggaaagaagcugucaggggucuuugggaguuaccagcaucagcaccuucuacucaguucuucaaacuuuuucaauguuaugccacuggguauucucagaagcagugcaguucagugccucugcaucugagcauacauacggaggaggaaguguaguaaguuauuagauaccagcuauagagaauaggaaugucugcaggauauuaaccauacacauuugguuagccacauacuuccuuccuauuugcaauaauauccaguagcccuuccugauggaaagaaguaagaggaccuccuaccauagcacagaccacugagacugcucaagggugagaaugcgucgucuccccauugggacauaccaucuguauacauucacagggugugacccuuugugguuugaggcuacacacacucccuugcccucagagagaacuggucauauaacuaacauaaugguuauaauaacuauuauuguuuuauuagucuuuaacuggccugcauucuaauacguggucuuuuccacguuuuuaaaccucaaaccaaacaggguugaaggaacagacuaccaagauugauuuaauacaccauaugcuaaagauuacccuggaauaucuaucugguucaugaauuaaucuggcuuagaacuuuaacuucgaaugacauguuaguauguggcuugucuaguagaaacauuauguccuuuucucuuugaggacuugguuucacaguaauuuuauuauuagaguagucacauaauguucacuuuauauuuuacaagaauauugagccuugaaguagucaggcgaugaacaagcacagagcauaagaguaauaagaauuguauccagcaaugugaaggcaucuuaguuaccaagaccaccagcagagaacaauaaacuaguuugauuuaaaucuccuccauuuccugugcacgaucaggaagcccaacuucccccugaauuccuaggaaucccuccuguuaaaaaauagugcauuguagucuauauacuugcguuuguauuuuaaaaugguuguaguaggagugcuggaaauguuccuucuuuuugucaucuuuauagauaagcacauggcauuguuaugcuguuucuaaugguuuaauaacacgagggucacucggacacaguuuagaaaaaccuacuuugaaagcagucaucuucucucaggcaaacacagugugaauugugcugcuuauucuuuugaugccuucaugauguucccagccuuagaugaugggugugcauuaaaggggcaacacauuuuccaaauucugauuuuuaguaguugaucccaaggcaccacucaucccaguguuuuguugaggguguguucuaaugggaaugaacauuuccccaaagcugaggcugagacagaggguggucuagcauguaacccaagauacaaaaccuuucuuucugcuucaucuucuagccagcaacaccaccuguguucaagccaucugaacaauacuuggguggcaggcagugucgaagccuccuacaaaaauuacaguuccucuuaauaacugcucaucuuccauucauauuuguauguuacagcucuacuuagggacugauuauauuucucuugggcaagauaaauugauuagagccaaaauuagaaaucgauaaagucuuuaccaagcaaaugcauuaguuuucaucuuucuguuacauggacauuuugaucaucucuaauaugaauugacaaaaaucuugggccucaaagaguaaucaaguccuguuacaucaaacccacauuuucagcuuuaauguaucuugcuaaacauggcccacuucucaaugcaaaaaaaaaaaaaaaauucugccacuugagaauuaaaauauauuucuuuuccaguuauacccuuuguuauaucugucacacaaauaaaaagagaaaucuguaagagaaagacucauguagcuuaacauguucaggcaaucuagaaaauguagcuucuccaguguuuccuggaccagaacaaaaggcauuccaagugaaagggcaaacuggccccaguaaacugcuuugaaauuuaagcccuuggguuuggcacuccagcuguugcaagguaaaaucgcuucauguuaaaaaauagucuguucuuaucagugguuuccauggguagccuuuguaguuuucugaaauauuuucaugacgcgaugagguaagaaguugauucuauuuuuaauucuauuuccugagucauaauaucucccugcauaaaacaggcacugauagaauguuuaguuagaaagguguaguucuaaagaaaucagauuggucauaauaucuugccucuucuaacgugugauuuuuggggcguauauauuuaguuuuuaaaugcuccuaaaauauuuguauugguuuucaauacuuuguuuaguuucauaaaaauauauauauuauuuguaaucuucauuuuaaaguuguuuaaaggaagaauuaaucuuuugaaagccacuacuguagcagauauuaucuguagugaagcaauaucuuguucuuuuuuggcuuagguucuuuguuagauaaugugauuuuuccaauguagcucugaacuuuuugugaaaaucuauauucaaaucaagcagauaucacagauuauuuugacugauagaucuaauuuuuagguauauaauaaugaaaagaaauaucgcuucuaggaaaaaaaaaaagauaaguacccccaaauaccaugguaauacauacugaaaaaagguuaguaucaucuauauuucacaucauuauuauuuucucuuuagaaugguuuuuagguuuguuuguuguucuuguuguuugaggcagaguuuugauccuguugcccaggcuagagugcaauggcgcaaucucaaucucggcucacugcaaccuccgccucccagguucaagcgauucuccugccuuagccaggcauaguggugcaugccugcaauccauguuuuuaguuuuuaaaggacuccuuaaugcagaaauucuucucauuuucacacuagauauaauuuguuguauuuuaucuuauauuaaauauuuuuaauacucuugauaucugagcugcucccagugguccaauuguaugaugucagacccucauuucaaagaacuugcuuauacaauaccuaucaugaguacuaaugacucauguauuuuaauaucauaacuuugugauauggaaguuuauuuugucacgagauaauuguguucuucuuaucaugugccagauuucuuucaguauuuuagcaauuaacaaauaaauauggguguggguuuuguaaaccaaauaaaguauauaucaaaacauuaucggcugggcaccgugacucaguccuguaaucccagcacuuugggaggccaaggugggugguucaugaagucaggaguucgagaccagccugaccaacauggugaaacccugucucuacuaaaaauacgaaaauuacuuggcgugguggcgugugccuguaauccuagcuacucaggaggcugaggcaggagaauugcuugaacccggaaggcagagguugcagugagccgagauugugccacugcacuccagccugggcaacagaacaagacuccaucucaaaacaaaaaagaaaacucaucugacaaacucaacauauaaauauaugaaaauaacaagcauaaauuagcuaugcuaagcagaggucaggagaauuaaauuaugaccuggaaaagccauagaauuggaccacugaagauccgaccccacuacugcauuuuacaaguguggaaggugaugacaacacauuuguaagaaagaaggcucucuuaguucaagaauggggcuggaaagucuuugaaauuauauaccuguuuaaugaaguuuugcuuggauucauugggugauuuaaccuuuccuuuucuuauuucacaaaauagugaaaaacaaucuucccucagaacuuuaauagguuuuauuuagauacuaugucuauuugcuaauguugaggcuuuaguaaauacaacauaccccaagugcuaggcauucuguuaauacugaagaccacaagaauccuggaaaucccauuuuaucacuuaguucuaaaggcaagauaccuuccaaugauacauguuaaagaaagcuggcuuugaauuguauacuguaauauaugucuuuuauuauucacaauacucuuuguucuucucuuuuguagauaaaaauaccaguguuuaaggcaguagagauaagcuucaugaauauguagacuuacuuuaucucuggaauucgaggccauauugacuuuuaguagcauaccaguucacuuuuuuuagugugaacacagacuuuuaaauauguggagaauauauguuauuuaaaacauuaaaaauauuuucucuccuuguuagccagaccuguuguggaaauuuuuguuuguuuguuugguguacuguaggacugugagacgaauaccccguuuugcuauguaucaaauuucuauuuauuugaaaacagauggaaguuauuugugaagauaauuccauuuacuauaaaauaauauaaagaaaagccagacucugaggacuccagagaccugaaaguagucuauacuugucagcaaugaccgucacauagcuugcuacauucaccagcucaucaacagcaaggggaaagucauagcaaggaaaccacuuuaucuuuaaaccaaggugucagguuuauauuuuaucuguaaaaaaguaacaugaauauauuugacaucuaccucagcaaacaaauuaaugcuaauuaaagauuaauguguuguaauuagcauuaaaaaugcaauuaaauugugaguaaauggaccaggaauagaaaauuguuagacgucucacugccugguuuucauauucugccuuuuguuuuugcagcaaauagaggaagcggggcagccggcagcucccagacuggagaugcucuggggaaagcacuugcuucggugaggaaauauugacuuuggacuccauauguaccauuguaaagggugaacuuuaaucagaaguggacauuuggaauuuuagaaaaugaauggcaaauagcuuugauuuuuggaaaaugcuagcuuucuugcauaacagucacuggaaaauuugagaaggcucugaagcuuccaguauauagucucuuucucucauccucaaaaugguacuaagcugcacucaauuauggaugugggaauauucuccuggucuuuggguuuauagguuuuuuauacugaugucuuauuuuucucuaaaguaauaugggugcacauugaccagcuaagacugucuuagcaaggaauaguucuaaaacacuuugaaagaggcauuugaaaaaaaaaaaaaaaaaaaaagacaauaacugagguccaugaagaacugucacauaauuggcaccugggggacucagcuucucugcuuugcccaccuacugccagaaagcuaaaauugaacauuucuugcauguucccugaugacaaaauggcauaccuucauugucucagagaguauaucugguauuuuagucaaaagcuaaacauggucauuuagaaauguaaguggagggccagguaguguggcucacacugguaaucucagcacuuugggaggccgaggugggaggaucacuugaggucaggaguucaagacuagccuggccaacacggugaagcccugucacuacuaaaaacaugaaaauuaacuaggcauggguggcacaugccuguaaucccagcuacuccggagacugaggcaggagaaucgcuugaaccugggagguagagguugcagugagcugagaucaugccacugcacuccaacuugggugacagagcaagacuccaucaaauaaauaaauaaauguaaguggagauuucuuucucuaagauuuugucucuucaguuggcuuuuaccauugagagcauuaaaaaaguucacacuguauuagcauugugcccuaaguaaaaguuuuuguuucaucugggccuucugaugcuaugcaaucaaacgccuagaucuggcaaaagaguggcaaaauaucuuaggaaugauccuguucaaccucucauuguguagaugaggaaaggaaaguucaaaguaucugcuuggcuugcccauagccacacagccaguaggaacgaagaguugguuugaagucugcugaccccagccuggcucuuuucccaccaucccauaccacaucaguaauucuuguuuugaaaaauuaaaauaauuguuaaguucuucauuugacaauuuugguacuguaguugauuauuacauguaugcuguaacuuguaaguucuaaaugaauugcguugacaacuucguaguuuagaaaagugugaauuauuuuaaugaaugaggguguuuuuuuuuucuccuuauuguuuuaagaucuauucuccagaucacacuaacaacagcuuuucaucaaacccuucaacuccuguuggcucuccuccaucucucucagguaguguauuucaaaucccauuucaucauauaacaguuuauaagaaugauuccccccuuguacuuccugauuuuguagguggaaacucacuuccccccaaaucccaaagcuuuaacauuccuauaacagacaaauacaaagggugggagagacaaauuaccagauaacaguauagucguuuacauccaaaccuuuucuuaaaaauuagauuaucuuuuuaaaauauacaggcauauggaaaauguauuucuuacacuuuucuuagcucugcagaagacacccaacggcagaauaauguauuccaauaaaacgucucagaugaaaaaaacucaguuaauauagucaugaauaugaauauagacuagauagucaucaaauauagacuauuuaaauggaucauuuccugcaggaauuucaggcuuuccaaauucccucuuuaaaguacaugccauugggauguuuagagaaaacuauaauuuuguaaauaaauugugaaauaauugugugggguagaagggauguuugacuucaaaguauaauacauucguaugaccuguggcuucaaauugaauaacuauaauuuguagaauuaugucaguaaauaauuucacuuuucagggguccguuuaagagacucauugucuuuccaauauaaaugcuuccagaaagccuuccuugguucaugucucugcucuuugguaaggagacagguggcuuauuaaaaaaacaaaacaacagcaacaaaaccuaaaucacaucuguaccugauggaaaccuuaccuuacuguaauuuauaguggaguuacuugcguuuguuauuuccugcaugcagcucucauggcccaguguaaacucagcuccuuggucgaggacaggagguuucacauugccacaaaacuuucagaaaugauggccauggcuuagcugggauuuaaugucaaccucuuccaagccuccgugguaugagaagaucacagaauagagagggcagugggauucugaagucucuauguccagagagaccgcguugaaacugggaagcgauugaggugauuuuaagaggauaaucaaacguucccccugguggaaauagaaacuagaguucaguauuguuguacuccucggguucuguaccagauucuuacacucugaaaaaugauuucaauugucaguaacccccuuucgagacaacaagagauacaacaagggauagaggaaucugagcagguggaacuccaguuuccacauuucaaacaaaguagcuuucauuuuauucauuuucuaauuuagaaaaagaaauguucuaugguaucauaauguuugagaacgacuaauguagucugauacccugauuuuacagaugagaauacugagucccaaaaagggaguugaguuguugaguuuauuaccagugguaauagcagagcuuggacaaaaaucuggugcucacaguucugccauccauuucuagauuaauggugggaaagaaaaauuaggaugcacagucauucuagaaaacaucacaaauucccucgaccugaguagcaugaucucagugaaaggcacagaaacaaggcuagagaugccacuuuuugggucuugguaaugcaucauggaagaccacauguuaggaagaaagaacuuuuaugaagaugcaaauauggggacagauugcuauuuucacaccgacggcucuguccaaauucugucaagaaaaguaauugaacaaaauauucuauuuuuauuuagcauaaaaauauacaugcacacccagaaaagacaggaagaguggauuuuaaaagugcuaacagugucggggcaugagauuucagugagaucauagcuauuauuuuuuccuuuuuugaauuauguauuuuccaaguuuucuacacugaauguguauuauuuuacauuuaaaguguuuuuuauuuuguagguuagacauguaauauguauucuaacagcaaucuuuuuuuaccuucaaguuuaaugaaucauaaaaaaauuauuuucuucagaagaaacuuuuagucauugcuguauauugacuuuaaauuucuggcuuaguggaucacugauaacuaaucuuauucccuuaaaaaguuuuucaagauuuaucuuuuucuaaagauuguuuuaaaaacaaguggcaaagcuguuuuccacuggugcgagaauuuugguuuaacauaaacuagccuugcaugaaggucuaacaaaaucccauuuuuguacccuuaaaaguaccuugauuccauggugauaguuuuucuuccacaggaacccuucuuaccaaaauucagaaucaauuaaauguucucuuuuaggagacagccagccugggggaauugugagucuauguaaagucuacauauuuuacauuuaaaauguuuuccuugucccaaaauucuuauaugggaaguuuacauguauuuacguuguuguuuaaaugaaaaucaucauugccauugccauuuccaaaaggacuguuuaaaauauuggcaagcgucuuuuuacaugugucuagaucugauuguaauucccacuuuaauaucagcaggcacagcuguuuggucuagaaauggaggacaggccucaucgucuccuaauuaugaaggacccuuacacucuuugguaugucucauuugcuaaucucugucccacccauuuucaggucauguucuuucuuguucagucuccuuuacucuccaagauuuugauuuucccuguuaguaacuuuaagucagcauuaagcacacagguuugcgggagccagagucauuagccuaugcuugcuccuauuuggagaugggaacccagauacuacuguaauggcagccccagggcucuaaauaucuaguagcagauaaaauccuggaagggcaauggccuucuccccaucucuaggaaagaucccugucaaugauuaaaucacuuuccugcuaucagagugcuggaacuccagccagguccuauaccuggaacauuugauucccucuaccucugcuuuacuuuccagaauaacagguuuacaggagcuuuccuucucguagaaacccagugguauccuucgugguagagaaaugccuacucuuccaggagugaauugcugaaaauuuccauggauguaguuaauuauuauaaauacucacaugaugauucagugucugacacuucagucuuucucuccucaugauggugggggccagaaauaugcaggaaacaaugcugguugugcagcauuuaggcuguacaugaauuuagcgggaaggaauagcaguaagggagaggagccuuuuaguuccucgggguugagguuuucuuuucucccuccuaucuugagaugacacauggaagaagacauagauuuaucuaucugcuuuaguguugucuuauauucuucccuuucagcuuaaucuuaaggaaaaucugaaaagaaaagcaaagguggauuucccuccuuugcuguguucuuccuugcuauaguguaugaaucauucagcuaugcauuuuaaccaguaaaggaaaccagacagugaaacauauaugcacuacccagcccaauuaaucugcggaccacauccacauaauuaguuguuuuaguguuuaccuucaucaguuauucucuggggccuauucaucaaaaccaggcuucguccaacuauagaacuguaaagacgggguguauaguuaugggccacagcuuccauucuguuugaauucugaacacugaagaagagauuuacaagcagaaacugcugucucuaccaggaagcugugagccagaaacugugauaggcacauguaugauuucuuuuccugcauacauuuacacucagaaguaaguauguauuaucauucccauauuuauaaauuagaaagcaugcacuccaagagguuuaguaacuuuuccaaggccaaauacguagcaaagcuagcagucuaggggagguaguuuaacucccaaacccaccaaaucagaauguucuguaccauagacuacuauauuagacacacauucuuccugucaguauaaaauagaaauguuuuuucucaugcaauagagcugguacacuuguuugcacagccgauucaaaaucaaagucaauuguagcaugaucuagugcaaagagucacuagauuuaaaauaaaaagaccuagauuccaacucugacuuuaccauuuccuagcagugugacacuacguaacuaauucacuuugugucuuugagccucauuuucaugucuguacggaaggaaucauaaugucuucccugccugcccauacacacgugaaacaaggaucaaugagaugguauauuuuaaaguguacacuggagagugguauuugauaucauuauugaucaguuuuuaaaaugaauacauaccuuuaaaaugaauacauacauuuucuucacuaaaaacuauacgcauugucuaguugugaaaaacuagaauccuaauggcaaggaugaacaaagguugguugguuuuuaaugguuuaaaguugcgaauucuaugcuauaguuggggcuuugaacucaguuagaugcccccagugaacaguugauucaaguguuugugauucuucagucuuaaaaucuuauacuacuuuaguugacagaauuuauauaauuuuuuucuguaaccauuuugaggcccuuacacgcauaccaccacacacccacugguuuugaugacaggaagccagaaacaccgguaaaaacucaacaagaaauuaucauccauuugcuuuucccugucucugauuugguacuuagcacugggucauauaccacagggaagaccaaagaaauauaccuucaggaaaagaauuuaauuaagaaacuauaaauaggucaucuuuccagugguaauuguuuaaaacucuuuaacuuaauaccugccagaaaguuccuuaaauucagugaauguuuuucucuucuaaaauaaauuuaaauugccuuucaaaaggcaguaccguauauagcacauguauguuauaauguccuggaauaauuauugaauuuaguuuguucaugaaaaauaacacuauaauuuuaacauuaacacguucuaccaguuuucuggaaacaacacuauuuguauuauuguuuuaaggaaauacauuuuauuggaaacauguauuuagaaacacaguguguuuuuugucgacuaaaauuuuacuuguauaauuuaggcaccccuuuugaacuaaaucaaauuuuacaucauuuguuaaccaacagcaaagccgaauugaagaucguuuagaaagacuggaugaugcuauucauguucuccggaaccaugcagugggcccauccacagcuaugccugguggucauggggacaugcauggaaucauuggaccuucucauaauggagccauggguggucugggcucaggguauggaaccggccuucuuucagccaacagacauucacucaugguaagugaugaaauuuauagacucuauaguuaucauauagaguuagaauuucagauauagauacuauuguugcuguuuuuuaaaaaaucagcuuuauugagauauaauucacuuaacauacgaugagcccauuucagguguacaauucaaguguuuuaguguauuuacaagguugugcaaccaucaccauagucuagguuuugaauauuuuugcccccugcaaaaagaaaagaauccccguugcccauuaagcagucauuccccaucccuccacuuccagcccuuggcaaccacuugucuacuuccuaugucuauagauuuaccuauucuggauauuuugaauauauggaaucauacaacaugugguggucuuuuuugacuggcaucuuuuacuuagcaugacuguugcaguuuuucuacaguuugccacguauuagagcuuuauucauuuuuauugucaaauaguauuucacuguauggacauaccacauuacacaguuggguuguuccaacuccuuggcuaugaugaauaaugcuucuauaaauauucauguuuaaguuuuugugcagacacauguuucccuugaggaugaauugcugggucauuguugguguuugaaauuauucauuuuggugacccuggccaaaguguacaauuugaguucauauuauaauaugacauugcuaguaauucaaauauuaguguuuuuuuuuuaauuaaagaagccaaaauagugucugucaauucugagucugggagauagaaauauaugguauguuuauuuguauaaauacauugcaugugacuguguaauuuaauagaguagcuuuacuacuaccuauuuagaauaagucuuuauuugaauuauauuuaagcagauuuguccauauuacaauugugauuuuuuuccucauuacuuuugaaaggauuuuggagauaauucuuuuugaggaugauuaugaagauucagagacucuucuuaauagaauauuaagugaugacaauuaaugaggugaccagagugguggagaauguaacuugaccagugauucucuguaguucugauccucacaagcucuaccucgucucuaagcaccuuaguguccuauuuugccccuuacaggcucgcuaaaaguugcuuggaugaagguauauuuuccauuaucacuguagcauuucucguuuaagcauggucccaaaaggaaaugcaaaauacauacaaauuauuaugagguucuuuuaaguucuugcucaguaguauucuccuguccaucuuucaguuucucuuaauaaaagucuaagauuaagaguaccauucugaacgguguaguauugaaaucugcaaccaauuugaaaccaaaaauacugguuuauaaauagaagcaacgaacucacaucuaaaauguggaaagauauuuuugaaugccaaagagaaaucuuuuuuucuuucccuugaccucugcccuaaaaauucaucauugaauaaaaauuguuuauauguucauggcaguugcuuagaguuuacaaaagaaaagucuagauuuuaauuuagcuuggccucagguaauguguuaaauacacuugggaugcauauaauaugagauuuucguuuguacagcucuuuuuuuucuaacuacaauguuuaaacauacugcuuuuaauuaagaaaucuggcuuuauuaaaagccagaucugugacuuauaaccauuucuguauaucugcucucaaucaacagaaaaauaguuuaauuucuguagcuguguucauuuugcauauguuaaacggauguaacaugcacccagggcauugcuucagagacuauuuuuuccauaaauauguaaaguuuuucuuaaauaccauauguagguuaagugguucuuuuaaauauuaaacuauacauaaauacuuuuggggacuauuugaccuuugaauugacuccuuuuugagucagauucagaggugggaugggaggaaaagacuagaauuauuuuuggagaugggaaguuggacugaccucaguagaaccgaaagugagacgacugaauagaacgguagaaaaaaggaaauaauuagccaauauuacauagaaaccccuuuaauuugaucuugauauacacacacacacacacacacacaaaagcaauaaagccgccaguuuugcugauaaggauaaguuccuguuuucuccucugaagacauuuaauauucaaucaaggacagccacagagccaagcagaucauagcguaacuccaaagauauggcaugucaucacccugcugcccuuugaaccaaaugggguuuugcagucucucuccuuucuuccugaaaaccauucaacguguccccagaaucugagcuccucagccugaaacacuaaugugugugaaaaggauugguuuggccuaucuuucccgugcaaacugguaugaauuuuaaaacaaaaacauaagaacaaaggaaauaguuuuugaauuuaaucagucugaaguuagccuuugaccauuugauacauuccacaauaaaaaggaaguuuaaggggaaggcaaaaaaaaaaaaaaaaaaaccucaucccccuuccccacaacaacaaaaaaauucaaggaggauacugguaauguuuuccacauuugaauuuuaauacaugaaacaggcuauaaaacuuuggccagcugcaguaaauaaaguagccgugggagguaugcaccggaaacuucagcagagagcacuggugagagucucauucccaacuacacaccuucguuuguuguucugggcggaagcgaguugcaguaacuugauacucaucccagucccgguuuuguauugagcacaucgccuuucuaacucuccucaguaauuccuucugauuaaagaguagacagcucugaauccucucgaccuccguacgcuucucauuuccuuucucccugccuuccaaaaaucaaaacaaaauggcuugauaacuuggaaggugauauaagcauuucuuucugcagcagcuugaaguugugguggggaaaacugugguucugccucggcuguuauguuaucucauuuaauugcuaacauauuguccuuagcuuuugauucauaaaauguuuuccuuggaguucugaaguaggucuucagugauuuacuaaguauuaguauaaugaaagggauuuuuuuuuuucacagcggcauggcucauaacacaagagcgaauguuuguauacuugcaagcucucuggaugauauuauugagcuaugcuuauuuccugcucaaaaaccuucccugccuuuccauuuucuacaagauaaagaccaauuccuuagcucagcauuugaagccuauuaccauuuaccgaaagccuuauguugagcucuuccaaucugcaacaagucuuccagcaagacaaggcugggcauauuaccagaauucacccuguauguucuccuucggaacuuuuguaucucuuugucuuguccagcccuaucugcuuaucucuguacaccuaauacccacccauucucaaagcacugacucaaaucauucuucuuccaggaagccuucccuugcuaccccacucaugcuagccauuuuuuucucuauucuuacagcccuaugaaucauaccauuucuagauauuuaucuuaaccagcuccgcauagcugugcaucuuuuauagauaugacucugccuuaccaacuguuguaaauuccucgagucucacauauuauauuuugucucucuccccccgaccccuguaaauagaucauccauagaaacgggagaaaagaaacgaggaaacuuaacauucugugagugugaguuggcagccccucugcuaggcgcucugcauguguugucuuaggcagucuucacaacagcccagugaggaugauaauaguggucauuucaggugucgguaaagugagccuuagaaguuugagcaguuagucucaaguccugcagcgggauuuaaacucaagcacaucaacuccaaauucaaugcucuuuuuuacuaccaggcauacucuccagagauuaucuaugagaacaccuuuucagaacuuauuuuaaaugcuaggagcuugugauuuucaaaacuugauaaguguugguuggcaaaagaaguuuccagguauuccauggcuggguucccagagcagcucucuucccaaauguauagacagagaacuuucccuccaaagugguggcaugcuuggauuaaaacccacauuaucuaugcacuuauucuuaaaccaacauguuugcgcugagugccuaagaggugugaacucucccuaccaggguccuugagguagcaaauuuuaaguuaucaaguuauuuuucuuacuauaaccacccacuuuucuuccaaaauuaaagcagaaaucucugaaugugggagaauaaggaaauagccaggucuucacuacccuaguuagaaacucuuaccaaguaugauucccucucugccucagagaccuccaugauuaauccugauauuaaaugauuagauuucuuauaaauuauggaaagggcaauuuuccagauagaauucucucuguuacucauucaguauucacauccacagaugaggccugaaaagaagcguuucaaaugaccuaaccgcuuuuuuaacugacuaagaacaaaacccacaucaaacuugucuuuaugugacucuauguguucccguuuauuuguugguagagucagcaacuacgugaucauugagcuaaaaauccccucuacuauucauauaucgcauuaguguagcucucagauccuucuuguuuaaagucuauuuauucauuucaauaacauuuauccgugguuaccaaguguagguucugugcucucaaggaauucacaggcuaguaggaaaagauguguacuuaagcagauugcucccugccagucugcuaugcccucuaaaagaccaggggccugacccuuauccaguagugaaagaucacaugguuguuuaguagaggaguggucaucuccaguugacuuagggaugggggagucaugugcaacucaccccacacaccuguccuccacagcaucccuucagaguccugcaggugggggauguggaacccauuucagaaaucaccaauaaaaguggaucuuugcccaguuuuccucuuuucaguaacaauuuuuguuuuacuuuggauuaaaugcagucuaucaaaagagcauuccuuaggaaaagugguaucuuuuuauuuaacugacauuauauacaugagaacuuuuaccucuuagggcuucauaggacaaacaacuucaguuaguuuuccuuguauaguuaagagcucagaccacugaauuuuagauucuaaaaguacccuggaaaucagcccauugcccuucuuugaagacuaaggccuaggaaggggaagugaccaaaccauggguacucacuaguagaauuagaaaccagacaaaagaggcuggacacgguggcucaccccuguaaucccagcaauuuaggaggccgaggcggguggaucacucgaggucaggaguucgaggccagccuggccaacauggugaaacccugucucuaccaaaaauacaaaaauuagccgggcaugguggugcacaccuguaaucccagcuacucaggaggcugaggcaggagaauugcuugaacucuggaggcacagguugcagugagccaagauugugccacugcacuccagccugggugacagagagacccugccacacacacaaaaaaggaaaccagacaaaacagcaagcagaccagcacuccuugugcuauauccuacacugcucagccgacuuccucuuuacccuaauaccauaaccauuucaaaacugugagugguagaaauuagaaaccauucuguuacucugacuuaacuaaugaaauccaagaaaacucuguaguuggcccuaggcugccugcaaugaguugcuauuuagcucuaccaguaauauuuggcaaaaagagaggguagugggcauugaugugauguggcaguuauugguacauagucaugggagcagcaggagucagaagauucuguuucuaugugggccucuucaacaaagauaugaucaacagaggcaucagcaucuucaguugauaaaguugauaaaauagaaaacuauuuucuaaauagccuguuacagaauuucagcgaagcuauugguggucagcaucaucuuuuaauagcuacuaucuuguuuuucuuuaaauuaggauauuugccuucucuaguguucugucaucucuccuaaucuccacaacuaucagguauuucggagagcagauuaguaaccucaacugaaaguuuugaucuuuaucaauuuaucaguugcuccucuugggcuuucacagguuuugauuccauaaaguucugugucuauuugagugcauacuucauuucuaagcaguuauucccauggacucucagggaauuuaagagauuaucucuacugaaaucucccuacagauuuccugccaagcagucaacaagucuugaucagccuccuuccuucaagggugacuagcuccaaaugcccacaaaguccauuuucaucaaauauuugaaaguucuuccuagguccagcccaaauuugcuuuuuucuacaguccuuauguuucugcccaauagaauugcccacaaaucaaguccaacaagcacuugagaaacucaguuauuugaagacagucugcugaguguuuuuucccucuagacgaaacaucacuaucuucaaauauuuaaccugaaaaaaaguuuggacucccugucaugaacuccauugcuucccagugcauucucccuaguuuagcaaggaugccuuuuucuccacaagaaccuuuuaguguguggaaccgcaaacugaacacagugcuuaagaaaggaucaaguggacuaggguggaucuaucuccucccccauucaguaccuuguaucuucauuaaggccaccuaacaauauccuguuuugcuauguuugaugcuuucauuguccugcugacauauauucaauuuguaaucaacugaaauccauaagccaccuaucuccccagucucauuguguacuuuuuguugugucuguacaaaacuucaugaaaccccauugaauguuauguuguagccucagucugauuccuguuuaaugguuucccugaagcccucauucagucacauacucugccaucucuguugcuggcaaaugugaugggugugacuaaugcccacaucaaagccaccaauacaauauuuucaggggaggggauugaccagaaggccaugaggcucaguguuacagacauucuuucuacacgagugcugucuucuauccuuugaguuuaaucucagcugguucugucucccuccuuauacaccguauggcccaccuuugcucauuuuguccguagcguugucacagaagccgggcaugcagcacucacugugaagcaggaaaugaggcuuguccagaaugccuugcucugguggaaccaaacugaguuugagaggccauuccuguguuucagagcacuuucaaaacuauuuucuaaauacccuguuacagaauuucacccaagcuauugguggucaacaucaucuuucaauagcuacuaucuuguuuuucuuuaaauuaggauauuugccuucucuaguguucugucaucucuccuaaucuccacaacuaucaaguauuucggagagcagauuagcaaccucaaccgaaaguuuugaacuuuaucaauaucauacuuuauuuuuuuaaaacugaaaaaaaaaaggacagaaagguaaaagaacuugaagaaauucuuuuagccauggaugagugauaacagcugagaauccuugagcuuaccauuugauauuucuauauuaauuuaaagaaaagucaaaagauuuugaaaacagcaauagaaguaagauccuuuaagcucuauucagcagccccuaagaaaagugaugaggacacugugcaugcccauaugugaacaugguuggccaccuuagguauuuccccuucucuccacaugaauacauauuuuacucaaauucagacucuaugauguugaaacagucuggcauuggauguuuaccucaaaacccugcucucucugcaccuaggacaaacaaauccuaguucucugguguuuagcaucuuggagccaugaauuuuaaauaaaucaaagacaaaaaccuugucuuucccaguuuuaaaauauaaaagauacacacacacacacacacacacacacacacguguauuuaaaauagacccuauaaccucaucauauucuuacauccuuacaugguuuucuucuuaaauuguggaggaaaaggcaggcagacacauuuaauagcacagugaucaucauuuuuuaaaugaacuguuacagggacauaaucuuaaacuauccauaauuuggaauaggcacaacugugcauuuaaaaaaaugcaauauuacccuuauuuucucaggaaagcagauuuucuggagggaaaaguauauauuguauauauuagaaaauauacauauguucauucacucuuucugcaucugcugugcuucagaugcuuuuggggaugcauaaacguguaaaagaaaguaucugaucuuacaggccuuuuauccugguagagugauaauacaaauaugggucuaacuauaaugcaagguagaauuaugaaaugaccuaaggagcaauucagaccgcuaggaaaagcuucccggagaagaugccauugagcucauauucgaguccacauagaauuucaacaauuagagacaggauagaaaaggcguuucagagccauauaauaaacaugauuuaaaaccaaaaacagaaaauaaaggcucaugcaccuaaauggaaguaagaaaacugccugaugauaccaguccuugcagcuugccagccagggcugcauugggugaaaagccccuccacagcacggcagcuccagcaguuggcucgaauauuucacaugagaguccacaggaagagcgagcuuucauguauauuuuuuacauccaaauuaaguuaacucauggaauuuuccacccuuaggaauuaaaguagcaacucaugaaguaauucaguuaugucauucauaccaaaacagaaaauacuggagcaacuuggcacuguuuaaaagccaagauuaggccuuggccauuuuauauuuuuucacauuccauggccguuguguuauuuuaacuuuuauuauggcuguaaauuuuucaaaucaaaaguaucuuaauugcuuagaaaacagaaguugaaaauggguucauaguaagaagaggguuuaggcaaagcagcuuuaggagugagaacugaaaaaaagcuguagcauuacauuuucuguaaugcgaggguucuaccuauuugguugacauucacaguugugcauaauuauagcuuccucuauauccauaaaucaucuuagaacuauaaaguugaguuuaaccaaaagaucuguccaauauuagugaaaugacaucuuuagggaagcauuguccugauacaauagccacauucauuuuaaagcaguuaauuggacacauugucaaaaaccacgguauugaguuuccacauuuuaauuucacauuugccuucucccuggcuucugcacacggacgggucucuuuuggagcugaaagugugugaaaguuauuggagaaugguagucucuggguaauguuucuguaagcugcccaaaauuuucccccuguagucuagaugggaaacagcugguauuuguuuaaaaagcuguuuugcaaaaugucuaaaccuugagauauagaacugaggucaccauuaaagcaggugcuuaagagcaagugagaaagacuucagaggccgacuggcucuggaaucuucugcagggcacuuccuauuagaagaaaaaguguugaaguuugcuccuuuauuuaggacacggcuauaaguauuaauaaguaagugcacuagcaauacuacuagaaauugaguauuuuugaacauagccagcccucaagugaauaauuagcucaguaugaaaggaacuaaaauggucauuuuucucacagggcuucaagauacaagagcccaaggcgcucuagucuccuuuggguguuugaauuuccucuuuaaacacaccaacaguaaaagaacuacuauuucaaauaagcaguaccauaacugacuauaucuuccaagguuuuggaugcaaucuaagggaaagggggaaaagagacccgacuuggcaagacccguaccgaagcagucuggaaaaaaagcaaagcaaaaaacauguggaaccacuaaaggccagugcacgucagguauccaccagucugaagaugaaaggaaguaagccuccuccccugggagcuggagguuauuagcagcuguuuauccagucgggaauagagauuaacauuguacuuuuuuuuuaagaacuagaagaaaauuuguuugggaaguuggcuuuucauaucaagucacugugcuuugccaaaaaaaacuuccuuucucagaacucauguacuagcauugagcaauguuaugauucucugagaaacucugaauuaccaaaaagucuuucuccauuaaauagaacagaaaaggacagagaaaugggugaacguuugccauugacacauugcaguuguacucuuuaccaugugaaauuugccguuuggucuauuaccuguucuccaaccugacucuaaaugggacacucugcccucuaccccucacacguacccucacaacuuaaucauugccacucuaaggugcacacaauggguucugcagauaccuacugcuugcaaaaagaccuuucaugagauauuggggaaacugccuaguacucugggugcuuuauucucaaaaaacaaacaaacaaacaaacaaaaaacgaguuggauauagguauuuuuccccugauuuaaugcuacucuuaaugucauuuucuuuuauuaaauccuuucuucugcuuuugaucuuauuuauagcagagccacuggucauauggaaacuauuacuguauagcugcgagaugaaagacuucauggcaauuaaauaagagugaaucauuugggccaauaauacacacauacagugagguaccauuuguguccaaaaugcccuguguuguucacuuuguagcaaagccauugagcuuuacaaagggcuuuacaaaaaucugcuuuuugucagaaauauguagucugacaauaugaaaacacauguuaacacacaguccuuagcugcuugcuucuucacacauacacaguaucuaaaucaugccacuuauugauauaaaaugaaauuuucacuuaaauuugggauauuauuuaguuguguuaagcgucagcucuuuaaaaauauauuuggauaaucuauaucaaaauucgacccaucacucaaaaccugccuaaaaugucauguucuucuuaaaguagucccugguuuccuaaacggguaugacuucaucauuuuuuaaaacccuacaugaccuuguacuccuuuaugacauucaucguauuuugccuuguauaguaauauuaucccaucauuaaaauaucagugccugggcuaggcgcggugguucaggccuguaaucccagcacuuugggaagccaaggcgggaggaucacaaguucaggaguucgagaccagccuagccaacauggugaaaccccgucucuacuaaaaauacaaaaauuagcugggcguaaaggugcacgccuguaaucccagcuacuggggaggcugaggcaggagaaucgcuugaacccgggaggcggagguugcagugagccaagaucaugccacugcacuccuuucugggcaacaaagcaacacuccaucuuaaaaaaaaaaaaaaaaaucagugccugcaaagucauagacguguuuauuuuuccuugcaaaugcccauguagugccuugcauauaguacacuuucauaaggcgcuugucaaauuaagugaaauguuuauuugauagaaacaugcuaaauguauauuuggcaauaucaaacaauuaaauuucagacauagucucacagauccauagcauuugugucaucauuugcuaagcaucuaacugcacauuguacuauuacacucccgugcagugaccugugcaguuccuguccuugggaugggaugcccacaaauggagacaaguauaggcuuuacgaauggcagcaaaacaaacuuauugaaguuuaugcccugcaccauucaacaaugaccuugaauguguuuuaaggguggugucuguaaugcauagugagcucgugaggugacaagaaaguggagauuucuggagauccacucagcccugaagggucagagagugaggggaucugugaggcuaauaaaagagaagcaguuggugaguuaggaggaaaaaacuagcccagcagacagagcagggagggcuuugcucaagccuuagugaugugggcguuaacccagcagaugagaggccaugcguagguaauugaacauugauagugaggaauuuaaaaauaggagggaacugcauugguccugggagucuaggugaaggaugcaucagcacaagguggaccucuuagacuggauccauacagcaagcaagagccaggcugaagccuuaauauugcaucaacugauggagagagaauauugcauuuaaaagaugaguauuuggaaagugauggggaagaaaugguucauucguuuaggugagcuucuuuauacuucuacucucuuuucaaauauauuacaguaagcauguguuacuugaauaacaagaaaagcauuuaagaaauaaaggccaauggguaaugguaaaucccuagggauccuuagggaugggccaccuggacuggcuaaaaacuguguggaggucagcagcaugacugugcacucucacagguaugcuugcacuucaggcauucagaauuccaaguguaaaucaaguguccaguugucuuuuccuuuaaacaaaagcuguuuacacauaauugcuagacuucaccauauucucugugcuagauauguuugguucacuaggauggauuaacuuuaguuccauaccaucuacuuacuagccugcuauguggagcaaggaagagauagaggaaugggcucuguuaaucugccaguguccccgcuaggugagcucucuccaguuaugguuuccacuguauaggaaaaugaugucgagaauugagggugugggacacagaagagagaaaugaaacaguuuuaauagauggaacguaugaguuaguacaagaaagaugaacugaggucggcucacauccguuugcauuucuugaacuauaucauagaaucauucauuuaaccauuuuggugaacauccaggggaguuucagcccagcugaucauaugauagacaagcacugccaaggucaggaucauuuagaucauguuuaaauccucuugaaaauuacuuuauuaucuggagaaucaauauuaaauaaaucuccaagaauugcacaauaaggaauuaccuuacauuucauacagaacauaagagaagcugugauguuucuggaaaacaauguagguguucucaagacaguuaugaaaucuucucccgacauacauguuaagaaucaaguaaaaauccaaacaaaagaauugaauccagaucugauguuaaugaaaagucucuuaaagguuuaaucacauguacuaaagaaaaaucaucugauaauuuuuuaaacugagaaauauggaaauuauguuugugguuggagugucccagauguuagcucuuucucccacaacaggugguuauuagagguaggucuuguuuucugcagagccucugugccucuaguguuguuccucacaguaucuaucuacugcugccauuccaugaacuuccuaauucccaucugugagccauuaaaaaaguuugcaugaccgcuucccaccucuuuaaaagaugcacuuuuguacuaaaugguguuuugcacauuugagaaaauaaguuugcuuuccucuaauaugacagaggucuggcaagauaauugaaacugaaaucuaguacucuacaacugucauguauaauugauauuucauggggagauuacaguucagacaccaaaacuguuuucuguaucaauggguuucuaauuacagugaaaacccaucagcuuuucuuuuguguuaauggaaaaacaacagagaaaaguaacaguaaguugcaguuaccaggacuucugucuuugucccauuuuguuguuguucuucuuucuaaaaaccaaaaaaaucuauguccaaaauuggaaaccagaugccauuaauagcaaacuuuaauuuugauguaccaaaauguuuauaauaguauauccaguuuugugucauuaucacuuggucuagaaacugaugacaaguuuccuaaaguucccauuguauacucuuuuagaaggauuaugguagaauagaagugacugaggucugaaagccuguuuugaagcaguuaucucuggagauaacauuaacuaggauugaauaacugccaaaugaaauuuaauacauuuucccauccaugaaauaggccucuuaaauacaacagaauaauuacuuucacaauacucccuggaaacaaagagagcaaaaauauugaaugucuuuuuuguuugugguguuuguuguuagcuagaggauaaggacaaggauauuuaccacaaugcugaaugcaucuccauauaaaaacagccuugccaacagccaccuaauuugaaucugcaugucuuuuaaaucuguuuauguuggagggaucguggcaaauauuaaauuuuauaauuuaguuagacaucuuggccuuggccugaguuaaugaacuaugauuuucccccugcaauaaagaaaaaggaaaugauuuuccucuaucuauauauguacguauauauauguauguuauaugcuuguaccuagguguguguauacauguauggacacacacacacacuguuuuaaaacaaaagcucugggaaauaaacgcaucuugcccccuaacucuccuccccucuccuauauaauuguucaguguuguaaguuuucugaguucaaaaucuguuuuagaucuccaacuaagcaucgaaaguuggaucuuaagucacuucaccauucuuggccuuagcuuucuuuguaaaaugaagaguuugaccuaacugauauauaaccaagguccuccaagcccucgacgucuaaguucugugauuuaaaaguguuucuaucaguuugucaagcccuuucuuggaaacuaagguuauuuaaaauuauauggugcuuacgugauucaaaauaauuauugcauaucuaaugacauuuaauuauuuccauugacaaauucacacaggagaauucaaauagcuguguuggaauuugaauauaauuugaccuaagauacaauguaacucagacauuuacaccuacauguaccagucaauauguggacgggacaggccaagccgccuguguuuggacuacaugaucuuauccccccuuccucguuuguagcucucuggaccgggaaaaugccugucauuaagguggcccauucauaguaugaccuaugucugcuucaaaaugagcugggccauccagugaucuuggcauucugagcuuagaaauacaaagacaaagaggaaauuagcaggagguacagaaccagaaagaaugcaccaagagguaucaugaagaaagaguccaaucugucaucaugagagggcagaagccagagagaagcagagguccccccagagagaggagagaggcugaauagcccagcagaggcgaggaguggcauucgguucccaagagcucucugaguccaaaaccuaagcuacagaaaacuauuuaugauaaaucuuuuauuugaacaaacucaaauagguuucucuuccuuacuauuaaaacuaccccacuaaauugaucagcauacaaaaauccccccaagaaucauuaugaguuccacaaaaaccaggaccacaucugaguuauuucucauucuauccccagugucucccaaagugacaggcaugagcuagauuagaaaauguuuguuaaauuaguaaaugcauucucugaucaaucaaugaauaaucauugaauaauuuuuaaauuucacuucuaucuucuauuuuuagcauagauaucacuaaaacugcauuauacgugacuaugggaagauucacauuuacaaugaguauuaauaaaauuuucauaagcuggcuuuuaacuuuagacuauuguuaucucuaugaaaagguuaucaaaauagagcuuuaacgaaguauggauuuucuaaaaauagggacgaaaugucaugcuuagaauugacuugugggaaucuccuuucuccuagucacauuaugacguauuuaaguucagaaugccaagaucauuggaugccccagcucauuuugaagcagacaugggucauucuaugaaugggccgccuuaaugccagugggcaaaucccugacccuuguauauacagagaacagugugaguuucuccaucuauuucuguguuauucuagcgauggauuugugccgacaguccacuguguuucuucccuugucucuuaugugaccagaaauaauguuucugaaagagaagaaaacaggguuagaauaugccaucuguggccaaggaaacaagcaaagccaagccaauuauucaaauuggaauacucuuccacagccacaggcaauggaguugauccuauccuggagaaucaagcucauuauuacauggcucuggaccuaucagagggcauucacaugaccuggaauagacacaaggggagucuuaaaacaucacgacaaauuagccggcgugguggugggcgccuguaauuccaguuacuugggaggcugaaacaggagaauugcuugaaccugggaggcagagguugcagugaacggagauugcaccccugcacuccagccugggugacagagcaagacucugucuccaaaaaaaaaaaaaaaaaaagucagaacaacuuugucucuaacauucuuuauggaaaaugauugauauuauuuaagaugaucuauagaaaauagauggaguuagguaacauaugggccuaaaauccaaacaaaaauguaguuggaacaacuauauccucagauauauuuauaauauuuaagaguuuacagucauuguauaggggaaagauuuaaaauuaaauggauuuuaacaaaauagagacaaagaucaccguaacugaagauagcuugaguuuugaggggguucuugaacuacacaggcuauuauuucuauauaacaugcaaguauuuucagucaaaacacaugauucugucugcaguuauuauguaccuauuacauaccaguugucauguacgauugcauggguucucuuuuucucuuuugagaacuuaccucaaugugaucuagagggaaaaaauuucaggagcaguaacugaauauauuuuaaguaaaaagcaaaacauuacucuuaaguuaugucacagaugcuugcaaagaaaucuugagaguguuaaugauucugaaauaggaguacacuucuccucuaugcucaaaucugugguuaccuucagugauuuugacuuagagucauccuuuguagaaauucaagaaauuagauccauugggaauacaaauaaauaugaaucagcacgaagaauuauuuagguuuauauugauugacagacauaaagagccaccauuugaucaaggccuguaaaaauucaugcuuacaaguugacaucuuagauugaaaggauaaucauugauugaauccguuuucuaaugcaugaauauaaaaauagcaaaucaaaaccucaauggaaaauagcuaucaugcuucugaauaaaaauuaaaauauauaagagagugaguuacaaaugguugcuggagcaggugggcguggucugccuauaagagagcagacuucagucacagaggaaaggagugguguggcaggcaacaggguugaauauguuuaaaaaaaaaaaaagguuuguacuuaacgccacagagcucuagaagcugaaacuagaaucagugagugaaaucuacaaagaggccaauuugugguaaaaauggaaugggcuucuuugggagauaucagucucaguacauuugaagcaccccacagaggccaaauaaccaccauucagaaaguucuguguugcgacacaggcaccggggagcagugcuggacuuccuacaucucucugcugaaacauucauuuauacuuccugaggcucauaagccucaaguguugucuuauucuugcuguauuuugaauccaaacaauuaauaugauuuaugugaucaucuccacccaaaauuuaaaaaaaaguuggagugcauacacacacacacacacacacacacaugcacacaugaauauaaaaauggcauacuucaggaucaauuacuuaaauauauuuucaguaaaaagcaaaauauuauaggugauacuuaauacauggcugccuuuaaauagcaugugcuuauuagguccugugaauuuguuguugguucagauacuuauuguugaugcauucuuuggaaauacccuuuuaaaauauauugguaacacaagagugaugauucuccuuucugguuucauauuuuugacuggaaaaaaaaauaaaccugauucauagcaguauaaauguaugguuaauuuuuuguguuuuagacccaccguccuguguaaaugcucacuuaaccauaggcuaagaaaauacuuggaaauagaaaagaaaaugugaacuacugauuguccucuuaguugacaaaugcuucauguuuucgcuugaaggcaugugcuaugaaguaggcaguugcugucucagugccacaaguucaaugucucuggaccccagagucgauaguaguaguuaauaaaaagcucagcaguauuuuuuuaaugaaguaaucaugcuguacucuauaauuuuauucuuggaagcauaaagaguauuuacaauauggugucuuucuagggucagaauagugaggaaaaaaauggaaaaauguccaaacauccuuccuugcauggcaaugauggcauuacugguguguuuaauaaaaccuuuauugguacauuuuccggugugguggcauuggcagaaaccaucccccuuuggauuuggaacucagcagcugaugaaauacaguaaacauuaauuuggaaugggcugccaguuuuggaaagccaggugacauuuuauuauauuuguaccaagcagaggcugugucccauacugcuguagcuuccgcugucagaggcuuagcuggcauuauggaaaaaaaaaaauggcaggccugagaaucuuauccccugaaaugaaagucgaaugccaaauugaaauuccuguaggauuuccgauagcaaugggggaauugagaagcucacaauuaagcauaugggcauuaagauaauugucagaucuguuggcggacaugauagaagacagauggguacgaaucagugcgcuccacugcagcacccugggaggcaauuugacguuuuaccugccugagcuacucugccauauuugucacugaauguacagcacggcaucuuacugaguguuaaguguuuucgccgggaacuauaggugcaugugcgguccuucagcgcccucuagugaaacgcguuugggaguaugguuuuugaaaagccagccuucaucagguccucuuggccucuggaaauagcugucgcaccuccgguuccugcucaccucucugguuccucucgcccuuucagguggggacccaucgugaagauggcguggcccugagaggcagccauucucuucugccaaaccagguuccgguuccacagcuuccuguccagucugcgacuuccccugaccugaacccaccccaggacccuuacagagguagguuggccucaccagggcacuucugaccucacuuucacaauaggaccaguguugauacccagccucuugguguucaucccucaagaagcacuggcagaaacccaggaaucaaauugggcacaaaaaugguaaggaaauggcaaaguauuuagaacuucgcccgcuaauuguguuucuccagggacuguuuuccucaaacauccucugaaauccugguccuauaucagcagggaaugaggccacagacugaugagaggaaauuuuauuuuagcuauuuccacauuuuucucauucagguccucuaaugugguuaguuguggccugaaaaugauauuuccaaaugaauaggaaggaaggaaauuguuuuuguuguuuaagauggaaggaaauauaggugcauuuaaaaaauggagcuugguugcaugauuuucgcucuugagucaucuagcccucuaaugauugccucauaccggugauuacgagcggcuuuucaugaccccaggaaguugggcuauugcuggccagcugacuaggagucgcuuagauaacaucuucucagucccuucacauuuaauauaaaaaugauaacauugccacaggaauacaugugggcauuuuuucagcuguucaacauuguacagaucugagugucaauuauauguauggguaugucugcccauuuuuuaugaauaauaaucauuuuauggacuuuuuuuuuuuuuuuuuuugacagagccucacucugucgcccaggcuggaguacaguggugcgaucucagcucacugcaaccuccaccucccagguucaagcgauucuccugccucagccucccaggggguagcuaggauuacagacaugcaucaccaugccuggcuauuuuucguauuuuuaguagagacaggguuucaccacauuagccaggcuggucuugaauuccugaccucaagugaugcacccgccucagccucccgaagugcugggauuacaggugugaaccaccacaacuggccaggaccuuucuuaucaggaggcuuuggauuuugcccucuuuguccuaaaccugugcuucucaaacugcacauaagcacaaccugagcaucuuguuaaaaugcagauuccacuucuguaggucugggauuguccauuucuaaugggcucacagaugaugaggccgcauggaccaaaguuugaguggcaagguucuagaauacacagauuacaaauaaagaggaauacuugacagauaugcuucuaccuuuaaaaaaauuacuacauuagggucguguuuuaaaaugcagugugacuuggaaaguugagcaaugauaaagcuagaaauuucuaaaaugaguagcaaacugccuuccauauguaccauuuuaaaaugcugauuacuucuugagaauaagagaagccuaauuucagaauaucauuaggguaccuauugaagucuugacugcacauauuuagcauacucccugggaauuauauuuuaaggacauuuuucuauuaaaucauugcauauggaagaaacucaauauaauagcugauauuuacuuggguucuuaaucagaacauuggcugugugauuuucaugauuaugauuuucauugcaauuaaguugauguuuuguagacagugaaauuaccaucuacuccaaaagauugcaaaauagaauuuaaccuuagagccaaugcagggaaaacuuguuucugcaggugcauuuuuugaaacuucaacagauagcagggggaaaaaaaagugacagaaggaucacaguucagcaguaugaauugucugcuggcagccuugcaaucuggugugcaggcagugagauugugguguacaugucaccugauuucucuuuuucggcaggcaugccaccaggacuacaggggcagagugucuccucuggcagcucugagaucaaauccgaugacgagggugaugagaaccugcaagacacgaaaucuucggaggacaagaaauuagaugacgacaagaaggauaucaaaucaauuacuaggucaagaucuagguaacaguauauaauacugucgcuucauuuaauuccuuuauuggacuuugaugaagugaacagaacgggaagaaacuauucaguuuuuuccuggcagguaaauuuacagcugaaaagaaaauuaaaggccuacucuagaaguacuaaaaguaucguuucagauaccuguacucuauuggagccuaaacuguuuuggcauuuaugaaucuggacccaaugcuaaugacacacagugaaaaaauuugucucugauucaaguacaguuuauuuguaaaacuauacuuauucuacaaauuuggucagaaauguugugucuauaauauuucuaaaaagagauuguagccauguuaaaaacucaacugauguaugugccaacuauaacucuuuucuuaccucuaaaguaagaaaauaauuuccuagauuuauccuaaacaugcugauguauauaagaguaauaccuuaauuguuuaugguuuuucuuccuggacacucuuuucuacagaaaacacaacugcaggaaaauagcuucugucugguuuucuuaaauaucugcuaucuuuaaauucaaaucuauaucuccuugaacuuuaaucugguaaucagaugguuuuugaauaccaacacccguguacuuugccucaauucccugagguuguuuuuauucacaaauucaaccaauuguccuaagacuacagcuuuccuucuaaaggcugugguucucaagguucuaucuggaaucuuuugugaauuaagaacaugcugccucuuuauguugcuguuguaauuauugagauaaauuccgugucuugccacaaguuuaaaaaugccgaauacuucuagauaaccccuuuccuuccuuguugucuuuuucugauucuuggccacuuuggcaagaaaucccaaggaggggauuucauaccuuuagcagcuucuguguuagaccagucaguucuugguaauuuaacuuauuguggccaaacuuaugcauguuaauggauucuuugaaguuuuggaacaacauuuucauucgcuguugagaaccuucuuauuuaaaaaggucacucuuaugacauuuacuuauguaugccuccaaaacuguauuauaaggcagugcuuuuucaaaucuaggcaguuuuauuugcauaacuaguuuauuuguaagugaauaaccaauucuaauuggucguuagccugaaaaucuuuggaagaaaaguuccuauuuuccagucuccuuuguguaagguguagcauuuguuggauguauaaaaauaucacccaaaugcucagcuuccggacaggccuggcagagacuguuuucauuugcuuuuuacagccuauuugcauaguagaauauaggagugaauuaaucauuacugauuuccuuggcacuggcagcaguugggggugagggcagaggagggauccgcagaaggcagagaaagagggccuuuuccaguggacucaguugacuuccauguuuaccauacacaccuguggcagacagugccaucuggaaaggcgcuuacgcuauggagagagaggagccuggucuuacagcauccuucuguggugucauccuccuugccccuaacuuuucuccuucacccaaguguucuugacuuacgugcauuaucuuuauguguaacguauacuugcaaccgaagaauaccacucccacuuuugauugauuggagcuucucaaguguaauugguccuuauugccacuuggaaguuacccagagauucuccaaaauggaacaucagagucauauauuuuaaaccagcauucauuaaauauacauuuaauugaguagauaauuucccacaucuuccaacuccgaaauguugugauuaaucaucuuuauucugugaacauuuccaaugugugaaauuacccuuuagguuaauuguuagucacuuccauggaguuucuugugauggggagucuacugauguucagugaaguuuguuucauuuucugugucucucauaagccccccaaaaguccucacucauguuuauucacaauagucauucagagcuuuauagcacgugcugcucugccuucuugagacaagacgucgugcacacuucucuuuuuuacaugacagcccuuggaauauuugaacccugcugcugugacgacuuccucauaugauaugcuuuccagguggcucaucauccucuuugccuuccauucaaaaguuucuaauuugucacuguaacacucagaaauggacagaaccgaucuuaucuuuucagacuauucugggcccggccaugcauuuguuaugaaucauggaauauuuugguuuucacaauuagaaauuaccuuuuggcuuuuuuuuuuuuuuuuuuuuguaagagacagagucuggcuguguugcccaggcuggagugcaguggccugaucacaucucacuguagccuccaccuccuagauucaagugagccucccaccucagccuccugaguagcugagaccgcaggugugcaucacugugcccagcuaauuuuuuuuuauuuuuuguagagacgaggucucacuauaucguccaggcugggguuauaggcaugagccacugcacccagcuuucuggcuucauuuuugacucacaaugaggucauggucauucauaagcugcagguguuugguuuguugaaucguuuugcaugacugauaucaguucagguuucccaaacuuguucuguggaucauaaacaucuauaagauuaaagaccauggaagucauguuuuuguaacuuuuuguuuaauacauagagaaaaugagacucacauaguggguugaccaggccuucaaagcaagguaauggggacaccugaauaaaagccucacugucuucacucccauugcucuggugucuuacauauaggccuuucuucuuacuccuguuaagcugccuuguauuuuuuugaccuaucaaaaucauuuuucaauuacuuguuuccccuagauuucagaugucacgguaugaaagguuuuauauauauuuaaaaaauaaaguauaaacauaaagucuuuuugaagcgugguuaugcaacauaugcuaggcguaaguuggugaaugccugcuuugcagaguguaaccccauugaauaaaaaaagcuuuguuuucccuuucugccccccuguaucaguaugggcacacccugcacucuaacuuuaaucuacgucacccucaccuguuugguuuggguuuaaugucugcgagaaaaccaaauaucuuguguauugugaacugucaaagccaucuaaaccaaucccaaggucaaguggauauaaaaauucugccaaaaacauggcauaagauggaaaaguucccugaaaacucuggaagaaaacaaaguaauguagacaccuucuuuuuccccacaccauuagaaaauguugcaucccuuuugucccacagcaauaaugacgaugaggaccugacaccagagcagaaggcagagcgugagaaggagcggaggauggccaacaaugcccgagagcgucugcggguccgugacaucaacgaggcuuucaaagagcucggccgcauggugcagcuccaccucaagagugacaagccccagaccaagcuccugauccuccaccaggcgguggccgucauccucagucuggagcagcaaguccgaggucagugcaggccagccuccuugcagagcucgugaggagcuuguggcaggcacaagcugagaugggcacgccagucuugagcaguggcagacaguagacuuucaagcaucauuccaaagaauuguuuccauugcagacugugucuaaauccauaaggcagcaucccuuucuccuguaauuaaguugugggauucucuuauaacuaagauuauauugcaacuuucccuauauccuuucaguaauuugagcuuaguuuauuugcuuuaccaaccuuugcuuacuguaaaguggcuguacacacucacaugcaguucaccuuuuacuagugacugaccaaauggauugccacaguacuuaguaacuguuccuuuuguucuguaauauaaacacugagaaaaaggucagacacgcaagaagagugcauugcugcccucugccagaagccucagcauuaaacaaagguucugugcuuuaauccuccacagaaaggaaucugaauccgaaagcugcgugucugaaaagaagggaggaagagaagguguccucagagccucccccucucuccuuggccggcccacacccuggaaugggagacgcaucgaaucacaugggacagauguaaaagggcaaguuuguuuucagccauuucugagaucgaucauucaaaacucucaucaguguaucagccauaaaagugaauuucacccaaauugacagauauuuucuuucauggaaaaagaauuuuuuuuaaaaaaagcauacuuuuucuguuacaaauauauuaaugaauuuuuucucucuuuuuuccuuucucagguccaaguugccacauugcuucauuaaaacaagagaccacuuccuuaacagcuguauuaucuuaaacccacauaaacacuucuccuuaacccccauuuuuguaauauaagacaagucugaguaguuaugaaucgcagacgcaagagguuucagcauucccaauuaucaaaaaacagaaaaacaaaaaaaagaaagaaaaaagugcaacuugagggacgacuuucuuuaacauaucauucagaaugugcaaagcaguauguacaggcugagacacagcccagagacugaacggcaaucuuuccacacuguggaacaaugcauuugugccuaaacuucuuuuggaaaaaaaaaauauaauuaauuuguaagucugaaaaaaaaauauuuaauuuaaaaaaaauuguaaacuugcaauaaugaaaaaguguacuucugaagaaaacuacaugaacguuuuuguugguauucaagucagcuaguguuuauaauuacuggauauugaauuaggggaagcucggcugcccuaguaacaaaaccagcaaacguccugaugacaacgaagugaugacauuagccauuccuuaggguaggaggaacagauggaucuuauagaccuaugacaaauauauauauaaauauauauauaaauauauauuaaaaauuuagugacuaugguaagcuuuuguucauuuguuucagacuuuuuucuccuguaaaaaaauaguacugauuaacuuuuuuaaaagaaagauuuuacuguaaauauggauuuuuuuuuuuuuggucuuauuucugucccuuucccugguuuguuaucguaaccuguagugccaacucugcuuccagagggguagugcaggaugaaaugcugacccugauguugcuucucauucauaaauaaguagaaaguuguuucuccagucuuuugggaacacaggacuuaaaagucacaucauguguagauauuacaagcagcauuaccaagacauggcaaaaagaguuugucugaauuguaauguugcguuugugaaccuauucugggauuuucagagguacaagguuagaaugcuacaauguuaccacugugccuuccaauguuuauaucaucggaaacauaacauaaucaaaguggcugugauuuaacaaaaugauuaaaguguuaccuaccuguguagccgaaguagugugcagugaggcguuucugaauacauggucagauuuuuggaaaaaaacaaaaacaaaaaaaacaaguaaaguucaaaaaccgucaaaugagaaaauugcaaguagugugacagagcugauugauuuuguugcuuucuugauuuuuuuuuucaaaauggguuuacuaaaauguagaugacuuaacugccuccuccuucgucugaaaaaugccaauauucaaucaucaugcagcauuauaacaagccuuauaaguccuaaagcauuaaguugcacuuuuuugaggagggguagugcaguauuucucuggccaguaugaaugaaguuuauacuuaccauauuugauagaaacauagaucaagcuauggcacagcgacucaucagauagcuagcuuugacgucugggcacaauugaaccaacuuccaucgugaaucuuuauaaugauugacuuugguguauagugcaguaaacaaauagugcuccuaguuaaguauuugucagcauccuuuugucucuaacuuguuucuauuuuuacagccacacaauucuuggcauguauuaagaaaaaaaaaaaucccuguucaaguaguuuuuccaccuaucagcacugaguaaaugccauaaauccauugaaauggucuaaauguuccaucuguucuccuguuuugccaguuauauaguaaugaaauacauuuguaaauuuuaugcaacaaauggcaaacguaucauuauuuugaaauuguguauguaaaaguuauauuuuuacauguagacucuuguuauuauguguuuuaauacauuguaucaguuuuuguuuuuuuuuaaaaacugugguuuaaaaagaagucucauuuaaaugaaauagcuacaagaaucagaauuuuauguucauuucugaaaauguaagaacaaauaagauaguuaccacguggucaucuuuuacaaacccauaaacauuuugauuagcuguguguguguugaaaaacuguaaauauguucaguagcgauaaaacuaaaauaacuuugauuuguugauaaguuccuaaaauguggagguggauuaaaaccuuaggagaauagcagaaaucaaacuucaugaaaaguuauuuuggggcuuuccugugaaauguaugaacaaagaggcucagagaaggacauggaagacaauaauguauacucucuccuccucccugaauaaugaaaaccauguguauuuguucccuccguauguuaaagauuuccuuuuagugguacauucugcacucauuuuguauagucuaccaaggcggguaucccuaggaacaauauuauauaggaagcagguauacucugaucacauucaggauaaguguacagaagaaaauacgguguuuacucuuuagggaacuggaaacacucccugcauugauguacauuuuaagaauggcacuuuugauacauguuaucauaaaggugcuuaauagagcugaauuaaaguuuuucaaaucuguaaacaaagcaaaaaaguaaauuguagucauuugauuauuuuuuaaauuggugcuuuauauuuuguucucacucagaguaaaagcugcaauuuauuguucaccagcuuugauguauucauuacucaguaaugcaauaccucuauuguugaauucccuuuggaaauaagugaaaauucuaacggccacugaaagcugcucgcuagguuuugcuugguggagaaacauaaucugcaccuauccauauuaauuggguuguauccccauuaaaaaagaaaaaaagggaauguggccuuuuuaguguguuuuuuauuguuguuguuuuguaauuaucaaacccagguaagauauugguauccugcacuggauuuucaaaugaaguucagcagaagacaguuaagauuaaaguacuauacaaaaauuucaaaaggguccauacuacgcuaucuguaugacgacacuuaggcuggggaucucuuucagaaacucggacuuuaaaagcaacuuggagcaguugauccaccuccacauucaaguaauuuaugaauaugcagaauagggaucuguucaucuagaaauuuuuaccauuugucuucuguguagcugcaaggaacacuaauguuuauacaacugucaguccacccaguggugcaacugguucugauucagucuuccgauuccuuuuuauuuuucacuuuuuccuauuucugaauuuuuuuuuuuauuugugaucuugauuuugaugagggguuggggaguggggagggagucgaaccaagacuuggaguuaagaggauuuucaucuuuugcauccaacaggcagaauaugaucuguguccaaaagugaacuugagucaggaaugaaucaauuucagcauaaacaagcacaaaaauuuagucugcuggcugacuggaagcaaaaaagucaagauggaauaugaugaauuccaacacaauggggcaccaaggccuuuaggccucucuuuuuauuuugcuuugguuuuguuuguuuuucuuuagagacaugcucuuucucaugggacuugaaguggacucaucuuugugcagugcugguuuugccauacucauuucaaguauuauagacauauguaauggugaaaauauaugaacuguggccuuuuucauucuuguuacuugugaugcaauuaagugaagauaagaaaaaaaaaaaaaaagcagagauuuaccauguaucagugccuggcuuuuuguuauaaagcuuuguuugucuagugcucuuuugcuauaaaauagacuguaguacacccuaguaggaaaaaaaaaaaacuaaauuuaaaaauaaaaaauauauuuggcuuauuuuucgcaggagcaauccuuuuauaccaugaauauuacaaaaaaauugucagauucugaauauuucuucuuuguagauuuuuggaaucauuaugaguaaaaguuuguuacuuuauuuuacuauuuaaaagauguuauuuuaccauguguuaccaagaugaaacuguauggguagcuuuuuuguuuguuuuuuguuuuguuuuuguuuuuguuuuuguuuuuaguuguaggucgcagcggggaaauuuuuugcgacuguacacauagcugcagcauuaaaaacuuaaaaaaauuguuaaaaaaaaaaaaagggaaaacauuucaaaaaaaaaaaaaaagauaaacaguuacaccuuguuuucaauguguggcugagugccucgauuuuuucauguuuuugguguauuucugauuuguagaaguguccaaacagguugugugcuggaguuccuucaagacaaaaacaaacccagcuuggucaaggccauuaccuguuucccaucuguaguuauucgaugaagucauguacaugaccguucuguagcaauaaaugugccauuuuuauaaacuguuucugacacuuguuucauuucauuuugcauuguccauauagcuaugauucucuucuguaaguaaaacgcaucuauauuucauuuuccaaguguuggagguauugacagcuuaacaaacaaaacauacaaaaaaaaucacaaaaacaaauugaaaagcaaagcacaugauugaucaaggaagagaugcccuuaaugaaaauggaacgggaugcaugcaaaacaaaaagaaaacugucuagaggauuaacuaauugaaggaauauaauuaauguguguguaacacugaagcuaugcauuugaagagcucugaacugcaccaguguuuucgguugugcugcagguugcuaagucaagucagccuuaaccuuuugcaccaguuggucggcuguuuggcagaacauucucagaucuuuucagucaaaaaucuaagaugauuuauuuuguaucacuuuguuaaaagcugaauauuguuaacuacaguuaauauuaacacuguauuuauacuuucucaaacuacauccgccccaccacuucugguugccucuguugacuauuaauccagauguaaacaaccagauguuuuuuucuaacuuguacaaacugacgugugucaacuaucauggaaggaaaaaaauguacagauuaaaauuauucaguguuauguacuguaaguuaauauuuuuguagaauggacaucaaucuacuuugcaaaauuuggaggcuauuucaacauugcacuguagaaauguaaaguaauguaugcaauguaaaggaaagcccgcgguagcugagcgcuucauaacagaauguucuaaucaaguacgugguauuuggggaugucuccaauauugcucuuguauucuuucuaauuggguuuagugacuaguugaaggaaaauguuauaacgccauuugguucacaugugaagugcccuccauagccaaauguugggauuuuuuuuuuuuucguuuuugguuggacuguuugcagauauuuaaauuuuaugaaauuuccaaagauuuugguugauaacccccuuuuaccuucuaaaugauuugagauguucuuauguucuuacuguguguuuuaaauauauauaaaagagccacaagcauuu

SEQ ID NO: 6328 - RNA, 366299 nt, Homo sapiens; identical to SEQ ID NO: 6321

SEQ ID NO: 6329 - RNA, 179780 nt, Homo sapiens
uccugcagaagaccguguuccugugggucugguuucugagggucaaggcggaggucauuagaguuuuggggagaagaaaguugacaacauccuuccuuucugcagauggucauggcagaggucucuguuuucgcugggccccuuuuucuggucauugagagaauaggcuuccucaccccuguauccuuucuuacuaauaggaauuggcgugauuccucacagacacaaagauuuccucugcugaguaagcgugaggccccuuaacuugugaaagcaucauccagaccgugugagucugucuguguaugugcagaacacagacccuccuuucuccguuuguggggaauacuucccucgggugaaacugaaguuaauuuuuuuuuuuuuccaaacacaaggugagaaguggaaaggggcagaggguggaagagagguggauggauuggcaugugauggcugaauuucugggccuugggagguucguuuugaggcauuaauguccaggaaaauucuuuuguauauagcacuaugacugcauaugcuuuucuuaaaaagccuucguaauguagccguggaguguggagauuccuucauucuuaauuugugcuucaugguugugagucuugcaagagucuacuaucucugugcuuagcguggucgcagcaaucuccauaaacagugugauuacuuagggauaaauaaaagugaaauuuuggaaauuugcugacagagggaaaauagggacugaagaugaaaaauguacagaguaugaauuucugcuuucugugaaauuugagaauagaacagaccauagugugucuuccagugaaucaguuucucuugugccguauuguuauuugaaucccugucuacaacaucagcuaugcaaaccaaagagaaaggcaaaaucucaguaucuugggcuucaagucuaaauagcagaucacagcugaaaugauuccccacugugugacaaggugagugacucguggaggggaggcuuuuguuuucuucuguuuacuacaugauugagauacggaauaggaaaccuucagauggugugcccuaaggagcuccaaaagcugcuuuaucguauuauaacaguguauccuauggacuuaaaggggugagcagugcuauauggaaacaugcuucuuccagucucaauagccuuuuguuugguguagagacagaguggugguaagcaacagguagcaaagcgcuguccuggaggaauacauuauuauugugagacguguguuguuucagaaauauaucaaguuaaaaauagauauauauuuuagauuucuccuaaggauuuaacacuaauacugauggacauaugacgcuuuuuuaaauggauauauuuuagcagaagaaugaaagccggcagguucuuuauuagcaauuaaguuguuuucauuaaaaauaguaaugagauauuauuucauuaaugcauuuccaccugaaguuaucagaaauaaacauggugacuuuuugagacuuuuaaaauuguguugaaaaugaaucaauagauaagcaaaaguagccaaacgaacuuuuuugaguucuuacuaaauaugacaaaacuaauuuaaaucaaauugggguacagaaaucacacccagcuuaacauguucuugccaaaugguaaccucauacuccuuuuaacuggcagagaaaaugaaauuuauaauggaaagucugacagaaacgaaaaugagugggaauaaaguuuuuugcaagcuaguccaaccuuaauacuauaauagccaauaacuaaaacuuaaugggcaucauugcaaaugccagaagggaaaaaaugucauuuguuuugguuucuuuuugcugcuuugaauagaauguugggugauuugcaaacuuuuaaauuuugcuaaaaucuauuuuuuuaaugagaugaugauaucaaaacaaauacuuguuauuacuucuccccuuaaauggaaguuuagaguugauuaucaggaauuguuuguauuuucuuucugggauauagcccaggucuaaagccaugguuucauuuuuaguauugugugugugugugugugugugugugugugugugugugugugugugagagagagagagagagagagagagagauggggagagagagagagagagagaaagaaagcugccuaucugagaccaaucaaauuagaaucuugugagcugggccugugcuuuucugacaacuccccagguuauucuaaugugcagcuagguuuuaucauuuccuagaauguucuguagaaauauacccuguauuaaugacuuguguucaacauaugaccuugaaaaugcuuuuaggcuuuuugcauuaauuugauuauucaaggcauggaaauauauugcauaugaacuucauuuaaaaggcagugaaaauuagugauauagugaaaaucuucaaaucuuuauauagaauuccacaacugaaugucccagcccauaucuuguuuucucuagugaaguccaaggcuuuaaccucauccaaauucuuuuucuucuucagcaagugaucaaauaggacuuugcugauacaguuauuuaauguuuacaucuuaaaaugacuaauggaauuuaagaauuagaccuaaucuaggagguuguuguuaauuuccagaaacuuggagaccagggaggaaacauauuuucuuaguuugcccauaggcuugcucauuuuugguucaucgaaauuaagcauguaguugauuccaaaaugaauuucacauuucagaauugauuucuuugucuuguuauuuuuacuuuugauucaauagguauuacaaaugacuuaauucuaaacuuuuggccucuuuuaguuuuucuuaucuaaagucaaaauagaaaggauguaagugaaaaccguacaaaauuauuuuguuuauuacgaaauuggcaauugaggccaauuaggccuugcgcaagcagaaauacacaucgcuuuuuaauuuacuaagaugccuaaguguuuauccugaguguucagcacauccaucgaggucuuaugcauccuuccugggaagcucucccuugcagggccuuagcaccugucuucaucgugcuuuuuaaaauuugccaucauuuuuauguguuuguugcaugcugauuuccacaggauucuguaaacuccuggagggcagggaccaugucugcuuuauccugaauguguaccaugugccuagcagggcaaaaauugcaaugaccuaguguuucuuuccucagcaucacuuuuggaagccauuuugagggaguaaggucugaauagcaauguacaugaaccauauugugagcaucuuuuucaugccuacgaaaaccagaaaacugcacucucccaaaaaaguccuuuggaagcucuuccuucuaacaugcugugcaggcucuggaaggacaccaaagucauaccguggagagacacccacucugacuuuuugggggguugaaucgucucauucaccuggugacuucacuguucuaggccuguauaucuggaaaggccugaaugagggaauuauagaugaucugugguucuggcagagguguuguuggaaccaaaggucagcauccugguccgaacauugaaauguagcagugugaaugguaggacaggauauuuuaaauugugacaguuucagacaucacagggccugaguuugcaguauauaugucaucgcagcugugucccugagcgguauuuuucgggcagcggcuuauucauuuugggggauuguuauggguauauacccuucuuucaaaagucagccgguacuuaucaaaggggagaauggguccauucuuucauugcauugguuaagaaauacuuauugacccuguagugguguguuagauacucaggagaaaaaccaagggaucuuguauaccuucccuucuauccccaccagcagcuuccuggauguuaacggggaaaaucgagcucuauuuauuuauuuuuauuuuuaaccuuacauagcauaaauuuuugagcauccagaacaguugaaaaaauaauaaaaugaaugccacauaccugcuauuuagguuaaacaguuguuuguauuuguuauacaguauuuucuuguguguauguauaauauguauaagaauacauauuuuucagugaaccaaccauuuuaaguugcagauuuaauaagaaugcacccauagauuuuucaguacaugucucuuaaaaauaagacauuugccuaacuaacauacuguuauuaucccuaaagagauuaacaguaguuucuuaaucucaguccauauucagauuucuucaguuguccucaugcaaaugucuucaguagcuuucuuaaaaaaggcaacuaaaaugccauuuacgcgugucauuugauuucuaugucucuuuauaauuucuuuuaaacuagagcuguuccucuauuuguauucuuuuuuaaauuguguaauuuauuuuuuagggaugggguaucgcuauguugccaaggcuggacucaaacuucugggcuugggauuuucccaaguaauuuuuuuguugguuuguuugaaugauagugacuuuaaagagaccaggccaacuguccuauaaaacauuccccuuucuagaauuauuagauuucguuuccuuguggugcuguuuaauuuuguucaucacuuguuuugccuacaaauuuaaaauuaguucuaaagguuuaugcagguucagguuaaacauuuucggcuggaguacuucauugggggugcuguguauaucaaauuacauuccaacagaauauugagcuaugcugcuguugguaaugcuaacuuuaaucacuuggcaaaaguggugaccacuggauuguuccauuguaaaggaaucuuuccccaucugcaauuaacaaauagucuuuguauugauacuuuagcaauggacagauaccccuuuuucccaacaaccuuugaccuaauaguuuuagcacacauugaugacccuugccugaaucaguuauuucaacugaagacuucaaacuggugauucuuuuaaaauuccaucauuccuuccacauuuauagcuaguauucuucuauaaaagggcaguuucuuucaucauucauuuuaacacuaucaguuucauguuucauauuuuauauaagugucauaacaauuacuguuucuaauguuuccuuaccuggaggauguuggaagcauuaaaguauucuugaaaucucuuaagguauauugauaagaaaaguaguuauggcucaggcugauggucagagaggcuuuaauuguaagaggagggagguaauuguaggcauguuuccuuguaaacuaaacuucaguauucuuuuggugaaauuuggaaccuugcaacaaccucugugccccuagcuguguuucucugauucucauauugccacucuauaauugcuaguaaacaucucacaagguugaucaucaguaguugacuggccgacucgaggggguugcuguggugcucugugaagcugcgcuaucagggaucagcuaauaaucccugccucaguccuugcacaauccagacaugguugauagugaaugucaaaaugagugaauuucuaaaagauaguuugggcuuaaucuaaaggaagccugaguaacuaguauuaggugccaauauaaaucucugaguugguuaauauuauugucccuuaauaauuaagaaagggaugcucagagaaguaaagcaaguagaccucaaaucauuugcuucaaguaaguuucagagccagacucugaacucuaagauguuuuguuucaaagccagugcuuuccaacuuggguucccugcuacuuaagcccaugaaggaguuuuuaggcucagaaguccauauuaguucucaucuagaaaacccugucuggucgauuccaggcccacugggggaucugggccugacacaguaucuacaacagaguagcugcacucagcuccguucaggguuagcuagaacucugaacagucaguagggaaaggcauagcggagggcagaucgcaucguuccugacugcccagccuuaagggggggaaaaaaagauuauaugaauaaucuauucaguaacauccucagaauuagcaugugcaauuuccuuaaaaccaaugaggauuuccugugaaaaggcugggguggaauaugccaauucacauuuuagcaacagcgugaacacuuucuuaaaaauguauagauuauguuuuggcuuugcuuuuugugcaauguaggcagaauaugguuugcuauuauauaaauuuggauucauuauagaucacauuauuguuccaaaaacacaagagcuacauacagcgagauucugaaacaauaccuuuagcagguucuuaaauaugccccaauaauuuuucgauuauggcauuuagcccucaaguaaaauauaugaaacaacagaauaugugcuaggagcauaggcaaguuuuauacaacaacaguucaggcaguuagugcauaaaaagccauugaaauugcuuugagaugauuuaugagacaccgaagaaauggacuccuaguauccaaauugaaauuucaccagaaucaugggauuaacuucucuuuucuuaugaaaaccauuaagcguuuuuaaaauagcuucuagcaauuaggacuacaguucuucaucuuuauguuucugauagguguaaagacaaaggggaaaaaucaauuaaugacuaaagaaauaauugauuuaaugcugagguguaucugauauaauuuaauguugaaacguaucuacauaucauguagagaucaguguagcucuauagccuccuucuguaagaaaggcaguauacucaaaauucaacaucaggauaguguuucaaugugaaaugacagaaauauuuauugaacgucaugcuugauauuauuuuauuguugagagcuuuuuacugaaacucuuuaaaacugaacccccaaauuaaaauauuggcaacacugaaagauagcaacagaagccuguaaucugaaguaauggacuuauuaaggacuucagaaaaaaagacuuuagaaaagaagcauauaucguugagucugcugccgugccugauagugauaaccugcuuagaauugaagcaccccauucuuugaaaaauugugugcgcucuguggauauugacguggguuuguuuacaugugcuuucacucacagaucaacugagcuuccuaaagcauggaccuuucauguucagcguguuguuuucuaaucucauagaaguaguuucauagggaggagaaaacagaaaccgacaagaauauuucuuugcauuugccuuagcauuuccaacaugcaaauguugcuuuuuucauaguauggcacuuauuuuugucagacauuucuuguacuuaacaaagggcaaaguuacauuuuggcgggagagcgacuuucgcccggcacuucaccagaucucguugaauagaauauauuaucacuguuagcauucuuaggguucuuaaugaaagcuacauacccuuuaucuccauuuuccucuccuuuuagaagacaucuuccaaugaacaauuucuaugacuugaauaccagauauauguuauuuucaagcuaccucaaagccauguuuauaugcauuugcgacaauaacaauuccgugcuucggaauaauuauguaggaguaucauugagguuauuaggcaggacccacccucuagaguucuguacaugggggggucucuguguguugggguuuuacugugcaagcacacagaauauccugagcucauuuguaccaugauaaugaacagcagggcacugaaucuuuuuaguuuuauuggcauuguauacaguaaguuauuaaauuucaucucuguaauauaccugcaguaaaauaacaaaauauuggugcacuuaaagaacauguguguguggaacaaugcccuccccaucauuucagcccccugcaaacagcugcuuacagauuucaagauccauuguauguauucccucgagcccaccucuaauaaucgagacacaucugccauugcaguauuauaggcauauguaguuuuauugaaaacuauaccuguaaaaaaauuaaauaacuccugccucaauuaaauuggcaagcuaccuuuugcaaagaucauauugcagaccucuugagacccaagugaguucauuuuauucuuacauuacaaaucacuaaauauguuauuuuuauuuagcugaguagcuagcuuuccucguacuuugaugguaaguuacuuucauccauucucacuuuuguuuuccuucuccccucaucuuuacauauuaaaaaaauuaugcaaauugcaugaagcaaacauuuugagaaucugaacagaauaaaaucaaagggaaaggacccuaacaugcagcuuuaacucugaagugauuauuaaauaaauacaugcaaagguuacaaaauuggggucaaauuuauaacucacguuguggcuugugauuuuuacaaacuucuuugagauccauuugaucaucauaaugguagaauaggaaguaauaugaagaggaaaugaguuaguaggccauacaaagcauaugcagaugaauuccuauuggauuaaauaacuuaacacuuacucuuaagaaaauaauagauacgagaucucacucuaucacccaggcuggagugcaguggugcagucauagcucacugcaaccuugaacuccugggcucaagcaauccucccuccucagccuccugaguagcuaggacugcaggcauauaccaccauggcugguuaacuuuuuuauguuuuguagagccagggucucacguuguuguccaggcugucucaaauuccugacuucaagccauccuucuaccuagacuuuccaaaaugcugugauuauaggcaugagccacugcacccagccaacagucuuaauacuuguugaagauugagucaguaauagaugucugcaaaauaguuuuuuauccaaagaaggaauaagaguaaaauauuuaccgauauaaaaaugugagccuaaacuuauuuuaaguuauguaagguaucuguauaggucuucaugugaguuaaucaugccaauauauagugauuuaaccaagaagaauuuuuuugcuuuauauuuucauagaaaaaauccaaaaagacaaguugcccacuauaugggaaacauauauguguauauaucguauauaucugaauuauguaugucuauauauaugaaacacacacacacacuguuauaagacaguaagcagguuccuuaucuauaguuucuuaguuaaaaaaacaaaacaaaacaacauuuugugcuauucagaugaacuguguauaacuggaccgagggagugguuagaggugaauacugucccaaagugaacauagagucagaggaaagacucuguugaaagucagaaaguagaugauuucauaggaucaagucacggauaaauaugaggugaugacuguuauagagaagguagaaaaucgaaaaucaagcagugauauucuuuuuuuuuuuuuuuuuuugugggguuguuggggauugggucucuauguuguccaggugggacucaaaccccugggcugaaucagucuucccaccucagcccucugaguaguugggacuguagguacacaccaccaugccuggcuuguaguagcaguauugacaaccagucaggauagaaaauaguuacauguuuaaauaaagaauuuccuucuuugggccgggcaugauggcucaugccuguaaucccagcacuuugggaggccgagguggguggaucacuugaggacaggaguucgagaccagccugacgaacauggcgaaaugccaucucuacugaaaauacaaaaaguuagcuaggugugguggugcaugccuguaaucccagcuacucaggaggcugaggcacaagaauugcuugaaccugggaggcggagguugcagugagcccagaucacgccacugcacugcagccugggugacagagcgagacucugucucaaaaaaaaaaaaaaaaaaaaaaaaaagauuuuuuuuuuuucuuuuagaugaagucucacucugucgcccaggcugcagugcaguggcacaaucucugcucacugcaaccucugccuccuggguucaagcgaugcuccuguuucacccucccgaguaguugggauuacaggcgugugccaccugggcuggcuaaguuuuuuuuuaauauuuuuguagagacaggguuucaccauguuggccagacuggucucaaacuccugaccucaagugauccgcccaccucggccucccaaagugcugggauuacaggcaugaaccaccgcgccuggcagaauguucuucuuuuuugauaggaauguugauucaagucagugaguggucguuugguuccacuugggcuuaccugggcccaggagacucugcucacucuguguucucccaggguauuuugugccccacugcugguucacagagaugccagguuucacggaauggagggcugaguccuagagagggucaucacuuacaaguaagauaucaaacccuaagggaaucagaauuuaaagucuuagaaggguuucaguuuugucauauagaaaaauauugaaaauuaaaaaauauauauauuaugaauuguaaacaaacuuuuugaucaaaacucaugaaaguuggggaauacaccuuaacuugcacccugccacugcuuugaagucccaucccugggaugugguucacuccuguggaaauauauauuaucuauuacauuugaacugugaauuguguuugucacacugagcuaagcagcucagaacugucauguguagagugacugguacaauacaacaucaguggugguaaaagauuuguauggacaaugacauguggcaaagaagaaugucaacagcugccacugcuaugacaucgucccucaaggagucuuucugcaucucugccauguaacugucucagccaaagagaaggcacuaacaugaacuucuuccccagaaugcuacucccaacuagcgaccacguaagacucgcuugagucuuuuuugagggugcaaguccugggugccauuugucaccggaaagaacauuuaaguuuggaguuuuauguauagagggagggauuauucuuugauuuauuucgaaagaacauguucuuaauguccuuuugcagauaauacacacacccuaucaguuuuuggacuccagacugucuccauccauaugucauuaugaagcagguuuuuaucuuauuaugauuuagguaauuguacuagccucuaaaauuuuauaauguaccuuucagaagcucauagaugccaagaucagaggcuccuuuggaguuccaucuaauauaucuuccuuagccaacugguacagauaauuuuaucuuuccucuagauaguuacacauauagcucuagaaauaaaauguaguuauccuaaaucagcuguauagagccuuaaccagcaaucagaccauuuagaacauucaacaauaauacauucuaccaaacucugacuuucuguguucaguagauauuuauuaggaaacucacccugugucccacugaagauccucacaugcucucuagguagaugacuucagcuaauaguauaguaaccaugaggccuuaguauuuaugacuuuucuuuucuuucuuucuuuuuuuuuuuuuuuuuuuuuuuuaagagucaggguccugcuguguugcccaggcuggucuugaacucccggccagagugauccucccaccuuggccucccaaagugcugggauuauaggugugagccaccacaucuggaaguauuuaucacuuuccaaauucguauucuuacauguguuuggauuuauuuuucaagaagccagaguaaaauuuggcaauuaccaaauugugaguugagaaaaauagauaauucaccuuugguauugugcuuuugaauuugaauuccauugauuggauuucaguccgucgggauuaguucuuccaucugugucccuuggugugaugacugacucccagccaccaucugagacugcucggucucccucaucuccaaaaguccucaguuuccagaucucaucaauucugcuugcaagauaccaauaaaucugcugcugccuccuagacccccagucaccaccguggcugcccgugcugcucugaucccucuacccaccuucucccucacaugccuccuguccacugcugcuggagugacagucuccacaaaacauuguuccuuggcuuuggggccuguccuuagcauggugguauccuggccccuguuucugccugcagccucagccuucguacucaccauucacaucucauguuccagcccuacugagcugcuugcaguucccucaagaguucuuucacgguucucucugucuuuauaagaaccugaaauaccuuugccuugccuccccuucuucuugccuuacaucuguucuaccagcuaacucaccugcuuuguucaagauucagggacccuggauguuauaaccagggcagagcgagcugccucucuucugugcucaggaagccuuuggagcacuucuuuuuccucacagucaucacacugucuacagccagagaagggcaaaggcuaggggcaagggcuaggcuugccgucucuaucugcagugucuaacaggggcacccaggaagugcuuguuccagagucacaggauggaugagugaaugaaugaaugaacuagcaauaguaagaaauuguaugugagcauguaacuuacuauauuuaaauacuuccaugcaaauuucuugacuuaaauuaaccaugccaaugaccccugaggcuggauuuauuuauuuauuuauuuuuugagauggagucucgcucugucacccaggcugaagugcaguggugugaucucggcucacugcaaucccugccucccggguucaugccauucuucugccucagucucccgaguagcugggaccacaggcgcccaccaccaugcccggcuaauuuuuuuuuguauuuuuaguagagaugggguuucaccguguuagccaggauggucucaaucuccugaccucgugauccacccgccucggccucccaaagugcugagauuacagcugugagccacugugcccagccgaggcugggauuauuuuuaauccaguuuuauugauaaagaaacugagauuuagagagauuuguuuucacucugaaggcagagaugggacuggggaacaaacuccuuuggauccagauuuggcauuuucuuugucacuucuuuagcacuggauaaaguugguguagcuuugugucauagcaaguagcccacagagucuuuucauagaugguuccagcucucuauucauuauuaacuuagggaucauucauggaggcacuuaccuaguuaccaggcugagaccucugucugccaaugagaaaaaaugugcauuucuaaagaggauaugaagaaccuagcaaucuguauaucaggagcauugucuuuacauagacaaaaaagaauauuuugaauguuuccuguaaguaaguaccaguugcaauagcguggugcguaccgcccaugcuaucuauugcccaucagugguaccucuacucucugguuguggugaaaaggaccaugguccuccuggaaauuucuggcccugaagcucaggggagaagugcaacaccagccacaucucaucccccaaguuucauucuccuucacucucccugguacaacuuggcagaggauggggagaacugggaagaaguggaugcauugaguagaucaagcuuuuccucuucauguuuacuuuauaugauuuuaauuuuguaaccuuguuguaggacauaaaaaaugaaugacaguggacuuagcuuuuauuuauaacauugaaauccuuaaagauagaauguuagagucagaaaggaccuagacaucaucuggcauccagugccgcuuuguagcaaguggaaaacuaaagcucagagauguugagguuggucgucaucacacagcaagcagaccuugcucagacacagccacacaauacaaguaaaauuccuagccuguaacacggaaguuuuccuuugaugucuuuguacccgcuuucuuccaaagagcaaaaggucaccuagaccaugaaguaauagccagcagcagccggaaacacauccugaggaaauuucuagacgauugucccuuuguuaagcuaccauugaaucauacugucacagagccagagggugucguuugcuuguaaauacugaguuuuugaaaugucacuguaacacuggaaaaauguugucucugaagguugccaaagugacagaaucccgacauuguaaauaccagccaacacaagugcuuauaaaugacaggaauaaaauauacuugacuaaauccauaauaaucacugauaacacuguuuacccucagugaccaggagcugugaacuuggauaaaaagcacaugugugcagauaucauuaauaugucugagccucuagccauuccagaauauuuugauggaaaagcucccuaaauauguaaaagcuuugcaauaacuaagaagcuaguguguaagguagggugucagucgucccugaugaaacuagagagagccuugacuaucuucagcccccagaggacugauaaggccucccuuguucugguuagacccaaacucugagccaggcuacuagggcaggcaaugcuguauuuucaguagaugugauucucagaaggcccauuugccagaagcaugagcccacaccuauaucauguuccauggagaaaauguggaaugaacuuagagauuaaaaacuuuggagccauaagugggaggaucccaugaacuacccuuugacuuucaaaggguggauggguggucagaccuuuccacaguccuaauacucuauagcccaggcuuuuucuuaauaauaacuuccuccucucuagaaaugauucucucccucuuuuuucuguucuaguguaaaaauggugccuguguguauccgagucuuuaagaggaaauggacacauuggcaaaccagugccuccuuuggcucugugauguggcugcuguuacuacucaacuggagcaccccuuauauuccagucuccccagaaaugcucaggaacaguggagacucaaugacagaggguugagcccuccugguuuuucaacuggugaaagagaaauucagaugguuaaggagauagcagaguagccagcacuccgggagcugcucuuaucucugcuaugaggcugugcauggggaagaguagggcugcuuggaaugaccuccuuacuuuucauauauugaaacauauuucuuuuuccuugauaugcuccuguauuguuugaauuuuauuuuauuuuauuuuuugugguaagcauuguuuucuuaauuaacaaugaaagguuguagucaauaaacuaguacuugaugagauuugagaaaaacuacaaaacuguagauugcaaguuggcauuugaccaagaaauuaugauugugcuccuuggauuuuuaugcuuaggaaagagugcacaagagggaaaaagcuuucggucagaagauacccauucuaguacuagcuggaauggugguaaagaauacgaaauggucugaauguccauggcugugugauauuggcguauuuugcuguccaugggucuaaguggaugguauuauagcuuugaaagagucauggcaaaggagggaacaggugugucccaaacccuaaugaacucagcagauuggccuggcauucuggcaauguagucauucagcggagccguggggacucccuggguggggacccagcaugcuucuggagguaccugggaggcgcugggaguagggccugcuguacugguuugacuaaugugguguagguguugauguuggagaguugguggccagucucaggcucuguucuggcacuacuccagcuuguuggucaugaaugcagauugagauugaauggcuccuuacauuucccuugaagaaaggcagcuuugucuuccaggaaugagcugauggcaguggccguguggacauucugcagcuuuggcacccaguagcgauggccugauugccuugaaacugggagccucuagggcccugagaacuugagcagggcuggacaagccuuggagcagaacuuugcugugaauucuuucauugacucgcaaaagaugaaggacucuaaucccugauaucuaccuuuccacuugaccuuuuuagucuucaguggucuuuuagaaguaauuuuaccuggccgcgguggcucaugccuauaauccuagaacuuugggaggccuaggcgggcagaucaccugaggccaggaguucgagaccggccuggccagcauagugaaaccccaucucuacuaaaaauacaaaauuagcagggugugguggcucacgccuauaauccuaguuacucgggaugcugaggcaggagaaucacuugaaccugggaggcagaggcugaagugagccaagaucgugcauugcacuccagccugggugacaagagagaaaccaucuaacaaaaaaaguuauuuuaugaaaaacauuuggagguuuucuuuuggguauggcaggcagauuggccucuuauuuggcauaggugaagaagaagaguugaauaaaaguaguuggggcauagaauggccaugcaaguucccaacuaaaucagggucaaguuuaaauguauuuguauuuuguucaaauucaucuuuaucuaaaacaggcugaugcuguuuugucucugugcugcagguggauagccacaaauuugacucuauaguuaccaguuaucccccugccaccccuuguuuuucuuccugauuucucuacuuccaaucagcugcucuuuuagaaaccaauagagaagugagacggggugggggcagaggaagagagaaaggggguaagggggagggagaaagaggaaagagagguuguuuuuugucauuagugaguaaaaaucugucgggcucggguaguuucuuagugaauucagcauuuagugauuagauuagagggguauauuugagcugaagauuuugggaacucaccuuucugcucuacagaaucccuagguuucuccuuuagcucuacuuucugauucauuccauccccauccacugaccccaccgccaauauugagguacuugugaaagcucagaaucuccaguguccucaaggagcuagccccaaagugcccccugguggcuagaggagaaaaagacaagauggaggaugggaaaaaggucagguggauggauaacuuuggcucuucuuuuggcucuucuuuucugauaguauuuuuguuaacagcaucuaauggguugucuucuuucaguaucaaugugaaccagcucugaauagguuaguguaucaauguauuucccuuuuugggugauuuugcugcagggauuucuuucccuaugccaguuuuuguuggucugauuuuuguuucuaggcauauugcauugaccugagccuucucacaguacugaugacacuggggguagggagaacaggagcaguugaagacgacacaugcugucaccucaugugcuggugugaguggcgcagggaagggcugugauuuuuuauaggcacacugauuagccaagcacuugucaccuccacugccgcucauuggccuacugagugugagcgugccaucuaauugacagcugucuguugucagagggccaucuuuucuccuuuucaguuugagugaacacaacagagacaucugcagagcucucugcagcucugacaagguugcccugccugccaacccucagacuucuaggcagcauaauugaagagaucagaaaagaauauuaacccguugaccaucuugggcugagguguaaugaccaaaaagucacuuuuuaaggugacugugagucuuucuuaguagaggaagacaugagauucucugucagaagagucaggccaguaggaagugcuauuucuugguagugauuguucgugggguuucaguucaucugagcacuuggaagaggaugagaaguucauuuucaagguagacccaguguuucauggugggguuacacugaagccugaaugcugggucacaucauucaugucugauuuggcuuguguaaugacaguagugcuuuggauguguguaguuuggaugaggguuacucuuuuucuuuuaccgccaggccugacacugcccuuuuagcguaagauuccagaaucucuuaugcaguagcauggaauguauggccaaccccguaguaacguggacugccucuuugggacauuuccuguaagccagagauaucaagguggacuuugugauggguagauuguuuauuauacagauaucagcuugggaauuugaauguuuaauuauuugccuugucguagugucuucaaaugaagcucuauuugagcaucuacugggauugguacaauaugcagacaagcuggcuuugugugggucgagucaccugugcuugcaggaugggggugcuugcuauauuuggaagugauuuagugguauccuagguuuaucaggaggaaaauacaucuuugcauuuauuugaacauuugauuuagaaagggacaguguguggguauuggauaaauugcuuuuacucuuucuuugcuuugcauuguucuccccucugaugauuugcaacuuagcaagccuucaucauugaaccugggugaaaaagaagaucugagaagccuugaguaauuuguuucagacuguuuauacucuaguguuuuacagaugugggcuuauuugaggaauaguauuggcgaaagguagcgucauuaaacugguuggagaaauuucaggcaaguagauagagaaauuucaggcaacuccuuuuccaaguuguugcucacagauuauaauagaugaauucagcagaauguucugaccuccuagacuaggucagauaacugaguucuuguccuaacucaaauccuaaguagcuguuucuuaaagcucuguucugccucugcagaaugaaggcuuggccuauauaguguaugagauuccuucuagcuucaggguuuuguaacuaucagaauagguaaugaggaaggagacuaugcccugguagccuuuagccauaucacaaauauuuaacauacucccaaaauagcacauacaagacagaaauucuuuguacuugaagggaauaauaaauacagaaagcauuugagaaguacacauuuaauuucuguuaacucuuuuuuucuuauuuauguuuauuauuagaugauaaaugacuuccuuuuuuuuaguauuaaaacaaggugaucaggauagugagaggauugggucaggugaaacacaugacucaccugcgugcuuaugauuccccuuggaagaugguuuuggguaacauucugggaaaacuauggauaaagucauaggcuuccauauuuaauuaauucuaagacuuuuuuuucacauuucaacaucucagaaauuuaugguaugccaauucaauuggcaacuuuuuuccucucuugguaggaaauagauaaugauguuuuugacauucaguggcaucuuauaggugaugaaauacaauucugaggggaggaagcaagauuuuuuuuuuuuuaacugagaaaggcuacgugacuaagugacuucuuuguuucaaugcugacuaaagcugugauguccuuuuuaaucacuuugaaagauucaaauugcuuuaggaagacaauucaugcauggagcucacccucccagaacuccacacuuaaugcccacugaggaaggagagaaaugcaugcaaauauauaucccaauauagaaggaauauucuaguucaguaacuuccacuccugagcuuuuaucaaauuuuucucuauagaauuauuuuuguuuuauuguauccaaaaugucagauaucuuuuucaaggaaggucaagggacuuugccauuuucuaagccagaaguauucucaccuaguccaguacuagucaaaguuuuuaguaaaucacuuagaauuuccuuuuuuaaaaaaaaaaaaaaacccuucuagaguuuguugauaccuuaaagaucaucaaauccagcuccuuauuucacaaaugaguaaaaagaagacauaaguugcuuguucagaguucagcuaggaacuagauagaaccuggguagccugacgcucccauucuugcugcuaaauuccaugcaauguaaugaaagcgggauugaguauaaaaccgauacucuacacaucuuuuguugauauuucugagggagaaacuugaauuucuguaagugcacauagcugguuucccuuugcuuuguauuucugaaugcuacacuugucuucugccuacuacacuuaaauucauaggugauuucacaaggcacagaagcccaacuugucacaugugguuuaauauaugccacacuuuaugcugcaguagcaccauuuggucauauuuagugaacucugugguuguugagaaugccaaagcagcaggcucagcuauugcagcauaggccuguacuuaguuagcaagcuuagcuuaaaagcugucagugcagcuaauguuacaguggcuuacugagaccuuggccugguugugauaguucuccaaaccuggguguuuucaccuuugaaauaugaaucuggauuuagcuuuuucuuagaaaacagcaacaacaacaaaauggugaaaucuuuaagcucguuaaugugaaugcaguaagaauguaaauuuaauacauauucacuuauuauuaaaugcuguuguaaauaacauuuuuagauuuaauaaugauuucccaagacauuucgugcuauucuuuacuuugaaacugauggggugagaagagaguugaaucuuaauuauuauuuuuuaguuaauuaacaugugauuuaaaaaaaucgagauauauuuuguguuagacccuaauuagaaaagaugucaagaauaacauaaugcuaacuuaauuuuaaaauugauaaaugagggcaagaugauuggaaaguauccucuagaucacacaggaaacggguuaauauucaaaugaauagcucugaaacgcuacuuuccuaccagcuccugaagcaauuuaguuuuuaagaccuaaaacugacucacaaucugugguaugaaggauagauguuaauaguuuaaauauuuaggcauugcgugggcuguuuguuaaaccauugguagcuugagauugaccacagugggaguguuuucaccaugcgaaugagcaucccugcucacaguggggcaugagcauagcacugcaggauacggaacugacauuuauuacauaccugacauuuccguuacucuuuuauuuaucguuuugggcugcuuguuuguguccuauccccacuccccaaauucauauguugaaaccuuaauccccagugggaugguguuaggaggugaagccuuugggagaugauugggugaugaggguggaccuccgaugaaggaauuaauguccuuauaagaagaggaagacacacuggggccugucagcggugggggacgaggggaggguuagcauuaggagaaauaccggauguagaugacggguugaugggugcagcaaaacaccauggcacguguauacccauguaacaaaccugcacauucugcacauguaucccagaacuuuaaaguauaauuuaaaaaaaaaaagaaaaguaaaggaagagagcuagccagccuucucucuucuccaugugaggauaccacgagaagauggucaucuguaaaucagaaagaggacccucgugguggcucacaccuguaauccaagcacuuugggagguugagguaggaggaucaguugagcccaggaguuucgagaccagccugagcaacacgaugaaacccugucucuacugaaaaaaagaaaacaaaauuagccagauguggugacacauaccucuguaguccuagugacccaggagguuaaggugagaggaucagcugagcccggaaagucgaggcugcagugagccaugaucaugccacugcacuccagccugggcaauagacugagacccucucucuccccaaccccuccagaaagaggaucuugucuggaauccagccauucugguccugaucuuagaauucuagccuccggaacuguuagaaguaaaugcuuguuguuuaggcuacccagucuuucguauuuuguuauagcagcuaaauugacuuagacaucauuaauuauguauuuuaaguccuguguuuuagcauucuggaaugagagcauugaaaaugaucaucaagccgaguaaauuaacugaauuaacuauuccaccaaaaaaaaccccaaaaacugaaauguucguuguuccuggggaauggcuaugcacuuggaggcugguccccuuccucccuccucuucuuccuggugaauccccugacuuuucucaaucaggcuuucugauguggaggcuuccucugcuucccagggacacacucccuucccagggcuccuggagcugcugcaucucugcuacccugagauguaauucuugccugagauuucagcuccuccccuacacuucagaggcuucaguggacuauuucuuauucaucugugcaggcacauuguccaauguacaaccugcucaaugggcuuguugaguuaauaaacuacucuguguucuguauuauguggauuuagauguuuugcuucuuuuucagccuuccuuucgcacccuccaccuacccgaccccugcuaagaugcuaccuuuuaaagaaaagaaauaaguucuucacacuuuucuacauuuauaauucaauauaaauaacugcuacugguauacuuaaucacaauuagauuaaauauguucuuugaaacagggaggucaucuaaugaauagaagugaaauaugucagaaaaugucacauaacugagagugugacaucuuuaguaaauagaauguugagaugauuuuagugcuaggcuaguuuuguaagagacaucuuauuugacaccuuuguucaaacaacuuuugugguucucaaacuagccucuauugaaaagaccaaguucccuacgucuucucuuugaacacuuucuucuuugcauuaaccuguucuugcuagugcguccaaguguggaaagcaaagauuaguuuuaaaucuuccgggucaaaacuguuuuggcuuuuuucuagagcugauaauaaguaguauaguuuucuguguaccauguguaagagaagagaaaaggucugacuuuauguuagauaauccauaauucgguugcucugucccacuauauggagaccaaagucacacuaaauggaugccuuggguaggggagaaggauguagccuuucaaucagacuucuuagcugcacuagucacauggcuagccuggggcagguauuuaaacuugcuauaccuaagucuccucaucuauuaauugacauuaauaucagcaccuucuucauaggguuuguaaggauugaauaauuuaauguauguaagacacuuagaagagugucuuaaauaaugugagcaccuucuucauuaacauuagcacauauuucauaugauuuugugaggauuaaauaauuuaauguauguaagacacuuauaagaguguguuaaauuacagacugugcucaguaaauguugucuaauauuauuuuuaaacugaugguuauuagccaagcuauaccauaucuucaacuuugggugcacaagagugggcaguaucuuugaagaggucguuguuucucaaucugugggucaaguauucuuagggaaacuuuucauuuugguccaacucauaacuuuagugacauuagucuuugcaauuuccugcugagaagagaagguagccuuucuauuuuuuuuaaguuuucaaagccuaauuuuauauuaaaagaaaacaagguauuaaaaccacguauuucuuuuaacuuauuaaaaggaaauaacacaguaacauuaauaaaaaguuacaaaauggcacaguaacauuaauaaaauguuacauugucuuuuuauucuauagcgugaauggaagaaauaaaguaacuuuucuagagcuacaaaguaguuaaugguggcaaagauucacucucuggcaaugugucuuguuucacaaaguaauacaaguucaacacaguauagaauugccuuugauuucaaaugguaacagcauuuauuggauuauuuuuguagauguucaaugccacaaguaaaaugaaguuuucucuuuaaaaggaugauagauguggcagacccaucacugggucccuggacagugguaacaugaugggguuuaaaguccuuuuugaaauagccagguuaaucugcauaaaggcuauggugcuucauuaagcuuuuugaaaacuuucugggguaggccaaguggcuauuuguaucaguuaaacguaaguacaacuacuuaaaauaacauuucuucccacuugugcuugagucugggucuauauuuuuccugauaauaacaggauaaaaugaaucauuugauuccauauuccaagaaaaacguguccauuagguagaggaagcucuuagaaauuaucuccaagaguggcuuguuuuguaccugucauauuuauuauaagguaaagggagauguagacuggugggggugaugguaguaaauugaaaugaguugccagcuguguugcccaggcuggucuugaacuccugggcucaagccaucccaccagagaagguucuuaaaccuuuugcuuuccauugggcaucuuuaucuacauuuuaccucaucaagcucaucaagugaaucagacgcuuugacucagucauaacauguugauggagagucacuuaguuggaaaauauagacaagaagaugggcucugggaagaacugguagguaggcaauggcucugaaaguguggggcccugguuuacaguguaaugacacccaccauuuagugccucagccauuauucaagugugcugugccuuuccuacuggccacguuaaugagaggguggagauagcaaguuccugcugaaauuuucacaggaaagcuaagcccuuaaaugauguuuugaaggaaugguuucucuaccaucuguaaaaaaggcuugauuaauuauuuugguggcagaaacuauaugcugugcuucagguuaaacagcaggaacauauugagguucuugggaagaguuuuccuacagccaucaaauagguguccacacagguuaaccggacugugcaauaagaaugugggacauuggcaugccagugugaagucuggaaaagucggaugugauauaugcaaguggaagagaacugaaacuaugaagagucauuuggaaagccccaguugugaguuugugauaguugagaaauggcaccuccucuuugcauacuuagguuugagcaggaaacaaagaagugacuugaagucauguuaugaaaagaagaauuggguuggaggucagacucuggauucuagaccugauucugaguuaacuaacauuuuagccuaguuucaggcacuccccaguggcccaaugagccaccccuucuugcaggccucaaaaugcacugugauaaaacugcauaguauuuucuuuuccuuauuuucauguucuaagaaauauuauuguccgggcacgguggcuuacaccuguaaucccagcacuuuaggaggccgaggcaggcagaucucuucagcccaagaguucaagaccagccugggcaacauggugagacccugucucuaauaaaaauagaaaaagacaaaacccugguguggugaugcaugccuguggucugagcuacucaggaggcugaagugggaggaucccuugagcccuggggguggagguugcagugagcugagaucccgccgcugcauucaagacugagugacagagugaaacccugucuaaaaaaaaaaaaaaaaaaaaaaggagaagaaaauauaauaaaaauaauacauggauacuuucuuaaaauaucagacacuugagaauguugaguaaaauauaaaaggacuuaaucuggagaucauugccuuaguuauaacauagaaccuuucuacuuaggagaauuucccucucuccuacucccuauuuguaaaaauuuucuuuuguggcuucagucaaguuucauacuuuuaaauguuuuuguuaauuuuauucuuuguguuuuuuuccuaaacuguauuuuuguuccauuaugauuuuuucauugguuagcugagguauaggaaaguugucuuuuuuauugucuguuaaucuuauaacccguaacuccagaacuuucuuacuagccucugguaguuuuuuuuaguuguuuaagauuuuuuaggaagaaaaucauuggcaaauauugggaguguugucucuuaaagugucuuucuguuauauuuuccuugugcuaguacauuggcaaagacuuacaggagaguguuaagagaauaguggaauacaggucagcuucgcauuuuguugacuugagcaaagaaucuucuaguguuucauuauuaaauaaguuuucuguaggcaucuaguagauuaagaaaacuuucuuaugauccaccacuucuuaaaaugaauguguguguucaaacuaaagagauauauguauauaguagaaauauauguguaugcuugugugcauguguguguauaaacuuuaaaucauccucucaaaauuccugaaguaaaagucuauuuuguuguuuuauguggaauuuuauuuuauuuaaauuuuuauauuuauauauuuuauuuaaaauuuucaugaaauggccaagcaggguuuaauauaaaauggaaacaggguuuaucucagaaauuugguggcuaaauuccuuguaucccgucuuaucuagggauguuguuuguuucaagguucuaccuugagaggagccugucauuuucuuuuuugugugcugcuuugccuaguugacaucuuggcuuuaugugcuccuguugaaugcauugggaaauuuucuuucuucuuucuauguccugaaauagcuuauauaagaggggaauuuuugauauuugggggaaauugcaugggacuuuuuuuuuuuuuuuuuuuuuuuuagacagggccucacucuauccucaaaacuggaauggagugcaguggugugaucauggcucacugcagucucuaccaccugaguagcugagacuauaggcacaugccaccaaucccacuaauuuuuguauuuuuuuguggaggcggaguuucgccauguugcucaugcuggucuugaacuccuggacuuagccaucugccugccuuagccucccaaacugcugggauuacaaaugugagccaccgcgccuggcaagacuaguacuucagaacuggauuuuuuacuaauuuuuccauuucuguuucuuuguguuucaauugugauaguuuuuguuauccuagaaaacauccauuuuccagacuuuaaaauuugcuacauaaaauuauacauacuuucucuuguuuuaaaaaacuccuuaucuauuuagcaaauauauuuuguaauuauguugauuucuguuuucucucuucuuguuuuuccuuacacuugccagagguuuguguguuuucuuugguuuuuuuuuucaaguaccuucuuuugguuucauugauaaucuacauuuuguuuuaucuaaauuuaguaaauuuuaaauuuuauuaauucaucauauuuaaauauguugcacuuuuucuagcuuuuuauauuguauguuuuguucauuuaauuuuuauuuuuacaucuugcaauuuaaggccauuauuuuucauugguuacagcuuuggcugcaucccuuagauuuucuuauauacagcuaucacuaucauuuauuuguguauuguuuuaaauguuauuuugcauucuuguguaguucaagaguuacuuaaaacacuguuuucacagucccacuuuaauaaaauguuuuucauguuggcagugcuacuguuuuguuuuuacuauuuaauuuuauugcauucugaguggggaaauggcauggauauuuccuacuuuggggguaaucuaguaggauuuuuaaaaaugcuuaguuuuuuuuaagcauuucauaugcauuugaaaauaaugaauacuauuucccuauuuuauuauuauuauuauuauuuuugagauggagucucacucugucacucagguuggaguguaguggcacgaucucagcucagugcaaccuccggcucccgguuucaagcaaucuucccaccucagccucccaaguagcugggaucacaagcaugugccaccaaccuggcuacauuuuguuuuuuuuaguagagauggaguuucaucauuuuggccagccuggucuugaauuccugaccucaacugaucuucccaccucagccucccaaacugcugggauuacaggcgugagccacugcacccggccuauuuucccuauuuuaauauauuaaaccuuuuauuacuuauuguccuucuaauugauuuaaauuucugagagauauuuguucuagucuucuacuuugauuauggauuuaccaaccgcucaggguauuuauauuuuaaaaaauauaucucaaagcuguaucauaaaugauuagaaguucaggaauauuuuauauuuuugguggacuauagguuucaucaguaugaaauauccaacuuuuuucuuuuuuuacauuuuugccuuagauuggcuuucaauguauaguaauguucucuacaugcuuuauuuuuguagauuuuauauuacauauuuuuuauauauuuuuauuuuucauagucucuguguuuuauuuuugaugguuuguuauacacagcauuuagcuuuacauuuuucuagccuaaugugacagccacuguaacuuaguugaggaauauaauauccaaauaaacauaguuuaauuuucuuuuuuuccuuggcuugaucacauuuccuuuguuuuauauuuuuugcugcuuaaaaaaaggucuuuuuuuuucuaauggugcaggaauuauacaucuuauuucuugugaaaguuauucuugccuuucuaacucacauauuucaaauuauauaucucuauuaaagucuaaaucuguuuggugucuguaucuuuccuaaaaaagaugacggagaguguuagcacauuuuuaauuacugaguuucucccuuuguuccuccccuuuaccucucauguugagguugauauguuuccuuuuugacguuuuaaauugcaucaacagucacauagagucuacuagcguuuccuugccccaucuugcuaauuuuuguggaccauguuguucuggguuuuuuuggguugauuugucauuauacaguuauauauccuuauguaauuuuuuucagaaguguggggguauaaauuuucagagucuuugcauuuucuaaauugccuguaguuagcucaccuuuuugaaggcaaguuuggcuacauauaaaauuugaguuuuaaagucuuguauccccuuuuucugucacauuuuuguucuggcuugccuugcagcucuaaauguagcaccccaauuaaucacccgauuauugcaucacacuccacuccagcuccauguauguauugacccugggauuggagcauccuagauuuagcuguuucuuugcagucuucuugauuggcugcugcuuuuuggcuugugauuuauuuauuuuuccucuguagagcaaauccaucuacuuuuaucuuuaagaauaauucaaaauuguuauuccaccgaagcuacucuuccuuauuuucuggcacuauuuggcauguauaucucuucuaaauucacacacacacauacacacacacccaguaucauuuaugacauaugagguuagaggaaaaguagaagcuuauguuuaaucuaccaucccaagccaaccccuuuauauggaacuuuacacauucuaaaugcuuucaaauacaguaccuuauaaggaaggagaugcuauuauucuccuuuuauaaauuagaaaacugagagguuauaagucauuuuauuuauuuauucuuucauuuauuucuccauuaauccauuggcuaaauuugcaucaucugcuauguauaagcagcccucagugccagagacacaaaaccccagcuuccaggaccucacagcugagaguggaagcaaguggguaacaauagagacuugugacaauaauuucagcauaggguggauuucaguuccaugcauguuugagacacgugcuaggugcagaggaaccuggggagaggcgucucuaugucagacuucccaguggaaguguugaggaguguuucccagcggaaguguugucauugauuaaaauccaugcuguaaauguaggcaugaguugacugcugugcucuugguaucuaguaaaguuccuggucccugguuggcacuuaaaaaaaaauaagugaaugaacaaacaaagcuuccuuggcucucaccgaagcacuccuuuuguacuaacauaugugauagucuccacaggcaugauuucuuuauuucuccaagcaucucuuugaguagguacagugaaugucuccuguccacaaaugaaggggccaaggcuguggggaguuaagugucuugucuaaggaggcuuggaucccagguuccucugacucccgacaggcaagacuccuacuggcccuauggcccccucauccagauuauuuuagccucuuuuuucaaacucuuuccugcccucugaucauguuucuaccaagaccaaguaucacaaacuaaugaagagguauaacuggcugccuccuggaggagguauuaagaagcauacaguggccaaaguggaggaggaauaaaaauaccuccagagaccucaauaauaccaaaauagcuagucacaccauauaugucuaagcuuugauacagccuuucuacaugacauguucauuuggaauuauauuagacauucagguuugaaucagggcaggucacuugaaaugucucaauucaaugcaaaaguuauaagaaaaauaacauuuccccccacacaaguauauagcauaguauaaaacauucucaaaaacuuuguaaaggaaacacauuuuacaguuuaacucauaccuacuucacuuccuucucccucuccuguucucuguucauuauuucccuacuuacuaacuggcucuuaguuaauauuuucguggccucacccccacaccuuuuuaguuggucucuuuuuugugcaaauugauuuuauuccuaucuaaggagaugcuuucauccuuuuuuucaugcuuugaggccucauuagaucacugcacucuaauuuugggggggagaguugucauuugcacuauauguacagucugagcauccuaaaguucuuguucugagaaaaacaucgccauggugagcggcccauuuugaauuaggaggacuggcuaaggugcucacuuaagcucuuuguaguuuuguucagucaauugaguguuucuauguuacaucuaucugucuauaugucugucuaucuaucuaucuaucuaucuaucuaucuaucuaucuaucuaucuaucaucugucuaucuaucuacauaccuaccuaccuaccuauguacugagcccaggcuggagcaguggugcaaucagagcuuaccguccccuugaccucccagacucaagugauccucucaccucagccuccuaaguagcugggaccacaggugugcaccaccauaccuggcuaauuuuuuuucuauuuuauuuucuguagagacugagucuugcugugcugcuuaggcugcuuucaaacuccugggcucaagcgauccuccugccucagccccgcaaagugccgggauuacaggcaugagccauugcgcccggccuucucuuuuuaacguaauauugagauuggggucagacugugcugguuguggguaaagcuauugcagccuuccagcuaugaaggccugcccuccacgaugggauggccaggcugguaccugagacuaguguuggaggcaguggcagcuucccuuugaucuauugcagaaugcauuuucaaacacacacacacacacacacacaaauaaaacucugauguucacuuuuuaauugaaagcuaaaaaugcccagcuccuuucugcagauugacaagcugauauuucagcaguagcuaaagaacccgguuuaguaagcuacugaauuuugacguuuauaaacauuuaaugaauacauuuuuauuuaugucagcuuaaaaaauacagcugcugauaucugcgccccccaacaacuuuuuuugucuuaaugccaaaauuagaauauuuaaauauuuuaaaauuuccugaugagcaccugugcaggugugagggcagcaugaauucacagggagaguguaugaaguugguuaucuugaugugcuuguggggaauguguauuuccuugcaaggacugucaugugcuaccugauccucuuucauggaccucagccacuuucgccucuaacuugaaaaggaaacuggcauuguggcacaggggccaaagggacacauuuguagccuuguccucaaaucaagugggacuucugguucuuucucugaccaucugcuugaccuucagucuggugucuccaaggagugugucucuauggcaguuuaaaaaauucuguuacacugagaaagagacaaaauguaaaucuuaaaggaaucaguagauuuuuaaccccacugcugguguugagaagacaguuugagucuuaaucucuuuccuuaaguuucaaaacauguaggauuuauguuauugacaugucaaacuuuuuguacuuauucauuagggaagguuucaauacacacaaaaauagaguauuauaagaugcgcuacuauguauucauuauccaguuucaacagacgucaccauuuucccagucuuuuguuauauaguauccccuucacuuuauguuccugaaauauuuuaaggcaaagccuugacagcauauuauuucaccuauaaauauuucagaagcaucucuaacaaauaagcccccuccuuuguuuuacauagccauggugccauaucacagcuagcaagacuauuaggaauucuuaauagcauuaagaacugacguuccucaguugucucacaaaugccuuuuuacagcuggcauguuugaaucagaauccaaaccagguucacacguugcauuugauuaucaugacuuugaagucuucuuaaaaucuacaacauggccagucucccucuuuuuaaauauuuaaacuggguccauuuuccuguagaaagcccacauuauggauuuggcuuauugcuucuuuguggugucauacaccauguucaucuguucuccauacuuccuguaagcugauacuugcauuuagggcaagcuugucuaacccauggcccacaggacacaugcggcccaacacaaauuugaaaacuuucuuaaaacacuguguuuuuuguuuuuuuguuuuuuuuaagaagaccaaguuuguuugcaguguaugaaugucuaggugaggcuggguuaauggggagaaugagacuaacauaacaucuauaacucucaugacuuuuuguuauuguuguuguuuguuuuguuuuuggagacagagccucccucugucacccaggcuggagugcaguggcgcaaucucagcucacugcaaccuccgccuccuggguucaagugauucuccugucucagccucccaaguagcugggauuacaggcacgugccaccaugcuaauuuuuguauuuuuaguagagucgggguuucuccauguuggccaggcuggucucgaauuccugaccucaggugacccacccgccuuggccucccacagugcugggauuacaggcaugagccaccgcgcccggcugaaaacacuaugagguuuuuucauggguaaucuuggauauguuauuugcuucauucaagaaguaguauguggccauucauuucucaagaugcuuagauuguucagugaguucaugugcugcccaccagaucucccuaauacagaguuuuacauugucuuucaccuguuuguuuuaggaucuauugaugauuauuucauuggagguugcaaaauagccauaaguaaauugguuuaaugaagcuucuucucccuacuaaaucuuaucuagaguuuaacuaucuauuaaucauucauuuuugcacauuuuuacagcuuuugugggguauuuuacauucuuucuucuguuugaauauagagggugccuugcaaacuucacucauuucacuagaagaggcaacuguuuaaauccuacucuucuaauauauuuccugguucauguuuuccugcacauucauaaaugaggaggacguugauuugucaguuaucuucagugcuuagaauaguugcugaaaugugacaagaauguuuauggaagaaauuaccuuauagguuguacauguccucuaaagacaucauaggcacuccuacauugcauuggugaaggggccaccaaacagcagaauccugcaacuugguugaacuaugaaaauguucuugauacauuauaauuuccucaaccccuuuagccaguauuggccauucaggcaaaggaauagaauuuccaagacuuguacuguauguuugcagaaggagggaggauggcagauagguuuguguguguugggauggagaaaguaugcaaauaagcuaauuaauaucaauuguuuuuauaucuauauuacacauacacacacucgcauacacauaagcacacauaauuaaucacacccaugagcacauguacacagcuggucuacaccagauugcccugacaauuuuagagcugugugcugaaaaauuuuagaggaauuuggcuuugaaugugcaacacguauuacagagcaaagaucaccuuggguccuaagggagaugacuuucaucucuaccaugugaguaaaaccugggugauugaaccauaaauuauuuuggguauauagaacuuucuucaaauaacacuuaaaauuaaauguccagguaagugauuuucaaaucagaacaaccaaaauuguuaauaguuaugaucaugcuuauauacguauggaaauguauauguauauggaaauauggaaauuuguguauaagcaugcucugcaguaaaucaaaaaaugaccauggagcaaacauaugaaaaugcucaccagcaaugaaaaaaaugacccuauggcaaacaauaaaguaaaaugcuacacugucuuccuguagaggaccuacuagguuuggacaaacuggcugugcucaaauacaugugccaaaauugagcaggcugggugcaaauauucuaagggaauugaaagacacuuuuucgugaaauagguuuagguguugacauuaucucuaaaaguaauuaaaagaugauugauguaguaaauuuucuuuuaagccaugccuuuaagcacauuguaggaaaaggacuguuaaacaccacauuuucuuauuuagaacccuuggggccauagguauuucacaauuuaagaaucauuugcauuuuaugaaguuaauaugguguauauaacauguccuguguaacucuccagugaagucugaaacagccgcaauguauauauagauuauuauuucuauagcaaaacauaugaauagauacaccuaguaagacaaaaacaaaaauuauagauacguagauauucucacauuaguucagguuuugucacaaaguacagcuuucaaaccuucuggaauuuuucaauugagggaaagauugugaaccuucaaaugaacaaauaaauaaauaucuaccuuuucugaagaaaaacaaaagccaaauaacaaauaaaucaagaaucacuuuucaugguuuuuaaaccccucaaauaaaugucuuccuucuuucaguucauagaagauuuagaauuauaaaauaaagaaggccuauccacauggucuauauaugucuuauauaucuauaucuauaucuauaucuauaucuauaucuauaucuauaucuauaucuauaucuauaaacaauuuuagaauuagcucgucccacacaaaaauaguuuuuuuguuguuguuguuuuuuguuuugcuuuuuuugggauggaguuuugcucuuguuguccaggcuggagugcaauggcacuaucucagcucagugcaaccucugccuuccgaguucaagcgauucuccugccucacccuccucaguagcuggaauaacaggcgugcaucauuaauuuuuuuauauuuuuaguagagaugggguuucacuauguuggccaggcuggucuugaacuccugaccucaggugguccacucaccuuggccucccaaagugcugggaucauaggcaugagccacugugcccagccaaaacuuuagauuuuuauccuguuugugccucaaagccuauucaguugaaaggcugaugggcucgcucugagguccauuguuggcugggggagagcauuagggagcugacuuuuggcagaugaggaaaacagcaugaucacugcuuuugccacucugcuuuguggaauugacccacucugaaguuguucucacucgacagcaaugcaggcauuuauccagugcuucuacaagaaauaauuugggcaaaagcaguaaggaaguaagccuuaacagaaaagugggacccagcaauaggagaaucuacacaucugcuaagcccagccaucauauauauauguguguguguguguauauauauauauauauacacacacauauauauacacacacacacacacauauauauacacacacacacacacacauauauauauauauauauauauauauauauauauauuuuggagauggagucucacacuguugccuaggcugaagugcaguggcaugaucucggcucacugcaaccuccaccucccgaguucaagcaauucuccucccucagccucuugaguagguggcacuacaggugcaugccaccacaccguuaauuuuuuguauuuuuaguagagacagaguuucaccguauuaggauggucucgaucuccugaccuugugaucugccugccucaguucccaaagugcugggauuagaggcaugagccaccaugcccagcccuuauauauuuuuaaugugcauuaguaaauuauaaauaaugacagucuccauguggaaaaugaaaaucaacuuagcuuauacauuuuuaaaaaucagucaaguggucuugucucauauacauagaccuugaaagauuuguuuucaguacauucuguagaaggcucuugaauaucugauagacuccccuggcagcuuucaccuggugugugcaugcacagauauaaucaccuuagucuuuauccugcaguaaacaaaguucaagagagauuucugaaaugaagauaaucuucauucugccuuuugccgcuaccuaaaguucccuuggaggacucugugaaguuacucagguuauauuuuuuauaacaaauauaaaccacagaauuugccagaaugagaaauauucugaugaacaucaugauuugacugaggauggaggaauuguagggaaugguuaaacuugaagauacuuuuuagaaaaacaggucaugugcuacagaagcuacuuuuaaaaacaugcuuuuucauuaaauguaaauuuaccacauuauuuuauauaucuucauuaauuuaauaaaacuccugcuaggcuuuuguaaauuuucacagauauaauguuaccauaggcaucuaugcacauguauuuuuguacacuuguccaauauuauccauagaguuaaaauuuuuaacuugaaacuucuaagucagaaggcauaugcuuuuaauauucugcaguacauuuuaacuugccuuccagaaaguuuauaccagauuacauucccauuagcuauauaugaaagugaacuuccucacuggcaguugaaaauuugucuuauuuuaauuugccagauagcuugucauauauuuauugccaaauuucaaauucauuccuuuuauaaaggaaugguucauguucuuccccagucuauuuaguuuuauucuuauuacaauguaagagcuuuucauuuauuaggaguaucuucucauuaaauauuuguuaagaaagauuuuuguucaacuuuguaugguuuggauaauguuuucauuuauuuuuauuuauuuauuuauuuauuuagagacagagugucgcucuguuucccaggcuggagugcaguggcaagaucuugguucacugcaaacuucgccucccagguucaggcgauucuucugccucagccucucuaauagcugggauuacaggugugcacuaccacgccugguuaauuuuuguauuuuuaguagagacaugggguuucgccguguuggccaggauggucuucaacuccuaaccucaaaugauccaccugccucggccucccaaagugcugagauuacaggcaugagcuacuacgcccagcuggguaauguuuugaaaaacgaguauguagucugggucccaauauguucuaauuuuucuagcucuaaugucauagcuaacaaaggccaucucuacuuaauugcuuguacuuuauucucaggcuuuuauguuuuaaccuuugcauuuaaacauauuuuaguaugaagugugaagcaaaaacguaaauuuuuccccuuaaaugcuaaacaaacuuuaguuaccauuuauugaauaauuuaucauuuucucauugauuuuuuuuucaaugacagccucgccauaaaucuuucuguaauauuuccugaucuggcagcagccgcacauugcuuuaauuuacuuuguuuaaaauguauauauucucaacuuacaucuuuguaaaaauuuucuuaacuauuaucaugcauuaauauuccagauaagcuuuagaauuugugucuucucuacccuauccauuuuucucucuuuggaauuuguuugaauuugcauuaaagucuccuuuaauuuugagucauccaaucacauuuaugcaaauacuuuccugggaaauauuugugugaaaagauuuucuuuuaaaaauugauauacaagauuauuucggucuuuuagaaguguuuauacugcugaauccuuucaugauuuuuguuaaacuggcuugugaacuaguucagcaagucagugucguaugcugaauaucuaaauauauuuauaaugagaaauauaagaaaacauaauaagaauauuucugucuuacauccguggagagaaaauagaauauuuauaaaugcaaaugcucuacaauuacucuaaggaaacuuaaagaucacaguccuauucuaacucuguaaaguuauuugcuuguuuguuauuuuaacagcaucuuucucauaagcauuuaaggcugguuauaauguuuugugugugaauauugaguaaaccaaaugauuggaggcccguuauuuuuacaaagauuuuauggaauaagcaaguucggaauggauuucgaaaaagagacagucccuguuucaguguggaagggacauuggaguccaaaggucagggucagauacauguuuucuucuuuuuuuuuuuccuuccuuccuuccuuccuuccuuccuuccuuccuuccuucuuuccuuccuuccuuccuuccuuccuuccuuccuuccuuccuuccuuccuuccucuuuuuuuuuuguuuuuguuuuuggagacaaagucucauucuguugcccaggcuggagugcaguggugcgaucauaacucaccgcagccuccaacuccugaacucuugggcucaagugauucucccaccuuggccucugaaaaugcugggauuacaggcaugagccauuacaccuggccauuuucuuuugacuagagcugaaguucugaaacuagcagucauuggagauaagacaggagaagacaguugggaggcuccaagcaugugauuucaggaaaagcaugaguugauuauugagaauuucagaugugagauuuccaggaacagugugaguccagaagauguaagaaagaucaguggaauucacacaguuugguuauucaugcaucuucgaauauuuuucagauaaucucggguggauacuucaguuauuucugccucagcccaccuuauuuguaaagcaguauuaguagaauccccuccuugagggguucuucauauuaaauaaguugcauagccaacagccugaggcauaccaaacacuguauagauauuugcuguuauuuguaugauugcugccuuuuacugaguggcauccugggcuggugcuugggacucaacagugaggacauucccucccacaucugccuguaaugccaaggccuugugauagggaguggccugaagcccgggguagaggaguggaccuccccagcauagcuggggaaggagucucaaggagaugacauuugaccaguccucaugguuguuugcaaguggcuucucugcuguggaaugggaagaaagggucuuccaggaagagggguuagccuuuguaaaagugcagagaaacguuuguaugagcaagagaguaauuagggaaccgugagcaauuccaugugacucugacuauagguaggcugcagggaagggaagagacagaugaggacugucuuccuagugccuagaacaguggcuggcccauaguagguauucggugcaucuuaguggagaaaugugugaaagaggaaagagagggcugggagguagacuacuacuagauuggcuauggguggagcugggggcucagcauuuucaagcucugaaguuuggucuccuugaaggaacaggagcagcucuggauuuuagaaggccaauucuguccacagugcaccaguguucuaggugagguuggaugauggggagagggaagucugaagauagcauccauaaaucucaugacauuucuaucccagcagugcaaucaaauguugagaauauguccuguagcuuucuuuuagaaaagggguuagcaggccaggugugguggcucaggccuguaaucccagcacuuugggaggccagcgcggguggaucacgaggucaagagauugaaaucaucauggccaacauggugaaacccuaucucaacuaaaaauacaaaaauuagcugggcaugguggcaugcaccuguagcccagcuacucgggaggcugaggcaggagagucgcuugaaccugggaguuggagguugcagugagccaagauugcgccacugcacuccagccugguggcagagugagacuucucucaaaaaaaaaaaaaaaaggguggggggcgggcaaauuauggcuuaaggccaaauccaaccaacagcuucuuuuuauaaauaaaauuuuacuggaacacugucugaccuguuuauuuacauauuauguaugguugauuuagcguaacaauggcagaguuggguguuuucaacagagaccacauggccagcaaugacuaaaauauuuucuaucugguccuucaagaaaaauguuuggugaccucaguguuagaagauuguuuuuagguauuuaauggugccauucuggaaaaguuggcauuguuggaagaguucaaauugaugcauguguagccuaagaaaaauggggccauaucacuuccuaugaagaaacacaccaaaauuuuaauucaauucuuaaguuguugucuugauuaucuaaguucugucucuagucuccuauggcuauuuuuguggcuuugacccuagcugacccagccuauugucaguaguuaagaagguagauuccaagugcucaaugucauguuaagacuuccuugcuaccuacuaagggaagucauuuuuuuagccagcuguuuuaaguucuccuaaccuauuucauaugcuauguucccacaauaaccauucccuucucuugccauuucuuuguccucucuccugcaauguuucuucuacugaaagaauacggcacuacugaaucuguuucuccugggcagggcuugcauuaucccaccuguuccaaauucuuuuuagaaccgggcccuuugggugaaugaugaaccauuuaauagccccauguacuauagaaauuuaaccauuuucaaccaaaccugucauagauaagaacaaagguaagccaucaugugucuagaaaaacauacaacugauuuccucacagacauuacaaguucuuacucuucaaauguacuuuaaaggacugagaguguaauuaggaaucagcagaaguuuuguggaaaagaggcauugagccuuuugcauauuaaggaucaaauuuuauguuuuguaugaagcauucaugaggugauguucuuaaaaaccacuccagaggcacaggaggaacgcugaggacaagacugaauauagagauggaggaauuacgugucuacuggguagagauggagaaggcauauuuauacuagggaugguugaaaucaugcaagcaucuuccauagcuaauaaauuauuuuauccaguuggccuuuacugagggcauacuguguaccggggcccacccuguuggaugccaggaauacaaagaugaucagaguucacuuucugcgcuugaggaucccacagauuagaaaggaggaaaaagaguuacuuuccauacaaggcuauaaauguuacaacaguugaauuuuucagaugaaguggaaggaaacgucuagaaggaagaggacugaaaugaaagaagacugggggaaaagaaauaauaauaaacaaaaagaaaaauaauuugaaacuuuuuagagaagaugauugaccccauuguggagaucaagauuaaagaugaauggcaggcagcuguggagagcagagguggagauauugggaggaucagacuaaagaacugaaauuucaguuguccaagcgggcaugcuguucuacagccucacaugucuugggccuauuagaaauauauauaaucuaucuaugcaugacuuauauaccauacaucacaucauuucuuccaaacuuacauuauaauauaacacauucuguauuaguauauaguaagauuuuaaaauguacaacauauuuaaauauacuccuuacaauuaagccucaguaagugcuaggaacuuugcuaagcacuuuguauuaucuaacugaauucuuaccauggguaggcacucuuauacaacauuucccaggcaaggaguuuugcccaccaagguuagacagauuguccaggauuauccaggggguaaguggcacucacaccagggcuugucugacccuacuuaauuagaugggcuccuaugaaguaaauuuuaggauaagcucuugacuuaaaaaugagccuucuaaugguugugggagagggagaaaaaacaaguuuacagaagauagcgggugaguguggagcagagaacuagcauaggcuuugaagucaagccuaacugaauucccagcuuggcuccacugcuugccagccacauggcauuggucaggucacauaaccacucugaauguccccaucuguacauugggguuuguagcaucugccuuguuagcauguaaaggaucugcaccugugccuggcacuuagcagacacugugacuuguagcugcugcugcuccugcuauaccuaccguccuugccacucuucuuauauucacauccacccauccuccuccucauacuacuauuacuaccuaugcuaauacuauggugguuaugaugagcagcaguaguaguuggaaugccucaaagauaagauuuaugcuaaaaaacagaagcacaguaguuauuuaagaccucgauuugaucaauagcauuaguucugcauuuacuucaauauuuagugagcaugugccauggcaggucucugcgccaggcacuguagaaaguuaaaacaugaagaagucauuuccucuuuuagcugccauauccucuaguuugaccuuuacgccauauacucuuggucagauauucaagaaagaaucuugggagggaaagaguuagugcucaucgagugcagacuggcuugaagcugugcauagcuuuggaaggaaugucaggacuuaaauaauuucaggaugaguugaagauuacauugagcauuuacuacuucuccagauaaucucaauuuccgcccaucaugugauggaggugucaccuuauuuacagguucagauuguuagcgggacacuuuguuauagugauaucuuacagaguuggccauuaggcuauaauugagccuuuauguggggugcuggguaggccacaugacccugguuccuguuuccagggaggccaaccuacauaaaaauggcugucauauaucguugcucagaggggcagauauuuacaacaaccuugaaauggaacuuccacccaauaugaugaagacugacuugugacaguuugauaugccuuuauuuugcuaaaauagcaaccuggccaaauauauuuuucagcacauuuauuauagcuacuuguuuauauuuauagcaaaaguguugcuaauucccuaguauguuaacaggucauauucaaauuguucuauuuuuacuuuggcacaaaauugcugaaggaaacauuuuuaaggcaaguagugauuauagcauaucaacucacuacauagugaauuauauauuaaaugaacuuccugaacugagaaggagcuuaaacugacaaagaagauaguuuucuuaaauucuguauuguuuacauaagauuucuucaaauccauuuuuuauuauagguuacugauugucucaauguuuucuuuuugcuaaauuucuaccuucccgccaacaaauauaaucccccuuuuaauauauaauagaugaccugggauuccagaauggauuuucagaaaccaucaaaaaaccuccucgcuuuaguguauacaauaaauaauauauucuuuuuuaaaaauaugagagucaaauagguauaugcguaaaccuggccaacccuugggcaguuguaauuuccauaccaaaaugcaugagucuuuacuugacuguuacucuguuauacauuaaguacuaguuaccauggcaaccuuugcaucacauuaugacauuuaaauauaaggugguguguuuccuuauaaggaaagacaauguauuugaauuuuugaguguuuggugaaauacaaucacuacuaaaauaaauaauuuuguuuaaggcaauugauuucuuugggaauuacguacauuuccaaccaaaccuauggagugcauucauuuauuuuuauuuuuuugugaugucauggagaaguaaaagauuuuuuuuaaaacaacgcuugauaaguauaacauaauaauucauuaaaugccuauaauuacccucguaaguggcaaaacacaaaauugaaccauauuugagguuauuuaucagugaccaauacuguagcaagaguucgaauguaacaucacaagauuuaugaaauucuaucgcauauaacacauuucuuauuuuuguauaucuaguugguuaacuguaacuaguuuugaucuuaccuauaguugaauuaacaguagcaguuugcucaugcgugcaaaagcaaaauuaaaggagccacugaacucauccuuguggcauuuccaggaacauggccacuuaaauuuaauuaugaagauuguugggcaauuucuuuauuaaauauggaaaaaaccuagucauuucuuguugccaguguagcucuaggccauaaggcuaucaucuuuguuauguagacucccauauauaacucauuuuuaacuuuuuauaguaacuuuuccaaauuauuaucacagcuuguacuuuuuaaucugaaaauagagaaucuaaugaucacucauaacuuuuggugcaucuuuucaauaauaaucaguggauuguaauaugggacuguuuugugugggacauaagaaagagguaagcucugugcuggacccuggcucugcggaacauuuuacauauguuguuucaucuauuccugauaacccuaugauagagcucuuauuagucccuuuuuacacgggaagaaaguaugguuuagagcaguugcauaacucacccccaaauacauugucuguauuucuuugagcuaagguucaaccagauuggucugaccuuaaagcccucccucuuuccuuaauagauuugacuucuacuucugacuuguuacagacacaaugugcaugauauguuuaauguagaaauaaaaaacacugacaaaaaaccuuuaaaaauguuugcuaaauaauaauuucaguaauuuguauuucucugcagcacagcaguuuuuuaagucccugauuugcaagauaucuuggucuuuguaaguuacccaaguccucuuuuguugaaaccaagcauaggacagaaauaaaaauaaauuauaaagguguacucuuggaccuucaggaaucaggaaagaagacuguccaaagacugaccuucaauuuugagcuuugaaguucaaaaguggacagguggaaauacuguguucuucauugcccuuuggugcgagauauauucuagguugcagaguaagugccaacagcagcaaaauuaucgccccccuccugcuacuguaguaagucagcaauggcccuucuguggucagaauggcacauucagcagcaacuauucgacagggauuuacagaaacuuccccauggcuguuaggaaucuuauucagcagugucuuugaaaacccgauucugugcagaauuagcuauguagaaaugaccuagguugugauaaaagguauuuuaaacaaaucuaacuuguaauuucacucaauguguauuuugcauuuaaugccacaaagucugguagauaccuacacauauauuuugcauucauaaguuuuauagugguucagaauuuuuuuccauauuaacauuuuaaaaaauccuggcuuuauagagucaguucaccauacaaagccacuauacaucacuuagguuugugaugaaagaauggaauugcagcugugugaguacuagaauacccaaacaugaauuagacucacaagcauuuggcaauaguucagaaaaagagcuuaaucugguuucaucugagacugcuuuucucuguucugcaacauccccccaagauguugugucugauaccggaucacaacguaaugggagugacgcagaaucgagaaagcccugagaaaccaggggcacauuugcuuuucuccagagauuuucuuucuccuacuucuuuuuuccccucuuccaguuuccaacucugaaauucaaggucauucaccuauuagaugcauuaauuauaagccaaaaaagcaguauucaucguacucugaucucagucauaucuauaauuaaguguaaauauaaucuuccuuuuuagaaauguaccacccacccauuacauuuaaagugcugacugaaaugaaauaauaguucagagcaagaugauuuuaguuuaacuagaaaaaaguugauaauuuaagcuucaagcagugaguucuauuuuugauuaccauucaguuauaaaucuaauuugagauauaugcugcuuuucuguuacucaaguuuaauucaugguuugcuuucuugguuguauaagcaaaguucagugguugaucaaggcuguuaagaagcuccccugaaaaggaaugggggcaggguugagaauguguucgaaagacauucugagaccuauaucugauguaaaacaaacaaauccgauguaaaacaaacaacaaaauuuuaauugaaaaagacacucacagagugcuguauuuggggauuugaauggccaaguuaggaauggccauuugcaggggaauuggcugcagagggugaaccccaaaacauuccaaccugguugauaaagucaguguguuuuauucuuugguuacaguauuuuaggucuuuugggaaaaaaaauuaggagcgaguaaggggaagggcuugucucaucacacuguggacaguuaagcaaaaugcuaaacuauggguuuaagauuuacagguuagcucugccagaugccacaucugccuccaguguuuccuggcagauucgggcagccuacuacugggacccagcauaaccgcagaacaugagcuugcacaaugugaaaaaccuaaaaccauuauaauccuauuuaaggccaggaugaauuugcccauuuugaaaguagauguaguuuucaagcuuaacuuuuauuaagcagaaacuugucuucagagcuauaucuauauaugcagguaaauucauaauauaaacaaauaccuuauccauuuugugcaaaauuuaauuuacuuuaaaucaaacgccauucacuuuuuaaaauucauaaacucagguuuuucagccaguggaaaauuuaucuuucucauugcuacagagaguuaaguaucugacguaaaggccagacaauaguaaauggucauuguucgcuuuauaaguauacucuacaauaagaacacauauauuuuuaucuucauuuucccuaaggagguguuuagggcccccuuaaaugugaggaaauguuuauuuuuguugcuuuagaagaaugauucuauuguccaagugagaaagaaauaggaacaaacaggucuaaggagaaagaaacaggaaugugcuuugugaaaaaaauaaagauuaacaggaaccacuaaagguuuguaagugcuaucugguccuagugcuauguuacugcacauaguccuugcgccugcauauguaagaguuggaugcgugauuuauuaugacuggcccaugaaauuauuuucuuuuaaguuaacaacaauaaggucaaccacagccuguagcuguuuuguaguuauuuuauauuuuucacagcucuauugugaaugcugcuaaaagacaguauagcaaguguguguuuuuagguugaccccuugaaugcauuuaauuucuugagagugaaaaccuuugccaccaggaccaagaggaauuaaccaaugguuaaacucauuuaaaaacacaagcaagcauuucaacauauuugcuuagccguuuucugaauauuuaauauacuucuagagaaagaaaaaugaagaaauaggggugauuugugucuagaauacaaaguuauuuucaaacuccucuuuccaaugaaaugaagacucauucguagauuuaccaaacuguaaggagguugugauuucaaaucauucacagcuuuauugauggaaauuucaaagaaaacuuggacacagacuucacuguaacuuucuuuguuaauaagaaaugcgaagagugaaauuuagguugagauucaaaaacuuuugaaugccacuccuaaaugauaaauuauuuguuacuagauuucugauuuaugcaaaacuuuauuauaauaagccuuauguuuuaguuugucauuguguaguguuuuaauaugucucauaaguucaaaagaggcaauaguugagcaugcagaugucagauuuuuaucugauaaaucugguuuuaucagguauuuaugugguaaacauuaagauacuagcaaugaguuuauuacucaaaaugugcuuucaaucugaaaucucauccuugaaguuguauuuugaaguaauguuuauuacauaucucuugaaaaagucuuaaacuggaaucaguaaaggcgagcuugucaguagcugauuaguccuuuauauaugacucauccaacacucagaaaaaccccuuggaauagagagguucucuuuaugauauuuagcuauauggcgguggaaaggggagguuugaauuuuugauuuuccagcuuaugggucauauuugaccaacugcuuucacuagaagacaugccacuuuguugagcuauuuaggaaucaaaaagacugucuuaauuuaaaacaaggacccuuuguuuuaguuggugacugccuugugaaauuuuucaguucucagcggguuaaccagggaacaggggcagagucauaauuggccuauuuagaguauuuugcaugugaauaguguguuagugaagcaucccuaagucuguugugagugacauggugauuagaauuuagauuagggaaaacacauucuguacuuuaucaaggacaguaauuaguucagucaguaaaaguugauuacaaguaacgauaaaguuagauuuuuaguacuuaauuuuaaaauuucuuuauuaaauaguaaauuuguucuuaauauaaaugguacuaucuacucuuguuuuauugcauaucagaauaauuaaaagaacaauguguucaaugcagaguauaaucaagcgauuuauauauuauggguaaguuucuauguaguuuuuagaaaauguaauauuauauaaucuuucugaugucaucauuuuuagaaguuuaauaauugucacacugugauagguuauuguggaaguuuucuaguguucagguaaauguuuaaucugugggaugugucuuagcuuccgauagaccucaagagggcauucugaaguccuuuguggcuguuagcuuggaauaucugcuauuucuguaauuuugagaguuagugugaggauuugaauuuccucuugguucaguuggcauuuucucuucugugggugcuaugucaguucguggagaaucaugauaugcgguacagagaggcaggguucucagucgaguucauaggcuacacuuacccccaguguaugcagccaggggaaguugugugcguucacaaaaugagguucuucuuguuaaggaaggggaugaauaguucccagauaugagccucagucuagagaaaggaaacauuagucuuauauaaaugccauuuguuuugugaaaugaaaacgugagucaucuuaaaagacuuaaaaaaauauuguuuaaagggaaucaucuacuuuccuccuaaaaguaaagaauuaaaaauucacaaacuuugugauagcuucuuagacugccuuucuuuuggguuuuuguuuuguuuuaauugucucagcuuagcagaugcuguuugcuuuauugcauugguuuaaguacuaacaaucaguugggagguggugaaaguaaaaaauuaaccuuauauguuuguuuucccuuuuuaaccuuuuagcagagucuccuuggaggugacauggauaugggcaacccaggaacccuuucgcccaccaaaccugguucccaguacuaucaguauucuagcaauaauccccgaaggaggccucuucacaguagugccauggguaagguauuccuuuguuugaaugccugagggaugauuaugccuuuuucuuuuuuucuuucuuucuuuaaaauaucgcccccccauccuaccucccaccccaagaaaaccauaaaauuuggcucaguugucagccuggagacuuccccccuaguacacugaguagguacguuaacagcuuaugguagcagaacuuuuuuggugucugcuuaugucuaguuuucucuuagcugcacccauaaggaagcuauuaaaagaucaaaguagcaaaaaguuaaauaucuucauuuuuaugaacaaagcagaauuugauuucugcuagaaucgaaugugaucgugguaacuacaguuugcuaagguaaugauuuaaggaaaugugguaucaucuagaagucuuugugguuuaaccuaucuuaguuaggaaaaugggcauuugggagcugaaagcaucuucauuuucuuucagagguacagacaaagaaaguucgaaaaguuccuccagguuugccaucuucaguaaguacugcuuguuucugcuuuguauauugcuuauuuuguucuguuuuguauugaugggaaggagauagaaguaaaugaguuuccaugcgcccagagcagcacguuuaucuagaagguggaugagguagaaaugaccugcacauccagccaccugacccacauuggagugauuaauugcacauccuggaagacugggugguuauguugauauucagcagguuaagcucuaaagagagccuugaaaaggugccugaaguuugaggaguuuuaccuguacagggcuugcaagagaaugaguauuaguuucauguguugguuaaauucuuugucaguauuaugaugauuuauggauuugcaugcgaaaggagauuuguggagaggauuuaggaaaaauuuacauggguuucagcccagagugcaggaagaaugucucuauuuucuggagagguugcugaauaaaggcugcaaagguagcugcaucaguagccauuugugucuuuacuaccaggugacaacuagaaguagucagcuguaaccaagagcauucugggucuuuuuaacagcuggagcucuaugcagaaguugcugauaucccccacccacccccaggucccuaguacagcaaaaguugguugugaucacaacucaauacaugauaucauauuuugaauucuuacguuccuagauaauuguauuuaauuuuauuuaggacuaguccauuucuaguaauuuucuccucauauaaaaugaaaacauaguuuccucucuucuuucuuuguuucuuuauccuuccuccuuuuuuucauucuuccuugcugugauauaaaguuuugauuuaauucuguagaguacuaguauucuuugaaaagaaugcugagacuuauuguuuuuauacuuuaauauaaaaucauauuuagauuucuuaaaguauauuaccaaucaaugcuugcauauuaguuucauuucauuuuuaauguauuagaagaauaauaggucuugcaaaugugcuaagauuagauuaacccaaacaccuguguauuugacuugauuucaguucagcucauccaaacaauuauuaaaugaauauaucagaauaagucuuaucaggaaaaagaguaaauuuuguaugcugauuaucauagaguuggugauguugaagaagcaucacaaaauuauucauaaauauagaaaaauauuguguaaauaagauugccaaugguguauagucacuuucaacuagcaauaagucacuuaaaauuguacucaguuguuuauuguuugaauuucuguguuguauugaaauugacuaauaugcccaaaggauuuuauaagcauauuuuaagcuugaaguuagggguggauuuaauguugaugaaacuuuagcuuuuaauagguuuuaugacaacuucaaaugauacaguccuaacagcuguuuacauuuuaaacaugccugaacuuaauauggacaauauuaaaugcauuugguggaccuuugaauguucugaaacaauggaauaacuguccuauaaaagccauaaaaaacuuaaagcuaucauacccuccuuaugcuucauauucaaauuaacuuguuuuauccaaugcuaagauuaggcagaaaucuagacaauuucuaaggagugcauugguguggcauuggaugguauguaucugcuuaaucacugucaacaacaauuuucauaauucguuguaaauguuuaaguauuucccuauagcuaacuggccccuuuagaaaauuuuacugguacaguguuuucuuugcuguuaagacaauuuagguguugcugcuaugucgugauacauucagaaauauaaaaauaauuuuccuuucuuucccaauaaacaaaacuugggaauuaggaauuuaguuuuauucuauuuaauuuucuguuuuuaguggucaguuuaggauuuacucuucuuagaagauuuaucuugacuaaauguuuucaugguccuuaugaaacauuuugaugaauagccuuuuuucugaaauauaaggaggaagaaaauacaauucaaaaugaaauuuuuauugcaauuuuuugagcaagaagaacaaguuuagguaauuuuauaauuuaaucauccauuuacucauuaccuaaaaaaaucccagcucuauuuucauagcaauuuaacuuaguuuauguaagcuuuguuguaaauaucaauugcuuauuacuuacaacaagauccacauggcuuaccaccacacaaaauauuuauuuuaacuugauuccaaaaaaggucugcaguagacauggucacacuuuucuaguagcagaucuguauuucuauauuuuuagaccucugccaugcuuuuuuuaaagcucaaauaaaauuaugacuauuugauaagagauacuucuuaaauuguuucaguauguaugaguauuuguauaacagauacuaaaagauuggagauaauaaaagguuuccuuuggagugauuaugacuacauaagacacuuauauguuuucuuugauacauauuuaccaugacaaauaguaauaaaucugucacaaucuguuguggcaacucacuuuaccccccauuuugaagugggcccucucuuucccuuauaauaaaaggaagaaaacuuaaacggugacacugcaucaucagguauuauuugugacacgccugugguacagagacuggacuucugccgccauuaggcugggucuuccucccaggcaaucaggagagagaggggauugccuagcccuguuuugaaaacacugcagcaucugugggagagagaaaacguaggccuggccagacaucaugccauggaucuggcaggauccacgaauguguguuuguacugugugcugcaccuagagaccucacgucacuguggaaguaugacacgauggugggauaacagaagacccaccaggcagggucuacaggacaagcacagcgugucggggggaagccugucccucuagugcacauagaccaguacuugcuaaggugauuuuuuuuuuaaaggaaagccugugugaaagacagcuaucuaauugcccacgagagcucugcuuauuacugcaguacauuuuuaucuucucgguucguauuuuaguauguugcucuuuuuagucacgucccaauuucucguagcccucguuuuuugcgaagaccuuaguaauaaaguguugucuuuuguugaugucagaauuuauuuugcaugucuaagcucuugaaucuacaugagaacaucuuguuuugcuagauuucuacauuuugguuuuccauuucaaaccauauuucaucuuaaacucaauauuuugcaacuuuacugcucauuucaacaaauuuguuuuauauaaccuaauaaucauacacauugaaucaugaauucauacacagaaaaauguacuauaguaaauuaaaguuggaaaaaaaugauuuaugauucuuaacagaaauuaacaugaaaguacuaaaaucuagaaaguagcaaaaaauuuuauauugugcuguuuuaagauacuuucaucaaacacagaaacaaagcaaaggcauuaucuuuuggaaacuuuauucugcccaucaacauguaaacauguaaaacuuuuaucuuagaauuugaaauauuucaaaauuauauacguuuuaucagaaacuguuaacaacuacaaacuuucuacuucagacuuugguggaauuugucuccacuuguaauccgauuugcaucuuuaaugauggucucaccaugaccccaguuggaaucucuugaacaucagauuuuucuggaaauaggauauuuuauccuuagaaauaguuuaugaccucucaucuccagugaucuuuccuaaagcuguacuucucaguaaagucuuuuuucuacguuaaaguacagagggguuuugugugucuguuuuguuuuaaaacucaggaggaccuggcaaacuuuaaguggucagagauaauuugggacacauggaucccaagauaaacaauuucuacuacuauaaagauucuaaaauaagguuuggacgcuucaagaauauuugugacauuaguuaaucaguagguagguuugaaaaauaaaaacaauguguauuagauauuagguucaccaauuuucauaaggaaagaauucuuaaauaaaaugaaauauuuaaguauggauuagaguuuccuuuacagaagcaauuauuagggguaucaagaaaaaugaguaaugcuaauggccuuaaauguccuauguauuuuguguuauauaaaaacuuuccuauuugaagauuucaaacaugauguugaauccauaucuugagcuauuuagggaaaaccccuuuuaucccaggugcuugaagaaaucacaaacaauuuaaaagagauauugguaaacuguuuuuuccuuauuagugggcuggaaauuauguaugauuuaaaaaaucaguacugaacucagaaauauauaauuuccuacaucacuuuugaaauugaucauagggaaaucagaacgaugcuuuuucaugucaacaaauuuuaacaaguaauaauacaauuuucuuuaagaugaaaguuuuauugaaauaugauaucgaucacaagugaacgaaauaucagccaucugggcucuauccuuuuuaggaaagucuggaaguagccgauugugugguaagacguaaaaggaggaaacucuucaagguucaucccugcagggauagauacuuugugaagaaguauaauuguuaaguguuuaaaauauuaagauagcucucaguauucacuuuuaaacuuagugugcccauuuucuaauuaaagauauuggaauaugagguuuggauauuaaaauugugcuuauuaauguuuaggcaagaaggagguuaagaguggcacaauuaagucaucucaaauaggacaaaacuauucacacaauuuacacggcauauauaacaugacaauggggaacagugaaagcugagaaaauauucaugacagagaaaguauuuuugugugugugcaguuaaugcugaauuugcuaaaccagacuucuaguucagcaugugcguuuuuuuuuuuuugugaaaaccaaucuuaucuucucuauuacacauugagacuauagaguuuaugauuuuuaugaauugcugauauaugaaaaaauauaggagaaucuuuauauuuguuuugauuggaggcuuuuguuccauuaaaaauuuuucagaaagcacacaagaggcuugcacauacucaacauacauacuauuaggcauucuaauaucccagaaguuugcucaaggauuucugaauuuuuguuuggaauuuuggaauaaugagcuccuucauccacuauccuccucuucucugccuugaagcccaauccugcacccuuuaagaaagaaggcuucuggugugcauauuuuagauagaaagagagaagaaauauaaaggaaaagacaagcaugaagguuaacuguggaugaaagguuuguguauuuuugagcuauuccugcuuuaucuuuacaaacaaaaagguuguaugccccaaacacucaaacaaaacaccaccaguucauuccuucccccagaaagaagccuuccuggccagcagcaccccauuuuucuacucagugaucucuucuaaggaguggugccugauguaucuuccuacucuccaauguguuuuuauuuuuaaucaaguauucaaaauaguauuuugcaugcuaagauuuaucaggacuuucguuaagauguuagcagcugcuaacauaaacaauaauagcauuuaguguaaaacuggacuuguugagaaaagagaaauacauuucugggaacugcuauuuugaacuuuaucauuuucacugaagaguauauuuuggugugaaguuuuggacucgagagugguuuaaauuacugagaaguguaggaaaccacugcagggcugcuuuacccagagagaauuauaacagggcuugcauguauuuugaaaauaaaaccuuuuucuauggcauccagcuuaacugugaauuuauauuuacgaaauaauguagauaaaugccuugauaauuugauugaauaccauuuuuuaacuuuuaaaauuuaauugauugaaauaguuuuauuugcuaacauagcaaaauguucuccuuuuuuccagaucacugacaauuucugcauuuucuauguuuucuugguuuugaauaauucuaaagguuuucauugaaaguaaugaaucaggaauuggagggcuaaauaagauucucuuagaagauguggcaguaauccuaaaagaauaaggagucucuucaagaauugucaaaguuguauuuucuuaaggcagaauccauacuugucaggcuguugacagacacuugcuuugucuuggcuuuuguuugauuuuuuacauaacugcacuggauuauuaaacugaacauaaaauugcaccucaaagcaauagcacaggauuuucagccuugaucaauuucuacuauccccggaugugugugugcacgcgugugugugugcacccauguguaugagugugcuucuuuuaaaggaauaggagcuuuuauacaauguggugcaaaacuuauaguuuuaaauacuuaauuauuuuaucuggaaacagcagcaugugagugauucuuuuuuaaguugcagcugcugcauagguguagagcuauuugaggaguuugaugcuuuacuugagcauauacucccucuucagagaaguuaagguagugcagaaguuucugcauuuuguaaaauuucaggguugaaaauaaagaugcuuuaugauuuggugagauggauagauuucacuucugaaagaaugugcaaguuguauuuugaaaggaacauuuuaagaauucuacuuaagugguuuagugacacccacucuugucucuugucugacuuugucaucugaggaauuaaucauaaauaagccacuagggaugaaacuugauauauaagugcuuacuuccagaguaauaagaagaggaacuguguguguguuaaauuucacuaaauuuauuuugauuauuccguagagcaggaaauaggaacauuucguagugaagcucucuucauagcaaacuguaaagaaaauuucucaguguguugccauauguuggcagugauuaaagggcauuuccuuugugaaacauggagccauauuagaaagacuuauauuuucucauaaaaaugaccuuugcaaguacauuuaaucaugaaaacuggugucauucgucacauacacauacaaaaagugucacuguuaccauuagggauuuuaggaaaaugcuacuuuggaacaauuauuuugauggcaucugagaaagaauaccuaagugucuacaggagccuccucccuccauggcccauaucauucuaaauaugccuccugaauuacgcuuauaauaauauuguaaugucuuucauucuaccgauuggcacaguauaucauuauaucauuagcugcuaugagaaagcaguuucaaguagguggcagauucuuagcauuaauguuuucaaguaacccuguuuggagaauuggguuguuucacaggugcucagguacauuaacacaguacaauaauauuuucuggcuugcuuuuuaugaaacgaacuugaaguacaaaauaauuuaauaacaaguggaguauaaaaacuggagcucuagcuuaagaaaguuuaauaacucaagacguuaaaggauaagaaaaaaauugucuaaggaggcagcaguguuuagcucauuuugcguuacuacuaaagcugaaauuuauuaggagaauguuuauggccugauuauuuagacuuguugaguuaguuuaaauuuuuuaaacgauuuggucaaguagaaaagcacaguucuguaucuauuguacuauuugaaaguauuguuacauaaaauaaauucgaaauucugccauuuaauacucaggcauaugauucaggagugaaauugcauugccagaaccuuggggucccucauguaucuuaauaugaauuuuauuuuuagagguguauaagacauuggcacauauaaucuguggcuuaauugauaacagcaaagaaaauggaauuaaaaauauuuauuauuaacagauacaguugggauuacaaaauucaaacugcagucaguaauuauuuuacaaauaaaugcuauuucauuuucccuuuaguaaauauaucaguaacuucacccaauauugauguaagugaaacccgacaguaacaagcugggagugcccagguagaaggggaaaaaagcauguucauuuauucauucauuccuuucuccguuuauacuuauucaaagaguauuuuucauugcagcuaaaaacuagacacaccauguaacauggaacaugucuuuuucuucuauguauucuuauuuaaaucguggagcuuuucaacugagauucuucacguuuaaugaaauuugcagucuugugucacuugcgucacaauuuguaggaauaaccuuagcauuuuaaagaguauaccguguagccuuuugagaaagucaugcauuugaaaaauaaaauaacccacaaaguguaacacauggacuuuugucccuuaagcugauugcccuuacucacuugucaccaccuuuacgagagugagggauauguuuuagauacauuuuuuuuuguccuauagaaaccagacucacugcuuuacuuaugcguauuacucugaaauauauuuccagugaaugaauauaguaguaaaagugguguagcaagguagaaaaaacacugcacuagacauaaaaagaccuuucaaguauaacgucugacagccucuacuuacacacccaguggccuugguuaggucacaaaccugcuucucugucuacaaagcagguauaaaauagugccugcauaauaagguggugucaauauacugauaacaaaccuuuaucaaaguacuuauuccaugccagaguacuuauuccauguucuaagugguacacuauuacaucauuugcaucuauugaaucauuuauuccuauaaaaauccugugagauggguacuacuguuuauucaagagacuuaaaaaugagacacagagaggugaagaaacaugucugcggucacacauaguaaguggcagagcugggagugagaccugggcagccugucucuaaaguuucuguguucuuaaccauagugcugucuaugcugccuagcguuucagacacucuguagaccaaaaagcucucuacagcaagguugucauuaaguuagcaaguauuugacuaucuacaauaaauuaauauucagaaauuucauuucacuguagagugaucaucaguaucucuguauagucauguccuauaacuuuugcccaagcaaaucaguaugccaggcaguccaggggagcaucuguguaaacaaagacaguauaauauagugguuagaguaugaaaucugaucaacuggguuuuuagggggcuaugucacuuccuagcuacacaguuauuuguaaaauaaguacucauugggguuugaaugcauuuauguaauauccuugaauguuacauacuauuguuacacauaauaaaaagcacugucaugcuauuaucaguaacaagguaacuaccuuucauuuggcauuugagaaacaaaucuaacauggcagccuacuuaggaguaguuagcaguagaauagaaacuaagaccagggucucagcuauguucaaaagaauuuuaccuaacagaggucacuugcuuuuucugaaauuauguaauauugcuuuuuuuuuuuuuuuuuuuugagauggggucuugcucugucaccuagguuggaguacaguggugcaaucauaguucacugcagucucaaacucccaggcucaagcgguccucccaccucaggcuccugaguagcuggguacacagguucacaaccaccacaccuggcuaauuuuuuucuuuuuuuuugguagagacagggucucccuguguuucccaggcucugcaaacccaucucuaucaaaccaagacacguagucagcccuuuuaaucauuagaccuaguggucugcaaaguuuguguuggaaauacuuuaucuucucucuuuugaacugguacaucggcugugaugcccggagcugcuuauacugugguucccuuggccaauaauuuguuuaugccuaaaucagccuugccucuaagugauaaggagauacgugcuuuuucuuuuguuuugugucagugguauucucuaauaggccgggaacgggucugcccaagugaugcacagccccuugguggggcuggcuauagauccccccgcaaaacugaagguuaggccuaagauauuagcuuugccuggcaagaugaagauguguggacuagguagaccuguguggcagucuguuucuuuuauaaaguaaacagaguucaguuuguuuaggacugcuuagguagauuucuuacacugagcaggaauauuuguacagauguuuuaagguaaagucaaagaauggcuagauuguagccuuugacgcauuauaauguaucuuuucucagugccccuguugaauucacaaaagaaaagguauuuuugaucaucggcuaugagaaacuuaaaacacuuuuuuuuauauauaaaggcugauuuaguuaacucuucuugcauuuaaagaaaaaaacaucugcugaaaguagggaggggggaggugugagcggaagcguggucuccacauuccacaaugaaugucuuuucccagccaauuuuaauuugcagaaaaaccaggcacugaguuagauuccucgggaaaagucccuguuggcugaugagcccugaacuucuuccguguacacccugaacagggacugaugcuucaguucacagagauaauuuuucucuggaaagccgauagauccgauuuagccaccccucauuuguagucauugccaccuuguggauuacaaaggauauugguuuucaucaaacuuccauuucgauuuggcuuuuuauggcaaguacacguuggcaguggauugccguguuccucaccaaaaggauccugguuuguucagcaacaccucacuucuccacucacaguucauuuaugauucugaugagaguguuuuuucaggaaacacacauuucacuuuuugaccuaggagcaucuguuagaauuuuuuuuuaauacuacuuuggcauucugaaaguguuaaugucuuucauaucuguuuaaugcuauuuagggauauuuaugaucaccucuugguuacucaggguaaagugugucgcaauuuuuuuuaaacagacaggaaagcauucacaugaggaaacagauugcuuuaaacaugugcuuccugugacaguaaaaagaacaaauuagauuuaacacuguguaaugaaugcauaaauguguacauuuaagcuuuuaaaagcuuuauguucaguucuggucacaacaaaaauugagucaccuguaaaaauuaaagaugcccaggguacucucagacuuuugaaaugcccagcaauugcaguccucaccugacgaugccucguuggaauuauaaaaagcaugaucuauuagugcuggagagaacuagaacauuacaaggcacauucagagguuaaaccagguuacagucagauuccguacauuuagcaaauaaaucagaauuuguugugggggggagaauacuucacucucaucuuccucccuaagaaucaaugaaaaaaucaauuuucgggaaccccauauauuccucugucuuucaugaaagaaaaagaaggaaaccugauguuuacuuacuagcauuuacuacaauuuaauuauauaagaaaaugacucuuuuucuuauguaauucaguuuguguuuuguaugcuggcagggagugaauagaaucugaguuaauauuuccaguuagacuagaguguggaauuggagggccugaauccucuccccggaagaagaggcacucauggccauuucugucugagccugcggauagugccucuccguccccugugcuuucaaagcuaaggauuuguggcacgcuugccaucucucuggccaaggagggccaggagagagucccucgggggagggcacauaguuugaggacaucugacucucuucuaucacauacugagguacuaauaucaaaacagacugcuugucgucgcacgguggggcagugcuuuuuuuggcugccguggucgaaaugaaaugggcaagcuguaguccgcuuggcaucagaaugggcuaagggaagcagggaaaucagagucagacugugaaugcaagucacagccaaugguuaacuuccuuuuugugugucacuuggcagcagcgagacugauggugauuuuuuuuuuuaacaugggugagaguucagugcccuaggaagagccguagaugcuguuauugugcuuccucauacaguugacuuguguugauuucuugaggccaguacagcuguuccaagagccagcuccaggagcuuuguguguauguacauggccaucggacgucggaugaaaaagguaaacagaugagaggugauccauacaaaaucucacugcugaucacuaggcagucuuaggggaaucagguucuggcauaaggcaauaauaccaaagaauaauauauagugcacuugaagggauacucccuuguauacagacacccaaagauauuuuuaaauuaucaccacuccgcaccccucaucucacauacaggauucaaaucaauuuuggacugucuggaaaauguaggacuaaaauagccagauugaauucagauaaaauuaccuucugcuuuuuugggagguuguugcuuuuugguuagccacauuauuuucuuugaagauucauuuggaagagaguuugguagaauuucuagccucucucaagauuuuccucccauuucucuguuugcaaagagcuguuccccaaaggcaaaaagagcgaguugccaucuugagcgaauuguauguuuagugaacaccaaauggucucagaguuacccuaaauuuucauuauaucugguugcuuucaaauacuauuuauuccccucaaaacuccuaaccauuuauauaagauaucaguaagaugaccaacuucugacaacccaaaagcagggaaggaagcuuagaaauagaauaccauuugucugguaauuagaguguaucucuuaagaguucgagagaauucugauuaaccuuucuguucccacauucucacguaaaauuagcacaccuuuuaaauuauuaucuaguauuuaaacacauauuuuugagucuucuuaaugcaacagguucuggggacacuaaaaguguguuauaguuuucuaaaaaacuucauuuuucuuacauuuuaaauguucuguuugugcaaaauuucgagaaucaccauaagggcuucuuugcauuuuuaauuuaguaacuaacauaugaauaaauuugcauauuaauuaguugcagauuaaaucaugcauacauaauugccuccuuacuguguuuaauguuugucaaaaucuccagccugguuugauggaugucguaugaaagauuacaauuugauguacccuuggaaguauuuacaccaauaaugcaagauucuuaauagcagaauuuucuaguuauauacaguuacuaauaaacauguaagauagguacaugucccuuugacuaaaauuuuuuucuuugcaccaaaucauuuacuauucauaaucauuaaugcaucuccuaauuauacagcauaugucuguuaacccuuucauugcuggccuucaaaugguagcuucuuucuuuuucuugcccccuaaagaaagcaaaauuguuugauaauacucugaaauuacucgauugccuuuuauuuauuucucuccuaguauauggacaaaccucauuugccauuuauuuuaacauacaauagauaauuauaugaucauuuuguauuuucuaguuaaagaucauaaaaugacccacgugcacaugguuaguagcugaugggcuuuugccuuucuuuuaccaaugcugaaaaaaauugaaauauuucagauacuucauauaguaguaaaaaaaaauguauacacagacauacucucuauuuaggaggguaauuguagaauaaguaaaaguauuaaaauuauauuuaaauucauuuugaauauugaaaugcauuuaauguaucaugaucaaacauaggauggaaaugugauuuuuuuuauuagaauugagaucucugaaguagaaacugacaagagaauagaugcucuugauuugacauaauuuuaaaaugccaauaaauguuuucucaaauuucuucagguauuuaauuuuuuaaguuuuaucuuacucauauaaaaaguagaccaacuggcuuuuuuuuuuccuuuuuacuauuuugaugucuaagcugcuuaucacacuguauuacccugcauuaaugaguauuccuacugugcaaaauucuaucaaaaaugauggugugaaugucauuuuuaauuggaaguuuauacagucaaauuuauaguacacaacaaaaaauauguauguaguucugcuccaagccuuuuuuuaggcuuuugaucuuuuuaguuuaaguauacauuuuuauuaaucuaagugucauuugaaaaucuacacaaauaugacuacauuuuuuauuaauaccauuguauuauggaagagagggaaacuaaggcauagaguaauuauaaugucuguaaacuguaagaagaacaaauacaagaaugaccaagaauagauuuucaggggucuuuuuuagacaugaaaacuugcugaccgguucuguauguuucacauaagucagacuguaugauuucugucuucuuuauuuuugaaugccugcauuuauaugccuaguaaaaaggcaaagguuaaaaugaguugaaagcauaaacagcugauuucccuucuuugauucuuucauaggagaaauaaugucuccuggucaccuaccucaggagcauuuauuugcuuaucacaggacacaaugaacuauuuauugauuuaacacaacauucuuuuacaacacgcaauauuacauuaaauuauuuagcaaugugaaaaaugaaaugaaagcugcaaaacuuauaaaaggaagcaaacagucagaccugaaacauauuuauccacagccauugugccuagguaauucagggcauaugguauguaaaugauauuuggagauccuugccaaaucuacacacgacgggauaaauuaaggacagguuucccugggugugagucccaugauuguggccggcacacuuccugcuugaauguguguguucuguucuugucuuucagcaagagcgucacagagcauucaguggccaaaucugguccucagcugacuucuaagacauuauuugcaauucccaagaauugauuuuaugauuaaauuuaaaacauaguaccaauuugccaaacuuucccuuugcucucacauuugaaaaguaagaucugaauaauuugucaggauauguuuagauauuaagccauuuaaauggguaucuuugacauuagaaauugagugccucugagcuucuuagucacugaagaaagguguuccugagcagugacuuuucucuaagcuaggauuaagauguuuccuagaacagacuaugaauuauuuugaacgauugauaauuuugguuccagguuggcccaguaauaauuuauuaauucaacuugacaacccaaauuacugguaucacuuauuuuauuuuugaauuauuauuuugaagcauauacucucauuucuagaaaggugaaggcacugacuccuauuuagaauaaauuuuaaguagguaagagguuaugcuguuuucuuuuuuuuugaaaggaaugucuuuucuaagcugggggucuuagcucagaguuuuuaaugcuuuaaauuaagguucauuuuuaucuuggaauuaugcaauuggagauuuugauuagaaacuauggcagaauuuuuucuccuauaauuuauuggacuauaccuaaagagugcauuuacugugcacacuuaauuauaaauacaagacuuauauguuauuuauaaaaguuauuucgggguauuuuaagacauguagaguauggcuuaggauguuuuauuguuuuuacuauuaagaauaaugcuuuuacuaaauaaaacuguguuucuuuuauaaaagauaaugcucuuaauauuaugguuuuauuugaauuagcaguuuagucuguguccccacauuccauuucauuuauggaaugcaaauaacacuaguuacugcauagaaaaugaaauuaggcugaguccuuguucauugcuguguaaauuggguaaaaaucagagaaaaaaaaauacccuugagaucaauguaaaucaauacuacuugagacagauccagcuaaaaauucaugaaaggggucacaguucuggaggaguuuauauaauuaucauguagccuauaguuugugaacucagggcaaaguucugagcugguuguucugggaccauuccuugguucauugaaacuacuuugcacagcugugcuucaaacucaacaacagagagcaaaaacaauauucacuauaaaauaaaccucguccugccuuucaacuucacugugaacuugcagucuugaaaacaacaaaagggauaaucgcaauugagauuacagaauccagauuagauguaauacacaguagggugguauggcccaauuuuacuuacauggggcaaguggaagugcugugaaugccaacauguuaagcaucauagccacuuauuaagauguuagcuuuaaaugucagucuuuggaccccauuugaaaugaagcaccugcauuuuauucaaagaaauuaagauauauuggggaaugcggaggugaguugaggguuuuuuuuguuuguuuuucuguuuuguuuuguuuuuuuuuucuggugggagaaagugccauagacaauagagauaaaauaucucaaguauuaaaagucuauuuuuauacacuguaugauucaaaaugacugagcaguuuugaaauuuuguagaaagaaaggaauauaaggagaauaagaaaugauauuugcaucuuuacagacaacucuguauagcacauuuaagauucuggcaauuuccuuacaaguaucugaaaauuaggaauuaugaaggaaacccagacagauacuuaacuauagcauugcuaccaggugucucuuugauaucaaugaguuaggaaaccuuaagaaaaaaagguuaaaacauccagaaugauaacuuauuuuagaauaugcuuucagacaaaauauuucuuuguuaagaauguugaaagguuuuauuuaauuguucacauauauuuaguaaauuuuuugguagacuugaccgauuaggcuuguuucauaaaagaugugggcuucuguguauuuagaucuuaaguuuauuucaaauuggccuuuauaaaacuuuagugccuuucucuuagaauucuagucaacaaaauuauauucaucaaguguauacaucacagaaguaacuggugauacagaguauaauuccuaccauauugucaaauggagucuauaucuccucaaagggaaagaaacacugacgugagucagaaguuuucacucacuuggcacugaaucagcuuaaaguucgagguugaaaaauucacaaauauuuauagcacaccuacuaagugccacgccuccuggaagguggacagcaauggccaauguuucugccauuggaaagauuugcaccgaaguguguauggccacauguaguuguacaaaucagaguucauuuuguaaugcuuuauaagggucugguaccacugauucuccuugcagacuaauaaacacagagcuuauaugacucuuaaaaauacagugauagcaagugcauccuaaauuauguaaucaugugguccaugauaacaguguaauauaugauauacagauggaaucagccaccuggcuuacuguaauuguuguugagguccuuuguuaugaacauauauuucuguuaacaaugcaacaaaauaauuuuuuaagcuguuuuuuuuuuucuguacugccucaaaucuagauaaacggaauguguuggaaaggacaacaaauaagaaguuaaauauguggaaaugacauggaaagcaccuguuucuucccuuuguuuucuucuacgucaucaggaaauaauauuuaaccauagaauauggugucccucuaagaaaauguuuauaauugaauguucaaaguagaauauagauuaaauaaguaaagaugacuugccaaaaaaaauuaaagaacauuugaaacaaacagaagucugcaucacacauaauaaguggcauaacaguaucaccucucaaaagugacaauagauguguccaucuuuaugccuuuagcauguuguuggcauuauuaguuauuguauugagagaguagccacgcuauacaagagaaaggaagguaaauuagaucccucacgcccccuucuucugugaauuguauauguuuuugaauacacucucugccaggacagcaaauaaaauuugguucaucccugauccucagcagauuauaaucuagguaaaggacagaccagguucaugaaaucaaaaauaauaauuagaacauuuggaaacuaggggaacagguccucauauugugugcauguuuuaucagucuaaaguagauauagcucuauugaaaauuguuggcuaguaauaugcucauuuucccauuucaugaagacuuauucucaaauggaaguuacagcuggcuaucguguuuuuccgacaaacucucuucucuguggacaugaugauuucuguuguuguggaaaggaaggaaauaaaucucuuuuuguuccucauucacucaaugagcaaagugugauugagcuccuauugugugcagauuauauuguuggagcacaggacaaagaaagcuaaauuaucaucuuuguuuagaaauuuaagauauuugggagcagcaagguagaugccuaugccuaguuuauuuaacaaggcacugaacuuugcuggagaauccuauauucuagaauauaguccuuaucuggaagugacuacagaaccugauucuggaucacagagagcugcagaucuggugugauuaagacaguggccacagauacuccacugagcuucugucuugcagcuucugucugucucuucccugaaaaucacagggaccacagauacuccacugagcuucugucuagcagcuucugucugucucuucccugaaaaucucagggaccguguggaguuuugcuuggucaacuggagaaacaacuuuugauuguuuuuauguuuuucagagauuuauuugccagagauauuacauuauaauaaaaacauaaacacagaaguuagggauuggaacaaagguuauauggucacaauuuaacucauaguuauuugaaaauuauugguuuauaaggaaacagauuuagacaaagcuagaacuuaugcagguaaguuacaaagcuagaacuuacucaggcaguugcucacgucuguaauucuagcacuuugggaggccggggcgggcggaucacgaggucaggaguucaagaccauccuggccaacauggugaaacccugucucuacuaaaaauacaaaaauuagccaggcgugguaguggugcaugcugguaaucccagccacucaggaggcugaggcaagagaauugcuugaaccugggaggcagagguggcagugagccaagaucacaccacugcacuccagccuggugacagagcgagacuccgucucaaaaaaaaagaaaauguaguggacacaauacauuuagauuuuuaauaaaguagacauauguuuauugcagaacauaugagcaguugauuaguuaaagauauccaacaugccaggcgugguggcuaacacuuguaaucccagcacuuugggaggccgaggcaggcggaucacgaggucaagagaucgagaccauccuggccaacguagcgaaaccccaucucuacuaaaaauacaaaaacuaucugggcaugguggcacacaccuguacuccuagcuacucaggagcugaggcaggauaauugcuugaacccgggagguagagguugcagugagccgagaucgugccacugcacuccagccuggcaacagagugagacuacaucucaaaaaaaaaaaaaaaaaaaaaaauccaacauugcuggcaaguuugaaggucacagcccauguacaaaauugguauaucuugaggaacucuugucuuuaucauauguucuguaccauuuccuugcacacaacacaguuacuauaugaugguacuaaguagauacagguccagaccccauaaagaauguggcauucaguucuugaacagauguuagagaacacaacccacucggcaguaagggauaucuucaacuagagggaagggugagaguugaccuguuuguccuuuugacucauauuuagaaaugcuaaaguuguuuuauguucaaaaugcauuugauaaucaugccugaagaggucaaagugcugacauuguugaaaacaaauaccccugucaaacaaauagagacaauuuucaugucuuugguugguaagcaccauaauuuggccuuuggcauugcugucaguaaagcuaguugaugacuuuuacaucaauuuuuggcccaaccauaaaugaaggaaauaagaccaauacugccacaguacuuuuucucacucaucacccauaccugauucagcuggguuaauguuaaaagccaaaauuuaucaauaucaauuuuuuucccaaaucauucuuauuuuaguacuguuuaugcucaauaaaaguuuaugaauuucuuucacuguuauuuaaugaaaacccagaauuuuuuaaaauugcacauuaucucuuuaaaaaaagucuuuuagauuacucgugggauuuacucuaaguuguugucuuuuaauagaagaugaugcaaaacuugucucaccuguuccuuccuggucgugucuguguuuaugugugggguggguauauaagugcuuuugauuaacagaaugaagagagugcuuauuuugaaaacucagucguuaaaauucaaguuuauuuugaguuaaagaacaccauauuuagauuaggaauggaccaaugaccugcuuaagcuuuaggcuaucgauuggccuugagggaacuuagaucugcuaaacacgaacuugaaaaggcacuucagugauggauguacguuggaugcucucacuguauggucauucacuugcauuuuaaaauuuauguuuuguuuuuccuuuauaccuacucuuuucauuccguuugucagagguggccauuuaaaguauuugacaauuguuuguucucugccuagcaaguuguccuauugcuccaugaugugaaagaacaaagguaaucaacaguuagaaaccucaggaaauugcuagaaucuucacccccaaagaggguuaauaaacccuagauaauuaguucauuuagaaugaaaaccauuuucauuguaauaaucacauuuccccucugauuaucgagcaaugcauugggaagccugauauuuauucacaaauuuuuuaaaauugagaacauccugugcugagauuccagucagcuucauccauccauuuuuuguuaaaaguuucucaacuaucauccuucauccagacaaauaaacauaaccaggauuuccccucuaacuuuuugggaauucauuuacacguguaccauuuugagggaaaaaaacaauuguccucgaauuucauuugacucaggugauugugguaagcucgcuaaccagcuucaucuaggaagugcagcaaucugagucaacuuccuccaucucuguuuuuacauuguccagugugaugcuuccucauuguaccaaaauagaaaugguuuguuuuuguaucaaacuuggagacuggcuauggauuacacuggguuaggauaaggguuuguuauuuuuuuuuuuuuaagaacauuccacuuaucccaagggaaaaagauugacggccuggggaaaaauaagaggcauaaugaagucuuuucuccuuaaauaaaaaucacaucuagucuucagaugugucaauugcacuauguuugccuaauuucauuuaauauuugagagauuuaguaguaaauuuaugacuuuugcaguuacuuugcaaaaaauugaggaaggaagaagugaauuucacuuugagucaaauguguagguuccaguguaauuaaaccuaaaaaucuauauauucuggucuugcuacuugguauuacacuuugccauaucacauaaugcuauuagcuacauuuuaccuuguuugcagggugaugccauuuuguaucucugguuuguugaauuuccuagaagauguuauguucauguagauaauggcauacucauugaauucuuuaccucagacaugaaaauauguggaaaaguggggaaaugaaucugaucagauuucacuguauacugaaauuugagaaucugguuuuugcaucuauuuugcaugcugcugucucuccaaaccauauaugucugugugaguuuuuauaaugccacauaaagcaaaaugagaagucucuucuuucuucuaaagggaaauagugccacagaaagguagaagucaaauauuuacuuauggaucaaaaaucuaguuaaaaaacaacccauugcuuaccuuaguaaucaaugugaauuacuuuauaaucaauaugaauacaagcuaucugaccagucacucagaaaauaaauauuugaucaugugauaaaccauuugaaugucuacauaugaacccaggccauauaaaaauaaccaauucaagauaacauaggaagucacuaaaaaagacacaaauaaaauuagauuucacaguuuacgcugauauuuugauacuuuucugugauaaaagcaucuuccaaacuaaauguguccauauuugaaccauguaaauaguuaaaaguauuuuaccugagaauaucuaaaugaugccaagaaaauaaguucaugccacuaaaaagauugagaugauuugugcuuuaucugacuucuugguguaauauggauuuacuucagauaaguauauuuucuacuuauccgauaaguguguuuaucugagauaaauauuuucuccagauacguguguauauugaaaaaaaauuuaaaauaauuaggaucccaauugaaaaaguaaaaaucuuaauugcuuaauaagaaaacaguuauuucauagucuuaagauuucaauacaaagaaauaugggaauauacacguaagagguuuguugguguucauuauuaaauugcaaggcugucucaaguuauugucaucagaauaaauucugugugugugugucugucugucugcguccuccuguuaguaauuagaucuuuuaugaaguuguacucauaccuauuagggauuuuugucauugcaguuuuaaguugaauaugacacauggauccuuuguugggucuaagcuaucaccauuuauuacaauuuuuuauaacauuccauauauaugcaucuacuaacuaaacaucagccuuaauuuagcuuaugaauuaaauuuuuuguuaggagugacuccugcuggagagcaaaaaauaccaauuaguuuagcuucuaaauaaacuauacuccuuuuuucaauggacaaggguaaccuccuauuccuuggcuuggcaacauuuacuauuccucuaaguuuaaagaugagaacauagauuugaguacuaacacaucagcagaaauuauauuuuuaaguacauacauaauucucaggccagucguguuuggugcuccaaaaagauuugugauugaauaucuuugcuccauugggaagaguuuagcauggugcuguauuuuuauaauucuuuuuuccauuuuagcagacuucaccuaagucuauuuuagguggagauuuuuuuuuuuuuuuuuuuuuuuuuuuuuugcugcugcucuuuaaggcacucuugcauagaggaaacagcagaggagacacaaggaaaugcacucuccuuuauaacaugcugcugauucucugaacuagguguccucucauuuaagccucaaaagaagcuguguauuaacuagaugaaggaacuaacacucaaaccugugauacagcuuggccagagucacacugcuggggagcagcaagguuacucaucaagaugugucugacccucaaguuuaagugcucugauuuaauaacuuugcucacacccugauuccagugucuuaguagcuuuugaucuauaaaaugucaucuaaggaucuuugagccuuaauucuuugucuuuaaagugggaaugauaauaccugccacagaguacuaguuauggagauuaaauaagugaaggcaauuauuauauguucuuuaaauugugugucacuguacugugcauguauuaagugucguuuuauuagcaaauaucuuuuugauggguagauguuuaccugaggugguuauuuaauuuauaggcuggcuuguucacacuauguuauguaaucauuguauauuaaugaauaucacuauuuuccuuaggauaugauguuuagcuaauucagccaugcuaggcaaaagaggucagcauuguagaaauaagcaaugucuuauacugaaaaaaagaaagacaacaacaacaaaacaacaacaacaaaaaacaacuuuccguguucagugacuuaaacagaaacauggaguuguucaaauucuaccaaguuauauucgggaggagaaaaaugggaauuccuuccauaugaccauucuucauucauucauuuauucagcuucuauuuguugaguugccugccuuacacugcaauaugcagggcaguuuguguguguguagauguucauuagguuuauuugcacuuugcaguaaccauguaauauuaucauuauucagaaauaaagguagaaucuacucuaaugagcucuguggucgaguggauaguucagcucuuuacccuguaauaguuuguuaucuaauuguuuaauguaugugcgauugccuucacaauuaaagcauuauucuuuagucauauuuucucucuuuucucaauuuucucaggaagaaaauugacaugucugugaacccugugcauguccccaaauggagcuuaacccaaaguugggaaucacuaaauaauuguucaugaaaugguugaauauagcucuucauucaagugauguagauucugaauauuuacuuauucuuuaaugcaguuauucauucauucggcaaguuuuuauugaacaucuaccuuguagguaauacuaugccaaugcauuggggguuuuaggucaaauauuucccaguuucuuauaacaaauguauguguguguugucaguucugcuucaccucaaauauaucugucaaagacuuuuuggaaaauuacaaaagaacuguaaacuuuagauucuagaagaaaauaagaaucguguggguuucauuuaaguggucaacacuucuagacaguuugcugguaagaauuuuuuuccccaaaaguggcagaaaaagacaacuggguucauugccuacccccaguguccucaauagugcuuugucuaagcaccagagagggaugguggcuuucuguauaguguggcuaaccaucauuccccaucauuucagcgauaacaaggcugggcauggggggugggggugguaccaaguagguaaccaaguuaccuacugcuggcaagguaacuuguccaguuauacacuacugugaaaacugugucugugaaacaagcaguagacuaguucaggguccuguaaaaauuggcugcuuaagauuaagacuucuuuaaaauuauucugaaacacauggauuuaugcauauagcuucaguuguucuuauacuucuguucuaacuccccacgcaucacacuaaaaauuuaucauggaugauauuucugucacaaagaaaacuucaaaggcugagaucgcagaaaugucucaguugacaagccacugacuugaguucugugauugaaauguacuccaaggucagcaaaccaaaaccaaacaucacuggaugauaauacguucagugucucacuggcuauaauucguagaucaccuuucaaagcauuauaucuuuauuaaucauuguaaauuugugcuuuugaaaucuuagacucguuuccauuaggcaaugaagcccagaagcuuaauguucuagucucauuuuaauuuuuucagucuuaugugcugaauugucaggguuuaaaaaucgauuucaccucaucagauuaaaaauauuuauuuaugcacauguuaacaauauauuaaaagaaaugagagcuucaauuuuaaaaauaggaauuguagcucauuaagccaugacaauuugguuuauauuuacauaauuaauaggaaggcauuuauauguuugcaaaauagguaagaaaagguauuuaacguagaugaagcagaaugauuguuuaucaaaagaguuuagagaucuuucuagcagucuacccauggaaaguuaggaucuagaaaagccuucucaauaagggaagaaacaacaaagaaacaacaaccaggaaacuccccaacuuaucucuuuaaauuccagccucuuuucuaaguggugguuuuuacauacuguccucugguagguggguacccuggccuuguguauuaagcagugagggugguuuaaagguuacaaaugugauccugucagauugacaacuaacuguucuaaugaggaaaaaauccucaaagcaugaaauuugaaugaaaugugugauuauaauucaaguacuguuuacacaaaccucuggggaccuuccgaauaaaugcagagcaagugaguuagacaaaccucugggccuucgauacguguguguggaugugcgguguguguguguuuauuuuagagaguggggaaacuuuccaccauuagcccgggcuuugcuccucggaaccaacaccacuauuccuccuuguuuauuaauacuguauguguuuuguuagcauauugaguuguaaggaaauaggugcuuugaauuauuaaaguugauucuugagaauagauguaugcucggguggcauuugcuucggcauaugcaaaugauuuaguuucauuugggaucaauucccagaggcccuccuuuccugugaugcucugaauuuggcaagcucaagucagcccaucuccucuccccacaucccucccuuucuuucuuuccuuuuuuuguaccuccccccgccuuuuuguugauugguauaauauuuuuaaaagacaauaaauaaauauaucaacuugcuugugagaaaccuugccaucuauaaggauucuauuguucaguugugaucaauaaaggugaacaaagguuuucacguucuuaaaguuuagcaaaaucgaaguuuaguaaaaaugugcaugagauguuugcuaaaauauuuauacagauacugggcugcggggaugcugcaaaacucugaaaauguggucucaggggugccuuuggggaaacugacagcuguaagauauucgucgguucgaagguaccaauaaacuugcuuuagagcccagcaaauagcgugaaguugcaguagauugucuaaagcuacagugaaagcacccaacuccagaguggagaacgugcgcccuuggggcgcccagcgccagcgaggggagcagcgccccagccccuccguaggcucugggcccaugcggcugucugcggcggggcgaggugaaguucaugggcggccgcgcuucccaccagcuccggggaggccggggcccgcggagcccggggcgggccgcacugcuacucuguuucauuccgcaaccccguuuuguagguuguugaccaagcagucagaaaacacugcccccucucuccuuuugagcgaggucagagacgugguguuuuuuuuuuuuuuuuuuuuuuuuucuucccuccccuuucccuccccuuucuccgagucgaguucucaggcagcugcguacaaugcugggagcuagccagcagcagagacagauggcagaguuauuagaugugcaucauacgauucccuuccugccacucgcuuuuuaaucaaauuaaaacaaaaaagaaagagagggagagagagagagggggagucaauuaacugcauuuguauucugcucaauaauggacccuguuccacuuuuacccuaaggcaguugaguggaaauuuuagagaagaaaagggugccuagaacaaaacaaaacaaaaaaaaaaaaaaaaaggaaaaaaaaaaagaaaagaaaaagaaaaaagugaagacugcagaaauuuguaagaaucggcauuauucgaggaacuaauaaaaaccccucggaaaaguugaaucgaucucgcguaugcauuaggauuucgagcuccaucagggccgggcugccuuccagcuccgcugcgcaaaguugagcgucugacagcagcgccgcggccucccccgcccgccaggaauggucucuuccugcuuugcauauucaccacgcuuggcccggccauaugggaaaaugcaacugaaggaauuguugugaaaaaagggacagcgaguuugaaauaaaaguuguuagagugguacugaggagaaaaaagaauccgagaccauguacugcgcauacacaaucccgggcaugggcggcaacucuuugauguacuacuauaaugggaaagcgguaagcgaaugcgggcugcgagggggauuuuugacaaguuuuauugucgcagggaugagcauccuagguggugaucauuguuugcaaaguugugcaggacugccgcaccuuccugggugccaugaaauauuuaucauuugccaauccuaagaucuucuucuugccuacuucuucuccuucgucuuuuuuuccccccacuccucccccagaguagaaaaauagaugcuuucagagcuuuagagaguggauccuagagcgaaaguuugcagucagguaaaguugagaggugguaugauuuuuuuuuuuuaaagaguuuuggaaaauucuuauuccuuccaaaugacuguuagaaaggaaaagcagauaugagaagcagaauugagaaagcccaaguuaggcugagaggaaauuugggguaaguuucucccuggauugagguuuugugauaucuaaagucuuacuaaguuggaagcuugagugcaguggauagaguggagagaaccugaaagguuaaaauagagcaaacacauaaaacugagagaucaaauuaaggaguagauuauauaagcuuagauauauauuuaaagccaaaauggggaaggaaaaacaaacggguucauucaugcauauaacaguauugucauaaguuauuugugcuguguggcuucuucccucaauuucccccccuuccaacagaaacgcuuuauuuaagaaaaaaaugugucugguauuuugugcauaaccccagcagaagguuuauacuugccaucuggagguuuauuuuuuuuuuccuucgucugggcccacugaaggaaaaggauuucaauauuuucaaaucgguauguggggcucucgggaagaguuguugggugauagaggagcaaaaauuuauuguuuuaaaauagaaaagaagaaugagagaaaagugaaaagcagccauuuauaaacuguucucuuuguguacuuugaacuuccauuuggauugaucuuaaucagggauaguugggccaaaggggacagaucagagcuuucaggaaggcccaguucagcuguagcaauuggcgcaaacgaauuaaacauguguaugugcugcuauaugccugugaguguauauacauacagaugcaugcauaacgguuauuucuagaugagcauauucuguaauacauacauauacacaacuguuugaaggugcaguuucagaagauuaauaauuucauuuaagaagccaguuuuaugaaugggcaacuugaaauaauaucguuuacuuuuauuuugaaaaguacgaguaaaucaucaaaaguucauagcgcuauccuauuuuuaucuuuuuuaaaaaagagcacgguguaauuaaaauaguuaagugugguaagggaaauauaauuuuaaaacaaaugguuuucguugugauuugaucaaaguguuuaaaucuguaaacauaaauauugggauuauguaacaucuuuuuuuuuuuuuaacaaguacaugauuugcaauugguaguuacucauauauagauaagacuuuugccuauuaucuuuuagauguucucauacauaacuuauucagcaccuuucauuuuaaagcacuuuuaaugaaaauuuugugaaugaugccaucguagucaguaagcaaaagugucucugaagcagauucagggauuagauagcccuuauccguaaugaaagacuuacauuauaaaagaauauaaguuuccaugguuuuuaucuuucaggauuaccaaugaugugacuuuuacauguuaauuguuaauuuugcaucuuaaauaucugaacugacaaaauuuuaauuuaaguuuuguaccuuuuaacucccuuuuggccaaaaggaauuuucaaaaauauguauuccauucccacagcuugccaguugccuccaccguaagaaaaugcugaauaugacaucauaucacuaauaugcccucucaguugccaaauauuuugguuguuagauuuuuuuuuuuuuugagaggaugguacucauaaaaucaagaucgcucugucacaggaaauguauuuauaggaacuguuuuaaggcguuuauuaaaaacaaaucuggugauguguaucucuauugauucaaacacuagaaagaggcaaauuguacacacauuauaguuagaaaaaaaauagccauuuggaacaccagcagaaagcuuuugaaacugcggauggcuaccaguuguccaucuuagcuuuaugaaacagacagcaaaguccaguugugugugucccaaggaaggggccaauucuauaccauuuuuuaaaaugcccucaugcauacacugaggaagcagauuuuuguuuauucuacaguguguauucugcuggcucuaauucugcauugaguggcuuuugauuuggugccagacauguuguggagauuguauauaccaugcguuaauuguucaaaaugccuaucgaagagacuuuacauuucuugaguuuuacuuaucguuuggagguugaauaucuaugcuuuuuuguguguaugugcaugucuaaccaauguguguuugaaccugaauuguugaaguuaaguguggucagcuauuuguugcacaaguuuuccucugaagagaacacagcacugaauuccuucuuuuuucccagugacaagucaauuacuuguuuaaauucaguuugaacucccugaacugagagaggccagaggaagcagguuuucccugugaauaaacaaaagaagaaaaauggaaaaucauuccaaaacacagugauuuuagcuugugggaagaauauaauuaagcauuacaagaauuaugguuucuucuuuuaugaacuggcaacuauaggguuuguaaaaucaguuguccucuaacuuucuagcagaaauauaaucaaugauauuuuaggacaaacgaaaaaaacgugaauuuuuuuacuaccuuaaguuaugaaguguuuccauguccauaucccacaaaaaaauuuuuccuuguuucugugaacaacuguaccuguccagaaguguggacucugaaaaaaauacuuaacaaaaaaucguaacacaagagcuaucaaagaauaaauuuuggauauaaaccagaauguauuuuuaaaaaucaguuucuccucaggugagaguuucaugaacuugauaaaauaauuuuugugauuuuuuuuuccucuaugcauuagagguuuaaauacuaacggauccaaaucuaagcuuaaaaaaaauuaaagcaccacuucugaacuacgaaacagauuuuuuuuugcagagaaaaucaguagcuuauuuuguguuggaaauacaagcuuguaucaaagugugccaaugugucuguccuuauuaaggcuauaagaaguauuaggcauuaccugcucuccaauaaguguaguucuagcucuaaauuuugaucuuuauggcuucuugcauguucauugaagaagaauuuuaauaagugauuauuuggucaaauuucacauaucuaauauuauagcauauccacgaagauaaaauuauggcaaauaaaacugaaaacaaaaguggcgaaauguccucguaaugguaauugaagaucacaucaucagcucucgccagcaugugcauguguuaaaccguagagagaaaccuguaauuauuguaauugcucuuuuugcuuuauacuaacaagcuucaaaccauguuucaaaguaguuguuuugaaauaguuauuugucaaaucaucaaaucucggaaaguaaaugguaaugagcuuuuuauguuuauauucugacuguuggucauauuaugcagcuuuucaaguccauaaaguucagagaugaaacuggauguuaauuauuucugauaucaaggccaaagaauaaaauaauguuacgaguccugcuuaaggugaaaaauuaggaauauuugaauaucagaaucucucaauugggaaacucucuauucuuagaagaaaguuuuccuguaaauaagugacaauaucagucagcaaccuaaauuuuuuaaagcugaaaauugggguaugaagaguguagcuuuuucucauuuaucacaggaagugcuaagauaaaaagaucaauauuuaaaugacgccacuaauaacauuuuucaguacauuuuacauauggcucuuuuuuuuccccccaaaccucacaguugguuggaacagccacacauaggacauagguagccacuggguuuuaaaguuuccaguagagugucaacuaugcaaauuacauuuggcauuuuaaaaauauauuucuuauacuuacuauuuucagaaccaugauuauaaaugaaagcagccaguauaaaugcuuuuauuuuuuuuaauugcuguuuacuugcuauuacacagcaaaaauuugcuuaggccacaaaguaaucaaauuuuuaaauuccccacugguucaauaaaauaaaacauaucaaagagaaagcauguaggaaaaacugcuuuuuugugagcuuauuuuuuaaauauaguuggcacuuuaauuuacccauuuaaaaauaacaaugaaauuuuuuuuuaugcuucauuacuuuaaaacaaaauuauguugauuuuguucuuuauguuuaagcugauaaaaauucaccagacacuuaaucuugacauuguggcuacaucuugccuuccugccucugauuaaauuuucaaaaucccugcaugagauucacagauaccaguuugaacguuucugugaggcuaauuucucagggaaaaaauauggaucaguuacaucuuugguuaauuuuaucuaguuccuaauuucugcuaggucuaagcauuuuaaauauaguguugguaaagcauccuucugucgcugggugauggcauuauugcaggcagaauuaggagaaaggacauuggcauaggagaaagaggguuggggagaaaaguggucaggaaaaaagaucuaauaguugaugcagucuuuuaaauaccuuuccaacugaucuacaggaaauugugcugaagaaucauuuguuuccuguuccacuauaaaugugguuugcauuacauccccuguucggcuuuuuuuguuguuguuuuguuucuacuaaauuguaguaccacgauggaggcuugagaauaagugaugucuuccuuuauaacuuaucuuuuaauggcuugaucauaguuggauuuuagacacugucauauuucauuauaugaauuuuguauguguguguuuccaagccuacuugaaacuucuauuacugcucugccacuaagaaaaacaaugcugcagucuaaguucuuuagaaucacuauuguaggucaaauacauggucuacaugcugccaucagggaucuauuaaaugaaucucuuguuuacucauucagaaaauuuagagauuuuagaugugguucuggcaauuguaaaaguuguuagaauucagauuuacuuuugccuuaagaagaaaauacaguggagacauauauuugcucugcacagcugaccuaaaugcaugccuuguaccugugagaauuucaguaugcggacacauaaaagauuacugggccuuuuuucccccuccaauauuaucagaguuacaaaauaaauaaucuuucacagucaacauaguuuaaaaguaauuuuaguuuuaagcuuuuucaaguuuuuauauguuuaauugcacuuuauuagcccuuaauacuucaaacauaacucuaagaugacacaggcuaaaguuguauaugauaaacauuauugauuacuuaaaaaaaagggauaucuguauauucauaaaacauuuauaaucuauuuaggaaaucaucauaguccuaaaaaaaaagcaguuguuuguauaccaggaaaaagagaucaguagugacaaaaguggaaaagauacuuguauaaaauugucuccuuuagugugaagugaucuacugaaaguuauacuuggaauuuucagaaaauguccauaguuguaggcuuuauaacauuucaaauucuguaauaaacuauuuggcacauuaucauaucauuuuagguauauagauaccauggcauuuuauuaagcaaaacaauuuuuuucuucugaagaauacuuaaggugaaauuuacugguuuugagcuugaaagugguuugagaauuauacaugaacuccacuuaaacuuuggagacuuuccuuuuugcagugcuaaagauccaugacuugguuccaaacuacaaccuuuuauuugcagauguauuuauggcacaguaccacauucugauuagaauuuaagaguucacauuucugauauuucugucucuaaaugcuguguugcuucuguuuaccuaguuuucuuccuauucuuccuaauuucuuaaagaaaucugcacauauucauugagguauuuaauccaaaaagauuuaaaagagacacuacgccucuaacauucuguuuaggagaguauacuacuuuaaacuccguucuccccaccuaaaaaaggggggcuaaagaguggguuugaacaccugagaagucagaggugggaacaguguagaugauggucuaauuucaggcucaaccaaaaaaaaugcaggcuuuggcuggcauccuccagggaccuagcucugugcuuuccuagagaccaaauuacacucaucuugagagagggcauguugagguaauuggugggagagaguggggagaguugaauuccagcugcuuccauuguagcuguccugaaaaugaauaggggauguuaacaauggaggcuaacauuugacuuggcuuuuucaccuccacaaaccuaagggugagaauuauagaguacugaaugacugcaccaauaaugauccuguuuaagugggaauugcuauguugggaaaaacucacaccauuuuaaaaauaguugaugcauuuaccaaccacaguccuauuacuguagcccaauaaaguuuauccacaguauggaaacacuccuuuuuuuuauugucagccaucuaguguguguauuggaucuucaccucuuugguuaccauuuuaaaaugcuccuacugaaagacauuuggaaggcaccagaaucccaucuccaagaagggaagcaagauacaagugcccuguacucccuuucuccuagaauguguggucuuuuuuuuuuuuuaaggagaauaaauacuguaugacucaauagcuuuucuaacgaauaaaacaaauuaaauugauguuacaugcguauuuaaacccuauccaguuaaguacugaugugauuaaaauaaucaaauguauuacuuaaaaaauuaaaaaggauaaauucugcaccccauuauuuuauugacuuuuaaauauaaauugcagaaauguuuacauuccuaauggcauuauuaagcuaaacugacaaaucagaggaaaaaguugauuggccagcacauuauuauuucugcaccuguuauuacagaaguggaggcucagcauuaaaggagcuggauggaugcuguuuucuuaggcuuccuuugugugauguggggguugggauaaauguguaacaaguguaguuucacuuuguagugccuuuuuguguguugaugugauuaaaagacuacaguguuuuucaugucgcuuugaaauuaauaugcaaauaauaugggauauuagggcuucccucuaccugcugcacuaagcuucccuaagccaaaugggguggggauuggugucaacuuuuuucauacaaguuguuuaguugcaaauaucgccaacguuuuaucucuacucugugaauuuguaagggggggagggaaaugucaaacucauugaaguaggauugaagaucugggaugaaaauacuuuaaauuuuuauuuucuacuuauauaucagccaggauguuaggagaccuugaaaacauuuugaaaaaguuguguaacauuaccaaggcuuugguauaagauuauacuuuucuucugguugaguucuuccuuguauuaaucaugcaauaucauuucucagacacuugagcccggcucuccccuggagcauagguggcaauaauuguuuguuauuauaauucuagaauuucuuggguguucauuguccguaauucauuucacacagagaaaucuaaacuuucuucagccaguagaauaaauaaugccuucccuguccuuuccuuuucuuuuuuaaauuuugaguucuuuaggaaugucauuauagucuuugaaacguaaugacauuaaauuuggauugaaggggaagggagaggaacuuuuauuucaugccauccaguggcuaguuugaguuugcaaagaaauagauacaaugccauuauuuucugcaagauacuaguuaacacuauucucauaucaguuuagacuuuguccuguguaauaauuuaaauuccuagauuuuaauaacacuuaauauguagcauggaucccacuuaaucuccccccggcuucacaacaaaauguuuacauaaaugaacucucaauuuugauaucaacuauuuaacucacucuuuccugaguuaauacuuccauaauuaaacauguuccacaguugccauaggaguguaucuuaaaaaugauguucuucucuguucuuuugagccaucuguuugcuaggucaguaaagaaaugggagccugauuuuauuuuaaagccaauaaguuauuacucuacuauuguauuagacauucagcuucagagggaguaaaagauaaaauuccaucacauuuccacuuucuuacauuugcagcagaaacuuguaugcucaaauugguuauuuucaacucaugacagcugugauauuuaaaaugaucacagcuguugugacuuaaaauugauuuuucuauuaacaccugagaaaaagaccugugccguauuaaaaacuuaaauaagguaacuguaaaauuagauguguugaugugaaucugguaauccuacuucccagagguugcaaagugcagcacaccucuugcaugcuuccagggaaugagcuaaaacugcuagaaauagaugcaugauuguuaaaagcguuuacauuuuaaaggauuccuguaauagcagauccucuuggcccaacuuuacagugucacuuuugcugauaaaaucauuuaggauucaguuuccuuaauuaaccccaagaaagaugacuuacaugaaucauuaugauauccuaaccucuagacuagagaagcugcuuuaccuuucagauaugacauugaaaaaugcaaaaccauacggaauuguuucuuaugaaggaaguuuugguuuuauggugcuuuuccuccauuaucuuuagaugacgaaaaaggaaaaacagaugagaaaggacaaauagaucauggcuaaguagcuuuaggcuagcacuuguuuuuggaaucuuuaauacauuuuuaaucuucauguugaagauccauuuaaccuguuuuaaaguuagauggugauuccuggguucaguuggucuguuuaaauguuuaccuuuucaggauaauccguauuagaaucuugcaucucucaauagauuaccuauuuaacaaaguaaccaauuuaagaaaaccuaaacacauuuauacauuaagauauuuuccuguuucgaguuagaugauguaguauauaaaauauauggcuggccugauguggaauuauguauagacaacagugucuucacagaugcauugccaauagggagcuauguagauuaaacucuuuggccaguccuaggcuuuuuaccuguguaacucaaucagaauugaaagcaugacagguuuuaugaugaugaauguauggcuggauuggagaaaguaugguuggguggguagauagauggauagauuucauaacuagacaguaauagauaaugccaauuauuuauuacucaaacuuguuuauuccucagaaauuuuucugcagaguauuauuuugauuauugcauguaguucagaacauuuaguugaaaaugauaaaauauuugcugucacauaaucaagacugcuauagaguugguucuaaaaguuccagagugaacauacauuaccugugucaaaguuagaggcuaagacuauggagggccauaagaucacaaagucagacuaucacauacuaagugaucaugggugucaauggcuauuuccuuguuuaguugaaagaagauacuccucgagauggacauuguuuauaugaagauuuaagaaaaucaaaguggauauuuguugcugacagacuaagauuacaaacauauaucuuuagaacaggguguuccccaggggacauacggcaauaucuggaaacgcuuuugauugucacaacugugggggucaggcaggagcuugcuacuggcaucuagggcuggaggccagggaugcuacuaaacaucuuaacagcgugcaagacagacccucagaagugcugagguugggaaguccugcuugcaaagugauauaucuggaccuuaagaauuaaauaaugucauaauaaguuccauaauuaaaucuuggcauugugaggcauuuauagaggauaacauuuuuuuguuuuuuuucuuucccuuucuauuucccuuuuccuuuucuuuucuuuccuuuuuucuuuuguuuccaaaacauuguuuuuuguuuguuuguuuuggcauagcacacuauagcauugcccagguauuucuacguuuuaccaugaaaacgugagauuuuauaguguauuaaauauuguacauuauuugugaaccaacuggaauggcuucaaagcagcuguuagaauauguugagucaguaacacaacaugucugcauacccuaaacauauauuugucuuaccuuuuaaaauguuuagaacccucuaucaguguaacuauugguuugucuugaaucauccuaaaugaggaaguguauuaccauuuuuucccuacaggacauaaaguggaaagaagaaauuagcauaaagaaacuaauuaauaauuauguuuuaaguuuuuuggcauuacggacauuguuuacaucaucauuaacaucauaacaucauaucgucuguuaucaagaaaagauuaaaauuuaaagccaacauugaagauguucuuuccagcuuucccaauaaugcaacuccuuuaccuccucacaacuggggaccucucucccugccacugcugcgcuucuccucaauguggauaauucuuggccaugauacggaagugauuuugaaaccucaguugccuucuguagcacccuguggaggaagguggcaggaucugguggcugagucuuacaucugccaacuucuagaccucacuccuuaggugccacauuuuggagcuaguugccaagccucacaguaacuugagccacucuucaauuuccuccccaugauauacaaaguucuccaagguuuaaugagaguagauauggaggcugggcacgggaauggcagcucugauuugcaguauaucuuugguguacagauaugcuuucauuuauugcuuagcccauuagcuaauggaauuucaauuccuucccacaggcauucucagacccugcacuucacucuuccuguuucccuguccagcuugguacaacacauucuaguaaaaucacacugauguguuuagguuuacuuuguacaucacaucuguaaccaucuauaaguuugcccuaaacuggcauuuauuuugaacugucuuccaccuuuuauuguacagcguugucuguacucaaagugagcaacugaaaagaaaauuuuaacauucuuuuugugugccagacaaguaauaaagauuacuauuuuuaugguaauuuuuuuauuugaauauuucuguuucuggaagaugguaauuuuuuuaaaucaugaauuuccuguaagugaaacuauuugagggaguauugaccuuuuuuugaucaaucauugauuaucuguguugcacucucaguauuucucuuauaguccauaugucccucugaauaauuguagaacaauaacuugcuuacacaguguuuuuagaauaugcuucaggaagcuugccugugugguauuuaacucagacauuuauggaguauaaaaccaaucuuacugugacuuuuaauuauuaggaaaguggcuuacaguuaaaauaaagcuuacagaaaauauuguagcaauaauuaauauccaguaaaauacaguuguaagcuucgguucuuucagacauuuucucaacccaguucuaauuugaucguuacugcaccucaguaagauaggugaugcaggagucaucaucccauuucacaggcaaagccuggccuguucagugagguagccacuggccccauguggcuauuaacauucaaaugaaggccaggcacaguggcuuaugccuguaaucccagcacuuugggaagcugaagcgggaggauugccuaagcccaggaguucaagaucaacaugaucaacauugggacacccugucucuagaaaaaguuaaaaaaaaaaaaaaaauuagccaggcaugguagcgcucaucuauagucccagcuacuuaggagauugaggcaggaggaucauugagcccaggaagcugaggcugcagcaagcugugaucaugccacugugcuccagccugggcagcagagcaagacccugucucuaaaauuaaaaauaaugauaauaauaauaauaauaaauaaaugaugucagucaaugagaauuaaauaaaacuuuaaaaagaucacuuccuugguugcacuagccaaguuucaauuacugaguuuucauauaugaucaguggcuacuguauuagcacagauacagaauauuuguaucauuguagaaaguuccauggggaggugcuggccugggaaauggaagcauugagggauuaaaacuugcugaagaucaugugggucaugacagaauagagucauugcugcuauauauuccaauaggauauuuuuacauuuuucuuagcuuuauugucaaauaucugauguaagaauugacauuuuaaugcuaccuuguagcacuuuacugaaugcuuaucucaacugaauuuaaauuuagagcuugaguuacacaaacuuuucaaaggauacagcccuuugccugucugcacacaauggggaccuugaauuuccagccagugauacccuccagaagggaccaugucuuaaugcaucuuuguagaccuuuuggcauauuguagacaaccaagaaauguuuaugcagccuaaugaaugugucacauccaccauacgggcauauguccauacauacaguuagacaagaccuuuggguagaaugcucccgagagagcuggugucugccaaauuuuacagagcucaugccucugcucuugcuguuuuaguaaaaaguaguauuuuaucaaaaguuaaauuggguucaauauucaccauuuggguaauggguacauuagaagcccaguccccagcagcaugcaauauuccauguaacaacaagcacguauaccccuuggaucuaaaauuuuuuaaaaauauguauuuacucacauaauccaaauauuuuucauaguaaaugaaaacgucuguccaucuuguccuuagcagucauuuagucccuaaccugacuuuguguuguuauaaaguugugucacuuaaguaguacuuaaguaaguacauaccuacauccauacuaucuuuccauuuccugcaucacugaguuggacaaaugugcccaguuagcguugguagugcugaagaccauguucauucauacaugcacucaaaaucauauuaauuacuuuucagugauaaccauagguggcaacagaugaaugggcuagcccuaggcuauuauuaagcacugggaaugagauuguuggugccuuguaccugugcuacuuuaacaggugagacaauuccagagcuuuccccaucauccucucguugcuacagucuagacauugggagcacuggaagccuauggugacacagacuggcagaugccuugggcuucuaaugguguauauguaagccaucauuuuguuuguaauaauuaugguguugagaagcauuugugugcugugcacucuuucagcuugugccacguuuaguuccuguuaugcaaauaccacuuuaaacuuagaaauuccaauuugcauuaauauuuugguuucauagagcuaacuauugcauuucacaaacaagugcauuuuaaugaguaccggcagaaugauuuaaaaauguuauuuauuaaauacuauuguagaaaaugcagucuuugguugccagaaacuauuaagacgaaauauaauguguguugaggccacagaguacaccucuucaagaguauuugacccuuauggcuuucagugauacaacagccaaugcucuucaugcaggcuuggagggcagagguaauuaauauaaaauagaagccagcguaccauugacguuuggguuuacuuuuaaaauguaaacauauuuuuacuauuugacauuugucauaagaccauaggucauuuaccucugaguuaaggugaaggacuuuaccagucauaaacacccaaguuuuaaagcaguguuuucuuauaucuuacaucuugauguuaaauccugaaauggaguuuguugcugcuuuauaauuuuuuucccucuuccuaaaagccuuuuuuuaaaucagaauuguggauaaaaaaauuuugauguacaaugugugggaaaauaaaaauuuugcaacuggauuuucagaaaugaacuauuuuaacacauggacuuugaaugcugcugucaugguugucauagcuugugguuccuaauuauaaugagcuuuuuuggugguguuauugcaguuguuuuauucccccugcccccacccagucuucaacucacuuuucccagaaggagaguuccaagccuuugaaaauucucaugauuuugcaaauccacucuauuuuugucuagaauacaggaaaguuaaaacuguggcugguaugaugccauguuuugaauccaauuuuaaagcaacccuuugcaacccagggaguaaagcugacaucuuuguaucuguaaugaagauaauuauaccugcaaggugacaucacuagcaaaguaacaaauacccuugaaaacggaguuccuggucuucucugaauucuguagaccacauuuggcauuuaacaccagacaccucuuucaugccugucguuugagaaguugcuuucagaugaauuuacuaaagcugacugacacaggguuaaauuaauucuuuucuuuauuacucaaagugauacagaccuuucuuggacuaauguagcuuaauuaguggucaauuaaaacugaacauugcugaauugaaguucuuugaucaaacucccuggcaugggcuugcuuucuuuaacuagccaccaucuugaauucauuuggaaucaguaguauaaacaaguuaaaaacugguucuuuuauaagaaagucagcaggcuuguauagcugugguuucuuuuuuuacuucuguaggcggcaauucaaaggcaugcuaaaugaaaacaguacuacacccugaaaaaauuacauuuuuaaaaguaacacuaagcagucagaaaacagucaacacccuuaccuguuuauucuagauacauuuaucuucuauguagaacaaauaauuaauaauucacuucccaauuucagugguugauuuuguuguuacauggaaggugaaaacuccccacccucccuugcaaagucuauaguuauaacaaaaagugaagcaaacaaaauccaaccugguuguugggaguagagucggaaggggcacgguaaaugaaggugugcccaguugcuccuaaauucauucuuugucacucuugggaaaauaguucaccucuguaucuuuggagugggagugacacacuacuucauuuacuuauugauuucaucauuuauuuugaagggcauuauccuaucaguauggaaacugauaauagcauauauuucauaugaaucacuugauuaaaaauacacauugcuuuuguuagaauuugggugaaguuacaaaaaaagagaauuaggggagcugaaaacuggggcagaggaaaucguaagcauugguaauaagaucacccaccuccauuuauccaguuacaugucuuaauauuuaaaguguauauaccauucuugucuaaacauaaauugauaccauuccguaauccuaguuuuugaaagcuuaacaaccaaaaacauacauccuagcuggcauucaguuagugcugugcauucuggaguauuaauugaaacugguacuuuuguacuggaaauaaaaguaauagauuagguuuaaauagauaauuugcuuaguucauagugauuucuucugguuuuuggaaauuuucacagagaaagaguuaaaggaaauuuggaagugaccauguacaguguucccccuguaagugacagaauuuuugugguuuucauuacuuagaucgaaaaauuguaguuauaaucaauaauuaaaauuaaaaauuuuaccaguugacagaaagagaaauuguuuauagucaaugugccuuucagccuucucucuugccuucucccuaaaaggcugauuaggauguaauaauuggggaugauagcgggaggaagacgacaauuccauuuaauuaaagauaauuuauuuuacuucaaauuggugaugucccacaugaauaagaguagcuuuagcagauagauuuauuaauggguacugacaucucaguugacagaaaaagcaaacauuuucuuuccucauuguuuuuauugugucccgucaccugaaacugcugucaccaugcuuccuuugcugcuugacagagcuguagacuuuuccaccaaauaugcaauuauugguuuaucauugaaacaaaguugauccucuucugaguuaaaaacuaggccaggagcuugaaaggcgguucaggcuuucagagcuaaugcuacaaaugcucucuucuuaaaucacauuuucucaacugauccuucccauaucuaguucaugaguagauugaaccuuuugaauaaggaccaaagauuuccuuuggucuugggugaggugcuugcaugaauauuccuuuaauaccuugaaugucuuggauaaugaaaugugccccaaaaaacuaccauuugcauuacuuagguucauuccugacaaggaauucugcccucgugugauauguucguuguugucucaugcaaucguaaauggaucuuggaaguugggacaguuuuuuuuaauuaggaaguagauucaagaaaugcaugauauuguuuuucauauaaucuccucagucuauagugguuguaaaggugugcuguuuagcauaccuuuagcaaaacuguauuuauaauucuauguaucuuaaggcacuuuuuaaaugcuucugacaaacugcauucuguuuuuccaaugucuauuugaucucuguuacauuaggcuuauuugucuuacucucacaucgaauuccuauauuuuuguuuauguuuucugguguucagucauuucuguaugcuugccuaguauguuucuuucauaccgucuucuucacugaaugaaaugcagaccaccuuggccacuuccuuccuucugggcuucuuuuccuauucacaacuuccgccauucacacugacccucuagcuuuacuuauaucuauugcuccugcugcuuuguugcucuaauuuucauauauauuuccuuuaugcuaauauccuuuccuuaacucuuuggauuucacugguuugucuuuccagcuuuauuuagaaaauuaggccauauaacuaauguuuacaccguagaaaggaaaaugagauucuuucuuucuuuuuuggaagugaagaggugagaagguugugguagagguuuucuuuuauuuuaaaccagauggauuuauuuuguccugcuuugcuauuucacuauuucaaauugauuuuaaaucagugaugguguuuucaaggauuaauuuuuauuaaaucuugauuuucaugucguguuaaccuuuuccuuccccucagccaaagggucuucuuccuuuuuucuguccauuucacuuguuuguuuuaauaaccugaucucuccagccauuauuuuauccucaaauccugccacuuuuauccaucuuuuuuuauugcacuguuguccuuacuucaccuuauaucuuuucuucuucuguaauuauuacagaauccaugauaccuucuccaaaauucuaacaaagaauucuggaaaaggagaaauugggaaagagaaaaauugcaaguaauguucuuugcugagcccuaggaagucugcuuggauuuuuauauucgacugauauuccucccuagaguugcagucaugauucuauguaguagggacacgaaggcaaaaguuuaaauagacuaacacugacccuuaauuggaggugauaauccuacauauaaacuuucaggagggaaagcgauccugcauuuuacaucagguaaacucaguugcacccauugccaguagcugggucagguguguagggguguguguguguguguguguguguguguguguguguguguguacguacugggagccagguuggaaguaggaagagaaggagguucuucuuuccucucccacuugcaagcuauuuucuuucuuuucugucuguuuucauuauuucuauggcaaguuuacuugccacgucuuaaacaccuucaaccuuuuugucucuuccuuuacuuuuuugcuuuacugcuaucaaagaguuaaggaaguccauuaaauuggaggccauuccucaccauaagagaaaucuggaugggaugcuuuugacaacugggcucucuuuaguagcuucucucuacuugggaaaaugucagauauuuugagaaauaaaugcauugccccaaacugaaaacaccacuuuuauucuguaaaagaggcauucagggaaggagaccuccucuauucccaggaggucacaggaacugggaguggcaagaaggaagcugcuaaacgggcuccagaugcagcuuuauccaggggacgccucaugccuggucauuuggguggcugggcuugucccaccuccccuucuucaugcccuccucccggucucauccuaggcccucccaccccuaggccagccacaggccucacagcggacaucugcgggucugaguuucauauauccagcaugaaguucccucucucccucccauuaugaauucugggcugugguccugcuugcuccuugugugucagauugaaguucugaugcugucagccaugucugaccaaucagcaaacaacaccacaggaugaaauuuaaacaaugcagaugcucagauacagggcuauguugccuggaccacgaagggaaagcagagguaaggucagagucuccccaaaguggucuauccugagccugccugacuugacaccucuugggcugcacugugcugcuuugacuuguauguuacccauuugcuuugcacuacuucugucuucccuggcauucaccagaacuuucauuuuaauucgcucugcccggguuacuuuaccaccuucaucugcucacguccuuuucuuuuggauuggugcugacugucauuacgaauguuccuggauugccucguggccgaggguccuuggcaagugccaccuuguucaggucuuuuguggccagacuuuuaggaauagaggacugcugaggaucagggcaaacggacggaguuaauaggccuuauuaauuuucccucugcaggacaguggaauuuaucauucgguuacaaccacgguuuuguuucuuaccauugugauguauugaauuguaaauugagcuuaaaucaucuuuuuuucucagaaacgguuuacuuagaaaagauauaaauagauacaaccuaaacgaggaugaaucagcucaucuuccaagaguuuuggagggggagaaagggaauugauaacucucccccacccgaauccccccccacuuuuuuuuuuuuuuuuuuuuuuuuacaguuuuugguguuagcucacuagauuacuguuugcaaaagaagaaucucaucaucauccucuucuguuuuaaguguuuacuuggcccuuuuauaauuuaaaguguuuacacgguucugugcucccuaggcccaucuggaaaauauuuaaacuucauaagaucuauaagacuagaauaucacauauaaugggauagggggaaggaagaaaaauuagagccguugcguguguuuagaauaaguuaguuguuuguucagaagcggcugcuggaggaauuggaacaaauagcugugugcggugaacgauuggguccagagcuguacauuucaccacagaaugagccuugguuugugaaacugacauucuguugugacuucuaaauccaaacaaaucucugcaaauuucugcccgaucgaguuaauaagaaaauauauacaugcagaggcgagagccguaugcuacuuguacuucugucaguguugguggaaauaagagacggauuuuaccuacuguauuacauucaaccagcaauuggcagaacccccagcucagcggguuuucuugacuuuuuuuucugcugugagaacaaugggaugcaaaagggcuucagaaaaggagagcagcagauacgggauuggggucacuuuucuucuaauugccuuguaauuggggagugguuuccacuuucccacuaucucacuggugggaggggaggaagacagauguggcuuagcgguaacgagcuuucuccaggccggaugugcugagggaccaggggggucauucccugcucugggccugugaucugcuucacaccugugcucauuuucccccaugaucgaugaccuuguauuaacccagagugaccuuuugccuucgccuguucucugggacgagcucuuggcuaguggacccuccuuucucucugauuuacaggugguuacuggagccacauacacuuguuuuucauggugcacugugcacuuagcagcccggcaagaccugcaauuucaucccucucaaggggccaagcaggggauuggaaggugggagggaggagggugccgcgagagugguugcuguuugcaugugcuuuucuauuuuguggcucauaugguaucaauuaccauuugauggcaacgccaggccugaggcccuucgcauguuuguccugugagaaagaucuggaagaaccgacauaugguuuugauugcagcaauugcagguugauagaaugaacgcaggggugagguggguggguuuuccuuccggcccuuuccacucuggguugcuaaugugcuucgcuuguggaacuggucuuuucaucauccagccccucccccacuuaccccucccccacccccaacucccugccacuuugcauucccugccccugccuuccaaaugaccgccaggaacauguggcccacauuaaggaccuucaauuaaaacaaacaaaaaauuguccacucuucuguucagucccagagcaggucaguccaucaagaugguuggaaguguaccacaguuaagaaacaaaugguuggcauagggggcagauucccuccagaagcuugggacauguuuuaaaauggcuguuaguucagauuguuaaacaucgaaaugaugcugaaaaauagcagcaauagagauuaaugugggguguguguguguguguguguguguguauaucuguauguguguguauuucauuuaagacaccucuuggaaucugugcaucugcugcauagggacaggaagaugaugauaauggauaggaguucuuugggguuccaucuuucuguacaucccaggccauaagaugauggaaaagcaagugaggcaugugugucucuaugagcauuucccuucagaaggaagauguuggagacucaucucccaugcacagugacuucucucuuacuaaauuugugaugguaggggguacuccucauuacuguggcucagcagggauugcaucugugaauaugccaagggagggucuacuauuggggaauggugagaggcaaagaggagaaaagaacauuauaggcacuuugaauguuacccagcaacauuuuuuuuguuguuucaaaguaacaucuuucuauaaugcuuucaaauuuaccugucugguaaucuguucuaagaugggcagcccaugagguuuugacuuuuuucacuuuggcuauugcauuucaaaauauuacucacaauuaggaauuuauaccauuugaaacaauaaugugguaucucaugaguaaaugcugccauuaacaucuuccuucuuuuaaacugaaaacaagcaaaccagacccaaaaaaaaaaaaaaaaaagcagaaacaugcucccccaagaaagcuuguuuuuuucuuugagauggagucucgcucuguugcccagguuggagugcaauggugcgaucucgacucacugcaaccuccaccucccagguucaagcgauucuccugucucagccucccaaguagcuaggauuacagguguccaccaccacaccuggcuaauuuuuuguauuuuuaguagagaugagguuucaccauguuggccaggcugguuucaaacuccugaccucaagugauccgcccaccucggccucccaaagugcugggauuauaggcgugagccaccacaccuggccaagaaaguuuuuuaaaugugagaugaauuuuuaguuuugaaggccagcuauugaaaccuaaucacacugcuugacauacuucuucauauuuaucuuuauauuagagcugaucuuuaucaaaagguaguagaaacuaaaaaacuuaaguuauugaccuaaauuguagggaaaugucugucugaucgacucuagagagaaaauuggccguaucuuuauaaugguuacugaauguauaucuucaugaggcuacaguuuuuuuuucuuugcuccaacuuucuccuuaugauguagagauugguguauuaaauaaucacuuuuucaacagucuugaugacaauuuuauuuugcuauuucauaaucuucauacaaugggauaaguguuuucagagauacguuugaauucagagcaacuggcaauuaagugauuugcucuagucacauguuuuaguaguagcuauuugguuauuugccugauauuuaaugcacacauauguacccuuaaaucaucauucagugugauagcuuaagacaacauuucuguuugcugcucaugccacuauuagcuacguuugaagagugauauacugagaaguuuaauuugcugggguuuuuuucuaaaaacauugcuuuccugaaauauauaguauugggggcucauagcaaaaaaaccguaguauauggguugugagccugucuucgaacauggugggucacuuaacagcagcugugcuggagagauauuugauuugagaagacuguuuugaaucuucucagcccuaacaccauucugguuuugaaaugggaaaauggaaaagaguuuuagggaauagagauaucucagccuugaaaggaagcauagguagaaaucuuucaguucucacucagaugaaccagcauuccuaaucuggcuacccucacagaggacaaagagucugcugggaaauguggguuuauauuuguagagacacacuucagaggcaugagauaguguuagauaccgacuggaugcuucgugcccaacaucaauuugguuugcagauugaaauuuaggaaagcuugcagaggagccaaucuuuuuuauauacagcaccuuuaaaaaaaagacuguccacuacuauuaaaaucugauucagucuucuaaaauauuacuacauucaagacaacuuuuaaaaugaucaaauuuagauagacaucaaugauguuaaaagauaaaagcccuccuacauguaauauauagugucuuaaaccuuauuuuuuaaaaaagggauaccacuuuugccaaaaguuucaauguagggauacucaaacuguccuuggaaguccuaaaaauugcuaguuuuuuuuuuguuugcuucuuuuuuuguuguuuuuguuuuuuguuuguaguuauucacaaauggagaaauauuuauaaaauuauauuauaauuuguaaugcacgcaaacaaccaucagaccacacuugaaucagagaguuacaguuauaaauugaggaaagaggaugccagcacaaugccuaauggagugaaaaauugugcuuauuuucacaggacucucuuggagaggagcuaacuacuuuccucucucuuaauacccagacccucucccucagcccugacagcacguuacagaaugcauucacuuagugugugaagagcuagcucaccaccucccuuuaagaucuauucuuguuauucauacauugcaaauuuguacuuuuguauccacaaggaagacauuacuaacuucaagaaaggcagugucaaugaggagcaggaaaauacaguaugauacaagccugccaaugaaagaauuauacucagacucuaugcgcucuguuaaacaaaauuugaaccuuugaggaaaaaauauuggggauucugaugaguguuuuuacucuuucuuuccuuuuuuuuuuuuuuucuauuuggaaaucauggcuuccugauccuaagggauaaaaaaaaaaaaaaaaaaaaaaaccucaaagaaaagacucaacaggcuuucuggacaucaaauaguuccuacaaaacaacauucugaugacuugcauguaaagaaaucagaaacauaugaauuaagcuucucucgaaauacauauggguugaaaaauagagagaagugcugagaaaauguguuuuggguuuugcugagcccaugacguuugaaaaauaguaugagacauugaacaaacacaaagcauggcuuggcucacccauuccuaauauuagccuucuaguucaacggcaaaucaguuuaccaugugccuaaaugugagccaccuuggugcacucccccacacuuaauuauaugcaguuuaaauuuuuucaauuaggagcucaaaaauaacauugcauuucaaggaaaugcaaaucuuagcauuuucuuaccugguuuguucaccucagaccauuuuagaaaacaccacagauuauuucaccuuaggagcagucacacugauguggcccucuuugauguggcuggcauauaacagaagaaacguaucauuuuuaagaaacuggcuccaaagacaauauugcuauuaaauugaagccaaaaaccacugcagguaaaacaugaugaagaugaaggacgcccucucuuagccauauaguagaagcccgaucauagacucucacccuuacaccaugacuugaguuccugcucauuuuuaucccugagcucugcagacuucuaagcaguggaaguuuucauucucuuucccacauugcacucaagagagcuaacaugagagauucuaaauccugggauuccucugcaucuggcuuuaaguacaggagcagaacacagggaauuuaaggaacaaaaauagccagagcuucaggcuucuuccacugaugguaagucauugacaugcacuuggaugaaauccuguaucuguucuuuggacuagcacuaucgccugagauuaucaguuucagagaguuacagagaggcaguagauuucaucuuuccuauuucaggaggaguuauuuugguuguuuaaaaaaaaaaaaaacacuuuaauguacuuuuccuaacuccuucacucagaugguggcaagaaguuugacagaauaaaguaauucagcuaauauuuaucaaaugccuacuaugagugagcuguuagaauauaacccugaacaagacaagcaugagauaggcaaacagacuauuaaaaccuagacugauaaugcauugauugggguguacaggcuccuuaagguagauauacaaaggacaacuaguccacauuuggccuuagaggaagugaagugcaaggaugaaugggaauuaagcuggcaaaaugcaaggguuauaacuggaagcaggggugagcauggcauauccggugacccagaaguaguucagaaugccagaagcuuaugguacaaaaggauaacauaaaagaugagacugaaaagguaaacaguggccugaucaaaaagcgacuugugagcccuauuaaggaguugagauuuuaucaugaaugugacgaggagccuuucaaauggguaugccugagaaguaauugaauuuaaaagucaagacggauaggaggaccuggaaaacuuagagucagagaagccaagggaggcagaucugaccagaaggaggaaauugucaacagugucagauguugcugaaagauagaagugacauuuggcugcagcauccaggaggucuugagcaguuucauugaaguagugaguguggaaggaagguaaagaaguggagaacaggcauugcaagauaauuuuccaucaucgucaucaucaucguccucaucaccggaaaaugagcaucaauuaucuuaucuaccagacauagagagugaccagguaaggaaugacacaccugcagccugggagauuucagaaaacagaucauaaauauaaaacagaagacagcaacacaugguacaacacaugcaaagggcaaaaugagcaguguaggccaacgggaugaagaacagaaagaauuagggggcaggugaaaugggagaguuuuucaagcagucagugcgcuugagguuugcauucuggauugugccuccuuauaagucaguccaaccuguuuuugauucuccauccaguggaaauaggaaacaccaucaaagaugaugcauagucuuaacuugccugugacuucugauuauguuuccgaauuuugggaggaagauuaaagucauaaacugacucuugguuuguuauaauuucuugcaacuguuauuuuaaaaauccggacacaggccaaggcaggaggauucucugaggccaggaguuugagaccagccugggcaacauagugagacccugucccuacaauaauaaaaguaaaauaaaaagaaaaucuggaugcagaaacugagguguagauaaauauagcaagucagagauauucguaaauucuacaucgaugaguuucuugagaaauucugcacacccagugcuggacaacuguggaauugcagcgugauaccuuucacaucugggucaucuccauaugauaucuucuuccugguacaaggccagaaguucaccccacgcacaacaccuauggaagccacuuacgauucaaaggacaguuuuucugaaaaagggugcaugauguauacuucccuucaacacuaaaauucugcugcuuaaacuuuguaagugaaggaaaggacugguucucuucuacuuuggcugucuuccuuguuuccuauuuauugggugcuugcuuugggcaacccauuguauuggaugugcucuaaaccacaaucuuugcuccuaaggaguccguaguauuuaucgggggauacgaccuggauaauucauauaagauaugaauuucuuucuuuuucuuuuuuuucuuuuuuuuugagacagauucucacucugucgcccaggcuggagugcaguggcgcgaucacggcucacugcaaccuccgucuccuggguucaagcaauucucaugccucagccccccaaguagcugggauuacaggcacccaccaccauacucagcuaauuuuuguauuuuuaguagagauggaguuucaccguguuggccaggcuggucuugaauuccugaccucaagugauccgcccaccucggccucccaaaguccugggauuacaggcgugaaccacaaugccuggccaagauaugaauucuaaaaaaaaaaaaaaaaaaaaaaaaaaaaaaaaguccuuggaaaguuuagaagaugaaauacauuuaaugaaaauugagcucauucuuccccaauauuuguuccauauuccucuccauauuauacuauuaguacacaauccuguuuggacuuacuggaaaaaagagcugaauagcuuauccacaugucaagaaacuuucuguuuaagaacacugagguucaucaacaucaaaaaauauuuucagcaucauucaggcacuggacaugcucuacaaauuaaauaccuuagggccccuacuauuucaguguuuucucagugucuuguugcaguggcaaaugcuaugaacuacauuuuucaaaugaauauugaagauugagaaagagguuaagaaccucuaucuauuaacgauagaaccaaaucuagaaagaugucuccugcucuguagagcacauuagggaucauuauuuauagccauuuggcucucuuaagacauuuuggcaaugagggaaaaaucauagguugauuuucuugguggaaugaagaacauugaguuugcuaacaaagagagcaugagugacuuugguaagagagcaguuuuuauuucaguggaaaggcagccuccucuccuaauaauagcuacauuauuuaccuaaauguuccauguagcaacugauaacaaggcuuacugcuuaagaaauuuggccaucaucuuguccucucuacuagaauuccaucugccuacagaugggcccuugcuaauauuuuuuuucugaaggacaacauguaacuuaagggcccacuacuguguguuauuuuguuuuuuuaauugaggugaaagucacauaauguaaaauuaaccauuuugaaguaaaccauucaguaauauuuaguacauucacaauguugagcagucaccacaucugucuaguucuaaaacauuuuccccagcccagaaggaaacucuguauccauuaagcaguuccuuccuaucccccuacuucuaggcuuuauaaaccuuuaauuuuaauguuauauacacacacaggcauacacauacauauaugcuauacacacauauguauguauauauguauaauguguguaaauaauguguaaauauagacguauaaagauguauaauguggguaaauaaauggauguguguauguguauauacauauauguacauguauacauauauacguauauauguauacauauauguaucuacgcacauguauauacguguauacacacacacacacacauucaugucuauuuauagauuaggaaguuccaaacagaggaccuaauauuuccuaauuauguaaacaaagaacuaucuacuuuaaugaauguuucuccaccaggaaaaagaaaaauaggaaacauuccuugcuucuuuuaaccugucuguauauuucucuuaaauucucacuagaugcuaauuuaucaaggaagacaaaaaagacagaaauaauccugagccuuuuguuguguaaaacugcugcucuucuuguaaagacauuuucucauuaauuucaucaacacugagaauuuuaaacugcuucucaauuuuaagcaauuguauggguuuuacauuucuauuuuugaaaauccaaaauuauugaacaaaguaauuuaguuagcaaaguuuacauuucuuggaaagaaauaugaaagggucauucuuacuauaauuuuuauuguuaaagaaauugcuguuguucacauguauuuaugcccuccucauuccggaagaauauuugagguagccaguagcacauuuuuuugaauuaagaaaaaauuagaucaaaugaaaaaauaccuaaaauuuaaauauuuagagaaagccaacucaauuauauuuuaaauaugccugaagucgugaacuaacuaauguugaucauuuagucuucugguccuaucucaggaauauuauugcccuucuuaauucaucuuucaccuccuuuaagaaguauuucugaauaacccuauaggauaacuuccuuuacauuucuuuagcucauaugguuuauacaaaaggcuacucacuuuaucacauuuucuaguugcuuauuguacuucauaaaucucccaacuaguuccuagugaaaauucugcccuucuaauuuuuuguauguaauuuaccaaagcaccuagcuuugugcuagcuaaaagcucugcucugaguuaaauuagugaaauauugcugguugauuucaccuaaaaguuugccccgggcaggagggaagagggugggcauuugaauggguaacagacagagaagcagcugauuggacauagauguugacaacuugcauacuuauuuuuuucauuucaaucugugccacagagucauacauuugguaauuauuucaugcuuuuguuuucaguugaaaguaguuagggccauauguuuugacagaaaaaagauaauucguacuuuuuuucagcuuuaugaaagggaagaugggguaacaauuuuacaguguaccauggcagugauuccuguucaaaacuuuaccagauuggaaacucacuguucauaacaauucucuugguaagcagaagaugaaggcaucuguuuaaagcacccagaguuaaguuugaugcuucaaagcacagcagaguucauuuauaacucuacuuagcacuauuagauaucuuuaacaaauaugaaaaguuguccaccagauuccuuagacuguaggugauuuggaaggauauucuggucaagugcuaacuucugacugaggauuucaaaugaaaagaccuagguuauaaccccauuccugcccuuacucugucuugugacucauggaaaaggaaggcacuuaacccgcuccaagcuuauguuccugaauguauaagauggguagcaugguugaccacuuagacagauaauccaucucaaaaugaugauuaaagaagauaauggaugagaaaaguccuuuugauuuaaaauacuaugaagaugugaacuuuuaauaaugacuaaugauagaauuuugucaaauuugcuuuacguaauuaaguucaagaucaaagaauauaucuagagaaguaccuauguauuuugugaaauguuucuuugaguauuauuauuaucauuuuaugucuguuagaaucuuggccucacugucuuuucauucuugcuugaaugucgacucuucaaagugugacuuucugcuugugucugaugcaacuuucuuccugaucgcucuugcuuccugagaaggaauagguacuuaggaaugauggcuuuuuggcugucugugcuuauuagguacaaacacagcacuaaagacauuugggacuggagaaauaagaagagcgccuuuaggguuguaugcaaaaggucaaacuauaauguaguuagcauuuuucuuuguacugcuuucccuucuuguaacaaccucucaauacccucauaccuucucugcuuuccagaaaugcuuucuaaaaauugauuauugggaaaagaucugagaccucauugcccugaaguguaauuacugcugacaaacugugacagcauuucccaaagacagggagugauuggagaugugaugaaaaguggguuugugacuguggaaacucuuucagggauguaggcuuuuaccccucuugguaauguaccuugacaaaagucugcagcaaugaaauuaacuuguucacuccaaucgcaucuaaaguuauuugagcuuaaguccuuucuuaaggaugucagcuuuaggcuucaggcaucaaccuguggacuagaauucaaagggaaaaggguagggaauggugcucuuaaaaucuuuaggaccauuauagguaauuccauauccuaaagaaagcucagcccuaaacacauuagagaaguggaaugcacuaaaauauauuuuggcagaaccaaugaauguuuaucuuucucuguguuaugauguuauucuuaguuugacguguaucccaugugugguguguuuauucauucaugcaugcaugcacuuaguaaaguuuugagccuauucugugcccggcauuacaugcacacacacauauguccaagcacaccugcacauuuuuuuuuuuuugguaaugccuuuuuuaccuuauuguuucugcaacuggcuauccuuagcaggccuucuuaauguacaauaggguauagaagaaauaacaaucaacauuggaguaaaccuaaaauuaauuucugucuuuauuguagagucauagaauuuguuuuccucuggaagaugugcugcccucauuuaauugauaaaacagugcuuucagaggucacaaagcuauuuuuuggcagauauaaccaaaccuauuuugauguuccagcaccuccuaaugaagcaguagucgucaucuaaaacaaaaagcagucgguugcuaaaggaggagaaaguguugagaugugagaugaucuguuagacauaauugacaaucaugaauuugauaugauagguguaaacagagauagaaauaauuuaguuacaucuguuuaagauuuaagauaaccagaagcaauaauguuuaauugaaauaauauaucagguucuccuuaacauuaccuugaauuucuucacaugcacaucaaugcauuugguaaauaaaaguuuggaaacaacuuaguuaaguguuuagaacauauuagaguugugaugugcuuagcauccgcagucuuuuaucugugccaacccugagccugguaaugaagccaacucccacaugaauaaguaacauaaggaguguaaccaggaagaagucaggguuucaccuggaccaaauuuuaggcaauuaaguguuucaagagaucuuuagccagguguaacuuaaucaguuuaaggcacucucagcuagggccaagguacucauaauguuggcagugggcauucgucugauacaccacguugaaaguaauaggaaacauagagugucugcucaguuauugccaagagcaagagaaaugcagguguaaaaauauaaagaaguauuuggagccagaggcuaguacacauagacaagacuguauuuacacuuggcuuuaauaguucagauaauaacauggugguuuuuaaucaguuuagugugcugauauuuagucgugggucugguuucaccacuaaacccuaguguaacucucagccgguuacuuagccucucucugucucuaguaauauuaaacaaguguauuaauaccugcugcaucuuagcucaacuucaugucuggaagacagaugaaugguccugcuucuugcaguaacacacaagaaccuccuuugugcugcccugacugagaugaucuuguguucuucucuacgggcaaaacagcccuaggcugcuaaauggccaggcaguauaggggacuuaggacucuacaaagcuggguuuugguaggaguccaugagcaccgcggagagaauucuuaguuaucaggagauacgguuguaguacuuaaaaacucaaacuccaaaacaagacuacgugguuuugaaucucaguuuugccaguuuauuagcugugugacuuuaagcaaguugcuuaaccucucugugccucagaucccuuagccauaaaauugggaugaucaugcaacaauaggauuaguauguaagcaaaaugaguauauguacaguuuggcugcaauagagcugauagguguaaacagauauaaauaaugacuucuuuucugaaaaugacuucuuuucuguuuuucucguuggugaucccugcuuaugucacugggauggcugcgggaauucaguaggauaauauuggaaaauagcuuaaaucucaaauguucuauagcuaugauaacaucacuaugacgucauagcagagugaguccacucacaucucuccuggcaguuuugcugccucagaguuggaauaauaacucacugaaaauacuuccaaaauagugagccacucugcagauuuaauuuguaauauuauucuuucuaauuauuaguggcucugucuuaaguuccuuuguuuuaauugaagcaggguuuuuuuucccccuuguaaauuucuauacaugucaaaggcuaccaacucauuuuuauuuagaguuugaaauuugauuugaaaaauauacugcagccagcuauaugaaaaacauaagaggauauuguugacuuuugaugaagggaagaaagaacaagguagagcugccuagccaugaagaacgccaggguuuuuguaaccccuggugugcuuugcacgcagaaggcacacacuuaaauuggcauggcucacuuuuuuuacugugccuuugcugagcuugcugcaggcugagugcacugguagaggagugcagggcuguguucuggccaucccugccugcucaggccucuccugcuccuuuguggaucgcccaggucucugcugcuuccuggugccgucuccuggauccucuugacauuuuuccguucuguaauuugauugacaguuacagacaaggaaggggacugaaauucuuaccguuuugugacuuccuaaaacgggaaaggaaauuuggugaaugagaaggggaaaacgccucuuggcugaaauuauuuacaggauuuagccccagguuuaauguacucaugaaugaauaaugacucagcugauauuuagaagccgggaaaauuaugcgauuuuugugaugggguguauagauauggauguauacuugaagugguuuguguucuaaauauauuaacaugcucagggaauuucuuuuuggggaaauacauauauucuuuuucauagauuuuuguggugcauucugguagacggaagaugggucauugcucaguuaguaaaaaugaaauaugaauaucauacacauaagugguacauuuuacacuuuuugauaguugugaaauacucuuuuuuuuucagacuaccaauaaagagaauuugaggaguaaaacucuucuuaccaugaauuguuuuggggcacuuagaacuauuuaguuaauucuuuuaaauacuccaacugauuuagauagaauaaaagugucacaauuuuaacagcuuacaccagugaaauguuuccacuuauaagaaauacccucuuauuugucagcauacugaagacauauauguguuauuucuaagcacauuuccuauuuaugugauaauggagaucgcccuuuaaccaucacuuggacgugaaggaggauucuucuuccuccauuaguaaauauuccuugacuugauaauacugaaaauaugugaggugaaugagcuuuaauccugugguuugguuugguuuuugguuguuugcagucuuggacuguucaccugcacugucuugugccuuugaguaugauuaacugccuugacgccuuacagugcauuacacaacucuacuucuuccauuucuugacuaaucucucaugcuguuugacugcccauuggaaucuuuaaguuagcuacuuaggaaagacuuuaggaaggagaaugcuaagagaacuggcagagaagucaggagccugggcucuguccaggcccuggcguaaguccuuucaccucuuccuuugacuccuuuacaaaaugaaguugaacucauucgagcuuuaaaaagaugacgccaagaggcaagacagagggcaguagaugugaaaguaacaugaaagagaaaggaacaucugaaaaaaaaaaaaagguagaaaaagauuuugacaaauaguacuaaaaacaaagaauauagaauagagagacccaauuauacugauaauuacaauuaucaguauuguaaaaacuacagcaaaaaagcuaaaaacauauucagcuuuuauuguccauaaaaagugaucacaccaugucuaacuguaauucguuugucaaaaacacuagaggccaaggacuaaauugcggauuaagaguuucuuccuuuuauuuccugcauauccagaaaccuggggucauagauacucuuccaugguguguuguuuggcacaacuugcaaguauuuuggcagaugguuagaaaaaaagacuuuaagaaauaugcaauaguacucaggacucuaaauauaauaaauaaagcuaagauaccaguauccugccauucauuacaaucaacauuuauugaacagcaguuauaugccagguagcagggauaccuagaacuugccccucccacuagcacuccagaagaguuccugcuuucccagccuaaagcaacagcaagucuuacaugagcuaggcuuacugugauagcuguccugacggcgaguggcaaacauggcccagugccuuccucauggaugaacaugacucuacacugggacuccccgguagaccuuuuugugaugaugagaaaguccuguguuggugauguucaguaugguaacuagugacuguaugugcuguugagaacuugaaauauggcuacugugacugagggacagaacauuuaauuuuauuuaacuuugguugaguuuaauucaaauaacuacauauuacuaauggcuacugauuggacagcagcuuucuagacccauuguuaaaaauaauuauaagcaaugaguaccucuuaugagauagaauuaauaaucccauuuauugagggcccaugacagauuaagaauuauguuugacauauauuaucccuaauccucacaagaaugguucauuugacaaauaagauaacugaaguucugagagauaaauugcuuuguuauguccucgcaaggaauugugagagcuggaauuugaaccuaauuggucagacuccagagcugggugauuucuaguaaucugccaaaucuguguauguacuguccggaugcugugucuucugaguacaucuucuccuugcuuuauggauuaguuagcaaugucuuuaucuuggucacauaggacaguuacaggguccaucuuaucucuucugaauauggacguaucacugcacuggaaccauucauuuuucuuacugaggccuauguccuucaaaaaauauuaagaguugaggguccaacccagcuucuugaguaguaagcuaaucaccuacaaguauauuuccccaguagaugcugagagaagcaucaaaguacauggguaguucuguggacaucaguggcacucaguaaacucuuggcauuugaguguuuaacugucacaguugaggauaucugugaacucucccaaggccugagucacugaaugagcccagccaguacuugggcgucuguggcuccauucugcuuugcuguuuucugcuuuccauggaacauacaguaacucucuugaagggucugaaagccucaauuacaacguuucagugauucugaacugauuuuucuuuggaaaguauauaugcagaugguacuugcagaaucaccaggggguaguaacguggaggagugguaaaggucuacuggacaaucagguggcuaccacccaaccacacauggugaugugauaugaagccacuuuucuuuauuccuucagauuuaagguuuccccuucaggaagcagguuacuuaacaaguacuugauuucaccauaacaugcauuaugacauuaucuuuuuuucuuuuuucuuuuuuuuuuuugagacggaaucuugcccugucgcccaggcuggagugcaauggcacgaucucggcucacugcaaccuccuucucccagguucaagcaauucuccugccucagccuccugaguagcugggauuacaggugcaugccgccacaccuggcuaauuuuuuguaucuuugguggagaugggguuucaccauguuggccaggcuggucucgaacuccugacuucguuauccacccaccucaaccucccaaagugcugggauuacacgcaugagccaccguuccuggccgauauuuuauuuucuuaaaaggucauuaucagaugccacaagaguauuucuauaaacuaugacccaaguauagccuaauguuaauagcuuaaaauagguuuuauuuaccuuuuuugcccuuuaaaagcaaggaauuauuuuuuaauggaaagaacauagacuuugaugaucaguucacauccuugcuuuaccccuugaaaaaugugcaaccuggaaagacagcuuaacauuccugagucacauuuguccaaauaauacaaacaauggcaacaagacuucagcacuaaugucugauguuuuuuguaugauuaaucugugccagguuccauucuaguuucuuuacacacauuauaccaucuaauucucacaacaacuuugcauagcaggcauugucauuuccacuuuacaagcaggaaucugaggaccagaguuaaaaguaacugguccaagauugccuaguuaauaaaugguggaauuugcagucagacccaagcugguuugggccaauacacuugaccuucuuaugauacgucagccuugugaaauagggcagauacuauuaauaauauccaccuugugugaucauuaugaagguuagauauaauguauguggaacucuugccaccaaagugguuccacaagaggcccuaaacaaaugaguaaucauuauuauuuuaaaauguccguaagugaaaccgauaugccaagaccaguaaaaaugagagcuucuuaaggaaaagaguaggaggcauaccuuuguuucauuuuguuuguugguuucugugcuugcuuuuuguucuuuucuguuaggcacagguuuuauuuagaauaaauuaaauuuuuuuuucuuugaugagugcagaaauaauaguuggaaacauugaauggaacagcuaauguaccauaguaauacuucuuggauuaccaaaaaaaaaaaaaauuaaaucuguaaaaugaaaacauuuuuguuuacuuuggucaguucaagguucaguguuaucuagagauuuuuguuaaacucaggauuucuauauguaugauugucugcuaaauucagaauuagaagagaagagauaauggcgcuaacuuugcauguuaaauauacuguguuacuaguuuuccaugaaguuuuuacucaacaaauagguuacuaaaagagcugugaccuaugaguuucaccaagucuuuccauuuccaauucggcaacaaaaguuucacacuucucaauuacucuugugggaggaaucagaaugccaacagucaccuugaucuaagcguauuauuggagaaaaauucaaggauagauauuuguuucucauuagauuuuccucauauuuuaucauuggggucacucuaguacaugguacuagaauuugggauuuuuauuucauuuuagauuggacugauuuucugguguuagucauuaaaaauaauuccaacucuuugaagagaucugggauguuuguuauuauucuauugauuaaauaaagcuauuuuauuuaacaauuguguuguuaaacuuucuauauacuuagaauaauaauacuaaaaacugaauggguaugagcuuuucuuauugaauuuaaugucaguauuaaauaccuuauugaaacccauacuuugaaagcuugauugagaaauuggcaaaagaguugacugaaguaaaaguaaugaagcaguucacuggucauccagguuaugaaaaauuaaaccauuagagauaaacugaacugugaaaauuaugaucaugguguuuucauaaauaccaucuaugucuccgccaccauucuaaaaaaaaguacccuaucaaauggugaaaaauaagagugauguuucugugaccauuucauuauucaguuuucuuauauuugaaaugugggagguugaacuaaaauuuguugguucccuucuuuaaaaaaguauaguuauaugugauauuuauuuauuuauauaaacaaaaauauagagaucuuaccuugaaaauaacuuuugagguaagaaugauaaaguaucuaaauggaagaugaauaacauuguaucugauuuguaaauuaugauauaaagaaaauguauaaaauauguagaaauugucuguauaaaaaacuauaaacagugguccguugccuauuaacaaagaguuucauguuaucuaaaaagucuucaauuggcuaaaacagcagaaaaauagaaauuacauacuauaauauauccuaaaaacauuucaauuccauagauacucuucuccaugcagccaauauuuaugaauuuggaguaagugaccuacucuuagauauuugagcuugauuauaauucauagucaaaguagccuccuuguaaauaaccaaaauuaaccaaagauuuuuccuuaucuuccaaaagcaaugccaaguaauucuauccaaauuggaaaaaaaaaaagaaaaaggauaaaccuuauuaggugucaucaaaugguguugacauaaugauauauauguuuaaggauaauguaauagaauauguaauuaaaauuaaaguauauaugaaaagaauugauuuuaauuguuuuaaaacauaagaugauuuaauaauaugggucggagauucuuuuuaguuuuauaauaaauauauugauuucugaaauuuggguauauuccauaguacacuuagcuuauguuaauacugaggccagauugcugucaggcuaauagcguguagauauauuauagucacacuacaaucauuccgucaguuuucaguuucccuuuuuccugugauguuucuuucaucuuguuagauuauucucaagaccuucucuaaauaccuucaguaguaauucacaaacucuuuguuaguuaauaguucucaagaaaauucugagaugugguugacagaacuuagaucauugguuuguuuuuggauuccuagccaaaguuuuauucuuuguuucuuaaaaauacucaaaaaaguuuuuuuuccuuauuguaagcccucuggaaauagaagcaaaucacuguuuauacauuuaaaaugugaugaaaauuacaaaauaaaguccagugaaauauagggcuuguauccauuagugccuuaagaaaaaucccuguuuucugaagugcgagugggcuuuucugguuuguuuuuguuuuguuaaagcuccaggaccucccaauuuucaagggcacuuuggggcauguguagcauuuauuugauguauggauguagaugcauauuuucccacaucugucucuguggaccuauccuuugugaaauccuaaaccuuguauuaaugcuuaguuuaugauucaugguguucugagagcaauuauauaauuuuucugggguguuuauucgaugugcacuguaaaaaaaaaugagaguuauuuuuugguaacccugcacuugccuuuuuauuggugaauuucuuuuccuuuuacugugaccugugaauaucacuguaggcucacugccaauuuugugagccgcugccugcuucaaaauggaggcaggaagguauccauuuucaucaagaggaugacaguguuucagucuuucugaccaucuggagagaggaacuuugagagcaaaagaaaauggggauuaaaaaaaauuauauuuagcagaaaaggcaagggggaaaaccaauuaaaguuaaacuauaccuuaugaauuugugcuuuucuacuaugcuguccuguuuaaaaaaaacauaaacaagaaaauacacaggcuauuuguauaaagaauugguuucccaagucucaugaguauuaguaaaugaauguaaguaaauuagguuuuuggcacacuuuuuaaguuuauuguacacacaaauauaauaagcaugaaaaaggagggcucccuccucccgcuuccuaugcacacacugauuguugguggucuuauguagauccaggcuuuuaauggccuuuuucaugcaucucugcaaaaagcugacacuaugggaauuuaauauucuaagauauauuuaucacuuucugugguuuggauaguucauuuguguucucucugucuccccccucccuaccuccucucuguaaaagugaaaauuuuaauugaaagguagaguuuuuacucuaccauuugaaagagguuugaugcaugucuuucuguuuuuaccauuuucacaugcuuaugggccaucuguguuuagaagaaaaagaaagaagugcuuagacucacaggauuacccuaugggcauuauacaguguauuuacaacuagacaugguuuacaucaacuggaauauaacacaccugguuauuuucuguucgcacaaauacaccgagcuuuuguuucguuuuguuguguuuguuuuaguguguucggaaagggcacuguuucuaggguuuguucagauuuaaacuggaaaggguagaaauguagcacuuucugccuacuucuuauauaagaauggagcuugggcugcuguggucaaugcaaaaagcaaaacucaguugguucuuucuccucaggucuaugcuccaucagcaagcacugccgacuacaauagggacucgccaggcuauccuuccuccaaaccagcaaccagcacuuucccuagcuccuucuucaugcaagguaagaugcugcugcuucugagggaaaggccacuggauagcauuuuccugggucacuuaaugucacagauggggcagaagaaauggaauaguaggcaaguguagaauuuuugaagucaugcucuucuuaggaauugaauuccuuaaaaauugauguauuaauuaaaacuguacuaagucuuucuuuacaauuaaaccccuuuaagcaguaauggguuaagauuagauugaucugcuucacuuagagccgaugcuuaugauggucuuccacucaugaccaaccauuucagcaucuucaccauccccaagacgauguagcuguuuguuuagaagugguucagcuccauguauguuuugaacauccuggauuuagccaacugggaacaaguuggccuaauguauaaccuuauguaaaauuuucacccacuuacuaauuuguagguaagaacaaggguccaagaugaaguaaccuaccacagacuggaauauuacauggugaaagcucugucccaacauaguaacugguuuaggauaaaaggcccaacuuuugggggagaagacaaauauaggaaauuauggaauuguccaguauguuuaaauacauggaugugugcccccacccugagcuuguagucuugcuacugauagcguauaccuuucugcugcucaaaaaagaccaagauguggccgagugcgguggcucacgccuguaaucccaacacuugggaggccaaggcaggcaaaucacaaggucaggauaucaagaccauccuggccaauauggugaaacccugucuguacuaaaaauacaaaaaauuagccaggcgugguggugggcaccuguagucccagcuacucgggaggcugaggcagaagaauggcaugaaccugggaggcagagcuuacagugagcugagauugcaccacugcacuccagccugggcaacagagcgagacuccaucucaaaauaaauaaauaaauaaauaaacaaacaaauaaauaaaugaauuuuuuaaaaagaccaagauguuugaaaugauagcagcuacuucaagaaugaaccacuuggaggaugccccuaagggcuccauccugauauguguguggcacuuauuuucuaauguaauuaucuuguuaccaaguuaaugcccugaauuuagauguggaauuuaccaagaaccccugugugcaaaauguuaacucuuuuugcccaggugugaaaaccuuauuuguauaagccuugucuacgggccaugggguuuccuucuuuaugcaucucuaggaagggccaugucacaggaaggggagcacauuuggggcaaagaguaccagggaagcagccugauauaguggacacacucaaaaucauucucauuaaaagauacuaaucuuccuucccuucaguguguuagcucuuuuaguuuguuaguucacgugugaaauuccauggaaaucuauaaaauuggauggaauggcucuguuaggaauagagagaauuuguuccacgcauaauagagcccgugugucagaaguccuuuaacuuugugacccguccuagguguaacucaaagggacacagcaggcuaugucaccugggugcguuuugugccgugacaaaaagcuaaucaccuucaguuauaaacaguagcuaccucagcaucaguccccuguuuugugagcagugggagauauuguccuacaggagcuuacagagauuggcaacucaaggauccaucacucaaaacagauuucgauugaaaacauugacggaaggauauauuuuuucuaucugcccaggaaaguggcuuucuggaagggugcacauugcaggagaggccagguagauuauaucaguaggcuccuuucccuagcagaccacacaaaauauggggaacaaauuuguuuaucugcauaugcauacccgaaaagcaaaaaaaaaaaaaaaaaauugaguugacauuuuugaugagcacaauuaauuugcacacaucuaauucuauucuuucuuucaaaagaacauuaugccaagaucaugggaugugauaaauauuaauuuacugugaaaagcauaauuuauguaaaauauguauuuuuauaagucugcaucaagcagaguacucuguguuaacaguccuaaacgcauugccacccaggguaucacauugucaggagacucuuguuuagugauauauguuuucaauuuauuugucauaugugccaucuauuuaaaauguuagugaucuugaacuucauauuugaauuuaaggugacauuuaaaccucuguaaucuaaggacuaaagcucaaguacaugaaugauaacuuuaaaaaaaaucauguguuuucacaugauggccacagaaacaguugcaucaugguccugucccacaucagcuuccuuucaguagagggguacuuggugcccugagaauucaagacuugaaggaauaugcaauuaaggugaaagauguucagaaacugucuggggcauauuguaaacucacuacuguggccucuuauuuguaacuucaauuuccaucuucuaguuaaaacucugaaguugucaaaaucacagacaugauuuugcuugcaugguucuuaaagagaggaaucugcaaacuauuccucccaauaugaaaugaguccaguuacaaaauucuaacuuccggauuuaagaacucaaugaaaaagagcuucacgaaauacagugucagauuuaacuuuucuauugccuaacuuuuuaauaggccuuuacuauauaaaauguuauggugaaaauaaucuuauuuucaaggaagcaauaucugcuauacauuuaacagccagcugauggccuaguguauaccuaguacucaauacuuuuuguuaaacuauugaaacaaagaaaaaaugaaugaauuuagcaguaauguagaucaucuuuucccuuaggcuugggaaaccaaaccuaaacauuagcaaucauuaauaauaaccuguaggccaauaggcccagagaaugaaaaaauccguagggauguuuuuaauaagaauguuaacaaaagguuaaccuuauguugaaagauacuuuauauaauuuuaaaccucuauaauucauaaaucguuuuauaaaauccagagacucucaaaaauaucuguaauauaauagcuaccuagggcauguuuguacccuuuggauugcuacugaagguuuaagauagcuauauaccuauacaccaaaaaauaaaaauaaaauauccuaagaacuauauauuugagauucaucuucucugcaugccguaauauaauuauaauuccaacuuuaauucuauuuauuguauauguuaaaaaugaaauuaaacauuuucaaucugagauuuuuuaaaauuaauacuucuuuacaugcuuuuaaaacuugucaacuuuguaauuucucaaguacuuuucaccccaaaguuuaggaacaauuuaacuuuuuaguugguuuucauagaaaaaacaguuagaagacuucuaagaaauguuuccuuuagcaguaauuaccuugcgacuugacauaauucaugguagaaauauacucuguuguucuuuuacaguucaauuuuuaccaagaacacuuuaacuuuuuuaaguguuuauauuuguuugacaauauagagccacuugggaagaaaugaugacugucuucugauguaaucagcuaaccaacacaaagaugaauaacacaacaggcagucauuuucaaguauaugaaaaaacccuauucuauaaggcaaggcugaaugccucagaaagucaugguugucuuuguccuuuacagauggccaucacagcagugacccuuggagcuccuccagugggaugaaucagccuggcuaugcaggaauguugggcaacucuucucauauuccacaguccagcagcuacuguagccugcauccacaugaacguuugguaaggcagacauacacgguaacgggaaugucacagcuaguugauuaaaccucguccucugucuuuccaugcauauacacaaggacucugcaaauaagugcaaaaauggcacacacccauuauucuuaaguuguauuguuucugugaucaaagacauaacagguucaaaucaccuuuguaaauucuuccagauucucucuggcauuguucuuuuguuuauuguguuuugcucugugccuucuuuaucacaaugucagcuuccuuggguacauaaauagauaccuauuuaaguuguagaaucuuaacauggugguuccugguuuuuuuuuuuuuuuuuuuuuuucuaucuguaguuucaaaagauguacugcagagggcagagugacagucgguagauuauaugcaucacccaggagcauuucauuucccauugacuggccuaugucagcuuuggccuguugugauguauccaaaagaaggaguuuguauuuucuguagacuuccaucaguaagagaaaccaugagguuucuacauagaucagauucccauuuuucaguauuuuaacuuuaauucccaucccagccugccacucauacuguguuuugcgucacuccaggugaaaacuggugggcucuagaauguuaggucuuucauuacuaaacauuuccacucuguccaucaccuacauucaucuaucauaguaugucucuuuauccuggaggaaacaacucagcugacuuucuucuagccuuaaauaucaccacagcccagaauccacuguugaacuuaagucugucauuaaagagaggaaagagccuagaucuugagugagauuugggaugcagauaagaugaaacuugaaucccuugugcaagaacauagcuuaaacaauauguggaccucacauccuacaaaugcgaaagcauaugggaaauccagugaucccaggugauacuuacaucacuacuauucaucuugcauuugccccuuuuucuucuucucauaucuacacuuagguuucuuucucuguucugauaaaggaaaucauucuggauucauguggucuuugcucucuuuugcucaaccaguacagauaagaaacaggaucugaucuccuacuccaauaaucaaaaaaauuccagaaguuaagauuucugauauccuugaaaauccguauuuaguugguccuagugguagagaugcuaaguagucaauuagccuauacauuccugagaggcagacaguggaaaugguauuggccuuuuuguaucaccucccaagauugaauguguaaaucacaaacuaucucacauuucagcacauuuccaguaaauagcagaugacuuauuuucaaauuuucucuuuucccaccuccuauuuggagauauuagagugaaagcuuagagaaauaucaacuauaucaacuauuauuaugcuagaauccguuuuggcuaaaauuuucauuucugcaccaucauuuuccacuucugugggaacucauggucaaaacuguauguguccuaugagcaaggaaaguuuugauuacaaauaaaaguuuuaggcacuauaccgcauguuggaauuucaguucuuuuaagaguugcccauuugacauuaauuuuucuucccuucuguguuucuuucuuucuucuccuaucaugcucaagaguuuugaguuaggcgauuugauuuuauccuaguccaguucacugcaugggaaguagcuuuaaaaugugcuuccaugcacaaaaaguauaauuucaaaauggaaaccaacuauauuccuuuuagaaaaaauuuuacagaaccaaaacaauauuaugaacuagagagaaaauaucauuuugaaguaguaacccaguaggcuauaucagaagccauauuugcaaugccauuuaccuaucacgaaacacaggauuuucauuuuucaucugaacaguuaacagauuucagagaguagaguuuuuguuuuaaaggagacaugaauaagcuaucuugcaauguauacuaaugaauuuucccacuguuagugaaacuauugaauuauuauaucuaguugucauuguacuuucaguauuuaaccaugugaaaaucuuuuacugaagugacuuagaagaaucugacacugacaauacuuugaauauauaguagcaguugguguccuuucaguugaaaauaaugguaguuccuuauaauuuuauucuuagcaucuggcuagccccauacugaacaaagggauaguuuaagaaaaagcuaagcgcuguuccuggauuauuugggguauaauuuggccaaguugauauuaucuguaaagauaaaauauuuuaaaaacaucauugccuucaucacuuuaugccauguuauaacagaauguguaauuauaaagcuuaagauccacauauuucaguagcgacugucaaguuacugauguuuagucuuuaaauccccuuuacaguuuuagccuguccaacagaaucccacagcuaaucauuacuguguuacacauacccacacaaaaucacucagaugaauggaguuugcgguuaaaguuuggaauggguuguuguagaugauuuuauguuuggaaugacuuggcagaguucuuuuuaagaacaggauagaguccucacugucuggcaugauuuaggcauggucuuugcacuacagggcgaaacaguccuaggagucuggaauuuuccuuuaaaggaaguucuguuuucuuuuauuuuuuuguaacauaaacccuuacuucaguaauucucaacugauggcaguuuuucccuucagggaacguuuggugaugucuggggacauuuucauuguuacaacuaggggcuagaugcuacuggaauccagugcguagaggcuaggggugcugguaaacaugacgucauguaugggagagccuccacagcaaagaauugucuggcacaaaagaucaguagugcuaagguugugaaauccugcccaaacccaaagcaugauuuuauucuuauuuaugugcaccaguuauuauauuuuucuaauguuugaauuaucaaccaguauaucaguaauggaaacauuuccaacaauuacucuguuaauagacacgaaauacaggacucuugggcaucauaaguuaaaaugaacgaauagugggcauguaaagccucgcacuuugucacacuccucauguccuuuguagcaagcaggaaagacaguaauagcuggaguaagagacuaagaggaccucuuauaguuuaucccuaaauccucuaaaagagacauuauucucugugguguauuuauuacaucucugaaugacaguaguuuucaagauaguuuuuaauguaaaauaaucuaguuauaaaucucguuaguuuauuucaacaacuaauuuucuaugagucucuaaaaauaacugauuuacauggauuccauugguucacuccuuuauaaucuauggggauuaauuuuucuuuuuauucugugaacucagcguuaacccuuugucaaaucccaaauuacugcccauuuuacauaaaguuaaaagggcccaaagauucucaccgaugugauuaucuguuuuguuucaucuucugauuauuauaguuaguuaaauauuuauaauucuucuccucuuuuuuugauuuuugcacauuucaggcagauuuguaguucgucuguucuucagaaauuccacauggaauaggacuguguagaagugagguuaaaguuagucaucucuuuuuuuguucuuuuuuccacauucuguuucuuuuccuccauuuuguuauagugcuuaccucuauagcagaaauaccucuaucccugcuaagcuuucagaauagcuguacuauggaaugggcccacuauauuuuucauuggagaaaauuccauggacuaccuuggguguucauuagguggcaaguagaaaugaguuuaacagguggccuaaggaauuuuggggucaaggaaagaaagagguccauggaauuuaaaaauuugaaaggcauucucaggaacuuggaaagauuuaaaggcaucaucucaacuuuuuuacggaagucuuuuaaguugggcuauuuuggucauacagagguaauauuuucaaaaacauucaugcgucuuugaaaauccuaccucuaauacguagauucauuuccuuagacuaguuggcucucaaauaaguuauacuucaauccacuguuuauuaaauucugacugauaaccaauuguucauugagcguauaguauaauuauguguucaguaguuagccacaaguugugggaugcagaacuauaagcucuauuccuuuaaagaguuuacaauacaggugaaaauacauuagaaaaagcaagaaaugaaaggccaaauauaauuaaguguuaaagacaauagugcagaauguaagugcauuagggaccuagagagaagagaugguggaagaguuggagguagucagggacucuucaagaaagagguagaauucaagacggaucucacagaguaaacagggcaacacucaagagacuaugguuucauuccucgugagcaaaugcuuggguuuuaaauacccgugacuaucagcaucauauucaaucucuuauuuugaaauaaacaauuuuuaacagcauuuccaauaaugauauaauaaagacucauaauccauuaauauauugcauaugaagaaaaaguguauuuuagcuuuaauauauugccuuuacauaacacauucagaugccuaugagaauaacuuuugaagcugcuuuuuaucuugaaaauagcucagcacuuuuuuguaaauuacuauguccauuuuagugagcuguucauucccaagcagauggguggauugcaacuaauuugccaccuuacaggcacuguggcauacccaagaaacacagcuuauuuggaaaacuaauauaauaauuaaacucaaagcagagucuuaaaccaagugauucuguaaagauguuguucuuucauugccagcuaugugaggauugcuuguagguggggcauggaaagaaaguacucaaaccaaaauaagucaugugguccuaauuuaauucaguauagucaauaguuacauauugaugaguaagagagauauuuaaccauuagugcuuuuuaaauuuuuuauuuacuaaauuuuauuguugcugggguucaaaaaaauuuaauuugggaggaagaagauuugagacugguuagucuuugccauuuaguuucaagaagaucaggaugaaauguaauauaagcccuguggaucauaauguuguuuuauucauuauauaguggaaucuuuuucacuugaucaauaggccacacaaaaaaauuaauaguagaguggucuuuuauguugccgaaacccuggagaugauuuuaagcaguaaucuguagauuucgagauugugaucauuucucaaugucccucauugccauuauaucccuccacaguugaugcaaacccaagcuauguuucuguauaacuuauuauuugaaaaaugaaagcugucagaucuaaacaagauauauucuuggcuauuuugaaauucuaaaagcugucuccauuguaaaauagagaguugugagaaaaguauuugaaaauaacucacuaaauaccuuaugauuaaauauggccaccuuuuucugcuucuugcuauagagcuauccaucacacuccucagcagacaucaauuccagucuuccuccgauguccacuuuccaucguagugguacaaaccauuacagcaccucuuccuguacgccuccugccaacgggacagacaguauaaugggugagucacagaaaugccaauucugauaccaacaauuggugucagaguuuaaucaucaaggaccucuuuuucccuuucauaacugaauagcaauuaggcacuaaauauuagucacaugacagaaugaacacacaaauguaccaaacagaaguaaaaucacuggcuugagcauaaccauauuuuucgucacaagacacugaaauuuagcuacguucuacguugcaagucauuagauugaacaaggguucaaacagaccaaaacuaucuuguuccucacauucaaaaagagugaacaaagucauaagaugagccaucagugacuagugagcuacaaagcagaauagcucuuaaugguaguuauugaccacuucccaaaauuccagucauugugcuaggcucuuauccaugaugugccacugucuuccgaggacugguuaaugugaaauucucaggugacugcuaauaacuacaugagguuaaucuccuggagaaugugacacuguggagucccucagaggggaagaaguauuuguucacuuaugagagaggagaugcgugggcaucaguuggccagaaauuauuugcugcuuuuuuaaauuaauuaauuaauuaauuuuuaccaaggacauuuacuaaugaguuaagguccaagaagaaugcuguucccaugaacugagccaucauccucucauuucuugugauguucacuguagucuuuuccauaggugguuccccagucaguauucccacuuugaggaaugaacugggcuggauguccagcugccccuggagggaagagguggaguugguggggagauagcuaccugcuucugaaccagcuuugacaccuuguuguucagaugagcagcacagcuuagugccccagggucuuauuaaaaccucagacuucucagguagucacuuucugcgguuauagcucaaacuaacuccuugcuuggccugaaugucacugucagagcgucgguggggagaauacucaguguaugucuuugagagaagauggcgcaacagaauaaugcugcuguugaguccucuuagcucuuugcacuuguuuucuuuagagaguguguagaauuuggggaaguggcgugaaucacuuauguaggaaaguuuuugauguuggaggagagauguguuuugaaauguuggaaauauaauuucugccucaauaaugcccucccugcguauucaauaauauaucucacacuugagaugagcuaucucgcagccucuccacuccgcuauccugucuaagaagcaaauugaggagagaguuuccauuuuuuuuaacuuuuccuaaccaagcuucuacaaauauguugcaucaguuugaccuuggagagcuacagacagaggucacauggggaaguuuguuagcuaucaaugcaguuuuggcagauuugaaaaacaagaagaaagaaagcagugcagaacugaaagagugagaaaagcauauuucacuucagugugguuugacaaauggaaagccccuuucugcagucaugaggucugguuauaaagaaggaugaccggucauucauccuuuuacaagacagauuuccugucuacuugugguuugaguaauuuucuuuuuuaggaagguaugaagguggagcagaaccuugaguugaggaaaacauacuuaggcucuguuugaaaaaaaacuuuuucugauugauuugcaaaacaguccucuugagagagaggcacuaugacuuggaagggacauaucaggaaauagggugguuaucuccaugagcuguagacagcuuagccacagcucucagugggaaugaguuuugcuugguuuuagcuggucaucuucauuaguuuguggaugaacaggagaaucuacuuguuggucuagccagaguggagcaauaggugacuucuauaugcugagaauagacuuaacuuguuaaaaaccauagggccuuauuuaagggucuugacaauaauaaaggagcuauaauuuaaaaacaaaaguaugagauuuuuagaacccagaaaagggcuuuuuagaaauuuauuucauacauuauuuuacaauaauggaugcacuugucaaaauccacuagcggaaugagaaaaagaugcauaaucuuuaaggaaauagguagacaugguaauucagcauuuuggaggagcaaaccuuuauuauuaugcauagauacagauauuacuuuaagguuacuuuaagggagaacauucuagaauguuuuucuuuaaaauaauauguucaccaauugcguacgugaaaaugcagaggaaaauuuaagcauaauaagccuuaguauugcgugaugucugaguggcccauguuuuuucacacuuaaguucucuuaggcuuugguuugauuuuuugagugugguagaagucagugauggcagcgugucuguauaacaagaagagaagcuuucucuucugauguuagugauacuacccuaacaaacaguauggauuaauaggauacaucugcagacuuuugaaaauauuuggcauauacucacucauucugaaacgcaggaaguaaagaaauauuacguugccuguaucucaaagaacaaacagagcuaauuaaauaauuggcaaauagggaacacauagccugacacauguuugagauuacacacgauucuguagaaaaugacuguaagcaauacuaaugccuuaagaaugggguucgagcacuaacacauggacaucacauuuuucacguuuuccugguaaaaaguugcaagacagugcagucuuuucauacaugguguugaugucuuaggaagcugcuuuuucaguucagaagagggcugcugcccuucgucucagugucauguuauaauaugucuuucugguggucagcaguuguccugaacugacacuagaacaacgcagugcauguggggugagauacaagcucuagaacucucggaagggaaccucucuguaaccacauucccuuucuucuucuguucucugcaucucaaagguggaagaugcccacugagguuugcuguuuguuuggcuugggggagugaccagguguuucuuguuuuguuuucuuuugcccuauaauacccaauaucauuuuuugagaaauccauaagaaggauaaagcuuacuuggauuacauuaaugagagauuuuuuuuuuuucaugacacauucauccauggauuuucaagagaauuguagaacaagguauuuuacucauugcauacaguccacuacuuuucucaagccuugcuggcaaacucuggagaucauauuagaccuuucugaauugaaaaggucaucuaauuagcccuccaauuagaggaauauaauguaugggacacagcauggauucacaguaguucagcugguggcgcacccaguuaaggaaagaagcugucaggggucuuugggaguuaccagcaucagcaccuucuacucaguucuucaaacuuuuucaauguuaugccacuggguauucucagaagcagugcaguucagugccucugcaucugagcauacauacggaggaggaaguguaguaaguuauuagauaccagcuauagagaauaggaaugucugcaggauauuaaccauacacauuugguuagccacauacuuccuuccuauuugcaauaauauccaguagcccuuccugauggaaagaaguaagaggaccuccuaccauagcacagaccacugagacugcucaagggugagaaugcgucgucuccccauugggacauaccaucuguauacauucacagggugugacccuuugugguuugaggcuacacacacucccuugcccucagagagaacuggucauauaacuaacauaaugguuauaauaacuauuauuguuuuauuagucuuuaacuggccugcauucuaauacguggucuuuuccacguuuuuaaaccucaaaccaaacaggguugaaggaacagacuaccaagauugauuuaauacaccauaugcuaaagauuacccuggaauaucuaucugguucaugaauuaaucuggcuuagaacuuuaacuucgaaugacauguuaguauguggcuugucuaguagaaacauuauguccuuuucucuuugaggacuugguuucacaguaauuuuauuauuagaguagucacauaauguucacuuuauauuuuacaagaauauugagccuugaaguagucaggcgaugaacaagcacagagcauaagaguaauaagaauuguauccagcaaugugaaggcaucuuaguuaccaagaccaccagcagagaacaauaaacuaguuugauuuaaaucuccuccauuuccugugcacgaucaggaagcccaacuucccccugaauuccuaggaaucccuccuguuaaaaaauagugcauuguagucuauauacuugcguuuguauuuuaaaaugguuguaguaggagugcuggaaauguuccuucuuuuugucaucuuuauagauaagcacauggcauuguuaugcuguuucuaaugguuuaauaacacgagggucacucggacacaguuuagaaaaaccuacuuugaaagcagucaucuucucucaggcaaacacagugugaauugugcugcuuauucuuuugaugccuucaugauguucccagccuuagaugaugggugugcauuaaaggggcaacacauuuuccaaauucugauuuuuaguaguugaucccaaggcaccacucaucccaguguuuuguugaggguguguucuaaugggaaugaacauuuccccaaagcugaggcugagacagaggguggucuagcauguaacccaagauacaaaaccuuucuuucugcuucaucuucuagccagcaacaccaccuguguucaagccaucugaacaauacuuggguggcaggcagugucgaagccuccuacaaaaauuacaguuccucuuaauaacugcucaucuuccauucauauuuguauguuacagcucuacuuagggacugauuauauuucucuugggcaagauaaauugauuagagccaaaauuagaaaucgauaaagucuuuaccaagcaaaugcauuaguuuucaucuuucuguuacauggacauuuugaucaucucuaauaugaauugacaaaaaucuugggccucaaagaguaaucaaguccuguuacaucaaacccacauuuucagcuuuaauguaucuugcuaaacauggcccacuucucaaugcaaaaaaaaaaaaaaaauucugccacuugagaauuaaaauauauuucuuuuccaguuauacccuuuguuauaucugucacacaaauaaaaagagaaaucuguaagagaaagacucauguagcuuaacauguucaggcaaucuagaaaauguagcuucuccaguguuuccuggaccagaacaaaaggcauuccaagugaaagggcaaacuggccccaguaaacugcuuugaaauuuaagcccuuggguuuggcacuccagcuguugcaagguaaaaucgcuucauguuaaaaaauagucuguucuuaucagugguuuccauggguagccuuuguaguuuucugaaauauuuucaugacgcgaugagguaagaaguugauucuauuuuuaauucuauuuccugagucauaauaucucccugcauaaaacaggcacugauagaauguuuaguuagaaagguguaguucuaaagaaaucagauuggucauaauaucuugccucuucuaacgugugauuuuuggggcguauauauuuaguuuuuaaaugcuccuaaaauauuuguauugguuuucaauacuuuguuuaguuucauaaaaauauauauauuauuuguaaucuucauuuuaaaguuguuuaaaggaagaauuaaucuuuugaaagccacuacuguagcagauauuaucuguagugaagcaauaucuuguucuuuuuuggcuuagguucuuuguuagauaaugugauuuuuccaauguagcucugaacuuuuugugaaaaucuauauucaaaucaagcagauaucacagauuauuuugacugauagaucuaauuuuuagguauauaauaaugaaaagaaauaucgcuucuaggaaaaaaaaaaagauaaguacccccaaauaccaugguaauacauacugaaaaaagguuaguaucaucuauauuucacaucauuauuauuuucucuuuagaaugguuuuuagguuuguuuguuguucuuguuguuugaggcagaguuuugauccuguugcccaggcuagagugcaauggcgcaaucucaaucucggcucacugcaaccuccgccucccagguucaagcgauucuccugccuuagccaggcauaguggugcaugccugcaauccauguuuuuaguuuuuaaaggacuccuuaaugcagaaauucuucucauuuucacacuagauauaauuuguuguauuuuaucuuauauuaaauauuuuuaauacucuugauaucugagcugcucccagugguccaauuguaugaugucagacccucauuucaaagaacuugcuuauacaauaccuaucaugaguacuaaugacucauguauuuuaauaucauaacuuugugauauggaaguuuauuuugucacgagauaauuguguucuucuuaucaugugccagauuucuuucaguauuuuagcaauuaacaaauaaauauggguguggguuuuguaaaccaaauaaaguauauaucaaaacauuaucggcugggcaccgugacucaguccuguaaucccagcacuuugggaggccaaggugggugguucaugaagucaggaguucgagaccagccugaccaacauggugaaacccugucucuacuaaaaauacgaaaauuacuuggcgugguggcgugugccuguaauccuagcuacucaggaggcugaggcaggagaauugcuugaacccggaaggcagagguugcagugagccgagauugugccacugcacuccagccugggcaacagaacaagacuccaucucaaaacaaaaaagaaaacucaucugacaaacucaacauauaaauauaugaaaauaacaagcauaaauuagcuaugcuaagcagaggucaggagaauuaaauuaugaccuggaaaagccauagaauuggaccacugaagauccgaccccacuacugcauuuuacaaguguggaaggugaugacaacacauuuguaagaaagaaggcucucuuaguucaagaauggggcuggaaagucuuugaaauuauauaccuguuuaaugaaguuuugcuuggauucauugggugauuuaaccuuuccuuuucuuauuucacaaaauagugaaaaacaaucuucccucagaacuuuaauagguuuuauuuagauacuaugucuauuugcuaauguugaggcuuuaguaaauacaacauaccccaagugcuaggcauucuguuaauacugaagaccacaagaauccuggaaaucccauuuuaucacuuaguucuaaaggcaagauaccuuccaaugauacauguuaaagaaagcuggcuuugaauuguauacuguaauauaugucuuuuauuauucacaauacucuuuguucuucucuuuuguagauaaaaauaccaguguuuaaggcaguagagauaagcuucaugaauauguagacuuacuuuaucucuggaauucgaggccauauugacuuuuaguagcauaccaguucacuuuuuuuagugugaacacagacuuuuaaauauguggagaauauauguuauuuaaaacauuaaaaauauuuucucuccuuguuagccagaccuguuguggaaauuuuuguuuguuuguuugguguacuguaggacugugagacgaauaccccguuuugcuauguaucaaauuucuauuuauuugaaaacagauggaaguuauuugugaagauaauuccauuuacuauaaaauaauauaaagaaaagccagacucugaggacuccagagaccugaaaguagucuauacuugucagcaaugaccgucacauagcuugcuacauucaccagcucaucaacagcaaggggaaagucauagcaaggaaaccacuuuaucuuuaaaccaaggugucagguuuauauuuuaucuguaaaaaaguaacaugaauauauuugacaucuaccucagcaaacaaauuaaugcuaauuaaagauuaauguguuguaauuagcauuaaaaaugcaauuaaauugugaguaaauggaccaggaauagaaaauuguuagacgucucacugccugguuuucauauucugccuuuuguuuuugcagcaaauagaggaagcggggcagccggcagcucccagacuggagaugcucuggggaaagcacuugcuucggugaggaaauauugacuuuggacuccauauguaccauuguaaagggugaacuuuaaucagaaguggacauuuggaauuuuagaaaaugaauggcaaauagcuuugauuuuuggaaaaugcuagcuuucuugcauaacagucacuggaaaauuugagaaggcucugaagcuuccaguauauagucucuuucucucauccucaaaaugguacuaagcugcacucaauuauggaugugggaauauucuccuggucuuuggguuuauagguuuuuuauacugaugucuuauuuuucucuaaaguaauaugggugcacauugaccagcuaagacugucuuagcaaggaauaguucuaaaacacuuugaaagaggcauuugaaaaaaaaaaaaaaaaaaaaagacaauaacugagguccaugaagaacugucacauaauuggcaccugggggacucagcuucucugcuuugcccaccuacugccagaaagcuaaaauugaacauuucuugcauguucccugaugacaaaauggcauaccuucauugucucagagaguauaucugguauuuuagucaaaagcuaaacauggucauuuagaaauguaaguggagggccagguaguguggcucacacugguaaucucagcacuuugggaggccgaggugggaggaucacuugaggucaggaguucaagacuagccuggccaacacggugaagcccugucacuacuaaaaacaugaaaauuaacuaggcauggguggcacaugccuguaaucccagcuacuccggagacugaggcaggagaaucgcuugaaccugggagguagagguugcagugagcugagaucaugccacugcacuccaacuugggugacagagcaagacuccaucaaauaaauaaauaaauguaaguggagauuucuuucucuaagauuuugucucuucaguuggcuuuuaccauugagagcauuaaaaaaguucacacuguauuagcauugugcccuaaguaaaaguuuuuguuucaucugggccuucugaugcuaugcaaucaaacgccuagaucuggcaaaagaguggcaaaauaucuuaggaaugauccuguucaaccucucauuguguagaugaggaaaggaaaguucaaaguaucugcuuggcuugcccauagccacacagccaguaggaacgaagaguugguuugaagucugcugaccccagccuggcucuuuucccaccaucccauaccacaucaguaauucuuguuuugaaaaauuaaaauaauuguuaaguucuucauuugacaauuuugguacuguaguugauuauuacauguaugcuguaacuuguaaguucuaaaugaauugcguugacaacuucguaguuuagaaaagugugaauuauuuuaaugaaugaggguguuuuuuuuuucuccuuauuguuuuaagaucuauucuccagaucacacuaacaacagcuuuucaucaaacccuucaacuccuguuggcucuccuccaucucucucagguaguguauuucaaaucccauuucaucauauaacaguuuauaagaaugauuccccccuuguacuuccugauuuuguagguggaaacucacuuccccccaaaucccaaagcuuuaacauuccuauaacagacaaauacaaagggugggagagacaaauuaccagauaacaguauagucguuuacauccaaaccuuuucuuaaaaauuagauuaucuuuuuaaaauauacaggcauauggaaaauguauuucuuacacuuuucuuagcucugcagaagacacccaacggcagaauaauguauuccaauaaaacgucucagaugaaaaaaacucaguuaauauagucaugaauaugaauauagacuagauagucaucaaauauagacuauuuaaauggaucauuuccugcaggaauuucaggcuuuccaaauucccucuuuaaaguacaugccauugggauguuuagagaaaacuauaauuuuguaaauaaauugugaaauaauugugugggguagaagggauguuugacuucaaaguauaauacauucguaugaccuguggcuucaaauugaauaacuauaauuuguagaauuaugucaguaaauaauuucacuuuucagggguccguuuaagagacucauugucuuuccaauauaaaugcuuccagaaagccuuccuugguucaugucucugcucuuugguaaggagacagguggcuuauuaaaaaaacaaaacaacagcaacaaaaccuaaaucacaucuguaccugauggaaaccuuaccuuacuguaauuuauaguggaguuacuugcguuuguuauuuccugcaugcagcucucauggcccaguguaaacucagcuccuuggucgaggacaggagguuucacauugccacaaaacuuucagaaaugauggccauggcuuagcugggauuuaaugucaaccucuuccaagccuccgugguaugagaagaucacagaauagagagggcagugggauucugaagucucuauguccagagagaccgcguugaaacugggaagcgauugaggugauuuuaagaggauaaucaaacguucccccugguggaaauagaaacuagaguucaguauuguuguacuccucggguucuguaccagauucuuacacucugaaaaaugauuucaauugucaguaacccccuuucgagacaacaagagauacaacaagggauagaggaaucugagcagguggaacuccaguuuccacauuucaaacaaaguagcuuucauuuuauucauuuucuaauuuagaaaaagaaauguucuaugguaucauaauguuugagaacgacuaauguagucugauacccugauuuuacagaugagaauacugagucccaaaaagggaguugaguuguugaguuuauuaccagugguaauagcagagcuuggacaaaaaucuggugcucacaguucugccauccauuucuagauuaauggugggaaagaaaaauuaggaugcacagucauucuagaaaacaucacaaauucccucgaccugaguagcaugaucucagugaaaggcacagaaacaaggcuagagaugccacuuuuugggucuugguaaugcaucauggaagaccacauguuaggaagaaagaacuuuuaugaagaugcaaauauggggacagauugcuauuuucacaccgacggcucuguccaaauucugucaagaaaaguaauugaacaaaauauucuauuuuuauuuagcauaaaaauauacaugcacacccagaaaagacaggaagaguggauuuuaaaagugcuaacagugucggggcaugagauuucagugagaucauagcuauuauuuuuuccuuuuuugaauuauguauuuuccaaguuuucuacacugaauguguauuauuuuacauuuaaaguguuuuuuauuuuguagguuagacauguaauauguauucuaacagcaaucuuuuuuuaccuucaaguuuaaugaaucauaaaaaaauuauuuucuucagaagaaacuuuuagucauugcuguauauugacuuuaaauuucuggcuuaguggaucacugauaacuaaucuuauucccuuaaaaaguuuuucaagauuuaucuuuuucuaaagauuguuuuaaaaacaaguggcaaagcuguuuuccacuggugcgagaauuuugguuuaacauaaacuagccuugcaugaaggucuaacaaaaucccauuuuuguacccuuaaaaguaccuugauuccauggugauaguuuuucuuccacaggaacccuucuuaccaaaauucagaaucaauuaaauguucucuuuuaggagacagccagccugggggaauugugagucuauguaaagucuacauauuuuacauuuaaaauguuuuccuugucccaaaauucuuauaugggaaguuuacauguauuuacguuguuguuuaaaugaaaaucaucauugccauugccauuuccaaaaggacuguuuaaaauauuggcaagcgucuuuuuacaugugucuagaucugauuguaauucccacuuuaauaucagcaggcacagcuguuuggucuagaaauggaggacaggccucaucgucuccuaauuaugaaggacccuuacacucuuugguaugucucauuugcuaaucucugucccacccauuuucaggucauguucuuucuuguucagucuccuuuacucuccaagauuuugauuuucccuguuaguaacuuuaagucagcauuaagcacacagguuugcgggagccagagucauuagccuaugcuugcuccuauuuggagaugggaacccagauacuacuguaauggcagccccagggcucuaaauaucuaguagcagauaaaauccuggaagggcaauggccuucuccccaucucuaggaaagaucccugucaaugauuaaaucacuuuccugcuaucagagugcuggaacuccagccagguccuauaccuggaacauuugauucccucuaccucugcuuuacuuuccagaauaacagguuuacaggagcuuuccuucucguagaaacccagugguauccuucgugguagagaaaugccuacucuuccaggagugaauugcugaaaauuuccauggauguaguuaauuauuauaaauacucacaugaugauucagugucugacacuucagucuuucucuccucaugauggugggggccagaaauaugcaggaaacaaugcugguugugcagcauuuaggcuguacaugaauuuagcgggaaggaauagcaguaagggagaggagccuuuuaguuccucgggguugagguuuucuuuucucccuccuaucuugagaugacacauggaagaagacauagauuuaucuaucugcuuuaguguugucuuauauucuucccuuucagcuuaaucuuaaggaaaaucugaaaagaaaagcaaagguggauuucccuccuuugcuguguucuuccuugcuauaguguaugaaucauucagcuaugcauuuuaaccaguaaaggaaaccagacagugaaacauauaugcacuacccagcccaauuaaucugcggaccacauccacauaauuaguuguuuuaguguuuaccuucaucaguuauucucuggggccuauucaucaaaaccaggcuucguccaacuauagaacuguaaagacgggguguauaguuaugggccacagcuuccauucuguuugaauucugaacacugaagaagagauuuacaagcagaaacugcugucucuaccaggaagcugugagccagaaacugugauaggcacauguaugauuucuuuuccugcauacauuuacacucagaaguaaguauguauuaucauucccauauuuauaaauuagaaagcaugcacuccaagagguuuaguaacuuuuccaaggccaaauacguagcaaagcuagcagucuaggggagguaguuuaacucccaaacccaccaaaucagaauguucuguaccauagacuacuauauuagacacacauucuuccugucaguauaaaauagaaauguuuuuucucaugcaauagagcugguacacuuguuugcacagccgauucaaaaucaaagucaauuguagcaugaucuagugcaaagagucacuagauuuaaaauaaaaagaccuagauuccaacucugacuuuaccauuuccuagcagugugacacuacguaacuaauucacuuugugucuuugagccucauuuucaugucuguacggaaggaaucauaaugucuucccugccugcccauacacacgugaaacaaggaucaaugagaugguauauuuuaaaguguacacuggagagugguauuugauaucauuauugaucaguuuuuaaaaugaauacauaccuuuaaaaugaauacauacauuuucuucacuaaaaacuauacgcauugucuaguugugaaaaacuagaauccuaauggcaaggaugaacaaagguugguugguuuuuaaugguuuaaaguugcgaauucuaugcuauaguuggggcuuugaacucaguuagaugcccccagugaacaguugauucaaguguuugugauucuucagucuuaaaaucuuauacuacuuuaguugacagaauuuauauaauuuuuuucuguaaccauuuugaggcccuuacacgcauaccaccacacacccacugguuuugaugacaggaagccagaaacaccgguaaaaacucaacaagaaauuaucauccauuugcuuuucccugucucugauuugguacuuagcacugggucauauaccacagggaagaccaaagaaauauaccuucaggaaaagaauuuaauuaagaaacuauaaauaggucaucuuuccagugguaauuguuuaaaacucuuuaacuuaauaccugccagaaaguuccuuaaauucagugaauguuuuucucuucuaaaauaaauuuaaauugccuuucaaaaggcaguaccguauauagcacauguauguuauaauguccuggaauaauuauugaauuuaguuuguucaugaaaaauaacacuauaauuuuaacauuaacacguucuaccaguuuucuggaaacaacacuauuuguauuauuguuuuaaggaaauacauuuuauuggaaacauguauuuagaaacacaguguguuuuuugucgacuaaaauuuuacuuguauaauuuaggcaccccuuuugaacuaaaucaaauuuuacaucauuuguuaaccaacagcaaagccgaauugaagaucguuuagaaagacuggaugaugcuauucauguucuccggaaccaugcagugggcccauccacagcuaugccugguggucauggggacaugcauggaaucauuggaccuucucauaauggagccauggguggucugggcucaggguauggaaccggccuucuuucagccaacagacauucacucaugguaagugaugaaauuuauagacucuauaguuaucauauagaguuagaauuucagauauagauacuauuguugcuguuuuuuaaaaaaucagcuuuauugagauauaauucacuuaacauacgaugagcccauuucagguguacaauucaaguguuuuaguguauuuacaagguugugcaaccaucaccauagucuagguuuugaauauuuuugcccccugcaaaaagaaaagaauccccguugcccauuaagcagucauuccccaucccuccacuuccagcccuuggcaaccacuugucuacuuccuaugucuauagauuuaccuauucuggauauuuugaauauauggaaucauacaacaugugguggucuuuuuugacuggcaucuuuuacuuagcaugacuguugcaguuuuucuacaguuugccacguauuagagcuuuauucauuuuuauugucaaauaguauuucacuguauggacauaccacauuacacaguuggguuguuccaacuccuuggcuaugaugaauaaugcuucuauaaauauucauguuuaaguuuuugugcagacacauguuucccuugaggaugaauugcugggucauuguugguguuugaaauuauucauuuuggugacccuggccaaaguguacaauuugaguucauauuauaauaugacauugcuaguaauucaaauauuaguguuuuuuuuuuaauuaaagaagccaaaauagugucugucaauucugagucugggagauagaaauauaugguauguuuauuuguauaaauacauugcaugugacuguguaauuuaauagaguagcuuuacuacuaccuauuuagaauaagucuuuauuugaauuauauuuaagcagauuuguccauauuacaauugugauuuuuuuccucauuacuuuugaaaggauuuuggagauaauucuuuuugaggaugauuaugaagauucagagacucuucuuaauagaauauuaagugaugacaauuaaugaggugaccagagugguggagaauguaacuugaccagugauucucuguaguucugauccucacaagcucuaccucgucucuaagcaccuuaguguccuauuuugccccuuacaggcucgcuaaaaguugcuuggaugaagguauauuuuccauuaucacuguagcauuucucguuuaagcauggucccaaaaggaaaugcaaaauacauacaaauuauuaugagguucuuuuaaguucuugcucaguaguauucuccuguccaucuuucaguuucucuuaauaaaagucuaagauuaagaguaccauucugaacgguguaguauugaaaucugcaaccaauuugaaaccaaaaauacugguuuauaaauagaagcaacgaacucacaucuaaaauguggaaagauauuuuugaaugccaaagagaaaucuuuuuuucuuucccuugaccucugcccuaaaaauucaucauugaauaaaaauuguuuauauguucauggcaguugcuuagaguuuacaaaagaaaagucuagauuuuaauuuagcuuggccucagguaauguguuaaauacacuugggaugcauauaauaugagauuuucguuuguacagcucuuuuuuuucuaacuacaauguuuaaacauacugcuuuuaauuaagaaaucuggcuuuauuaaaagccagaucugugacuuauaaccauuucuguauaucugcucucaaucaacagaaaaauaguuuaauuucuguagcuguguucauuuugcauauguuaaacggauguaacaugcacccagggcauugcuucagagacuauuuuuuccauaaauauguaaaguuuuucuuaaauaccauauguagguuaagugguucuuuuaaauauuaaacuauacauaaauacuuuuggggacuauuugaccuuugaauugacuccuuuuugagucagauucagaggugggaugggaggaaaagacuagaauuauuuuuggagaugggaaguuggacugaccucaguagaaccgaaagugagacgacugaauagaacgguagaaaaaaggaaauaauuagccaauauuacauagaaaccccuuuaauuugaucuugauauacacacacacacacacacacacaaaagcaauaaagccgccaguuuugcugauaaggauaaguuccuguuuucuccucugaagacauuuaauauucaaucaaggacagccacagagccaagcagaucauagcguaacuccaaagauauggcaugucaucacccugcugcccuuugaaccaaaugggguuuugcagucucucuccuuucuuccugaaaaccauucaacguguccccagaaucugagcuccucagccugaaacacuaaugugugugaaaaggauugguuuggccuaucuuucccgugcaaacugguaugaauuuuaaaacaaaaacauaagaacaaaggaaauaguuuuugaauuuaaucagucugaaguuagccuuugaccauuugauacauuccacaauaaaaaggaaguuuaaggggaaggcaaaaaaaaaaaaaaaaaaaccucaucccccuuccccacaacaacaaaaaaauucaaggaggauacugguaauguuuuccacauuugaauuuuaauacaugaaacaggcuauaaaacuuuggccagcugcaguaaauaaaguagccgugggagguaugcaccggaaacuucagcagagagcacuggugagagucucauucccaacuacacaccuucguuuguuguucugggcggaagcgaguugcaguaacuugauacucaucccagucccgguuuuguauugagcacaucgccuuucuaacucuccucaguaauuccuucugauuaaagaguagacagcucugaauccucucgaccuccguacgcuucucauuuccuuucucccugccuuccaaaaaucaaaacaaaauggcuugauaacuuggaaggugauauaagcauuucuuucugcagcagcuugaaguugugguggggaaaacugugguucugccucggcuguuauguuaucucauuuaauugcuaacauauuguccuuagcuuuugauucauaaaauguuuuccuuggaguucugaaguaggucuucagugauuuacuaaguauuaguauaaugaaagggauuuuuuuuuuucacagcggcauggcucauaacacaagagcgaauguuuguauacuugcaagcucucuggaugauauuauugagcuaugcuuauuuccugcucaaaaaccuucccugccuuuccauuuucuacaagauaaagaccaauuccuuagcucagcauuugaagccuauuaccauuuaccgaaagccuuauguugagcucuuccaaucugcaacaagucuuccagcaagacaaggcugggcauauuaccagaauucacccuguauguucuccuucggaacuuuuguaucucuuugucuuguccagcccuaucugcuuaucucuguacaccuaauacccacccauucucaaagcacugacucaaaucauucuucuuccaggaagccuucccuugcuaccccacucaugcuagccauuuuuuucucuauucuuacagcccuaugaaucauaccauuucuagauauuuaucuuaaccagcuccgcauagcugugcaucuuuuauagauaugacucugccuuaccaacuguuguaaauuccucgagucucacauauuauauuuugucucucuccccccgaccccuguaaauagaucauccauagaaacgggagaaaagaaacgaggaaacuuaacauucugugagugugaguuggcagccccucugcuaggcgcucugcauguguugucuuaggcagucuucacaacagcccagugaggaugauaauaguggucauuucaggugucgguaaagugagccuuagaaguuugagcaguuagucucaaguccugcagcgggauuuaaacucaagcacaucaacuccaaauucaaugcucuuuuuuacuaccaggcauacucuccagagauuaucuaugagaacaccuuuucagaacuuauuuuaaaugcuaggagcuugugauuuucaaaacuugauaaguguugguuggcaaaagaaguuuccagguauuccauggcuggguucccagagcagcucucuucccaaauguauagacagagaacuuucccuccaaagugguggcaugcuuggauuaaaacccacauuaucuaugcacuuauucuuaaaccaacauguuugcgcugagugccuaagaggugugaacucucccuaccaggguccuugagguagcaaauuuuaaguuaucaaguuauuuuucuuacuauaaccacccacuuuucuuccaaaauuaaagcagaaaucucugaaugugggagaauaaggaaauagccaggucuucacuacccuaguuagaaacucuuaccaaguaugauucccucucugccucagagaccuccaugauuaauccugauauuaaaugauuagauuucuuauaaauuauggaaagggcaauuuuccagauagaauucucucuguuacucauucaguauucacauccacagaugaggccugaaaagaagcguuucaaaugaccuaaccgcuuuuuuaacugacuaagaacaaaacccacaucaaacuugucuuuaugugacucuauguguucccguuuauuuguugguagagucagcaacuacgugaucauugagcuaaaaauccccucuacuauucauauaucgcauuaguguagcucucagauccuucuuguuuaaagucuauuuauucauuucaauaacauuuauccgugguuaccaaguguagguucugugcucucaaggaauucacaggcuaguaggaaaagauguguacuuaagcagauugcucccugccagucugcuaugcccucuaaaagaccaggggccugacccuuauccaguagugaaagaucacaugguuguuuaguagaggaguggucaucuccaguugacuuagggaugggggagucaugugcaacucaccccacacaccuguccuccacagcaucccuucagaguccugcaggugggggauguggaacccauuucagaaaucaccaauaaaaguggaucuuugcccaguuuuccucuuuucaguaacaauuuuuguuuuacuuuggauuaaaugcagucuaucaaaagagcauuccuuaggaaaagugguaucuuuuuauuuaacugacauuauauacaugagaacuuuuaccucuuagggcuucauaggacaaacaacuucaguuaguuuuccuuguauaguuaagagcucagaccacugaauuuuagauucuaaaaguacccuggaaaucagcccauugcccuucuuugaagacuaaggccuaggaaggggaagugaccaaaccauggguacucacuaguagaauuagaaaccagacaaaagaggcuggacacgguggcucaccccuguaaucccagcaauuuaggaggccgaggcggguggaucacucgaggucaggaguucgaggccagccuggccaacauggugaaacccugucucuaccaaaaauacaaaaauuagccgggcaugguggugcacaccuguaaucccagcuacucaggaggcugaggcaggagaauugcuugaacucuggaggcacagguugcagugagccaagauugugccacugcacuccagccugggugacagagagacccugccacacacacaaaaaaggaaaccagacaaaacagcaagcagaccagcacuccuugugcuauauccuacacugcucagccgacuuccucuuuacccuaauaccauaaccauuucaaaacugugagugguagaaauuagaaaccauucuguuacucugacuuaacuaaugaaauccaagaaaacucuguaguuggcccuaggcugccugcaaugaguugcuauuuagcucuaccaguaauauuuggcaaaaagagaggguagugggcauugaugugauguggcaguuauugguacauagucaugggagcagcaggagucagaagauucuguuucuaugugggccucuucaacaaagauaugaucaacagaggcaucagcaucuucaguugauaaaguugauaaaauagaaaacuauuuucuaaauagccuguuacagaauuucagcgaagcuauugguggucagcaucaucuuuuaauagcuacuaucuuguuuuucuuuaaauuaggauauuugccuucucuaguguucugucaucucuccuaaucuccacaacuaucagguauuucggagagcagauuaguaaccucaacugaaaguuuugaucuuuaucaauuuaucaguugcuccucuugggcuuucacagguuuugauuccauaaaguucugugucuauuugagugcauacuucauuucuaagcaguuauucccauggacucucagggaauuuaagagauuaucucuacugaaaucucccuacagauuuccugccaagcagucaacaagucuugaucagccuccuuccuucaagggugacuagcuccaaaugcccacaaaguccauuuucaucaaauauuugaaaguucuuccuagguccagcccaaauuugcuuuuuucuacaguccuuauguuucugcccaauagaauugcccacaaaucaaguccaacaagcacuugagaaacucaguuauuugaagacagucugcugaguguuuuuucccucuagacgaaacaucacuaucuucaaauauuuaaccugaaaaaaaguuuggacucccugucaugaacuccauugcuucccagugcauucucccuaguuuagcaaggaugccuuuuucuccacaagaaccuuuuaguguguggaaccgcaaacugaacacagugcuuaagaaaggaucaaguggacuaggguggaucuaucuccucccccauucaguaccuuguaucuucauuaaggccaccuaacaauauccuguuuugcuauguuugaugcuuucauuguccugcugacauauauucaauuuguaaucaacugaaauccauaagccaccuaucuccccagucucauuguguacuuuuuguugugucuguacaaaacuucaugaaaccccauugaauguuauguuguagccucagucugauuccuguuuaaugguuucccugaagcccucauucagucacauacucugccaucucuguugcuggcaaaugugaugggugugacuaaugcccacaucaaagccaccaauacaauauuuucaggggaggggauugaccagaaggccaugaggcucaguguuacagacauucuuucuacacgagugcugucuucuauccuuugaguuuaaucucagcugguucugucucccuccuuauacaccguauggcccaccuuugcucauuuuguccguagcguugucacagaagccgggcaugcagcacucacugugaagcaggaaaugaggcuuguccagaaugccuugcucugguggaaccaaacugaguuugagaggccauuccuguguuucagagcacuuucaaaacuauuuucuaaauacccuguuacagaauuucacccaagcuauugguggucaacaucaucuuucaauagcuacuaucuuguuuuucuuuaaauuaggauauuugccuucucuaguguucugucaucucuccuaaucuccacaacuaucaaguauuucggagagcagauuagcaaccucaaccgaaaguuuugaacuuuaucaauaucauacuuuauuuuuuuaaaacugaaaaaaaaaaggacagaaagguaaaagaacuugaagaaauucuuuuagccauggaugagugauaacagcugagaauccuugagcuuaccauuugauauuucuauauuaauuuaaagaaaagucaaaagauuuugaaaacagcaauagaaguaagauccuuuaagcucuauucagcagccccuaagaaaagugaugaggacacugugcaugcccauaugugaacaugguuggccaccuuagguauuuccccuucucuccacaugaauacauauuuuacucaaauucagacucuaugauguugaaacagucuggcauuggauguuuaccucaaaacccugcucucucugcaccuaggacaaacaaauccuaguucucugguguuuagcaucuuggagccaugaauuuuaaauaaaucaaagacaaaaaccuugucuuucccaguuuuaaaauauaaaagauacacacacacacacacacacacacacacacguguauuuaaaauagacccuauaaccucaucauauucuuacauccuuacaugguuuucuucuuaaauuguggaggaaaaggcaggcagacacauuuaauagcacagugaucaucauuuuuuaaaugaacuguuacagggacauaaucuuaaacuauccauaauuuggaauaggcacaacugugcauuuaaaaaaaugcaauauuacccuuauuuucucaggaaagcagauuuucuggagggaaaaguauauauuguauauauuagaaaauauacauauguucauucacucuuucugcaucugcugugcuucagaugcuuuuggggaugcauaaacguguaaaagaaaguaucugaucuuacaggccuuuuauccugguagagugauaauacaaauaugggucuaacuauaaugcaagguagaauuaugaaaugaccuaaggagcaauucagaccgcuaggaaaagcuucccggagaagaugccauugagcucauauucgaguccacauagaauuucaacaauuagagacaggauagaaaaggcguuucagagccauauaauaaacaugauuuaaaaccaaaaacagaaaauaaaggcucaugcaccuaaauggaaguaagaaaacugccugaugauaccaguccuugcagcuugccagccagggcugcauugggugaaaagccccuccacagcacggcagcuccagcaguuggcucgaauauuucacaugagaguccacaggaagagcgagcuuucauguauauuuuuuacauccaaauuaaguuaacucauggaauuuuccacccuuaggaauuaaaguagcaacucaugaaguaauucaguuaugucauucauaccaaaacagaaaauacuggagcaacuuggcacuguuuaaaagccaagauuaggccuuggccauuuuauauuuuuucacauuccauggccguuguguuauuuuaacuuuuauuauggcuguaaauuuuucaaaucaaaaguaucuuaauugcuuagaaaacagaaguugaaaauggguucauaguaagaagaggguuuaggcaaagcagcuuuaggagugagaacugaaaaaaagcuguagcauuacauuuucuguaaugcgaggguucuaccuauuugguugacauucacaguugugcauaauuauagcuuccucuauauccauaaaucaucuuagaacuauaaaguugaguuuaaccaaaagaucuguccaauauuagugaaaugacaucuuuagggaagcauuguccugauacaauagccacauucauuuuaaagcaguuaauuggacacauugucaaaaaccacgguauugaguuuccacauuuuaauuucacauuugccuucucccuggcuucugcacacggacgggucucuuuuggagcugaaagugugugaaaguuauuggagaaugguagucucuggguaauguuucuguaagcugcccaaaauuuucccccuguagucuagaugggaaacagcugguauuuguuuaaaaagcuguuuugcaaaaugucuaaaccuugagauauagaacugaggucaccauuaaagcaggugcuuaagagcaagugagaaagacuucagaggccgacuggcucuggaaucuucugcagggcacuuccuauuagaagaaaaaguguugaaguuugcuccuuuauuuaggacacggcuauaaguauuaauaaguaagugcacuagcaauacuacuagaaauugaguauuuuugaacauagccagcccucaagugaauaauuagcucaguaugaaaggaacuaaaauggucauuuuucucacagggcuucaagauacaagagcccaaggcgcucuagucuccuuuggguguuugaauuuccucuuuaaacacaccaacaguaaaagaacuacuauuucaaauaagcaguaccauaacugacuauaucuuccaagguuuuggaugcaaucuaagggaaagggggaaaagagacccgacuuggcaagacccguaccgaagcagucuggaaaaaaagcaaagcaaaaaacauguggaaccacuaaaggccagugcacgucagguauccaccagucugaagaugaaaggaaguaagccuccuccccugggagcuggagguuauuagcagcuguuuauccagucgggaauagagauuaacauuguacuuuuuuuuuaagaacuagaagaaaauuuguuugggaaguuggcuuuucauaucaagucacugugcuuugccaaaaaaaacuuccuuucucagaacucauguacuagcauugagcaauguuaugauucucugagaaacucugaauuaccaaaaagucuuucuccauuaaauagaacagaaaaggacagagaaaugggugaacguuugccauugacacauugcaguuguacucuuuaccaugugaaauuugccguuuggucuauuaccuguucuccaaccugacucuaaaugggacacucugcccucuaccccucacacguacccucacaacuuaaucauugccacucuaaggugcacacaauggguucugcagauaccuacugcuugcaaaaagaccuuucaugagauauuggggaaacugccuaguacucugggugcuuuauucucaaaaaacaaacaaacaaacaaacaaaaaacgaguuggauauagguauuuuuccccugauuuaaugcuacucuuaaugucauuuucuuuuauuaaauccuuucuucugcuuuugaucuuauuuauagcagagccacuggucauauggaaacuauuacuguauagcugcgagaugaaagacuucauggcaauuaaauaagagugaaucauuugggccaauaauacacacauacagugagguaccauuuguguccaaaaugcccuguguuguucacuuuguagcaaagccauugagcuuuacaaagggcuuuacaaaaaucugcuuuuugucagaaauauguagucugacaauaugaaaacacauguuaacacacaguccuuagcugcuugcuucuucacacauacacaguaucuaaaucaugccacuuauugauauaaaaugaaauuuucacuuaaauuugggauauuauuuaguuguguuaagcgucagcucuuuaaaaauauauuuggauaaucuauaucaaaauucgacccaucacucaaaaccugccuaaaaugucauguucuucuuaaaguagucccugguuuccuaaacggguaugacuucaucauuuuuuaaaacccuacaugaccuuguacuccuuuaugacauucaucguauuuugccuuguauaguaauauuaucccaucauuaaaauaucagugccugggcuaggcgcggugguucaggccuguaaucccagcacuuugggaagccaaggcgggaggaucacaaguucaggaguucgagaccagccuagccaacauggugaaaccccgucucuacuaaaaauacaaaaauuagcugggcguaaaggugcacgccuguaaucccagcuacuggggaggcugaggcaggagaaucgcuugaacccgggaggcggagguugcagugagccaagaucaugccacugcacuccuuucugggcaacaaagcaacacuccaucuuaaaaaaaaaaaaaaaaaucagugccugcaaagucauagacguguuuauuuuuccuugcaaaugcccauguagugccuugcauauaguacacuuucauaaggcgcuugucaaauuaagugaaauguuuauuugauagaaacaugcuaaauguauauuuggcaauaucaaacaauuaaauuucagacauagucucacagauccauagcauuugugucaucauuugcuaagcaucuaacugcacauuguacuauuacacucccgugcagugaccugugcaguuccuguccuugggaugggaugcccacaaauggagacaaguauaggcuuuacgaauggcagcaaaacaaacuuauugaaguuuaugcccugcaccauucaacaaugaccuugaauguguuuuaaggguggugucuguaaugcauagugagcucgugaggugacaagaaaguggagauuucuggagauccacucagcccugaagggucagagagugaggggaucugugaggcuaauaaaagagaagcaguuggugaguuaggaggaaaaaacuagcccagcagacagagcagggagggcuuugcucaagccuuagugaugugggcguuaacccagcagaugagaggccaugcguagguaauugaacauugauagugaggaauuuaaaaauaggagggaacugcauugguccugggagucuaggugaaggaugcaucagcacaagguggaccucuuagacuggauccauacagcaagcaagagccaggcugaagccuuaauauugcaucaacugauggagagagaauauugcauuuaaaagaugaguauuuggaaagugauggggaagaaaugguucauucguuuaggugagcuucuuuauacuucuacucucuuuucaaauauauuacaguaagcauguguuacuugaauaacaagaaaagcauuuaagaaauaaaggccaauggguaaugguaaaucccuagggauccuuagggaugggccaccuggacuggcuaaaaacuguguggaggucagcagcaugacugugcacucucacagguaugcuugcacuucaggcauucagaauuccaaguguaaaucaaguguccaguugucuuuuccuuuaaacaaaagcuguuuacacauaauugcuagacuucaccauauucucugugcuagauauguuugguucacuaggauggauuaacuuuaguuccauaccaucuacuuacuagccugcuauguggagcaaggaagagauagaggaaugggcucuguuaaucugccaguguccccgcuaggugagcucucuccaguuaugguuuccacuguauaggaaaaugaugucgagaauugagggugugggacacagaagagagaaaugaaacaguuuuaauagauggaacguaugaguuaguacaagaaagaugaacugaggucggcucacauccguuugcauuucuugaacuauaucauagaaucauucauuuaaccauuuuggugaacauccaggggaguuucagcccagcugaucauaugauagacaagcacugccaaggucaggaucauuuagaucauguuuaaauccucuugaaaauuacuuuauuaucuggagaaucaauauuaaauaaaucuccaagaauugcacaauaaggaauuaccuuacauuucauacagaacauaagagaagcugugauguuucuggaaaacaauguagguguucucaagacaguuaugaaaucuucucccgacauacauguuaagaaucaaguaaaaauccaaacaaaagaauugaauccagaucugauguuaaugaaaagucucuuaaagguuuaaucacauguacuaaagaaaaaucaucugauaauuuuuuaaacugagaaauauggaaauuauguuugugguuggagugucccagauguuagcucuuucucccacaacaggugguuauuagagguaggucuuguuuucugcagagccucugugccucuaguguuguuccucacaguaucuaucuacugcugccauuccaugaacuuccuaauucccaucugugagccauuaaaaaaguuugcaugaccgcuucccaccucuuuaaaagaugcacuuuuguacuaaaugguguuuugcacauuugagaaaauaaguuugcuuuccucuaauaugacagaggucuggcaagauaauugaaacugaaaucuaguacucuacaacugucauguauaauugauauuucauggggagauuacaguucagacaccaaaacuguuuucuguaucaauggguuucuaauuacagugaaaacccaucagcuuuucuuuuguguuaauggaaaaacaacagagaaaaguaacaguaaguugcaguuaccaggacuucugucuuugucccauuuuguuguuguucuucuuucuaaaaaccaaaaaaaucuauguccaaaauuggaaaccagaugccauuaauagcaaacuuuaauuuugauguaccaaaauguuuauaauaguauauccaguuuugugucauuaucacuuggucuagaaacugaugacaaguuuccuaaaguucccauuguauacucuuuuagaaggauuaugguagaauagaagugacugaggucugaaagccuguuuugaagcaguuaucucuggagauaacauuaacuaggauugaauaacugccaaaugaaauuuaauacauuuucccauccaugaaauaggccucuuaaauacaacagaauaauuacuuucacaauacucccuggaaacaaagagagcaaaaauauugaaugucuuuuuuguuugugguguuuguuguuagcuagaggauaaggacaaggauauuuaccacaaugcugaaugcaucuccauauaaaaacagccuugccaacagccaccuaauuugaaucugcaugucuuuuaaaucuguuuauguuggagggaucguggcaaauauuaaauuuuauaauuuaguuagacaucuuggccuuggccugaguuaaugaacuaugauuuucccccugcaauaaagaaaaaggaaaugauuuuccucuaucuauauauguacguauauauauguauguuauaugcuuguaccuagguguguguauacauguauggacacacacacacacuguuuuaaaacaaaagcucugggaaauaaacgcaucuugcccccuaacucuccuccccucuccuauauaauuguucaguguuguaaguuuucugaguucaaaaucuguuuuagaucuccaacuaagcaucgaaaguuggaucuuaagucacuucaccauucuuggccuuagcuuucuuuguaaaaugaagaguuugaccuaacugauauauaaccaagguccuccaagcccucgacgucuaaguucugugauuuaaaaguguuucuaucaguuugucaagcccuuucuuggaaacuaagguuauuuaaaauuauauggugcuuacgugauucaaaauaauuauugcauaucuaaugacauuuaauuauuuccauugacaaauucacacaggagaauucaaauagcuguguuggaauuugaauauaauuugaccuaagauacaauguaacucagacauuuacaccuacauguaccagucaauauguggacgggacaggccaagccgccuguguuuggacuacaugaucuuauccccccuuccucguuuguagcucucuggaccgggaaaaugccugucauuaagguggcccauucauaguaugaccuaugucugcuucaaaaugagcugggccauccagugaucuuggcauucugagcuuagaaauacaaagacaaagaggaaauuagcaggagguacagaaccagaaagaaugcaccaagagguaucaugaagaaagaguccaaucugucaucaugagagggcagaagccagagagaagcagagguccccccagagagaggagagaggcugaauagcccagcagaggcgaggaguggcauucgguucccaagagcucucugaguccaaaaccuaagcuacagaaaacuauuuaugauaaaucuuuuauuugaacaaacucaaauagguuucucuuccuuacuauuaaaacuaccccacuaaauugaucagcauacaaaaauccccccaagaaucauuaugaguuccacaaaaaccaggaccacaucugaguuauuucucauucuauccccagugucucccaaagugacaggcaugagcuagauuagaaaauguuuguuaaauuaguaaaugcauucucugaucaaucaaugaauaaucauugaauaauuuuuaaauuucacuucuaucuucuauuuuuagcauagauaucacuaaaacugcauuauacgugacuaugggaagauucacauuuacaaugaguauuaauaaaauuuucauaagcuggcuuuuaacuuuagacuauuguuaucucuaugaaaagguuaucaaaauagagcuuuaacgaaguauggauuuucuaaaaauagggacgaaaugucaugcuuagaauugacuugugggaaucuccuuucuccuagucacauuaugacguauuuaaguucagaaugccaagaucauuggaugccccagcucauuuugaagcagacaugggucauucuaugaaugggccgccuuaaugccagugggcaaaucccugacccuuguauauacagagaacagugugaguuucuccaucuauuucuguguuauucuagcgauggauuugugccgacaguccacuguguuucuucccuugucucuuaugugaccagaaauaauguuucugaaagagaagaaaacaggguuagaauaugccaucuguggccaaggaaacaagcaaagccaagccaauuauucaaauuggaauacucuuccacagccacaggcaauggaguugauccuauccuggagaaucaagcucauuauuacauggcucuggaccuaucagagggcauucacaugaccuggaauagacacaaggggagucuuaaaacaucacgacaaauuagccggcgugguggugggcgccuguaauuccaguuacuugggaggcugaaacaggagaauugcuugaaccugggaggcagagguugcagugaacggagauugcaccccugcacuccagccugggugacagagcaagacucugucuccaaaaaaaaaaaaaaaaaaagucagaacaacuuugucucuaacauucuuuauggaaaaugauugauauuauuuaagaugaucuauagaaaauagauggaguuagguaacauaugggccuaaaauccaaacaaaaauguaguuggaacaacuauauccucagauauauuuauaauauuuaagaguuuacagucauuguauaggggaaagauuuaaaauuaaauggauuuuaacaaaauagagacaaagaucaccguaacugaagauagcuugaguuuugaggggguucuugaacuacacaggcuauuauuucuauauaacaugcaaguauuuucagucaaaacacaugauucugucugcaguuauuauguaccuauuacauaccaguugucauguacgauugcauggguucucuuuuucucuuuugagaacuuaccucaaugugaucuagagggaaaaaauuucaggagcaguaacugaauauauuuuaaguaaaaagcaaaacauuacucuuaaguuaugucacagaugcuugcaaagaaaucuugagaguguuaaugauucugaaauaggaguacacuucuccucuaugcucaaaucugugguuaccuucagugauuuugacuuagagucauccuuuguagaaauucaagaaauuagauccauugggaauacaaauaaauaugaaucagcacgaagaauuauuuagguuuauauugauugacagacauaaagagccaccauuugaucaaggccuguaaaaauucaugcuuacaaguugacaucuuagauugaaaggauaaucauugauugaauccguuuucuaaugcaugaauauaaaaauagcaaaucaaaaccucaauggaaaauagcuaucaugcuucugaauaaaaauuaaaauauauaagagagugaguuacaaaugguugcuggagcaggugggcguggucugccuauaagagagcagacuucagucacagaggaaaggagugguguggcaggcaacaggguugaauauguuuaaaaaaaaaaaaagguuuguacuuaacgccacagagcucuagaagcugaaacuagaaucagugagugaaaucuacaaagaggccaauuugugguaaaaauggaaugggcuucuuugggagauaucagucucaguacauuugaagcaccccacagaggccaaauaaccaccauucagaaaguucuguguugcgacacaggcaccggggagcagugcuggacuuccuacaucucucugcugaaacauucauuuauacuuccugaggcucauaagccucaaguguugucuuauucuugcuguauuuugaauccaaacaauuaauaugauuuaugugaucaucuccacccaaaauuuaaaaaaaaguuggagugcauacacacacacacacacacacacacaugcacacaugaauauaaaaauggcauacuucaggaucaauuacuuaaauauauuuucaguaaaaagcaaaauauuauaggugauacuuaauacauggcugccuuuaaauagcaugugcuuauuagguccugugaauuuguuguugguucagauacuuauuguugaugcauucuuuggaaauacccuuuuaaaauauauugguaacacaagagugaugauucuccuuucugguuucauauuuuugacuggaaaaaaaaauaaaccugauucauagcaguauaaauguaugguuaauuuuuuguguuuuagacccaccguccuguguaaaugcucacuuaaccauaggcuaagaaaauacuuggaaauagaaaagaaaaugugaacuacugauuguccucuuaguugacaaaugcuucauguuuucgcuugaaggcaugugcuaugaaguaggcaguugcugucucagugccacaaguucaaugucucuggaccccagagucgauaguaguaguuaauaaaaagcucagcaguauuuuuuuaaugaaguaaucaugcuguacucuauaauuuuauucuuggaagcauaaagaguauuuacaauauggugucuuucuagggucagaauagugaggaaaaaaauggaaaaauguccaaacauccuuccuugcauggcaaugauggcauuacugguguguuuaauaaaaccuuuauugguacauuuuccggugugguggcauuggcagaaaccaucccccuuuggauuuggaacucagcagcugaugaaauacaguaaacauuaauuuggaaugggcugccaguuuuggaaagccaggugacauuuuauuauauuuguaccaagcagaggcugugucccauacugcuguagcuuccgcugucagaggcuuagcuggcauuauggaaaaaaaaaaauggcaggccugagaaucuuauccccugaaaugaaagucgaaugccaaauugaaauuccuguaggauuuccgauagcaaugggggaauugagaagcucacaauuaagcauaugggcauuaagauaauugucagaucuguuggcggacaugauagaagacagauggguacgaaucagugcgcuccacugcagcacccugggaggcaauuugacguuuuaccugccugagcuacucugccauauuugucacugaauguacagcacggcaucuuacugaguguuaaguguuuucgccgggaacuauaggugcaugugcgguccuucagcgcccucuagugaaacgcguuugggaguaugguuuuugaaaagccagccuucaucagguccucuuggccucuggaaauagcugucgcaccuccgguuccugcucaccucucugguuccucucgcccuuucagguggggacccaucgugaagauggcguggcccugagaggcagccauucucuucugccaaaccagguuccgguuccacagcuuccuguccagucugcgacuuccccugaccugaacccaccccaggacccuuacagagguagguuggccucaccagggcacuucugaccucacuuucacaauaggaccaguguugauacccagccucuugguguucaucccucaagaagcacuggcagaaacccaggaaucaaauugggcacaaaaaugguaaggaaauggcaaaguauuuagaacuucgcccgcuaauuguguuucuccagggacuguuuuccucaaacauccucugaaauccugguccuauaucagcagggaaugaggccacagacugaugagaggaaauuuuauuuuagcuauuuccacauuuuucucauucagguccucuaaugugguuaguuguggccugaaaaugauauuuccaaaugaauaggaaggaaggaaauuguuuuuguuguuuaagauggaaggaaauauaggugcauuuaaaaaauggagcuugguugcaugauuuucgcucuugagucaucuagcccucuaaugauugccucauaccggugauuacgagcggcuuuucaugaccccaggaaguugggcuauugcuggccagcugacuaggagucgcuuagauaacaucuucucagucccuucacauuuaauauaaaaaugauaacauugccacaggaauacaugugggcauuuuuucagcuguucaacauuguacagaucugagugucaauuauauguauggguaugucugcccauuuuuuaugaauaauaaucauuuuauggacuuuuuuuuuuuuuuuuuuugacagagccucacucugucgcccaggcuggaguacaguggugcgaucucagcucacugcaaccuccaccucccagguucaagcgauucuccugccucagccucccaggggguagcuaggauuacagacaugcaucaccaugccuggcuauuuuucguauuuuuaguagagacaggguuucaccacauuagccaggcuggucuugaauuccugaccucaagugaugcacccgccucagccucccgaagugcugggauuacaggugugaaccaccacaacuggccaggaccuuucuuaucaggaggcuuuggauuuugcccucuuuguccuaaaccugugcuucucaaacugcacauaagcacaaccugagcaucuuguuaaaaugcagauuccacuucuguaggucugggauuguccauuucuaaugggcucacagaugaugaggccgcauggaccaaaguuugaguggcaagguucuagaauacacagauuacaaauaaagaggaauacuugacagauaugcuucuaccuuuaaaaaaauuacuacauuagggucguguuuuaaaaugcagugugacuuggaaaguugagcaaugauaaagcuagaaauuucuaaaaugaguagcaaacugccuuccauauguaccauuuuaaaaugcugauuacuucuugagaauaagagaagccuaauuucagaauaucauuaggguaccuauugaagucuugacugcacauauuuagcauacucccugggaauuauauuuuaaggacauuuuucuauuaaaucauugcauauggaagaaacucaauauaauagcugauauuuacuuggguucuuaaucagaacauuggcugugugauuuucaugauuaugauuuucauugcaauuaaguugauguuuuguagacagugaaauuaccaucuacuccaaaagauugcaaaauagaauuuaaccuuagagccaaugcagggaaaacuuguuucugcaggugcauuuuuugaaacuucaacagauagcagggggaaaaaaaagugacagaaggaucacaguucagcaguaugaauugucugcuggcagccuugcaaucuggugugcaggcagugagauugugguguacaugucaccugauuucucuuuuucggcaggcaugccaccaggacuacaggggcagagugucuccucuggcagcucugagaucaaauccgaugacgagggugaugagaaccugcaagacacgaaaucuucggaggacaagaaauuagaugacgacaagaaggauaucaaaucaauuacuaggucaagaucuagguaacaguauauaauacugucgcuucauuuaauuccuuuauuggacuuugaugaagugaacagaacgggaagaaacuauucaguuuuuuccuggcagguaaauuuacagcugaaaagaaaauuaaaggccuacucuagaaguacuaaaaguaucguuucagauaccuguacucuauuggagccuaaacuguuuuggcauuuaugaaucuggacccaaugcuaaugacacacagugaaaaaauuugucucugauucaaguacaguuuauuuguaaaacuauacuuauucuacaaauuuggucagaaauguugugucuauaauauuucuaaaaagagauuguagccauguuaaaaacucaacugauguaugugccaacuauaacucuuuucuuaccucuaaaguaagaaaauaauuuccuagauuuauccuaaacaugcugauguauauaagaguaauaccuuaauuguuuaugguuuuucuuccuggacacucuuuucuacagaaaacacaacugcaggaaaauagcuucugucugguuuucuuaaauaucugcuaucuuuaaauucaaaucuauaucuccuugaacuuuaaucugguaaucagaugguuuuugaauaccaacacccguguacuuugccucaauucccugagguuguuuuuauucacaaauucaaccaauuguccuaagacuacagcuuuccuucuaaaggcugugguucucaagguucuaucuggaaucuuuugugaauuaagaacaugcugccucuuuauguugcuguuguaauuauugagauaaauuccgugucuugccacaaguuuaaaaaugccgaauacuucuagauaaccccuuuccuuccuuguugucuuuuucugauucuuggccacuuuggcaagaaaucccaaggaggggauuucauaccuuuagcagcuucuguguuagaccagucaguucuugguaauuuaacuuauuguggccaaacuuaugcauguuaauggauucuuugaaguuuuggaacaacauuuucauucgcuguugagaaccuucuuauuuaaaaaggucacucuuaugacauuuacuuauguaugccuccaaaacuguauuauaaggcagugcuuuuucaaaucuaggcaguuuuauuugcauaacuaguuuauuuguaagugaauaaccaauucuaauuggucguuagccugaaaaucuuuggaagaaaaguuccuauuuuccagucuccuuuguguaagguguagcauuuguuggauguauaaaaauaucacccaaaugcucagcuuccggacaggccuggcagagacuguuuucauuugcuuuuuacagccuauuugcauaguagaauauaggagugaauuaaucauuacugauuuccuuggcacuggcagcaguugggggugagggcagaggagggauccgcagaaggcagagaaagagggccuuuuccaguggacucaguugacuuccauguuuaccauacacaccuguggcagacagugccaucuggaaaggcgcuuacgcuauggagagagaggagccuggucuuacagcauccuucuguggugucauccuccuugccccuaacuuuucuccuucacccaaguguucuugacuuacgugcauuaucuuuauguguaacguauacuugcaaccgaagaauaccacucccacuuuugauugauuggagcuucucaaguguaauugguccuuauugccacuuggaaguuacccagagauucuccaaaauggaacaucagagucauauauuuuaaaccagcauucauuaaauauacauuuaauugaguagauaauuucccacaucuuccaacuccgaaauguugugauuaaucaucuuuauucugugaacauuuccaaugugugaaauuacccuuuagguuaauuguuagucacuuccauggaguuucuugugauggggagucuacugauguucagugaaguuuguuucauuuucugugucucucauaagccccccaaaaguccucacucauguuuauucacaauagucauucagagcuuuauagcacgugcugcucugccuucuugagacaagacgucgugcacacuucucuuuuuuacaugacagcccuuggaauauuugaacccugcugcugugacgacuuccucauaugauaugcuuuccagguggcucaucauccucuuugccuuccauucaaaaguuucuaauuugucacuguaacacucagaaauggacagaaccgaucuuaucuuuucagacuauucugggcccggccaugcauuuguuaugaaucauggaauauuuugguuuucacaauuagaaauuaccuuuuggcuuuuuuuuuuuuuuuuuuuuguaagagacagagucuggcuguguugcccaggcuggagugcaguggccugaucacaucucacuguagccuccaccuccuagauucaagugagccucccaccucagccuccugaguagcugagaccgcaggugugcaucacugugcccagcuaauuuuuuuuuauuuuuuguagagacgaggucucacuauaucguccaggcugggguuauaggcaugagccacugcacccagcuuucuggcuucauuuuugacucacaaugaggucauggucauucauaagcugcagguguuugguuuguugaaucguuuugcaugacugauaucaguucagguuucccaaacuuguucuguggaucauaaacaucuauaagauuaaagaccauggaagucauguuuuuguaacuuuuuguuuaauacauagagaaaaugagacucacauaguggguugaccaggccuucaaagcaagguaauggggacaccugaauaaaagccucacugucuucacucccauugcucuggugucuuacauauaggccuuucuucuuacuccuguuaagcugccuuguauuuuuuugaccuaucaaaaucauuuuucaauuacuuguuuccccuagauuucagaugucacgguaugaaagguuuuauauauauuuaaaaaauaaaguauaaacauaaagucuuuuugaagcgugguuaugcaacauaugcuaggcguaaguuggugaaugccugcuuugcagaguguaaccccauugaauaaaaaaagcuuuguuuucccuuucugccccccuguaucaguaugggcacacccugcacucuaacuuuaaucuacgucacccucaccuguuugguuuggguuuaaugucugcgagaaaaccaaauaucuuguguauugugaacugucaaagccaucuaaaccaaucccaaggucaaguggauauaaaaauucugccaaaaacauggcauaagauggaaaaguucccugaaaacucuggaagaaaacaaaguaauguagacaccuucuuuuuccccacaccauuagaaaauguugcaucccuuuugucccacagcaauaaugacgaugaggaccugacaccagagcagaaggcagagcgugagaaggagcggaggauggccaacaaugcccgagagcgucugcggguccgugacaucaacgaggcuuucaaagagcucggccgcauggugcagcuccaccucaagagugacaagccccagaccaagcuccugauccuccaccaggcgguggccgucauccucagucuggagcagcaaguccgaggucagugcaggccagccuccuugcagagcucgugaggagcuuguggcaggcacaagcugagaugggcacgccagucuugagcaguggcagacaguagacuuucaagcaucauuccaaagaauuguuuccauugcagacugugucuaaauccauaaggcagcaucccuuucuccuguaauuaaguugugggauucucuuauaacuaagauuauauugcaacuuucccuauauccuuucaguaauuugagcuuaguuuauuugcuuuaccaaccuuugcuuacuguaaaguggcuguacacacucacaugcaguucaccuuuuacuagugacugaccaaauggauugccacaguacuuaguaacuguuccuuuuguucuguaauauaaacacugagaaaaaggucagacacgcaagaagagugcauugcugcccucugccagaagccucagcauuaaacaaagguucugugcuuuaauccuccacagaaaggaaucugaauccgaaagcugcgugucugaaaagaagggaggaagagaagguguccucagagccucccccucucuccuuggccggcccacacccuggaaugggagacgcaucgaaucacaugggacagauguaaaagggcaaguuuguuuucagccauuucugagaucgaucauucaaaacucucaucaguguaucagccauaaaagugaauuucacccaaauugacagauauuuucuuucauggaaaaagaauuuuuuuuaaaaaaagcauacuuuuucuguuacaaauauauuaaugaauuuuuucucucuuuuuuccuuucucagguccaaguugccacauugcuucauuaaaacaagagaccacuuccuuaacagcuguauuaucuuaaacccacauaaacacuucuccuuaacccccauuuuuguaauauaagacaagucugaguaguuaugaaucgcagacgcaagagguuucagcauucccaauuaucaaaaaacagaaaaacaaaaaaaagaaagaaaaaagugcaacuugagggacgacuuucuuuaacauaucauucagaaugugcaaagcaguauguacaggcugagacacagcccagagacugaacggcaaucuuuccacacuguggaacaaugcauuugugccuaaacuucuuuuggaaaaaaaaaauauaauuaauuuguaagucugaaaaaaaaauauuuaauuuaaaaaaaauuguaaacuugcaauaaugaaaaaguguacuucugaagaaaacuacaugaacguuuuuguugguauucaagucagcuaguguuuauaauuacuggauauugaauuaggggaagcucggcugcccuaguaacaaaaccagcaaacguccugaugacaacgaagugaugacauuagccauuccuuaggguaggaggaacagauggaucuuauagaccuaugacaaauauauauauaaauauauauauaaauauauauuaaaaauuuagugacuaugguaagcuuuuguucauuuguuucagacuuuuuucuccuguaaaaaaauaguacugauuaacuuuuuuaaaagaaagauuuuacuguaaauauggauuuuuuuuuuuuuggucuuauuucugucccuuucccugguuuguuaucguaaccuguagugccaacucugcuuccagagggguagugcaggaugaaaugcugacccugauguugcuucucauucauaaauaaguagaaaguuguuucuccagucuuuugggaacacaggacuuaaaagucacaucauguguagauauuacaagcagcauuaccaagacauggcaaaaagaguuugucugaauuguaauguugcguuugugaaccuauucugggauuuucagagguacaagguuagaaugcuacaauguuaccacugugccuuccaauguuuauaucaucggaaacauaacauaaucaaaguggcugugauuuaacaaaaugauuaaaguguuaccuaccuguguagccgaaguagugugcagugaggcguuucugaauacauggucagauuuuuggaaaaaaacaaaaacaaaaaaaacaaguaaaguucaaaaaccgucaaaugagaaaauugcaaguagugugacagagcugauugauuuuguugcuuucuugauuuuuuuuuucaaaauggguuuacuaaaauguagaugacuuaacugccuccuccuucgucugaaaaaugccaauauucaaucaucaugcagcauuauaacaagccuuauaaguccuaaagcauuaaguugcacuuuuuugaggagggguagugcaguauuucucuggccaguaugaaugaaguuuauacuuaccauauuugauagaaacauagaucaagcuauggcacagcgacucaucagauagcuagcuuugacgucugggcacaauugaaccaacuuccaucgugaaucuuuauaaugauugacuuugguguauagugcaguaaacaaauagugcuccuaguuaaguauuugucagcauccuuuugucucuaacuuguuucuauuuuuacagccacacaauucuuggcauguauuaagaaaaaaaaaaaucccuguucaaguaguuuuuccaccuaucagcacugaguaaaugccauaaauccauugaaauggucuaaauguuccaucuguucuccuguuuugccaguuauauaguaaugaaauacauuuguaaauuuuaugcaacaaauggcaaacguaucauuauuuugaaauuguguauguaaaaguuauauuuuuacauguagacucuuguuauuauguguuuuaauacauuguaucaguuuuuguuuuuuuuuaaaaacugugguuuaaaaagaagucucauuuaaaugaaauagcuacaagaaucagaauuuuauguucauuucugaaaauguaagaacaaauaagauaguuaccacguggucaucuuuuacaaacccauaaacauuuugauuagcuguguguguguugaaaaacuguaaauauguucaguagcgauaaaacuaaaauaacuuugauuuguugauaaguuccuaaaauguggagguggauuaaaaccuuaggagaauagcagaaaucaaacuucaugaaaaguuauuuuggggcuuuccugugaaauguaugaacaaagaggcucagagaaggacauggaagacaauaauguauacucucuccuccucccugaauaaugaaaaccauguguauuuguucccuccguauguuaaagauuuccuuuuagugguacauucugcacucauuuuguauagucuaccaaggcggguaucccuaggaacaauauuauauaggaagcagguauacucugaucacauucaggauaaguguacagaagaaaauacgguguuuacucuuuagggaacuggaaacacucccugcauugauguacauuuuaagaauggcacuuuugauacauguuaucauaaaggugcuuaauagagcugaauuaaaguuuuucaaaucuguaaacaaagcaaaaaaguaaauuguagucauuugauuauuuuuuaaauuggugcuuuauauuuuguucucacucagaguaaaagcugcaauuuauuguucaccagcuuugauguauucauuacucaguaaugcaauaccucuauuguugaauucccuuuggaaauaagugaaaauucuaacggccacugaaagcugcucgcuagguuuugcuugguggagaaacauaaucugcaccuauccauauuaauuggguuguauccccauuaaaaaagaaaaaaagggaauguggccuuuuuaguguguuuuuuauuguuguuguuuuguaauuaucaaacccagguaagauauugguauccugcacuggauuuucaaaugaaguucagcagaagacaguuaagauuaaaguacuauacaaaaauuucaaaaggguccauacuacgcuaucuguaugacgacacuuaggcuggggaucucuuucagaaacucggacuuuaaaagcaacuuggagcaguugauccaccuccacauucaaguaauuuaugaauaugcagaauagggaucuguucaucuagaaauuuuuaccauuugucuucuguguagcugcaaggaacacuaauguuuauacaacugucaguccacccaguggugcaacugguucugauucagucuuccgauuccuuuuuauuuuucacuuuuuccuauuucugaauuuuuuuuuuuauuugugaucuugauuuugaugagggguuggggaguggggagggagucgaaccaagacuuggaguuaagaggauuuucaucuuuugcauccaacaggcagaauaugaucuguguccaaaagugaacuugagucaggaaugaaucaauuucagcauaaacaagcacaaaaauuuagucugcuggcugacuggaagcaaaaaagucaagauggaauaugaugaauuccaacacaauggggcaccaaggccuuuaggccucucuuuuuauuuugcuuugguuuuguuuguuuuucuuuagagacaugcucuuucucaugggacuugaaguggacucaucuuugugcagugcugguuuugccauacucauuucaaguauuauagacauauguaauggugaaaauauaugaacuguggccuuuuucauucuuguuacuugugaugcaauuaagugaagauaagaaaaaaaaaaaaaaagcagagauuuaccauguaucagugccuggcuuuuuguuauaaagcuuuguuugucuagugcucuuuugcuauaaaauagacuguaguacacccuaguaggaaaaaaaaaaaacuaaauuuaaaaauaaaaaauauauuuggcuuauuuuucgcaggagcaauccuuuuauaccaugaauauuacaaaaaaauugucagauucugaauauuucuucuuuguagauuuuuggaaucauuaugaguaaaaguuuguuacuuuauuuuacuauuuaaaagauguuauuuuaccauguguuaccaagaugaaacuguauggguagcuuuuuuguuuguuuuuuguuuuguuuuuguuuuuguuuuuguuuuuaguuguaggucgcagcggggaaauuuuuugcgacuguacacauagcugcagcauuaaaaacuuaaaaaaauuguuaaaaaaaaaaaaagggaaaacauuucaaaaaaaaaaaaaaagauaaacaguuacaccuuguuuucaauguguggcugagugccucgauuuuuucauguuuuugguguauuucugauuuguagaaguguccaaacagguugugugcuggaguuccuucaagacaaaaacaaacccagcuuggucaaggccauuaccuguuucccaucuguaguuauucgaugaagucauguacaugaccguucuguagcaauaaaugugccauuuuuauaaacuguuucugacacuuguuucauuucauuuugcauuguccauauagcuaugauucucuucuguaaguaaaacgcaucuauauuucauuuuccaaguguuggagguauugacagcuuaacaaacaaaacauacaaaaaaaaucacaaaaacaaauugaaaagcaaagcacaugauugaucaaggaagagaugcccuuaaugaaaauggaacgggaugcaugcaaaacaaaaagaaaacugucuagaggauuaacuaauugaaggaauauaauuaauguguguguaacacugaagcuaugcauuugaagagcucugaacugcaccaguguuuucgguugugcugcagguugcuaagucaagucagccuuaaccuuuugcaccaguuggucggcuguuuggcagaacauucucagaucuuuucagucaaaaaucuaagaugauuuauuuuguaucacuuuguuaaaagcugaauauuguuaacuacaguuaauauuaacacuguauuuauacuuucucaaacuacauccgccccaccacuucugguugccucuguugacuauuaauccagauguaaacaaccagauguuuuuuucuaacuuguacaaacugacgugugucaacuaucauggaaggaaaaaaauguacagauuaaaauuauucaguguuauguacuguaaguuaauauuuuuguagaauggacaucaaucuacuuugcaaaauuuggaggcuauuucaacauugcacuguagaaauguaaaguaauguaugcaauguaaaggaaagcccgcgguagcugagcgcuucauaacagaauguucuaaucaaguacgugguauuuggggaugucuccaauauugcucuuguauucuuucuaauuggguuuagugacuaguugaaggaaaauguuauaacgccauuugguucacaugugaagugcccuccauagccaaauguugggauuuuuuuuuuuuucguuuuugguuggacuguuugcagauauuuaaauuuuaugaaauuuccaaagauuuugguugauaacccccuuuuaccuucuaaaugauuugagauguucuuauguucuuacuguguguuuuaaauauauauaaaagagccacaagcauuuagucuuuuaguauuauauuugaucauauaacuacuacugaaaaggggugggggggaaugugccugugcaccccuacaguaucuuguguagugucuauuaacauuguucucuuuuagaggaccacauuaaaagg

SEQ ID NO: 6330 - RNA, 366432 nt, Homo sapiens
guguguggaugugugagugagagggaacgagaguaagagaaagaaagaagugaggggauguaaacucgaauaaauuucaaagugccuccgagggaugcaacgggcaaaaacugaacuguucaggcuucagauuguaacugacgaucugaggaaaaaugaggugcucgaugaauuuucguuuguauuuuuuggcgaggcgggggagguguugagauuuuuuuuuuuuccccucggggugggugcgagggggaugcauccuagccugcccgacccggagcaagucgcgucuccccgccggagcccccccacccauuucuuugcugaacuugcaauuccgugcgccucggcguguuucccccuccccccuucccuccguccccuccccuccccggagaagagaguugguguuaagagucagggaucuuggcugugugucugcggaucuguaguggcggcggcggcggcggcggcggggaggcagcaggcgcgggagcgggcgcaggagcaggcggcggcgguggcggcggcgguuagacaugaacgccgccucggcgccggcggugcacggagagccccuucucgcgcgcgggcgguagguaccggcgccugcggggcucggcggggcggaggcgcccggcggcgcgggguucgggcucggcggccccgcacgcggcuccgcgccucccgcgccgcgggcucccggcgcccggcgcucccagaagagacaccccuuccccucccgccgcuucccucccccucgccgccagcccccccgccccuccccuugaugcccccucggagggaccgaggacuuugccaggggccugacuuuaauuuuuauaaccccuuucuuucacaaauuagggugcuggacaauuagaggacccgacccuccacuccgcuccccccaacccugucaccccaccccucccccuuuggacguguuuucacuccagagacgcucaucuuuaauuucuugauagcuacuuugaaaagcggaggggaguggugugugcgagugugugugcgugugcgagugugagugugcgagggggguggggugcaggguggggggaaaguugagaucggaucguucucaguaguuucucuuuucucugugauccauucauuucucgcucuaccuccuguugcauaaaaugaugcgcugaagagcggcuuuuuuuuuuucuuucccugauuugguuuuauaguggauguuaccaguuugaucgucucuuuggaaauacaauaucgcuuuuuuuuuuuuuuuuuuuuuuuuuuuuuuuuuuuuugcuauugcugccuauuccaucuuaaaaaaacaaaaccaaacccaacccaacaacaagucucccaucccuuccuccuuuccaccuuaaucccacccgcccccacguccccacccccaaccccccagucuccaaaaauccgauuguguuuucuccaaggauugggacuggauuuucugauugcgguuauuuccauguuucuagguuugugugauuuugcuaaaaugcaucaccaacagcgaauggcugccuuagggacggacaaagagcugagugauuuacuggauuucagugcgguaagaaagaacgguggaaacuaacaacagcugugaaaaaaacaaaacaaaaacccaaacacuucagcuagaaaccaguaggaaucuaaaggacaguaauaauuuuuaauuggcugaauccuugguaaauaugaaggucuuuuugacaaguuuuuaacuauaauuuuguggugugauggaagauucaggcuuuuuuuuuuuuuugaguuuuauuacuggccuucaauucccuacccacugauuaccccaaauaauggaaucucaccccaguggaaagcaaaaauagacaccccuaaaacuaaaccaccccuaaaacuuggccaugucugaacacugagacuacuaauacuuugcacacuacucuucguuuuauuuauuguuuuuggaaauggaaaauagaaaauaggagacccaguugucucuuuaaaguuuuaagcuaaugaugcuuuggauugguaggaccuguuccuuacaucuuaccuccuaguuacaucuuuuccuaggauucuuaaaacuaguauggauaugcugagcauacauucuuuagaaccuuuuggacuguuuugguaaauuucguagucguaggaucagcacaaagcggaacuugacacacuuguggaguuuuacggcuguacuugguccuucuccaucccuuugcuuccuuuuccuaaaccaagucccagacaugucaggagaaugaauucauuuuuaaugccagaugaguuugguguaagaugcauuuguaaagcaaaauaaaaagaauccacaaaacacacaaauaaaauccaaaccgccuuccaaguggggcucuuucaugcugcugcugcugcugcugcugcugcugcugcugcugcugcugcugcugcugcugcugcugcugcugcugcugcuccuccuccuccuccuccuucuccuccuccuccuccucuucuagaccuucuuuuggagaaauggcuuucggaaguuuugccaggaaacguagcccuaggcaggcagcuuugcagcccccuuucugcuuguugcacuuucuccauucguuccuuugcuuuuugcaggcucugacucagggaaggugugcauuauccacuagauacgucgaagaagagggaaaccaauuagggucgaaauaaaugcuggagagagagggagugaaagagagagugagagugagagagagagagagucuugcuucaaauugcucuccuguuagagacgaaaugagaauuuagugcagguggcacuuuuauuuuuauuuggguucacauaugacaggcaaauccuauacgagauggaaauggacauugccacguuuauggccaagguuuucaauauaaaacaaaacaacuuuuuucuucuccuuggugaaacuaguguuuuucuagagaggcugcuggccuccaaccugaaucuugauaacauuauggggacuguguuuguuccaaauguagcaguaguacugcuuggccaucuaaugaaccugaggaaaaagaaagaacagagugauaaugggggcuggggugggaucuguaauguuguuucucuuuuaguuuuaaguuggauggugauguauuuuacuaaauaaacccuuagcauaaacucuaagcuguuugguaacaguaugaaagaucuuugaggagcucugaaggcacaagugucuucuuuucaacuguaauauuucuuuguuucuuuuagauguuuucaccuccugugagcagugggaaaaauggaccaacuucuuuggcaaguggacauuuuacuggcucaaguauguaaauucuuuucuuaguguuaaguuaaauguucugggcuguuuauuuacucaauuguauguuuuuggcucuguugaagaguucugaaaaagucauugaauuuuagccuguaaucauacgguuauugcauuacccaucagugguauaacuuacacaaaauguuaucuugugcgauuaaaauuaggucuuuuuuuuuaagucaaggaaacucucucaaaauuccaucacuuaauuuaagagcaauuuucuaauacaguuguaaucaaacacaugaagauaagaccaguguuaacauggggaauaaauuaauguuuucuauuugaaaauaaggggaaaaaaucucuaacauucauaaaaugggaaaaucccuuguaaauaauaucauuuauuagguacuguauacaauuaacccuuuuaaagaaaugaacacuuaauucugcaaaugaaugcuauguaguaaaccauagcuguaaauagccucuugcuaaucuuagaggcuaaauaugaauucauuuauauuuaaaauacccuuuuugaugcuuuagcuguuuuuuuuucccuaacgauuuacuugugcaaugaauuuuuacuguauuuaaaguugcaaaucuggaaggacuuuuacguuuuauaaaugaaagaucuuugggugaugcuuaaaaaagaugcuagcacuauucacaaaggaaucugugugcacagugauuaucuggaaucuaaggagggguuuauuacagggcuauucgaauaucucuuauuaaaagugcagagugaaaauauucauuuaaaauguauuuuuuuuaauccaaugaauuucaaauaagaaaaaguuauacauuguugccugcuauccuuuaaguccguggcuuaaguccauuuaugcuuguuaaacagcugcaguauuuuaggaguucuggcaaugguauauaacaguacauuaggccaaguacuauucuuaagucagacugguaaauguugacaucuuuuaacugugagaugccaguggaauugucugucaacuaugaauauaauuuaacaucuuuuaauauucauuuggugcuauagcaaugaaagaaguuuguucacuuaugugauuuguauaauugguauauuuuuauaaaacuaauggcuuuaaaaguugcucauuuccaaauaaguuccuucuccuucuauugccugccuaaguuuagggaauuugugucucgauaacuuguuuuaaaaaaugugagaugcuucuuguauuuuuauuuuaguuuucuggugcacauugauuaaaaggaccauugacagacaauauguuuguguuuuacuauccuggaccugguuauguuuuccacuuagggauuugggauaguuuuuauauuaguauuauaucuuuaaauuucuguaugguauccucuaugcaacuuuuaagauggaaaauauuaauaugcauguuugauguaaagguaaggacaaguaucuuuugugggcaaauuaauuuuucauguuagacaagaucaaaacuaacuguuuuugacaguaauuuuuuuaugacuuaacuuaaaaauguguauucaguuucaaucuaaaaguagcuuaugucagacagacacagagauagacuacuuuuaaagucaaugcuaaaaaacuaguuugcaauguugugaaaauaugcauuuagaauaacuuaaguauauuacauuagauauuuaauaaaguaagguguuuagaaauaugagauuguguuacauuuaaaaagacaacuguaugucugauccauuuucuauguucacauuuaaauaaaguucuugcugugauguuuaaauguuuauagagaguacaggcuuaauaaguugaauauguauuaaugcauuuugguaagugaugauauaucaacacuuacacaguucugaagacaauaacacacacacauacacacauacacacauacacauacacacauauguucaugcaugcaaaccuggagagagacuucacucuuaauaagucauguuacacugcuucuaaugcauacacagugauuauuuugaagguguggaacuuuaaguuacguuguaccagaaaugguguuuucaggaccaaauguuuacuuguaaggguaaaaaguguaaugguccuuuuauucuggcagccugaaugagaaugcaggguauucauuucauguaguaugauggugauuauaauauguaggguacagauuggaguguucaguuuuccucuaucaagauaguauuugaacacagggcuguuaguuaagaaaacggguuguauuuccacuuaaaagaguuaaaucuuuuaaaaagcguaauacauuuuaaaaaucaugaauacugcauuuugcccuuuaauuggaaggaucaacuaggaaacuuuggagagagaaauaauuuucuaaauuuaccucaaguuaauauccauugucuugaguggacucagaugucccuuucauggauugcuuugaaacuuggauuuaggaaagaucuaaacuauaaguagacuguuccuauuugaaaaaucagcuaugguuuuucaaagugaggcaugguaauaauucaugcuuaaaguucccaauagcuuuugauuccauuaauauaggaugcuccauagugauuugcaaugugagaauaaaaauaaaguguggccauauucccuuuaaucuuucauuucacaaacaugguuuuuccuaccaccuuaagaaauggugaggcugcuagggagaauggaauguaaccugagcuacagccugacauucccagggagcauuuuucacaugaaaggcuuuugucaacccaggaaaggacuagcaguuuuuguuugauguuugcagguguucagcagaaagcacuaaaacaauucagccaugaugguucagagcuucgaugaccuuaacagggaaaauuggugggcucuggaauuauuuuuaagaaauaguuauaaccuauaugguaacuuaaacaaagggauuuaauauccguuauaucauugaucuuaaaacaaacuaaaagcauccacaugccuggaugauuggaaaauuauucucauugaaaaguaggauaccuaaguuaccaaaaaaagaaaaucaucuaaagagucuauaauuuauugaugaguauggacuuaauuuucugauauagcagaaggacaguuuauuugguuacuuuugacucuugugaggaaaagauaaacauccuagcuuugacaucuuuuuaaaaagucguuuuaaaguugggccacuaaaaugauacauucuaaagaacuuguuagaucaggucuggucacaucuguuacauguauuuacugcuggucuaugacagauacuacaucuuucucccuuaguuuaaaaguugagcuuuuuccccugugacuguuuaguuuuacugagguguucagguauuguuaaaagauugucaaaugaacgaguguuugaacaauuaagagcagcguuaaaacacaccacaucucuguugugggucauuuuuggaagaggaaaguauugccugaaauuuaccuaaguuagcuaaccuauauccacaugacaccaacauaauaugccaauuuagugaauucauugaggcggaaaaaaaucaguccgguggguaguuuuguaugauacagaaaauuaacguggucacauccugaauuaguuuugaguucauagugauggcaugaaaaaaaaauugguuuccccuuaaagauauuuguugaggagagcugcuuaauauuguguguguguguauaagugagugaaaacacccuuaaaaucguaaaugguauaauucauaaggguucuguggcuuuuuguaaagggcagaguaauuuaacagguuaaaagaaguacaguggcguuaaacccauuauguuagaaucacagaauuuuggguauagaaacccauuagaaauguugcccagugccuucauuauacaggcaaagaaaacugaggcccaagauaaggaguuccaaacugugcuuucuuauuuguuauuuuaaaaaacaaguuuuuauuugcuaauucucuauggcccugcaaauccuuuauuggaaauaaccuuggucucacugcugucuuucuguccuuuguacugcguaauggggcuugaggauuagugugcugauauuugugcauguaaaugcuucuguauaugcaugugccuucugaaaacuuuuuuagguuuggagcugaauuuuggauuauugaucauucucuuuugccuggucuucccugugacuguuuugcaugauguuggguaaaauaauagugugggugagcaugucacagugcuucucaguguguuagagaggugugcuguguaccuuauaccuguuguauuuuuuaaauccuaacaagaaccuaaugagaugcaaggauuacuacuauccuguauucauagcugaggaaacagagacagauguuaaacaacuggaucuuaaggcagccaauaaugaaauuagguuuuaaccucagguuugucuagcucaaaguccugaguucuauacacacacacacacacacacacacacacacacacacaucagacagcucauuuuugcaagauuauauaggcaaacagugugauauugaggcuucgcacgaaaugcuaucugugaucuuuaggguagauagcauuuuuaaaaaugugucuaauguuguaaugaugucaaccauauccauuauuuuucccgccuuuguauccaaauaaacuacccuuccaauuuaugacagauaucaaugugacuaaauaugucuuucucauaucuuuauuaguuuuacuaagaaaauacaguagauauuuuaaaaguugugcuuucauucuguuguaaguugauagucuacauggaugccaaugaaaacauguuuuuauguagcuaaucaauucagaauuugagguaaccaagccugauguauuaauauguaaaaaaauaaggaucuccugucuuuaaauauaaaaaaguuuugcaguucguuguuagaucuuugaaacuuaauauucaagaacaauacccucaauucuaucugcaucacuaaaauaagcaguuuugaagguuugauaugucuguuaccagacaugugcuuaaaauguuacauuuucuaaauucagaaggcagaagcaguacucuauuugacacugacuuaaguaaauaaaaugcauuaaacaagcguggggauccaagaacuguugaaacugaaaugcuuaacauuuuugacagcaucagcaaauuauccuuacccuacuauuguaaugaggaaaucacuuaaauaacagaugaacagccaagucacauaaacauauauaauagaacuauguaaugaaaguuuaugcuguuaauugcucgaaucugucuuaaaugcuuagaaucauggagcaguaaagacugucauauaaacaguuuuguuuugagcuuaaaauuauuccuuuuugcuuucaucugcuaugauaaacaaaguaauuuuguaagcuuuaaagaucaaacauuuacuccuaaugguaaacuacauuuuauauuggaaguuugcaaccucguccaagucauagaguugaguccugguggccccaggccugugauuuucaacguuuaguauuaugaugcuauuuagaucuguucccauaagccaagauaacagaucuuaaguugccuaauaaggaacaugguguguuuugaaauguucuucaguuuacaagucuuaaaccaaaauguucuuggccaaaccuuuagaaucuauauguaaguugaauaagucagauuuuauacagacauagcaugaaaaugaagcuaaguaggaacagaaaaaucugcccuuucuuuauuauuuuuuuuuuuguauuuuaugagcuauuuuuuauggccagguguuuguucuuccaaguuaauuagauagugcuaaguauuagaaaauguaaaauacauuacagauuuuuuaaaagguuauuuuuguuacugguuucuuauuacucuggguaaaauuuucacaacugaccaccagguuuauuagcuuauaugugagcuacccauuuuguacauucgugagccaauugacuaggaauaagguaugcacauggguuuuauguggauacuuuugacccauaucucucuuaauacuuaggagagagauauaagagaaauaauaauuuaaucuuuggagaagauuaacacuuuguuauaaguuauauauagguaaauauauauauauauauuuauauuagacuugcaggaauagugaaaauguugaaaagguugucauguuuacuuucauuucaaagauaaaggcccaguuaaucagcauaucaaauacccagguguguuuaaaaucaguuuaugugggugaauuucagggcuguaagaaaguauuuuauuuaaaggugcagccacacgauugauuguucaaaugggugcuuuuguacuuuugugugacaauuaacauuuaaugaaugacuuucuggacuggcauuggugguaauuacuauauguaguuuauuaacugcaauccauuguuggaugugccuuuauugauuuguuuugcaaacaccccuucacaugugcggcaguauuugugcagccguauuuguacguuacuuuuuaaagaaccuguuucacuugcugaugcugacauugccucuaaaaauguuaguuuauaaauucucaugugccagaaugucucuuugauccaaguaauuuuagcugaaauacaaaauccgucaacuuuucugcuauaaaaaguuugcauucaaauccucagggaaucccaaaguaaugacacaauauuguuuuucaaguaaauaauuuauggaaauuuacauuuauaagagacuuuagagaugcucuauuuuuuagguaaggagccaagguucgggaggguuaaaagucuuuugcccaaaucaugcaguugguuauuggcuguaauaggacacaaauacacauguccugacccucuggucaaagaccucaugcugcuuuuaauuaaggcuuggacucaauucgaugguaccaacuguauauuucuuaagaagggaaaaauguguauaaucuaccauuucugaaaaaauuauuaaaaauugagauugugaaagauggacguuguaauccagcccacuugucaucacguguucuaauuuggccaaggcaguugacaaauaacuguuaaaauguauuguguuauuaaaaauaacaaaguaagacccaugauuaaauaucagggcuguaauuuaaucuugggggaucuggugcuguucauaaaccauuuggcuuuuuucuguaacggaugacgucaaaauccagcuugauugaauuaugacccuggguuacagcagcaccugcuggugccuuuuuacuucauggccugucagcauuuccauuacaaacuuuuuucucugacauuuuaaacuucaaauaguuaaacuggacugaugguuggcauauaaacuuucugcuccuugggaaaagaccacuugcucaauaaaaacagagaagguggugacaaagccccauuacaggauaccccuuagaauguucugcuuugcuuuaaucuuccauucauuuaaacauucuuuugggggguacuuagcugaauugcaaggcauccaaauggaagguuuuuaaucucaaauuucccaugugaagacuuaaguaugggguguuuacaggacugguaaagugcaaaaagaccuagcaucuaugcagguuauugaaacucuggacaauccaguuuucauacaguguguaaaaugcugaggagcaagccaugaaaaacaugcaaauuggcauaccuugucaguaauugcuuuuauauucacuuaagaugaguaaaaauugauaaugauuaugguuagaaaaguaucuuuauuuauauuuauaucuggagacugguagcauagcuucaguuuguccccuuggguuuuaauauguugggaauggagaugggauguuguuugcaucuagcuagucagcuuuucaucuaucuagucuaauucugauugauggaucaucauauauauauauguauauauacacauauauguauaaauauguauauacauauauaaauauauaaacguauauauacauuuauauaaauauauaaauguauauauacauuuauaaauauauaaauguauauauacauauauaaauauauaaauguauauauaaauauauaaauguauauauacauauauaaauauauaaauguauauauaauauauauauauauuuaguaccugcuauucucauaucuccauguuagcaauuagaggacauagagggcuuuauggaagagagaaccuucucucagagggcauauauucuaacacagggguguccaauauuuuggcuucccugggcuacacuggaagaagaagaaucaucuugggccacacauaaaauacacuaacgauaguugaugagcugaaaaacuuuugcaaaaaaaccucauguuuuaagaaaguucacgaguuuguguuaggcuguagguuggacaagcuucuucuaacaggagaaaauagaaaaguaaaaaugugauuaacaucuagcauugggaagacacaauaaugugggaguuuagagaaaugaaaacuuauuucuuucauggggaaauuaauaaugaaggguucauggaaaacucaauucuaauccuugaaggaaugguagaauuuugacaaguagguagugagacugagcgugcauaucaggaucacugugaaccaagcacagaugaaagaaacuggaaaggguagauuaaagagagcucccagaaagagaaguuucuuggcucuaaaguggagucaacucuggucuagacacaugggaugauuuccaggcaaaaaccccugucuugguugccguuuauuuucuugacugaguuugcguuucacucggggguguuaccgauuauaauccaguuccauccaaaaguauauguuuuuaaugguagugucgggauggaaauugaagauuuugugucccuacuucccaaaauucuuccuauaauaucacucagcaguggaaacuuucuugagccaaaugaagcugcuuuggagaaaauuguucauguagccaaauucuggaaaucuagguucuuuugcaauguuugcugguaaguagcuguuucauauugaggaagugguagaaucuuaaaggcugcaccucaaaacuaaacaaaaucgaaacucaccaguacaauucaagagggguuuucacauuuuuuaaaaaggaauacugcuguauuuaaaacauuuuaagauugcaaaaauucaucauuauaauuuuuauuaucaucacuggcaucaccaugaccagugucacauuguuuggucaaaagcuggaauggaaaugugauaguuaucuuugccauauuauauauugagaaaugcguuuaaaacuuuuccggagauaccgugaucuuagcaaaaacuaauguaauauuuguaaaaacauugugaaguggccagauauaccuuuuaaugaaacugaccagaaguacaucacaaauagaaaaauacacguguguguguauguguauaccaucccuucccccaaauauuguucagauuaaagugucuuucucucugugaccugcaaguaucuuaacuuagcauguguguccaauuuccauagugaagccaaaaauucaaaugaugguugauauuggcuuaggaagaauuuauuaaugaaugacugugcuugguauagaguaaaaaaaaaaauuuaugacaaagaggauauucuagacucauguaaaagauuucaguuaagaaccuaugaauuccucaaccuuuuucuucacuuuucaaaaaguaaaggauuuauauuggaaauauuuugcaacccuacaaccugaaacucaaagcuuuggucagcaggugguaauaauauuuccagguugaauauccaauuucauacauaacccaauuuguaaguuugaaaagaaauauuaaacgaugucaguuuuaaugcuuguuugaauaauuguucuuuguuaugugcccucuuggacauuauuguccacuagugccccaaaccauugaaugcuuuucuguucucuuauggccacugugauucuucaaucuaguuacuucuaacugcaagauuaauuuucuucugacaucuaauuuuccccugauuuuauuaacaucuuauuauucuuuuucuggcucauuuugaacaauuucucuuuuauaugggguguauauuuguagugucccacuuguaagggaauucuacacuuuaauccuuaguaauuuugguagaauugggauaagaugagagauaguccauaauuguuuaaggcuugauuguuuaaagaagguugaaagcuucagaaaaguggaaguggaugaaugcaugccauguucuuauuauuuuuucagugugaguguguuucacuggaguaacgauagaguuauuaggaauuauuaccuuuaauuuacuuaugugcacauucauucguccacucauucauucauucauucauucagugaaaguuuuuuuuuuuuugagagccaagauacaaguuauagugcuagaaauuauggugcuacaaagaacaacaaauuucaacuucagcacugggacauuauguugcaguuguuaaauaaaaguucuacaguaauucaaagaagguacuuuugaaauaaaugauguuggccaggcuggguggcucaugccuauaaucccggcacuuugggaggccaaggcaggcggaucauuugaagucaggaguuugagaccagccuggccaacaugauuuaauuauuuuguagaaaucccguuucuacuaaaaauacaaaaauuagcugggcgugguggcaggugccuguaaucucagcuacucgggaggcugaggcaggagaauggcuugaauccaggagguggaguuuguggugagcugaaauugcgccacugcccuccaguauuggcgacagagcaagacucugucucaaaaauaaaauaaaauaaaauauguugaaauaugcaaguauacuuuuucaaaggacacuuuucaaauauaaccaaguacagacuucacauuucuaacugaaacggaaauccuaaaaucucuguauauguguacauguucuaugugaauauaaaggaaggcgaauggauuugaaugcuuauggaaauuggcccuugaaguguaguguuaggaauguacucugaaauuuagugucagagguugucugggaggcaaugagaauuaaguuccauucguccuuuuugagcagaaauuaaaauuuuggauguguagaugguacucauuuacuucuaggacacuagauauacaugcuuaucuuuuuuauccccacacuugaauuauguuaauauuuguguuuaaauugauacacaguaaaauauucuuuuaaaauuaaguagaugauuauugagcaucuaccaugugucagguaauacuuuggcagcucuauauaaaaugaugagcaagacaggcauguuucugauguugccuacauggaggacacagacauuaauggauaaucagccaaagaaggucaaguacuacauuugagagguguguggccugagaagaguuugcaauagggauaucugaucaaggggagcagucaggaagggcucagagaucagcccaggugaacuguggucuuacagaugaggaggaguuaaguggauggagguugcuuggcugacagguagggcaugauuccagccgcuguggcugguggggguugguaggugucagaucccgcaagacugagccacagggagccuugacagugugcugcuaaucagauuugugucugggacauggacccaaaggggagucacuguggguggcccacaccaguugugaaguuuuugcagaaguuuaggugagagacaggguugcugguucuacagugugggugguaaaguuggagaauuaacuuuguagacuuuauuugaaaucuguaccuuuaggucauuggggagcauucauaguggcuacuuguuuuuuuuuuuuuuuuuggugaaacuuccuauaacuuucuaauacuugaaaaucuaccauacuuuauacauuccgacaguaauuaugagaccuaauucagcugugugauagccacugccuuuuuagcaaccaagcacuaacuagagaagugcucuuuuauuuucugagaaaaguuagauugaguuugcaauucugcgaggguacagggguggaagugggucuuauugaauggucuucaguaccauuuuggcuuuuuuuuuuugagacggaguuaagcucucauugcccaggcuggagugcaauggcgcggucucagcucacugcaaccucugccucccgaguucaagugauucuccugccucagcuuccccaguaguugaaauuacaagcaugugccaccacaccuggcuaauuuuguauuuuuaguagagacaggguuucuccguguuggucagacuggucucgaacucccgaccucaggugaucugcccaccucggccucccaaagugcugggauuacaggcgugagccaccgagccuagcccuguuuaggcuuuuuauagccuauguucuuaugagcaguaaacauuaugaugguuuaguuagaccuguugaauugaauucacuucuccugccuguggucagguaucagguagcacagccacagaaguuacugaaugucuuuguugguggacuuuaggagagugguuuaauuuaugugguauucuaucugggauugcagcaguauuguuagauugcauuuugucacagggaggaaauuaccugguaacuccugauuaggaacaaaaugaagcuuccccuuuuuacaaauccuggcuaacauuccauuuggcucucuucuguugaccaccucucucucuccccucccuccucacuccauuuucucaguuauuuuauuguuuacuauuggaagucaccucccaacucaggauacuuguuaguccauuuuaggaaaaauaucaccauucuuucacuauuauucucuguugaaguugaagaacagaauauuacuuuuuuucuuuccauuauugguuacaccagcuaguuagagacuugggguaauacugugggcauggguuggauccugauaucugugucaguuagugagaguugguucuaugacccuagagcucuuuguguccuucaaacgagggugcugaaacaagacgaacauagaacugucuauaccaagcaaaaaacuccugaaagcacaugcccacugcaggugaauugguagcauaguguggagauaagugggcagugcuugguccuguuucugccuccuagagaguaccucucagcauccagggaugcuuuaguaacucuuaguuaaaacgaaaugaacuauaauuaauuaccuuucuuuugggagggacacagagaguuucaacagcaucuacaaugcuuuuuuuuuuuuuuugaaaagaaaauaugauagaauauuaagauugacagagcuggggauggguuggaggcugaauuaugauguguguuuucuuuaugcuugaauuauuucauaauuaaaaacaaaacauauaauaacaaaaaaaaaaacacccucuaccucucauucacauuccccucuggccauagccucuuucuugacuuccuuccuagcaagacuuuuguuaaguguuuucuacacaggcugcuacugcaugcuucaaaauuuaaccccaagcaaauauuagaaaacauauuuuaucuuauaauacuugauaccuacagaauaaucuguguaacaaauguaaguugugaagcuuaauaauggagugaacaucuaugaacccaccaccaacauaaguacuggagcaaugucagauccauuggccggccuguggguuuguucccuguccaccuuccccuaucuuuccugccagagagaaacauucucaugcccuuuuuaaaguaguauugugacuggcauauguaucccuaaacaauacuguauguuguuugguuuugcuuguuuuggaggauuauaaaacugauagauuguuuugugcuacuugcuuuuucacuugguauguuauuguccauguuguugcaugugguguauguuaauuuucucugcugaugaauagguuguaguuuauuuaugcauguuccaguugaugaaccuuuguguuccucuuuuuuggaacuacaaacuuucuuguauguuucucuugaugcacauguguaagacuuucucugugggguauaugaguggauaucuaugaguagaauuguugguuuguagaguuacaugaaaguccagcauggcaggauaguguccaguuguuuuuuaaagauucuuacugaucugcacucccaccuguagcauaaaggauuacuauuggugcagucuacugguauaaaauagaaaauguaucccauuauagucuuuuuuuuuuuuuuuuuuugaggcagggucucacaucucacucuguugcucaggcuuggagggcaguuuugcaaccucggcucacugucuggucucgacuuucugggcucaaguuauccucuugccucagccucccggguagcaggaccacaggcacacacaucucacccagcuaauuuuuguauuuuuuguagagaagggguuucaccauguugcccgggcuggucucgaacuucugagcucaagcaauuugccuuccuuggcuucccaaagugcugagauuauaggcaugagccaccacacagggccgcauuguggucuuaauuugcauuuccuugauaauucgguuaaacaacuuuguauauauuuauuucagaucauucauguccacucuguggaaucuaccccgcccccauuuucuauuggguuauuuguuuuuucuuauugauuucuagguguucuugauauauuuuuggaugauaauuauuagucauacaugcugcaaauaccuucucuuauuuugugacuuuuacucucucuaugguagcucuugauaaaguccuuaaauuuaagauagucacguaauuauuuugaaggguuggaaaagccuucuuaccccaagguuguacauauauucucuuguauguuuccucugaaaaggauuugauaauuuugccuaucacauuuaaguuuuccaugcaguugggauugauuuuguguggaaauccauucacacguacugaaaaguccauccuuucuccagucauucacaauacuauuucugugauauuuuuaguuccuguauuuguggggucuuuccuucugggccuuuuauucuacuugguuaguuuggcuaccuugccucgguaucacauuauaauaaauguuauaacuguauuuuguuguuuguuagguaaagcccuuccuccccacuuuucgugucccauauguacacauuugacuuugggcuauuguggagccugaguucuucuacgugaauuuaaaauucagcuugucaaggucuuugagaacccuuugaggcauuuuuauugaaguugcauggaaacuaaagaucaauuuugggagaauuauuaugcauuuaaugauuaucucuacucauuuauaucuccauuguuuuaggugucugauaucucaaaacaauucuuuauaauuuuuuagcuguaauuucguaauuauaguuuuauaauuuucuccaugaaguuuuacauuuucugaugauuuauucuucaguaccuuauuuuucuguuucuauuauuaccaguauauuuuuuuaauuauucaaauuauuuguuacuuguauauagaaagucuuuuuuaaaauuuuuauuuauuuuuuauuuuuagagauggaaucucacucuguugcccgggcuggagugcaguggcgugaucuuagcucacugcaaccucugccuccuggguucaagugauucucuugccucagccucccaaguagcugggacuacaguugcccggcaccacaccuggcauucaauugauuuuuguauaucaauuuucauauucagccauguugcugagcucucuuauuaguucuaaaaaugucuuuguguuuuccuuagaguuuuuucuguagaucugucacaucaugugugacucaagacaauuuuauuguuuuuuccuuucaaaccccaauacuuggccuuuuuuuuuuuuugucuuuacugugcuauauaugaccuuaaguacacuguuaaauaggaauggcaauacugauuaucuugucuuauuccugauuuucaccaugaauagugauguugauguugauagauacuugauuaagaaaguuucauucuauucauauuucaugaagaguuuuuaucaugaacagguauugaauuuuaucaaauacuuuuucuacauaaaauuaaaugaugacuucuuuauuuccuuuaaucuguuaaugucgugagugacauccguauauuuuccugugguaagccaccuuugcauuuuguggaugaaauuaaugauguagcuucauuacucuuuuaaaaauauuguccuggacucaauuucaaauauuuucuucaguauuuuuacaucuaugcuuacaaguaagauuggcauauaauauuuuuuuccuccuacuuucuaagucuaguuuugucuacaaaguuagaauaaggaaguguucucacucuguauucucuggaauagucuuaaauaaggaugaaacaaucuguucuuugaaauuaggucaaacuuaucuguaaaauugguccuaguauaagaagauuuuaagccacugauauaauuuuuaaauauaauaauauugagagugagagcuuuacuuuuucugcagauacuuuaacaauuaaauauauauauaaacuuauauggauguguguguguauagauguguguguuguauacauauauauguaauauaugucaguuuucucucuauuucauuuacauuuuaaaauuuauuaccauaaaguuauacaaagguauucucuuagcuuuuuaaucucugcugacuccauaauuuucauuuuucauucauaacuuuauuuauguauuccuucuuuuuuucaugaucaagcuaauuugaaguuuuucuuauuuauuacucuuuucaaaccaacuuuuggcuuuguggauuauuuuucuuguguguuuucuacuucauuaauuuuuaaucuuuguuauuuccugcuuucuauguacuuaggcuuauuauucuguuuuuuuuuuuuucuaaauagaguugacuacuuagugcacuaauuuaucauaauuucuuuuuauaauauaagaauuuaaggcaauauaauacccucugaugacuguggugacuguauuacauagguuuuaauuuauuacauuuucaucaucuuauaaguauuuuaauauuuacaguaugauuucuucuuugauacuugcaauauuuuuuggugccuucaaaauuuuacaaaugaauguauuacuuaucuuuuuauuauugaccucuauuacaauuuaauuguugucagagaacuauucuguauggcaacaguucuuugauauuuguugaggcuugcuuuguugccaauuuugugaaucaguuuuaaaaguuccauugugugcuucagaagaauguguacucuaugaauucagggaucuauauguguccagaaauuaaagcuuguugauuguguccuuuuuuuuuuuugagauggagucucgcucugucucccaggcuggagugcaguggcgcgaucucggcucacugcaaccucagccuccuggguucaugcaauucuccuuccucagccucccaaguagcugggauuacaggcgugugccaacacacccagcuaauuuuuguauuuucaguagagacuggguuucaccauguuggccaggcuggucuugaacuccugaccucaagugauccacccaccucuguugauugugucuuaaagucaucucuacauuugcuaauauucgaaaucugccugacauauuuguuauugagaaaaguagauugaaauaauuugcuaugaugaugaauuuauaaauuuuucccuguauuucuauuuugacuuuauacauauugaaauuauauuauuacaugcauucauuuuaagaauuacuauauuuuccugguuaauuaaacccuuuauucaguuuguauguggcuauucucuuucugcccuuuuaucuuaaacucuguuuugucugauauugguauaauuauugcacuucccuuuuguguaguauuugucuauauaucuguuuuuuaauuuuuuguuuucaguuauuccauguugcuauguuuuaaauaugcagaguggcauuuuauuuuucuuaguauucugaugguuuuauucuacuguuuucugaauuucccuguggcucauaagaaguucaguaucuuucugauugccauucuuuucuaguagaucuacccuuuucccugacuguuuuuuggcauuuagcaguuuuacuguaauguaucuauuugugaauuuuaaaauucuauuuggucuacauuguucuucaugcaucuguggcuucaugucucccuccaauucagaaaaauuaucagcuuuuauuuccuuaaauauucugacuccuuuauucauucuguucucuucuuuggggauuccgauuacaugugugcuugaccuucuuuucuguccuucauucucuuaacuuuucucucauauuuucaguccccuuguaucugcugcauucuggguaauuucuuuagacccaucuuccaguuuacaaauucucccuucagguuucucuaacguguuaucuaaugcaaugauuaauuuuuuuuauuucauugcuuacuuuuucauuucuaaaaguuccauuugguucucucuaaauuaugccuacuaauuuuuaaauacuuucuuauuucuuguucauuuuugugauucugucuuuaaguucuucuuguauuuaugacaguuuuuguauuauauguauuuauuuauguguauaaauuuauaggguacaaguacaaaacgugacaugcauagauugugcaguggucaagucaggacuacauuguacccauuaaguaauuucuuagccacccgccuccugccccucuaccuuuccggaucuccguugucucucugcccacugauagacuacauccaugucuauacauuuuuauuuuuauuuuauuuuuauuuauuuuuuaguuuuugaggcagaaucucgcucugucgcccaggcuggagugcaguggcaugaucuuggcucacugcaugcuccgccucccugguucacaccauucuccugccucagccucccgaguagcugggacuacaggcacccgucaccacgccgggcuaauuuuuuuuuuuuuuuuuuuguauuuuuaguagagaugggguuucacuguguuagccaggauggucucgaucuccugaccucgugaucgccugccucagccucccaaacugcugugauuacaggcgugagccaccguaucuggccauccaugucuauacauuuuuuagcacccacuuaugagugagaacauguaauauuugccuuucuaugucugguuuguuucaccuaagauagugaccuccaguuucauccauguuacuacaaaagacaucauuuuauucugguuuuuuuuuuggcuucauaguauuccauuguguauauaugcuacauuuucuuuaauaauuguaaaauagacuaugcaauuuuauagauauuuucuaacaaauccaaugcuuaaauuccaugggcuugagguagucuuguuauuucuacuaacccucacuuaagcuucuuuguuuugcuuuugugagaugcuuaugaauucacaucugguggguauugaaucuaugaaaaucugggagucuaaagugagaauacuuucuccagagaggaauugcuuuugcuucauagucucuuuccuacucugggaguccuagucuucuuaucacagugcugauacuggcauuugcucucagagcaucccugcuucuugugccuaccuuucaguauugaaaacucaaguuuuguuuuauuuuuuggugcuuucaagauuuccuuauuucuugcauuuauacuuuuggagaauuuuuuuuuuuuuuaauguugaacauugguuguuuuguagugugagaggccuuggguguauugucauacuuuuggaagcagaauucugauuuacucuuuaacccuuuucagucugacuucugucaccauuuauuccaaugaaacuaguugugcuaagauuaccuauaacucccauucuucccagcaacuuuagagaaaauguucuuuuuaaaaaaauggaaacucugugcuucuagauucugcacaacacaguuuccucuccuaguguucuuucugccucucuuuuguuggaagaggaaauguuggggaucuuaccugggcuuucuuuuucucuucuauugagaggcaguuuggugcagugccucaaucuggaaucagacugaguuguuaucaucugguuauuagcaauaugaccuuguuuucucacuguaaaauggauagaaauaggguuguugggagaauucauuaacauaacacuugccaugcacucagcccauuucuaacacauaguaggcauccaguacaugucuacuuuuauucucugguacauuaucuucuuaagucaucucuuguuuccaagaugacagcucacguauauauugcuccaguaugaucugugcaucucagagucaguuuguagagccaucuguauguuauauuugauuuucuucugucuccuuaauguauaccuucccuaggcuucugcauauaggaaaugacacugccaugcaccuagaugauuaaaccaguuccggacacuuugaccuuaucauuuguguuaccaucucacaugauaauugugaguugugcucuccacaucugcuuucaccaguugaguucaagacaccaucauuucuugccuggucuacucuaguagccuccuaaguacuuucugcacuuugacuucuucccuguugaauccauauuucacagcaaccagagugauuuuuuaaauaagaaagucaaacagagcaugcuuucucccagcuucaauguuuuucucauagugccuagaauaacuucuguucuccuuaauauggacuugagguaccucuacaaccucauuugguuuccuucugcugcuguauacuguuuggcuacauugggauucuucuaggcuuuggacuuugucaagcuuuuucuugauucagggccuuugcacaugcaguagaacacaucuucucucacucugcguggcugauuccauucagagcucaucugaaaugccacuuucucacggcgacuuucuuuuauuuccuaguuuaaucaagacucuuugguucagugcgugcugaauuugcuuaauaaaugauuccauaaacauacauauuuugaauagaaucugcugauuaauaggaaugauaguucugugagaucaugcucauuuuaaauuuagucauagugucauuggaaaccacuacaugucuuuucuauucauuuaaugaauuuucaaggucauaaaaauuucugaugauauuauaauuuuugcauuugcaaauacacuuugcauaguauuuauugcuggauaaaauauuggcccaaaucagggguuggagaacugacauucacugagcaccauaugucacguucucuuaccuuaauaucguauguuaggcccugaaaucuaguuauccccgagucacugaagaggagcugagauucagagauuccccuaggcuggccaaggccauaccuuguggagggcacagccuaaguuuaguccaggaguuugaacucuaaggagagaacucuuuccauaucugcugccuuauuucuucucuaagcaaacuccuuaaguucacaaaguucuuucauguguauuacucauaauauguaugucaaguucuagagagugcagggcauuuuugacauuuuauuuuggaucaagcuuucauucacuaauuuuuuauuuuucugagcaucccuuugagguccuugaauucacggaugagaaaaauuaaacaaucagugauuaaguggacucucugugaaguuacacaauggaauauuaaauuguugauggauauuuuuuauuagccagagaaagaaaaaacgcagacuuuuuuuuuuuuuuuuuuuuugagacagggucucacucuguugccugggauggagugcaguggugugaucacggcucacugaggccucaaucuccuggucucaggugauccucccaccucaaccucccaacuagcuggaaccacaggagugcaccaccacagcuggcugauuuuuguauuauuguaaagacaggguuucagcauguugcccaggcugguccguaacucguaggcucaagugaucugccugccucggccucccaaaguguuggaauuacaggugugagcuacugugucuggcccaaagcauuuuuuauuccaguaguugugucagucuguuuucuuucuauguauguauguauaauuuauguaucuauguaucugccugucuaucuaccuaucucugguuaaauauguuuuagaaaaaauguaacuagcacaacuaggccuggacuuauagauauuauuuaugguagaaggcuaaguuguuuauuuuuuuaaguuaauuauuuauaaagaaaaauauuaaccauauacaaguacauuuaguacuuaguuauggcaaaaaucaagaaggugaaauagauauggaaaaugugauugggugaguugguuuuauuggacugguagggugugcccuuggccaaaccaaaggccagaggguacaaggaagucagggggacacacugcuggggagauagagagggggcugcccaguugugaggggaacuaacuucuuguccagaacuucccuagggccuucccuggcucuugccuucuuugcuguauauuuugguuacuggcaggacacugguucaaauauacauuuccgugguuugauuuuauaaagcuaaaaaagccucaugcuaauauucagucucuuauguuaugaauguuaccauuuuaccucuuagcuauauagguaucuauaaaggacauuuuuuaaaaaugaaaaucauccuuccucaguaaagaacuagagaauaaacauguuucugaaaguagaaugauguggacuagagcaggggucggcaaacuuucucugagaggggccaaaugguaaaucuuucuggcuuuguaaccacagacucucuguugcaaauacuaaauucugcuguuguagcaugaagccaguuauagacagcaaagaaaccaaugagcauuacuguauuuuaauaaaacuuuauuugcaaaacagacaguaguuguauuuugcccaggggacuguaguuuguagaccccuagaugaaagaaauguaucuuagggccuccccucuuagcccuuuccaucaucagcaaugugaucuuggacaauauacuuuaagucuuaaugaauuuauucauuugaaaaacugacauuuuauuuuagaucaggcuuuucauucacuaauuuuuuauugcucuggacaucacuuugagguccuggaauuuacagaugagaaaaauuaaacaaugaaugaggacaguuuucuuguaugagggauuuuuguuuucuucauauuuuuaauguguuuaauauacuggagugagcaugucuuauucuuguuaacagacaagcuaucuaaaaauuaaaacacaaacuaaaaguagaggaagauuguuaugagaaacaugucauguaugugaaauacauuuuauaaggaauagauuagauucuuuauggaaccaggauggguauaaauacaucacuagauaaauauuaaguaggaagaucauuauggacaaagauuguuucuuaggaauuuugcaucguauagcacuguguuagacagaguccuuaacugauuauuuuuguagcauuuguuuacacauucacuuauuaauuaauuuugccaauguauugagccaucuauggagauguguggaggucuguguugaaagcuugagauagaaaaaaugagaaauaaaauaguuuuggaucucgaggcacucacauugaaggagauaaacauguauauaaaauauuauccuauuguaugauaaguucucaauuagaagcauguauguauagggcaccacuaggaaaucuguaucauuggaguagagggaagcuaggcaagagaccugcacagaguuugagcaguugggucuugaaggaugaguagggauucuuagacaaaagaagauugaaaggcagcuugagcugagggaaaugucugugcaauugugaacuuuacaaaucauagguaguucuguaagauuauaacuggagucaugaagacaggugaaggaugggauacucaaaguuuggcuagggccaugcaaugaaagccagggaauuugaacauauucagaaccauggaaugcuuugggaaucuaaugaaagauaugauacauuucuauaggaaaaucaucuuacauaaaaauuucaauauuuugcuacaguuuuaggaauaaggauguagugaucacuuuaugaacaguacagacuuuuuauaugguucccuucugaaaaaaaaaaggaguucacagauagacacauacuucaucauccugcuugaugguggcagcaaaugcucuggaugcacuuaugugaaguuuaucaugacuuuauuacuuaagagccugggaguauaugagauugugccauacuguuauuuauaauuuccucaaagagauggcuaggcaugaucagagaagccuucuuacugguagauguccacauaugucaguugccuaggcaugaucagagaagccuucuuacugguagauguccacauaugucaguugccuaaaugcuggagaagucacguggcuucggauagaauuuccucauuuguaagauggugcuccucaaaggaccuaccugccauuagagugguaaggauugaauuaacucuucugaugacagcacugagcccuaaauuuagcacauacuaagagcucaauaaauguuagcaguuaauacccuuauuagaauuaugaaaagucgguaauuucauucauguauguucauauauggagugcucacaaauacuugaauucuuuuauugaacaugugaguuagucuugcauuacgcacugcauauauguccauguauuucuggaucaucaugggucauuuguuuggaauaaaacuucauuuacggaaaucgucuguacagcccugguuaauuuuuucucugugauggguugcauuacauauuuucuauauaaaacagcaauggugaagauaaguuaacuaaugaauauauauuauuaugugcuuuuauuuuacagcuucuaauauucaguggggaaauuuuucuuguuaagagacaauggcaaggccaguuggccuaaaauuagauccagcagcuguguuuugaaucaaggccccacaugugcacuuuauacuccccacccccugcgcugggcuugucugcuucuuuuucuugcuucaggaggcagcauuuuugggugaauguuaacauucauguuuuuccuaguacaaccagaaaggugcuucuguuuaauuguaaggcagguuuauuuacauuuacggaauggaaaaaaagauuuauuuaauuauuaauuuuacaaaaccacccuuuagcaccaagcauaaaacuuuggagcccaaaucaaggcacuaggucacuuauaauuugauuucuaccaaaauaaguuuuuuuuuuuuuaaagaaaaaacccuaugauaauuuuuaacauuuuugacagcuacaaguaauuuaaguuguguuuuaucaguuuauauucagaagccaauguuaacugguguuaauuuuauagguccuaguuucuuuguauuucuugcccuacuguuugguuaauaaaccuuuuuuaaagaauauauucauguacacacaacauuaucaugauucgguuuaaguauccguguuuauaagugcacuucauuucaccuaauuauguuauuuauucauuuacacauuagcaacguacuacauauuccacuuuuacaggaacuuauuuuaauuauaccuacaguucuguucugcuccauuauaucauagaucaagcugaauaauagcagucuuaaaaggcauaugcuaaaagugauuaugggucauuaaggccaaauuaagguaacauuucugauagccacaagcagaagucuaacuuacaauuacuuuuuuuuuuuuuuuuuugcuuuggggaacguguucuaguuggcuuugauguugacggucucaugguugaaugccuaguggguguauggauugauccuugaucagacugauuuuuuuuuuuuuuuuuaggggggagauauauacaaaccauacuuuuuauuuauccagaaaucuguauuuauccagaaauagucuauucaaugacuuuacugccauauuucucaaaauguaugcuuuuucuuuagcccucucucuuccugccugccauuaagagucacacaggcaaccaaucuccccaucuaggaaagugaguacuagaaugcauuaaagucacuuuuuuauugaucauuagcauaaagccucauugugccauuggagagugaccuaaauaaguauaucacauccuuucaaagagaaaugccccauggaaaccauaccuaaaaacgauaacaauaacuaacagaaucugcguuuuaaugaguugauuuuuaauucuuguuucgauuggcccaauguaaucuauuaagaaauuaaagggcaucuuucaagcuuauccauauacuuuuauaaucaggaugugugacucuaguguuguuaauuuuauuuuugagaaauacuuagauuuuguaugggcauaaguaauucaaaauuauuuuguugauuuuauagacauuuuacuagggagauccauuguuguuacuuauuuucuaguuucauaauugcugauuaaaauuaauaagauucaaaugggaaaaugacaguagaaauauuccaauuuagaguucuuaguagguuggcuuacuuuuugcuggauuuaugaugauuuuccuacauacucagauuuggaagauacagcaucauaaaauaaacuguaguuuauauggaaccucuacauuuugguuggagauacaaguuucuacuggcucagaaauuuuuucuuuuaguuuuugauuuuuuuuagagacagucucacccuguugccagacuggaguacaguaguaggauccuagcucacugcagccucgaacuccugggcucaagugauccuccuaccgccgccugcugaguaucugggaauacagguguaugccaccaugcccagcuaguuuuucauuuuuaaacuuuuuguagaaauugaaucaaacuauguugcccaggcuggucuggaacuccuggccucaagugauccucccaccuuggucuccccaaguucuggcauuuaaagaacucagcccagcucauguaauuuuuaaauauucccacuccaugugauuacuucagucuggacaugucagacugaacugucauuucaguuuacaugucaauuugucuuucauguaaaaagggggaaaauaggaauauaugcuuauauuuuguuguaucugcauuuaaaaaaacacaagaaaccaaagugguuaccugaguagggguggggaaggcaguaaagaauagugugauggggaugagacuuccaaauagauaacuuuuuguauuauuuugacccuugaaccaugugaauguauuuucucuaaauauauuuagauuuguuuuugaacaagaaaaaaauugauagcagcuaugaacauuuuuuucuuuuuuucauuuuccuccuugauauaaguuacauuuuaauugucuuuuggauuguuuucuucagaauuuuaaucauaaaauaaaugaaauaaauaaaugcaaucaucauuccauuccuaucaguaauuucuauuaguguggcuuuuucuguguuuguuuuugucauuuagagauggcaucucccuauauuacccaggcuggacuccagcuccagggcuccagugauccucuugugucagcuuccugaguagcugagacuacagguguacacuacugcucccuacuuugugugugugugucugugucugugucugugugucugugugucuguguguuugcauuaguuuaugggcaacuagaacacguuagaugcuuuuaagcaucgauuuggauaaagaagcaguauuaaaaauccaacugaugccauacuucauggaagaaaaucauugcauuaaacaggaauuacacauaccgauaugaauuaguugauccaaugguccuuugaaauggaaguuacauuuuuaggagauggguauagcaaaagcagagguguuuuuggaugaugagcaauaaauaggggguuguuccuagauucccagagacuuacauaaaguugggaaugggagaaguaagugauggggacaagcuaaauuuuaaauuacucuuaaaguacuuuguuuagauuauauuaaccugucaaugugacuaaaaugucaacagaauucucuuaaguuuuacagauuuguagaugcuaaaugcucaugaacugaacugaauaacaguaaugagguaugaugauuugguaauuuuauuuuaauuagcaacaugaguaacuuuaaccuuuauuuaagaaaauaaagguaauauacacauguguauuuauuauacaaugggaaaaguucccuuugaaauucuccaugugguuugguguauuggcuuaugccuguaauuccaguacuuugggaggccaaggcagguggauagcuugagcccaggaguuugagaccagccugggugacauggugaaaccccaucucuauuuuaaaaagaaagaaagaaagaaauucucagugcaacagucuuuaaaucaugaaacuguucaguuggagaauuugcauuugcuuauugauagcugcauaucuacuauugugaauuuaauaucuuauuuauuuacauuuaugaauauaauacuauugagaaauuaggcucuauucuuuuuacaguggcauuuuuacugauugaucuagucucaucaaauauaacugagauguggaagccauuaucauaguucuuaaacacuauugcucuugagcaggggaugugagauacagagcauuguggaaaaaaaugcuauucuggaaaaccacucacuccuuugaaagucaaagagaauaaacaauguggaauuugaaaaaaaaaucacacugaaagauaaagguauauaagcucacuuaacuauuaaugauacaaauuaaucugcaaagaauuaaaagcagcuuuguuaauggcagaagacacaugcaguuaauaaggacauuacuucucauuugggguuagauuggcuucuccuuuauuaauaucuguuuaaacuacaaauagaaagaacuccauucuuaccagacuucuugucacaagacccagucucuaaagagaaauaucauugauaggaaaccagaaagacuaaauagauguauuuggucucacaggcaguccauuaauuugcucaaauuaaauauuaucuuuaaauauugaaagguuaaauguacaccgauaauggauuuagacagcuauuaagcuguaauugcuuucuaaugcaguuacuaaaagacauuugauauaacauauugagaaggaaggauuagagacuucucuaccucaguuuuaacugagaguuuuauggcuuuaauucuggcaguuguaggaauuggauaacaacaguuuuuaugagaacgcacacaauaugcauaaaauauucagugggcagauuguugagggaaugcauuauguacaguguauuuauguucauaguuuuugcaaaucuguaccagcaguacuaucagaucaacuauucacccuaaauauuuuucuauuagaucuaaaagucguauuucugaaaauguuaccauuuuaugguuucgaccccucuaagcugaauuaauguguuuugugcccuggauauaugguuacaguagugaccaaauuaauuugaaaacuucucagucuguuggagagucacaucuaguucagguagucaaacugauggcuuucccugccuggguaggcagcuuucuuuuuaguauucgcauuguuugaauuuguaguaugagauuuucacauuuuuacagguugcauuuugugaguugagugucuagcugugacaaauuauuguuaaccuaagaacauaugcugauugauacagucagccacuugccuccagaguucaauggaaggacaaaaaauuuuuggaaaagaaauaugaaugagagcuaggcucuucaaaacauauuuuccuggugaauuauuuaaacauaaucuaaguaugaguaugggucaggaaaaaaaauuaccugcaguuaagauaucaagccaaaguauuuuuugaauugaauaaagaaagggaaggaaaaagccugcuguugaucccugucacucauguuuuuguauuaauaggcagcaucugcuauuuguucuauuaauguuuuauauuaacauuuucauuuaguuuccuuuuuaaaauggugaaguuacagaauucacuuugguuucacaaaccuuuauggagaaauaaaugcauaugaagaucuguucuggggccuggggaagauguuuaaauuccaggugaugccagggccacugcauggcacccccugggguuguacaugcacauuguauauggcagccgcuugcuuccuucaaagaagagugugauaauaucugugcuuucuguugaacuuucagaguacuuccacagauauguuuuuaauacuuuuaaauccucagaaauaauuugauuauuucaguuuuauacaugagaagucauguucagaggaguacacacgaauauaaggcagaaaauaaaaaauauaagaauuucauggauuacaaagaaauaaaccacuacuuccauucacuguaaaccagagaagaauauauagggaaguuagaauucaguguguacccuuauuaauaaaacuaguguuuuauuaauaaacuauaauaaacuaguguuuauuaauaaauuaaauuuuuucaaauuuuuucugcuuucucaauagaugcucuauuuucuccccuccuccuauuccacccuaaaauuaaaagagaaaauacauuucuaaauuuuacugagauaguuaagcacagaauggaauggcauuacccauaagagucuaauauauaauguuuauaauccuuuaaaaguagaauuaggguucugucaucucaauauacuaugcugacuuugagauuucuuuuagucauuaaaucuguucugcaaaucuuuuuuaaaaaaauuaugagugacuuuauguuuuguuuuagauaauuuuaucacuaccaucuaacuaauuuuucuuuauguauuuucaaaaauuuaauaaugaauaugauugcaauaugcuuugagaccaggauagaugcuugcuuguuuuuuucuuuuccuuuagacuaucaucuuuuacauaccuuucucuuucucuuaaaguaaguggaaaaauuggauucauugaauuggucuugauacuaucuaggguuauaacauccuaauauucugugagucuuauuuuaggacuugcauauuuaauacaguuuuuaagucuuugaucuccuaaauaugcuuauagcagccgcuaccuucaccacacccaaauccuugaauguuaugauacaucauacuacucaugcuggauauuuacugaucugcuguguucaagacagacugcugagcuucguaaacuuuaccacccaaacuaaagacagagaguaaauacauaaacacagggaguuggggacuuggcugaaaauugccacccaaagcuugaaauuuauuugcaugcuggaacaaagaauauccaugaacuugaaacucaggaugacguauguuugauguuuauccuguaucauuauguauucuagggcaccacuucuguauacccagauggaaaucccaauuuuaaagcaaugcucuuggguauugagggguauauuugcgaagucacagucaucauuuauuccauguucccuugccuucuuuucugucaaguacucugagagucuugauguugaggauuuauuggaagcaaacguuguuaccuaaaugaagucuagugaacaaaaccaccaaaagaggacaugaagugacugcuauguauguauauaugauauauuuuuccucagaauuaucuaagugcuuugguugguugcaaauguggaauuuugcuguuugucucuaagucacucuuauagaaaugaucugugugugugauaccauaggaugugcuuccacugggcuccugagcagugggaauauauaccugaaacaguaugugacacuucugugcuuuuucucccucugugguuucuguucuuccuauaauguacgcaagugcaaauaugagcagugagcgaguagagagaaaacccuguaaguuuugugcucuacuuuagguguaugugauugcuucucuugcugugccauucauuucugauuuaaaugucuaaugacucucaucaaacaacauuuaaacuuucuaugagauccuguaaauguuccuuuagaucauauuaugaguaacaauggaugaaacgagcuuuaauggggaggcugcgguucaguccggggguucugcagcuguuggugauggcagaacacgucaauugaacugcagccaugcguucaguggcauuuugcccauuaagcgauguauaaaaacaguauuccugguacaguuacauuucauuucugcagcguuuucacagucagcacuggugugucccguggccuggccuuuucuccucuuggcgacugaaaaaauaaaagcccagugcuuuaaggugguguugcuuaagcaugaaugaaaucacucaaaaaaugucuucuuagcauugaaaaaauuggucacaagucaguaauuaauucauuuuagaguaaguucaucuuggggcugacaaagagguguaguagcuaauuuuaaaagaugaguguaacaucuuucccaugucauacaugucaagauuaaacuuaaauuauguauuauauauuaaugaccuuaauuuuauucauaaacuacuguaaguacaacagaaaucaauuuaguucuauuucagccaucauuucugggugugaacuucuaguuucuauaaggaauaaagagauaggcaugaacuaguaccugaccucaugaagcauacacuguaguuggagacguauagaccaaaagcaauccuagauggaaugggauauuugaaugagcuaaauagaggauugcuuugcacuuagagaaccuucaguaaaugaguguugaaagaaaguguguucaagaguuaccuuugaauuuuagauauuuauaugucacuguggacuuccugggagcugacugaaaauggugauugucauugucauuugacauuuuuuagucuaccagucuggggccuaauucagcauugaaaauaguuuuuccuguuuuaccagaaaaaguagaagccaggaguuuguuuuucucucuuuuccuugugcucuuuuaaaucuuauuucccucacaguugagcaggaggaggaaaaaaaaaguccuauuuccuucaucuuauuuuccacuaggcuuuugaggaggacgagauauucugaagcauauuugaaauaaauugaggaccguaacuuggcaaguaugaggugcaggaauaauccaugugcaggagagacggugaaagauuacucagagguacagagccauggagagucggaaggaacacuggaaguuucucguggagauggaaaccugagaacuugacugugguuaggacagguuggaggaguccuggguggugcugaagaggcucgguuccggagucaggccguugagguugaagccuggcucugccauucgcuaacauugugaccuuggaaaagcuuaccuaccucucugagucucaguuugcucaucuguaaaauggcaagaguguccacuucauggauuugcgaggaguaaauaagcuaguccguguaaagugaugcauacagaaagcaccagaaguauuagcugugauugauugcaggagccacagcaugcagcaggagaaugauuuuugagguguuugaagaauaauauguaaagagggcugggugauaugacucacgccuguaaucccagcacuuugggaggcugaggugggcagaucacuugaggccaggaguuggagaccagucuggauaacauggcgaaaaugccaucucuacuaaaaguacaaaaauuagccaggcuuggugcugggugccuguaaucccagcuacucgggaggcugaggcaggagaauugcuugaaccugggagacggagguugcagugagccaagaucgcgccacugcacuccagccugggcuacagagugagacuucgugucauagaaaaaaaaaaagaauaacaugaggauguguuugguguuggcauuuuggucacauugaagcagggagggaauggacauuucuuucagaaccaugcagcccuaaacguuaaacagagagguuuuuggggauaaguguuaagauuuugauguggauauuuuagaagguugggcguaacagcugauucaacccuuuuuuaucaccaucaaugaaaagggcuacauaaagauuuaagaagaggaggacauucuuuucuccacagcuggucaugcgcccaguguaguuggcaggaaaacggauuguuuggaaugugucccuaaaauccuguaauuuaauuuucauuauuuauauaacgcaguccguauauguggcgcuguacuacaugcacacaagaccaaauuucuggccaguguaauuuuaccaaagaagagacuguaacugaaauauuuguaccuacuaaauuaucugcagcuugguaacucaccguuagggaguccaugugaucccaaucagcaacagggauuggaggaacgcauuguuggcagugaaauaaggggucaggaacuagaauaaauagugcugggaugguaaacgggcccauguuauacuaaauguaauauaaagucacugacuuugaggaguccagaaaaauaaguuuguaaauauugacauuaaaguagcaaccaguuugcaugcuacuauguaaaaggaaacuauuaaaauaauuauuauacguaguuuuuugcuugcagcacuuguuucauucuguucacuuuuagaaacacaaauuagaaaggagugagucucuugaugugugucuaagagaaguuagaguaagauuucuagaaaucacgagauauauaacuuggauaguuuauaguuuucuacaaguguuucauguuaaaaguuccuacauuaaugguccuucaaugaauaguauuuaccucuggaauccaggagauauauccacaguuaccguauuggucaugcuaggcaagggcaugauuuauuggacuugauauuaucuguauauaguucuugcuuuucaaaacagucaucuggaccgggaguaagcuaauaaggccaugcacugcauaauggcguuucggucagugguggacugcauguaccacuuuggucccauaagacuauaauggagcugaaaaauuccuaucuauauuucuuaucauuauuuagaguguacucauucuacuuccaggaaaaaaaaaaaguuaacuguaaacagccucaggcagguccuucaggagggauuccagaagaaggcuuuguuaucauaggagaugacagcaccaugcuguuguugccccugacagcgccaugcuguuguuguccagugagacaagguguggaagacugauauugaugacccagacccuauguaggccuagacuaauguaugcauuugcaucuuuguuugugacaagaaguuuaaaaaauaguaaaaaaagcuuauaaaauaaggauguaaagaaaaauguuuugugcagcuauauaguauguuuuguuuucagcuaaguguuauuacaaaagagucaaaaaguuuuacaagaguuaagaagcuuauaagguaaaaaaguuagaguaagcuaaggucaauuuuuuuuuuuuuauuaaagcaagaaaaaucuuuuuucuguuuuugagacagggucacucugucacccaggcuggagugcaguggugcgaucuuggcuuacugcagccuccgccuccugggcucaggugaucuuccucccucagccuucugaguagcuggaaccacaggugcgugccaucacgugcagcuaauuuuugcauuuuuuguggugacgggguuuugccguguuacucaagcuggucuuagacuccugagcucaagugauccaccugccuugaccuccuaaagugcugagauuacaggugugaaccaccaugccuguccaaagaaagaaaaauaagaaaaaaaaaauucaauguauccuuaauguacaauguugauaaagucuacgguaguguacaagaauguccuaggccuuugcauucacucaccauucacucaugacucaccuaaagcaacuucuuguccugcaagcuccauucauggcaagugcccuauauagguguacaaucuuuuaucuuuuauacuauauuuuaaauguaccuuuuuguauguuuggauaugcucagauacacaaauaccauugugauacccuugccuguggcuauuuaguacaauaacaugcugugcagguuuguagccuuggagcaauaggcuaugccauauagccuagguguauagcaggcuacaccaucuagguuuguguagguacacucuauaauguucucacaaugacgaaaucaccuaauguauuucucagaauguauccacaucaguaaguaacacauaacuaauuuauugcaaggggcagaauguaaaccauugguuuaguaguuuuagauugaguuaaaaaaaaaagauauccuugagguuagugagaggaaucaaaaucaggggacaguguaggcauuuggggucaaaauuuauucagcauaugcuagcaugccaccaggaaccagaaggaauaaauuauucugacuccauucuuggcaagaucuguguggcuacagaacguaauuauuuugcaaaucauuuaaguugcugaccacagcuaggagauuaccaccuaagugaagauuaccaccuagauggagugugauuccucccugggauucccuuucagaauugucagaaaacaaagcaguaaauccacauguuaaucauuaaaauaaacgaagugcaauaugcccagcaaaucauuucacacauuuucuauuucaaggaauugggauucaaaucuuaaccuaaauuuuacauauucacauuuuaaagcaucacucagacuuguucagauuacugagcggaguaaggguuucaucugaacacauagaagcuggcugcguucuugaaauggggaggaugggguuggugaggucacaaaacuucuuuucagcucccugguugcaaagaauaugagugcuaugacauuagaugggaauucaaguucuggucuaaauugauaaaauagaguuguuauuuuauggccucaucuuuguuuuuauauaucacagaaucacugcgaaaauggcaguuuguuuucuaaagaggccugagaccagagcagcaggucacaaagcgagcauuuuacagcguugucagucagccuauuuggcugaacugaauuucccagggcaaaaguuuucuuacaacguuucaaacaauucaucaaaaagauggccuaggaaguauuaaaugucuuacaauguaaauauagacaaggcuuuauuaggaaagugugcaccuguuuauuuauugacuuauuuauuauaauagccuuucaaguaguuuucuugauccuuacacucuucacacaaugaguguaaauagacaccagucauaguuguagguggugagcuacagagcucuguauugauuagaucuucaggcugucaaaacaacuagaaauuuuaauaaauguuuucaaacaagugaccaguuccaucuaacccaucagaauguuuuauuguaaauauaacauggcugucaguuugacagaaauugucuucccagaauaauuuauagugugauuucaaaaugcauccagucacaggcuuuuaggaauccugucauagaauauuauuuuaugccaucauguuuuaaaaagacacagugauaacauugaauaggaauagugcaaugacacugaagugcaguuuuagaugggaggggaagucuuccuugcuucagcaaaucagguguuugaaguuuaaaaacugcuuaaguggauuuguaguaaagcucugucuguuuuaaaguacuggugacucaacagcuguggggaaucugucuggaaucggcgcggaacuuuggagaauguuuucuccucaggagcuggaacucaacucuuccucagcccacacaaugcaggaucugugguuuucugucccuguuucuuuuucuccauuuuucuccccuucacuuacucugauugauggaaacacgugcugggagcuuucccugacauucuuuccaaagacugaaaguaagaaauguuaugguggugcuaugucuauuuuugaaaguaagucuguuaacguaaagccuguguugauauauugggaugaauuauaauggugauauuauuacagccuucaaagcugaaaauuuauuauuuuucucaccuacuuuugguugcugauacuugaucauaggaacaugcugugcaucugguuaauuuuggggaacccauuuguagauuuucaaaaguuaaacuuuauccuucuuuauaucuucuccaggcccucuuuuguuauugaaaaacaaauagaaauacaauccacuacaacuucggugcuucugcuuuucuggucacucucauuauuaaugcuuauaaugaagauauuuuuggaaacacugacuuaucauugguuuugcaaauacaguaaaaauaauauuguuuguuggaacucuucauuaugauucuuuuacuuuuaaauauuuaauucauaauuauucuuguuucuacaucuguauuuuaauuuuuauuuguuuuuauuuaguuuuaaagacagggucucucucuguugcccaggcuggagugcagaggcaucaucauagcucacugcagccugaaauuuccagguucaagccauccucccaccucagccuccugagucgcugggacuacaggcccgugccaccaagacuggcugauuuaaaaaauuuuuuuuguggagacgaggucucacuuuguuacggaggcuggucucuuacuccugggcucaaaucauucuccugccucggccucccaaagugcugagauuuacaggcaugagccacuggacccugcacuuacgucucuauuuucaaauguuaaaugucuuuauguauaggaggucauguuggauuuuaaaagucaacagaaauugauaggaagcagugugcagcccugaaugaaacucuuaaguuaugggggaaaaaaauaccagaaccuaugagugaaauuauuuuuuaaaaucucgucuugcugguagacagguuuuuuagagacagggaccgcaucuucuuuaaucuuugcuguaucccuuguucccagcauauugucuggcacagaguauuuaauacauuaagugggugaauaaaaaagugaauggcgccgggcguggugucucacgccuguaaucccagcacuuugggaggccgaggcaggcagauuaccugaggucaggaguucaagaccagccuggccaacauggcaaaacccugucucuacugaaaaauacaaaaauuagccaggugugguggugggcaccuguaaucccagcuacuugggaggcugagguaggagaauugcuugaacccgggaggcagagguugcagugagcugagaucccgccacugcacuccagccugaguaacauggugagacagugucucaaaaaaacaaaaacaaaacaaaacaaaaaaaaccccagaccaaacaauaacaaccaaaacaagugaaugggauaacuuggugcugaguuuaagagccaagguucauuuccuugguaccuguugcuugacuagaagacaaaucugucguaaaugaucaaaaaaauguuuacauagacggauguggaggagaauuuuauguaugcauacacacagaauacuaaguggcauuuuuuaugugacagauucauuuccaugcauauuccauauuguaagucagucuucacaacuguuuugugaaguagcagaucccuguuuugcagaugaggcaacugaugcauacauagguuagguucacuuuuccaaaguccuagaguuuuuauuuggcugagccaggauuugaaugucagcacuuuagucucuuucuagaguuucugugugcaaucacuacugucuauuaccucuagcaguuuaucacaugcacaauuguucguaacaccuggcugugcaugauguacaucuacagguagacacuucauguacuugcugugguaguacucuagaaacacugguaaguucacauguuaucaaagaaacuccuguauccgcucuccgagugcugaucuggucauuuucugcuugaugacgccagucuuuugaguuaacucguaggugugcauguugguuucuuuaaaguguuagauuaugaaccauagggcagcaggugauuaauuucugcaucauaagaauucagcuacuguuuuuaggaauuugcuuacaaaccaucaaguuugcuuauucuuacagaguuuugucuuuauuugugguauuguaauauauaauaguuaguaucugaccccaagagccuuacaaugaggccacgaagacaaacagaauuucgagaagucagaaugaagaaugguccucaaaagagaaaggauagaaucuugggguuuuauucuugugagggauguuagaaaugaucuuaucucuaaguaauggggagagaacuuagcaaaauccuuaaagagcaggggaguccacuuuagugugaguuauuuaacuucucugugauuuguuuaccuuucuucaaaaauggaaugauaaugauacucagcccccuaguauguugugaggauugaaugagggaauaaacauacauggaguacuuaaaacagcucuugcacacaggaagugcauaacaaauauuaucauugaaauuaucauuuuacaauugaggaaauugaaucccagagaaauuaaauuacuuacucaaggcuaauccagcuagcuaaugacugagccagggcuggaaucuugacauacaugucgucagcacucuuguaauauucaacagaauuacuguaaagcaauccucuauuugacaaguaauaauacauaaucucugcauuuacuugggaugcugaauauauacugaacuucuugcuguucuuuauuuuuucuucugggaacuauauauugggugauucuuuuaaaaaaugugguuauaugccaacauuaugggaaaggaaaaaaaaacuuaccagacuuuucuuccauacauaauccaaauuucaaauguauuaauuuugccgaaugccauggcaacauacauaucuguuuuucaguucaugaaagguauuuugggaauuauuggcucaugcaugcuugagcguuuucgucuuucagcuauagaaauacacuauguauccucuucauuuuguguuugugcuucuauucaagaugagaauaaaagcaguuaguuucuggguuguaauauucuucagugaacgguggcuuucuaaaacaguuacaccuugacugaaaugaaaacucugcuguaucauaaaagauauucuaauuacugcaucuaguuaaaaggagaauaaaucacugggagauuauuuuaagugccuuaaauauaauaaaaaagaauaauggacguugaacagcuugacagguuugaugaaugcagacuauggcugauuucugcugcuuucuaauggaaaaggagagcauuuuacuuucuagguguauugucaaagcaaauuuuuguuagggaagauaaggagaagccuuaucuuuguugagcacuugccuuguaccaggcauuagccaaggcaguguauuaucucauuuaauuucauuuaauccuccccaaccuuguagauaauguuauccccauuuugcaucuaagaaaaaugaggcucagagaauuugaauaacuugccucaggguauauagcugcaaaguaggauccagacuagguucuuucucuuuauuucauuaccccaguaggguugugaugaugauguaaauauaaauguaaauauaauugucuccacuguuacaaagauacuaauuucaucccauuuaauuuagaaugguuguguccaaacaauuuuaacuucuuugagccucuguaaaaugggaacagucaggucacugugaucuaaaaggagaauauaugugcaaaccucuuugcuuagugcuugacaguaaauggggagugccugggagauuuguuuuccauaucaucaacagacaaauggguguucccaacugauucuaaguuaagaguuuuagauguuuaauuaauagacucauaaauugugccuguaaauuuaaaacgguaucuguugaguuuuucuaaauguauuuuacagauuagauggugauagacuuucuuaaaauguuguguuuuccauuggauuuugccuucauaaauguaugaaaauauauuuaguuaguguggacaugauugcagugcuaauacauggcagauuguguguacauauauguguguguguguuggcuauuguucuaucuguaggaggguaaaaaucuaaauggugggcaaauaaaaucagaagaaaauguugguuaauuuuuggauuauguugucucuauaagagaauguuauuacugguaaguauuuugcaaaguuuuucauccauguagugaauaugaaacaugucuucuugguugacucauuuguaucuuuuacaguacauuuugggugccaguuuauagauucuuuuccuaaaaucugcaaaguaauagaagaguuagaauucaguaccuaagauacagagauucuauuacuccaacccccuugccauaugaagaucuguguuuaaaugagucaagaaaauuaacuuuuaagauucuauguggauguaugaauuuauucauauuccaacauucaguugauggcauuuaugggaacuauacucauggaaacucagaaacaaagaaacuuuuauuugccacuauauucacacacuuuaguaguucuuuccuaaaucucuuuugaaguaaagaauacuauaacaucauauaguuuuguguucacaguuuuacaccuaauuuuacacauucacauuuauagauaugcacaauuacuggacuuacucuuugcuuguguucaaauauaaaagcuuauagaaucuuguaccagcuaucaacacauucauccaaauguauuccggguuucuccauugcugcugugguaguaaauauaaaucuacauucucagugguauuaguuguucuuagucaagcaugagaggaacuguauaugagugucauuaucuaauaauuuuucuaacuguguuaaauaacgucguauucucccuuccuuugccaugcugaaucagcugaagagacaaauaaguacagaagggaugaguguggcuucauaaucagggaugaauguguuaugauccaucuugauccaauaagcagaugaauauuucacaacugcauuauuuuguaagugaggauacugucaguuuuguagcaaagguucugguagauaagauugucuuucuugaucuuuuauaaguaaauuuuuauuguaaauuauuuaacugcauucucugaaaaauguacuuuuguaucagagaaauaugcuuaggauauauauguguaagaauuuaaaggacagguuuaguuaugggccaaaaucuaauguuguagcaucaacaugauuuuuauuaagaaaagagaauuugauguugagaguuuucaguucacauacagaauaaguaaaccuuauccuauaaacuacacuuauuauugguauccguguuuuuaaauguuuuauguguaccucaucaaaaugagaucaugaucuccuaauuuauagugauugugauuauuuaaaacuagcugaacuaggauaacauaaauaguguaaaaagggaauccuacaauugugauuacuacauuaaaaaugcaauuugcaguauaaaaugccaugugaagguuaaaugauguuaaagauaauaauguguauaaugaaaucaagaauagagcauuuaacaggaauguaucacuuuaugggcauagaaggcaagagagaucuuuacacugucauuauuacguacaugguaguauuuucuaauucaguggucuucaaauuguauacuauggaacucacuauaugaaagagauaauuuuuuuacaugggcacaaacacacaauuaccuuagcaauggcugaagucuuauucuuaaaauauauucuuuguuuuguuguauauuuuucucuaaaauaaaauaauuugaacaaaauaaauauaggacuauccuuuucaaaguaauagucagcgauugaauuuuugaaguggaaagacugaaugaaggccuguggauaaagacgaaauccugaaauaucaaaaaacaauaguuuauucacaaaauagauguuugugaaauaaaaguuaugcccuuugcuuucucaauugugugauauuuauaugucuuaguguuaaugcuuguggaguagggacuuaauauuuguuaacugaauaaaacugccuaauucuaugaagaauacuaaguuuauaugccaggaauuucucuuauuuuuugcaaauauguaauaauaauguuuuuuauaacuccucagauauuaugauuuacucuugauuaggcaaacugugggaggaguaucagauuauacaacaugccaaaaaacauuaauuauauuucucuguaaugaagaccugcaaauaaguaaagauguuuguaagcagucaaaguagaugucaucaaguucauguguuaaauuuguuuugggcagauagugaacagucauuuacucuauuagacaaaauaucauaauuagugaaaacaauauucuguuuuuuuuguuuugagauauucccuuuguuuuggggguucugcagauuuccugugauaugucugcaucugauuuuguuuauuuagucugcuucuucaaugugcugacuucauaccuugcaaaaauucugaaaucuucucaacuaguauuuguguauugccucuuccuuacuccuccucuguuuuuuuaaugaaacuccucuaagaagguuuuggacaauucucauucuauauuaugucuauuuaugucuauuuaauauagucuacuuuuuuuuuugcaucucuguuucauucacuagaauauaagcucucugaggaccauagucuguuuuguucaauaacguauauugagcauuugaaagagugacucagaauggauguccggugcgcaaguggaagcauuuuuugaauaaaugaacgauuucuguguaauuuauucugaucuguuuuucacuuuaccuagcuuucauuggucucguguauuguauaauucaagcucuguuucaauggcuguauuuuuaauuuauugguguucuauuugauucccauucaaacuuaucuuuucauuaugauguacauuauuuuugucuguauuaacacuuuaaauaugaucauuuaaaaaaucucuuucaaauuacucuauuugucaagaucuugggggcacuaauccuccuuugugugucuacugacuuguccacaguggauaaguuuguguguguuucuaauuuuugauugugagcucaucuucaucugggauguuugucuccuuuggaaguuugugcucuggguuaugggacaguucuuacaaagugguuuucuguuaguuucugccaauuucucaggaauuucauugguuuggcauuaguuuuuacauuaauuuuauggcuugugguucccaaacuaagcaaauaguauaaauuuagauucugcaacugcauauggaaaaguuuucaggguuggauuacucauaggcaacucuuucuuugcccaccaaagcccuugccagacauguuuucuggccauuucccugaaucagugacauaagaaucaguagccuuuccaaaucucuggcuuugugcaggggucuuaggaccugugccucuguggguuuaaaaacuccagccccuaucccuuagggcccauagaucugcuaauguuuccaguucuguguuuuuuguucuggcuguaaauucccucucagaauuccauuucuuuugaguuuggguauguauuuaacuuuuuucucaucauguuuuauccaggcuuuuuuuuuuuaaauggagugugugugcgcgcacgugugugagaguguguuuggaggaguguauuauuugaaccaucauauugcugagacuagaaauccccucucauuucuaagaucaauuauuauguggauauuugcuuucuuuuucugaguguaauauuaaauacgaaauggacucgugaaccuggagaaugucugucagaaauaccgaaccuuccuucuuucauuuucgccuguaaaaucuuacaauuuuuuuaaagauagauauacagccaucuagagaauacacagaagagugauuugguguucaucuuuguguuugcuguuugcugaaggaucacucgcuaagauacgucuaacauugcuauaauuguucuguuucccuuugaauugaauauuuaggguaaggcacugauaugucaguaggaugaccaacacuaaaaguccaguauccugggaaaccucugucuuugguagaccuggauugucaccuuagucuuggauuccuuccggagacugaagaaauccuuuaaaaacuuuccugcuguggagucuucuggcucaggccccaacuacaguguuacauucagacuucuuuguuagaacaaaguuuuacauauauucaaauaguaaggauaaauauuaaucuguuuagaaagagagccuugaaaggauccuagucuuuuugcauaggaaaaauguccccaaucaaugagaaagucuaggagcaugaucaagacuuauuuuauauaguuugucuuuuaggggguacugguggauuauacuuuuagaguuacauucaguauuauuguggcuggacuaaaaaccccucaagaauacauuucacauugauuuuauuauagacaucugucaagcaaagcagaggcaaaugauagcauacucauuuaccaguaaugcaaaucaaaugagcuaguggcaacaaaaucacuccugacaccuuugcccuuuuucucuugauuugaacuaaugacgugugugugugugugugugugugugugugugugugugugugcgcgcgcgcagacuagcaaaauccagacuagcaaacaaaggccaaugacaggauaacuuucauaccuucaugccugggucacucaccauguacgauaggagcagugcauucucuugugaauuaaaaaucuauuuauccuuccugggugcauaagucccauagaaggcugggaggggaaguggaacucuuuauauaggaggggcuuagaccucaauagccugucccuuugaaugacaaaaugcccaccagccuugccacaaauagcuucugaaauaugagaaccuuuuuuaauucuuaagauccuugaccacugcaacuaauguaaagacacacuccgcaacaaacuuauacacacacacguacacacacauuuuauucuguuuuauaggaauggcagucuuuagcagugcauaauuuuuuuauuauuauuuuguuugagacugggucucacucucacucaggcuggagugcaguggcaugaucauggcucacugcagccuugacccccuccugggcucaagugauccucccacuucagcguuuugaguaguugggaucacaggcacgugccaccacgccuugguaguuuuuguguuuuuuguagagaugguguuucgccauguugcccaggcuguucuugaacuccugagcucaagcaaucugcccaccuuggucugggauuacaggcgugagccacugugcccggccaacauuccaucauuuuaaaagcugggcaaaaagggaaggaacuaguugagaaaggaagguucuauggccagaacaucagaaugcuuguuuuuaguuuuugcaaacauuggugaaauaauaguuggcuuuuuuguaaagccuuuccaguuggaaacugcaaguacuuuuuuuuuuuuuuuuuuuccgagacggagucucgcucuguugcccaggcuggagugcaguggugugaucuuugcucacugccagcucugccucccagguucaugccauucuccugccucagccucuccaguagcugggacuacaggcgcccgccaccacacccggcuaauuuucuguauuuuuaguagagaugggguuucaccauguuagccaggauguucucgaucuccugaccucgugaucugcccuccucggccucccaaagugcugggauuacaggcgugagccaccacacccggccagaaacuggaaguacuuuuaaaaguaugauggaagauacauacuuuguaauauacauacauacaaaauuuguucuuugagcaaauuuauucaguuuuacuggcaaugaaacucauaauguuuacuccucagaaauuuuaaaacauuuguuuguugaauguauuuauuguuucuaucggcagucuuuggaaaucugucuugugauaguucuaauaauaugguuugaauacagcauugucauaugucuuauauguuggggcaacauucuaauaacuauacauuuuuuaucuuccgauacguuuuucugaauaacucuuuguguugacugcaaguauguuuuugcagagucaccaaguucugaaaguaugcuuuuaggauggcacuagguuacuguguuuguauuaaguauaauuguguucuuuuguagauuuguuccuauagagcuaugguuucauggucugaagcugaaagagguuuaaagaggucaucacaguuccuccucccacccuuacuguuguuaaauaugaauguacguuugacuauuggaggaauuuuguuucuagaacuuucaagaguaauuguuuucuguaauuuauaguaggaaaauauugauuuauuaauaguuaaaauguucuuugggaugcuugaagaccaugaugugaaaaacuuaaaaaaauuagcauugauguuguuucuauauauuugccaaugggaguacuauaacuuugaaauguaggggauuguuugaaacaugaauugugaaaaauaacgcaacuuuaguuauuuuauauuggguccaggcuaguccgcugaagaguaugaaguacaguuuuauguaaaauauaucucagauugagaauguggaaacacuguucuuuaaaaaaauaaaaucuucaguaagauccuuuuaugaauuuacugguuuguucucauuugucaucggacuguuuccagauguaaaauauuacuuucuugaaauugcuguugagucuacuaucaagaccaggugcauguuguuuuacagcuauuuuacuucugauuuuuaaugcugaaacucauagaaugccuugaacugauaauuuguuuaacucucuaccuacuaauuggaccaagaaauaacuuuguaucuuuaucucuuuuccauuucauguuuuauuucuguuucaauuagugugugccuuuggcaaaaaggagaugauuuugcuuucuguuuuaggauuugccuccaagaaaaaauauauuuuauugccacauuuucucaauugauccaguagaguucacagacaaugaaaagaguaagaaaacuaauuuuuaaagcuugguaguguuauaauuuucuuccuuauaauaaucagaaaaagaauuuguauaacuuuuguuucuaauauagcaguucugaaaaucuaggcuuacacauuuuccuucccauuacugcuguuuauacuuaaguaaaacaaaaauggucgcugcagguuuuuuucucauuuuagugcagaguuugaauucuucaaagacugcuaagguuuucccaccuuaacaauuuaugacagacccuuauaucuucauaggcugaguccgcugcuaagaguuugcuaacucaugacuuuaauacaccaguagagaucacacuggaguuaaaacaaagagagcacgaacccugaaaugauuuaagacuguucuuagcugacuacuggaacacagugucucacgugguguuauugguaaccuuaaugcagauuauaauucuguaguuuaaccaggauguguuggcuaugguaaagugccuuuauaaggaauugugaaagggcacaaggaauggaaacagaaccucaguuuucucaguguaaaugaugaugacaagaauucccugugcacauuuguuguugugagaaagggugagauagaauagauuggacacauaguaggugcucacuguuaguuuuucucauucauucauuacugugucauucuauuggcaugcucacagucauguaguggaauaugaaguuacaucgugauauuuuucauucauucaccacugugucauucuguugacauguucacaggcauguaguggaauauaaaguuacaucaugauauuuuaaaagcuaccgaugugguagauuucacagucuugaaaagggguuuuuuuuaagcugaauuuucaguuucacuugagaagaguccugauuugcuuguacaaagagcaguaggguugcagagaaggaaagaaggcaacucuuuuaagucccagccgcuacucugcugugucuuauucucuaaaacagugaagaagucuggguggacauucuaguggucagaagccuaagcuuugucuuuugaugagugcagacaggggagggagcaacugacgagggaguagaggggcuuggagccccuucccaagucuaccaucccucacuuaugugucucuuccucaguaaagcacccccagugcccuuauuugcuguauuuuucuucauggaacuuacugucuaugggaccuauuugugcauucauuuauggugugucucugcauugcuuucccuuucacuacccauguaaguuccaugaaggcccagucuuaagcauuacagguugagcgucccuaaucugaaaugcuccaaauuccaaaaccuuugaacacugacaugagauagugacaccuuugcuuuuucuguuguuccaaaguacgcaaacuguuuuaugcacaaaauuaucaaaaauauuuuguaaaauuaccuuuagcccauguguguaagguauacaugaagcugcauaugaaacauaaaauacauuucauguugaaacuugguucucaccccaaaguugccucauguauaugcaaauauucaaaaaucccaaaaaauuagacauccaaaacacuucugauccuaagccuuugagauaagggauacuuaaccuguacuggguccucagugccuggcacaggguggaugcucaguaaguauuuucuuaaaagaaagaacaagggaaagguagaugagacgauaagagguggagguacagggaagaagaacacagaaacauggugaugaaaagaacagucugauaccuuauuugggccccagaaaaugauugguacugaagggauuuuauuaguggucauuuaagaaacuuguguuguacuguuuuuguguauuggaaggaggcuagacauuguuacauggaaauucacaguuacauuuucacuaaauguuucauugugaaaaacgucaagaaagguuggagaaggucuaggaaaacuuaucuuugaagauacugucuuaugaauuuccagcucagacuugcagcuuuugggagcugaggcuaugaggugaucuugagagcagcugaggaggcucuaauggguuccagcugugugcccagagaacccacccucucaggauaacauuaaccagguagacccugcccugacugacuuccucugggcuuuauggguccccguggucuguugcauugaucuugcauuuucagguuuuauagcaauucuaaacaugugaggguacauauuugcucuuugaugugcccuuugauagaagccagagugcuuuaccugagccugccuguaauaaugggggaagguggguugcaugcccugcagccauacgcucccugggaggcugguuuuauugcgguuguugauuggcagacuuuaaucagggguguuucuuguuguauuuuugaacaugaaguauauuaaggauaguuaaacauguaguccugcugguguuuuguuuuguuuugaaccacauuuuguuccauugugccacuugauagaaaggagggcagaauggaaacauauggggagcagaaauaguaacacuuaugucauauaacuacacuguguuggugauuuuuuguuuuuuuccauguuuuauaauaccuuuauguacaucccuauuaagaaggcagcuauugugucuccauuucacagagagguaaguuaaggaauguggaauuuggaaacaugcuugccgguuaguguggauggaaccuaaauuagaauucagagcucuuauuacuagauaggagaccaaucccaggcagucauggcauuucugugaacucuuucgaagaguaaagggacaggaauugccuuuucagaguagaacucagugcauaucaguggaauuauagaacuuuaggguuagaagggccuuugaugggaccauccuuuaagcuagaacugccucuugaaguuugcagugugcaugaccugcagcuccauuguuuauauuccaaaucuaugaaacuagugagagaauaggacacaucuuuguauguuuagguuugacaguacuuaucagaaguggucauauuacgguuuucuaucuuccuuugguggcuuuucagcuuuccuugguaccagccuuccaaaagaaauuagcucccuugugcccucacuuuaauuuggaagagauugguuuggaagagccaccaagggcccacuagacagcuccuuagaaguugcugugacuuggcagauggcaccugagguuuaaggauuggggaucuagccauggcguguugaugaugaugaugaugaggauggcaaugacuauuaacuccuuaauccauauuuaaucauaucaccagaacugaugguuguucauugaagauucacuucaugaaguacaagcuaggugauuccuuuuugaaaauaacacugugggccuaagauauauggaccuuauguggcuuaaaaugacccacuucucugugcuuacuccuaauuaccuucuuauuucuuugaauuuaguaaugggaguaaauccgacuuuaaagccauuugugguggcaaacccuaacuauucaaugaaauacaaauuugguacauuugcauccuaugcaaguuuuauauuuuugacagcuauuuuuguauuuaagcaagaagccgaaauaaaaauuucuaaacagauaugccagauuauauucaccauguuugaguauaguauugauuggucauggcugauguuuaucagacuaagcaaagugugucuguauuaguugucucaagagggucuuuauucuuaaaugcuuaugaauuccauaauaagucuuggaaaguggaacauacccaagcacaauuuauaacuuuucuaggcuuuauugguauucugagccauccagugaggacuggagucauucacaugauagaauaacacagauaccauuuauuaaucugcugaauauugaucacauuuagcaaauugcugaauauuaguagugaaauacuauuccucuacaaaauaguaguagccauaguaguagcaaaauuauccucauguguccaugcaugauuuauauguauguguguguuuauauauauacaguguauacauccauaucucuauauuucuauuuugcuaucuuuguugggauuuauaagguaacuuuuaauuauuuuccuucccccauucucuacuuagcgauccuuucuuuauaccaaucaucaugguaaacacugggaauauaaagauuaauaagucacaguaccuauccuuagagcuggaagcaaauacuuuuuauccagcauaaugaguguuacgagagaugguauagaaaaugcucugguaggccuggugugguggcucaugacuguaaucccagcaguuugggaggcugaggcagguggaucacuugaggucaggaguuggagaccagccucgccaacauggugaaaccccaucucuacuaaaaauacaaaaaaauuagcugggugugguggugggcaccuguacucccagcuacucgagaggcugaggcaggagaaucgcuugaacccgggaggcggaaguugcacugagccgagauuacaccacugcacucccgccuggaugacagaacaagacuccgucucaauuaaaaaaaaaaaaugcaaaaagaaaaugcucugguaucccagaaaaugccuacucuguuucaggaaugcaauucagaaagguguaccagagugucauuugcagucuagugguaguuucauagaaugucuguuucaagaggacccuucucuauagaucuguaguuuuuauuaguuauaauuucuucacacuucugucagaaauguuugcuguuaauuuugaacacuguuuuucaugugaauauauuuuuuaaguggauaucuuuuucauuuuguuuuuuuccuccuggcuuuuaaauauauauuuaaaauauuuuuauccauaucuaauuuuugcaacuuucaaaaaaacuuucuaagcagucaccuccugacccucuuuuucccccuuagcuguuucccccccccuuuucagggccaccuccccuccuucagagcccccgcauaaugcuauuccuuuaccguccagccaucugccuguuuuagccucuucuucacucucucuguuucuucuauauagauuuccccauaugucugcuucuuccuuuauccacaaguccagacacuccuccauagcuuucuuaccaccccauccuggugucccgucuguucauaaauaacucuuucauccgccuugaaucccaacccccuacucuuucuaaaaagagugugcaaauaaaccuaaagugcacggagccaagaugcauagcauaguuuugauucagaauagacuuucuccuuccaaucaccuguuuuaguccccauuuuuuguugcuuggcuucuuuguacagauccacaauugccguucaauuuuuguaugaaaguggaugcaaaguuauuuaaugucuucaugacaaaguuuuugccucuuacuggcagguuauuuugcccuaaucaguuacacagucuugugcagccuagugguugcuauuuuggaguagucagguuugaaccuuuuguucuucagaaauuaacguauuaucucagaaacagcagucucugcuugcgugcuuggcaacacaaaacugcguuagguccuuuucuaagucugaguucuaggacaugugccaugaaaggaguguuaacugaaucaccugcagaaauggccacaaggagggcuuuguaauguucuagauauuuaaaauguugguguccuccuccuagcauggugugcuagugacaggcuccuuucucccuggucaagaguaaacauuggcaauuuacuucccuuuagaaauguguuacuguagccaucgcggaguugccaguguuuuuccuuccuaaugucagugauaauuuuacucacagauucccugcagagauuuuagcucagcaggaaguaaaucuagguaagauugccuugaaaacugaucuaaaacaauaaaugcuaacuguaucauuccuuuuuauuuaaaaaaaauuggaggcauaacuaacuugauuauuuguaacuggugagaucuaauaaucgugguuaagaccccauucguucauacauucucucguucucucucucacugcuucuuugccuauagaaaaauaaaagucagagauugaaaugauucacacuauauuuuuuaaggaugaaauaucauaguagaaaugaaagguagaacuguuuacucaugagaugcugagaaaaucuaaacuguagcuuuccuagaguuuaggaagcuaaauauuuuauugguaucaaaaucagaaauaucuaaagaauaagauauuuaguuuuaaauguuucauacuuucuaaaaagaguuuuugcuuuguuuuguuuuguuuuuguuuuuugagacgagucuggcuguuaccacccgggcugaagugcaauggcacgaucuuggcucacugcaaccuccaccuccuggguucuaguaauucuccugcuucgaccuccugaguagcugagauuacaggcaccugccaccaugcccggcuaauuuuuguauauuuaguggagaugggguuucaccauauuggccaggcuggucuugaaguacugaccucaggugacccacgcaccuuggccucccgaaguacugggauuauaggcaugagccacuguguccagccaaggucuuuuguuguuguuguuguugauagucaagaaugagauuuuacugaaacaaggacaucagaauaaaaagaaauguaaaaaaugggaaagacacugaaaauuacaacaacccauauuacucauucagauucuuuuuggaauuucaaauagucaauaaugaagagacauaaauuccuuggagaaacguagcuuagggucagcuuuccuuuaaugacacuagugcuauagucacuuauauguaguauuuuugguguuguccaauuucuguggauucugaacauuagcuguacacagauccaagucuguggcuuuagcauauuuuugcuuuuacaucuugucaaaaauauacuguuagaauaucuuagacucgagaagauuuuagaaaucacuaauaauguaacaacuguuauugguuaugaaugaacaaagguucaguuaaagaguauuuccagguaaggcuguacauauccacaguauauuauagagacuucuggguuaugcacuggauauuaaugguuuggauuauggugauguuucugaaugugugaagggugaaguucuagacuucauuuuuauuaaaugaaauugauuuucuuacccccaccaaauuacuuaccaaacauuagauaccuaagaucuuaaacauagccauccucuaaauuauuuguucuuuaaguguccagagaauaucgugcagcuuccagaucauggagaaaccaguucugugcucuugaaguugcagugguaggagaaauagcagucuucuaugacagauuuuucaacuuuaacccucucacucucugcuaauuagaaucauacggucauacacuuuugguuuuuuuuguguguaacaaauuuuuucuaaagauucaacaaaagaguuucaagguuaccuucaaguagguacaaauaucuuagcucuggcuucuuuuucucccaaauuggcuguggacuguaggagcuuaauuaguucaggcucagugcaauugguuugcuccuagggugugucuauacuuaaaacauuuuuuuauaacagaaaauacguuuuugaccacuuuucauaacuuccucuuguuguuuaccaguuuuaauuuuaucuuggcaauugaaaaucuugggggaggccaaucuaaaaaaaauucuuggauuuucaaguuggauauacaucgguuuccuaaaaagaacucucuuuuucaauaacuuugauaucucauucauucagccuguauuuauugagagcuuaucaugcacgugguguuaugcuuuuuaauugcugguaccuugaauauuuagagaaaaaauaccucgugcauuuugucucuguguguuugacaugucaccuuguugaaucugcaccaagaaaaugaugaauuccaaugaucuaugguaguuacaaggccuuagaagaaccagggaugugaauuuuuggucugcuuccuccguauuuccuauucauugagaaacgugcuuguaugcauauaaacaauuccuuacuauuuuucuuucuggagaggaaacaguaauggguggauuuuaucacaggacaaagacucuuccagauagcuguuacagucccucccucugcucaccugauuuagaugaaccucucuuugacccaccacgauggugguaagucugccguugcaguuuuguagacauguaugugaaggcgauguuuguuauggggucaguguugccuuaaggaugcgggcuagagugaggggaccuuuguggugggcuuugcagacuucuuggcagagggaagcacagaugcgugagguuacuauuuucaccuaucuccuccuuucuuuauuguuuacaggaacacuugucuaaguggugcacaauuuugccuugcuuacgcuucuagagugaaaaauaucuguccagacucccugggauagguugguucuaacaucuugguggauugagccuggaccaggaguuuugacuuagaauucauggagagaggugucuguaaauguauauauaccccuuuauguuugggagaaagcaucuguggagcuuaucuggguagcaagaggauuuugugacccagcaaagguuaaggcacacugccuggaaaaaucaauuaggauccaguugaggguuagaucuggccauagacuuugccugguguugguaaauaaucugaaagccuuaaagcaucucagaguaaugaaaggggcccaaggguucacagugccuuuucucaggauugcugcaaggauucuggauuaaaaauccuucugcugucuguggaacagaacauuuccugggaucaauccuugagccuuccauagacaaagaauuucccaaaacuaaucuugccccauguggugucagagguaaaauaagugccaagcaugagaagccagaguaaccuuuacuggaguaaccucugcuagaucucuuguuaucuauguacucuuagaauaucuuagacucgagaagauguuagaaaucaccaauaauguaagaacuguuauugguuaugaaugaacaaagguucaauuaaagaguauuuccagauaaggcuauacauauccauaguauauuauagagaccucuggguuaugcacuggauauuaaugguuuggauuauggugauguuucugaaugugugaagggugaaguucuaaacccuuuuuagauaggcaagugugaugugagcaguagaguacauuuuuuguuuuuguuuccugaaguggggcacauuucucuccccuuugugguucuguaaauacauuguugaguccaguggaacuucaaagauggcacauagcuacugaugacacacacaaauauuguaaguugauaaggaugucugaaauguuauaaguggcuaccugaugccugaugucaaugcugguaucuguaaagcacacacacuaagaauagagacuggcagcucaaggguguugaugguaauuuuauuguaucuucaagaaaguguguuuccagagaauuauuaucaguaauaaugacuaccaccuuguuuucuuuugccucauuucucuuucuucuuccaugaaacugggguaagccuuauuguagagagaagcccacauggauauccagcaccuagguuccgccgagggcaaggcggaaaugaacugaguuauuccauuucuguguaaaucggcgucauuugcuacaugugcaaguuuugggccagagguguggaaauuggguucacuguuaaucuaacuagugauagccuuuuuaaucauguauuuuaauaggaagguagcacaguugagggaccucuuuugccucuugugccuaagacagcuggguuugaaacucaguuuuuaaugaauuauuuaacuuuacugugucucauuuucaaaucuauaaaaugggguuaauuguauuuugcaggauuauacuggagaagaugauaguacauuucagauuucuaccacaaauauggcccucgaauuuacuuuucucuacuacuaagcaacaaaauaaaauugaggaaaugggagucucucuaccuggucuuugauuuagagugugguauuucuucauuauggguagaagaguauuuuucuuuauagagagucauuaaccuucaggaaaaaaaaaucaaucaaagguuacguggaaugaagaagcgaugucauguaauugagauuuuuuuuuuuuugauucaaaauguaaacucacuugauuuagaauugauuggaacauggcaugugaaaaaaacacaggagacauuuaaaacuguaccuaaaucugauauaguaguuaagaaagcuagcuuuauaggaaauuaaagggggcugauuagaguaagauaggagagagagggggaaaggggauaugguggguagcuagaagaaaggcauacacaugcuuagaaguaggaagccagagauggaggaagaccuaggaugggcuuggaaaacuucugaagccuuaaugaacugaucuugucacacacagcuguucauuugaguugugggccucagaguauuauuccuuuuuaucacugucuuuugaaaugcuaauuagauaauugaccauuguucccaguucuuugguuacuuuuuauucuuaaacuucuagagacuaggccuugaaugggauacucagagcagcacaccagaugggaaauuauucucuggccuucaguugccaaaugaccaccacaguagugcuugggauguauaaaauccagcugagaggcagaacuagccuaaggggugguuagcauacuucuugggauaguccuucaucaauagauuuuuauuuuguaaugaugaaggggacugccuuuguauuuuuauacagauuuaucagauuuacuuaaucaauaacuuaaucaauauugauuacuuaaucaauaaucauggucuucuugaccaugaaaggcucauuuaaagaaaagaacacuugaagaauaucugaaaaugauuagcaagauaccuuugguuuuucaugaaacaccauuauaagucuaauguuugaagaauguuuuuauucuacuucugaccuaguuaacucauaguuuuuuuuuuaaauugaauuagauaauguguaugaaagcaucuugaagaauauacacucagcacaaauguaagauuugauuaauaaggugguuauuaaugaauaccauauaguaacaauauaucugagucuugcagaaaaacauucuugaccaacaggacgugaucuaguagaagagcugccuguucuacauauuuuauaaagagaacuaaucauuuuucuucuguauacucaauccgauaucaggaaaccucauuuaggucuauucacacuguagaggcagcaaaauaacaugccugaccuuuucuauguaaauauuaaaaauuauuaaaucugcauguuggaaagauugauuucggcaauaccuucuaaauuuucagugaauauuuaaguguaaguuugcagauaguuucaugaaaauaauugacuuuuaguuuugguacuagaacaauuggaauauuggugguauuuuucauuuuaaaucugugugaacuaaaauuuucuuauuugucuggcaugaacaucacagaaaaauccuuucccuucaagcuauuuuuuuaaaaaaauuguaaaggagauacuauguauugcagaacauuuagcaaauagugaaaaaauaaaaagggaaagucaaaaauucccucuuauuaguucaguacuguaacagucgauuguauugccugggcuauuuuuuuaaaaaaauuguaaaagagauacuauguauugcagaacauuuagcaaauagugaaaaaauaaaaagggaaagucaaaaauucccucuuauuaguuaaguacuguaacaguugauuguauugccuggugguagucuuuauaucuguacacauauacauacaauuuaaaauauguaugcaauuuuagauuauuuaaauaaauucauacuuauuguuauauauuuuucuuuuucuuuuuuuguauuugcauuuuuaaaaaacugauaagaccugccaggguuaugugugcuguaguguuuccugaauuuauuuaacuacuaugguuuuucuguuuucuaauuuauuaauucauuaaacauuuguuauuccuuuguuuucuugggucaguuuuauagaagucauuuuccuuaaauugacuguugaguuaaauuauuucacucuuauguuccagaucaugaauuuguauuguguaaaaauuuggcugcauuccauaaguuuuguugauaauguaauauucucuguguuacuaguuucugaaguuauuuuggcaguuuuuuccuuuuaauacaauagcuaacuugaacucucauuuaaauuucaaagagauuaucaaguuuagcuuuuaaaauuuucauaacuguuuucuaguuuuauuaaaguguggccaguaaagaaacaguguauuuucugugucuuaaaauuucuuauacucuuagugucccaacaaaugauauuuuaggaauuucucaguauuucagaugagauuuauuuuuauauuuguaauaguuggaaauguggcuuauuuucuguaguguacauuuuaauuugcuuuucaguuuuuaaaguuuuuucuuaacuagaucucuuuugaaccuagaaagauguguuaaacacucccacaaaauaauacauguuucucaugcauaagcgauucaugaugacuguguguuuaugguagauauuuucaucuuugaucuucaguacucccucuuuuauuauuaucucuuuuuuuccauguauuauuguaagagaacuuuucaaguuugucgucuacaucagugacaauuuuucuacaauuuuaugcaaauuuuaauuuuguuaaugcauuuuuaguuuucuuacaauauuuccuauuacauccaucugcuuuuacaucucuucacaaaucuuuuguguugacaccuauuuuauagaaauauucuauuuuauauaacugucaaaugugauguuuucuagacuccacuuguauuuuuuauagggugaaaauguuuuucaaaguauaauuucccucugaauuaugaguacauauuucccuauauuuuauugugcagauuuuuuucucacuacacaguuuuuaacauguuaaacuuuaggacgcugcaaaucugccuuucuuaauauauucugugauguugaggcuaacuacauauauuuuguaaagagguaugcuggucuccaugucagccucuaccaauaggaggcgcuggagggagaguagaaggcuagaggaggaagaacuuggccuuuccuguucuuguuaucaucacucugguaacaucagucuuuuccaguuuuuaguuuugucuacauuccuaaaauuaaccuccuuggagauaacagccccagucugcuggugucucuuccucaucacgucucucugagcuuacaggcucuggaaacccaaccgcuucccuguuuccccagccguggggaugguagcuguuuccauccgacuguucaugggugcuucuucucaagucuaaagccagaggacuguaaauguauguuguuuaagccacacauccaaccauacugguucaggaaggcagcggucuuccaguaguuaguuagcuuucuaaaaacucccuuuaaaaaugagacuuuagaaagaggaugacaaauccugaggacucgugucuuaagcaaauuuucugucuagauauuuauuauaaaccuaauugcaucugauaagugcuguguaugucauacucuaucaaagguaaaaggguuauuaaaguaaccugcacuuuuuagagcaaugguggauggccuugcagaaggcacauggccuuuaucagucaacucacuguggggaagcuggagaaauaaaguucaggugagaguaagccgacaguucuggugugauuuucuugggaggauaacguauaauguagguagcaaacacaugggagaaagaagguuuugcauuaugagauuugacuuaauguguacaguuugcuuuugguguuguaaagcaguaaagaggcuuauugacaucucuauugaaggucauugcagugcaugaaauguaaaucaaaguguuauucuuuauuagaagcuagaagauaacauuuacauaacaugcuuuuaagguaaugaguuaaguucauuauuuuuuauuacuauaacuguuugaagaaaguuauuuucaugcuaaaaauacuccuacuugaauccgauuugucauaauuuuugcaugauguauaaucuauuguuaggaaacgauaauuccauuuauuuuuguuucugggggaaaauuguuagacagcuguuucagucuuuccaaauaaacucgcuuccagaauuccuaguaaguagcaaugcugguugauaggaaugucaccauuuuucugaccccccucagccuuaucacaaagacauagugcagaagccauauaagaaauuugagaaaaggaaaagauaccaaggccuagguauuucacaaacuggauaauuagacucugaauugcgacgaauaggcugaaagaaaaaaaugucacaagccuauaguggcuuaaggaacacugauuucacagugaaaucuuucuacauaaauuuuaugguuaacugguaauaggaauaaaacuguggagcaaugucagacaauucuguuaugauuccugccuaaugaauggcaggcuuucccuugguauuuucuccuuaaccugcccauugcccuuucuguaugaucacauuuucuuuaaccaguucuuugcucauaaauaaagccguguguuccgguucaaaaguugcaucuucauuuauaaauucacagaauauguuuuucagggaaaaauguaacucaaucagcuuugcaugguuuacauaaugugauagucucauauuuacuaugugguuaacaagaaauaacuguuaccaacaaaaaucagagaauuuaaaaacaacgaacauuuugcuugggagccuauguauaucucuauauaaauacauauagacaucuauaaacaucaucgauccuucccaugugcacaugccauauauauguggaugugggaugauacuuguuuuuauauauacauaucuauauuuauauagcugaagaagugaaacauauugcuuuuuauuuaagugacucaaugcguuuauagacaagcuuuauuuuacaguacuuuaucaaugccgagaugauaagauacugcuuugauuuggucuucuaaaggucaaaauuugaaagaauaaauugauuccuagagacauucuuaugcuaucauuggccuuauauugaacagagaauuucuaggaaaauuauuauuccucaauggaaauaaaaauucauuuuagguagcuuaaucaauuugaauuauucauuuauggcauugcuuucaauuguugaugaguguauuuguguacuggguguggggaggucuucaggggaugggaagguggagggaugagaagauucuuauagcacuaaacugaauuuucaauucccugcuaaagugugaagaaagaagugaagugcuucauuuucuucuuuuuagaaucauuuagcaaccacaguucguacuuuauauuuuuuauggaguacuuucaacaacuugcuuuugcaguugggaaaugacacuuaccuggauuuucuuggguucuuuauucaugacaucaaugaagacuacugcuaaugaaccauagaugaaguuacacauaugcuaagcagggaaaugcaggaagaaugugaagguccuagaguaucucaauucagcauguaagugaguugugugcacaguagcacaguucugucuuauggcuggucaaugcuccauauuaugaauuuacauaggcuuuauuuuaggcucugaaauaauuauuuuuauuauauuucucaaauuugccaaaguaucucugagagagauucagaucccaucuguuugacagcugaggaaauggggacaguugguacaaugguuucucaacauuagaacacaucuuuuuuuuuuuuuuucuuuuuuugagacggggucucacucuguugcccaugcugaagugcagugguaccaucagggcacacugcagccuugaccugccuggcuuaagcaauccuccuaccucagccuccugaguagcugggaauacaggugugggccaccaugcauggcuaauuuuuguauuuuuuuguagagacaugguuucacaauguugcccaggcuggucucgaacucccaggcucaagugaucugcaugccuugggccucccaaaguuuugggauuaaggcaugagccagcacgccuggccagaacaugucuuaacuuuuuaagauucaugauccuguugggagucuuauguuguugcuaauguugcuuauguaauuuacuuucauaauguccuguuuccaccuauuuuucccucuuugugcugaagacuauugaagagcauugacuagugacauucagauaauagucuggugaguuuggguugaauguucuuuuuuguguggcaugcuuggauauguguaaauauguaagaauauagggaacuaaaucuuacuuuucaagaugcuaucgugacaccucugcuuguuaaaauguuggauaauugugagaaaacacacaaaaaaauacaaggaccccgucacacuucuuuauucucuuucagauuuuauacacuuaaacagauuuacagcaaaaaauccuccaaugacuuuuuaaaaacacuguuauguuacugauaaacugauuuuugucugugucccuucguauauauucacacaauuuucauauuucuggguuauucauccuugcuucacauguguuaucucacgguuaaaaaaauuuuuguuggaugaucaaaagcaauuaaaacauucuuauucagugcuuacauacuuuuguguucuuuuucugugucauuuuuucauauacagaauauguuuuccaauaguuuacauucugaauuuuuuaaugaccaguguuaaacuguuagacuuaccaucauuuacuuaagucucuccuacauauuuggugauuuugguuauuucuguaucuuugcacacguuuuuucauuuuuguuucuauuuucuaauaugcaguuuuuauagcuucuugauagagucuuugaaauuuuguuucugugaaauuguguaguuucauagaacuaaauuugcucuacuuaacuguaccugaugaauucauauuagcuauaaauauuuaaacauuuuauauaacagacagcaaaucaucauauugcugggaauguaaggaagauaaacuccaugcauucuagaagucauuagagauuuugcauauaaagaccacagcuaguuucaagaucuaaaucuugaagcaggcauucaagguguuucaauaaguacuuaacgguaggccauuaauucauguaaucauuuaggauaaaugaugggcagaaaaguuacugugcaaaaaguauuauuuggagaauaauggauauaugaaaacuuacauaaaugauuauuuauuguaauuuuuguuacuuucaauuucuuggucauggcaaaaauugaaaugcaaggucaaacagaagagagauggagaaagcucuaaccagcaagggccuggacucucacacuucccugauuggagcugcugugugugucugaggagucaccauugcuuuacugcuuauaccuaaacagaaguauauguagcuuugcuugcacugaggauguuuauaaauccucuggguuuuacauuugauuuacuuucuuccucagccuucccaucucauuugaagacaccuuuaguuuuuucauuucucagacuuaaccucuagggaauuauucauaucuccauuuucucuuauauuguacauuuaaagucuuccuaaauguuguuagcuuauauuuauuaucuaucgcugcauagcaaacauuccccaaacuuagugauuuaaaacaauaaccauuuuauuggcacacaaaucuguauguaguuuaccugcuuggacugagcucagccaguugguucucuuguugaugucaaugguggucacucaugaggauacagucugauggcggguggacaggagggccugguugguuuagggagccaucaacugaauuggcucacuucuguuccaugugguuuaggccuccagaggauagcucaggguucuucacaucaugguagaaaaucacccagccgcacaaaagagcaagaucaaaugaguaagcacuuuuuaagucucugcuuacaucaugcuugcagauacuccauuggucaaagcgugucauguggcauaguccaguaucagggugcuaagaaacuccacaaaaucaugggugaaggaugguguuauucauuaggagcucuuauuauaaccguuucccacaagguucugacuuuuaagaauucaaccacuuuuccuaaccucuguugcuaggacuuuguagcacucugguaauagucugcuaacuggacugccugcuuuagcccuugaccuuagucuguuuuuuaauggagcagugaucuuuaaaacauaauucagauguuauuccuccucuucucagaacacuucauugaccuuacaccuuauuuaguuaaagccaaagaccuuaaaaugguauguggcuucccugguaccucugugauaucauuugcuuucucucccacucuacaccagccacacucuuucuuaguguucugcaaaugcaccaugcaagcucccaccucagggucuucacauuuguuauccuuucuguuaggaacacuugacucagguucuccauaguuggguccuucaucucucucuucacucaaaugucauaucagaaagccuucccugaccacacucuugaagauuacagucauuuccucuucuaaugcucaccaucguguuuccuacuuaguuuuucuccauccaggccuccggaucacucuccauccugcucugugucucaagaggcuaaccuucuacaguugcauaaucagacugccuuucucucguucucucagucuucugguuggguucaccuaaugggaagcuguagcuuucccuucauuuugcuuauaaaccuuuaaaaaaaaacccaaaaaaccagacaguauauuauuuuagauuuagauaagaccaaacuaagauuuagugagcauuuuccaugaaccaauuucugugcuuucagauaugucauagaaaaaguuaagugaacugucaucccuguuuaagagucagggauacugagguugagguuaaaugacuuguucaagguaacaguuagaaaauaaacaaacaagacuuccaaacucacguccagucaucuuuuccaucuacagcccugucuccguaagucaucacugaaugaucgcuguuacacacaccuuuggaauuugucuuuuaucacauacacaccaccaccaccauuuucuggaaacuucuuuuaaacccaaucugacuuuuuaaucaagucuauauuugcuagucucaauagcuguuaccuucauccucuuacaucuaagggcauguucaccaggagucuuucuccggaaucaccaaccuccucuucucuccugacucuucagcauuuuaauaugcucauuucuccuaucuuaaaauuaaagauggauuuuuaaauuuaaagaugaauuuaaauacgcccaccccccuccaaauuuugagacuaacuuuucucuucauuuuguucuguccuuuucaagccaaguuuucucacacgacauucuguauauaaugugccaugaucuggcuucuuuccacaacacucucugaagauuccaccucaaaacgucaucaguagcaugugugauuggcuuugaccuuucuacugcuuuaccucuuugaagcguuggacuuuggaacacagccuucuucuauaccuccuacucucuuucaaaacucagcucaugucuaccucuucaugggaguuuuucuuaacacagaagacugaucugauugucccuccagcuuguccucuuguaugcuggggcauaugccagcaaucacagcugcugagaugcuuagucuuccugacggaacuguaguuuuuggaguggucaggaucaugucuucagaacuugcaccccagccaugugucugcacguaguucagugaccagaacauagucaacacucaguacaugccugaugaaugaacaaaugagugugaccauacuuaacuuggugaggccauuuuuuuccgugaguuuuauacucuggguuguuuuccuaccuuggauucucugacuuuuuucucucucaucuacuugccugacuuucuuaggucuuuuaacuuuguuucuccaucuuuacauuaaguguugggauacagggcugaacaagaacagguaacugucuuauggcuuuacguuuauguguuuuccucugaaauuaggcaaauuuccuaaucuugcugaaguuauuuucauccuuaagaaaguaauauuauaggucuuuauagaguggggcaggaucaaaugagcauguuuauuaauugcuuagcauuaugccuggcacaaauucaauuaccauuauaugguaauaauuuuaauaguaauaaaccauauauuacacauguauuauucauaaucagaugauguaugcauuauauaaaaauuguacuauucuauaaauauuguaaaaaaagaguaaauaauauacaucaauugcuuugugcauccauauauuuuuacgugugcuccuuuuauuaaaucauauguuuuuccucaguuuauugguugcuuuuuacuuaccaaaagcuucuguccaaaaaaaaucaaaugcugcggcugcccugagcagaguucaccuuggaagaggcuuuaauugugaugaaccuguaagaacaaaguuuaagaauugagauaaucagcagcuguguauuucuuuaaauuuuuauauuuaaugauuuauuugaauuaacuguuaccacguuuacaucuucuagauuaguuuuuaggccuuuacuuuuccuuggcuguggguacugaccagcauggugguagguaugauuggggugugugugugugugugugugugugugugugugugugugugcauggauagauguguguguaugcucauggaugugcaugugcaugcaugaaugcauaauauuucaaacacaugcucagugauugagucacugucaggaaguaaacuuggagaccauguugcucgaugccacaauaguccuguuauugcauugucaccacaggaugccauuaaaauagguaugaagaaugucaguguucauuaauuugguucucuucagagaacauuagccauggggaaaagauacaguagaaaucugagaagagauggaagauaggagagaaaccuggcuuuugaagaaugaucuuugaucuuucagaagaggaauacaugucaagagcuuaucuaugugaaagaauuuacaugcaaagcaaaucaagaacauagauuuugcuuaucuuuauagauuauaguuucaucuuagauggcaaagaaaagccaggcuucucuauacaaagggauuugcauguuuaugauaacucaauuagccuuaacagagacuaccaguauaugcuggcugucuggccucaaacuuuaaugcauauguauuuucaaagagaacuaaaagauuuugggauuguaacacagagaaagaagagauagagaauuaucaaacauuggggaucagcuuuaaaauuauaaaacaaauuauauauguucugaaaaauuacuucaggaauaagcagcuuuuuuuuaaauaugagaaagcaaaaucauauccuguaugccauuaaagguuauugcguuuuccaaauuuauaguugcaagugauggaaauuuucuuuaacaaacugaaggaugcauuuguagucuaaaugguagcuuugagaguaguuagauauuuauggaaaaauuauaagaagcaaugugcuuuuaaaauuuuuuuuucaaaaauagauauugguuaggaaaacuacacucuuucacuauuugguaaugcauauucugacucauucacacagucauuguggcaccuaaaguguugcaaaauuagacauuuauauggagaugggcuauugauguaaaaaaaaaaaaaaaagcugagggcuaggaaugauaagacaugaguagaggguuuuaaaaaugagcucuuuguuuuccacucuucaucaugccuagaucucagagagguuuuguccagugagaauaaagaacccaugggaauuaugcagaaaucacuguccaguaaaaggaauaguuuuccuucagugaccaagggugggaccugaagucagcacuagucagugacgcuguuuuaucgucuucaugccaggugaagauuugcauaggugaaaugcccacuuauuaggagaauuacacccugacagaaauccaaaagauggugccccuuuaucuucuaucaggggauuucaucuaauacuagaaggagcaguaagauaccaugaguuuguuaccaguuauucacuggccugauccugaaggucauugccuuucuucaguguuauuugcucaguauccugccugcuacccuuaagcacuuacuuugccuauugaaaucuuacuagcuauucauucagaaguaccaguauuucuuucaagguugaucuuaugaugcuacuguauuuuuucuugccuuuuaauuauuuuuuuaacuuuuuauuuugaaaaauuuuuaaacacaugcaauguauacacaguaguagaauaaucuucugugucaccaucauacaguuucaauauuuaccagcauucugccuucuuggcucaucuauauauaccacucccacucgauuuugauaaauucuuaauaauagacuaugagauccuugaaauuugaaacuauaauuaaauaucugucuauagacaccauacacauauauauacagcuauauaugcacauacacacauauaugcauagacacacacaccuaccccuuuauuuuauuuuuuauuaaaauguaacguauccucauuguggagauagccaauguuaauauuuugauuacuguguagauucuaucuuccauugguuuuuaaaaacauaacaugaaauuuguuuauugcuuuuaaacuucauauuuuaccaugaauauuuuccaauguccuugaauguuuugaaagugugauuuuuaaaggcagcguaauauuccaucacauggaucuuccauaauuuauuuuaagaguuugcaacuguugaccacaucuuaaacuccuugcacauaaacacuugucugcauuugcaaggauguuauuaggauaguuuccuagggaauuauuaggugaaaggcucuuuauguaucuugccaaguugcuaucuaggaaggcugugccaauuuguauuauuuuuaucuuauuaacgugguagucgacauaguaucugguuguguucuuuuagaaauuggcauuuucuggauuaaugacacugaacguuuuucauguucaugauucuuauuacauguguaaaauaagguguuaucuggaauuguagugaaugguacaugccauuuaguuuagcuccaaaucuagugcuuugcagcaaugauuaauuauuuuuaguauuucacaaaucaguuuuugcugucuuuggaccagaaugucugccuaagugcaaguuacauuaguugagaguuggucuuauuuuacuuuuugaguauuauuuuaaaaaauugucacuguguauaauuuucucccuuuaugucauguaacuuuauugagaaaugcaauucaaucaggaauaauuuaguuuagguaaaacuucuuuguccaagaaauauacugucagguccaaauacauuuuaaguuuugaaaaaaauauuuauuuagauaaaaauuuguaaucacucaggguauuugacuggauuugaagcauaauuuacuuccagaaugaauuuagaacucuguuguuaaaguacuugguacaauuuguauauccaguaaaauaaaaguugccauuuuugcaagucaguguuuuaaugcugauuugguacuuuugcuaugugaaauuccccauacuccaguauaggaacugaaugaaaacauauaccuuauuaaaauaguagagguaaguauuuucagcuuccuaaacagcagagaaugcuuuuuuuuuuuuuuuuuuuaaacuuuuggaauuacucuauuaccuacaucuaaguugcaaauccaaaaauaaaacuaggauuuuauuaacauauucugcccuucauugcuuccgguuauacuuugcugaacuguguucgaguauguugaaaaauaauuccguguauuguguguugaaaaugauauuaaaaguauauguguuauguggaagaaacaaucaaaacagaccuacucagacaucaacaggauauuauuaccccaaagaaaugacgacaguuugccagcuugaugcguaaaggaaggaaauuuacaaacaucuccaagagaggcauguugaacgguugaaggaaaugaggcacguccugcuuuuauugugcuuauugcagugggauucccagaagacugaacaaggcuguccugagaccucuguuuggcagagaucuuguugauucauauuuuauuuuuguuucagaaaaggucugcuauuguucaaauuucuaauguagcucauaaacacacagccaguaucauuuccccuucuacugacugauauauacaaauaaauuaaaaucuacggucaucauuaacucauguucuguuuccauggagcacaggagaguaacaaggaaggccccuuaaaagaaaggccuuuuaaaguggaggucucaguucacaaacuuuaaaaguuuacgaaguaguauuuuagaauuuuaaucaccagauauauugggggaauuuauuacuuccuauucauauggaagaggacagcagagguaaauauuuauguaacuuguauuuuaaaagcuuacucuugauuaaaauguuugaucuaucgacuucuguauccuuagaaguuugaauugcuggacauauuugacugggguuuuuacaaaggcuucuagguugaaaugcaugguucaggauuuugguuucaaauuucugucagguuggacacauauaaaugagaaaguaauguggaauauuauaaacauuucugcuuuuuuaagcucuaacuuuuuuuugcuaucucuaccaaaaugccugaaaaugucaugacucuuuagacggagaaauagaggaauggaaaccauucuggauccucugcugugacucagucagucuaaggggcagacugagcgcuauaucuggaguuuuacuuuaugaaugugcaccuuuaaccuugagucagaaaaugugguuacugucagucuuacucaguaaguggugcugcauagaacaucagggggagacuuggccuugguuuaguagaaacuugaaggagacaaacaugaaaagcagugucagaaaauggaagaccaguguuaaaaaucuuugguuuugcuuucauuucucuugguuauuucuuaggauuauugcuuuagaucauuuucccaggcauuuucauggaugaagaauuccaaagaaaguuauuauuucaacucuugaaagcuacgcuucagggugaagguagggcuugauuaucaaaggaauuucccuggcugcaguccuaacaguuuaacuuccugugauuuccccccgccccuuucccuuuauuuuuggcucagaacuucaguaaugucuggauugauggaauuccucugggaggcagauuugagggucuaaaggugcuucucaauaaagauuuugaggaaugauauuaacuuauuagaggcaacccucuauuguuuuaguauaaaggggaugagauuugggggaaucauuuuggaugucacauuaagccacuagccauuuuacucuugaugaccuuaguugccuuuaaacuguauuuuuaguggggaucauucuuucaacaguccauucuuuuuuaaacgcaauuugguuuauaauucugggggcugccucuacaugcuguacugucaagagagacaucaaauauuuucugaguaguuuucaacacagugaauuaaagcugaaaaaacaaguagcgauacuaccagcaucuuaacugaguaugugguggugguguuugaguguuugugugugugugugugugugucugucugugugaguguuuuauguugcuguaccuacuugcuuuuagguagcuacaguuuuaccagagaagagaauaacuuagauuauaucaaaguuuuuuuuuauauaaugguuuaaaaaccugcccugugucuaguacuccuuuacgaaguccgcaagacuuggggauaacaguggacaauaauguuccuuaaggacuuacagaaauaagacacacacagauauauuuaaauuccaauuaaucugauuuuuaguguggauuauugaagggcuaggaacuuagacucagaaauggaguauuuuuccuguuuaaaauguaaagagauuuaauaacauacaggagucuugcuaugauuuuugagaggagauuuacucuaauguuucagauaaucuguuuaacaguuaauaaaaauacgauuuacauuuuguuuggauuuuuuaaagucagcacauaauuucuaaaaguaagcaaauuucuugcagggauggugaaaugaaaccuuguagcauuuagcguguauugcgguuuuguuauuugcaguuuguuauuaaguguuccuaggaauaaaaggaggugcacagcaacaauguuuacugugccgauuucugguauuuuauaauuaaagagcaagugugagcugggaagggugggcuggaaagcauggauucuggcucuaaaucucagcucgaccacuuacuaccuguaaccuggggcaacacaguuauuuaauuucucuguaaaaugaggauaauacaagucccugcuucauugggcuaugggaauuaaaugagugaaugcaucuaacauugagaacaguguucagcccauaguaacugcucagugaguauuuuuaagcuauuagcaugaucaaauuuagagaggagaaauauaauggagcaguuucucaguucuuguuagaaauaaucauuacauuugaaaauccaacaaaauauuaacauucaaaacccauuuucagaagugguggugguagaauugcuauaacggaggaaaauuuaggaauggcagccugguuaaaagaaagggcggguagaccuggaguagguuauagaucaauuuaaagcagcaaaguuuucuaaaggugcuucuaguuuuacuuuaaaugaguuugcaguugcacauaucaaauaauaagguguuauuugccagaggcauuuuguugguggggggugggagaaaguuuugggguauauuguguguguuggggguacauuuccccggcugccuuuuuccacugcugcugguccucuggucaggaagccucccugucccgcacugguucuguuauuuguucuuggauagcaucaacuugaggaugagacuuuauaggcaacacauuagccucagugucuccuccugguuguagucauuucccgguuacaugggucaguuucuccaccuuacuugagugaaugccuagaaaggcuauuucagccuagagaauuuuuaggggaauggagaagcugaggguaacuccucagcaccaacacuugaacccaaucaauacuugauagauuacucccagcacacacaauacacccagaaaucuucuccccaauccacacccaauuaaguuucagccaagguuagaauucagugguucccucuguguguguccccuuagcuguugcuguucaggugcaaagguguucauuucuuugucuacccauguguaguugccugauauccaacuaaacugcaucaaaauauggaaccccuagguaggcaaaaaagauaauuagaauacaguaguccccccgccccccuuaucuguaguuucauuuucucuaguuuuaguuacuguccaucagcugugguccaaaaauauuaaauggaaaauuccagaaauaacuccuaaguucuaaauugcucgccauuugaugaaaucugcacuguccuuugccaucucauccgggacaugaauccuuacuuuguccagcagauucacacuccagacacucccugccuauaagucaccucuagguuuucagauugacuguuacuauggcagugcucagguucuagucacccuuuuuugacuuaacuauggccccaaagcacaaaaguagugaaucuggcaauucagauaugccaaaagaaagccaugaagugcauccuauaaguuacaagggcaaaguuccccacuuaagaaaaggccaggccugguggcucaugccuguaaucccagcacuuugggaggccaaggcgggcggaucaccugaggucaagagaucgagaccagccuggccaacauggugaaaccccaucucuacuaaaaauacaaaaauuagccagacguggugguggacgccuguaaucccagcuacuugggaggcugaggcaggagaauugcuugagucugagaggcggagguugcagugagccaagauugugccacugcacuccagccucagugacagagcaagccuccaucucaaaaaaaaaaaaagaaaaaaaaaagaaagaucauaugcugagguugcaguauauuauaauuguucuauguuacucuuaguuauuguugucagucucucacugugccugauuuaugaacuaacuuuaucauagguauauaugcauaggaaaaaucauagcguauauagaauuuugugcuaucugagguuucaggcaucugcuggagaucuuaaaaccuaucccucucuuagagugaguacugugauuauguuuaaauaaaugaaugcaugcuugcuuguggaaauauuuuugugugugggguauguauauguguguguguguguguugcauguggacauuuuaauguguguguauuauccuagcugaugguuuuccuuuggacauuuggguucauuuuguagaaagaaaaugcaguuuuagaaucaggaagcugauuggaugauuccaucugaauauauguguguguauaaauaaaauauauuaucaaaagccugacuugacuugggaacugggaaguagcagccucagguccuccuagguuuauuggaguuacacuuauuaguaaguagccuaauccucucugcaaagagaggaaguacaguuuuaugauagaaucacgugggaugaggaucauugaaccagagagaaacugcugcuguuugauuuccacugcaggucaucaguauuucuugaucuagaacaaugauaaaaaguguucuggucuuuaagcaaaacucagauuuaggcuuuauccuuagaaucugaucuuuaaaacuggaagcacaagcuuuccagcuuugaauucacuccauuucagagaugaagaaaccauuucucaaagaggugucucuguugagguuucacagugaacaagucaggucagcugaauccaggucuaguguuauuuccugcaaauacauuuuauuuuucauuuuugcaguaaucuuuagauuaaacccacuccuauacuguuggauuaguuaggcacauggacuggguguauguuucccagauuugaagguugguucuccaugucauaguuauuuguucugguugcuuuuuuuuuuuuuuuuuuuugagacggagucucgcucuguggcccaggcuggagugcaguggcgggaucucggcucacugcaagcuccgccucccggguucacgccauucuccugccucagccccccaaguagcugggacuacaggcgcccgccacuacgcccggcuaauuuuuuguauuuuuaguagagacgggguuucaccguuuuagccgggauggucucgaucuccugaccucgugauccgcccgccucggccuuccaaagugcugggauuacaggcgugagccaccgcgcccggcccgguugcuauuuuuucucaguuuucuuaucuguacaguggcgguaguuauuucauagaaucauacugaggacuaaauaaguuauuucuuguaaauuacuuacaugaguacccagcauaaguguuagcuauaauaauuauuauguuauuaaugauuaugucauuauuauguauuguugauaguaauauaauaauauauugcuuuuuagacacuuuaguuagcuauccagcauaugacaauaaaaagguggcucuauugaagagaaggauuccauaauuuucuugugaaauuagcgccauaaaucauugaacaucuugcuucaguuuugugugaauuauuuggauugacuaaguacucuugguacugggcugaguuaccaucugcuguguuuugcuuccauaggucaggcuuauucuccuagggaauggugagguggaaaaaaaugccaauaaccuaaccccaaaauguauccuaacugucuuguucacauuuauaggacaguuuuauugcuguagguaagacggauaacugggcacuauuccagcaucuuggcaguuuuccuuuuuucaagguacuaauauuaggauuagcauguuguuuuaaagccauugccuuucugcaccuuauaauugcuuguucuugggggaggcuuggaacauuugaauuacgguuuuucugccaaauaugggagagguugucuguuuuguuuuaauacuucgauugguuuuuaaaguugguacuacaguccauuuugccaacagacaacacaaauuagaggcagugugggcacacuguguauggggcagaugcagagaggggcagcgaauaugcaugagcgagaauguuauagcucugucaguuuuuguaugugugccucaguuuauuuuugguauugauaccaauguucggcaauacagugauuugccuccucuauuuuguuucuaaaucaaagccuuggcagauuaaaaugacuaggaaaagauuaaauuguuaaugguauaaucauauuuuucucuaaagcauugaagaauuacagugucuauacuuauuagcaugugauaacuuuagugauugaaauguuuagcuaguuuuacucaaauauuaguaggauuucuaauuuucauaggagagccuagugccacaaaaguuacugguaacuagcacucuucaguuuucaucuucauguaacuguugugagcauucaaggaaggagcugggaaaugguuuagucuucauagaugcucaacagaugugaguucucuuuucucccauguauacguuucuuaucuuuuuguagaguucaugggagcagcauuuauggauucagacuuauauuguugacaauguccuugcuaccugauagaugaucaguaaguguugcagaacgaauacauaugagagcagcagagauaggaguacauuagggcaauuagaauagauuccuuuuuuuguuuguuuuuugagacagagucuguugcccaggcuggagugagguggaucggucucacugcaacuucugccuccuggguucaagcgauucuugugccucagccuccucaguagcgggacuacaggcaugugccaccacaccuggcuaauuuuuauauuuuuaguagagauggaguuucaucacguuggccaggcuggucucgaauuccuggccucaagugauccguccaccucggccucccaaagugcugggauuacagguaugagccacagugcccggccauuagaauagauuucaaagaaaaguugacugugccaaucucugcucccuccuguauguuguuaagucuacagggccauauugccuaaagaaacggaguuccccaagaauguguuaggaauaacaaaaauucuguacuuugaccugaaaauugcgguucuugagcugguuauuuuucuagguauuguuggaaguuaugagucagaguuagguacuuauucguggauaacacaaggacuucugucagagaucuggaugcugucaguagaaucucuguuuacccucuugggcucaguuuauucaucuauucuaugaggaggaguaugccuguuuggccuuccucuuagguugcuuuugagaaugaaugaaauaauaugugaaaauucuguucauaaguguagaagauggcuagugaugaugaugaugaugaugaugaaauugaugaugcccaaaauauggagaaucuagacugaauuuauggcuuucuaacuucgaauuuucggcuuucuaacuucgaauuuucaggaaugcaugaugauagaauguuuuuauuucugauauccacugcauuguuucuauagaccuucaaaguuugacacaaauaacuaaauuauuuuguuuuguuggugaggaucacuuuuauuuuagcgguguauccuguuaaaauaaccuugcaugaggauucucaaaguuauacuaauguugcacuaguaacuaaggcaguuccaaaaagagacauuuagaaugaauaaggauaaaucaaaaguaauucauauccauugguaaggagguggcacauaccaagugucaacuguagauauuuuagaaauugaaguguuaccauggaaucaaaguauuccacuguaagguugaauaucucaggauaccuacuuuaagucgucgauuaagaugaaguuaauauucauuuuacauauccugcuugaaaccucuuaugcugugaaauuuuccugucuauuaagaauaguuuuagaaaaaugaauuagcuaauuccuuaacuuguauguaacuugaauauaaguuccuuuccuuaacuugugugaaaaucaguucuccuuugugaagagcaugagagauaccucaauaaaauaguaauuuuauauugacaucgguugcaguuucaaagucagaguuuuacacuuaugugccccuauauugucuagcuuuguaauccccacuuuaaaaggcaucccaaaauagcaacagaagaauaaauugugacuuggguguauuagauuuguaugaucuuguuuauugagcugcuuuguuauguaguuaccaaggaugauguaagcuucucauccaaguuuuccuuuacuaugcugcauuguccuuuaaaugucaugagaauacaaauauuuucaagguagcagugaggaacaaucuagaugagaugaccaaaaggaccucucauaugaaacugcagugagcaaagguuuauuggucuuuggaucucuaaauagagugacuuuagauaucuaaauuuagugaaaaccagaauucagugacuuuagauuucagaccauaagggguuguaacaccuacuccuuuucucuguaaugaagaaaaaugaccacaacaaugugguggauaucagaaauagaaacuuuucaucgucaugcauuccuggaaauuccagguuagaaaggcauaaaagagagagaaaaccugucauaguuaguauaucuaccuugguuaguguuuuucacuuaggggauugcaaauucauaugagaauugcugagagaaacaauuaauuuagaacaaauauucuccuuccauuguuacagccuguaaaauguuacuucugaguugcuacuuaucuaucaccauuucucuuucuccacuucauuguuaguguuuguaugauuagggugggcgggggucuucuggaugggguugcucacacuccacaaagccuuuucccucuucuguugaaagaagacacagcugaaaucagucucuuugccuuuucaugauauggggaugcgguggaaucaaagcaggcaggaugaaagcccaaaagcuuccuguuuccagcuguuuucuucagcgaagguuuuuuuuuuuucucccaaagaugaugcuuccuuucaagggguuuuuaaucugcuaacuguuuccucaguuuauuucacuacaguaaaauguguucccuuuaggucauaucugucucuuuuaaaacccaaccuguccuuuucagccguguuaguugcuacucaaaagaacaaacgugauuuauaaaaguccuuuuaaugagguacaaagaccaauaaaccuuugccacuagaguuucaucuuuucaguugcuuuauuuucauuuaugaaaaauuugagaugucaaaaagccauugagaacacuauugauuugaccauuuaauauuuguaaacaaagccguuaaaaauaaaauauauuguuauggccuuaagguugguugugguuuuuuuuucccuuccgaaugcaguauaaucauauguaauuuguuuaauguaaauucuuuaaaauuaaggcacuggaaacugcauaaaugcuaaaaugaauacuaagaguggcuugauuuauuaagugauaaugugcaugaaaauauggcuuuuuugcacugauguuuauugcuucacuuuuugcauugauguuguuuuggaauuuacauuucuaaauucugcauccucuagggauaaaugaaauauaaaaaugaauucuuuuaaucacucauuaaacauuaacuagaccuuucacccauuuccuagaucuuccaggguucucaguaauaaucaucaucauuauacauugauuuauaaaggaauaucagagugagucagaauuuuucuguuucuuuaucacuugucuuuccccaaauauccauacugaccuaaacguaggagaauuuaucagcaagaagguucacauugcugcccuguuauuugagcucauucuuugugauauaaugaagccaguggcauaugggggagaaccaccucauuucauuuucacuuuaaugcuaacucuaacauaugcuuuugaauugaaguggggucccaaaugccaauauauguuaaaagaauuaaacacuuugaaaaaagagaaaguuuucccuuauuuacuccuguugcccacucucuugagggugagaggcugauagcgcuuaaaaacaugagcaugccuauuuuaucuguacuguuuaauagagagcuaugaaaaaaauggcaauuaacauauucagacagaaaaucauccuggcugaaugacucauuaaauagucguauaaacaggaugugccgaaaugaacugguucagaauuuaguuccauuggucuuuucagcacacacugcucauuaucagcacuuuaagaagcagacuugugggugcuuagaggacacuuaaauuucuuuucucuuuauuuuuuucuuaaauacuucuccccuccuccacuccuuuccccugcuauuccuaauucuuugcaggcuaagauuacucgucuaaacaugaaacauucuguuggcaaucgaguuagggguaagagcuucugacuuucauccaggucggugguccuaaccccagaugacaaucaaaauguauuugaagauuuuuuuuuuuggagacaaagucucccucugucgcccaggcuggagugcaauggcacaaucuuggcucacuguagccucagccucccagguucaagcaauucuccugccucagccuccgaguagcugggauuacaggcguauaccaccaugccuggcuaauuuuuguauuuuuaguagagaugggguuucaccauguuggccaggcuggucucaaacuccugaccuugugugauccgccugccucagccucccaaagugcugggauuacaggcgugagccacugugccuggccauguuuuuaaaauaugcagacauugcugaaccucauuuuuuugggcuucccauucaguaggucuagaggcaaggccugguaguccguauuuuaauaaaagcucccaguaggauucagauagccagccgggcuuggaaacuauucacugauuuguguccccucacaguaaaaaugcucuuuccccagguacaggauauauggccaucuggccuggauaucagugguuugcagaccuggcugcaaauuagaaucacuuggggagcuuggagaauaaauacugauguuugaccccacccccaauuaaauuguugguggggggaguaguuaaaaccuccccaguugauucuaauguacagucaaguuagaguacuucuguccuacauaaacagauggagcuagguuuagcugaaaaagucuaguuuucuuuuagaauaugcuuuacccugugcuaaaacuccucuguuacugugccucccuagccacacacacagagcuuaaacguauugccucuacuaaggcuuucacauuuauugguacccuguucucaggugggaguagaaugcuaggcucucacguuguaucagauuccuguuucuuccuaccugaguaucacaucugugaugugcagauguguugguauagcaugagcaccccacaaaggcuaaguaauaaggaugaagaacaaaauugcaguuuagcaaaggaaggagcauccaucuuuugagucccuguauacuccaagaaaaauucugaguaaacaaguuucuucuuuagcaaguugugauauuaaaugggugccuuucauuacauuggcuaacauuugcauuucuuggaccuguucuggaaaagggucugagaugaacccaucguugaagaucuaaaaaacaaaaacuuucaccaugucaagggaaagaggaaagauuuccauaaguguaaucuuguauucuggaugguacaugaaaacucuacuuccuaacugcccacagggauuuaagggguauuuuaagggguacuuacaaauaaaaggaagaagauacauuacaucacauucucauuaccaaggagaaacucauccucucuaggaaagguuucucuccugucuuacgugugacuuuccaccugcuaaguccccuugaaguuacugagcaaagacacucuuacaacacuaagccauuggugcuagaaguggaaguagacggagccccugagguucaggugccagguccuuguaucucugauggcgugggaaacaaaagucagcagccauuucucuucacuagagacucagaggagguaaaaaggggggauucacgaagucaucuugauuuuuccguaucuuauggcgaagucuugugguagaccccagaacccugaugguuggucucacgcucguaaguuuacauaaggcuuucucaagaaacugacauccagagcgcuugccuuagagaagacagcugaccauggucaugacacuggcagguguuaggacuggcuggucuacucugguauggcagaaacccugggccccugaauaagggaggugauuaugcuuuaaagucuaggcuuaccauguguagggcugugggacucacugucaggguuguguaaggcgagggccaucgcuugcagaagucugagugugugagcacccccuuaaauauugcccccaggugcuguacuugcuuaaccccggacccagcccuggcagggagcaacagcaggagggaaaaccauugguaauuuaggucuucacaucuuaugcuucauuuaaugugguugauaaagagccuccuuguaaaaauaucuugguguagacucccagggaaggaaacacuugugugacugacaagcuggcagugcccauggccacgugugucacccugguggaggauaaucguccuauuauuuuuugucaguagguauaacaaguggguagugcuuuguguauuccacugugaugaauuaauuuuguguucauuguaguagcacugaucauaaugaauuaauuugguauucauguggaugucagagguuuuuuuuuccccuuccaauuucauguagcuuuaguuaauggauacuuuaaaguacaguacaucugaucugauuucuguucucucauucacuucucauaauuuuccccccgcuggauauugugaggucuucuguuuuuaaaacauuuaacuugaucuuuaaauaauuaauguuuuaauagcuuuacaugaacucaaacauuccuccugcuuuuaauuuauaaaauaaggaaaauaagguaaauaguuauaacaaauauaacugcuagguugaaugauauacuuaauaacuuguauauuuuaguuugguuuaaaaagaucugaacuaaucauuuguaauuuguagccuuauugaagacaaauauuguauccccuuaugcaaauaugaaauaaugaaaacugcaugccguauauaauaguuugcucuucuuuuaauuucuucucucuuucccucauagacaagauugauaaauguaugugcauauauuauuuaucuguucauauaaggacauguaauugacuauuagauaugguaauugcauaaauauaucuuauucaagcucauuuccuuuucuguuuauaaaauaaauguuuuuguuaaauuggaauauguacugaaauagaagugccuaauuuaggauucagaaacuagguacacaaacaaaaaucaaacaaaauucugggaaccuuugacaaacuuguucuuuaaccuauauguguuuaaaaaauuuguucaucauguuugcugauuauugaagauauuuauaauagaauaaggguuuccuucaucacuaacacaccugcucggcugauuugcucccaguggaaauaugguugaaccuuuagaaagaacgauguuuuuuugccuuacgaguaucaggaugccauuuuuggucuuucuuuaaauuuaaacuuggaaaugguauccuccauauauucucuuguggcuuuaaacuuuuuuuuuuuuuuuuuuuguaauuuuacagcucuuguucaguuugauucucagcagcagcuguauuccauuguagacugcuguguuucagcaauugauggauccuguauauauucuacuauuuagaguauauaaagaaguugggacucuugcaaguggcaaggacuauauaacuggguuacuauggcuuucauuauuuuuguuauuauugugacagauuguacaguaauaugcuaacaaagauuuauggcaucaugcagcaguaggaaauguugggauggaggagaaaacucauguuaaaacaaaugucuauaauaauaagaggaaaacaaaacuucaaaaaagcugagaauuguuucuaguauaaauauuuuuauuaacauuuguuaugguugaagaucuugagaggaacuguucaugcauuucugcaguuuagauuaugcuguaugccuauuugugcaucaucguucuuaggagauuguucuuucuucugguuuuuuuuuuuuuuaguuuuuuuguuuuacuggaacacauagguauugaauaugcaaugaacagaaaauuuauggagggcagaguuaugaguaucugaggaaaguuuaauuacuuuuauaauuuagauaagcuucauaauuuauuguaacacgcuguacuuuggcacaauuuguaacaauuauaaagcacuugaauuuagguucuuuacuuggcagcuaucaacagaguuagcuguaugaaaacuuuaagcauuuacuuuccuuccuccgccuugcauuacaggcuuacgcuguaguaguuuuguugcucccacuuucauuugccacaucucuggguuuuauguaucacaguauaguaggcuuguggcuauacacuaggaagcagacgaagagagaaccugaagauaccuccugaugcccaaaccuaggaaagggaaaaaugcagaagaacucagacgacucuuggaaaugauucuugccucaauuaaaaagaccucaccacucaccuccauguaaaggacaggucgugaauuauucaaaugauucagaaaucaacauuuaaaaaaaugaacauaaauuccuuuucauaauuaaagagcgguggaaaauggcucuuuucuuaggucuagauuauauugcuguuaaaggaauugcugccuaguauacaauuuuuugacauuguuuucuacaacaucaaucuuauuuguuguccuuuuuugucacgccuguuaaauguguauuuuucuguguugauauugaaacuaauguacaaagugugacaucuccaaaaacugauuugguuguuccuaaaaacauugguccuuaaaaguauauuuauuugcagcccaggaauuuuuagcuucacauuuuucuuuuaauaacuaaacuguagaacagaauuagcucucauaaaaccuuguacuugcugaacaacucucauaauuaaaugaauauaaugauuuuaugugacacuuugaacuucuaaaguucuuucacaucuauguauguuuaggacaagauuuaaaaguuaaauuauucuacaguuggaguagaaauaaguggccaaguauccaacuuuuguaucucaaauaccuucuuuuuuuuuuuuuuucccaaauaccuucuuauauucuccaccgacuuuuugggcuggcuaagugugacagaaaugggaacuuuaguucuggcuuuugauucucucauguuaauguagguuuuugauaagucacuuggugcaaaacacugaaacaacuuaucuauuggcuuaaaugagucaacagucugaaucaaacagguugugaauugguuaaaauaauaaaccaguaacccugugguugagcucuugaugauuaaagaaccagaccuaagaaugcauuuauagucuuuuaaaagagaguaaagacucccacuucuuugagcuguguuucuuuguguagauuucuuuuuuuuuuuuuuuaaagaaaggcuucauuaucuguuucagaucuuuauagauguugcaauaagguacuccuuucuauuaguauaggauugaaaggaucaaaguuaauaacuugaacugagaugcuuuaaaauaacaaaauaguuuauuaucucuuuccuuuucaagauuuauguucuuacaaggguacaauguucaugauugaaugugguccuacugguaaggcuuccauguaauagaagaguaauucccuugucuagcauucucuggguuguuuuaauguugcaggugaauguguucugcugugcaaauaaauguaguucucuuauucacauuccugaugacuugcauccuuaaacccuuuuggucaggguauuauuguccuuuauccugaaaaaugucugugauuguagugcccuaauacuauaaaucaauggggacugaauucagcgccugcuaaguagagugaggcaacccuuuaaaugcaaaugcaucagggcuaguuuuaauguaauuuuaauaaggcugaaaccauuuugaaguagacuuaaaucauaauacuaaucuuaaaagacucucuauuuagcugagaagucccuuuauucucacuggccauuuuuccucugugugcauccaaaccaccuuucaugugauuccacaguuuuucauuucuuuuuuuuuuuuucucaaauagaauauauguacaguuugugguuacuuuauuaguuggagaagagcuuguauugacuaaaauugcuucacuucuuuuucuuccugguuguacaugccugacuaaucuguguguguguguguguguguguguccauaauauuucaaucacauugcuguguuuuggucagagaaguaaaaaucuagcugucaaugccaacuggaguaguuauuuaagaauauaauauuuaaguaggggaguauaugcaaaguaauauaaaaaugaggaaaacauuuacaaaaucaaaugugaccucaaguccaauauuuuucaaucuucuaagucuguugguuucaccaccucacauuauuucaauguaugugaaauauaucuugcuguuuauauuuggguugaugggacaggugcaggaucuuugaccuggggaaauaaauuggauuaaggacuagcuuaacuagucuacagaaacuguagacuacaaaaacugaaggcaagaaccuacugucacaucuuuugcagagagacaaaggcauuuugguauuuggauauuuuacuugggauauguauuuuguguauuuguguaauuuuguauuaauuuacacaaacuuaaguaaacaauauauuaauaagauucaucaaguaauuuauaaauuaacuuucccacauuuuucuguguucaagaauuaucaaggagauguguaaauauugaagccuauacuauauuccauuauuugcuuuuaauguauuucauauaauucagaaaacaguaauuuaucauuuacauuacuucccuuuuccuauugagccuucugaaagaauaauguagaccagcauuuuaaaaaaaagcuuguuucaagacauguuaauagaaauuuuauuuucaguccauucugcauuaaauauuguaaaacaccccuagagagugauauuauuuguaaugauucccaaauugcuuugaccagagaacuccuuuuuucaugaaauaccucccauguggaacauucugcagaagaguuuugugaaaugcuaacucagcccaaaagguuuuuuaaauuaaggccuuucaaguugguaaugguauuuaguuucuuguuuuuuaaaauagacuuuguuuaggacaguuuucuagggucacugugccacucaugcugacuguccugucgucuugaaaaauacuacugguaacaugugaacagauauggagguccucuacccgaguauuuuaauaccaaauaauagcuauaucuucucagauauugguagcuaugucaauggagaugugaaauuggcucuaucgauggcuuuuguccauucuccaagagaggccugucuuuguggguggagguguugguggauauguguaugugucuccuucucuuacccucuuaacaguuuggucacaguggugaccagugaguauagagcagagccuugacaaugcaccugacuuugggcuuuagccagauaguaugaaugagugaagcagauguuaaggagaggugaguuuagggcaacuggggcauucgugcccccucauucauucaguuaacauuuccaagaauccugugcagggcaaauaagaucuaucucaggaccagcaauaucucauccuugguaugaagauaagaagucaggagacuugagcuguagguuugguugucuccuugccuggcaggcuugccuaauuuacagcaaguagaaaauaaucugugucuuguucaaaucuaaauaacaaugcuuuaaagguaguguagaauauuuguuaaaaagaacauauuaauuauguuuuuagaagcuucuguaaggaagaaagaaguuugaccccccaacuuuucucuuuucuagaacugcaaauuacugcuauuuuaaauagacuuuguuguuuaacuguacauccaggaaaaucuaggaaauuaaagaagcaugcauauaaaugauuguguagcagaacaugaacauuaaauucauacagugaagaaauuaaaguuagaaauacucucaaacauaagaagguucuagaaucaauccuuuaagcacagucugagacaugguauaucuuugcacuuacuuggaccuugguuucuauuccugugaugauuauuggauuugaugccaucugauguccuguuccucagauucuaugaagcugagucugagauuaacuuaggucugagauugacauaaaggggaaccggucccuagauuuccucagggcugagaaguuauugauuucucaaguauaauaggacugcacagacgcacaauuugcaccaaucggaacaaaauguuuaacaaguucugaguauagaaaacacuuugcaauuugaauuucuaugauuccaaaauucaaaaaagcuccuuuuugauuaaaugcacugcccucaaccacacaugcucauuuucucugucuacugcuuugucauucuguuuauuuaacuuuacuuggcauaccagaguuuuaacgcugagauuuuaaaguacauaugcaaaauuggaaugugucagagaaccuaggaacagauucaucaaaggagucaugaggcacauugcacaugcuuuaacaucaagguguaaacggagcccauuaaacuauuaguuaaguggugaucaggagcaagagccugauuagauuacaaaaucuucugugugugagcgcgguaugugaaaacauaacacuugauccucaccauagugccaggaagauucaauuagagaacugguaugugcccagauuuggggacauaaagggcaacuggauuuugaaggaaagaugguaaggaaacaccugcaaaaaucugcuucucugugcaacagacuggguaauugcauaugcagauggauaguuagggauauaauugcuugauuugugaacauaaaugcccuuucgauugugucaguguugaauuuugcagugacaggugccugcggauugcuguguguguauccuuugcaccccuguuuaaauauuuggccuggaguaugucuuccauucauugugaauggaaccaccgccgucccgcccccaugauggucuggggguauuguuauagcucuuaaugucucuccaacuuuuucucauaaauaauaaccuuaauuugaaaccuuaacuaaaagaaggacugcauagaggcauguggugaagggcuuacgaauuaugcacagaauucauuuuuuaaagcugcuggauguaacucauuaguuuucauuguuuucucaaaauaaggaaaacuauuaaccaacacugcagacuaauagccuggauuuuuuuucccccauaaucaacugaaguuuaauggaaaaucaucuuuugaaagacuuccuuuuuucuccuugcuuuuucuuaaccuuuccauuaauacuguuccaauaucuucucuaaucucucucaacuaaauagcauucucagucauuccuuuucuaugucaacauuucuauaccgcacugaagauguuuguaaaaauacuggugcaguccaaaugggauuuauuuuuaaauugaagaauuuguuaagcacuuacuuauguggaauggucaggucaucuccguauuccuuucucuggccuuauggagaaaguggaggaaauggugucugccuuuaaugagguugcuaacgugccugaacuacacaauaaguuauuaagucauauuuuaugugauuauucaguuucuuuuuuuuuuugcuccauucuaaaucaaacuaucuaaauuauuuuugucaaauaaagguuaauuucagcaguuguugauaauaaacacuugcauguacuauucauaucaacguguaugauacucugcuaaguauaguacaucaguaaucucauuuaaucugucaaacaguauauauuauucccauuucacagaugagcaaacugagcuauaagauuaaguauauuacuccugccauauaguuaauaaauagaaagggauuggaguucagaaauaugugccucucuagcccacguuuguugcuguuuuggcaucuaauuugcaaauauaaauaaauauaucuaaauaaauaaaaaauaucuugaaucugccuuuuuaaaggagccugccaaagagaggcaaaauaaccgcagaaaucccauuuugacuggcuuugauaugaagacuucacacaacucuuauuuuaauuucuugguauuuccuuaugcuuugcugcucuucugaggcacauuuucucaguaagauauucuuuaugcuuuuuaacuaaaaauguggggauuaaauuuuacccacaaaaagguuugaaaccguucuuucuaauucuucaugugucauuaaaaaaguauccgcauguauuuuggugcguguggagaaggagcuggcacugugugcucaaauaaugcucagaaccaccugcuuugaauguggucugauugaaucaaaugacgacugcuuuucaucaccgagccgggauugggaugugggggaaguguuuuguuuugauauuucacaugugcuuagguguucgugguuucagguuguuuaagaacagacucucauugaguguuggugaguccugugggggagauuugaaagcaacguugaggauuucuaggucuguuucaaaauuacauccucuuguguggugcauuuauuuguguucaggaugcagauugccuuguggaaaauggcaaaucauuuucccucauaaaagguuucuuuuguuuuuuuguuuguuuggucuucagcuauuuuuuuugguaguuuccccuccugaguucagauuaucaguacuuucaucauuuauaccacucgguucucuggaguucuuggugcacuguggguccacuuuucuuguuuggggugaugacuaacaucugcccugauacucgccugguacuugaggcucugaacuuuauuaucuucucuucaacugcagcucguggcacuuguaggcaacgugccucccaaagagccugaaagagauuacagcucacuuccugccaucagacaguauguggggaggucaaggggugggcagaggagaggcuuggugaaauucagacuuuugggccccaucuagaagaaucugcuucaguaucucuuggagcuacccaggaauauguauuuucaacagugcuccagaucugagggacaguuggaauuaggaaaacuguggcucuaacugaugccccaguacuucucaaagugggugcccccacauccugauaugcuggauguguuuuguaacugcagauuccugggcuccacugggagugguggcccuggaccagccucugucauguguccccaaccacacucuugggauucguauuuguaugaacuuuagagaaugaacugccacagagauucuaggugacaggaaauugugggguaaauuggaggauuacagaucaugcuucuaauaucagcacagguacacacaaucgucaaaauaggggacagguguguuuggaaagcuuguuuuguaaagaaagucuuuucucccuuugacuucucuucuuuacguggaagcuacacuucugaauuacaaagagacagagaaaaaagagaacaauaacaacaaaagguuccugaggcauaccuaagcugcaggagccaagggagugucccuuguuuuacuuggugauggcuguuugaacagccguuugcuuucuccuuccuguccucugaugugaggaugcaggauuggaaucauuagaaacccuagguuaguagcaucaggcucccugcccuguguagucucugggaggacagagcugcagcuuaaguugugcuuuugucuuggcaagcaccuuucaauuuuuauccuagcucaguugcuuuguuuggcauuuuacuggccaauacuccuuuuuuuuucccucucuucuccaucuccuaauucucaaccucuucuggggccaaaaacuuggaggaaagacuuuaaaaaaaccaauuucacuccuguuuauguaaucguuucuauauuacagaaggcuaugguauguuuuaaaauguauacaucucuuugcuuuucucccuugugacugaauuuuugaaaaaugcuugaaauacggacaccaaaacggaauguaugugugucacauuuaaacggaaaacccuguuuguuuuguauauuagacuauagccaaugaaaacccagggaguaaggauuuucaugaccacaacugaauauagaaccucauagguuucuguuauaaguauaaauauugagaauaguuuuguuuguuuaugccagugcaguuuuauagcaaauccuuucaaauggggugcaaagccauccauggauauuuguaaaggcuuugcaaaaucauacauaaaauaaauuguccauuugauuugaacaaguuuugcaauuauuuguggcuuuaacaggggcuuuugaagggcacuguauauaucuaccagcugguucuacuuuuuuuuuuuuaagaaaauggagagcuuuguauacaaucccuuggguaaaccaguaauaaacuauauaucagguagucaagucaugccauuucaaaucuguuuuacauuuuaaagggguaauaauuugugaauuucaucucauagaaauuuuuaugcuucaaaucaaguuguuaucccauccuugucuauuuuuuuuuuaucgauccccucacucaguguuuuagagaaauaaagcauacaauggaaucucuugcugggaaaaaauacuuucuuacuuauuauauuguaucuuguaauaauauauuucuaucaccauuuaaaaaacauucuuuuaguuauugaugauuauuuugucaaauuauaugaauuugguucuguuuucuuuuugugacaaagauucugaauuuucauguuuaauaaaugcacuucuucacaugacaaauguucauugagcccuuagccaggcauuggugucaacccugguucauaggugcccagaguuccuguccuucugaagcuugcauccugguggggaucaauaaacaaagauaccaaccaacaaauauaaauauauguauguauguaauugauugauugauaucugugugugaguguuuccucaauggcauuaugcauuuauuuauucauucuucaugcauuuguugugugggaaagaauguuuuccagguugaggaaagacacgagacucgacagccagggauauauuagguaacggugaggagucuggugugauugaggcacagaaggaagugccaguguaaaguaacaugagaagaaaguacacacagauccugagcaccuuaaaugcuagccuaaggaauuuuaaguuuauacccaaagcaauagggagccacugaagauuuuuguauggagaagugacaguugucaguggcucauaguagauuggagugggcaccuuugcugaaguuagggaaccuguuuucagguccuuauuaugagacgugcuaguuaaaagaggaaaggaggggaggggguuggcaaaggcugcaguuaguuacauugagugaggucaaguaaaauguuuugaagcauuucuauggagaagucccagaucuucuuaccuuucaugacuuuguuagacucacucuucagugaaauaagacuggucuugauuuuuccaugcgucuugaguuaaagcguuacccuuugcuaccugggcucuacgauuucaccuguucucuggccacaccuuggaauucacuucuuugugcucuccaauauuugauuuccuucuugucuucuuuucuuuguuguuguuuuuuguuuuugauacaagagucucacucugucacccacgcuggagugcaguggugugauguuggcucauugcaaccuucgccucccggguucaagcgauuuuccugccucagccuccugaguggcugggauuacaggugugcgccaccacgcccggcuaauuuuuguauuuuuaguagagauggaauuucaccauguuggccaggcaggucuccaacuucuggccccaagccaucugcccaccucagccucccaaagugcugggauuacaggcagcauggccaccaugcccggcuuuccuucuugccuuuucuuaagaguccugcuucaaggaaacuuccgucuccuuuucaaaaacuauuucaguaacaaucccuugguguuuauuuaccauuuguagcuuaaacuuaaaacuuuuucccuguauuaguuauuuuucaaauauacuuuuugucucuucaacuaaauuuugagcucaggauucauaauuuauuugaagagguacaaacagaaagguucugucccauauuucuaaguaguaggauuuauuuuuccuucuauugaaaugaaaauauaaauggccuuugaggcuccaggagagcccacaaaauuuuauuuaguccaaaauaccguaaaacuucaguauuauuaauacuuaaagaugguuugccucaagcaagaaauaugaagcucuggggaacacauucugugugugugacacauccagacagugugguuugccaaaugguagcugauccagagugagguucuuaaccuucaucaagucagggacugcuuugaaaauccaaugcaagcuguagacugucuucccagaaaaaugcguauagcuaaauacaugaggaaaauucugcaguccuuagucuguguauguagcauguguguagguaugauauugguaaauccaaaagaaaaaaugcuuuuuaguuaccuuuuguagccauuaacguuaccugugcuaagugcucauuaggcauuugcuggcugauucuauucaugugagggccacagggaccaggagaggugagagcaaagaugcaugcacagaucagagaaggguuaaauggggaauuaugcagcauguaacuuauacauuuccugaaaaugaugcuucuguggacuuagacaaaaaugaguggccaggagaggauugccguuggauagaugaagucuagauuuauccagaguugguauuucuuguuaaagaaccucagugagcaguaaguucauaaaccuacuggggugcugguggagggggagaucuacuguuuauuuuaggauguuuucagcugcaacaaaagaaaacccugacucaaauggacuuaaacauagggaaaugucuuacauuacguuaccuauuccaaaaucucuggugguuuccuuccuccguguacugccuucauccuaggaaugauaaggaaauuccugcuuugguucugggcaucacauccaaacagaaaaaucaucaaagaggauaaguggucgucuacugaugugucucuuuccuuggaguagggagauauuuccaagaacccaguagaggcugcaccuuugugucuuagugcucauuuugaaaccaguaucuggccuggggaaggcaaggggugugauuggcuguaggacuuggggguuucccucuggaacuggaaaugaggucaccuguuccugauccacuaggaggagugguggcuaugugaacaaauagcaauuauaccaaaaacugcugcacguucuacuaagaaggaagaagagaaaaauagauauuggaccaacagaacuaacagugucauuguaucuucugauaaacucacauucugaauaaaaaaggaagucauguuuguauuuuuaaaauuuaucuaaaucuguuguuauuuucucuaccacaacacaugggguacagucauaugcuuaaguccaugugagugagcuuuuauaauagauguucuguccacacaaggacugguuuccaaggcccgcacucaguuuacuuaugggccccacugccaugcacaauuaagaaaaagacgagauuuuagcaacuuggacugaacuauagacuuugccuaaacucauuauuuacagcagcacuuuucuucauaggugaauuguuaauagguuugauuacuuauucuugccuuggagaauuuucagguauggcuuacaaagugauaugaauugucaucucucaaaugcaucuuuaauuuaaacauauucucuauguuucuggguagaggaagaggaaaaaagucuaugaaaaugaauuuaaaaugcuucucagagucaguauuaauuuaaaccguugcgguuuucuguggggcauauuuaacccaaaagaaaagcccuuauaauuaggaaauugggauucugaauaauuaauuugaaagaggaaauauaacuuuuucuacagagaacaucuuucauccaaauuuggaguuccaguuucugcagaugucacuucucucucauaacauaagaaaauagguaagaggcaguuuggaaagagguugaaaggagaaauuauagguucuccucccagcuuuuccaauaacuugccuugaggacuuggaccaagcccugacuuucucugauguauaaaguuguaaaggaagaugaaauacugugcacgaaagugcuuugaaaaauugaaagcaguaaacugcucuaggauauuuauuguuaguguggugguucugguuauuauaaaugaagcagaacuuuaaauauuaaugguacucuuguucaucaauggggaaguuauaggggaaagguuuuccaaaaaaugcugagcuauaacugccauccaaguaagugacgcagaaugccuaacccaauuuguaucuugcuaucaccugaucacagaaagcuguuucacuguagagguaacaguuguuuucuccucuguccugaggccaaugauuauauaauauguaucaaaucacuagggugcauaucaaagugagcauaaagaggcaaauauuucccuuuacaaugaccauauaagagauuauuucugucaggggauaaggcauacaugaagucugacuguuucacugcauuuuuacuauagaaaucacugagcuugagacuuguacauuaacuccaucuggucaugugacuggcaagugaaguguuucaauguguuaagaggacugaucugcauauuucuugcugaaucuuaaucuguacuugcauauuugugaaacgaaugaguauuuaaauuauggagaaaagauguauugugccaaacuaaccuuuauagcauaccugugguuguaguuucucuagcuaacaguggacaagaugaaaacucauuauacauuuucaucauguuagguauucuucucaaagucacaggagcacugcagaaugguucguaacuuuaugaauucagcuggcauuuuggauauauggacggccccuuugaggggcuaaagacacagccauccauuucaccaagagucgccgagggugccuuauugccccuaccccgugcuggguacugagggugggauagaaggcaaaccagacacaucccuuguguuuaugcagcuuuuucuucagugggcaagacauuacuugagaauccuaaaaauauaaaauuacgucuaugacaaguccaaugaaggagaaggacaagacacuugauugaggaggacauuuauugcuagucaggggggacaaggaaagcugacccaaggaaaugaugauucagcugaguugauagaggagugaaauagucauaguaggaaaguggaguggugggaguugggaggaaaguacuguauuugaagaaccacguguucaaguucugcagcagaagggccaaugaaguacuugaguguugucaaaggcaaucaagguaacuggaagagagaacacgagggcgugaggguauguuaucaggaugaccuugauguucacaauuaagaaaguugcucuaauccugacaucaauaggaagacugaaguaucugaaggagggaguuugcaugucuguucacaaagaccucuuaagcaauacacuguacacuauuaauaugccagugguucuuggggcgcugucuccaaccugugguugucucacuacuguauacucuacuccuuccccagugugugcuaucugugugauuugugugggaucacuacaucccugguggacuacugugacuggacuaaaacaaucaagguaauccuaucccucucaucacggugauuaauucgggucauccaggccuaagcaaauccaugcaugguauuuuuuggcuuuagggauuguuccaugauggucccaaucaggacaaaguucagcaggaauuuugcucuuuuauagacugaacuugcugccauugaaagucaaugaggaagcaaguagaucuggaauccuaugaccaugagagaagccugcuuuagggugaaguugacauggaagugucagaggugagggguacaaagaaccauuuuguccuugcuaauauaguagauccacuguaucucagauugcaccugauaccuguugaaguuuucaggcuuuucucaccccuaggcccuucuccaauccugaugcuagcuguugacaacagucauuauuaaauaaauaucagaaaccucaucugaauucaaggaaucucccagcucuuucuaaacccauacuugcucauuguaacuguagcucaggccaagauggaauagacuaccuuggugaggacagguguaugaagaaucacugauuuaaagauuguucauaacguaucgcagucauuaggcauaagucuauuucuugagacauuguaagggauuauucuuggaaggacauagguccaaaauguugaauuggacgucuaggagucagggugguaaaaaugaaguauauauugauuaaguggagaguuacaugaguagagaagcaaaaugaagccgaguagaaaauuaaagguuuugggaggaguacugccugaauuuagauguuuuuaaaguacagcuuucugucuucaugggaauaucuuuucgauauacugagaaaaagaaauccagguguucuucacuuuuguaagcauccugguuuuucgugcagggagcacagacaacaggauuucuugccaaucaguuaccauugugaggccugauuuuucaucuguaaaaugaggauaauacagucuaccugaguaauggcugugaaaguuaaaugaagcaauuugaguacaaauaccucacaaugaaugauuguuuucauugauguggugguaaauguuuaauaaccucuuuuucaaagaauaaaagccguuauuggucauuuuugccaauuuccaugguguaaauacuuccaacauugugccaguuccgaguuaccaguguguuacaaaauugaaauggaguuagagaaauacacauauaaugccggagagcucaccaggaugccacugcuuucuuuccuucuuuccaaauuacauacaucccagauuuuuuuuuuuuuuuuuuuuuuuuuugagauggagucuugcucuguugcccagguuggagugcaguggcacagucuuggcucacugcagccuccgccuuccauguucaagugauucuccugccucagccucccaaguagcuaggauuacaggugccugccaccacgcccagcaauuuuuuguauuuuuaguagagacagaguuuuaccauauugccuaggcuggucucaaacuccuggccucaagugauacacccuccucagccucccgaaguguugggauuacaggcgugagccacugcacccggcccauaagccaccacgccuggccuaugccagauuuuguacaaaguaaaaucaauccuugucccccaccacugugauacuaggguuuguuugauuuuagugacaucuguauuaggguugacacagaauuaauaacugaaucaauaaagagaccgggaacagggccacgccuuacacaaggugacaugaaaaauguugagguguagcaguuuauucccuuagguuaaucaugaaccuuucuguuaggccccuuugaaauuuaguaucacucuguccuaaaucaccaguaccuugcaaguguugauucuagcccauauaacucaccuuucucaaaaauucugcuauguuuguuuuaguaaccaaauacuguauuuuauuuucguaagauuuucuucccaaucuagauuauauauuucagagagaaagcguccuauuuuauguacauuuuguauccuuuuggugucaaauaucaugcuaugaccauaacaguaaguguaauacacauaauauccuccccccgcccccccgcuuuuuuuuuuuuuuuuuuuuggaguuccuacuguguuccagguuccaugguaacauuuuccuuguuaucuguaaucaucacaacaguacuggaggguaaauacggucauucccauuuuacagaugaggauacauucaaugugagauguuaaagauguucuucagaauuucccagguagcaggcagcucaugguauucaaaagguaaugguuaagagaaagaauggauaaugaauaucuugugucuauuuucuugagacagacgagacugagcagccugagaacauuuggugcucagagggaggaaaugcuaagaggggaaaacaagucugaaagggaaagaaggauaguucaaagaccaguuuccccugcuucagaauucugacuggugccagcucuaacugcguauguuugcuuuacuuggaagauagaaucauagugccagaauucacggaagucuguuuuggaagaugcauuagucaggguaugcuaauugcuggaacaaacaauccccaaacuucaguagcuuaacacugcagaggguuauuacccuccggugucacagagcaacgugggugggcucugguccuagccuggcuucuuccauggcucaggucugcuauccccuaggaccuuggaguucacuagauauuggcaucaggcugaucaaagaggaaaaggagaguggugcauagacgauuacaugggaaauuuuaagggccaggucuggacaaggcaaguauuacuucugcucacauuuuauuggccaaauccuagucauaugaucccaugacugcaaaggaagauggggaauuucagauuccuagguggucacgggcagaaagagauggggauuggugaaaacauagccuggcuuuagccacagaggguuacaccagaggccugcaaguuuggugaccacuaguuuucagagguauuggguauuugauaaaauccagugucuuccagagguugagcaugagccacauauaaauaacuuucccagugacgggccaucagcaguccaaugaagacauugggucuucaugucuucauuggacugcugauggccugucauuggggaaguuauuuaccuucucugaggagaaaauaauaacuugcauuucagagugguuugggacacuaaaggaaaucagaagauggaacugauuuguuaacuagaaauggacauaaguauugguuacagguuuaaaaugaaacuugcaauguuugaggaagaaagggaaaauguuaaugcaaaaacaaaaaagguaaagaaauggugggaaguagauuauuggcacuuuuucuuuggaaacccauugccauauuucauguaauuaaacuucauuccuuuuaaugaaacaauucuucuaaauaauacagagauuucccaccaauauaauauuuaacauuuauaauuuucaccuuaaaguuugaacauuuuuaauuuuaaaacuguuuguugcaguuuaaaucuccuuaugccacagaacuguggacuuucucugguugcaaaauucuuuacagugucuugaauugaaaagggcuuaaguaaaaaaagcugggggaagugggggccuuuuacaaacaaauuacaacucauuugguacaauaaggauaauucauuuugucuuguuuugcauggcuguauauuguuuugaauucauucugcauuucggaagcuugcaguauuucuuuucuguagguuucuuacuuguaacugcagauuucgcgguuucuuuuguguaccacuugccucccagaauuuggcccaacaguuuugaguagcugaacaauuuaucggggacagaucagcugaaauguggcucaacuugaguaaagcagaaggaaugacauaagguuaggugacugaugugugaguuuuugaauuugauuugguuuuacauggaaagguugaagcaaugauccauguauucuaauaaaaaucaucaguacaaaucaaauaaaaucuggcuuaguggcuauuuucccacuguaucacucauggcuagccugugcuguuacagaccacauuuggcaggcacggcuuuuuccuacaacaaaucuuaaaguaacauugcaaucuuugcuguguuaaaaaggcaucuuuucuaaucaaacugucugcuaaucucaucagauaaaucauuauucucuacugacagcuccggcuuucccggaaccccuucccugcuucuuguuuucucucaagaugucugguuaucgucauucuucaggucuuugccucuaucuccuuucacacuaaugacauaucuuccauuccugaggaagaguuacagcuuuuuaccauuccacuuacugaauugguaagaccaguaccucagagcagcucaucucuuucugaccgguauuccacuaguuaucagaugggcaaaaggcaggaugcauccaaguugcagaccuacuagaaccaaaaaugccuauucccaggaauuugaugugauuaaaccuaagaaaucaucaguugaugcguucucaucucuuucagcuggacuaguaaaguaaggcagauguauuuucacuacuucaguagugaacauguuuuauagaaccugaaagugaaaguaagggaagcagcaugguuuagaggaaaccuugguccauuuuuccgucauagaccuguccugcuagcaaaguccugggcguuucuuaaacugauggcaacugcgugugcccugguggugaaaugguguugcaguaugccugggcacugcccugugaaaaaggacacacagaggggagacucacaguuuuguuuucauugcugacaugguuuaaaaauguacguugcuagcugugaaaacucagucauuauaacaccguacaccuuucuucuuucagcaaguauuccuugugaacauuagcaaguauucuauucucuguuagaauuaaacagguaaucguaauagcaugaaagggugaaaguaugucuuaugcaaaauagccucuuuuauauagggcaucuaccaauuuucuugugauuuuuguuuuuuccucuuuugaaaaaugauuuuagucugcucguguuuagguagguaacuucucuugaucccaauuuuauacuuuaaaugaucccagauauugcauuuuaaaugagaugaguauauaaaaaauaggaagcagaaagcauaauuaaaaauugugguuacauuaucgugagaccaaaugaccagucagacuccucugaccaauuucauagaaaauaaggagguaucauuugaacaaguuguaacauaugggaacuguuuuaaacaccaucauugauaucaagaaacuauuaggaaaugcaaguuuguguaucguguguguguguaugcugauuuuacacacacaggcacaugcacacacaugcacacacacauuuauaagcccaaguaagagaaaccuuugccaaugucugccaggcauuuggcugaaguggaauugugaggaacauuuucucagccuuuauaaaucacaguugaaauaugucagcacuguucaguuuauaaaaugacaagggcuguaggcugggcaugguggcucacgccuauaaucccagcauuuugggaggcugaggugggaggauugccugagcccaggagucggagaucaaccugagcaacauagugagacccugucucuacaaaaaauucacugggugugguggugugugccuguggucccagcuacucaggagggugaggugggaggauugcuugagucugggagguugagguugcagcgagcccugaucgcaccacugcacuacauauacccuagaugaagagcaggaccccaucucaaaaaaaaacaaaaacaaaaaacaaaaaacaaaaaaacaacgagggcuucaucuaaagguuaaagggacuguuucuaccuuauauugauuauaacaaguuaacucacucaauauuguaugguaugcuuaugcuguauugaauggcaaaguuccucucacagucuuuuuuggggucacccuucacucuucacuuugugagguggcuaguucauuuguauaccugcucucuaaaugugggaauauauucuuuuaaaaguggcaacucaacuuaucucccccuucuaaaauauuuuagauguuuccaauuuuuuuuuuuguacgucagcccauggaaaccacacuaaauuuuucugugucaugaguaugcuugucucugcauuugaauuuaauugggaagugccucugaaauggcaggucuccuuuuuacacagugguuuacagaauguggugggaggaggcaccaaauagccuguuaggauagcauggcuccaaaacugauucuuuaacuugccuuuauacauugcauuaauucacaaguggaucaguccaucuugucuucaucuuggccaaauuccuucaaaauuaauaguaaaauaugccuaaauauauucuuguuccugcccuccccacucccaccuaggucacagggcuacaacuaaucauugucuccauugaaaugucacuagaugaucaacgauugaagaauauuucuuaccaauucaaauagaacagaaacuucagucaaguuuagcauuuauugcccuacauuucugcggcugucaaaaccaguugaucagagacgugaagauauguaaggaaauaggaagcugugauggguuaucgcuugucuaagagugguacaagugagacuugagggcauuaucacuuuuuaccuuauacauuuuuguauuuuaauuuuuuucaauaagcacauacuuaaaaauuaguuugaauguucuuaacgaaucuuuccauagguuacugauuaguucaacagggacaaauuauaaucauacauugcagaauuugcaugccacuuugaccaggugaucaaaauuggcauagcacaugaggggcagaccaacaugccaucaaggggcucuggaagugauguccugggaaggacaccagaccacuauuguaguauuauauccacuggaauauaaucaugaggaagcaucugauccucccaaauugagaaacauuuccauaaaauaacuggccuguauucuuccaaaauucuaauaucacagaaggaaaaggcugaggaauuaugucugauucaaauggauaaaagagauagacaauucagugcagugcaugauccuggacuuugucuucuaccggagagggaggaaguucccuauuggaauauggauuauggauuggaucuaaguacccacaguauauuuucugauuuugauaauaguacuguuuuuguucuuaggaagugcacacagaaguacuaaggugcaaaaggauauaauugaugcaacuuacacaugguucagaagcaacauauuauauaauuauaacugcacuguaauugaaaacuuuuaaaauuagccugguguggcagucccagcuacuugggaggcugaauugggaggaucuccuaagccuaggagguugcggcuguggugagcuguguuugugccacuggacuccagccugugugacagaacgagacccugucucaaaaacaaacaaacaaaacaaacaaaaaccccaaaacuuaaaaaaaauaaaaauguaaaauaugggaagaaugaaaaaauuauacauuuuccuugacuucaacccuugaucuuuucuugaucaguucccaggugggguuaggauaucuguguuuuuuaugagguuccuuggaguauuuggguggucagccaccauuuggagaucaccauguagugccuagauuauaaauuauccuuuuagaaagaguugcuggaaucauuucaagauuggucagguaccaauaaauaaguaauagaaacacccucaaaauuggaauugaaagaguggaaauuuauuuuauuuaguuuggggauaugaacaugguauaauauugucgcauuuuuucuggaguuuagaugaauaagagcagccuacaguugaccggaugacuuaauauuuuuuucguaccacaaaaauuaaaugcuuuacuaaaacuuucauucucuuacaauucugaugaacaagguuguacuguaugguuaaguaucacacuguaaauuuaggcaauacauguccuauugagcccauggaguaaaauagauuuucccgugauccaagcuauuacaauuucagauguguaaaguauuucaaauucauuuuaauagacugcuucccuucaaauacauguggagguagauuuauacaacuguaaacaguuuaugcauuuuuacagauuuucauuauauguguuugauacuaauuuaccucuuuuuaauuguaggagagauaaagaauuaguaguuuaaaacaguaggaacugcguguucugcugugaucaaggaauuagauaaucuggcuuguuugcuuaaggggucuguaucuugagacuuuuauagggcaguauuaaagcucugagccuccuuauuaugccaguacccagaagauugcuuuaaugagaaguaaagggccuuuuuccaauuacaagggaauaacugcauuaaguuccuguguuaugucaaccugcuuugauuugauuacuaugaaagaaauggauuuaucugucaguguuacuuaauuaagccuucucauugauguuuugcagaguaauauagugugguuugcacauuugagccuaaguacagagaaaauuggccuaaaacuaagacaugaccccugaagauaacaugcaagauugaucauuugucauugccaggucauaggcugcaguguuaaacauagguggaaggauugccauguugaaaggguaaaaugaaaaucaguuuaugggagugaguauuuuaagcaaaagggguugugguggaaaacuggauuuuagggaggaguuuugaauauguaaaacuauugacuucaccaauauuagucaagcaucuggaauaggaaaugacaauaaaacaaacaggagaaguagauuuuguuaaaguauaaaaggaaauagaagaaaaaggagaaagcaagaggaaagaaugccguuugggagaaguagaccauugugguuaggcagagcaauuacagccuacagauauuucaauuaagccagccuccccuucucagaaccucacaaauggcacccucgggagaaaagagguaucaggaaagaaaagaagaaaagaggaaacaguuccauguuucauguuggcuaaccucucccaagaauaaauucaauaaauuauuuaccaaauaggcauuuuaaauaccaguuuguauaucugaagucauuacaauauuauggauuuugcacuauaaauauuacauguaugguuugaaaaauacacacguaauuacauguagacauuaucagagguauauauucaguuuuauuaggaaaugaagcauauucuuaaauguauuccuuaguuguuuaacacuuuguuuucuaaaguaucuaccuuuuauuucuugcacucugugauauaucuuuagaaggugauaugucuuuaggaggugccaaacaccuacuuaaaaacuuccuugcaauauuuucacauuuauuuaaguacuuugaaacuuaucuguguaauguugaaguuagaugguacuuugauuuuuuuuucaaagucuucagauaugguaacuuacuuccaauuguuauucucacgcaauucacaauguuuacucuccaagaaaacugucuuaguuaagacugauuuuuaagugcuuuuagauuggucacauuucgaaaagucaaagaagguauauauaguucacguuauacucuugcuugaguuauucauggcucuuauuuguaggauauugcuuuaaaagguaggauccccaaacgacuaacuucucuucaagaggaagaccccagcuagccagucccauacacuugaaagguugcuaaauggcacucaucucucagcauuucacauuauauauucaagcuaggguauaauucaaguuagaugaucguugacaccuccaaauauauaaauuaauauaaaggcuucaauguacguuugguucaguugcauaauguaacuguuuaccaccuugagcuucaaaaagauuucugaguuucaauauaaggaacaccacugacauauuuguaacauaacaguuacccacuucauuuuguuacuuucucauuaucugaauuuuauguuauaggaagaugcuuucccuguuuaugacagcacacaauggaauuaacuccauaucuuaagcagcagaaauguaguguucauuuuugaaaaacagguuauuuugaacuuaaggaaaauaauacuguuuuaaaggacuuauuaauggaaguuuaaguuggauguuaauuaaggcuaaaauauugcaguaauugucugcgaacacuuuuuuccuacuauacuuucucaccagcauaucuacccuuuaacuuuucuuaucauaugaaaaauacucuaagaugaucucaugcuugaccuuugaguuucagauuuauuugguuaggaaauccauuagcucugagaaagccaggguugacagcagucaucugaaaauggaaagcccaggucuguauucuuuauauuugacuuaucuuuuuuuuuuuuuuuugagacagagucuugcucagucaccgaggcuggagugcaguggcacaaucuuggaucacugcagccuccaucuucuggguucaugugauucuagugccucagccucuugaguagcugggacuacaagugugcaccaccaugcccagcuaauuuuuguguuuuuaguagagauggguuuuaccauguugcccaggcugaucucgaacucuuggccucacuuuuucuagucugauaguuuugauugcuguccacauaagcaaaguagagcuuugaguaaucaaaucauaauccaccugccucggcuucccaaagugcugggauuauaggcgugagccaucgcaccuggccugacacaucuuaacauuugugugggaagcauugacacaacccucauccuuugcuuagucagauuugggaagugcuggaagcuucuugucgaguuucuuguuagugcccagaucacucauucugaagcaccauuucuuaugucuaauagaaaacagaaacaaucaugcuuguguggacaucaucugucaauauuugaaucuccucaacucuuccuaugucuguaauaguacucaaauuugacuucaaauuacucuacuuagagcucuuauuauacugggugcuaaugaaaaugugcacauccuuaacacgcucuuugcugaugaaauauuuugaacucuaaauucaucuggcacugacggagagcauaugccaucucaguuugugugagggcucagccaaggguucuuccuggacuaggaaauuaguaggagccacagauguacgcagucugugagucuccauaaugguguagaggauauuuaauagugucuguuguugcaggaagaagguuuugaggcaguguagacuucauuguguuucagaaugauuaucuuuccuggaagaacuugacauccuaucucugaacgcauucugaauguguugaaauuuuuauuaagaaaucaauauauuuccacaagagcaggaaucuguagacuuagagcaaugcaaaauaccauuucaggcauuuuucuaauuucauaaaacucuaggguccugggugauuggcauguuguaggcucagaguauagaaaggacaacuacacagcucuacgucaaaucaaucuagguaacuuucauacuuguuuauuucaaaucaagcugaaaguuacaugguauuuagucuguguucuuagcuugggacucugaucagcauacauaacuucugacaacaugucauuuguguauuacacauagaaguacacugagauauaaagagaauacucuaaugguaaacuaagccacugaauaaaucuaaugcuuacugaauucuuacucugauaguguuauacagggucacggagaagguaggauuguuuaaccuaaacguuuuggguguuucuaagauccaggagaguauuuaaaaaucacugaccuguuuagcagaacaaggagucauaaaaauguaaggcucagauuuucuuagauauuggaggguauuauuaaauuaggcacucaugauaaauacuggugacuaugguagauauuuacuacggaucaaguacuuuccuaaguguuuaacaaauguuaguuaauucauuuacuuuaacaauaacuccuuaaucuugcaaauacuaucauccccuuaucuucuguuagaauacugacuuugggguaugucuuggguuuucacuucuguucuccuugacucaagaggccauuacauuuucaaggcugacagauguccccagggcaaaaaauguguuuucuucuucccuggguuccagccuucacuuugauuuuggcucccugauuccuuguuaucuugucugcucaguauuuuaaaauuuuucaaaaaacuguuauccaucauuuuuaguuuucugugggagaguuguccaaauauacuagccugcccuauuuccaagaauggaaaucaaacuugcuuauuucguaguucacaaaaaugaguacggagaggccagugacuugcucagaccagagaacuggucacugcagagucccugcugaaauccagcucuuuaucccaacucccagugcuguguuuucuaaaguuugucuagucugucugauaguuuugaucuugcugaccacaagagcaaaguggagcuuugaguaaucggauuacaaguguaaugaauguggaugggaaaucgcagaagguaagaauuaugucugaacaucuuuccccuaaauagaguguuuggucauaguucugcccaaacuguuguguuuuggcacugaucugucaaauacuuuauuuauuauuuuuuuuuuugagacagucucgcucugucacccaggcuggaguacaguggcucgaucuuggcucgcggcaaccuccaccuccuggguucaagcaguucuccugccucagccuccugaguagcugggauuacaggcguccaccaccaggcccagcuaauuuuuguauguucaguagagauggggucucaccauuuuggccaggcuggcuucaaacuccugaccucagcugaucugcccgccucggcaucucaaagugcugggauuacaggcaugagccauugcacccgaccaaugugucagacacuguagaggggacucaugcagaaugaaucaaauaagaugaaaauuuguggauuuucagauugccuccuaaagcagccagcaaucccauggaagaguuacuaaaucuaucuugguuuaggguaaaauaagaaauuagaaaaaucuugaacugagcccauuucagucuuuuggaacaggaauuucuaucaucuacuugcuuucuuccuuucuuuuugcccgggguaauaucuuucucuuuauucucccaucuuggaaaaaggguggcaauagaacaaggggggggggggcgagaacuaaauagauucagcagcuucaucccaggcaguuuuucauuugucacuauguugccuuaauggauuucacacaucuauuuccuguauauuguuuagucucaccucuagauguaaacacuucucauaccacaauauuaucuuacuuuucacuuucugcuguuuuaacucauuucaauaaagaacuaaugagcccaccauuguacaguaccacacaagauguuauuugugucaaguauguuucuuuccuauaauaaacguacaucacaguuggguaugauauaaguauauagcucuauagcuguauauauauucacaugguuauuuggauaauaaauucuguguacuugcugaacuaucguauugagccagccauacaaguuuuaucauugugccuacuguugauacuaugggcugcuaugggauauucuguccucuguguugggagcucacagauauuuucugucuggcuuaauaccaggauuagguaugcuucuccuggacacuuuguguguuuuuaucugaugguuauugucaaucuuguuucccucucugcuuugucuacuuaauagcuucuaaaguuuugacccacuucuagcaaauagccaguccuucacugugugcauuuugauaaacucaucauaccucuggccuuacuguucugcuacuuuuauuuugcagucacuuggguccuucaaauauugauuucguauauuuuguguuguauguguuucuguaaucuuuuguggacacaagaguuggguauaaacucccaaauaaauauauucacucugcguggggagaagugacaggagggaacguucagcugguuagacagagaugugacauucuuacuggggagucuuuacagcagugggcagagcuucagccuccuuuuguguccaagcucugccauuuccugaucccuugggcaaguuuucuaacccaucugagccucaguucagauauauaaaaccagaauacuaguaaggcauuugagaguuuagcgcagugucugacauacauucaagcucaccacaugugagcuguuacucuuucuuugagaggugaggaacaguuuaggcagaaggaauagcaguuacaaaaacauggugguauaaaagaccgugcaguguccugguacccuagcaggaguaaggaauggccagguguaggcccugugcaagguuuacaugaaaaugagucuggacaagaacuucuuggaugcucaugugauggagguguauagugaaugcugcugaaaccagcaacccagacagcaauuuuaagauauggagugagagaggcugcuguuggugguguggggcaugcauuugucuuguguuacaguggaguaguccugugguucucaaacuccugugugcauaaaaguuaccuggggaccuguuaaaaacaguuuucucagccccacccccagaguuucagacugaguagauaugagacggacccuaauaagccaauuuaaaaaugggcauacaggugauucagguggcggauacacuuugaaaugcacuugguggugcacuggaauaguuauugaggaaaugcuaacuaaggggcaggccugacaaaguucaaggagagggaagauggaagaaaaugacuucaaaguaacauguuuacauucauuaugaauuaccauugcgcaugcuauggaaacacuaguuuauagugucuucuauggauauggauaaaugagcaccgguccuauagauuuuuuucaaagguaaaauauaauuagaauucauaugauuauucuauuuauuagguuugggagagcuagugauuuguccucauccuugagauccagcaggagaccaagggaaggggaagccuguucaacagagagcaaucaaagaaagaaaggugcagcagcgugaggucaggaagugggaaagauggaaaugggaaaggguggaaaaagagcagucagauccgauuggucaggaaucuauuugugaaggaacccagccaguauuuaaccugcuuugaaaaagcuagacuuccagcauuuuuaauuaguggauugcucgcuuuugaaauugcccaguugggaauacucaaguguugauguguuuuaucugccugcuaauuagcaggcugcuugguugaccauuacuuuuccuuuuuucuguggacagaagauguauaugaaggucucuugguacauuccagcucaagucuagcuuaaagugcauaagaaaaacuguguauuuaauaagaguucuuacuaaauuauaaaucaaauuuuaauacaucuuuucuccaacuugauuccuuuugcucuagcacagggcuucucaaucucaacacaauuuuuauuuggggucagaacaccaaaaauauauauauauauuuuuagggacagggucucacucaguugccuagguuggagugcaguggcacaaucguaguucacuguaaccuugaacuccugggcucaagggaucuuccugccucggccccuccaauuagcuaggacuacaggcaaguuccaccacacuuggcuaauuuuaaaaauuuuuguagcgacagaaucuugccguguuucccaggcuggucucaaacuccuggccucaagcaauccuucugcuucagccucccaacgugcugguaucacaggugugagcugcugugcccugcacaggguauuucuuacuguggagagcuguuuugugcaauuaugagauauuuaauagcaacucuuggccucugugugaucaaugccacuagcaacacccaaauugugacaaccaaaacugucuccuggguggcuuugccaaauguccuuugggaugcaaaagccccacugaccuggcaguagcguccucuuuccuccaagucucugccuacuuuucauguuuaaaauccucuuuuaaaauugaaaagauaaaaugaguccaaacaauuugaaaucuuaugguacuuauagggauucaaaucuguuccuccauuacuuuuuggccaaauucaagaggagaaaucucucaaaugaauccaagcuggcuguuauaggugaaaagaaagucaagaugcgccagacuuuuaaaagcuugcagugguugagagauuuuguuauuuauacacuuuuuauuuuggcugaaaauauuugguuuuuguuuaagaauuaagagaaccguguaggcuacaaaauuuauuuaugugcgaaucccagaggguuguaaguagcuucuuugugugcuucaguucaacauauacaggauaggccagcauguuggauuguuaaacagcagaucuggggaagguuuuacaccuuuucucuaggcuuggugcagucccgagagcuuucuugacaugccuugaagcucacagugcacugauuuaaacuguccauaggggacaucuguuugcaguuuguguuaucugcugaagcaccaacuaaaaggaagugaaauaauauuugucauuaaaaaaaaaaagagaaguuaauuuaaugguaauaacuuaguuguuguugcuuuucuaucucuuaagauauucugaaacaccauguacucuacuguaucccaaaauaaauaaauuaauuauacuaugauuacuucugcugauaauaaaauagcaguaauaauaaaaggaaugacaguagagcauuaagagaauaaacaguaucacugaaaugugaggaaacacaauaaaugggauugugucuccugaaccuuaguuucacacuuccuccuccacuucugucagaggguguuugugauggccgucuguuaucagccgugaucaaaauaauauaacagugaaacuuuuuauacuuaugaaggcccuuucaucaaaaaucucacagccauuucuaaauauagagcaacugaucuuuaaaacacuuuuauguuuuaagcaauuaauaugguaacuuagcuguuagacuuuccauccugcguauuugccauuuggagcguggauggaacauuucguaaucuacucagcauuaaaacuuugcugguauugaguuuagaauuccaacuuuucgaugguucauguaggucuuuucacugucaucuaucaaaacaaaacauugcuuuauaauggaauaaccacauucauuuccacauaucaaaacccagauuaaggauuauagaccaaaugguaugucuaguuuaaaaaaaaaaggaaagacagagacaguauugucuuaaccuaaaaaaaaguuuuguuucaguccuaauaucccuguaaugugcugguggaaauagacuacugaauacuuucucagucucauuuucuguugcaugucuggugucuucugugauaagccugggcuauggaacaaaaaggauccaagagcauuauggcgaggaugcuaaagguguuaguguggauauuuaccuuaauuuaacuuuuuuugcauuaaaguuauguuagugcauuuuuaaacuuauuuuauccaaaagauuguaauaaaacuuuaaguacaguuucacaucuauaaagacugaggcuaucaaacacugugaaggauggaaguaauuuuuauguuuauaccucugguuccugaggguccaguucauuucuacugugaauuuaaaugaguuaauuuaaguagaugggucagaagccacuaucaucaugguagcccggugccugguucuuaauuaaaggcaacaggagauuaauuugaaacauuaauuugaaagugcauauacaaaaagaaaaaauuacugcaagaaagccuaaagaacuuuucucuugucccuagauguagaagacagaaguagcucaggguccugggggaauggaggacauccaagcccguccaggguaaguauaucuaaucuuuucucccacaaccagacaucccacauauguaaauugacaaacagaagguguguuucucucucucucucucucucucucucacacacacacacacacacacacacacacagaggcaugggcaugcacacgcacacaaacacacacgcauauaugugcauacuaaguuuaaugaggaucagcuugacuuuggaauuuuuuucccccauucucuuauuggaugcuguuauucaauuugacaccuguuccacuucugcuaaccagaagaaaauuccuucguuacauguuuggucuuucuuuugucaguuauugauccauauuacauaaugcuguuuguuguagauggaaaaacuuaaaaaaauuccuaauaucccuauaagguauuggugugaauagacuacugaauaaucccaaagauacacuaugaaguucuauccuaccaguauaaucuacguacugaaucugaguugauuucgcuauguagacauguuaucauuccaccaguagggacuuugaucacuagauggaucauucauuuauuugcccucaacuuuuugcuauucuucuccacaguuuuccuacaugcauugguuguuucuuggggaagacccaaggaauauaauguaauaggaauguaauaggaagaccauggaauaagaguugggugggugguuaagcaauacguguuucuuguauguauaugaucuugggcaugucauuucaccucuuggguccucauuuucuuauuuugcaaaaugaggaaguagauccagaggaucaucuguguuucuuccaguuuaaauauucaugauuuuguaugaaauuucuuuaacugaaucauugcuaggcccucuaaaauccaugucaguuuuuaugauguacauacaaugccccagauuaaaaguacacuucguguacaugguaaaaccagcaugucuuccuuucccaaccagcuauauauauauagaugaagcauucugcagggaggguaacauuuuacuguaaguguucacacaaauuuggguugggggaagguuccauuuuggcauaagaggcagggaagguaaucaagcugucaaaaugagggcauuucagcaagucagagcuagacauuuccaccuguccuuggcauugugauccuuagucuaguguucaggguacagcaggaucucuaagcuuaccaguaacuuugugagcccuuacaccagcugucgagcuugacauucuaaugcuuuauauggauggguugaggaaaucuuuccuccuccucauguuacagucugcacuugcagaaauaaauccauuccccuugacagcaaguggagaucauagaacuccccucaauuguuuaguucauccagauuuucacaauuucuuaugauuuauccauucaguacacaugguacuuuuaauuguguuucagaaaacaaggucuguuuagaaucaucuuaauuuaggauuaaaacuaacuagcuuuugguuuuuguuagcuguccugccauuuuucucaaggaauauauuggugaauaauuucaaaccaauuuuguguaauuuauauuuucuaaauccagaaguuugcaugagacaaaucauuuguggcagauuuauacccaggcguacuuucaaggucucucuuuuuucaucuuaacauggggauagugucuaccuuacagcacugugcugaggauuaaauuagauaauauauauuaagcuuuuaguacacuaucuaggaugaggacacuuaauaagugauaauuagcauuaugcaaugccugguauagagugagugaguguacuaugauggguauuuaaaauguagccucuuuuuauagauggacauguuggcagaauuagauuacaguaucaggcaaguuaauuguuauacacgaggaaaggugauugagaacgggguaguuuuccuuaagguugaggggaugugucuuuuccuuguucaugcagcagcccucucuuuugugugggcagauuuugcccuuuggcucacaugcaaccgauaccucugaguaaauuugacuuagacuuucaugggcaguuccaccagcugagcagaaugacuuuuuccccccuuuuuggucacuuuaugcacuuuaguagacugaaaguugaaccauguaguauagaugauuuuaacucuuuccuauugcguuaucaaauuuccccauuaaaauuaaguaacuggacagcuuaagaacauuguuuuaauuuuaaauuccccuuaaaacaauaagcugauuguaauaaugaaauauuucugucaaaauuugucugccuuacaacugguuguuuuuugugacaugcuuuguccaacuccagaaaugcuaauuuaugcuaauguuuugauguucauauccuaguuaaacccuaauauucuuaacuuucuuauguguuaauuacuuaugugacaaucuaguucucuuacaaccacaauaccacaauaguaacuauaauaaaacauugaaacuucaguauccuaacaccaaauguuauuguuugaauggcucuaucuuggucuuugaaaagcaauucauugcaugcuaugccuaauuuucccuuguggcacaauuuugcuuuaauguggccuuauuaaaauaauaauuuuuaacauaagcaauauacuuuguaugugucuggugucuuacauacacuauuuuauuuaaucaugucaacaacuccaugcaguugauaccauuauuauuauuccuaagauuucucagcuauuaugaggaaaauuuggacuucguagacucuagagcuuucuuuuagccacuauaccugugaaagugcagauuccuucuagugaaguuccagggagggaauaguggacuccaauuucuuuggaggggagaaguuuugguaguggagcuauguuuguuuaugugcuguuuauuaauauaaaauaauaacuuacacugucauuuuauuuacagaacuauggagaugggacucccuaugaccacaugaccagcagggaccuugggucacaugacaaucucucuccaccuuuugucaauuccagaauacaaaguaagacccauuuuaaauuaacuuacacuuuuugaaugcucaaguuuuacuauagaagguaaaaccauguccuagacagagguucugcuuuuagaaacuuggauauuuagucaguucacuuguaauaaucuuaaauugcagagaggauuggcagucuguguuugguaauagugcauuaaggauuaaguuuuacaagcauauggaaugaaaugcuuuuagugauacugaaucuauguggaaauuuuguuuuccuuagaccuaaagcacggaccacaguuucaauguuguaucaguaguuuccuaaguuaagguagaugaagucaaaguggugaauauuuagaauaaaaauaucacugggcuuguugguuggcagugauauauagucaguguuaacugugauuucugcuaaagggguuaugaaaauaaaugguguuaaugggcuuagugugcuuaaaucagaguagugcauucaaguugaauuguaaaaucugauuguauauuuaucaaggcaugaacuuuagugcuaauggccuaggcagaccccauccugcuuuauuaaagcaaguuaccuguuaguuugaggcugucugugaaucuccggcaugccauucauccuggcauccucagcauguuuuucugcuuuuggcuacccuguagggauguuuguuuaacagcaguaacuugagcaaugaaaagaugauuccuaauggcuuaaaaggucccaauagcuggcuacuuuaguuuugauugaaaaaaaaaaagaucuuuguucuaguaaacaugaguucuuaacaauauuaguaaaucucucaaccuggccaaauucucuugagaaucugucaauaagugaaguuaaauuucuugguacaaucuguuggacaacacuccaaggaaacacacacagcgaugauuauauuuuucugagaccauaacugcaaaugcuucuaaagaaugucaugauuuuaagcuuuggaagcuauaccaguuacuucagguccuugaaucucaggcauucuuugaaaaaucaccaucaaauccaucuaaauggauuucagauauuuaacacaaaauagucaaagcagauaaauacuagcaacuuauuuuuaauggguaacaucauauguucgugccuuugaguaucuuaccaacuuugagaaccacaaaguugguuuuggucauagaauguucuuauuuuugugcuauuuuugccuucaaaguaguaaauuucauauuuacguuuuaacauuguaacucaagcaggaaucccaguucuuuaucaguuguugauagaaaggugcauuguuucuuguucucaggauauguagauacaggugaccagauauauuuaucaacuuagauuuuaaaaggcagcuuuugacucuucagugucaauaguuaugauuuuauuucuaacacccuugcuucucuauucaucuccacacaaccacuuagaauaaaagauucacuugaaaauguagucuugagaaguagcaccuaaauaauauacuaacuuccuuggauccuaaaaugauccuccaaugagcuacaguaagaaaaauagaauaaauaaauacucauagggagacgcuuauguuaucuaugugaaaaaaguuuuaacucuaaagaacaacuugauaaauuaauauuacagaauacaccaagcaguacaaacagauuaaaugauuguucuguucauguuuccucaugggcaacugcuuuacaaaucaaauuaguuuuucaacccaaauaguauuuaaaauauaaguggccugacagucuagagcggagagagcugauucuuuucacuuaguuguuguuuaggcugcaaauccaugucagcuuugcucuuuuauccugucugcccuccuucccauuaaacucuuaaauauggagaccaagacagucuccugcauugugauaggaaaugcuacuauguccacgaggcccccacccacuguucccagugaaaggacuucucuguuagauaagcugucugguuugaaacauggcucuuuauuguuuacaaacugcuacauuuuccaccucgagcagauuuuugcacagaaaagaauugugcuugggcuaaaugguuuaucugacauuaacggcgcagugucagacuggggucagggaagucacccucagagcgagaggguauugcgcgguaugcaaaaaaaauggaaaagggagaaaaagacauugaaacaaguaugaaauaccuuacauuuuuaguuuagagaagaauaauuuuuuuaagagaauugacucuuaugcugcauuaaaaacuucccaucgcuauaauuucucacacacccgaugccuucuugauuggcuugcguaucugaaggcuagauucggggaacaaagauucucauugauuuugcccaagcugcuguuuauuuaaaaugaaaccacuuuucagaugagccauauuugguguuauguuacagcuuuacaaagaaaagauagaucauuuucaagaaauuaacgacaauuaauuuacaaaugauaauaaaaacaaaguaagaucuauugguguaggggacaguuugaacucauagcauauaugcuguguucuaaaccgcacuuuguguccagacccagagcccauguugugaccuuuguggauauuuuccuucuaccaaaagaagguaguagacuuuagcauaaguguuugacaacacuccagucuccacuuucagaauguuuaacugguuuuuguuaaaacuacaaaguauuuguuucugucucaaaggcuuaauucugcugugaugucgcaucaggguaaaagcuauagcaucagaaauaaaucagccacuuuauuggagcagauucucuauugucaaaucaaucaagccugugacugaauuaggcgucugcuacagaaauaagugacacuaauuuuauaggaaagaguuauuaacugcagaugaccugauuuuuuuuuuuccuuuuuuuggugaacuguucauuuaguaagguuuuauuuuauugcaaagaaagaaaaaaguacuggacuacucuuuccuuuugagaguggauuaucauuaauuauguauuuuguucuuuauggcaguauacaauuuuagggaaaugauaacaggcauugcuaguauauuuguuuauaaccucuaugguaaugaaacccauuauuacaacucugaacuucuugauuucacaugaaugguuuugcauuuuacagauuuuuaaacauaauacuucuauuuggcacugaaauuccaaaacuuaguucauuugugucucuauuucacauuuaugcaaagugggauauaaauuauaagaguaauaaaguguuuuagccuaggcaacauggugaaaccucaucucuaccaaaaauacaaaaacuuagccaggcgugguggcacacuucuguggucccaacuacuugggaggccaaggagggaggaucucuugagcucagggggcggagguugcagugggcugacaucaugccauugcaccccaaccugggcaauaagugagaucccaucucaaaaaaaaguaauaaaauguuuguuuuaauuuauucuuuuagaaauaaucuuguguguguggaaaaaugcacuauuugauaguuugugaaucccuaaaguaaauaaaacacccaugugugguuauacaugcaugcacacacauguacacccauacacacaauguauguaucaugcuagaagacuuaaugacguuucuugguuuauaagauuguucuguauuccugucugugguuauaguugucauacaggguuuuagugguugauacuuguaaguguuuuaaagaagaaccuaacuaacagaaacaaaaagcaagcuccuaaauuuuuuuuaaauaggugugaauagccuuuguguuuguuuugauguuggcaggguugagagaugucaguacugacugccuacauugaccaauucauauacuuuuaccugacauuuacuaagaacucacucguugcuuucauuguguagauacaugccagguugcauuuugccuuaguugaaauuccaugcauuguuuuauaucuggagaaaauaaaucauuucuuccuugugacugccuaucauuauuaaugauuauaauguacacuggaccuauuggagacuucuucauugcaguuuuuaaacaauuugaugaaaccuuccuaggugguccauuggauaccuuucagaguaugcuaaugguagaaagggucgaugagucuaauuccucuguuuuuuuaagaggguuauuuauaugcuauggaauaguuugagaauccuggcaagaaguguauggaaagaauauggacauuaaaaaaaacuuuuuuuuccuuugucaagcacuaaacuuuugcagguaauuguccagauauuuuuacaaugguagacaauauauuuucuagcuaaaacuguuugcuccaaggaaggagcuaagcauuccauuuuccuuuuauuauuccagagcaucgauugaaagcuagauugaggauaagugagcaaguugccccauaaaauuacauacaugcauuugugacugaagggugugaaaagcgauacuuuuguacauuuggcuacagcuuaguucagcaucggggcuaugcuuucacauggcccauuuugaaugguucaguuuccuuacugugguauuugguucuaguccuacucaugguacucucccagagcauuaaauaauuuaccgccauaggguagcuggguucuaaccuagcucagcagaacauuuuucugcuggauuagauugagguuucaggcagaacugaagaaagcugcuggcuuacaggaugaccuuugaaucucaucuggguuagcgguugauauuuugauuugguuacuguggucauauugugacagcugcuagcucauuauaauucgguuccaccgcuccguuugccuagcaggaauauuuagguuuguauuacuucagaguguuuauggcuacccugaguuuagcccagcauaaaggugaaguguugugaguguuuucaaaucccaguggcagaagcaggugccacagucuucuuguaaaacagcaaaugugaguacaugcuaauacagggaguuuuacucuucauuguaaaacagagaauaaccaaugaaucagcuuuuacuaggaaaaguguuuuuggaagccuuaauguacaaaggaaaagcaugacuacaaagaaacauaauuuuucaaagcacgaaugagauguuaccugacuucaugguuagauauuuuguucuuugcagaagugugaguauuagaaaauaguaaaaccuguacaauaauggcaaucauuugauguuugaaaguuccaaaggucaaauaaucuuuaguaacuucauaagaacggaacugugaauauagaugucagcucuagaaauuuuaguucacuuuuuaaaugcagcgaaauuagguagugauacaagcaggccccuuugcuaguucauuaguuagggacaucuuggugugcuucuuuuuuuuuuuuuuuuuuccaauaacaccuuucagcuugauguuaucucgacaucaacucuuaaguguuggacuuauaauguggcacaaguaauuucugagaaaggaaauuauuaauuguggucuuauuugauuuuacuuugggaauuuucauuucuuuaauguuaaauuuaaaaugcccuccugaaauauuaacaaguaugacucguuugagccucaucgcugguguuuuuagcaaucuugauuguugagcuaaggcugguagucaggagucaggagaacucaguuuuucuuucuucuacuucuuccuuucuucuucuacuucuccuucuucuuuuucuuuucuuuuuuuuuuuuuuuuuuuuuuuugagacagagucucucucuguugcccagacuggaguucaguaggaugaucucugaagccucaacuuccugggcucaggugagccucccaccuuagccugcugagcagcugggacgacagguguacaccaccacaucuggcuaauuuuuauauuuuuaguagagaugggguuuuaccauguuagccaggcuggucuugaacuccugaccugaagugaucugccugcuucagucucccaaagcccugggauuacaggcgugagccaccacgcccagccaagaauugaguuuucuauucuguuuugcuacagcugccuguggguccucuggucaggucguuuucacaucuuuagguugagggaggaacagcucuuuaggugaucucugagauaauuuuauuaucuaaugguccauugaucuuucugauaugucauuuuauccuuauacuauauuuucucuuuggagauguuuuauuguucuuucuaauccauucaucucuauuuuaugaauaccuucaagugacuuugccagugauguguuuuccaaauguaauucuuuaaagccuaacuaaaauagauauuccuuuuauaucucagcugauuccagaucuauagcuaaggaauuggauugguuggggauaaauaaaauaauaacucauuaaguugagucaccaggagaaaaguucugugcauagaucaguauuuagcauagagguuguaggaccucaauaaaugacugucgagugaaucagggaauuagauagauaggguuuaaacguugaaugaaaagcccauacauuaaaguuaggccuauaccuuacuguaccaagaagaagacccuaaaccagagccagucauauagaaauucacauuuuguucuauaggacuauauccuugacugggcaaaauauucugccaagauaggaaacgggccauauuacaguguggccuguuucaguuuucaguacaccacagauuauuuuauauauaagcggaaauaaguaaaaucaauaauauuuugggucgggcauagugccucaugccuguaauccuagcacuuugggaggccaagguggaaggauugcucgagcccaaguguuugagaccagccugggcaacauagcgagauccuguuucuacagauaauaaaaaaauuagcugggugugguuuuaugcacuaguggucccagacauucaggaggcugagguggaaggacuacuggaggcugggagguugaggucacuacagugagcugugauugugccacugcacuugcacuccagccugggugacagagagagaccccauugcuaauaauaauaauacuuauuacuauauuuauauuuuuguaauuauauaauaauaauaauuacuauuauuauuauaaauaauuugaaaggccauugaaaaaaguugcguuucugguauugagcuaagauaacugauuuccuuuuguccagucagaggacauuuccauucuucucucauuggucuuguuuccuuuccggccuacucugugauauagcacagcuaaugcugugguccucaaacacuuuuagaguccaacuagguuuacuaauccaagucguauaacauuuagaagaauuucuaaacagaaaaauguuacuugaaaacuauggccaacagagauguauagaccuucuaaauaccaggggaagauuucucacauagaaaguuauugacccaaagagaagauaaaucauuuaagcuucacauaaaaguaaaaagcaauuuguaucagguaggaaugcuuuugcuucgaaguaauggaaaaugugacuaaugauggcuuaagaauaauuuuucucauucuagaaaucuggugguaggucccugcuggaagugguuugcagcucagugaugucagggcugguggcucugugauucuuuuguccuuccccucauugucuaaagaugggggucacagcuucuugugucaaguucagguuugaugcagaaagaaggggaagggugaguugaguggugucuccccaccacacugcuuccccauaacccaggccaucuccagcugcagagguuggggcagggcugggaaugcagccugggaaauagacaggagagaagcaaguuugggacucauacugggcuuacuaacuugcaguguucaauucacacuuuaauuuuuuaaagagaaaaauauauaauuuucuauuuaauaauuuugaaaauuaagaacaaggccuuaacuuucauguaauaaaaauauauaaaaagaugucucagcucuaauuucuggucagcaaauuagagaggaagauggaguaggaaaaaagauacuguaaagaggaagauggagaaaguacaggcaugagcgucuugcaugggaaggagcgugaggucugcuguuugcaucucaccuucaaggccugugucuucauuguccuaagcccuugagcaaggcagcaaccagccaaagccagcucuccuuaccuuugcuuuccccaggaccuucucuuuuaggucucuggcuugacuuucugccagccuguccagggcacccuugucacgcaacaggccuguagcuccagccaccaaccacucuuuucuccaguccccuggguggucuuuggcagagccaaaggccaggcuuuacucccagugucuccugcugcacccauccagagcaggccuggcacccuggagcacgucccugggacaugcugcuacaagugacagacaaagaucuuucuccuggaccauugcccaaacaguuuccagggaacuuaccuccagcaaccugccaugucaccaugaaacagucagacaagaaugccuacugccuaggggagaaaacccucuauuuucuuuuaauauguacacaauugcaguuguugauuuuuaauguggaggauuaggugcagccaaaagacauuuaguuuuagacaacaugccaagacuggaugaaauggugagagcuggauccaacuuuuguccagaaguuucccaacccuauugaacagucucaugucaugaaucagacccauuggaacagaggcagggggaaggaccaucuaucauuaaagguaaccaggaugugaaauaaacagugcugcuuuuauuuaguagaaaaaguuuuucucuagguuuuuacauuuuuauuuauuuucauguuuuuauuuacuuacuuucuuuuuagacacagaaucucacucugucacccaggcuggaguacagugacaugauuauagcucacugcaucuucaaacaccuaggcucaagugauccucccgcuuuagccucccaaaguucugggauuacaggugugagccacugugcccagccaauucucuaagucuuuccuugggaagaugguuucucugaauuuugcauaagcccuauacuuaaaaugugucugugacaguauuaaccaguacccuacuucuggacuggaucuuggguggcgggguugcgauuaaacacuuuguguuucucaaaccucucauuacuccauggcuucaggagaauaacaucaguauaguuagggaauccugaaccucacauccuugaaacuucuguguccaccuuaagugcuguauucauccucaauaaaaauaagacugcuuucuuuguucacauuauauauucuuagaaccaaagaagcaaaggagcuguuuugagcagugcacaucuuacagggugucaugggacaguggauucuaggucuucaggggucacuucagcauaauucuuggcuuuucacuuccuagugaugggugaugggacauugggcaaauuuccucagagcccccguuuucugguuucccaggugaggacagggaugccagccuggcccaccccucccaggcucacugagaaagauguggugaugugauacacuuuguaaucacugugcucugcuguguaacuguuagggcauugcaaggcuaaccacuggucaucugucauuuucgucuggguaaugaauggaaaaaucuauagacuuugggguuuugggugguagcaauuuuaaaauaccuauaccuucuaaagagauuggaacagaaggcaggagcagguggagguaguauagaauguucacuucuguaaacaucaagaccaaaaugaaaaggcuucuuuuuuagccaguccacaaaacaguaauccuauaaaauaaguaccucuuuggggacagcuguguuggauucagaugcucccuuuugugaaauauuugccuacagccauguuucucuccauuuuaaauguucucaaguuucaucuuuaaacacaaggccaagaacacccuggugugguguuugaguggugagacuagggagaacccacugacaaaugcagauuucuuugccuguguuguaggucaucugaauaauggagucacuacaagguaccaugguuuucaucaaggagauaguuuuacaaauaccuuccauauucuugggaauguuuuggagacaguccuauuccacuucauuucuuucuucuccacagaugcuugguauagaauguugccucuguauaugggauuauucucucauucccuuuacuccacagacgcuugguauagaauguugccucuguauuggauuauucucucauuccccuuacucuuaagaguuuuugaauccgaaggaaacauguuuuguuuugaguaaaaggagguguucaguggaucucauuuucuuuucuuuugcggaauaugaggccuaggaacuaacaauugcaaaauauauggagcauagguugagauuaaauuaaauuuauuucuaagugguuaauagacacagcucgaacauuuuucaucuucuugaugauugcuuauuaaucacuccuuaauuccuugacacauuuauuaauaggaaaaauugcaaggaagcaucauuugaaaguaguauaaaauacagcugguuauauuguuuauguuuaagauaaaacauuuaaagcuuucacguagguugaaaaugccacaagagaacuaacaugggggaagugguggaugguggaccuagcagagcacuguggucagcugggcauugcugugagcaccagcucaccacucuccaguucugugaccuugggcaaguuucuuuagcacugugaugaaauuucucaucuaaguaguugcccuguguuuaaaagaaauaacguaaagccaccuggcccuaaaauucaguuaaugcaaauuauuauuacaccuacuauuauguuaucuagucuguuuuucuguucauuggguccgaucagcuuggcaaaagugauaugcuaacuugagcaucauguagugaauucuggcagaacguggaagugauuaauuaaaugccacccccucgugggccauauuaaagcugaaugaaaauagaaaguguguaauaucugauaacauuugguggagaagggggagacagaaaaauugaaggauaagagaaaaggagacacauauaaagcuaauuuuagagcgauagaucacaaaguaagauuuucuagcuuuguauuaucagcauuggcuuggcuuucugagucucgaaauuacuagguuacugacuggccgugccuuuuccucaccuuggcuauucagaccaagcuguacucuuaacagcucaguagccaaaucugaaugcuucaaauauaagcauaaacucuuuauguguaacugauugcacuuaauugggcaauaccaaaucauggaagaaaauuuauuagugacccugucuccuucagaacuuucagaguaauuggaaaugagccuaauauccguguuuuugaaagcuuuaacaauuggucuacugacaggauuaaauucauacuuuauaugguguguauguuuuuucaugcuuaaguuuuuuuccuuauuuauugauggucuuacaaauauuauuuggaaauugagaugcagugagcacagaucuuaaauaucuuggcagaccgccucaguagcuguggaugaucccuguuagcuagagaaaaaccaggaaaaaaaaacccaaccugguacacaauaguuuacgaaaugaucuuugugugauuuugaacaagcuguuuuucauuuuaaucucaguuuccuugcuucuguuacugaccuaacucauggagauguggccaggagagggugggagagcucucugaauuuuuuuguuucuccugaaauaaaacaguucuaaauagacauacuuuugugugauuacauuuuccauuuuucgcaaagucguagguauaguuugaacaccaauugagaauaaaagaagcugccuucucccagucuuuucaagacauuuuaauaguuaaugagauuuugccccuuacccucaugaguuucauuugguucugaaauaaaaauuuacggcuguucucucagcugagcugauacuaguuuaagaguggaauugaguucacaccugcucuggcauaaaaagccucuaugugacuucuuugaaauauucacagagcagaauaagagagaguacucacuaucucuacaacuguaguaacuacacgguaauguugcuugcaagcacuuuagagaagcugcucuauaaacugacucuaaucugcugauauuguccacagauagaugccuccccuaagucaccuguguuccucaagguggaaugugguuguggaaaugcaguugguuuguguaggcagugggucuacauuaacacuguaaaguguacauaugggaaaaucuuugcauuugcuaggccauuuagccguucaagacaugguccguuagucaggcaacguacaauggauuuucugaguguucuaguuaaagagcaggauguguaaaguaguauacauuuaggcggauaauuaauaauugguguaggcuuguaaggcuguaauagaauauauaaauuucagcaccuguuaaaguuuuaucagagcagaucaccuuuccuuacugugagggaauauucccgccuguagaaaaauaaagugcucccacuacacgugaaaaaccuuuaugaugaaaggaggacugguuuuuauaacaaauauuauuuuccauggucacugugauuaggugacauuuuagcagucacauuuagagagcguuccuagacaauaguauuuuguauggguuugacuguagguggcaaaacacugcauagaaacaauauuuuagugcauucuaauauucagauacaguuuacuugucaaagaagccaccuccccccccauaucauccccccacaaaacaauaggguuguucauuuuauaaguucaucacaaguaaauauucagagcgaaagccuuuucuaguggcuacguuggaagggguagagaagaugaaacauagaucccaaguucaguuuuuggcuuugguuguaucauaagcaguuuuuacacuucauaucuuagcugucuucauuuucagacauagaggaagugcucccuuacagcagugagggaaagggcaaaugauauauuugugaaagcaaagcagacuaucuuacugcuuuaaaaguuucauuggcugcuugauaaauaaaauuaacauguuaucgauaugucugcaaucauaugguccucaguauauguauuuuuuaaagccauuuauauaaauuccauuuauucuagaagcugcccaaaaugauaaacuucaauacucaaaugagucuuugguucguacagucauucacccagcaaguacuuuugggaagcuggugaucugcaagcccuauguuagguacuagauaguggcaugcuacuuuucuugcuuucaacuuggcccacauccuaauaaaagaaucagguagauaucagauaauuacaauucagagaguuggggaaauaauccauguguucccaggguguuguugcauacauaucagggauacuccaccaucagcuuccucauaauaaugucuaauuuuuuuuuuuuuuuugagacggucucaccccguccuucaggcuggagugcaggggugcuuacugcagcuucaaacuucugggcuuaagaucuucccuccuuggccuccugguggcagggacugugggcacgugccaccacaccuggcuaauuuuuucuauuuuuauuuuuuguagagacaaggucucgcucuguugcacaggcuacucuggaaccucuagccucaagcagucauccugccuuagccucccaaagauuacaagugugagccacuguguccagcuuggcuaagauuuuuuuuucuuuuuuuccuuuuuuuuuuuuuuuugagacagagucucgcucuguccccaggcuagcaugcaguggcgcgaucuccgcucacugcuagcuccaccuccuggguucacgccauucuccugccuuagccuccugaguaucugggacuacaggcaucuaccaccacgcccagcuaauuuuuuguguguuuuuaguagagacaggguuucaccguguuagccaggauggucuccaucuccugaccuagugauccgccugccucggccucccaaaguacugggauuacaggcgugagucaccgcgccuggccuggcuaagauuuuuggguacucacuguguaccaggcacuugcuaaguacuuuacacauauuauccugcuugcuccuuauaauaaacuucuuuguuagacauugucauuaccauuuuacaaaggaggcaauugagaaucagagagauuagguuauuugcccaguguuguguagcugguaaguggcagaauccagauuugaagcaagaucugcugaacucuaaagccuuguccuuacccaccacugcauugccuccuuuguagagaauuuagaaagaauucccagagguggaauagcagcuaaacauggguucagcugcaacuaauagaauaccugauaacaaugguagguuaguaaaacaaagggguuuuuccccuucauuuuaggaggugucuggaggcaggagguugccugugugaguucagcaaaucaauguuucuuucuucccauucugcccuccuuagcaugcugauuuucauucuucagcuuuuuccucuccucuugcauuucuuucuugcaagcuggcucuugagccucacacagcacauuagaguccccuaaaggaggcaggggaggcagagguuaggguaacauuuauccuuacauauauccuauuccauccaggaagggggaaaaacauuaccagaaucugguggccuugagcaggauucugcuaacaacuuauuggcuaaaccucuagcagacaucuacucauagcugcaagggaagcuuggaaugugaacucuuagagccaugguugggucucugacucaagagacaggcaagggaggagggaguuaggaauggcuauuguauggaucaacaugaauuuucuuaauaauauacgugguaaugccugagcuucaucuuaaaggugaguugguuagaacuauccugauggaaagaaaauuaccaguugguagagaugcuugagcagagccuugggagcuggaagacguaauaggaauacuggaacugaagucauucugugagaugacuaugagauguaguaccacagaggaagggaugacagguugauauggcuuggcugugucccacccaaaucucaucuugaauuguagcucucauaauccccacauauugugggaaggaccuggugggaggcaauugaaucaugggggguggguuuuucccaugcuguucuugugauagugaauacaucucacgagaucugaugguuuuauaaaggccaguucgccugcacaugcuaucuugccucccaccauguaggacgugcuuuugcuucuucuucgccuuccaccaugauugugaggcuuccccagccaugugaaacuaugaguucauuaaacccccuuuucuuuauaaauuauaauuauuuauaaauuauaauuaaaaucuauaaauuguaccaucuccgguauuucuucauagcaguauaaaaaugcucuaauacacaggugaagcuggaauacaauccuggccccagagaaaugaagggucucuuguguuuaggaguggaagaugucagauuuucaaugaagcgugugguaaacuacucaaggauugauuuuaaauagugagauaccaugauaugauuuaugauuuaggacacucaagcaacugugaauaggaggcaacuugagggcaaggagauuacucaggaggugauuaaggcaauuccaagaggaaaugaugagauugagcugaacugggaacaaugaagaugaagaggaggauggauuugagugauauuaaaaugauggaaaugguuggacuugguaacugaugggcaaggcaggggucguccuuggcuucuuggugucuggcuugggccacuuggugguuggcagugccauuuguuaagauguagaauauaugaggagaaguaggucaugggggauuaagguggucaguucaguuuuggaaauaaugaauuuuugacaugucuguggguggacagauuugugauucuggguuugggauugcagauuuggcacacaauauuaauauuucauaguugaagucaugggaguagauaaguuccccagagagagacaugaaccaccaccaacaaggcaauuuguugcauugugacagcucuaacuuuuagaaaguucucaauucuguagcugucagccugaaauacucauuuuucccucugaagcuaacuaguauuguguauugucucucuuuccacauguuuugaaggaugcuaaucuuggcuuccuucaaaagcgcaacuggaaaacuuucaacacauuguagaacaugguuuaaucacaccuuguauucccggucaccauccucugcuguguucuaguucaucucuuuuucccuccaaguggugaauccaagucuuacccuaguauuccagaucugguuugaucaauaguggaucugcucucauuuuuaguguuaaugcagucuaagauuccauguauacauucauauuuuaacauugacugaaaauggagcuugugguccacuaaaaucauuaaguguuuuuaacauuaauugcuuuacauccagggcuuccacaucuuuguguagaaugggacuuaauacguauccucgucugauuucuucauguugguuuuggucugcaaaugugcaauaauucuguccuuucacucuguugauauaggaagugagauggugugaugcuuaggaaugcaaacucuuggauuuauauccuggcucugcccacccuuuacuaccugggugacaucuaaguugcuuucucugagucacaguuuccucaucucuguguugaagauauuauaaaauccaucuguugggauuguugggugaaguaaaugagguaaugcauguauaaugcauagaggaauccccagaacaucaucaacacucaguaauuuuucccuguuacuauuguagggcauauaaggaguuaauggcgcuauuuuugugauuguggauccuuucucucaguauucuuucuggaauacuuucaguaucucuuucuggagagaaaguuuaaggcaagugguucaucugugacgaauggaagaaggaaaugugguucuugauuuugaguugugugaugaacccaaauuuaccaggcaauagauaggauaugaugauuacuaaauuugccauugacugauaguuaacuggcuaccuuguugggucucuugagaaaagaacuaaaacaagaacaacaacaacaaaagcuuaaaauuaccugaaaauaugucucuuuaccuacaccuaauuuuaaggcagaaaauuccaaagugagccagcuacucaauacaggugcugaagguuaugugaaaauucggguuaacacuaaugauagauugagagguaacuguuugcuuuacaaaccgcuugccaaggaaugcccauauuagacuaugaaaauuagacucauggcaaauuuucaggaacaugauucuugugauaaacaagcuaucuggagggugaugugugagcucacaggggaguuuuaagaacagguuuccauuguuggacaguaaccugacagcuaggcauacucagaggaagggcauagauuaguauccaacaaccuguuuuaaaaccaagcaaugggaccccauacaagguccagguugacccgaaccaagguuagaugaaccugacuuguuuuuauaguaaacgucacaauggugacaagccagcagggucaucagcacacuuugcagcuacagacuucccacuggacaaaccauuuucagcuuccucuguuuggucacacccacaagaaguacgaaugguauauuuaaaaagcuaguccaucuugguucauuuauaccaguguguaggauuucuguagacucugggcugguuacaaccuagagcugcagaagggugcagagcuucauguguucauucuguacugugauaaaguucuuugcacguuuguggaaaugcaaaaguucuucuaugcaccuggcuucuguuccggucauuuccuuguauauggguuuugauccggugugacggaagagggaagcuaugcauucugagaucucagauuucauuguauccaauuauuuauaagaccugagaggugcuuuauuaguuaggaagcacugcagauuuucucuguagcuuuuaaaaaucauccugacuuccuauguguuauuuuuugcauuggcacccauugccaaugcuaugucucagaagagccgagacuuguggccaauaauccuuagaaacugauggggcuguagaauuuauuucucugucacccuuuuugaaaauaaaauaaaguuauauuuuucauuuacauggauggacaaauuggggucuuuaaaauaaaaccuacuuccccuuuucauucuuuuucugaucauuuguagcaaaagcuuagugguuuucuguagaacugcuuuguuuuaaaaaucaaauugaagaccaacuugauucugccugcagagcaaagcuaucugccuuuuuagaaaaucuggaugguuaaauuggaagcacauucugcacaugguuuagcaguuaguagccuggaaaaugacccaauagccaagauaguuuuuuuguuuguuuguuuuuuguuuuuuuaaucuucauuguaagugcuuguuuaaaguguaagcuuguaauggacuauuuugcacauuguucauuguuaauucuuuucaggcuauuauaguucuguaaauacauugccugcuaaguugugucaguggagaaacauuagugcuauaagaaaauccagugaaaugugcuuaaaagcauuaccaauuagcgcaugggacuggaucaccgcgauuucuuagugauccuagagaagucaguuucaguugacuucccauuuauuuaaaauggguaugacaacguucuuuuuggagaauagggcagcacacaaaugcacacuaugcuguggccugcugaagaguuuccacugauuugugacuauauuacucaauauugcuuuguagcacccuuagucuaauccacauugaaggagcaaaauccuucuguaucuuacuuauuauacgauuauguaauacauauguuacuuuauauauaauauguaguaguacuuauuuuacuauuuuuauucauuauaaugaaaauaacaaauuuacugggugguaucuaccaucuagcucaagcuguucuauuuuguauuguuuaaauuugagaaaagcuaauauugguuaauaauuaaagguuacaaaaauuguagugggaaaggaguuaaauucugucucucagauaguaaagacugccagaacauggacauaaucaugggaaauaauaggguggauagaaugugauuuaucugcguauguuaaagaaagaaaaauagugaucgugaauguacugaauauagcuuaaacuauuuaucauuauguacaaauggaaacuuacauaaaaccccuguugauuaaguuuuaucugaaacaaaggauaugauuggaaguggagaaugggagaguauuuuaagagcaugugauaauccagcuagaagcuucagcaagucuguggucaaacaagagaagagaaagaaagagcaaggaagcuugauuugguuaugcaaauuuggagcacacauaugaguugggaccuaauggauuguugcacuggauuuggucaucaaaugaugcuuuucauagcaaauauuaucugagccauuaauucaaacacugagaaaugcaggccauguguaggcagaaccacagccuuuuuaucccucaaaacaaaauguaaaaguuggccuugaugguuagaccuuauaaagaagaauaaggggggaagggggaaaggagcaaguagugaaggaaaaagcacccagaauggaaacaggcaugcguauucagacauaaauccaauaaacagacaccccaaaguuaugcuguguaagaauagacacacaguaagaaauuuccagcuaucaggcuaacaggauggaaaacuggagagcacagagcaauuacuuacgaagaaagaggcacaguugacaucaaguguuauagaggagacuggcaugauuacaggaagauguugagaauaucagaaaacauccccaaauuaagagugccaaaaagaagaaagauuaccgaugagaucaugauaaauaauaaugagcuguuucucaaaguaccugaagaaggggccugaaaagugguuugucaagccuggaagacagagaaaggguaauguauugacggacgauggagacacugcuaaaaaauaaaugaaauuuucaccccaguguucacaaaggaggaggugguuggggacagaugucagacacagacacaaauuucccaggggagaaugaagaaauacaaaagaaaucaggauccugcuaaaacaggugaucaaggggugagaagaagaaaaugaauaaaaccccaaaaaccccaaagcuuagcgguagucaccuaaaaaucuucaagaagugagaacaaagaagcuaacaagaagaggaaaaacauacccgcaucacuuagaaaggcuggaaauauuuucauguguguguguuuuuaucuaguuaauuuguuagacuagcccuuuugaaacuuguccuuaaaggaaguaagauagaauacuuaaagaaaaaugauuguggcugggcgugguggcucaccacccagaguggaaacaggcaugcguauucagacauaaauccaauaaacagacaccccaaaguuaugcuguguaagaauagacacacaguaagaaauuuccagcuaucaggcuaacaggccuguaaucucagcucuuugggaggccgaggagggcagaucauuugaagccaggaguucgagaccaaccuggccaacauggugaaaccccgugucuacuaaaaauacaaaaaauuagccaggcgugguggcacgugccuguagucccagcuagucgggaggcugaggcaggagaacugauugaacccaggaggcggcgguugcagugagcugagaucaugccguuauacucuugccucggugacagagugagacuccgucucaaaaaagaaaaaagaaaaaugaucguuuaaguggccuugaauaaccaagacaucuuuccugcuaaguucuuuucgaguuacccauuaugcccagcguugaauguuuacugugcuuauuaaggaugauuuuuguguccuaggugaucacugaguccuugauugggccaguauuuacuggauggaugcuucuuagugccagggagugcgcuagauccuggacuacugggauggaaaagcuagauacuuucugaggguuuuugaagucacuucuuccucacucauauaagcaaccccaccucuuuccaggcauugauuucaguguguucaucaucccuggucuugcuuuuaaccagcuacuugaugggcaaaggucuggagaggggcagccuccuuuguugcuggcucagugugcugugcuguccucagcguggugccugcuuuuugcccuuauccucagauguggaucccucucuucccaagcucuccuccauccccugugcugcaaacaaaacuccuuguuuguugcuccccaccaguggccacgaaggaauuugcaaaccccucaaccuccuacuguuuuggaauucaugaaguuuuugcccugagcaagaggcuauacuuucaaaaguacuuuuuccuuucuucauuuucccacccccugccuuucaaccacugccccgcccuggugcacacaccuccaucccaggcugauaacucccaucucuauuugaaccacccacucccuucucuuggccucugucaauuuuagggcucagcaaaacugggcuuacuaaaaacaccuuucaauuucuguucucagcauuaaucugucuuugcuuaguguucaaagaauacuuuaagauacucauuaaugcaaacacuguuaugaggagggagcuucacuucggucccuucuucucaccuucagauacuacuguaacagcugugugggacuggaguauggaauguuucagagaagcugcuucugaguguguaggagagggcugaagaaacuuucauccaguacacaguuuuguccuguaguccuuguucccauggccaaaagucuucugguaaaauuaaucuccagugcuaccuuuccuaccaggacugcagguggugucuuuuaguugaaacagacucccguggucccuugauucucauauguaauguuccauguucaggugucucugaaagcuguuagacuucauccaauggagaaggguccauugagcuacaucacuuucuuuuuucacauuugcguuucuuuauguagagugaguugcaguuugguuggcuuuuuuucugggaauagaucacucuucuggggacugucagacuuggucccugcccugggugaguuugccaucuuauugaggggguacuaacaugugcgagacaacuauaaucauagcaauaccaaccccaccucaauggcugagugacuaaugagaggagagagugaggggcugagcagaggccucuaggaagcagcuguggucaaucuuagccuacauuuacuuuuuuuuuuuuuuuuuuugagacgaagucucacuccgucacucaggcuggagugcagugguaugaucucugcucacugcaaccuccaccucccagguucaagcaauucuccugucucagccuccugaguagcugggauuacaggcaugcaccaccacacccaguuaauuuuuguauuuuuaguagagaugggguuucaccauguuggccaggcuggucucaaacuccugaccucaagugauccgcccaccuuggccuccgaaagugcugggauuagaggcgugagccgcugugccuggccuaaaccuauauuuacuuugaauuucacuauagucuaccauuuccugaugccuuauauaucugacauauaucugaugagugacauucuugagaugucugcccaggacuccugaaccccaugagaaauaagauugcacuuugcaguucuucaaccuugcugugcaucugaguaacauguggcccauucauacacugcagaugccugggcuccgucugugagauucuguguuuagaggccugggcugggaucuaggcuucuguuauuuaaacaggaauuucugaccuacacauugcuucaaaaaauugucaauuuuguuuucaaaauuguuauuuuuucuugaacucaauacuuauuuuuaaauccuuuuucacucaggaaaagugaaucaucaccuacuuagcaccuaauuauuuaccacuaagauauuugugugcaaaaaauuaauaauuuuuagaucaaagaaaauggauaacuucuaauauguuaaaaucgugcauauuuccauugagagagagaaugggcugaaauuaucccucuuuuauauuuuaauuguucaucaaauugauagauuuaaucuacuggcccuaaagauuugcuucuauaauaauguugugaaugaaaccuucauugcuguagauucacaauucaacaucauacguaugugguaggugugauuuuucuuguauuaaaggaaaaaggguuagcagauuuuuaccaauuuagaaaaaaggcaagccaaauuagagggaagucagcauuauaaauauuucgaaaagaacccccauucauuauuuuuuguaauguguagcuaagaccaagcaacagugaagugggaaucuuugccuuaugcaaaaugguuagggaaauagcuaaggaugcuaagaaauuagcuucaauauugguuguaggcaugaauguuuuucucagggacuugggugauuuuguuacacuuucuaauauuaucucugcuaucuucuaggacuuauuuugugcagucaaagacuuuuuaaggcugucuguucuguaaaagaaauacaaacuccaaguuguuugauuuuaugaguuuuguuguuguuguuguugcuguucagucuguaaaauagugacguggauaauaaagauauuuaguuguauguccagugaccuuuggaauaauaaaacuguuuuugucuguguggguuuuucacauacagguaauguuuuguucacauucuggauacagaccugaccucaggcugcucagcacugcaauuucauaggcuccuaugagguccccggcuaacauuuugacuguggugguagaccuucaccucuuagauuucauauaucuuucauuuugcuucuuuugugcuucuguugaauucuguauauuuaagaaaauuaagaugcagagagaaaauugguuaaugucuccucugugucuuguaauauguggcccaaacagaaagaaaauguauggaauuuagaaauuuuauuuacuuguuuucuuacaucauagaauaccauuuuaccauugaaauuauuaaaaccugcuuuuauugagaauuuuggggaaguugaaaauguaaccuuuacggggaauuaaagcuguuuuauuuuaaugaauaaaguaguuaaauuauuaaucauauaaaauuauuucucuggauguuaauaaccauuucuuuacccaggaacuuuuuucuaaucacagaaucuugauuggugguuuauuugaaggcauaucucacuauuaaugguucaagaauacccauaacuuuuggaaagacucaaaacauauugcauaauuggauuuuaaguuauguuguuuguaagcuuauuugacuuguaucauguagugauuacuaucaguuuuucuggauguagguaggugcuucuuaugauucuuucauagauaguauugagucauucauuaagucuauuccucagaugcuuauugagcaucagacuugugucacauacuugcacagcuugguguuggagauacacccuuuaucaccacauacuuggaguugcuuuuugucugcuguaagacacaggauguagugaacaggccaagagaaauauaggguccugugggagcuccuuacagggagggacauagcacagagaaacucaggguaguugacauuuaaguucagaucugagugaucaggaaaacagccagccagagggagcuggcaugggaauggauggaggcguguuugagucauggcagccagaucuaaagaaggcuacaaguagagagaggacugugcauuucuccuucccaucacuggaagaggaaggguaugaggaguaggcucuacaugaacaugagagccagcucaugaagggcuguacaagccauguuucaguguuuaucauucauucugcaaauacauacucagcacuaugugucagguacuuggcuucaggaaacaaggcagaaaauaaugccugcccuuguggagauuuuauucaaauggggaagagacaaacaguaaacauggcacuagugguuuugaaaaugggucagaaguauguguaguccaaaugguuacagacucagcauuugccaauaucauggagccaaaucuaagacuauuuaauaaaaauaaguuugcaaucauuuccaguccucagcugauaacuacagauagacuuauucuuaacucaacauauuuacagguaaaguugaagguuaccuaucauuuauauuuauugcucacucacauugcaucaggcauugggcuaagcaagcaagcaaaccacauuugagagaaggugcuacaguuuagugcaaucaguauuucaaguucaccagaguagaacuuaagaguagaagguuuauuuguuaaauaagaauacuugaccuuaauggcuaccaaaaaagaguuggaagaaugaauaagaucuaguauuugauggcacaacagggugauuauaaucaauaauaauuuaauaguacauuuaaaaauaacuggaagaguauaauuguauuguuuguaacauaaaggauaaaugcuugaguugauggguacuccauuuacccauauaugauuauuacacauuauaagccuauaugaaaauaucucauauaccucauauauacccacuauguaccuacaaaaauuaaaauacacacacacacacacacacacacacacacacacgaauacuugagaggugaucagaauguccuguauuccuggccgggcacgguggcucacgccuguaaucccagcacuuugggaggccaaggcgggcagaucaugaggucaggagacugagaccauccuggcuaacagggugaaaccccgucucuacuaaaaauacaaaaaaaaaaaaaauuagccgggcgugguggcgggugccuguagucccagcuacuugggaggcugaggcaggagaauggcgugaaccugggaggcggagcuugcagugagccgagaucgcgccacugcacucuagccucggcaacacagcgagacuccaucucaaaaaaaaaaaaaaaaaagaauguccuguauugcuguuugaaaacacauuaccagaaccagaauucuuccuugaaguuuugaacaauaucacaauaacagaaacaucucaagauuuuaucaugcagccagcaaacaaaaaaauucuacauagugauugaaguagacauuugcuugucacucaagaugaauuauuguaaauaaggaguuuuuauuacaaugaacacuuuuuuuggcagaauuaauaaagagcagaggauacuagaagucagugcauagaagcaaaaggagaaauguaguugagcauagugaauagagaagauuugcuuucguuuauuugcccuauacauuaagaccauugaaugagacuauuuuguguaugacaagcauuugaaaaaauuguuuuacucuggcaaucuuaggcugauuuguuuuauuuccuuuagaauaaaaguugcaaguggguaggaauuaugccuuaaaguguuagccuacaaaggacuggaaaacuacucaaggguaacagcugaagaggaaauggcucugucagugucgugcgcauggaugauugggcacauaagggacacaagcagggagaaaggugcagagagaagagcucauaaaaccaaggaggcuugcuuggaacuaaaauagaauagcaaaagugaaaagccuggggagccacuaaugugauauaguuucccucguaacauaaugcaaauauguaaaguugaaaacgugugccgccucuugcauagacauugcugucaucagcagcacacacaguuggguauauuuggcgaggcauuuaaucuccuggcucucuggucucucaguccauaucaccagaggcauguauuuucaaaacaguccagaucaaugucuggucuuuguaucugugguacaaauauaaagcuuacuuguccacauaacagcaaaguaaauccgugguccauuaacgcuaaauuguaaauagugauagucacuuuuguccaacagugucuguaauguuuauugcuaaagcccauacauguuuauugauauuauccuaaucugggaacaguagcugcuaguuaucuaugugccaaacacugugcugcuguuugcaaauuuuaucuaauagcaacuguuugugaggagcauuuguuaucugcauuuuacccauaaggaagguaggagggacagaaagguuaaaauaauccagauggaggacccacucuuggucacugguauguuuugggcuuagcacacaguucugccagacucugcaacauguguucuuaaccaucagacuuuauuucucuggugggcaacacagguagaugugacagguuagaaguauuagauauaaauauaaguuaucgagaugauaugacuaccgaauucacuacugcacuuuuuuuacuuuuuuaaaaacauguauuucagcacacugcuaaaccacagcaagaaucuuuuuaaaaagaccuuacaagaagcaugauuacaggucacaaaaucaagggaaaauauugucaucauuauuuuuuaauaagugauaagugaggcugaugaguguagaccuguugcuuuauuaauagaaauaugugcaucuggugaggacuuguauuugccaagcacacugcuggccuggaauuagacuccucuguggaauucaggucaguguuuacacccauaguaguuuacaaucuuucauaaauuugagcaaaauauuaggaaagcacuuagaagcaauuuagagaaucagaauuaaaguagaaucgguguagcauguauguucaguggagaggggcgaguagaggagugaguuucucugacagaugaugaaucuaguuuguuuacuuuuugggagacccuguuuccacacucacugacaugugaguuugcauccuggcucaagcacuuaaacuccccagucucccuuucugugugugugggauggagauaacaaggccaaccuuacaagguuguauaggguaaagugcccaguguaagauuugaagcacaguaagucuucaguggggcuagguuuucuccuuccucccugcuacuuacuucaugaagaggaugaauaaguacaaaucucuguucagcgcugcaaaggaagauuaucauauuuauuuauuuauuuauuuuugagacagagucucacucugucgcccaggcuggaaugcaguggcaugaucuuggcccacugcagccuccgccuccuggguucaagugauucugcugccucagccacccaaguggcugggacuacaggcgugugccaccaggcccagcuaauuuuuguauauuuuaguagagacaggguuucgccauguuuaccaggcuggucucgaacuccugacuucaagugauccauccaccuuggccucccaaagugcugggauuacaggcaugagccaccuugcccagcccagauuaucauuuuuaaaugcugaaaaccuaaauuucccauugcacugugcuauuacuuucacaguguugacuuucagagauauccgugcaccgccuuuugguagcucccuauguccucuugcuucucuaguugccauuucuuuggaagacccccccgacauuaguuaucucauuuuccaugagugauuuugaaacccaguuugugccacaguaaaauuuauugaaauagaagaaacacuggaucuugagagauaccaccagcaccugcagucuuaacgcuucaucuccucuccugaccuggguccaacucaucuuuuuuucucaucaccgccugcugccaucuuguuuacuccaagucuucaccguucagucagaaauacaaagcccugcaugggucagguaguccucagagaaggagagaaguaagaaagaaaguggaggccggccacggugguucacaacuguaaucccagcacuuuuggaggcugaggugggcggaucaccugaggucaggaguccaagaccagcuuggccaacguggugaaaccccgucucuacuaaaaauacaaaaauuagcugggcuugguggcaggugccuguaaucccagcuacucgggaggcugaggcgagagaauugcuugaacccggaaggcggagguugcagugagccgagaucgccccauugcacucuagccuggacaacaagagcaaaacuccgucugaaaaaacaaaaaacaagaaagaagguggaaucaaagggauguagggguuccacaaauuuagaugagaugucagguuucucagauguguuccuugauuugagguaggugaucuuagaagagcugcaacuaaacuccaacuggcuccuuuuucccccaugucuuagaagaaaaugugcuucguuuuuauucucuugacaacccucugcauuugcaucuuucagcuucuucuaacuugugucuccugggaccuuucuuuucauaacucuauuuucuuucaucaucugucuuuccccugacuccuuuucccuuugcuucaaaaugugcaaauggauccucucuucucuggcagugauuaucaaagugugguuucucggcgaaaugugaucacuuacuucaaaucuccugggaugaugugaaaguugggacccacuucaggccuaugugucaauaccucaguaugauauauuccagcaacuuucccaaaaaacuacuuaguuuccaaggcaguuuggcaucuccuagaguggcacagcaaauuccaugauuuuuuucuagcccuguucguuuugucuuuuaaaaccugucucccucaacauccacaauguuaaaaacgucuaacuugccuucuguuucgcucacuacucuuuuuuuuuuuccugcuuucugcuucugucuucauaagugcaggcaugggaagagcugggaauuuggagucccaguaggguuugauuccuuaaugucauugcucaguagcugcgugaucuugggucacccauguaucuucaguagggcaucugcuuuggagguuuguguggcuugcaagugucauuuuuaaauugggagcccaaaugcaauuguuugugcucuaaaaaucugccucuuccaguuugcuguuggaaaacuuggaaauuauuggcuuugccaggguuguggccucuggaugagagcuaaaaggugaacagccuuuuauccauucugcuuccccccacuuacucaggguccuuuccuguuacaaaucauaguuuguauggcauggcaaguacuggaagggagaaauucucuccagugagccagaaaaugcaacgggaucuguuugugauugauagagauaagagugccugaucuacuuuucccucugccagaaaaguauuuuucccugacagcuggagacaucaaaggucugaagcugugaauacagagagaugaauguucuaauauuaauauuauauuuaaaaauauaccacguaacauuuaacaucaacaugucuaguuuccucugucugguaacccccagucguccauaugcaaaaagaggaauuccaaucacagagguccucacuccaaggagacaggcaaccauuacgugucugugaauagcugaguaagccaaacugugauaguuucugauagaucaugucaagaccuaaauaguggaaucuucaggauuuggagguggggagcaagucaccuggauugaugaggacucacugaugaacugaccaaauuguuuuuuuuuuuuuuuuuuuuuuuuugagauggagucuugcucugucccccaagcuggagugagugcaguggugccaucuuggcucaucgcaagcuccgccucccggguucacgccauucuccugccucagccucccgaguagcugggaccacaggcgcccaccaccaugcccggcuaauuuuuuguauuuuuaguagagaugggguuucaccguguuagccagauggucuugaucuccugaccuugugauccgcuggucuuggccucccaaagugcugggauuacaggcgugagccaucgugcucggccccaaaugggcuuuuuaggaguucucauggaagagauggaaguuucuucuugagugagagcaaucccagagucugauauuucaccuaguacaugggaagggaacauguuuuguccuaagccaggugugaaguauagucauucauguugggcaaaaacguggcaggacuuggaacuucuguggggacccacaaaggagaauagaggagaagacuccaugaaauuucugguccugguguuguguggauggcccagggcccuggccagagagauucaacuacuaggugagguuuuuuucacuuuagacaacccugcuaaggcuucauuucacuuauaugccgucugugggccuuugaugguucuuuuuuccuauauuugcuauggauauauuuaugcauuuaaaaaauuugcaucauuguaacuuuucauugacaaaauauauuuaauaugcucgguuuuuacaguuuugcuuaauuaguuuuuuucccacuuauauuuauuuucuguaacuuuucucuuuuuuguugucuguuuugcucuauuaagauguuauauaucuucuccuccuucuccagaguagaccucucaucaguucaccaaaaucucucuccaguaagagucaggaagcuuaccgugugacaaccccuucaaggcaauaaggcuccaacuaagggauuaagauuguuuuuugacaccaaacauuguuuauccucuuaauuuugagcuauguagccugaaauccaugcucugugaugaaauggaggugguuuaucugagcuuuaauacucuuaaaaaugaagauaaugauagagcauaguaaugaaaauuaaauaagaugcaugcaucuagcagagaagcuaagaaauaggagauucuuaacaaauguaaccucauuucuucuuuaguuucuguaaaaccccaggaauguuagaaaauaucuaggucgaaaggagaagaucaugaguuugguguuaauuuugagguaccuuuaaccagucaagugaagacaugaaguagacaguugaauuuaagggugugcagaucagagaugucugaguggagagucugcaguugaagagcuguuuguagagaugccaguugaugguaugagauugcuuauggagucuugaguaacaggugggccuugagccuagcaguagaaggauuuucaagauuuaaagacauucaauugagaacaaaagagcaugccagggacugggagagaagggaaaugugauguuauagaagcuaugcuaagcauaguuuuuuaagaaggaggggaugggugugucuuuuuuggucaucaaggaagaugaguacucaacagugucucuuggcuuuaaccacuuuaguggucacuguugacauuuucagagaguuuucuugguggaaucauggaauaggaacugacuuuccaucccucagaguugaguugucuuucaucugacuuggcaaaguauuucuuuuauguacuucuaaugugauuuuucucuauuguuuauaguuguuugcacuuuucauucacguaauaaauuaucaguuuccugaagacagaggucaugcaaaaucccauguaaauuacaccuaguuaaguauuuagucuuagaaucauugguucucaugaugaacaaaacacauuucuuggucuguucauuuauucauucauucgcugaacaguuuuucauuuaccaauuccauacaaauagcagguacuauuuuagguuaugugaauauaguggugaacauaagauacucccuuuucuguaaacuuucauuguagguggagacagaugagaaggaaugaauacaaauguugagggcguucagugucuucacuuauuuguuccucacaacaauagcaugauguagauguuauuccuaguccuauuucauugaugagaagauggaggcaucaagauauuuaguaacuugccaggguucucaguucauuggaaacagggaugauguuuggagcuaggauucaaacccaggcgguuugacucucagauccacuuugcuaaucaucucacuacacugcaaaguguuuggcacggggaaaaucauuauucuuauuauuaauguaguuaauaguaacuauuucucaagggagcugaggaaucauuuacucuaauucagaugagaaaauggacacucauacagcuagcuauuggcagaacugaaauuuagaagccauauuuccaggcuccccuuccaauguuuuccccucauccaguaccucuucuuuaaggaauggaguauggaaaagggaaaagaagcuggaagaaugaaggaaugggcaaggagaaggaaggguguguagaagagauauaggaaauaauuaaaccuguuggauuugggguuuuugaugcuauugaacugucugguuuuuaaaguuuuuuucccccuuauauucucaagagguagauauccuugaaaugauaucuucaugcaaaauaguguuuuauuucaucuaugaccaaaaaauaauucaggagcuaggaaaccuuagcuccuuaaaaguaaaagacuguauuuugggaaagaacauuguuacuggaauuuauacugugaugacacugguugguagacacacuagaagcuuugaggagugugugugugugucuuugugugucuguguuugugucuuugugugucuguguuuguauauguuuguauauuaguaugauauauauagaaguacauauuuauuuuauaaaauacugguaguguuuaauuugugcauacucuuuaggggagaggguauugaaauauuuuucuggguuggaaaaguuuuuguacuuacaugcaaggcugcucuaaaaucaagcaccauauugaaacaucacaaauauacacuaagcaagggacagaugcacaaggaauuuaagcagaguuuuucuaaauggcaaauaauuagaggggaacagaugccuaugggcagcaaaggaugaaaugagguaccaggaauuuuaaaagggagauggaaauacaaauguagaaugcaguugcucucaaggauguuuaagccuagagggugugcuugcccaaaguucacucuuuuuguggguauugacuuaaauuugguucucucuucaccugucuuccccaaagaaguagaugaugcuaaucauucugaaguggaacagauuuucuguggaaccucaguuuuggaugaucuguggcugcaucucuuucuucugccucccuagggucuuguccuuuuauaggacugccaggauaugacauuucacaaccaugucaguucucacuuauuuauuauuuauaccccauauccuuccaaaaggguuuuuagguagccuaccaauaaaagacacguaugaaaauauauguguguguguguguguauauauauauauauauauaaaauuuuuugucuugguuuguguuuuaggauggacaugucccuucuuuagaaacaagucugcuguaaaauggguuguauccaucucagagcuauucugcguagucuugauguggaaaaggaaacaaaucuccaagaauaaaguagagcacuaggcauuucccaucuuccuguagagugguaguuuaaacagcaggggcacugagcagagcgauugagccacccagcaaagcugagcuguagcaccugaucauuaucccucagguuuaagauuuaccuguugugcucauuguaacaaaagaaaugaaaucucuguaauuauauuggaagggggaggagaucguguuuuaguuccuuugaucuugagcuagaauaggcucugcuuuuggaaauuuaauuugaaagagcccaacguacacaucugcuuuuuguacugcaauuucuauugagcuugaaaauagaaauuuauuaaugcaaauguguagagucuguuccuugaggaaaagauauacucauucaaaacacaaggugaucccuuccuacauagcuauggaagauguuaauauguuuucuguuuuuuuuuuuccuugacuucagauaugagguuccuugcuaacaaggacuaagcauaaaaauuauaggauccauuggggaauggaaagauucauucaauacuuaaaaguuuccaaaggacaaauucauuggugaagagcugggggaagcauacugaauccucaaaagaaaaaaaaaaagccaaaaacaagugcaucaucaaaccauucugaaaauauguuugaauugaugauagggcccaugcuaagagacaaagcuuucauuucaacgaauccaaucugccuaguguuguguaaaauugccuuugccuguaaauggaauggcaugcagauuuuagguaggacacuuucucacccaacuuagccuguacucuauuucauuuuuuccaccauuacaugaagcuucacauaaaugacaacuugacuuaauccuuaaaguggcuggauuguguggucuauuuugauuaaacuuuuucuuguucuuaguguaaauuuucaguaaugccuaaaaugucaugagcauuuugggacauaaauccuuuaagcuauuuugcagucauauaguuguucuuuggaggguuugagugcuuuccuaaacuccuucucaucucuaaauaggcaaaauaaauuauaaauugucgagaacauucaaucacucuucggaugagcaggcaucuccuaaagcuggggaaaguauccauuuucaauauuuugaguaaauauaguugauucuuuauaauauuuguacuguaucaaaagaucucaaaaacuguuauaaauuaccuagacuuaaggaagaagacaugauuaaauaauucauuggaucaauaaaaccaaucugcuuuuuucugauguggugugaugaaguuuuuuuucaaaugggguaggugggccucagugcuguguauuauccuuuugauucuauugguuacugucuuucucugcuccccccuuaguuguuguuugauauuuuugugcuuuuuguuuguuuuguuuuaaagaaaggaaagcugcaagccauagaaaguuaggcugugaguuaggaauucugaguuuaaagcagggagccugucccuaacuuuguguuuaaguugguguuucaguuauguugccaguguaagcuugugacccuuacaaauguacaauuucauuuggguucagugauuccuggaugaguuugugauauaggaugccaaaggcuguggaauuucuuuaagacacaaaaucuugagacagagcugauuccuuggaagcuuguggguaacuagagucucauguuaacuaaucuggagggggcuaagaaaagucuuccuacccacuuccaauuaauuaauuucuaacauuuccaucuaaucaugacuuugucgagugacacacaucuuuuuuccucacaggcaagaaacucacacacaaaauuucuauuucuaauggcagacaguuggggugccgcagccaagcagucacccuuaaaaauuaaugagcguaaugaugguuagaaaagcgauucugauggugguuggagagggaggggccauggggauggcagaaggaggaagaccggacuccucauaagugacaaugaugugagccccuguccucaucuccccucccauccccccuuccgcccagucaccaccccuuccauccuccucucuuuacaggagccaaagcagauagaaagacagggcgauuaugaagacgucaguuggaguguaggcaggcgagaggggcgcagcgccccagaugagguccggggggagcugaggagggucacucauggacgaccgugugugugugucugacagacugugaaauggugcguuguugcacggcugcgcugcaccugggcccuucaucugugauugauugguuuggucauguguaauggucccaucugcucuguguuguuuuucuuuuuuuacuuauaaacaccguucccagaggcugagagaggaugagcuauguuuugucaucuucacuuacacuuuagcucaaaaaaguggucaaguagguaagcucuaaagucuguccaaguaauguaguaggaaaguacgguuuuuccccuuugcuugauugugugugugugugugugugugugugugcgcgcgcgcgugugccucuccugcgcacgcgugugugcguggaguuuuaaugcugccuguuaauaucugaauaguucgugaaccacggaagaccaaaauaucgcagaaaugauuugcacaacucuguguauugugacucuuacugcagugaggauuuuuuuuuguaacggagccaauacuuaauuaaaaccgcugacaucaugguguuauaauuaagcguggcauuaauuaagcuggaauaacgauuuuuuuuuauuaagaacugcuucuauuguauaagaccauuaucgccuaaaaacaaaauaauuuuaaggcaaaaauaaauuugcuuuaaccuagcccuuuucaacuucccccaaaguccggccucaggacugucaucaucagggcuccgagucugugugugcgugugugugugagcaugugcguguguguguguguguuuggugguguuggguugggggagaguggaagugaaauuuguuuuuuuucacccaaaaaugcugaucggcuccuggcauucugauggcuaauuaugcaucggagagcuucgacagcugcauucaucaucauaaaauguaauaauuaaugacauuccaacaaagaaaaauaugcaaaugaggacucauuagcauuuucauauucagcuuugauaaugcuuuugcugacaagguuguaauuaaugaaaauucaugucgcagucaggagauuggaucgguuucauuccgcucacaauucccaaaugcuugcauuauggaaaaucggcggcucugccaacuuuucagggaagaaaaaaacacacacacacacuaaaagcaccagaugcaaauuaaugguagggagucuuuaacucuuuaaaccaccccccuaaauuuccaucauaggaaacaugugaugaguguuagccuaagaacuagauucucuuuuuuuuaauaauaggaaaguacuuuuauuugugacccaaguaugagaauuucuggcaaacuuuuuuuuuaauauuaaaaaaaaccccccaaacccuccaccuuuucccuucuuuccuuuucccuuucaagacuauuuaaauguacauaguaaaacauguuaggacagccaagccccagcauguuguguucuguccucuggcuggcagauucacgccacaacaguuuauucauccacaugcuuuuuggcgacucuucaucacguauuugggcuuagaucuucuggugccucccucggcgugcuacccauaaggucgaaagaaaagcaaguauucgauuucucuauucaggguggguuuuuuuuuuuuuuuuuuuuuuuggaugauagugguuuuuuuuuuuuugugcuuuuucuuuuuaaucuauucccuuugugguuuaguguaagaguuugagaaugugcccauaauucucucacucaacacuucugguuuaguguuguucuucaaauguaauuuuaggagacacucugcaaucaaaauggaaacccagaaaccccagagcagagauaucgacaaauauuuaacacagagagcuguuaauuuaugaaagccucuguguguugcuuucaaaauguggaacuuuagguuggcaaauguacacuugaugccaaccugguaccauguuugacagacaagccugaaguuaaacugaaaguucuaucuggcccucaagguuagaaagaaaaacuuaaacagagucugacuucauuuucuauuugaucuuuagguuaaaaaaugaugauuauuaaaacuggucuuuuugcugaggcagauguuuuaauaaaagguuuguauaaugauuaagaaaaagggaaaauagaaguguacuucuuuauaaauuauaacguuuauaagcauuuucacucucagaugaauaaaaugacuucugggaguuccuaagaugcaguuuccuguuuauuuaaaguuaaauuguaauucccaaaguugcuagcccagcauaaauaaagauuauaauacgccuuguuaagggaagagagaaacuuugauaugcggggccuuauuuuuuagaguauuucaguaaaacagaaagaaucaucaguuauuucacgaaaauuuuaaaauaaaucuuuuuucccuuguaugugauuaagaaugacuggguuucauuccuuguuaaacucuugggguuccaagaaacagaauuuuauuucaaucucuugcuucuuccaacuuuuauuuugucacaguuuguacaugaaccuguguguguguacacaggcauguguguaaauguguguguguccaugucuaaagauuaugguggcucuguccucucuccuguaaaaucuauugugguaaaauagcaggcaaaagaagguuuuacuuuuuuuuuuuccuuuuaguuuauuucuuuuuuugugugggcaaacugcccauccagaugguagaauuucaccuguaagcaaucugaaacgauagguuaauucugacauuuuauagagcuuuuuuuauuuucuuuucacacaguacaacuaagugcagaauaacugcucaagauaauguuucuuuuuuuuuuuuuuuucuuuuaaagcgcuuucugcugugauugguucuuuuuucccccaaaucugaauuuggggcucauuuaaaaaucuguggcuuuaggcacuuugcuguuauugucaaaaccacaucuaaugaaaucuuugaccagcuucuaauauguguaaaugaggaagugauggcagaagugaaaaagcagguuagucgccgagaagcagauccuuguaauuuuauaacgcugaacguuccacuggcuuugauaaauuuacuguuaguuuucuccucccaccaaauucacagauguauaccaacucauaacuucccaaguaaugccuagcaugguauuagcccccggaauccugggacuugcuuuuguugucagugugguuagccucugguggcuuaugugacugaguaaacuggagaaaaacuucagggugauucguugucccgugaucaaggaaucccauuauuuccaaaagcggguuagaagauguuuuuggaguagaguguggaagggaaagggaguauuggagauuguuuuuacacauaaucaugguaaucaugcuguguugacaaguuaguuuugaaugugccaccuucuuguuuuuauuucuagaaaaccuucauuuucaugaauuauuucuugagcugaugauaaagaugacuuuagagacaucuucuccccugguguauuccuuuagggaaacguuuuugaaaguguuucccuuuauuauaccuguaaggcuugggaccuuugucauggcauuguuuguuguuuuuuccguuuccuguuuugcacguguuaauuccugugggcauuuucuuuuuaaagugaugggauuuccacuguccagcagcaagccacauuuacuggaguuauugaacucuguaauaggaaaccugugggugaucaguuuuacccucccuagaagauacugcuucagucaaugagaauuacagccccaugacugagaauuuuaaagaagggguuccacuaagacacccagauguuuuguuucagguguugcaacaaaaucaacauuuguuugugggcagcgaagccaguguuccugccaguauucccguucagucgcuucucauauuucccuugcaaacuuucccauugguuggggucuguggagagauuucaguggcuggcugguggaaauguuugggagaacauuugcguaucaaagcaaccuaaauauuugcaaaaauguuugcuugagaaaaaagaauccacuuaggauuaggaaguaacugcuuaaacauuuuaaaagcauuugugauuucccuaaguauauuacucaugagccacugccuaaccugaauuucaggggucacucuggaaucuguauauuuaaaaacccuauaagauaauaaagguuuugcuuuaugauuaagaucugaauccauacauuaaaaugaaaaaacacuugacaagacaaaauauauuuuaagaauuguuuaucauuuagugaaccugcaaaacaaaagguguaaagaaagggccucaugaaaugguuggauguugaauaccucuaacgucauucuuucccucuacuguagauuuuuuguugguaaaacccaauuguauugcuaugauaugacauuccuucuguuggaguccauaagcuuucuuccagugguaaugauuugaaugucagaucuuuuucuugaguuuaauguaggcauuuucuguccacauuauuaaaguuucagcuacauuuuacugaugguuuggaaacaguauguguaaaacucaguguaggccaauuuuuccaauuuguuaacaagguaggaguugagcauugacaauuacuguacuuaaaagccccucggaucagguguuauuuuaccaucuggacauuuuaauuaguaauaaaaguguggaucuggauacacagaaauaggaucuacaguacacaauggcccaaugcacucuguuggugcugagguguauguggcuacauuuuauaaauauguauguaugugugugugugggcaaguguaauuaugugccagguguguccuuuuucaaacugggcacuaacacaacaccaaagaauuuggcuacuuuucuuagauaaaaaguaaaaauguauaaucuauaaacuugcacauaaguaaaacuguaucuuuuuaaugcuccuacuuccucaaguauggcaugacaaaauauaaugcugacauuuagguaggccugggcaaaagaugugacucuucucuuucauagcugugugcucuaaggcaaauaaauuaaccaccaaguaucccuuuuuucucauauucagaaugaaaguauaaaugauaauuguuaugguaucuaccuaacaggauuaugaggaagcucauuugagcauguauguugaaaagcacuuaaugaaauauaaggagucauaacaguucuuaacaauugauuguuaauacaggaugcagaugaccaauucauaccccacauaccaucuuuuauaauucaguaaaucaucucauauuuaaaaauaagggagaugcaaauauaauguuacauuagauuauuaacaaaugauaaguuuaagaccaccagaaaaaaauguguucauaaguuucaacauaaagcaaaaugacucauucuuauaaaguauauacaggcucauugacgcaauguuauccuuaauuaaggcaaaagcgaugcauuugagggaaauagugacccucuggagaaauagagaaugaaaauaguuuagggaaaugaaucuuaacaucuucucuuuuggaaaaauucaugcauguuucucuuaaucauuaugaauuucauguuugcaaaccagugugaauacuuaaacgauaaucauuauuguuuagaaucuaccuauuacuacacacacagauacacacacacacacacacacacacacacacacacacacacauuugcucaagaaaaucauccucaggaaguaaaggaguugauaaaauuaccauuggagcagaugaguuuggauacuucuacugaaagcuguuucaguuuuuauuauagguacaguucucccccgagaauucuuugggagaaauaaaaacauuuguuuuuaauuuaaaugagugguaacaugcuguagcauaauauuaacuauuucagugauuuuaucaauuuuaucuuccucugccuuaauguaauaaaugcauaucuugauuaaguacaaaucuuuacauuacguugucccuaaugacaaauauuauuuuaggcaacuuaguuuuaaucaucagagugucuuagggagcuuauaaaacuugucucugggacaugguauuagcaggauguacagaguuccuuuuuggugccaugcuaggaggagagacugacagagucaguccaguccauucauucauuugauagauaauaaguaaaccacagaagaaacgagaauaugucaguucugacuguacagguuuuaagauuuuuuagacuuaauauugaaaacuaguuuuacuuaauguucuaucaguuucauuuaaaugcccuaauccaaugaucacuuucauuuaaauauccuaaucuagugagcagauagggcuuacauagcauuugucuugaagacguuuuaaaaaugcagcugcagguccucaucuuugaaacuccauuugguaaaaauggccaugucuaccuuuaccuguagauuuaaguguccacagucgcgggaugagaaaagaaauugugacacuucuugaaaaauggucucaucaaagggauucaguugaaaaugugagggacugcauuuaaacuuugauaaaaaaaauaaguaauucuaaguaaagucuguagccaaacuccuuaauugugaugcauuugcugaguuccccucuuccgucgucgggccugcucugaugccauauggccuaccauggaacauuuaacuugucagauauaauggauuguccuggaagcagauuuuugcuuugagcacucggcuccuuucuugcauuucacucucagcuccaggcugcaggaugaaggauugugguagaagugcaaagaagagacacacaguugauuccccuuaagagagugaccuauaugccacaaaauuuuacccacguaaagaggcauuauccccgucacuggccuuagcaggcugcaugucaaagucauuuaaauuucccuggacuuaacagauuguguaaacauuucagaacugagagcuuaggaauaaugaaacaucgucauuuuaacuuaggcaaaaauggugcagccauauuggccaaaggaggcauauuauuuauugugaccuacauguaacguagaccaccugguuuuuagauucuauaaauuaaguucucucaaguuuaugaaggaugcuaaaaaauauauauauuaugauggaaauguuacuuggcuuuauuguuuuuguuucgugaauagagaggugagguugaaaugaucauuuaggaaucgcuucuuagccuuuuggcuaagaucaagugaaaugaucauuuagguggagggacaguggcagcuaauuauccuaccaggcuuucuagcuugaaacuuaggggcagaccuuccauucauucuaaccuauuugaaauuagagauuggauguguuauggacuauuuaauuuuuaucuguaaaaguaaauaauguagucuuuguucauuuuaauuuggugcuuuuaugaguuaauuuuuuuuucaauuugugcuauuguuucaacaagcuuggaaaacaguaggaacaauuugugacuuuugcaucuguaggaaaacuucuuuaaaagaauaaacagugcccuaccuauauguguguguacauacauagcugugagguacucuucugguauaaccuacuguaaaccccaaagcaaauauugugauauagagacacagaauagacaauuuacaaguaaucaaucaagcacaaaccagugggaaaauaaggaacuuauguaucucaauuuauucuuuaaaugcuacauauuugauugcuuuaggguugcaaaaguuaauuaauagauuuguauaagacacacagaaauauacauacacuaaaagagacuuugcuaaguguaauucaauauacucacaaaaauauguguuaauuauguuagaaauuuaauauuuaauuuaauuccauaaauccuugcauuacaaauaaguccucauacaggucagauagggcaauaaaaacuacuguggccuugaaaacugacagaagcucacuucuguacaaaucuuuuuaaugaacaacuuuccaucgagcagcuaagaaauaucuguuaaagucaguauuuaauacuaaaguguacuuauguauguuucuuacugauccuaaauugagcacguuaguuuuaucaaugccacucaucggcugacuguaccccuccucccccauacagauuuggugagacuuaguacuaaauaaguuuggggagugccuggccauagccggcucuuguuggggcaugugcgcccucugcuggcugcucacauaggaacugacuggugugugagguucuuucuuucuuuuacuuuucaagguuggguuuuuuuuguuuuuuguuuuguuucaauuuauuuuuauacaacugaucagauauuuaccaugauuauaaaguuguagcuuaauacugaguauggccguuaauuuguuuuuauuuggaaauaaaggugagguuuuguuuuggguguguuuuugguaaauagauaguccugauaguucaaauaacaugcaauguguguaauacucuugaguuuuuuaagugguugauuguauaucacgauuaaccauauuuucauugcuuucauauuccccuugccuugauuguauuugagaaguauucuuguuggacuaaguugggaauagaacuuaaaaggggauagauaagucauugaaauuuugaaauaugauuauuugucuguaauggaugugguagguaaucccuaguagaaaaauuccuguuaugguugguugauaguuuucacuugcuuugccaaggaaaaugaguauauuuacaucauaauacuuuauaaaagcauuuuugguuuccuugcaaaccaaauuaagcugugcucacuggcagacauugagaaugguaguuugaguaaaauauuuuuuguuuuguuuugcuuuugcaguugcuguuuauagaguaugagauguuaaaggaacaaaucacugauggucucuuuacucccaggacacaggacuaaacuauacaagggcaguuacagaggaagagugucagccucucuaccauugccuggguggagagcauccuuggguccugguagugaaggccagggcucuguguaaugagugugucuuuuaaaaauagcaacaauuuuuguugacaaggcuccaucaaagucuuuauaauaauuuaguuuguauaagugauuucuguguaucucugaaauuaaaugacuugauggagucaguuugguauuuguuguacagagaaggcaguuuagauuuuuauaguucuuuugucuuacauugcaaauuuuucuaauuuguaagcaaaagccauaaaaacuuccaaaccaaccguggagugaucaaagaacuuagagcuguggaagggcagaaaugucaucuacguuuuuuuuuucuuuucuuuucuuucaguuuuuccccuuugcaauuuuagguuccaguuaccuuaaaauuuguuuuggauaaaugauauaaauuuuuacuuaauagucuuuacuuacuuugauuuaacauugucaaauaacuaagaauugcauucuaacaaauauuaaguccuuauuaccucuguuagaaugucaucuugcaugaaaucucacauacaugucucuccuguuaccaccuugucuucaaugagguuguauugggugcucuuucuuggugcuucucuggguucccauuauaucccuuacugguggauagcauuguguuacuccugguauuuagucaucuaaacucuuaccuccuugagaauaaugugcauuguugacucucuugcauccagcacauguuacacagaaagcacccaacaaauauuaaauucccuauauuguguuuuuuaggccucauucaccacuauucagaugauaauuuuugcaaguuucaggauuaaaaauuguggucuguaaacauaguauauguaaugcauuuuauuuucuugcauacuuuuuauaggaugaggucauucuucuggcuacuccuugucugcuuucuuuuuucucuuuuuccucccucucauccuucccucugccucuccucuuccuuccugugcuccccaccuuccucucuugauugagucaugcuccuagauucagucauugagaggcuucucuuaaacacugcagcaugggaccauucaucuaccaaccuuccccuuccuugaacaauaacuagugcugcaggcugguuggacucuggggaguguggcccugcguaucuggcaguuugguuauuauuaugggcccauucucuugaaguugaucuugaagagcaggcuuggcuggaaaacaucauucuucuauaaauauaaugguuagcaaucuuccuacucuuugucuuccuuggaauguguuuucaauucugggcuguuccucccacuccccuccaguuucucucaguagugcauguuuaggggauauaggucaauuguauucagugcuaaggcuagagaaaugaucauuuaauauauuacagauacguauacaaauggcaguuggauuaucuucugucugggguuaaaaaugucacuuauauauguguguuuauguauguauuauacauaucuauauaccguauauaacauugucauguccccccccauucuuuugauguaguuuugaguaucauauccaauguguauaguuuaagagaugaacauuguuauauucuuguucacuguaaacuuagcuugaaaguuaaggccaucaccuguguaccauggugcuaaaauacauaauuuuucuauauagacaacuaagugccuauguagacuacucuauaacaaacaaaccuuuuccucucuuuuccaucucacuguggcuuauuuagaguuguaucauuuuuaucuuuuacauugacuguugcuaagacucugguggaacauucaguuaagugagcagcauauaauuuaugauuaaaagugauuuguguggugaaaugcggcugcugauuuccuucauauuuuccaauaaauuccaaaauauuuagccaggcaccaaagucuugcccagaugauguugucucuauuacauucagccagaaaugucacccaucuccuccaaugaaagggaaaggaccggauuuucucccucacuguggacuugucaugccuccacagaacguggacagagaagggguagaaggacccuuuuaaaugaacgaaccaggucagguucacuagaguuggauccuggauucuaaaggugacauccacucuugagauagaagagagaugcuuucagagcagcgggccagugggucugaucaaugaggagcaaccuuaacaaaacuccgggauucucauauuuugggauacuguuguuuauuaggggaaucgauuuggcaauguaaaaucgauuucuuaaaaaaaaaaaaaacagccuucauuauuggagaugagcacauuuaaaggccuagcacgcugccagagaaagguuucucuaacccaugaaauguaacugucugaaaugaccuuggggaucaacaaguccuugucuuuuaaaaaacucugcguaaauaggugagugcuaguaguaaucuacuuuuuguuaucuaccauguuaccaggucuauuggaguuuuagcuaauguaaccuauagagcugugccuaucacuuaaauugguugcuugucucccuagcuggucagaauaaccaguggaauuuuauuugcaagaaaaaaaaaucuguugggcaugguggcucaugccuguaauccuagcacuuugggaggcugaggcagguagaucacuugaggucgggaguucaagaccagccugaccaacauggugaaaccccaucucuacuaaaaauacaaaaauuagucggaugugguggcacaugcguguaaucccagcuacucgggaggcugaggcaggagaauugcuugaauccaagagauggagguugcagugagcugagacugcaugccacuguacuccagccugggcaacagagugagacucugucuuaaaaagaaaaaaauaaaaauaaaaagagagaaugccagacucuaccgaauucacguaccauggagaagagaacccaggaaucuguuuuuaggaaaagucuugcugauaauucuccugaucagcaagguuucuuagccaugaauugaauuugaggaaauugcuuuucuccacacucaccaucucaucacaagucuuccuucugccuaagaacauagugaaaauauuuuauuucugcgugcuuuugacaccuuuagcauguauugcaagaugagcuuuuuuucauuuuuauaugaaaaacuauuauguucuuuugaauaaaaaauaagcuuucaaaugcauaugcuguuuuuucuaagaccacacaaguccuuaauugccuugguuauauccaauuaucauagacucaaacugcaguaaaaauauaagauaggguaggcaucacugugaagauguuauucacauaaagccaaugguaaguuacucauuagaaguaaguugagugauuucaggguugcccuuaguccuucaggucucuaggggacccuuguacaaauugcugauucagaaaaucauuacuuuggugguucaagugguacuuuaguggccuuaaagaguuauuugacacaccuccccaaacagcuaaguuauccccaugauuauguugauuaauugcacacucuguggaauuaguguuauuuucaaugaaagauuuuccugcguucggaaaaucaagcauaaaacucaugugcuuuaauuugauaauguguguacuucuccuaagcaggaugccaagugaggggcugauuuugguuguuguugucugggccaugugaaaucaucuaggacaauauuuuuauucugcacugaaaagguaguuuuugauggacuguaggauguucacucaaaaugcuuaucgauucggacauuuucauccaucauggaacuugagaacucuuugacuuuaugaauugaguuuaaauuauuuggggagaggauuacgguagugagaaggcaaugguuguugcuacaguaggcacuaauaaugauacaucuagaaaacuccaaacggagguggcauauugugggaaagccuugguacuggaacuggaggucugugugcuaacuucaccacuucauaucugugcagccuuuuuaacuauaugagcugguuacccuuaauuuuagugacuucgucuauaaaaacauggacuaaaaugcccauuuaaugagcuuuuaggguguguugccuuaaauaauguaaguuaaauuugcaugcgagauagugcauuacaaauauaagugcucuauggagaauugaauauagaaucugaaauucuucacuuaggcagagcccugaagugaagacuuuugguggcaccuuaagauacuaucugggguuucaguacccacacuguguuaaaggcagcacaaugccuagaugagaugaggggaaucagugaugaaaugcagccaaaacuccccaauuuccagugggaucagagcuauaggccauuacugaguauucuauuuuuaggacuaaaagaacaucagcggaagagagaguuaaugccagucuuuuccagaaaaaaaugguuuacugcccauuuuucauuaucccuugauacauacaagcuaugugccuaguuaguuaccuuuucccccauuugucuuuauaggauuuccuagguuguuggaugacuaguuuauuugcuggaauggaguuguaauucuuuuagcacaaauuuauuuuacauuuagauuuuuaaaugacuguggaugaaggcagaguugucccuguaucguaagauucuguaggagagaaccaguacucuucucugaaauguuggaaauugaaagaauaaugucagcuucugcuuuuuuguaaacccagagucucaccuccaaacugggaucaggaguaaaguugacuagcuagucagaacaaugaagcuauaccugcauggccacagauuaccguaagacauauaagccaauagaaaccagcaaauuaaauagucaaaauguuuucauaucaauuuaaauaaaauaaaaauuuaauuuuugaaccuacaucauuuaucugauagaaaacuacaaauauauaguaaccugauauauucuuaguguuaaguuguaaauaauaguaguucugaaaggucaucagcucuuguauuaauagacacaaaaaagauggggacgggcauguaugcucaagucaguuuaggaaacauuguauaaaacuaaauugaaagccaaguacagugucucaugucugugaucccagcuccucuggagagcagugcagaagaauccuugagcauaggaguuagagagcaccuuggguaacauagugagaccccaucucauuaaaaaaaaagaaaacccugaauuaaaugucuuaacugcaguacuucucaagagucuuuaacaugcuagauacaauguaaaucuguuggggggcagggcaauagcuuguaacaguucguagauucuuuuaauuagucucccuuuugguuuuuggagcccguugugggaucacuauucuauagaugacacugagugaugcuggguuguccuguauuauaauuauauuuuuacuuuuacucuucuguacaucuuaauacaaagacauagucuucacauagagguguagaaaugcaguuuucugccauguuuuuguuaauuaguugcuuuguguuaaugugcggagaugguggcaguuuauuguaagaugucacagaauccauguguaucauuugugcagcuauaaaguaccuagagaccuuuuaggaauaaaacaccauguaaauguaaauuaucauugccuauaagacacuuucauuaauuucauaucaaauucaugaguguuuugagcucugggauuugagagucuucagugucgggccucuaguuuauuuauacuuuuuuuuuuuucccccagaguuuaaacaccagcagcauagcauagugcuaagagcacagucugggcaaacaaacugccaggguuugaauccuggcucugucacuuguaccuguguggcugugggcaauuuucuagaucucaguuuccucaucugcaaaaugguguuucuauuaccugccuuaugggguugugcagauugaaugaaucauuuuauguagagcuuugagcagugguuaauacaugauaaggacacagcuauucuuauuuggacagggaaggaaaaggcaggcauggaaacgaugaaggacuguaaauaauaaccucauguauguguucagaacuacuaaaaaguucaguuguuguuuaaugaacuaguccuuucuacauauauauagauucacaggguaaucagagauggaugggacuggggauggggacagaaauuuauucugagucaaacauguuuaugaugaguucccuagucugaugccagggaacaaaaggcucauucuucaguucccagaaugaggauuaacagugaaacagccuugcuugguguuguccugcagcaucagauaauuuuucaucaaggcguuucacgggaugauauauucucccauauagaugaaucuauuucagcggugggugaaacaccuaccauuuauauauaauuuuuaaaguggcauuuuacaaaugaaaggcuacacaaccaaacaugacccuguuauuauccuacuggucaaccacaagagggaucaucucuguuagagcuuaucucuagaaaucauuuuauugauaaguugcucgucugucucuagcucuuucuaggugguuuagaacugucauguguauccaggggcaguaaucuaccaaaggugauccuucuuagaaguaucccuaugaguggaauggauuuaugagaucauuuuuuucccuucauguaauauuuucauugucacccaguucccuuacaauaggauaccauggauguaucggaagaaaaauuggaagucaaauggcugauaauacaagaauauaaaaauauucaauuugaaauucuauagacauuuguuaaccauaucacccucaaauaaaaagcaaauuuuccugcuccuucuugggacagcaagauaaaagauuguugaauagaucagcaaaacauugacuuuuuuuuuuuuuuuuuuauauggaaguugcuugccuuuccugcucauauuaguuuuucugggccaggggaagcaagugaauccuuuauugauugccauuuggugccauuuuuaauaaucaaauuuaaauauaggcuuuagcagcggacggguucgauuuggacagaacacauguugacuuccuggacuguuugcucacuggagaugccgacuuguucuguagacggggcugcauguugaucuccuuugucuccagaaggauugauugacggauguugugucugcucauuuacagcguuuuccuuguuuaauuuaaaaaauugugacauaguauuacauguucccuuguauacaucauuuuugcagaagaaaguuguuuagccaauaugucgacuuaguuuaugaaauccucucuauagcuuucauucagcccuucguguacuccauuaggucauauucauuucaugcacggcaaaucgucaccagcagcaaaauuuaacauuugguccuuuuagguauaaaaaugaaucaaaugccugacaagauuuguuucugguauauauuucagaaucuccccccgccccccgcaccaaccccaucuuuaugggcauacaacaaauguuacuaacggguacuuuuaguuuuaaaaauauggacaacaguacuccaugcaguaaaagacuugagcgauuaaugcuacccuuaugccucuuuugaguaguuuuagccauggggcuuggcacugccaccauugucuuugugccaaaaaauauccgcagcggcugucgcauucuaguaccggaggguugucucgaaaauuccgcagugaacgcgccggguuuguucaucacugcuaucucuuuuaaauauuggaaaaauagaaucuuuagcucuuucaaagccccguugugguuguggggauggggggaggcggguggugaagaauggagaaaggaggaaagaggcuguccgcgccagccaguugguauaagugacaaaaauccaugccugacauagaguaaacacagauauuuaagagcuuuuguguucaugagcacagauaguuacuuaaggauccuacucaaacauguuaucagcgcucuugaaaauuuuauuaucugaaacaaauguuccaagugaauuuuaagcagaaaaucaacaucaagaccauagcuaauuuuuaauggauaauuuacacaaaagauaguuucuuuucuagaaacugagguguccuuuuaaaauggcugcuuuuagucuuuaaaaaaaaugauaggaaucgcgauuuuauguuugagaaggugcgugggcuuuauccacagugccugauuauuuugcucccaaacagggguucuggcucugagggcagauuuauaguugaauuggggaacaaaaagauguaauaaaguuaaaagcuuacacuaucagaaugaaauguguuuguucaugaucucuggaccgaucuauuugaugguaaaaguggaugcuacagaugaaaucuuuacaaggagcauaauccuuaaaaaaaaaaaaaaaaaaaaaaaguccaccucccagccuccugcuggcugugcugccucuuugguaccucgcagacuucgacagagcccuggacgggugcccauugaugucauggaaacacucaaauuacugagaaugauucaugucuaugcuggucucuuauccucccccacacaaacaggaguagauuuuuaacccugacaacuuguaauuugcaguggguuuauuuuuguaucuggauaaauauuuuuuaacaagcaaaauuaagauuaagcagucuguaucugauaugauaguaaagaaugcuggguuccauguagccaagaguacuuuggggacucugcagcgugaauucauauucuucuccuccuccucucccuccugccucuuucuuuuccuaccucuugcucuuugcauuccacucuuccucucuuuguuuuucuccuacuuauucucucucuccuuuuaaaauccugcccuuuuaucuuuaaaauaauggaaggaguagcccaacuuauaucuauaagugaggcaaauccuggcagaaagauuccucccuccuguucuguguguuggagucaaguugggaaauaaugcugaguggugaaauucuacaggggauagcuucaggaauuccuucuagagaaaaaaauagaugcuuuuucuuccuuaaacuguauuuuacaauuuggauuuuuagaaauuaccaaaacaggacacuagauguucaguuucuuaggaagucagagcagauucuacuuuauccaucuuucugucuuucugccugccuccuuaccugcccagcuuccugccugccuaucuaccuguuaaacaagugaauauuacaucaaaguaagugauguaauggugauauugaagcauucuuagaugcaagagcuuaaggaaggacacgcguccuuugauagcucaugaaggucgagccuuuucuguuaguaauauuuauagagagaaguuaaaggguauaaguagcuuaaauuugauguacacagaugaguaaauaugucuuugugaccauucacacugcugauacaaguauaaauuuaucuuuucuucagugcaaaauccucauacaauggaaguuauucuguuagaucuucuaagacugacagucugugcgauggugucuuguuucacugaaauugaaacugauauggggcauugauuuuauacuuugcgcugagcgcuagaccagaaauggggcggagguguuuucccaacuuuaagauucauuaaaaucaguagaaaaguuaauacugggaaacgggguuaauuuuaagacuuagguuuggcuuucuuugaaaaccaccauccauuuuauauauguaaugacuuggauacaggauacccuuuugaccacauagaaaaauuuauggauauaaauguaucaaagauacauucuuuguguggggucaggaaggcauacucuaauaacauugccauugccauugaccuaaaagauaaaaagacuacuguuacuuuuagcauucguguugaguugagaggggaaaacuuggggguuguaaacuucagaaggaaaucuauucagccucucaaaauacaaguuuagaguuuuccuguuggaaaaaggaauacuguaguccuauguaucaaguacaauuacuguaaagcuccagucuugacgaaagaaguauccuuuagacuugcgugggguggggucuuaggcaccugccugccucuuuuagccccuuuuaauguucugguauggacagauuucuacaaugauucuccacaugucacuaucuggacucuacugcuuagaucucuuguaaugugauuucauuauccucccuaaugauuauugggguuaaacuuuaaaaagaaacaaaugaacacccuugauuuuauucuuagauguggccgaauagcaucgaagggucuauagaucucuguagagcagucuacagauaaaaauuggguuguuagaauuggaacaagacauucacauuccaugaucccuuguccugcugggucuauugguggaaucugaacuuggguucagaguaggcaauuuuucaaaagcccuguuucccaaauguaaauuccaucaucaucuugaucaugaugggguucacuccugggaaagggaguuuuuaaaaaagagagagagagagagacucagaauuuugaauaguuucuuugcuaaauucaccaucuggagagccugugauugauuaguuuuggccucacuauuaagugucaauauaaucaaugggaauuacuaggcuagggucauuacauagauaauuugccugcuguguaaauaaaaaugaaauuguuuaaauuuugugcaagagaaagugaaaauaaggaguuacgauuuguuuguuagagaaaguggaggccauuggaaugacaguuuuuggaaguguggagcaguuuggcuaagaauaggaaugaaggauauuuuuuuccaguuuaucauagccagagugaggaaguguuauucccucucuugcuugcauacauugccaguagugccuacuuuacguauguaaacaucggggaagagcaguagaugucuguuaccuggaggagauuuuuuuuuaaggaaaaacacaauuuacacuuuuuugucguuucucuuggcagguaaaacagaaaggggcucauacucaucuuaugggagagaaucaaacuuacaggguugccaccagguaagugagaaucucuguugcggaaggguugagaggauuaaccugguaaaucaguuuguuuucuaaauuagaugaugcauuuuaaacugugacaccaaagaugcaccggcaagucagaugauggcucucucuuuaaguaaugaaauaacacagagcuuagaacuaauaaacaccucaucuuuagaucgcugcuguaucagaacuacauucaugggcuuguuuuuauuuuuuaauccaucagccgguaccaguggcacuguuugcaaaccagcaaugucggugaaagugguucuauuaaaagaguuuauuugcaauuaagaacuuaagaauuucuuacgcaggaaauacuucgcggagucaugugucagacccuggguuucggguggcuauugcccuaaauuauaguuuucauaggggcuguaugauguugugugaaaacaggguuguauugagggauaaaaaugucugugaaaauaugauuuguugucccuuuuuguuucugaauuguuuuuggcuggaagucaaggccagcaggcuaacagcaaagccgucucaagggaagcaugcgugagcuagaaaaauaagaguacuuuaauuaaauaauaaaaugccaguguaauacaaagguauagcauguguguguuugugucucugggcacuuugcauuuguauacuuuaaacucuccagagagagccuauuucuaaaaauacugucaauagcuaaaaguauaagcuuuguuucaagacaacugaguuuuuauagaugcuuucuuuuucaguucaguaucaguauuaaucauguauuuaaaaucuuuuuuaaaaauuuauacuuccuuuuuauaagugcauugguuucuuacuuuggaaaacucuugauggaauuuaauaauccucuuuaauauucagagcucucuacuguuuuuauuauucacgcaaacaaaauguacuuuuuuuuuuucaaaugcuggaaaggggaugcuuacucucuugaacucucucacccucugauguucuugaugggggaaaaaaaucuauuuuaauuuuauuuuaaacagcccauuuaauauaccccugaaaaauguaagcaaaguuuuguuuuuguaauuaaaucgagccuaugaggaaaguuuccuuuacguaccagacauaggaagguacgacuucugguggguugguguguuuguuuuuucccuguauauauuugcauuuuuaaaguuuacucccuuggcccagccaccaauucagucauauucggcaucugaaagauuuguugcauugaggugaacagugcuugguuaagagcuccugccggagugcaguucauggcaguuuguuuggaaagaauucugcaggaaagaaauuuacagccauuccagcgcaacggaaacaucuuuggaaugugagugcaaauguucgggcuagauagccugggcgacaagccucugagugcugugucucugguguaaagcucucaguuccugcagaagaccguguuccugugggucugguuucugagggucaaggcggaggucauuagaguuuuggggagaagaaaguugacaacauccuuccuuucugcagauggucauggcagaggucucuguuuucgcugggccccuuuuucuggucauugagagaauaggcuuccucaccccuguauccuuucuuacuaauaggaauuggcgugauuccucacagacacaaagauuuccucugcugaguaagcgugaggccccuuaacuugugaaagcaucauccagaccgugugagucugucuguguaugugcagaacacagacccuccuuucuccguuuguggggaauacuucccucgggugaaacugaaguuaauuuuuuuuuuuuuccaaacacaaggugagaaguggaaaggggcagaggguggaagagagguggauggauuggcaugugauggcugaauuucugggccuugggagguucguuuugaggcauuaauguccaggaaaauucuuuuguauauagcacuaugacugcauaugcuuuucuuaaaaagccuucguaauguagccguggaguguggagauuccuucauucuuaauuugugcuucaugguugugagucuugcaagagucuacuaucucugugcuuagcguggucgcagcaaucuccauaaacagugugauuacuuagggauaaauaaaagugaaauuuuggaaauuugcugacagagggaaaauagggacugaagaugaaaaauguacagaguaugaauuucugcuuucugugaaauuugagaauagaacagaccauagugugucuuccagugaaucaguuucucuugugccguauuguuauuugaaucccugucuacaacaucagcuaugcaaaccaaagagaaaggcaaaaucucaguaucuugggcuucaagucuaaauagcagaucacagcugaaaugauuccccacugugugacaaggugagugacucguggaggggaggcuuuuguuuucuucuguuuacuacaugauugagauacggaauaggaaaccuucagauggugugcccuaaggagcuccaaaagcugcuuuaucguauuauaacaguguauccuauggacuuaaaggggugagcagugcuauauggaaacaugcuucuuccagucucaauagccuuuuguuugguguagagacagaguggugguaagcaacagguagcaaagcgcuguccuggaggaauacauuauuauugugagacguguguuguuucagaaauauaucaaguuaaaaauagauauauauuuuagauuucuccuaaggauuuaacacuaauacugauggacauaugacgcuuuuuuaaauggauauauuuuagcagaagaaugaaagccggcagguucuuuauuagcaauuaaguuguuuucauuaaaaauaguaaugagauauuauuucauuaaugcauuuccaccugaaguuaucagaaauaaacauggugacuuuuugagacuuuuaaaauuguguugaaaaugaaucaauagauaagcaaaaguagccaaacgaacuuuuuugaguucuuacuaaauaugacaaaacuaauuuaaaucaaauugggguacagaaaucacacccagcuuaacauguucuugccaaaugguaaccucauacuccuuuuaacuggcagagaaaaugaaauuuauaauggaaagucugacagaaacgaaaaugagugggaauaaaguuuuuugcaagcuaguccaaccuuaauacuauaauagccaauaacuaaaacuuaaugggcaucauugcaaaugccagaagggaaaaaaugucauuuguuuugguuucuuuuugcugcuuugaauagaauguugggugauuugcaaacuuuuaaauuuugcuaaaaucuauuuuuuuaaugagaugaugauaucaaaacaaauacuuguuauuacuucuccccuuaaauggaaguuuagaguugauuaucaggaauuguuuguauuuucuuucugggauauagcccaggucuaaagccaugguuucauuuuuaguauugugugugugugugugugugugugugugugugugugugugugugugagagagagagagagagagagagagagauggggagagagagagagagagagaaagaaagcugccuaucugagaccaaucaaauuagaaucuugugagcugggccugugcuuuucugacaacuccccagguuauucuaaugugcagcuagguuuuaucauuuccuagaauguucuguagaaauauacccuguauuaaugacuuguguucaacauaugaccuugaaaaugcuuuuaggcuuuuugcauuaauuugauuauucaaggcauggaaauauauugcauaugaacuucauuuaaaaggcagugaaaauuagugauauagugaaaaucuucaaaucuuuauauagaauuccacaacugaaugucccagcccauaucuuguuuucucuagugaaguccaaggcuuuaaccucauccaaauucuuuuucuucuucagcaagugaucaaauaggacuuugcugauacaguuauuuaauguuuacaucuuaaaaugacuaauggaauuuaagaauuagaccuaaucuaggagguuguuguuaauuuccagaaacuuggagaccagggaggaaacauauuuucuuaguuugcccauaggcuugcucauuuuugguucaucgaaauuaagcauguaguugauuccaaaaugaauuucacauuucagaauugauuucuuugucuuguuauuuuuacuuuugauucaauagguauuacaaaugacuuaauucuaaacuuuuggccucuuuuaguuuuucuuaucuaaagucaaaauagaaaggauguaagugaaaaccguacaaaauuauuuuguuuauuacgaaauuggcaauugaggccaauuaggccuugcgcaagcagaaauacacaucgcuuuuuaauuuacuaagaugccuaaguguuuauccugaguguucagcacauccaucgaggucuuaugcauccuuccugggaagcucucccuugcagggccuuagcaccugucuucaucgugcuuuuuaaaauuugccaucauuuuuauguguuuguugcaugcugauuuccacaggauucuguaaacuccuggagggcagggaccaugucugcuuuauccugaauguguaccaugugccuagcagggcaaaaauugcaaugaccuaguguuucuuuccucagcaucacuuuuggaagccauuuugagggaguaaggucugaauagcaauguacaugaaccauauugugagcaucuuuuucaugccuacgaaaaccagaaaacugcacucucccaaaaaaguccuuuggaagcucuuccuucuaacaugcugugcaggcucuggaaggacaccaaagucauaccguggagagacacccacucugacuuuuugggggguugaaucgucucauucaccuggugacuucacuguucuaggccuguauaucuggaaaggccugaaugagggaauuauagaugaucugugguucuggcagagguguuguuggaaccaaaggucagcauccugguccgaacauugaaauguagcagugugaaugguaggacaggauauuuuaaauugugacaguuucagacaucacagggccugaguuugcaguauauaugucaucgcagcugugucccugagcgguauuuuucgggcagcggcuuauucauuuugggggauuguuauggguauauacccuucuuucaaaagucagccgguacuuaucaaaggggagaauggguccauucuuucauugcauugguuaagaaauacuuauugacccuguagugguguguuagauacucaggagaaaaaccaagggaucuuguauaccuucccuucuauccccaccagcagcuuccuggauguuaacggggaaaaucgagcucuauuuauuuauuuuuauuuuuaaccuuacauagcauaaauuuuugagcauccagaacaguugaaaaaauaauaaaaugaaugccacauaccugcuauuuagguuaaacaguuguuuguauuuguuauacaguauuuucuuguguguauguauaauauguauaagaauacauauuuuucagugaaccaaccauuuuaaguugcagauuuaauaagaaugcacccauagauuuuucaguacaugucucuuaaaaauaagacauuugccuaacuaacauacuguuauuaucccuaaagagauuaacaguaguuucuuaaucucaguccauauucagauuucuucaguuguccucaugcaaaugucuucaguagcuuucuuaaaaaaggcaacuaaaaugccauuuacgcgugucauuugauuucuaugucucuuuauaauuucuuuuaaacuagagcuguuccucuauuuguauucuuuuuuaaauuguguaauuuauuuuuuagggaugggguaucgcuauguugccaaggcuggacucaaacuucugggcuugggauuuucccaaguaauuuuuuuguugguuuguuugaaugauagugacuuuaaagagaccaggccaacuguccuauaaaacauuccccuuucuagaauuauuagauuucguuuccuuguggugcuguuuaauuuuguucaucacuuguuuugccuacaaauuuaaaauuaguucuaaagguuuaugcagguucagguuaaacauuuucggcuggaguacuucauugggggugcuguguauaucaaauuacauuccaacagaauauugagcuaugcugcuguugguaaugcuaacuuuaaucacuuggcaaaaguggugaccacuggauuguuccauuguaaaggaaucuuuccccaucugcaauuaacaaauagucuuuguauugauacuuuagcaauggacagauaccccuuuuucccaacaaccuuugaccuaauaguuuuagcacacauugaugacccuugccugaaucaguuauuucaacugaagacuucaaacuggugauucuuuuaaaauuccaucauuccuuccacauuuauagcuaguauucuucuauaaaagggcaguuucuuucaucauucauuuuaacacuaucaguuucauguuucauauuuuauauaagugucauaacaauuacuguuucuaauguuuccuuaccuggaggauguuggaagcauuaaaguauucuugaaaucucuuaagguauauugauaagaaaaguaguuauggcucaggcugauggucagagaggcuuuaauuguaagaggagggagguaauuguaggcauguuuccuuguaaacuaaacuucaguauucuuuuggugaaauuuggaaccuugcaacaaccucugugccccuagcuguguuucucugauucucauauugccacucuauaauugcuaguaaacaucucacaagguugaucaucaguaguugacuggccgacucgaggggguugcuguggugcucugugaagcugcgcuaucagggaucagcuaauaaucccugccucaguccuugcacaauccagacaugguugauagugaaugucaaaaugagugaauuucuaaaagauaguuugggcuuaaucuaaaggaagccugaguaacuaguauuaggugccaauauaaaucucugaguugguuaauauuauugucccuuaauaauuaagaaagggaugcucagagaaguaaagcaaguagaccucaaaucauuugcuucaaguaaguuucagagccagacucugaacucuaagauguuuuguuucaaagccagugcuuuccaacuuggguucccugcuacuuaagcccaugaaggaguuuuuaggcucagaaguccauauuaguucucaucuagaaaacccugucuggucgauuccaggcccacugggggaucugggccugacacaguaucuacaacagaguagcugcacucagcuccguucaggguuagcuagaacucugaacagucaguagggaaaggcauagcggagggcagaucgcaucguuccugacugcccagccuuaagggggggaaaaaaagauuauaugaauaaucuauucaguaacauccucagaauuagcaugugcaauuuccuuaaaaccaaugaggauuuccugugaaaaggcugggguggaauaugccaauucacauuuuagcaacagcgugaacacuuucuuaaaaauguauagauuauguuuuggcuuugcuuuuugugcaauguaggcagaauaugguuugcuauuauauaaauuuggauucauuauagaucacauuauuguuccaaaaacacaagagcuacauacagcgagauucugaaacaauaccuuuagcagguucuuaaauaugccccaauaauuuuucgauuauggcauuuagcccucaaguaaaauauaugaaacaacagaauaugugcuaggagcauaggcaaguuuuauacaacaacaguucaggcaguuagugcauaaaaagccauugaaauugcuuugagaugauuuaugagacaccgaagaaauggacuccuaguauccaaauugaaauuucaccagaaucaugggauuaacuucucuuuucuuaugaaaaccauuaagcguuuuuaaaauagcuucuagcaauuaggacuacaguucuucaucuuuauguuucugauagguguaaagacaaaggggaaaaaucaauuaaugacuaaagaaauaauugauuuaaugcugagguguaucugauauaauuuaauguugaaacguaucuacauaucauguagagaucaguguagcucuauagccuccuucuguaagaaaggcaguauacucaaaauucaacaucaggauaguguuucaaugugaaaugacagaaauauuuauugaacgucaugcuugauauuauuuuauuguugagagcuuuuuacugaaacucuuuaaaacugaacccccaaauuaaaauauuggcaacacugaaagauagcaacagaagccuguaaucugaaguaauggacuuauuaaggacuucagaaaaaaagacuuuagaaaagaagcauauaucguugagucugcugccgugccugauagugauaaccugcuuagaauugaagcaccccauucuuugaaaaauugugugcgcucuguggauauugacguggguuuguuuacaugugcuuucacucacagaucaacugagcuuccuaaagcauggaccuuucauguucagcguguuguuuucuaaucucauagaaguaguuucauagggaggagaaaacagaaaccgacaagaauauuucuuugcauuugccuuagcauuuccaacaugcaaauguugcuuuuuucauaguauggcacuuauuuuugucagacauuucuuguacuuaacaaagggcaaaguuacauuuuggcgggagagcgacuuucgcccggcacuucaccagaucucguugaauagaauauauuaucacuguuagcauucuuaggguucuuaaugaaagcuacauacccuuuaucuccauuuuccucuccuuuuagaagacaucuuccaaugaacaauuucuaugacuugaauaccagauauauguuauuuucaagcuaccucaaagccauguuuauaugcauuugcgacaauaacaauuccgugcuucggaauaauuauguaggaguaucauugagguuauuaggcaggacccacccucuagaguucuguacaugggggggucucuguguguugggguuuuacugugcaagcacacagaauauccugagcucauuuguaccaugauaaugaacagcagggcacugaaucuuuuuaguuuuauuggcauuguauacaguaaguuauuaaauuucaucucuguaauauaccugcaguaaaauaacaaaauauuggugcacuuaaagaacauguguguguggaacaaugcccuccccaucauuucagcccccugcaaacagcugcuuacagauuucaagauccauuguauguauucccucgagcccaccucuaauaaucgagacacaucugccauugcaguauuauaggcauauguaguuuuauugaaaacuauaccuguaaaaaaauuaaauaacuccugccucaauuaaauuggcaagcuaccuuuugcaaagaucauauugcagaccucuugagacccaagugaguucauuuuauucuuacauuacaaaucacuaaauauguuauuuuuauuuagcugaguagcuagcuuuccucguacuuugaugguaaguuacuuucauccauucucacuuuuguuuuccuucuccccucaucuuuacauauuaaaaaaauuaugcaaauugcaugaagcaaacauuuugagaaucugaacagaauaaaaucaaagggaaaggacccuaacaugcagcuuuaacucugaagugauuauuaaauaaauacaugcaaagguuacaaaauuggggucaaauuuauaacucacguuguggcuugugauuuuuacaaacuucuuugagauccauuugaucaucauaaugguagaauaggaaguaauaugaagaggaaaugaguuaguaggccauacaaagcauaugcagaugaauuccuauuggauuaaauaacuuaacacuuacucuuaagaaaauaauagauacgagaucucacucuaucacccaggcuggagugcaguggugcagucauagcucacugcaaccuugaacuccugggcucaagcaauccucccuccucagccuccugaguagcuaggacugcaggcauauaccaccauggcugguuaacuuuuuuauguuuuguagagccagggucucacguuguuguccaggcugucucaaauuccugacuucaagccauccuucuaccuagacuuuccaaaaugcugugauuauaggcaugagccacugcacccagccaacagucuuaauacuuguugaagauugagucaguaauagaugucugcaaaauaguuuuuuauccaaagaaggaauaagaguaaaauauuuaccgauauaaaaaugugagccuaaacuuauuuuaaguuauguaagguaucuguauaggucuucaugugaguuaaucaugccaauauauagugauuuaaccaagaagaauuuuuuugcuuuauauuuucauagaaaaaauccaaaaagacaaguugcccacuauaugggaaacauauauguguauauaucguauauaucugaauuauguaugucuauauauaugaaacacacacacacacuguuauaagacaguaagcagguuccuuaucuauaguuucuuaguuaaaaaaacaaaacaaaacaacauuuugugcuauucagaugaacuguguauaacuggaccgagggagugguuagaggugaauacugucccaaagugaacauagagucagaggaaagacucuguugaaagucagaaaguagaugauuucauaggaucaagucacggauaaauaugaggugaugacuguuauagagaagguagaaaaucgaaaaucaagcagugauauucuuuuuuuuuuuuuuuuuuugugggguuguuggggauugggucucuauguuguccaggugggacucaaaccccugggcugaaucagucuucccaccucagcccucugaguaguugggacuguagguacacaccaccaugccuggcuuguaguagcaguauugacaaccagucaggauagaaaauaguuacauguuuaaauaaagaauuuccuucuuugggccgggcaugauggcucaugccuguaaucccagcacuuugggaggccgagguggguggaucacuugaggacaggaguucgagaccagccugacgaacauggcgaaaugccaucucuacugaaaauacaaaaaguuagcuaggugugguggugcaugccuguaaucccagcuacucaggaggcugaggcacaagaauugcuugaaccugggaggcggagguugcagugagcccagaucacgccacugcacugcagccugggugacagagcgagacucugucucaaaaaaaaaaaaaaaaaaaaaaaaaagauuuuuuuuuuuucuuuuagaugaagucucacucugucgcccaggcugcagugcaguggcacaaucucugcucacugcaaccucugccuccuggguucaagcgaugcuccuguuucacccucccgaguaguugggauuacaggcgugugccaccugggcuggcuaaguuuuuuuuuaauauuuuuguagagacaggguuucaccauguuggccagacuggucucaaacuccugaccucaagugauccgcccaccucggccucccaaagugcugggauuacaggcaugaaccaccgcgccuggcagaauguucuucuuuuuugauaggaauguugauucaagucagugaguggucguuugguuccacuugggcuuaccugggcccaggagacucugcucacucuguguucucccaggguauuuugugccccacugcugguucacagagaugccagguuucacggaauggagggcugaguccuagagagggucaucacuuacaaguaagauaucaaacccuaagggaaucagaauuuaaagucuuagaaggguuucaguuuugucauauagaaaaauauugaaaauuaaaaaauauauauauuaugaauuguaaacaaacuuuuugaucaaaacucaugaaaguuggggaauacaccuuaacuugcacccugccacugcuuugaagucccaucccugggaugugguucacuccuguggaaauauauauuaucuauuacauuugaacugugaauuguguuugucacacugagcuaagcagcucagaacugucauguguagagugacugguacaauacaacaucaguggugguaaaagauuuguauggacaaugacauguggcaaagaagaaugucaacagcugccacugcuaugacaucgucccucaaggagucuuucugcaucucugccauguaacugucucagccaaagagaaggcacuaacaugaacuucuuccccagaaugcuacucccaacuagcgaccacguaagacucgcuugagucuuuuuugagggugcaaguccugggugccauuugucaccggaaagaacauuuaaguuuggaguuuuauguauagagggagggauuauucuuugauuuauuucgaaagaacauguucuuaauguccuuuugcagauaauacacacacccuaucaguuuuuggacuccagacugucuccauccauaugucauuaugaagcagguuuuuaucuuauuaugauuuagguaauuguacuagccucuaaaauuuuauaauguaccuuucagaagcucauagaugccaagaucagaggcuccuuuggaguuccaucuaauauaucuuccuuagccaacugguacagauaauuuuaucuuuccucuagauaguuacacauauagcucuagaaauaaaauguaguuauccuaaaucagcuguauagagccuuaaccagcaaucagaccauuuagaacauucaacaauaauacauucuaccaaacucugacuuucuguguucaguagauauuuauuaggaaacucacccugugucccacugaagauccucacaugcucucuagguagaugacuucagcuaauaguauaguaaccaugaggccuuaguauuuaugacuuuucuuuucuuucuuucuuuuuuuuuuuuuuuuuuuuuuuuaagagucaggguccugcuguguugcccaggcuggucuugaacucccggccagagugauccucccaccuuggccucccaaagugcugggauuauaggugugagccaccacaucuggaaguauuuaucacuuuccaaauucguauucuuacauguguuuggauuuauuuuucaagaagccagaguaaaauuuggcaauuaccaaauugugaguugagaaaaauagauaauucaccuuugguauugugcuuuugaauuugaauuccauugauuggauuucaguccgucgggauuaguucuuccaucugugucccuuggugugaugacugacucccagccaccaucugagacugcucggucucccucaucuccaaaaguccucaguuuccagaucucaucaauucugcuugcaagauaccaauaaaucugcugcugccuccuagacccccagucaccaccguggcugcccgugcugcucugaucccucuacccaccuucucccucacaugccuccuguccacugcugcuggagugacagucuccacaaaacauuguuccuuggcuuuggggccuguccuuagcauggugguauccuggccccuguuucugccugcagccucagccuucguacucaccauucacaucucauguuccagcccuacugagcugcuugcaguucccucaagaguucuuucacgguucucucugucuuuauaagaaccugaaauaccuuugccuugccuccccuucuucuugccuuacaucuguucuaccagcuaacucaccugcuuuguucaagauucagggacccuggauguuauaaccagggcagagcgagcugccucucuucugugcucaggaagccuuuggagcacuucuuuuuccucacagucaucacacugucuacagccagagaagggcaaaggcuaggggcaagggcuaggcuugccgucucuaucugcagugucuaacaggggcacccaggaagugcuuguuccagagucacaggauggaugagugaaugaaugaaugaacuagcaauaguaagaaauuguaugugagcauguaacuuacuauauuuaaauacuuccaugcaaauuucuugacuuaaauuaaccaugccaaugaccccugaggcuggauuuauuuauuuauuuauuuuuugagauggagucucgcucugucacccaggcugaagugcaguggugugaucucggcucacugcaaucccugccucccggguucaugccauucuucugccucagucucccgaguagcugggaccacaggcgcccaccaccaugcccggcuaauuuuuuuuuguauuuuuaguagagaugggguuucaccguguuagccaggauggucucaaucuccugaccucgugauccacccgccucggccucccaaagugcugagauuacagcugugagccacugugcccagccgaggcugggauuauuuuuaauccaguuuuauugauaaagaaacugagauuuagagagauuuguuuucacucugaaggcagagaugggacuggggaacaaacuccuuuggauccagauuuggcauuuucuuugucacuucuuuagcacuggauaaaguugguguagcuuugugucauagcaaguagcccacagagucuuuucauagaugguuccagcucucuauucauuauuaacuuagggaucauucauggaggcacuuaccuaguuaccaggcugagaccucugucugccaaugagaaaaaaugugcauuucuaaagaggauaugaagaaccuagcaaucuguauaucaggagcauugucuuuacauagacaaaaaagaauauuuugaauguuuccuguaaguaaguaccaguugcaauagcguggugcguaccgcccaugcuaucuauugcccaucagugguaccucuacucucugguuguggugaaaaggaccaugguccuccuggaaauuucuggcccugaagcucaggggagaagugcaacaccagccacaucucaucccccaaguuucauucuccuucacucucccugguacaacuuggcagaggauggggagaacugggaagaaguggaugcauugaguagaucaagcuuuuccucuucauguuuacuuuauaugauuuuaauuuuguaaccuuguuguaggacauaaaaaaugaaugacaguggacuuagcuuuuauuuauaacauugaaauccuuaaagauagaauguuagagucagaaaggaccuagacaucaucuggcauccagugccgcuuuguagcaaguggaaaacuaaagcucagagauguugagguuggucgucaucacacagcaagcagaccuugcucagacacagccacacaauacaaguaaaauuccuagccuguaacacggaaguuuuccuuugaugucuuuguacccgcuuucuuccaaagagcaaaaggucaccuagaccaugaaguaauagccagcagcagccggaaacacauccugaggaaauuucuagacgauugucccuuuguuaagcuaccauugaaucauacugucacagagccagagggugucguuugcuuguaaauacugaguuuuugaaaugucacuguaacacuggaaaaauguugucucugaagguugccaaagugacagaaucccgacauuguaaauaccagccaacacaagugcuuauaaaugacaggaauaaaauauacuugacuaaauccauaauaaucacugauaacacuguuuacccucagugaccaggagcugugaacuuggauaaaaagcacaugugugcagauaucauuaauaugucugagccucuagccauuccagaauauuuugauggaaaagcucccuaaauauguaaaagcuuugcaauaacuaagaagcuaguguguaagguagggugucagucgucccugaugaaacuagagagagccuugacuaucuucagcccccagaggacugauaaggccucccuuguucugguuagacccaaacucugagccaggcuacuagggcaggcaaugcuguauuuucaguagaugugauucucagaaggcccauuugccagaagcaugagcccacaccuauaucauguuccauggagaaaauguggaaugaacuuagagauuaaaaacuuuggagccauaagugggaggaucccaugaacuacccuuugacuuucaaaggguggauggguggucagaccuuuccacaguccuaauacucuauagcccaggcuuuuucuuaauaauaacuuccuccucucuagaaaugauucucucccucuuuuuucuguucuaguguaaaaauggugccuguguguauccgagucuuuaagaggaaauggacacauuggcaaaccagugccuccuuuggcucugugauguggcugcuguuacuacucaacuggagcaccccuuauauuccagucuccccagaaaugcucaggaacaguggagacucaaugacagaggguugagcccuccugguuuuucaacuggugaaagagaaauucagaugguuaaggagauagcagaguagccagcacuccgggagcugcucuuaucucugcuaugaggcugugcauggggaagaguagggcugcuuggaaugaccuccuuacuuuucauauauugaaacauauuucuuuuuccuugauaugcuccuguauuguuugaauuuuauuuuauuuuauuuuuugugguaagcauuguuuucuuaauuaacaaugaaagguuguagucaauaaacuaguacuugaugagauuugagaaaaacuacaaaacuguagauugcaaguuggcauuugaccaagaaauuaugauugugcuccuuggauuuuuaugcuuaggaaagagugcacaagagggaaaaagcuuucggucagaagauacccauucuaguacuagcuggaauggugguaaagaauacgaaauggucugaauguccauggcugugugauauuggcguauuuugcuguccaugggucuaaguggaugguauuauagcuuugaaagagucauggcaaaggagggaacaggugugucccaaacccuaaugaacucagcagauuggccuggcauucuggcaauguagucauucagcggagccguggggacucccuggguggggacccagcaugcuucuggagguaccugggaggcgcugggaguagggccugcuguacugguuugacuaaugugguguagguguugauguuggagaguugguggccagucucaggcucuguucuggcacuacuccagcuuguuggucaugaaugcagauugagauugaauggcuccuuacauuucccuugaagaaaggcagcuuugucuuccaggaaugagcugauggcaguggccguguggacauucugcagcuuuggcacccaguagcgauggccugauugccuugaaacugggagccucuagggcccugagaacuugagcagggcuggacaagccuuggagcagaacuuugcugugaauucuuucauugacucgcaaaagaugaaggacucuaaucccugauaucuaccuuuccacuugaccuuuuuagucuucaguggucuuuuagaaguaauuuuaccuggccgcgguggcucaugccuauaauccuagaacuuugggaggccuaggcgggcagaucaccugaggccaggaguucgagaccggccuggccagcauagugaaaccccaucucuacuaaaaauacaaaauuagcagggugugguggcucacgccuauaauccuaguuacucgggaugcugaggcaggagaaucacuugaaccugggaggcagaggcugaagugagccaagaucgugcauugcacuccagccugggugacaagagagaaaccaucuaacaaaaaaaguuauuuuaugaaaaacauuuggagguuuucuuuuggguauggcaggcagauuggccucuuauuuggcauaggugaagaagaagaguugaauaaaaguaguuggggcauagaauggccaugcaaguucccaacuaaaucagggucaaguuuaaauguauuuguauuuuguucaaauucaucuuuaucuaaaacaggcugaugcuguuuugucucugugcugcagguggauagccacaaauuugacucuauaguuaccaguuaucccccugccaccccuuguuuuucuuccugauuucucuacuuccaaucagcugcucuuuuagaaaccaauagagaagugagacggggugggggcagaggaagagagaaaggggguaagggggagggagaaagaggaaagagagguuguuuuuugucauuagugaguaaaaaucugucgggcucggguaguuucuuagugaauucagcauuuagugauuagauuagagggguauauuugagcugaagauuuugggaacucaccuuucugcucuacagaaucccuagguuucuccuuuagcucuacuuucugauucauuccauccccauccacugaccccaccgccaauauugagguacuugugaaagcucagaaucuccaguguccucaaggagcuagccccaaagugcccccugguggcuagaggagaaaaagacaagauggaggaugggaaaaaggucagguggauggauaacuuuggcucuucuuuuggcucuucuuuucugauaguauuuuuguuaacagcaucuaauggguugucuucuuucaguaucaaugugaaccagcucugaauagguuaguguaucaauguauuucccuuuuugggugauuuugcugcagggauuucuuucccuaugccaguuuuuguuggucugauuuuuguuucuaggcauauugcauugaccugagccuucucacaguacugaugacacuggggguagggagaacaggagcaguugaagacgacacaugcugucaccucaugugcuggugugaguggcgcagggaagggcugugauuuuuuauaggcacacugauuagccaagcacuugucaccuccacugccgcucauuggccuacugagugugagcgugccaucuaauugacagcugucuguugucagagggccaucuuuucuccuuuucaguuugagugaacacaacagagacaucugcagagcucucugcagcucugacaagguugcccugccugccaacccucagacuucuaggcagcauaauugaagagaucagaaaagaauauuaacccguugaccaucuugggcugagguguaaugaccaaaaagucacuuuuuaaggugacugugagucuuucuuaguagaggaagacaugagauucucugucagaagagucaggccaguaggaagugcuauuucuugguagugauuguucgugggguuucaguucaucugagcacuuggaagaggaugagaaguucauuuucaagguagacccaguguuucauggugggguuacacugaagccugaaugcugggucacaucauucaugucugauuuggcuuguguaaugacaguagugcuuuggauguguguaguuuggaugaggguuacucuuuuucuuuuaccgccaggccugacacugcccuuuuagcguaagauuccagaaucucuuaugcaguagcauggaauguauggccaaccccguaguaacguggacugccucuuugggacauuuccuguaagccagagauaucaagguggacuuugugauggguagauuguuuauuauacagauaucagcuugggaauuugaauguuuaauuauuugccuugucguagugucuucaaaugaagcucuauuugagcaucuacugggauugguacaauaugcagacaagcuggcuuugugugggucgagucaccugugcuugcaggaugggggugcuugcuauauuuggaagugauuuagugguauccuagguuuaucaggaggaaaauacaucuuugcauuuauuugaacauuugauuuagaaagggacaguguguggguauuggauaaauugcuuuuacucuuucuuugcuuugcauuguucuccccucugaugauuugcaacuuagcaagccuucaucauugaaccugggugaaaaagaagaucugagaagccuugaguaauuuguuucagacuguuuauacucuaguguuuuacagaugugggcuuauuugaggaauaguauuggcgaaagguagcgucauuaaacugguuggagaaauuucaggcaaguagauagagaaauuucaggcaacuccuuuuccaaguuguugcucacagauuauaauagaugaauucagcagaauguucugaccuccuagacuaggucagauaacugaguucuuguccuaacucaaauccuaaguagcuguuucuuaaagcucuguucugccucugcagaaugaaggcuuggccuauauaguguaugagauuccuucuagcuucaggguuuuguaacuaucagaauagguaaugaggaaggagacuaugcccugguagccuuuagccauaucacaaauauuuaacauacucccaaaauagcacauacaagacagaaauucuuuguacuugaagggaauaauaaauacagaaagcauuugagaaguacacauuuaauuucuguuaacucuuuuuuucuuauuuauguuuauuauuagaugauaaaugacuuccuuuuuuuuaguauuaaaacaaggugaucaggauagugagaggauugggucaggugaaacacaugacucaccugcgugcuuaugauuccccuuggaagaugguuuuggguaacauucugggaaaacuauggauaaagucauaggcuuccauauuuaauuaauucuaagacuuuuuuuucacauuucaacaucucagaaauuuaugguaugccaauucaauuggcaacuuuuuuccucucuugguaggaaauagauaaugauguuuuugacauucaguggcaucuuauaggugaugaaauacaauucugaggggaggaagcaagauuuuuuuuuuuuuaacugagaaaggcuacgugacuaagugacuucuuuguuucaaugcugacuaaagcugugauguccuuuuuaaucacuuugaaagauucaaauugcuuuaggaagacaauucaugcauggagcucacccucccagaacuccacacuuaaugcccacugaggaaggagagaaaugcaugcaaauauauaucccaauauagaaggaauauucuaguucaguaacuuccacuccugagcuuuuaucaaauuuuucucuauagaauuauuuuuguuuuauuguauccaaaaugucagauaucuuuuucaaggaaggucaagggacuuugccauuuucuaagccagaaguauucucaccuaguccaguacuagucaaaguuuuuaguaaaucacuuagaauuuccuuuuuuaaaaaaaaaaaaaaacccuucuagaguuuguugauaccuuaaagaucaucaaauccagcuccuuauuucacaaaugaguaaaaagaagacauaaguugcuuguucagaguucagcuaggaacuagauagaaccuggguagccugacgcucccauucuugcugcuaaauuccaugcaauguaaugaaagcgggauugaguauaaaaccgauacucuacacaucuuuuguugauauuucugagggagaaacuugaauuucuguaagugcacauagcugguuucccuuugcuuuguauuucugaaugcuacacuugucuucugccuacuacacuuaaauucauaggugauuucacaaggcacagaagcccaacuugucacaugugguuuaauauaugccacacuuuaugcugcaguagcaccauuuggucauauuuagugaacucugugguuguugagaaugccaaagcagcaggcucagcuauugcagcauaggccuguacuuaguuagcaagcuuagcuuaaaagcugucagugcagcuaauguuacaguggcuuacugagaccuuggccugguugugauaguucuccaaaccuggguguuuucaccuuugaaauaugaaucuggauuuagcuuuuucuuagaaaacagcaacaacaacaaaauggugaaaucuuuaagcucguuaaugugaaugcaguaagaauguaaauuuaauacauauucacuuauuauuaaaugcuguuguaaauaacauuuuuagauuuaauaaugauuucccaagacauuucgugcuauucuuuacuuugaaacugauggggugagaagagaguugaaucuuaauuauuauuuuuuaguuaauuaacaugugauuuaaaaaaaucgagauauauuuuguguuagacccuaauuagaaaagaugucaagaauaacauaaugcuaacuuaauuuuaaaauugauaaaugagggcaagaugauuggaaaguauccucuagaucacacaggaaacggguuaauauucaaaugaauagcucugaaacgcuacuuuccuaccagcuccugaagcaauuuaguuuuuaagaccuaaaacugacucacaaucugugguaugaaggauagauguuaauaguuuaaauauuuaggcauugcgugggcuguuuguuaaaccauugguagcuugagauugaccacagugggaguguuuucaccaugcgaaugagcaucccugcucacaguggggcaugagcauagcacugcaggauacggaacugacauuuauuacauaccugacauuuccguuacucuuuuauuuaucguuuugggcugcuuguuuguguccuauccccacuccccaaauucauauguugaaaccuuaauccccagugggaugguguuaggaggugaagccuuugggagaugauugggugaugaggguggaccuccgaugaaggaauuaauguccuuauaagaagaggaagacacacuggggccugucagcggugggggacgaggggaggguuagcauuaggagaaauaccggauguagaugacggguugaugggugcagcaaaacaccauggcacguguauacccauguaacaaaccugcacauucugcacauguaucccagaacuuuaaaguauaauuuaaaaaaaaaaagaaaaguaaaggaagagagcuagccagccuucucucuucuccaugugaggauaccacgagaagauggucaucuguaaaucagaaagaggacccucgugguggcucacaccuguaauccaagcacuuugggagguugagguaggaggaucaguugagcccaggaguuucgagaccagccugagcaacacgaugaaacccugucucuacugaaaaaaagaaaacaaaauuagccagauguggugacacauaccucuguaguccuagugacccaggagguuaaggugagaggaucagcugagcccggaaagucgaggcugcagugagccaugaucaugccacugcacuccagccugggcaauagacugagacccucucucuccccaaccccuccagaaagaggaucuugucuggaauccagccauucugguccugaucuuagaauucuagccuccggaacuguuagaaguaaaugcuuguuguuuaggcuacccagucuuucguauuuuguuauagcagcuaaauugacuuagacaucauuaauuauguauuuuaaguccuguguuuuagcauucuggaaugagagcauugaaaaugaucaucaagccgaguaaauuaacugaauuaacuauuccaccaaaaaaaaccccaaaaacugaaauguucguuguuccuggggaauggcuaugcacuuggaggcugguccccuuccucccuccucuucuuccuggugaauccccugacuuuucucaaucaggcuuucugauguggaggcuuccucugcuucccagggacacacucccuucccagggcuccuggagcugcugcaucucugcuacccugagauguaauucuugccugagauuucagcuccuccccuacacuucagaggcuucaguggacuauuucuuauucaucugugcaggcacauuguccaauguacaaccugcucaaugggcuuguugaguuaauaaacuacucuguguucuguauuauguggauuuagauguuuugcuucuuuuucagccuuccuuucgcacccuccaccuacccgaccccugcuaagaugcuaccuuuuaaagaaaagaaauaaguucuucacacuuuucuacauuuauaauucaauauaaauaacugcuacugguauacuuaaucacaauuagauuaaauauguucuuugaaacagggaggucaucuaaugaauagaagugaaauaugucagaaaaugucacauaacugagagugugacaucuuuaguaaauagaauguugagaugauuuuagugcuaggcuaguuuuguaagagacaucuuauuugacaccuuuguucaaacaacuuuugugguucucaaacuagccucuauugaaaagaccaaguucccuacgucuucucuuugaacacuuucuucuuugcauuaaccuguucuugcuagugcguccaaguguggaaagcaaagauuaguuuuaaaucuuccgggucaaaacuguuuuggcuuuuuucuagagcugauaauaaguaguauaguuuucuguguaccauguguaagagaagagaaaaggucugacuuuauguuagauaauccauaauucgguugcucugucccacuauauggagaccaaagucacacuaaauggaugccuuggguaggggagaaggauguagccuuucaaucagacuucuuagcugcacuagucacauggcuagccuggggcagguauuuaaacuugcuauaccuaagucuccucaucuauuaauugacauuaauaucagcaccuucuucauaggguuuguaaggauugaauaauuuaauguauguaagacacuuagaagagugucuuaaauaaugugagcaccuucuucauuaacauuagcacauauuucauaugauuuugugaggauuaaauaauuuaauguauguaagacacuuauaagaguguguuaaauuacagacugugcucaguaaauguugucuaauauuauuuuuaaacugaugguuauuagccaagcuauaccauaucuucaacuuugggugcacaagagugggcaguaucuuugaagaggucguuguuucucaaucugugggucaaguauucuuagggaaacuuuucauuuugguccaacucauaacuuuagugacauuagucuuugcaauuuccugcugagaagagaagguagccuuucuauuuuuuuuaaguuuucaaagccuaauuuuauauuaaaagaaaacaagguauuaaaaccacguauuucuuuuaacuuauuaaaaggaaauaacacaguaacauuaauaaaaaguuacaaaauggcacaguaacauuaauaaaauguuacauugucuuuuuauucuauagcgugaauggaagaaauaaaguaacuuuucuagagcuacaaaguaguuaaugguggcaaagauucacucucuggcaaugugucuuguuucacaaaguaauacaaguucaacacaguauagaauugccuuugauuucaaaugguaacagcauuuauuggauuauuuuuguagauguucaaugccacaaguaaaaugaaguuuucucuuuaaaaggaugauagauguggcagacccaucacugggucccuggacagugguaacaugaugggguuuaaaguccuuuuugaaauagccagguuaaucugcauaaaggcuauggugcuucauuaagcuuuuugaaaacuuucugggguaggccaaguggcuauuuguaucaguuaaacguaaguacaacuacuuaaaauaacauuucuucccacuugugcuugagucugggucuauauuuuuccugauaauaacaggauaaaaugaaucauuugauuccauauuccaagaaaaacguguccauuagguagaggaagcucuuagaaauuaucuccaagaguggcuuguuuuguaccugucauauuuauuauaagguaaagggagauguagacuggugggggugaugguaguaaauugaaaugaguugccagcuguguugcccaggcuggucuugaacuccugggcucaagccaucccaccagagaagguucuuaaaccuuuugcuuuccauugggcaucuuuaucuacauuuuaccucaucaagcucaucaagugaaucagacgcuuugacucagucauaacauguugauggagagucacuuaguuggaaaauauagacaagaagaugggcucugggaagaacugguagguaggcaauggcucugaaaguguggggcccugguuuacaguguaaugacacccaccauuuagugccucagccauuauucaagugugcugugccuuuccuacuggccacguuaaugagaggguggagauagcaaguuccugcugaaauuuucacaggaaagcuaagcccuuaaaugauguuuugaaggaaugguuucucuaccaucuguaaaaaaggcuugauuaauuauuuugguggcagaaacuauaugcugugcuucagguuaaacagcaggaacauauugagguucuugggaagaguuuuccuacagccaucaaauagguguccacacagguuaaccggacugugcaauaagaaugugggacauuggcaugccagugugaagucuggaaaagucggaugugauauaugcaaguggaagagaacugaaacuaugaagagucauuuggaaagccccaguugugaguuugugauaguugagaaauggcaccuccucuuugcauacuuagguuugagcaggaaacaaagaagugacuugaagucauguuaugaaaagaagaauuggguuggaggucagacucuggauucuagaccugauucugaguuaacuaacauuuuagccuaguuucaggcacuccccaguggcccaaugagccaccccuucuugcaggccucaaaaugcacugugauaaaacugcauaguauuuucuuuuccuuauuuucauguucuaagaaauauuauuguccgggcacgguggcuuacaccuguaaucccagcacuuuaggaggccgaggcaggcagaucucuucagcccaagaguucaagaccagccugggcaacauggugagacccugucucuaauaaaaauagaaaaagacaaaacccugguguggugaugcaugccuguggucugagcuacucaggaggcugaagugggaggaucccuugagcccuggggguggagguugcagugagcugagaucccgccgcugcauucaagacugagugacagagugaaacccugucuaaaaaaaaaaaaaaaaaaaaaaggagaagaaaauauaauaaaaauaauacauggauacuuucuuaaaauaucagacacuugagaauguugaguaaaauauaaaaggacuuaaucuggagaucauugccuuaguuauaacauagaaccuuucuacuuaggagaauuucccucucuccuacucccuauuuguaaaaauuuucuuuuguggcuucagucaaguuucauacuuuuaaauguuuuuguuaauuuuauucuuuguguuuuuuuccuaaacuguauuuuuguuccauuaugauuuuuucauugguuagcugagguauaggaaaguugucuuuuuuauugucuguuaaucuuauaacccguaacuccagaacuuucuuacuagccucugguaguuuuuuuuaguuguuuaagauuuuuuaggaagaaaaucauuggcaaauauugggaguguugucucuuaaagugucuuucuguuauauuuuccuugugcuaguacauuggcaaagacuuacaggagaguguuaagagaauaguggaauacaggucagcuucgcauuuuguugacuugagcaaagaaucuucuaguguuucauuauuaaauaaguuuucuguaggcaucuaguagauuaagaaaacuuucuuaugauccaccacuucuuaaaaugaauguguguguucaaacuaaagagauauauguauauaguagaaauauauguguaugcuugugugcauguguguguauaaacuuuaaaucauccucucaaaauuccugaaguaaaagucuauuuuguuguuuuauguggaauuuuauuuuauuuaaauuuuuauauuuauauauuuuauuuaaaauuuucaugaaauggccaagcaggguuuaauauaaaauggaaacaggguuuaucucagaaauuugguggcuaaauuccuuguaucccgucuuaucuagggauguuguuuguuucaagguucuaccuugagaggagccugucauuuucuuuuuugugugcugcuuugccuaguugacaucuuggcuuuaugugcuccuguugaaugcauugggaaauuuucuuucuucuuucuauguccugaaauagcuuauauaagaggggaauuuuugauauuugggggaaauugcaugggacuuuuuuuuuuuuuuuuuuuuuuuuagacagggccucacucuauccucaaaacuggaauggagugcaguggugugaucauggcucacugcagucucuaccaccugaguagcugagacuauaggcacaugccaccaaucccacuaauuuuuguauuuuuuuguggaggcggaguuucgccauguugcucaugcuggucuugaacuccuggacuuagccaucugccugccuuagccucccaaacugcugggauuacaaaugugagccaccgcgccuggcaagacuaguacuucagaacuggauuuuuuacuaauuuuuccauuucuguuucuuuguguuucaauugugauaguuuuuguuauccuagaaaacauccauuuuccagacuuuaaaauuugcuacauaaaauuauacauacuuucucuuguuuuaaaaaacuccuuaucuauuuagcaaauauauuuuguaauuauguugauuucuguuuucucucuucuuguuuuuccuuacacuugccagagguuuguguguuuucuuugguuuuuuuuuucaaguaccuucuuuugguuucauugauaaucuacauuuuguuuuaucuaaauuuaguaaauuuuaaauuuuauuaauucaucauauuuaaauauguugcacuuuuucuagcuuuuuauauuguauguuuuguucauuuaauuuuuauuuuuacaucuugcaauuuaaggccauuauuuuucauugguuacagcuuuggcugcaucccuuagauuuucuuauauacagcuaucacuaucauuuauuuguguauuguuuuaaauguuauuuugcauucuuguguaguucaagaguuacuuaaaacacuguuuucacagucccacuuuaauaaaauguuuuucauguuggcagugcuacuguuuuguuuuuacuauuuaauuuuauugcauucugaguggggaaauggcauggauauuuccuacuuuggggguaaucuaguaggauuuuuaaaaaugcuuaguuuuuuuuaagcauuucauaugcauuugaaaauaaugaauacuauuucccuauuuuauuauuauuauuauuauuuuugagauggagucucacucugucacucagguuggaguguaguggcacgaucucagcucagugcaaccuccggcucccgguuucaagcaaucuucccaccucagccucccaaguagcugggaucacaagcaugugccaccaaccuggcuacauuuuguuuuuuuuaguagagauggaguuucaucauuuuggccagccuggucuugaauuccugaccucaacugaucuucccaccucagccucccaaacugcugggauuacaggcgugagccacugcacccggccuauuuucccuauuuuaauauauuaaaccuuuuauuacuuauuguccuucuaauugauuuaaauuucugagagauauuuguucuagucuucuacuuugauuauggauuuaccaaccgcucaggguauuuauauuuuaaaaaauauaucucaaagcuguaucauaaaugauuagaaguucaggaauauuuuauauuuuugguggacuauagguuucaucaguaugaaauauccaacuuuuuucuuuuuuuacauuuuugccuuagauuggcuuucaauguauaguaauguucucuacaugcuuuauuuuuguagauuuuauauuacauauuuuuuauauauuuuuauuuuucauagucucuguguuuuauuuuugaugguuuguuauacacagcauuuagcuuuacauuuuucuagccuaaugugacagccacuguaacuuaguugaggaauauaauauccaaauaaacauaguuuaauuuucuuuuuuuccuuggcuugaucacauuuccuuuguuuuauauuuuuugcugcuuaaaaaaaggucuuuuuuuuucuaauggugcaggaauuauacaucuuauuucuugugaaaguuauucuugccuuucuaacucacauauuucaaauuauauaucucuauuaaagucuaaaucuguuuggugucuguaucuuuccuaaaaaagaugacggagaguguuagcacauuuuuaauuacugaguuucucccuuuguuccuccccuuuaccucucauguugagguugauauguuuccuuuuugacguuuuaaauugcaucaacagucacauagagucuacuagcguuuccuugccccaucuugcuaauuuuuguggaccauguuguucuggguuuuuuuggguugauuugucauuauacaguuauauauccuuauguaauuuuuuucagaaguguggggguauaaauuuucagagucuuugcauuuucuaaauugccuguaguuagcucaccuuuuugaaggcaaguuuggcuacauauaaaauuugaguuuuaaagucuuguauccccuuuuucugucacauuuuuguucuggcuugccuugcagcucuaaauguagcaccccaauuaaucacccgauuauugcaucacacuccacuccagcuccauguauguauugacccugggauuggagcauccuagauuuagcuguuucuuugcagucuucuugauuggcugcugcuuuuuggcuugugauuuauuuauuuuuccucuguagagcaaauccaucuacuuuuaucuuuaagaauaauucaaaauuguuauuccaccgaagcuacucuuccuuauuuucuggcacuauuuggcauguauaucucuucuaaauucacacacacacauacacacacacccaguaucauuuaugacauaugagguuagaggaaaaguagaagcuuauguuuaaucuaccaucccaagccaaccccuuuauauggaacuuuacacauucuaaaugcuuucaaauacaguaccuuauaaggaaggagaugcuauuauucuccuuuuauaaauuagaaaacugagagguuauaagucauuuuauuuauuuauucuuucauuuauuucuccauuaauccauuggcuaaauuugcaucaucugcuauguauaagcagcccucagugccagagacacaaaaccccagcuuccaggaccucacagcugagaguggaagcaaguggguaacaauagagacuugugacaauaauuucagcauaggguggauuucaguuccaugcauguuugagacacgugcuaggugcagaggaaccuggggagaggcgucucuaugucagacuucccaguggaaguguugaggaguguuucccagcggaaguguugucauugauuaaaauccaugcuguaaauguaggcaugaguugacugcugugcucuugguaucuaguaaaguuccuggucccugguuggcacuuaaaaaaaaauaagugaaugaacaaacaaagcuuccuuggcucucaccgaagcacuccuuuuguacuaacauaugugauagucuccacaggcaugauuucuuuauuucuccaagcaucucuuugaguagguacagugaaugucuccuguccacaaaugaaggggccaaggcuguggggaguuaagugucuugucuaaggaggcuuggaucccagguuccucugacucccgacaggcaagacuccuacuggcccuauggcccccucauccagauuauuuuagccucuuuuuucaaacucuuuccugcccucugaucauguuucuaccaagaccaaguaucacaaacuaaugaagagguauaacuggcugccuccuggaggagguauuaagaagcauacaguggccaaaguggaggaggaauaaaaauaccuccagagaccucaauaauaccaaaauagcuagucacaccauauaugucuaagcuuugauacagccuuucuacaugacauguucauuuggaauuauauuagacauucagguuugaaucagggcaggucacuugaaaugucucaauucaaugcaaaaguuauaagaaaaauaacauuuccccccacacaaguauauagcauaguauaaaacauucucaaaaacuuuguaaaggaaacacauuuuacaguuuaacucauaccuacuucacuuccuucucccucuccuguucucuguucauuauuucccuacuuacuaacuggcucuuaguuaauauuuucguggccucacccccacaccuuuuuaguuggucucuuuuuugugcaaauugauuuuauuccuaucuaaggagaugcuuucauccuuuuuuucaugcuuugaggccucauuagaucacugcacucuaauuuugggggggagaguugucauuugcacuauauguacagucugagcauccuaaaguucuuguucugagaaaaacaucgccauggugagcggcccauuuugaauuaggaggacuggcuaaggugcucacuuaagcucuuuguaguuuuguucagucaauugaguguuucuauguuacaucuaucugucuauaugucugucuaucuaucuaucuaucuaucuaucuaucuaucuaucuaucuaucuaucaucugucuaucuaucuacauaccuaccuaccuaccuauguacugagcccaggcuggagcaguggugcaaucagagcuuaccguccccuugaccucccagacucaagugauccucucaccucagccuccuaaguagcugggaccacaggugugcaccaccauaccuggcuaauuuuuuuucuauuuuauuuucuguagagacugagucuugcugugcugcuuaggcugcuuucaaacuccugggcucaagcgauccuccugccucagccccgcaaagugccgggauuacaggcaugagccauugcgcccggccuucucuuuuuaacguaauauugagauuggggucagacugugcugguuguggguaaagcuauugcagccuuccagcuaugaaggccugcccuccacgaugggauggccaggcugguaccugagacuaguguuggaggcaguggcagcuucccuuugaucuauugcagaaugcauuuucaaacacacacacacacacacacacaaauaaaacucugauguucacuuuuuaauugaaagcuaaaaaugcccagcuccuuucugcagauugacaagcugauauuucagcaguagcuaaagaacccgguuuaguaagcuacugaauuuugacguuuauaaacauuuaaugaauacauuuuuauuuaugucagcuuaaaaaauacagcugcugauaucugcgccccccaacaacuuuuuuugucuuaaugccaaaauuagaauauuuaaauauuuuaaaauuuccugaugagcaccugugcaggugugagggcagcaugaauucacagggagaguguaugaaguugguuaucuugaugugcuuguggggaauguguauuuccuugcaaggacugucaugugcuaccugauccucuuucauggaccucagccacuuucgccucuaacuugaaaaggaaacuggcauuguggcacaggggccaaagggacacauuuguagccuuguccucaaaucaagugggacuucugguucuuucucugaccaucugcuugaccuucagucuggugucuccaaggagugugucucuauggcaguuuaaaaaauucuguuacacugagaaagagacaaaauguaaaucuuaaaggaaucaguagauuuuuaaccccacugcugguguugagaagacaguuugagucuuaaucucuuuccuuaaguuucaaaacauguaggauuuauguuauugacaugucaaacuuuuuguacuuauucauuagggaagguuucaauacacacaaaaauagaguauuauaagaugcgcuacuauguauucauuauccaguuucaacagacgucaccauuuucccagucuuuuguuauauaguauccccuucacuuuauguuccugaaauauuuuaaggcaaagccuugacagcauauuauuucaccuauaaauauuucagaagcaucucuaacaaauaagcccccuccuuuguuuuacauagccauggugccauaucacagcuagcaagacuauuaggaauucuuaauagcauuaagaacugacguuccucaguugucucacaaaugccuuuuuacagcuggcauguuugaaucagaauccaaaccagguucacacguugcauuugauuaucaugacuuugaagucuucuuaaaaucuacaacauggccagucucccucuuuuuaaauauuuaaacuggguccauuuuccuguagaaagcccacauuauggauuuggcuuauugcuucuuuguggugucauacaccauguucaucuguucuccauacuuccuguaagcugauacuugcauuuagggcaagcuugucuaacccauggcccacaggacacaugcggcccaacacaaauuugaaaacuuucuuaaaacacuguguuuuuuguuuuuuuguuuuuuuuaagaagaccaaguuuguuugcaguguaugaaugucuaggugaggcuggguuaauggggagaaugagacuaacauaacaucuauaacucucaugacuuuuuguuauuguuguuguuuguuuuguuuuuggagacagagccucccucugucacccaggcuggagugcaguggcgcaaucucagcucacugcaaccuccgccuccuggguucaagugauucuccugucucagccucccaaguagcugggauuacaggcacgugccaccaugcuaauuuuuguauuuuuaguagagucgggguuucuccauguuggccaggcuggucucgaauuccugaccucaggugacccacccgccuuggccucccacagugcugggauuacaggcaugagccaccgcgcccggcugaaaacacuaugagguuuuuucauggguaaucuuggauauguuauuugcuucauucaagaaguaguauguggccauucauuucucaagaugcuuagauuguucagugaguucaugugcugcccaccagaucucccuaauacagaguuuuacauugucuuucaccuguuuguuuuaggaucuauugaugauuauuucauuggagguugcaaaauagccauaaguaaauugguuuaaugaagcuucuucucccuacuaaaucuuaucuagaguuuaacuaucuauuaaucauucauuuuugcacauuuuuacagcuuuugugggguauuuuacauucuuucuucuguuugaauauagagggugccuugcaaacuucacucauuucacuagaagaggcaacuguuuaaauccuacucuucuaauauauuuccugguucauguuuuccugcacauucauaaaugaggaggacguugauuugucaguuaucuucagugcuuagaauaguugcugaaaugugacaagaauguuuauggaagaaauuaccuuauagguuguacauguccucuaaagacaucauaggcacuccuacauugcauuggugaaggggccaccaaacagcagaauccugcaacuugguugaacuaugaaaauguucuugauacauuauaauuuccucaaccccuuuagccaguauuggccauucaggcaaaggaauagaauuuccaagacuuguacuguauguuugcagaaggagggaggauggcagauagguuuguguguguugggauggagaaaguaugcaaauaagcuaauuaauaucaauuguuuuuauaucuauauuacacauacacacacucgcauacacauaagcacacauaauuaaucacacccaugagcacauguacacagcuggucuacaccagauugcccugacaauuuuagagcugugugcugaaaaauuuuagaggaauuuggcuuugaaugugcaacacguauuacagagcaaagaucaccuuggguccuaagggagaugacuuucaucucuaccaugugaguaaaaccugggugauugaaccauaaauuauuuuggguauauagaacuuucuucaaauaacacuuaaaauuaaauguccagguaagugauuuucaaaucagaacaaccaaaauuguuaauaguuaugaucaugcuuauauacguauggaaauguauauguauauggaaauauggaaauuuguguauaagcaugcucugcaguaaaucaaaaaaugaccauggagcaaacauaugaaaaugcucaccagcaaugaaaaaaaugacccuauggcaaacaauaaaguaaaaugcuacacugucuuccuguagaggaccuacuagguuuggacaaacuggcugugcucaaauacaugugccaaaauugagcaggcugggugcaaauauucuaagggaauugaaagacacuuuuucgugaaauagguuuagguguugacauuaucucuaaaaguaauuaaaagaugauugauguaguaaauuuucuuuuaagccaugccuuuaagcacauuguaggaaaaggacuguuaaacaccacauuuucuuauuuagaacccuuggggccauagguauuucacaauuuaagaaucauuugcauuuuaugaaguuaauaugguguauauaacauguccuguguaacucuccagugaagucugaaacagccgcaauguauauauagauuauuauuucuauagcaaaacauaugaauagauacaccuaguaagacaaaaacaaaaauuauagauacguagauauucucacauuaguucagguuuugucacaaaguacagcuuucaaaccuucuggaauuuuucaauugagggaaagauugugaaccuucaaaugaacaaauaaauaaauaucuaccuuuucugaagaaaaacaaaagccaaauaacaaauaaaucaagaaucacuuuucaugguuuuuaaaccccucaaauaaaugucuuccuucuuucaguucauagaagauuuagaauuauaaaauaaagaaggccuauccacauggucuauauaugucuuauauaucuauaucuauaucuauaucuauaucuauaucuauaucuauaucuauaucuauaucuauaaacaauuuuagaauuagcucgucccacacaaaaauaguuuuuuuguuguuguuguuuuuuguuuugcuuuuuuugggauggaguuuugcucuuguuguccaggcuggagugcaauggcacuaucucagcucagugcaaccucugccuuccgaguucaagcgauucuccugccucacccuccucaguagcuggaauaacaggcgugcaucauuaauuuuuuuauauuuuuaguagagaugggguuucacuauguuggccaggcuggucuugaacuccugaccucaggugguccacucaccuuggccucccaaagugcugggaucauaggcaugagccacugugcccagccaaaacuuuagauuuuuauccuguuugugccucaaagccuauucaguugaaaggcugaugggcucgcucugagguccauuguuggcugggggagagcauuagggagcugacuuuuggcagaugaggaaaacagcaugaucacugcuuuugccacucugcuuuguggaauugacccacucugaaguuguucucacucgacagcaaugcaggcauuuauccagugcuucuacaagaaauaauuugggcaaaagcaguaaggaaguaagccuuaacagaaaagugggacccagcaauaggagaaucuacacaucugcuaagcccagccaucauauauauauguguguguguguguauauauauauauauauacacacacauauauauacacacacacacacacauauauauacacacacacacacacacauauauauauauauauauauauauauauauauauauuuuggagauggagucucacacuguugccuaggcugaagugcaguggcaugaucucggcucacugcaaccuccaccucccgaguucaagcaauucuccucccucagccucuugaguagguggcacuacaggugcaugccaccacaccguuaauuuuuuguauuuuuaguagagacagaguuucaccguauuaggauggucucgaucuccugaccuugugaucugccugccucaguucccaaagugcugggauuagaggcaugagccaccaugcccagcccuuauauauuuuuaaugugcauuaguaaauuauaaauaaugacagucuccauguggaaaaugaaaaucaacuuagcuuauacauuuuuaaaaaucagucaaguggucuugucucauauacauagaccuugaaagauuuguuuucaguacauucuguagaaggcucuugaauaucugauagacuccccuggcagcuuucaccuggugugugcaugcacagauauaaucaccuuagucuuuauccugcaguaaacaaaguucaagagagauuucugaaaugaagauaaucuucauucugccuuuugccgcuaccuaaaguucccuuggaggacucugugaaguuacucagguuauauuuuuuauaacaaauauaaaccacagaauuugccagaaugagaaauauucugaugaacaucaugauuugacugaggauggaggaauuguagggaaugguuaaacuugaagauacuuuuuagaaaaacaggucaugugcuacagaagcuacuuuuaaaaacaugcuuuuucauuaaauguaaauuuaccacauuauuuuauauaucuucauuaauuuaauaaaacuccugcuaggcuuuuguaaauuuucacagauauaauguuaccauaggcaucuaugcacauguauuuuuguacacuuguccaauauuauccauagaguuaaaauuuuuaacuugaaacuucuaagucagaaggcauaugcuuuuaauauucugcaguacauuuuaacuugccuuccagaaaguuuauaccagauuacauucccauuagcuauauaugaaagugaacuuccucacuggcaguugaaaauuugucuuauuuuaauuugccagauagcuugucauauauuuauugccaaauuucaaauucauuccuuuuauaaaggaaugguucauguucuuccccagucuauuuaguuuuauucuuauuacaauguaagagcuuuucauuuauuaggaguaucuucucauuaaauauuuguuaagaaagauuuuuguucaacuuuguaugguuuggauaauguuuucauuuauuuuuauuuauuuauuuauuuauuuagagacagagugucgcucuguuucccaggcuggagugcaguggcaagaucuugguucacugcaaacuucgccucccagguucaggcgauucuucugccucagccucucuaauagcugggauuacaggugugcacuaccacgccugguuaauuuuuguauuuuuaguagagacaugggguuucgccguguuggccaggauggucuucaacuccuaaccucaaaugauccaccugccucggccucccaaagugcugagauuacaggcaugagcuacuacgcccagcuggguaauguuuugaaaaacgaguauguagucugggucccaauauguucuaauuuuucuagcucuaaugucauagcuaacaaaggccaucucuacuuaauugcuuguacuuuauucucaggcuuuuauguuuuaaccuuugcauuuaaacauauuuuaguaugaagugugaagcaaaaacguaaauuuuuccccuuaaaugcuaaacaaacuuuaguuaccauuuauugaauaauuuaucauuuucucauugauuuuuuuuucaaugacagccucgccauaaaucuuucuguaauauuuccugaucuggcagcagccgcacauugcuuuaauuuacuuuguuuaaaauguauauauucucaacuuacaucuuuguaaaaauuuucuuaacuauuaucaugcauuaauauuccagauaagcuuuagaauuugugucuucucuacccuauccauuuuucucucuuuggaauuuguuugaauuugcauuaaagucuccuuuaauuuugagucauccaaucacauuuaugcaaauacuuuccugggaaauauuugugugaaaagauuuucuuuuaaaaauugauauacaagauuauuucggucuuuuagaaguguuuauacugcugaauccuuucaugauuuuuguuaaacuggcuugugaacuaguucagcaagucagugucguaugcugaauaucuaaauauauuuauaaugagaaauauaagaaaacauaauaagaauauuucugucuuacauccguggagagaaaauagaauauuuauaaaugcaaaugcucuacaauuacucuaaggaaacuuaaagaucacaguccuauucuaacucuguaaaguuauuugcuuguuuguuauuuuaacagcaucuuucucauaagcauuuaaggcugguuauaauguuuugugugugaauauugaguaaaccaaaugauuggaggcccguuauuuuuacaaagauuuuauggaauaagcaaguucggaauggauuucgaaaaagagacagucccuguuucaguguggaagggacauuggaguccaaaggucagggucagauacauguuuucuucuuuuuuuuuuuccuuccuuccuuccuuccuuccuuccuuccuuccuuccuucuuuccuuccuuccuuccuuccuuccuuccuuccuuccuuccuuccuuccuuccucuuuuuuuuuuguuuuuguuuuuggagacaaagucucauucuguugcccaggcuggagugcaguggugcgaucauaacucaccgcagccuccaacuccugaacucuugggcucaagugauucucccaccuuggccucugaaaaugcugggauuacaggcaugagccauuacaccuggccauuuucuuuugacuagagcugaaguucugaaacuagcagucauuggagauaagacaggagaagacaguugggaggcuccaagcaugugauuucaggaaaagcaugaguugauuauugagaauuucagaugugagauuuccaggaacagugugaguccagaagauguaagaaagaucaguggaauucacacaguuugguuauucaugcaucuucgaauauuuuucagauaaucucggguggauacuucaguuauuucugccucagcccaccuuauuuguaaagcaguauuaguagaauccccuccuugagggguucuucauauuaaauaaguugcauagccaacagccugaggcauaccaaacacuguauagauauuugcuguuauuuguaugauugcugccuuuuacugaguggcauccugggcuggugcuugggacucaacagugaggacauucccucccacaucugccuguaaugccaaggccuugugauagggaguggccugaagcccgggguagaggaguggaccuccccagcauagcuggggaaggagucucaaggagaugacauuugaccaguccucaugguuguuugcaaguggcuucucugcuguggaaugggaagaaagggucuuccaggaagagggguuagccuuuguaaaagugcagagaaacguuuguaugagcaagagaguaauuagggaaccgugagcaauuccaugugacucugacuauagguaggcugcagggaagggaagagacagaugaggacugucuuccuagugccuagaacaguggcuggcccauaguagguauucggugcaucuuaguggagaaaugugugaaagaggaaagagagggcugggagguagacuacuacuagauuggcuauggguggagcugggggcucagcauuuucaagcucugaaguuuggucuccuugaaggaacaggagcagcucuggauuuuagaaggccaauucuguccacagugcaccaguguucuaggugagguuggaugauggggagagggaagucugaagauagcauccauaaaucucaugacauuucuaucccagcagugcaaucaaauguugagaauauguccuguagcuuucuuuuagaaaagggguuagcaggccaggugugguggcucaggccuguaaucccagcacuuugggaggccagcgcggguggaucacgaggucaagagauugaaaucaucauggccaacauggugaaacccuaucucaacuaaaaauacaaaaauuagcugggcaugguggcaugcaccuguagcccagcuacucgggaggcugaggcaggagagucgcuugaaccugggaguuggagguugcagugagccaagauugcgccacugcacuccagccugguggcagagugagacuucucucaaaaaaaaaaaaaaaaggguggggggcgggcaaauuauggcuuaaggccaaauccaaccaacagcuucuuuuuauaaauaaaauuuuacuggaacacugucugaccuguuuauuuacauauuauguaugguugauuuagcguaacaauggcagaguuggguguuuucaacagagaccacauggccagcaaugacuaaaauauuuucuaucugguccuucaagaaaaauguuuggugaccucaguguuagaagauuguuuuuagguauuuaauggugccauucuggaaaaguuggcauuguuggaagaguucaaauugaugcauguguagccuaagaaaaauggggccauaucacuuccuaugaagaaacacaccaaaauuuuaauucaauucuuaaguuguugucuugauuaucuaaguucugucucuagucuccuauggcuauuuuuguggcuuugacccuagcugacccagccuauugucaguaguuaagaagguagauuccaagugcucaaugucauguuaagacuuccuugcuaccuacuaagggaagucauuuuuuuagccagcuguuuuaaguucuccuaaccuauuucauaugcuauguucccacaauaaccauucccuucucuugccauuucuuuguccucucuccugcaauguuucuucuacugaaagaauacggcacuacugaaucuguuucuccugggcagggcuugcauuaucccaccuguuccaaauucuuuuuagaaccgggcccuuugggugaaugaugaaccauuuaauagccccauguacuauagaaauuuaaccauuuucaaccaaaccugucauagauaagaacaaagguaagccaucaugugucuagaaaaacauacaacugauuuccucacagacauuacaaguucuuacucuucaaauguacuuuaaaggacugagaguguaauuaggaaucagcagaaguuuuguggaaaagaggcauugagccuuuugcauauuaaggaucaaauuuuauguuuuguaugaagcauucaugaggugauguucuuaaaaaccacuccagaggcacaggaggaacgcugaggacaagacugaauauagagauggaggaauuacgugucuacuggguagagauggagaaggcauauuuauacuagggaugguugaaaucaugcaagcaucuuccauagcuaauaaauuauuuuauccaguuggccuuuacugagggcauacuguguaccggggcccacccuguuggaugccaggaauacaaagaugaucagaguucacuuucugcgcuugaggaucccacagauuagaaaggaggaaaaagaguuacuuuccauacaaggcuauaaauguuacaacaguugaauuuuucagaugaaguggaaggaaacgucuagaaggaagaggacugaaaugaaagaagacugggggaaaagaaauaauaauaaacaaaaagaaaaauaauuugaaacuuuuuagagaagaugauugaccccauuguggagaucaagauuaaagaugaauggcaggcagcuguggagagcagagguggagauauugggaggaucagacuaaagaacugaaauuucaguuguccaagcgggcaugcuguucuacagccucacaugucuugggccuauuagaaauauauauaaucuaucuaugcaugacuuauauaccauacaucacaucauuucuuccaaacuuacauuauaauauaacacauucuguauuaguauauaguaagauuuuaaaauguacaacauauuuaaauauacuccuuacaauuaagccucaguaagugcuaggaacuuugcuaagcacuuuguauuaucuaacugaauucuuaccauggguaggcacucuuauacaacauuucccaggcaaggaguuuugcccaccaagguuagacagauuguccaggauuauccaggggguaaguggcacucacaccagggcuugucugacccuacuuaauuagaugggcuccuaugaaguaaauuuuaggauaagcucuugacuuaaaaaugagccuucuaaugguugugggagagggagaaaaaacaaguuuacagaagauagcgggugaguguggagcagagaacuagcauaggcuuugaagucaagccuaacugaauucccagcuuggcuccacugcuugccagccacauggcauuggucaggucacauaaccacucugaauguccccaucuguacauugggguuuguagcaucugccuuguuagcauguaaaggaucugcaccugugccuggcacuuagcagacacugugacuuguagcugcugcugcuccugcuauaccuaccguccuugccacucuucuuauauucacauccacccauccuccuccucauacuacuauuacuaccuaugcuaauacuauggugguuaugaugagcagcaguaguaguuggaaugccucaaagauaagauuuaugcuaaaaaacagaagcacaguaguuauuuaagaccucgauuugaucaauagcauuaguucugcauuuacuucaauauuuagugagcaugugccauggcaggucucugcgccaggcacuguagaaaguuaaaacaugaagaagucauuuccucuuuuagcugccauauccucuaguuugaccuuuacgccauauacucuuggucagauauucaagaaagaaucuugggagggaaagaguuagugcucaucgagugcagacuggcuugaagcugugcauagcuuuggaaggaaugucaggacuuaaauaauuucaggaugaguugaagauuacauugagcauuuacuacuucuccagauaaucucaauuuccgcccaucaugugauggaggugucaccuuauuuacagguucagauuguuagcgggacacuuuguuauagugauaucuuacagaguuggccauuaggcuauaauugagccuuuauguggggugcuggguaggccacaugacccugguuccuguuuccagggaggccaaccuacauaaaaauggcugucauauaucguugcucagaggggcagauauuuacaacaaccuugaaauggaacuuccacccaauaugaugaagacugacuugugacaguuugauaugccuuuauuuugcuaaaauagcaaccuggccaaauauauuuuucagcacauuuauuauagcuacuuguuuauauuuauagcaaaaguguugcuaauucccuaguauguuaacaggucauauucaaauuguucuauuuuuacuuuggcacaaaauugcugaaggaaacauuuuuaaggcaaguagugauuauagcauaucaacucacuacauagugaauuauauauuaaaugaacuuccugaacugagaaggagcuuaaacugacaaagaagauaguuuucuuaaauucuguauuguuuacauaagauuucuucaaauccauuuuuuauuauagguuacugauugucucaauguuuucuuuuugcuaaauuucuaccuucccgccaacaaauauaaucccccuuuuaauauauaauagaugaccugggauuccagaauggauuuucagaaaccaucaaaaaaccuccucgcuuuaguguauacaauaaauaauauauucuuuuuuaaaaauaugagagucaaauagguauaugcguaaaccuggccaacccuugggcaguuguaauuuccauaccaaaaugcaugagucuuuacuugacuguuacucuguuauacauuaaguacuaguuaccauggcaaccuuugcaucacauuaugacauuuaaauauaaggugguguguuuccuuauaaggaaagacaauguauuugaauuuuugaguguuuggugaaauacaaucacuacuaaaauaaauaauuuuguuuaaggcaauugauuucuuugggaauuacguacauuuccaaccaaaccuauggagugcauucauuuauuuuuauuuuuuugugaugucauggagaaguaaaagauuuuuuuuaaaacaacgcuugauaaguauaacauaauaauucauuaaaugccuauaauuacccucguaaguggcaaaacacaaaauugaaccauauuugagguuauuuaucagugaccaauacuguagcaagaguucgaauguaacaucacaagauuuaugaaauucuaucgcauauaacacauuucuuauuuuuguauaucuaguugguuaacuguaacuaguuuugaucuuaccuauaguugaauuaacaguagcaguuugcucaugcgugcaaaagcaaaauuaaaggagccacugaacucauccuuguggcauuuccaggaacauggccacuuaaauuuaauuaugaagauuguugggcaauuucuuuauuaaauauggaaaaaaccuagucauuucuuguugccaguguagcucuaggccauaaggcuaucaucuuuguuauguagacucccauauauaacucauuuuuaacuuuuuauaguaacuuuuccaaauuauuaucacagcuuguacuuuuuaaucugaaaauagagaaucuaaugaucacucauaacuuuuggugcaucuuuucaauaauaaucaguggauuguaauaugggacuguuuugugugggacauaagaaagagguaagcucugugcuggacccuggcucugcggaacauuuuacauauguuguuucaucuauuccugauaacccuaugauagagcucuuauuagucccuuuuuacacgggaagaaaguaugguuuagagcaguugcauaacucacccccaaauacauugucuguauuucuuugagcuaagguucaaccagauuggucugaccuuaaagcccucccucuuuccuuaauagauuugacuucuacuucugacuuguuacagacacaaugugcaugauauguuuaauguagaaauaaaaaacacugacaaaaaaccuuuaaaaauguuugcuaaauaauaauuucaguaauuuguauuucucugcagcacagcaguuuuuuaagucccugauuugcaagauaucuuggucuuuguaaguuacccaaguccucuuuuguugaaaccaagcauaggacagaaauaaaaauaaauuauaaagguguacucuuggaccuucaggaaucaggaaagaagacuguccaaagacugaccuucaauuuugagcuuugaaguucaaaaguggacagguggaaauacuguguucuucauugcccuuuggugcgagauauauucuagguugcagaguaagugccaacagcagcaaaauuaucgccccccuccugcuacuguaguaagucagcaauggcccuucuguggucagaauggcacauucagcagcaacuauucgacagggauuuacagaaacuuccccauggcuguuaggaaucuuauucagcagugucuuugaaaacccgauucugugcagaauuagcuauguagaaaugaccuagguugugauaaaagguauuuuaaacaaaucuaacuuguaauuucacucaauguguauuuugcauuuaaugccacaaagucugguagauaccuacacauauauuuugcauucauaaguuuuauagugguucagaauuuuuuuccauauuaacauuuuaaaaaauccuggcuuuauagagucaguucaccauacaaagccacuauacaucacuuagguuugugaugaaagaauggaauugcagcugugugaguacuagaauacccaaacaugaauuagacucacaagcauuuggcaauaguucagaaaaagagcuuaaucugguuucaucugagacugcuuuucucuguucugcaacauccccccaagauguugugucugauaccggaucacaacguaaugggagugacgcagaaucgagaaagcccugagaaaccaggggcacauuugcuuuucuccagagauuuucuuucuccuacuucuuuuuuccccucuuccaguuuccaacucugaaauucaaggucauucaccuauuagaugcauuaauuauaagccaaaaaagcaguauucaucguacucugaucucagucauaucuauaauuaaguguaaauauaaucuuccuuuuuagaaauguaccacccacccauuacauuuaaagugcugacugaaaugaaauaauaguucagagcaagaugauuuuaguuuaacuagaaaaaaguugauaauuuaagcuucaagcagugaguucuauuuuugauuaccauucaguuauaaaucuaauuugagauauaugcugcuuuucuguuacucaaguuuaauucaugguuugcuuucuugguuguauaagcaaaguucagugguugaucaaggcuguuaagaagcuccccugaaaaggaaugggggcaggguugagaauguguucgaaagacauucugagaccuauaucugauguaaaacaaacaaauccgauguaaaacaaacaacaaaauuuuaauugaaaaagacacucacagagugcuguauuuggggauuugaauggccaaguuaggaauggccauuugcaggggaauuggcugcagagggugaaccccaaaacauuccaaccugguugauaaagucaguguguuuuauucuuugguuacaguauuuuaggucuuuugggaaaaaaaauuaggagcgaguaaggggaagggcuugucucaucacacuguggacaguuaagcaaaaugcuaaacuauggguuuaagauuuacagguuagcucugccagaugccacaucugccuccaguguuuccuggcagauucgggcagccuacuacugggacccagcauaaccgcagaacaugagcuugcacaaugugaaaaaccuaaaaccauuauaauccuauuuaaggccaggaugaauuugcccauuuugaaaguagauguaguuuucaagcuuaacuuuuauuaagcagaaacuugucuucagagcuauaucuauauaugcagguaaauucauaauauaaacaaauaccuuauccauuuugugcaaaauuuaauuuacuuuaaaucaaacgccauucacuuuuuaaaauucauaaacucagguuuuucagccaguggaaaauuuaucuuucucauugcuacagagaguuaaguaucugacguaaaggccagacaauaguaaauggucauuguucgcuuuauaaguauacucuacaauaagaacacauauauuuuuaucuucauuuucccuaaggagguguuuagggcccccuuaaaugugaggaaauguuuauuuuuguugcuuuagaagaaugauucuauuguccaagugagaaagaaauaggaacaaacaggucuaaggagaaagaaacaggaaugugcuuugugaaaaaaauaaagauuaacaggaaccacuaaagguuuguaagugcuaucugguccuagugcuauguuacugcacauaguccuugcgccugcauauguaagaguuggaugcgugauuuauuaugacuggcccaugaaauuauuuucuuuuaaguuaacaacaauaaggucaaccacagccuguagcuguuuuguaguuauuuuauauuuuucacagcucuauugugaaugcugcuaaaagacaguauagcaaguguguguuuuuagguugaccccuugaaugcauuuaauuucuugagagugaaaaccuuugccaccaggaccaagaggaauuaaccaaugguuaaacucauuuaaaaacacaagcaagcauuucaacauauuugcuuagccguuuucugaauauuuaauauacuucuagagaaagaaaaaugaagaaauaggggugauuugugucuagaauacaaaguuauuuucaaacuccucuuuccaaugaaaugaagacucauucguagauuuaccaaacuguaaggagguugugauuucaaaucauucacagcuuuauugauggaaauuucaaagaaaacuuggacacagacuucacuguaacuuucuuuguuaauaagaaaugcgaagagugaaauuuagguugagauucaaaaacuuuugaaugccacuccuaaaugauaaauuauuuguuacuagauuucugauuuaugcaaaacuuuauuauaauaagccuuauguuuuaguuugucauuguguaguguuuuaauaugucucauaaguucaaaagaggcaauaguugagcaugcagaugucagauuuuuaucugauaaaucugguuuuaucagguauuuaugugguaaacauuaagauacuagcaaugaguuuauuacucaaaaugugcuuucaaucugaaaucucauccuugaaguuguauuuugaaguaauguuuauuacauaucucuugaaaaagucuuaaacuggaaucaguaaaggcgagcuugucaguagcugauuaguccuuuauauaugacucauccaacacucagaaaaaccccuuggaauagagagguucucuuuaugauauuuagcuauauggcgguggaaaggggagguuugaauuuuugauuuuccagcuuaugggucauauuugaccaacugcuuucacuagaagacaugccacuuuguugagcuauuuaggaaucaaaaagacugucuuaauuuaaaacaaggacccuuuguuuuaguuggugacugccuugugaaauuuuucaguucucagcggguuaaccagggaacaggggcagagucauaauuggccuauuuagaguauuuugcaugugaauaguguguuagugaagcaucccuaagucuguugugagugacauggugauuagaauuuagauuagggaaaacacauucuguacuuuaucaaggacaguaauuaguucagucaguaaaaguugauuacaaguaacgauaaaguuagauuuuuaguacuuaauuuuaaaauuucuuuauuaaauaguaaauuuguucuuaauauaaaugguacuaucuacucuuguuuuauugcauaucagaauaauuaaaagaacaauguguucaaugcagaguauaaucaagcgauuuauauauuauggguaaguuucuauguaguuuuuagaaaauguaauauuauauaaucuuucugaugucaucauuuuuagaaguuuaauaauugucacacugugauagguuauuguggaaguuuucuaguguucagguaaauguuuaaucugugggaugugucuuagcuuccgauagaccucaagagggcauucugaaguccuuuguggcuguuagcuuggaauaucugcuauuucuguaauuuugagaguuagugugaggauuugaauuuccucuugguucaguuggcauuuucucuucugugggugcuaugucaguucguggagaaucaugauaugcgguacagagaggcaggguucucagucgaguucauaggcuacacuuacccccaguguaugcagccaggggaaguugugugcguucacaaaaugagguucuucuuguuaaggaaggggaugaauaguucccagauaugagccucagucuagagaaaggaaacauuagucuuauauaaaugccauuuguuuugugaaaugaaaacgugagucaucuuaaaagacuuaaaaaaauauuguuuaaagggaaucaucuacuuuccuccuaaaaguaaagaauuaaaaauucacaaacuuugugauagcuucuuagacugccuuucuuuuggguuuuuguuuuguuuuaauugucucagcuuagcagaugcuguuugcuuuauugcauugguuuaaguacuaacaaucaguugggagguggugaaaguaaaaaauuaaccuuauauguuuguuuucccuuuuuaaccuuuuagcagagucuccuuggaggugacauggauaugggcaacccaggaacccuuucgcccaccaaaccugguucccaguacuaucaguauucuagcaauaauccccgaaggaggccucuucacaguagugccauggguaagguauuccuuuguuugaaugccugagggaugauuaugccuuuuucuuuuuuucuuucuuucuuuaaaauaucgcccccccauccuaccucccaccccaagaaaaccauaaaauuuggcucaguugucagccuggagacuuccccccuaguacacugaguagguacguuaacagcuuaugguagcagaacuuuuuuggugucugcuuaugucuaguuuucucuuagcugcacccauaaggaagcuauuaaaagaucaaaguagcaaaaaguuaaauaucuucauuuuuaugaacaaagcagaauuugauuucugcuagaaucgaaugugaucgugguaacuacaguuugcuaagguaaugauuuaaggaaaugugguaucaucuagaagucuuugugguuuaaccuaucuuaguuaggaaaaugggcauuugggagcugaaagcaucuucauuuucuuucagagguacagacaaagaaaguucgaaaaguuccuccagguuugccaucuucaguaaguacugcuuguuucugcuuuguauauugcuuauuuuguucuguuuuguauugaugggaaggagauagaaguaaaugaguuuccaugcgcccagagcagcacguuuaucuagaagguggaugagguagaaaugaccugcacauccagccaccugacccacauuggagugauuaauugcacauccuggaagacugggugguuauguugauauucagcagguuaagcucuaaagagagccuugaaaaggugccugaaguuugaggaguuuuaccuguacagggcuugcaagagaaugaguauuaguuucauguguugguuaaauucuuugucaguauuaugaugauuuauggauuugcaugcgaaaggagauuuguggagaggauuuaggaaaaauuuacauggguuucagcccagagugcaggaagaaugucucuauuuucuggagagguugcugaauaaaggcugcaaagguagcugcaucaguagccauuugugucuuuacuaccaggugacaacuagaaguagucagcuguaaccaagagcauucugggucuuuuuaacagcuggagcucuaugcagaaguugcugauaucccccacccacccccaggucccuaguacagcaaaaguugguugugaucacaacucaauacaugauaucauauuuugaauucuuacguuccuagauaauuguauuuaauuuuauuuaggacuaguccauuucuaguaauuuucuccucauauaaaaugaaaacauaguuuccucucuucuuucuuuguuucuuuauccuuccuccuuuuuuucauucuuccuugcugugauauaaaguuuugauuuaauucuguagaguacuaguauucuuugaaaagaaugcugagacuuauuguuuuuauacuuuaauauaaaaucauauuuagauuucuuaaaguauauuaccaaucaaugcuugcauauuaguuucauuucauuuuuaauguauuagaagaauaauaggucuugcaaaugugcuaagauuagauuaacccaaacaccuguguauuugacuugauuucaguucagcucauccaaacaauuauuaaaugaauauaucagaauaagucuuaucaggaaaaagaguaaauuuuguaugcugauuaucauagaguuggugauguugaagaagcaucacaaaauuauucauaaauauagaaaaauauuguguaaauaagauugccaaugguguauagucacuuucaacuagcaauaagucacuuaaaauuguacucaguuguuuauuguuugaauuucuguguuguauugaaauugacuaauaugcccaaaggauuuuauaagcauauuuuaagcuugaaguuagggguggauuuaauguugaugaaacuuuagcuuuuaauagguuuuaugacaacuucaaaugauacaguccuaacagcuguuuacauuuuaaacaugccugaacuuaauauggacaauauuaaaugcauuugguggaccuuugaauguucugaaacaauggaauaacuguccuauaaaagccauaaaaaacuuaaagcuaucauacccuccuuaugcuucauauucaaauuaacuuguuuuauccaaugcuaagauuaggcagaaaucuagacaauuucuaaggagugcauugguguggcauuggaugguauguaucugcuuaaucacugucaacaacaauuuucauaauucguuguaaauguuuaaguauuucccuauagcuaacuggccccuuuagaaaauuuuacugguacaguguuuucuuugcuguuaagacaauuuagguguugcugcuaugucgugauacauucagaaauauaaaaauaauuuuccuuucuuucccaauaaacaaaacuugggaauuaggaauuuaguuuuauucuauuuaauuuucuguuuuuaguggucaguuuaggauuuacucuucuuagaagauuuaucuugacuaaauguuuucaugguccuuaugaaacauuuugaugaauagccuuuuuucugaaauauaaggaggaagaaaauacaauucaaaaugaaauuuuuauugcaauuuuuugagcaagaagaacaaguuuagguaauuuuauaauuuaaucauccauuuacucauuaccuaaaaaaaucccagcucuauuuucauagcaauuuaacuuaguuuauguaagcuuuguuguaaauaucaauugcuuauuacuuacaacaagauccacauggcuuaccaccacacaaaauauuuauuuuaacuugauuccaaaaaaggucugcaguagacauggucacacuuuucuaguagcagaucuguauuucuauauuuuuagaccucugccaugcuuuuuuuaaagcucaaauaaaauuaugacuauuugauaagagauacuucuuaaauuguuucaguauguaugaguauuuguauaacagauacuaaaagauuggagauaauaaaagguuuccuuuggagugauuaugacuacauaagacacuuauauguuuucuuugauacauauuuaccaugacaaauaguaauaaaucugucacaaucuguuguggcaacucacuuuaccccccauuuugaagugggcccucucuuucccuuauaauaaaaggaagaaaacuuaaacggugacacugcaucaucagguauuauuugugacacgccugugguacagagacuggacuucugccgccauuaggcugggucuuccucccaggcaaucaggagagagaggggauugccuagcccuguuuugaaaacacugcagcaucugugggagagagaaaacguaggccuggccagacaucaugccauggaucuggcaggauccacgaauguguguuuguacugugugcugcaccuagagaccucacgucacuguggaaguaugacacgauggugggauaacagaagacccaccaggcagggucuacaggacaagcacagcgugucggggggaagccugucccucuagugcacauagaccaguacuugcuaaggugauuuuuuuuuuaaaggaaagccugugugaaagacagcuaucuaauugcccacgagagcucugcuuauuacugcaguacauuuuuaucuucucgguucguauuuuaguauguugcucuuuuuagucacgucccaauuucucguagcccucguuuuuugcgaagaccuuaguaauaaaguguugucuuuuguugaugucagaauuuauuuugcaugucuaagcucuugaaucuacaugagaacaucuuguuuugcuagauuucuacauuuugguuuuccauuucaaaccauauuucaucuuaaacucaauauuuugcaacuuuacugcucauuucaacaaauuuguuuuauauaaccuaauaaucauacacauugaaucaugaauucauacacagaaaaauguacuauaguaaauuaaaguuggaaaaaaaugauuuaugauucuuaacagaaauuaacaugaaaguacuaaaaucuagaaaguagcaaaaaauuuuauauugugcuguuuuaagauacuuucaucaaacacagaaacaaagcaaaggcauuaucuuuuggaaacuuuauucugcccaucaacauguaaacauguaaaacuuuuaucuuagaauuugaaauauuucaaaauuauauacguuuuaucagaaacuguuaacaacuacaaacuuucuacuucagacuuugguggaauuugucuccacuuguaauccgauuugcaucuuuaaugauggucucaccaugaccccaguuggaaucucuugaacaucagauuuuucuggaaauaggauauuuuauccuuagaaauaguuuaugaccucucaucuccagugaucuuuccuaaagcuguacuucucaguaaagucuuuuuucuacguuaaaguacagagggguuuugugugucuguuuuguuuuaaaacucaggaggaccuggcaaacuuuaaguggucagagauaauuugggacacauggaucccaagauaaacaauuucuacuacuauaaagauucuaaaauaagguuuggacgcuucaagaauauuugugacauuaguuaaucaguagguagguuugaaaaauaaaaacaauguguauuagauauuagguucaccaauuuucauaaggaaagaauucuuaaauaaaaugaaauauuuaaguauggauuagaguuuccuuuacagaagcaauuauuagggguaucaagaaaaaugaguaaugcuaauggccuuaaauguccuauguauuuuguguuauauaaaaacuuuccuauuugaagauuucaaacaugauguugaauccauaucuugagcuauuuagggaaaaccccuuuuaucccaggugcuugaagaaaucacaaacaauuuaaaagagauauugguaaacuguuuuuuccuuauuagugggcuggaaauuauguaugauuuaaaaaaucaguacugaacucagaaauauauaauuuccuacaucacuuuugaaauugaucauagggaaaucagaacgaugcuuuuucaugucaacaaauuuuaacaaguaauaauacaauuuucuuuaagaugaaaguuuuauugaaauaugauaucgaucacaagugaacgaaauaucagccaucugggcucuauccuuuuuaggaaagucuggaaguagccgauugugugguaagacguaaaaggaggaaacucuucaagguucaucccugcagggauagauacuuugugaagaaguauaauuguuaaguguuuaaaauauuaagauagcucucaguauucacuuuuaaacuuagugugcccauuuucuaauuaaagauauuggaauaugagguuuggauauuaaaauugugcuuauuaauguuuaggcaagaaggagguuaagaguggcacaauuaagucaucucaaauaggacaaaacuauucacacaauuuacacggcauauauaacaugacaauggggaacagugaaagcugagaaaauauucaugacagagaaaguauuuuugugugugugcaguuaaugcugaauuugcuaaaccagacuucuaguucagcaugugcguuuuuuuuuuuuugugaaaaccaaucuuaucuucucuauuacacauugagacuauagaguuuaugauuuuuaugaauugcugauauaugaaaaaauauaggagaaucuuuauauuuguuuugauuggaggcuuuuguuccauuaaaaauuuuucagaaagcacacaagaggcuugcacauacucaacauacauacuauuaggcauucuaauaucccagaaguuugcucaaggauuucugaauuuuuguuuggaauuuuggaauaaugagcuccuucauccacuauccuccucuucucugccuugaagcccaauccugcacccuuuaagaaagaaggcuucuggugugcauauuuuagauagaaagagagaagaaauauaaaggaaaagacaagcaugaagguuaacuguggaugaaagguuuguguauuuuugagcuauuccugcuuuaucuuuacaaacaaaaagguuguaugccccaaacacucaaacaaaacaccaccaguucauuccuucccccagaaagaagccuuccuggccagcagcaccccauuuuucuacucagugaucucuucuaaggaguggugccugauguaucuuccuacucuccaauguguuuuuauuuuuaaucaaguauucaaaauaguauuuugcaugcuaagauuuaucaggacuuucguuaagauguuagcagcugcuaacauaaacaauaauagcauuuaguguaaaacuggacuuguugagaaaagagaaauacauuucugggaacugcuauuuugaacuuuaucauuuucacugaagaguauauuuuggugugaaguuuuggacucgagagugguuuaaauuacugagaaguguaggaaaccacugcagggcugcuuuacccagagagaauuauaacagggcuugcauguauuuugaaaauaaaaccuuuuucuauggcauccagcuuaacugugaauuuauauuuacgaaauaauguagauaaaugccuugauaauuugauugaauaccauuuuuuaacuuuuaaaauuuaauugauugaaauaguuuuauuugcuaacauagcaaaauguucuccuuuuuuccagaucacugacaauuucugcauuuucuauguuuucuugguuuugaauaauucuaaagguuuucauugaaaguaaugaaucaggaauuggagggcuaaauaagauucucuuagaagauguggcaguaauccuaaaagaauaaggagucucuucaagaauugucaaaguuguauuuucuuaaggcagaauccauacuugucaggcuguugacagacacuugcuuugucuuggcuuuuguuugauuuuuuacauaacugcacuggauuauuaaacugaacauaaaauugcaccucaaagcaauagcacaggauuuucagccuugaucaauuucuacuauccccggaugugugugugcacgcgugugugugugcacccauguguaugagugugcuucuuuuaaaggaauaggagcuuuuauacaauguggugcaaaacuuauaguuuuaaauacuuaauuauuuuaucuggaaacagcagcaugugagugauucuuuuuuaaguugcagcugcugcauagguguagagcuauuugaggaguuugaugcuuuacuugagcauauacucccucuucagagaaguuaagguagugcagaaguuucugcauuuuguaaaauuucaggguugaaaauaaagaugcuuuaugauuuggugagauggauagauuucacuucugaaagaaugugcaaguuguauuuugaaaggaacauuuuaagaauucuacuuaagugguuuagugacacccacucuugucucuugucugacuuugucaucugaggaauuaaucauaaauaagccacuagggaugaaacuugauauauaagugcuuacuuccagaguaauaagaagaggaacuguguguguguuaaauuucacuaaauuuauuuugauuauuccguagagcaggaaauaggaacauuucguagugaagcucucuucauagcaaacuguaaagaaaauuucucaguguguugccauauguuggcagugauuaaagggcauuuccuuugugaaacauggagccauauuagaaagacuuauauuuucucauaaaaaugaccuuugcaaguacauuuaaucaugaaaacuggugucauucgucacauacacauacaaaaagugucacuguuaccauuagggauuuuaggaaaaugcuacuuuggaacaauuauuuugauggcaucugagaaagaauaccuaagugucuacaggagccuccucccuccauggcccauaucauucuaaauaugccuccugaauuacgcuuauaauaauauuguaaugucuuucauucuaccgauuggcacaguauaucauuauaucauuagcugcuaugagaaagcaguuucaaguagguggcagauucuuagcauuaauguuuucaaguaacccuguuuggagaauuggguuguuucacaggugcucagguacauuaacacaguacaauaauauuuucuggcuugcuuuuuaugaaacgaacuugaaguacaaaauaauuuaauaacaaguggaguauaaaaacuggagcucuagcuuaagaaaguuuaauaacucaagacguuaaaggauaagaaaaaaauugucuaaggaggcagcaguguuuagcucauuuugcguuacuacuaaagcugaaauuuauuaggagaauguuuauggccugauuauuuagacuuguugaguuaguuuaaauuuuuuaaacgauuuggucaaguagaaaagcacaguucuguaucuauuguacuauuugaaaguauuguuacauaaaauaaauucgaaauucugccauuuaauacucaggcauaugauucaggagugaaauugcauugccagaaccuuggggucccucauguaucuuaauaugaauuuuauuuuuagagguguauaagacauuggcacauauaaucuguggcuuaauugauaacagcaaagaaaauggaauuaaaaauauuuauuauuaacagauacaguugggauuacaaaauucaaacugcagucaguaauuauuuuacaaauaaaugcuauuucauuuucccuuuaguaaauauaucaguaacuucacccaauauugauguaagugaaacccgacaguaacaagcugggagugcccagguagaaggggaaaaaagcauguucauuuauucauucauuccuuucuccguuuauacuuauucaaagaguauuuuucauugcagcuaaaaacuagacacaccauguaacauggaacaugucuuuuucuucuauguauucuuauuuaaaucguggagcuuuucaacugagauucuucacguuuaaugaaauuugcagucuugugucacuugcgucacaauuuguaggaauaaccuuagcauuuuaaagaguauaccguguagccuuuugagaaagucaugcauuugaaaaauaaaauaacccacaaaguguaacacauggacuuuugucccuuaagcugauugcccuuacucacuugucaccaccuuuacgagagugagggauauguuuuagauacauuuuuuuuuguccuauagaaaccagacucacugcuuuacuuaugcguauuacucugaaauauauuuccagugaaugaauauaguaguaaaagugguguagcaagguagaaaaaacacugcacuagacauaaaaagaccuuucaaguauaacgucugacagccucuacuuacacacccaguggccuugguuaggucacaaaccugcuucucugucuacaaagcagguauaaaauagugccugcauaauaagguggugucaauauacugauaacaaaccuuuaucaaaguacuuauuccaugccagaguacuuauuccauguucuaagugguacacuauuacaucauuugcaucuauugaaucauuuauuccuauaaaaauccugugagauggguacuacuguuuauucaagagacuuaaaaaugagacacagagaggugaagaaacaugucugcggucacacauaguaaguggcagagcugggagugagaccugggcagccugucucuaaaguuucuguguucuuaaccauagugcugucuaugcugccuagcguuucagacacucuguagaccaaaaagcucucuacagcaagguugucauuaaguuagcaaguauuugacuaucuacaauaaauuaauauucagaaauuucauuucacuguagagugaucaucaguaucucuguauagucauguccuauaacuuuugcccaagcaaaucaguaugccaggcaguccaggggagcaucuguguaaacaaagacaguauaauauagugguuagaguaugaaaucugaucaacuggguuuuuagggggcuaugucacuuccuagcuacacaguuauuuguaaaauaaguacucauugggguuugaaugcauuuauguaauauccuugaauguuacauacuauuguuacacauaauaaaaagcacugucaugcuauuaucaguaacaagguaacuaccuuucauuuggcauuugagaaacaaaucuaacauggcagccuacuuaggaguaguuagcaguagaauagaaacuaagaccagggucucagcuauguucaaaagaauuuuaccuaacagaggucacuugcuuuuucugaaauuauguaauauugcuuuuuuuuuuuuuuuuuuuugagauggggucuugcucugucaccuagguuggaguacaguggugcaaucauaguucacugcagucucaaacucccaggcucaagcgguccucccaccucaggcuccugaguagcuggguacacagguucacaaccaccacaccuggcuaauuuuuuucuuuuuuuuugguagagacagggucucccuguguuucccaggcucugcaaacccaucucuaucaaaccaagacacguagucagcccuuuuaaucauuagaccuaguggucugcaaaguuuguguuggaaauacuuuaucuucucucuuuugaacugguacaucggcugugaugcccggagcugcuuauacugugguucccuuggccaauaauuuguuuaugccuaaaucagccuugccucuaagugauaaggagauacgugcuuuuucuuuuguuuugugucagugguauucucuaauaggccgggaacgggucugcccaagugaugcacagccccuugguggggcuggcuauagauccccccgcaaaacugaagguuaggccuaagauauuagcuuugccuggcaagaugaagauguguggacuagguagaccuguguggcagucuguuucuuuuauaaaguaaacagaguucaguuuguuuaggacugcuuagguagauuucuuacacugagcaggaauauuuguacagauguuuuaagguaaagucaaagaauggcuagauuguagccuuugacgcauuauaauguaucuuuucucagugccccuguugaauucacaaaagaaaagguauuuuugaucaucggcuaugagaaacuuaaaacacuuuuuuuuauauauaaaggcugauuuaguuaacucuucuugcauuuaaagaaaaaaacaucugcugaaaguagggaggggggaggugugagcggaagcguggucuccacauuccacaaugaaugucuuuucccagccaauuuuaauuugcagaaaaaccaggcacugaguuagauuccucgggaaaagucccuguuggcugaugagcccugaacuucuuccguguacacccugaacagggacugaugcuucaguucacagagauaauuuuucucuggaaagccgauagauccgauuuagccaccccucauuuguagucauugccaccuuguggauuacaaaggauauugguuuucaucaaacuuccauuucgauuuggcuuuuuauggcaaguacacguuggcaguggauugccguguuccucaccaaaaggauccugguuuguucagcaacaccucacuucuccacucacaguucauuuaugauucugaugagaguguuuuuucaggaaacacacauuucacuuuuugaccuaggagcaucuguuagaauuuuuuuuuaauacuacuuuggcauucugaaaguguuaaugucuuucauaucuguuuaaugcuauuuagggauauuuaugaucaccucuugguuacucaggguaaagugugucgcaauuuuuuuuaaacagacaggaaagcauucacaugaggaaacagauugcuuuaaacaugugcuuccugugacaguaaaaagaacaaauuagauuuaacacuguguaaugaaugcauaaauguguacauuuaagcuuuuaaaagcuuuauguucaguucuggucacaacaaaaauugagucaccuguaaaaauuaaagaugcccaggguacucucagacuuuugaaaugcccagcaauugcaguccucaccugacgaugccucguuggaauuauaaaaagcaugaucuauuagugcuggagagaacuagaacauuacaaggcacauucagagguuaaaccagguuacagucagauuccguacauuuagcaaauaaaucagaauuuguugugggggggagaauacuucacucucaucuuccucccuaagaaucaaugaaaaaaucaauuuucgggaaccccauauauuccucugucuuucaugaaagaaaaagaaggaaaccugauguuuacuuacuagcauuuacuacaauuuaauuauauaagaaaaugacucuuuuucuuauguaauucaguuuguguuuuguaugcuggcagggagugaauagaaucugaguuaauauuuccaguuagacuagaguguggaauuggagggccugaauccucuccccggaagaagaggcacucauggccauuucugucugagccugcggauagugccucuccguccccugugcuuucaaagcuaaggauuuguggcacgcuugccaucucucuggccaaggagggccaggagagagucccucgggggagggcacauaguuugaggacaucugacucucuucuaucacauacugagguacuaauaucaaaacagacugcuugucgucgcacgguggggcagugcuuuuuuuggcugccguggucgaaaugaaaugggcaagcuguaguccgcuuggcaucagaaugggcuaagggaagcagggaaaucagagucagacugugaaugcaagucacagccaaugguuaacuuccuuuuugugugucacuuggcagcagcgagacugauggugauuuuuuuuuuuaacaugggugagaguucagugcccuaggaagagccguagaugcuguuauugugcuuccucauacaguugacuuguguugauuucuugaggccaguacagcuguuccaagagccagcuccaggagcuuuguguguauguacauggccaucggacgucggaugaaaaagguaaacagaugagaggugauccauacaaaaucucacugcugaucacuaggcagucuuaggggaaucagguucuggcauaaggcaauaauaccaaagaauaauauauagugcacuugaagggauacucccuuguauacagacacccaaagauauuuuuaaauuaucaccacuccgcaccccucaucucacauacaggauucaaaucaauuuuggacugucuggaaaauguaggacuaaaauagccagauugaauucagauaaaauuaccuucugcuuuuuugggagguuguugcuuuuugguuagccacauuauuuucuuugaagauucauuuggaagagaguuugguagaauuucuagccucucucaagauuuuccucccauuucucuguuugcaaagagcuguuccccaaaggcaaaaagagcgaguugccaucuugagcgaauuguauguuuagugaacaccaaauggucucagaguuacccuaaauuuucauuauaucugguugcuuucaaauacuauuuauuccccucaaaacuccuaaccauuuauauaagauaucaguaagaugaccaacuucugacaacccaaaagcagggaaggaagcuuagaaauagaauaccauuugucugguaauuagaguguaucucuuaagaguucgagagaauucugauuaaccuuucuguucccacauucucacguaaaauuagcacaccuuuuaaauuauuaucuaguauuuaaacacauauuuuugagucuucuuaaugcaacagguucuggggacacuaaaaguguguuauaguuuucuaaaaaacuucauuuuucuuacauuuuaaauguucuguuugugcaaaauuucgagaaucaccauaagggcuucuuugcauuuuuaauuuaguaacuaacauaugaauaaauuugcauauuaauuaguugcagauuaaaucaugcauacauaauugccuccuuacuguguuuaauguuugucaaaaucuccagccugguuugauggaugucguaugaaagauuacaauuugauguacccuuggaaguauuuacaccaauaaugcaagauucuuaauagcagaauuuucuaguuauauacaguuacuaauaaacauguaagauagguacaugucccuuugacuaaaauuuuuuucuuugcaccaaaucauuuacuauucauaaucauuaaugcaucuccuaauuauacagcauaugucuguuaacccuuucauugcuggccuucaaaugguagcuucuuucuuuuucuugcccccuaaagaaagcaaaauuguuugauaauacucugaaauuacucgauugccuuuuauuuauuucucuccuaguauauggacaaaccucauuugccauuuauuuuaacauacaauagauaauuauaugaucauuuuguauuuucuaguuaaagaucauaaaaugacccacgugcacaugguuaguagcugaugggcuuuugccuuucuuuuaccaaugcugaaaaaaauugaaauauuucagauacuucauauaguaguaaaaaaaaauguauacacagacauacucucuauuuaggaggguaauuguagaauaaguaaaaguauuaaaauuauauuuaaauucauuuugaauauugaaaugcauuuaauguaucaugaucaaacauaggauggaaaugugauuuuuuuuauuagaauugagaucucugaaguagaaacugacaagagaauagaugcucuugauuugacauaauuuuaaaaugccaauaaauguuuucucaaauuucuucagguauuuaauuuuuuaaguuuuaucuuacucauauaaaaaguagaccaacuggcuuuuuuuuuuccuuuuuacuauuuugaugucuaagcugcuuaucacacuguauuacccugcauuaaugaguauuccuacugugcaaaauucuaucaaaaaugauggugugaaugucauuuuuaauuggaaguuuauacagucaaauuuauaguacacaacaaaaaauauguauguaguucugcuccaagccuuuuuuuaggcuuuugaucuuuuuaguuuaaguauacauuuuuauuaaucuaagugucauuugaaaaucuacacaaauaugacuacauuuuuuauuaauaccauuguauuauggaagagagggaaacuaaggcauagaguaauuauaaugucuguaaacuguaagaagaacaaauacaagaaugaccaagaauagauuuucaggggucuuuuuuagacaugaaaacuugcugaccgguucuguauguuucacauaagucagacuguaugauuucugucuucuuuauuuuugaaugccugcauuuauaugccuaguaaaaaggcaaagguuaaaaugaguugaaagcauaaacagcugauuucccuucuuugauucuuucauaggagaaauaaugucuccuggucaccuaccucaggagcauuuauuugcuuaucacaggacacaaugaacuauuuauugauuuaacacaacauucuuuuacaacacgcaauauuacauuaaauuauuuagcaaugugaaaaaugaaaugaaagcugcaaaacuuauaaaaggaagcaaacagucagaccugaaacauauuuauccacagccauugugccuagguaauucagggcauaugguauguaaaugauauuuggagauccuugccaaaucuacacacgacgggauaaauuaaggacagguuucccugggugugagucccaugauuguggccggcacacuuccugcuugaauguguguguucuguucuugucuuucagcaagagcgucacagagcauucaguggccaaaucugguccucagcugacuucuaagacauuauuugcaauucccaagaauugauuuuaugauuaaauuuaaaacauaguaccaauuugccaaacuuucccuuugcucucacauuugaaaaguaagaucugaauaauuugucaggauauguuuagauauuaagccauuuaaauggguaucuuugacauuagaaauugagugccucugagcuucuuagucacugaagaaagguguuccugagcagugacuuuucucuaagcuaggauuaagauguuuccuagaacagacuaugaauuauuuugaacgauugauaauuuugguuccagguuggcccaguaauaauuuauuaauucaacuugacaacccaaauuacugguaucacuuauuuuauuuuugaauuauuauuuugaagcauauacucucauuucuagaaaggugaaggcacugacuccuauuuagaauaaauuuuaaguagguaagagguuaugcuguuuucuuuuuuuuugaaaggaaugucuuuucuaagcugggggucuuagcucagaguuuuuaaugcuuuaaauuaagguucauuuuuaucuuggaauuaugcaauuggagauuuugauuagaaacuauggcagaauuuuuucuccuauaauuuauuggacuauaccuaaagagugcauuuacugugcacacuuaauuauaaauacaagacuuauauguuauuuauaaaaguuauuucgggguauuuuaagacauguagaguauggcuuaggauguuuuauuguuuuuacuauuaagaauaaugcuuuuacuaaauaaaacuguguuucuuuuauaaaagauaaugcucuuaauauuaugguuuuauuugaauuagcaguuuagucuguguccccacauuccauuucauuuauggaaugcaaauaacacuaguuacugcauagaaaaugaaauuaggcugaguccuuguucauugcuguguaaauuggguaaaaaucagagaaaaaaaaauacccuugagaucaauguaaaucaauacuacuugagacagauccagcuaaaaauucaugaaaggggucacaguucuggaggaguuuauauaauuaucauguagccuauaguuugugaacucagggcaaaguucugagcugguuguucugggaccauuccuugguucauugaaacuacuuugcacagcugugcuucaaacucaacaacagagagcaaaaacaauauucacuauaaaauaaaccucguccugccuuucaacuucacugugaacuugcagucuugaaaacaacaaaagggauaaucgcaauugagauuacagaauccagauuagauguaauacacaguagggugguauggcccaauuuuacuuacauggggcaaguggaagugcugugaaugccaacauguuaagcaucauagccacuuauuaagauguuagcuuuaaaugucagucuuuggaccccauuugaaaugaagcaccugcauuuuauucaaagaaauuaagauauauuggggaaugcggaggugaguugaggguuuuuuuuguuuguuuuucuguuuuguuuuguuuuuuuuuucuggugggagaaagugccauagacaauagagauaaaauaucucaaguauuaaaagucuauuuuuauacacuguaugauucaaaaugacugagcaguuuugaaauuuuguagaaagaaaggaauauaaggagaauaagaaaugauauuugcaucuuuacagacaacucuguauagcacauuuaagauucuggcaauuuccuuacaaguaucugaaaauuaggaauuaugaaggaaacccagacagauacuuaacuauagcauugcuaccaggugucucuuugauaucaaugaguuaggaaaccuuaagaaaaaaagguuaaaacauccagaaugauaacuuauuuuagaauaugcuuucagacaaaauauuucuuuguuaagaauguugaaagguuuuauuuaauuguucacauauauuuaguaaauuuuuugguagacuugaccgauuaggcuuguuucauaaaagaugugggcuucuguguauuuagaucuuaaguuuauuucaaauuggccuuuauaaaacuuuagugccuuucucuuagaauucuagucaacaaaauuauauucaucaaguguauacaucacagaaguaacuggugauacagaguauaauuccuaccauauugucaaauggagucuauaucuccucaaagggaaagaaacacugacgugagucagaaguuuucacucacuuggcacugaaucagcuuaaaguucgagguugaaaaauucacaaauauuuauagcacaccuacuaagugccacgccuccuggaagguggacagcaauggccaauguuucugccauuggaaagauuugcaccgaaguguguauggccacauguaguuguacaaaucagaguucauuuuguaaugcuuuauaagggucugguaccacugauucuccuugcagacuaauaaacacagagcuuauaugacucuuaaaaauacagugauagcaagugcauccuaaauuauguaaucaugugguccaugauaacaguguaauauaugauauacagauggaaucagccaccuggcuuacuguaauuguuguugagguccuuuguuaugaacauauauuucuguuaacaaugcaacaaaauaauuuuuuaagcuguuuuuuuuuuucuguacugccucaaaucuagauaaacggaauguguuggaaaggacaacaaauaagaaguuaaauauguggaaaugacauggaaagcaccuguuucuucccuuuguuuucuucuacgucaucaggaaauaauauuuaaccauagaauauggugucccucuaagaaaauguuuauaauugaauguucaaaguagaauauagauuaaauaaguaaagaugacuugccaaaaaaaauuaaagaacauuugaaacaaacagaagucugcaucacacauaauaaguggcauaacaguaucaccucucaaaagugacaauagauguguccaucuuuaugccuuuagcauguuguuggcauuauuaguuauuguauugagagaguagccacgcuauacaagagaaaggaagguaaauuagaucccucacgcccccuucuucugugaauuguauauguuuuugaauacacucucugccaggacagcaaauaaaauuugguucaucccugauccucagcagauuauaaucuagguaaaggacagaccagguucaugaaaucaaaaauaauaauuagaacauuuggaaacuaggggaacagguccucauauugugugcauguuuuaucagucuaaaguagauauagcucuauugaaaauuguuggcuaguaauaugcucauuuucccauuucaugaagacuuauucucaaauggaaguuacagcuggcuaucguguuuuuccgacaaacucucuucucuguggacaugaugauuucuguuguuguggaaaggaaggaaauaaaucucuuuuuguuccucauucacucaaugagcaaagugugauugagcuccuauugugugcagauuauauuguuggagcacaggacaaagaaagcuaaauuaucaucuuuguuuagaaauuuaagauauuugggagcagcaagguagaugccuaugccuaguuuauuuaacaaggcacugaacuuugcuggagaauccuauauucuagaauauaguccuuaucuggaagugacuacagaaccugauucuggaucacagagagcugcagaucuggugugauuaagacaguggccacagauacuccacugagcuucugucuugcagcuucugucugucucuucccugaaaaucacagggaccacagauacuccacugagcuucugucuagcagcuucugucugucucuucccugaaaaucucagggaccguguggaguuuugcuuggucaacuggagaaacaacuuuugauuguuuuuauguuuuucagagauuuauuugccagagauauuacauuauaauaaaaacauaaacacagaaguuagggauuggaacaaagguuauauggucacaauuuaacucauaguuauuugaaaauuauugguuuauaaggaaacagauuuagacaaagcuagaacuuaugcagguaaguuacaaagcuagaacuuacucaggcaguugcucacgucuguaauucuagcacuuugggaggccggggcgggcggaucacgaggucaggaguucaagaccauccuggccaacauggugaaacccugucucuacuaaaaauacaaaaauuagccaggcgugguaguggugcaugcugguaaucccagccacucaggaggcugaggcaagagaauugcuugaaccugggaggcagagguggcagugagccaagaucacaccacugcacuccagccuggugacagagcgagacuccgucucaaaaaaaaagaaaauguaguggacacaauacauuuagauuuuuaauaaaguagacauauguuuauugcagaacauaugagcaguugauuaguuaaagauauccaacaugccaggcgugguggcuaacacuuguaaucccagcacuuugggaggccgaggcaggcggaucacgaggucaagagaucgagaccauccuggccaacguagcgaaaccccaucucuacuaaaaauacaaaaacuaucugggcaugguggcacacaccuguacuccuagcuacucaggagcugaggcaggauaauugcuugaacccgggagguagagguugcagugagccgagaucgugccacugcacuccagccuggcaacagagugagacuacaucucaaaaaaaaaaaaaaaaaaaaaaauccaacauugcuggcaaguuugaaggucacagcccauguacaaaauugguauaucuugaggaacucuugucuuuaucauauguucuguaccauuuccuugcacacaacacaguuacuauaugaugguacuaaguagauacagguccagaccccauaaagaauguggcauucaguucuugaacagauguuagagaacacaacccacucggcaguaagggauaucuucaacuagagggaagggugagaguugaccuguuuguccuuuugacucauauuuagaaaugcuaaaguuguuuuauguucaaaaugcauuugauaaucaugccugaagaggucaaagugcugacauuguugaaaacaaauaccccugucaaacaaauagagacaauuuucaugucuuugguugguaagcaccauaauuuggccuuuggcauugcugucaguaaagcuaguugaugacuuuuacaucaauuuuuggcccaaccauaaaugaaggaaauaagaccaauacugccacaguacuuuuucucacucaucacccauaccugauucagcuggguuaauguuaaaagccaaaauuuaucaauaucaauuuuuuucccaaaucauucuuauuuuaguacuguuuaugcucaauaaaaguuuaugaauuucuuucacuguuauuuaaugaaaacccagaauuuuuuaaaauugcacauuaucucuuuaaaaaaagucuuuuagauuacucgugggauuuacucuaaguuguugucuuuuaauagaagaugaugcaaaacuugucucaccuguuccuuccuggucgugucuguguuuaugugugggguggguauauaagugcuuuugauuaacagaaugaagagagugcuuauuuugaaaacucagucguuaaaauucaaguuuauuuugaguuaaagaacaccauauuuagauuaggaauggaccaaugaccugcuuaagcuuuaggcuaucgauuggccuugagggaacuuagaucugcuaaacacgaacuugaaaaggcacuucagugauggauguacguuggaugcucucacuguauggucauucacuugcauuuuaaaauuuauguuuuguuuuuccuuuauaccuacucuuuucauuccguuugucagagguggccauuuaaaguauuugacaauuguuuguucucugccuagcaaguuguccuauugcuccaugaugugaaagaacaaagguaaucaacaguuagaaaccucaggaaauugcuagaaucuucacccccaaagaggguuaauaaacccuagauaauuaguucauuuagaaugaaaaccauuuucauuguaauaaucacauuuccccucugauuaucgagcaaugcauugggaagccugauauuuauucacaaauuuuuuaaaauugagaacauccugugcugagauuccagucagcuucauccauccauuuuuuguuaaaaguuucucaacuaucauccuucauccagacaaauaaacauaaccaggauuuccccucuaacuuuuugggaauucauuuacacguguaccauuuugagggaaaaaaacaauuguccucgaauuucauuugacucaggugauugugguaagcucgcuaaccagcuucaucuaggaagugcagcaaucugagucaacuuccuccaucucuguuuuuacauuguccagugugaugcuuccucauuguaccaaaauagaaaugguuuguuuuuguaucaaacuuggagacuggcuauggauuacacuggguuaggauaaggguuuguuauuuuuuuuuuuuuaagaacauuccacuuaucccaagggaaaaagauugacggccuggggaaaaauaagaggcauaaugaagucuuuucuccuuaaauaaaaaucacaucuagucuucagaugugucaauugcacuauguuugccuaauuucauuuaauauuugagagauuuaguaguaaauuuaugacuuuugcaguuacuuugcaaaaaauugaggaaggaagaagugaauuucacuuugagucaaauguguagguuccaguguaauuaaaccuaaaaaucuauauauucuggucuugcuacuugguauuacacuuugccauaucacauaaugcuauuagcuacauuuuaccuuguuugcagggugaugccauuuuguaucucugguuuguugaauuuccuagaagauguuauguucauguagauaauggcauacucauugaauucuuuaccucagacaugaaaauauguggaaaaguggggaaaugaaucugaucagauuucacuguauacugaaauuugagaaucugguuuuugcaucuauuuugcaugcugcugucucuccaaaccauauaugucugugugaguuuuuauaaugccacauaaagcaaaaugagaagucucuucuuucuucuaaagggaaauagugccacagaaagguagaagucaaauauuuacuuauggaucaaaaaucuaguuaaaaaacaacccauugcuuaccuuaguaaucaaugugaauuacuuuauaaucaauaugaauacaagcuaucugaccagucacucagaaaauaaauauuugaucaugugauaaaccauuugaaugucuacauaugaacccaggccauauaaaaauaaccaauucaagauaacauaggaagucacuaaaaaagacacaaauaaaauuagauuucacaguuuacgcugauauuuugauacuuuucugugauaaaagcaucuuccaaacuaaauguguccauauuugaaccauguaaauaguuaaaaguauuuuaccugagaauaucuaaaugaugccaagaaaauaaguucaugccacuaaaaagauugagaugauuugugcuuuaucugacuucuugguguaauauggauuuacuucagauaaguauauuuucuacuuauccgauaaguguguuuaucugagauaaauauuuucuccagauacguguguauauugaaaaaaaauuuaaaauaauuaggaucccaauugaaaaaguaaaaaucuuaauugcuuaauaagaaaacaguuauuucauagucuuaagauuucaauacaaagaaauaugggaauauacacguaagagguuuguugguguucauuauuaaauugcaaggcugucucaaguuauugucaucagaauaaauucugugugugugugucugucugucugcguccuccuguuaguaauuagaucuuuuaugaaguuguacucauaccuauuagggauuuuugucauugcaguuuuaaguugaauaugacacauggauccuuuguugggucuaagcuaucaccauuuauuacaauuuuuuauaacauuccauauauaugcaucuacuaacuaaacaucagccuuaauuuagcuuaugaauuaaauuuuuuguuaggagugacuccugcuggagagcaaaaaauaccaauuaguuuagcuucuaaauaaacuauacuccuuuuuucaauggacaaggguaaccuccuauuccuuggcuuggcaacauuuacuauuccucuaaguuuaaagaugagaacauagauuugaguacuaacacaucagcagaaauuauauuuuuaaguacauacauaauucucaggccagucguguuuggugcuccaaaaagauuugugauugaauaucuuugcuccauugggaagaguuuagcauggugcuguauuuuuauaauucuuuuuuccauuuuagcagacuucaccuaagucuauuuuagguggagauuuuuuuuuuuuuuuuuuuuuuuuuuuuuugcugcugcucuuuaaggcacucuugcauagaggaaacagcagaggagacacaaggaaaugcacucuccuuuauaacaugcugcugauucucugaacuagguguccucucauuuaagccucaaaagaagcuguguauuaacuagaugaaggaacuaacacucaaaccugugauacagcuuggccagagucacacugcuggggagcagcaagguuacucaucaagaugugucugacccucaaguuuaagugcucugauuuaauaacuuugcucacacccugauuccagugucuuaguagcuuuugaucuauaaaaugucaucuaaggaucuuugagccuuaauucuuugucuuuaaagugggaaugauaauaccugccacagaguacuaguuauggagauuaaauaagugaaggcaauuauuauauguucuuuaaauugugugucacuguacugugcauguauuaagugucguuuuauuagcaaauaucuuuuugauggguagauguuuaccugaggugguuauuuaauuuauaggcuggcuuguucacacuauguuauguaaucauuguauauuaaugaauaucacuauuuuccuuaggauaugauguuuagcuaauucagccaugcuaggcaaaagaggucagcauuguagaaauaagcaaugucuuauacugaaaaaaagaaagacaacaacaacaaaacaacaacaacaaaaaacaacuuuccguguucagugacuuaaacagaaacauggaguuguucaaauucuaccaaguuauauucgggaggagaaaaaugggaauuccuuccauaugaccauucuucauucauucauuuauucagcuucuauuuguugaguugccugccuuacacugcaauaugcagggcaguuuguguguguguagauguucauuagguuuauuugcacuuugcaguaaccauguaauauuaucauuauucagaaauaaagguagaaucuacucuaaugagcucuguggucgaguggauaguucagcucuuuacccuguaauaguuuguuaucuaauuguuuaauguaugugcgauugccuucacaauuaaagcauuauucuuuagucauauuuucucucuuuucucaauuuucucaggaagaaaauugacaugucugugaacccugugcauguccccaaauggagcuuaacccaaaguugggaaucacuaaauaauuguucaugaaaugguugaauauagcucuucauucaagugauguagauucugaauauuuacuuauucuuuaaugcaguuauucauucauucggcaaguuuuuauugaacaucuaccuuguagguaauacuaugccaaugcauuggggguuuuaggucaaauauuucccaguuucuuauaacaaauguauguguguguugucaguucugcuucaccucaaauauaucugucaaagacuuuuuggaaaauuacaaaagaacuguaaacuuuagauucuagaagaaaauaagaaucguguggguuucauuuaaguggucaacacuucuagacaguuugcugguaagaauuuuuuuccccaaaaguggcagaaaaagacaacuggguucauugccuacccccaguguccucaauagugcuuugucuaagcaccagagagggaugguggcuuucuguauaguguggcuaaccaucauuccccaucauuucagcgauaacaaggcugggcauggggggugggggugguaccaaguagguaaccaaguuaccuacugcuggcaagguaacuuguccaguuauacacuacugugaaaacugugucugugaaacaagcaguagacuaguucaggguccuguaaaaauuggcugcuuaagauuaagacuucuuuaaaauuauucugaaacacauggauuuaugcauauagcuucaguuguucuuauacuucuguucuaacuccccacgcaucacacuaaaaauuuaucauggaugauauuucugucacaaagaaaacuucaaaggcugagaucgcagaaaugucucaguugacaagccacugacuugaguucugugauugaaauguacuccaaggucagcaaaccaaaaccaaacaucacuggaugauaauacguucagugucucacuggcuauaauucguagaucaccuuucaaagcauuauaucuuuauuaaucauuguaaauuugugcuuuugaaaucuuagacucguuuccauuaggcaaugaagcccagaagcuuaauguucuagucucauuuuaauuuuuucagucuuaugugcugaauugucaggguuuaaaaaucgauuucaccucaucagauuaaaaauauuuauuuaugcacauguuaacaauauauuaaaagaaaugagagcuucaauuuuaaaaauaggaauuguagcucauuaagccaugacaauuugguuuauauuuacauaauuaauaggaaggcauuuauauguuugcaaaauagguaagaaaagguauuuaacguagaugaagcagaaugauuguuuaucaaaagaguuuagagaucuuucuagcagucuacccauggaaaguuaggaucuagaaaagccuucucaauaagggaagaaacaacaaagaaacaacaaccaggaaacuccccaacuuaucucuuuaaauuccagccucuuuucuaaguggugguuuuuacauacuguccucugguagguggguacccuggccuuguguauuaagcagugagggugguuuaaagguuacaaaugugauccugucagauugacaacuaacuguucuaaugaggaaaaaauccucaaagcaugaaauuugaaugaaaugugugauuauaauucaaguacuguuuacacaaaccucuggggaccuuccgaauaaaugcagagcaagugaguuagacaaaccucugggccuucgauacguguguguggaugugcgguguguguguguuuauuuuagagaguggggaaacuuuccaccauuagcccgggcuuugcuccucggaaccaacaccacuauuccuccuuguuuauuaauacuguauguguuuuguuagcauauugaguuguaaggaaauaggugcuuugaauuauuaaaguugauucuugagaauagauguaugcucggguggcauuugcuucggcauaugcaaaugauuuaguuucauuugggaucaauucccagaggcccuccuuuccugugaugcucugaauuuggcaagcucaagucagcccaucuccucuccccacaucccucccuuucuuucuuuccuuuuuuuguaccuccccccgccuuuuuguugauugguauaauauuuuuaaaagacaauaaauaaauauaucaacuugcuugugagaaaccuugccaucuauaaggauucuauuguucaguugugaucaauaaaggugaacaaagguuuucacguucuuaaaguuuagcaaaaucgaaguuuaguaaaaaugugcaugagauguuugcuaaaauauuuauacagauacugggcugcggggaugcugcaaaacucugaaaauguggucucaggggugccuuuggggaaacugacagcuguaagauauucgucgguucgaagguaccaauaaacuugcuuuagagcccagcaaauagcgugaaguugcaguagauugucuaaagcuacagugaaagcacccaacuccagaguggagaacgugcgcccuuggggcgcccagcgccagcgaggggagcagcgccccagccccuccguaggcucugggcccaugcggcugucugcggcggggcgaggugaaguucaugggcggccgcgcuucccaccagcuccggggaggccggggcccgcggagcccggggcgggccgcacugcuacucuguuucauuccgcaaccccguuuuguagguuguugaccaagcagucagaaaacacugcccccucucuccuuuugagcgaggucagagacgugguguuuuuuuuuuuuuuuuuuuuuuuuucuucccuccccuuucccuccccuuucuccgagucgaguucucaggcagcugcguacaaugcugggagcuagccagcagcagagacagauggcagaguuauuagaugugcaucauacgauucccuuccugccacucgcuuuuuaaucaaauuaaaacaaaaaagaaagagagggagagagagagagggggagucaauuaacugcauuuguauucugcucaauaauggacccuguuccacuuuuacccuaaggcaguugaguggaaauuuuagagaagaaaagggugccuagaacaaaacaaaacaaaaaaaaaaaaaaaaaggaaaaaaaaaaagaaaagaaaaagaaaaaagugaagacugcagaaauuuguaagaaucggcauuauucgaggaacuaauaaaaaccccucggaaaaguugaaucgaucucgcguaugcauuaggauuucgagcuccaucagggccgggcugccuuccagcuccgcugcgcaaaguugagcgucugacagcagcgccgcggccucccccgcccgccaggaauggucucuuccugcuuugcauauucaccacgcuuggcccggccauaugggaaaaugcaacugaaggaauuguugugaaaaaagggacagcgaguuugaaauaaaaguuguuagagugguacugaggagaaaaaagaauccgagaccauguacugcgcauacacaaucccgggcaugggcggcaacucuuugauguacuacuauaaugggaaagcgguaagcgaaugcgggcugcgagggggauuuuugacaaguuuuauugucgcagggaugagcauccuagguggugaucauuguuugcaaaguugugcaggacugccgcaccuuccugggugccaugaaauauuuaucauuugccaauccuaagaucuucuucuugccuacuucuucuccuucgucuuuuuuuccccccacuccucccccagaguagaaaaauagaugcuuucagagcuuuagagaguggauccuagagcgaaaguuugcagucagguaaaguugagaggugguaugauuuuuuuuuuuuaaagaguuuuggaaaauucuuauuccuuccaaaugacuguuagaaaggaaaagcagauaugagaagcagaauugagaaagcccaaguuaggcugagaggaaauuugggguaaguuucucccuggauugagguuuugugauaucuaaagucuuacuaaguuggaagcuugagugcaguggauagaguggagagaaccugaaagguuaaaauagagcaaacacauaaaacugagagaucaaauuaaggaguagauuauauaagcuuagauauauauuuaaagccaaaauggggaaggaaaaacaaacggguucauucaugcauauaacaguauugucauaaguuauuugugcuguguggcuucuucccucaauuucccccccuuccaacagaaacgcuuuauuuaagaaaaaaaugugucugguauuuugugcauaaccccagcagaagguuuauacuugccaucuggagguuuauuuuuuuuuuccuucgucugggcccacugaaggaaaaggauuucaauauuuucaaaucgguauguggggcucucgggaagaguuguugggugauagaggagcaaaaauuuauuguuuuaaaauagaaaagaagaaugagagaaaagugaaaagcagccauuuauaaacuguucucuuuguguacuuugaacuuccauuuggauugaucuuaaucagggauaguugggccaaaggggacagaucagagcuuucaggaaggcccaguucagcuguagcaauuggcgcaaacgaauuaaacauguguaugugcugcuauaugccugugaguguauauacauacagaugcaugcauaacgguuauuucuagaugagcauauucuguaauacauacauauacacaacuguuugaaggugcaguuucagaagauuaauaauuucauuuaagaagccaguuuuaugaaugggcaacuugaaauaauaucguuuacuuuuauuuugaaaaguacgaguaaaucaucaaaaguucauagcgcuauccuauuuuuaucuuuuuuaaaaaagagcacgguguaauuaaaauaguuaagugugguaagggaaauauaauuuuaaaacaaaugguuuucguugugauuugaucaaaguguuuaaaucuguaaacauaaauauugggauuauguaacaucuuuuuuuuuuuuuaacaaguacaugauuugcaauugguaguuacucauauauagauaagacuuuugccuauuaucuuuuagauguucucauacauaacuuauucagcaccuuucauuuuaaagcacuuuuaaugaaaauuuugugaaugaugccaucguagucaguaagcaaaagugucucugaagcagauucagggauuagauagcccuuauccguaaugaaagacuuacauuauaaaagaauauaaguuuccaugguuuuuaucuuucaggauuaccaaugaugugacuuuuacauguuaauuguuaauuuugcaucuuaaauaucugaacugacaaaauuuuaauuuaaguuuuguaccuuuuaacucccuuuuggccaaaaggaauuuucaaaaauauguauuccauucccacagcuugccaguugccuccaccguaagaaaaugcugaauaugacaucauaucacuaauaugcccucucaguugccaaauauuuugguuguuagauuuuuuuuuuuuuugagaggaugguacucauaaaaucaagaucgcucugucacaggaaauguauuuauaggaacuguuuuaaggcguuuauuaaaaacaaaucuggugauguguaucucuauugauucaaacacuagaaagaggcaaauuguacacacauuauaguuagaaaaaaaauagccauuuggaacaccagcagaaagcuuuugaaacugcggauggcuaccaguuguccaucuuagcuuuaugaaacagacagcaaaguccaguugugugugucccaaggaaggggccaauucuauaccauuuuuuaaaaugcccucaugcauacacugaggaagcagauuuuuguuuauucuacaguguguauucugcuggcucuaauucugcauugaguggcuuuugauuuggugccagacauguuguggagauuguauauaccaugcguuaauuguucaaaaugccuaucgaagagacuuuacauuucuugaguuuuacuuaucguuuggagguugaauaucuaugcuuuuuuguguguaugugcaugucuaaccaauguguguuugaaccugaauuguugaaguuaaguguggucagcuauuuguugcacaaguuuuccucugaagagaacacagcacugaauuccuucuuuuuucccagugacaagucaauuacuuguuuaaauucaguuugaacucccugaacugagagaggccagaggaagcagguuuucccugugaauaaacaaaagaagaaaaauggaaaaucauuccaaaacacagugauuuuagcuugugggaagaauauaauuaagcauuacaagaauuaugguuucuucuuuuaugaacuggcaacuauaggguuuguaaaaucaguuguccucuaacuuucuagcagaaauauaaucaaugauauuuuaggacaaacgaaaaaaacgugaauuuuuuuacuaccuuaaguuaugaaguguuuccauguccauaucccacaaaaaaauuuuuccuuguuucugugaacaacuguaccuguccagaaguguggacucugaaaaaaauacuuaacaaaaaaucguaacacaagagcuaucaaagaauaaauuuuggauauaaaccagaauguauuuuuaaaaaucaguuucuccucaggugagaguuucaugaacuugauaaaauaauuuuugugauuuuuuuuuccucuaugcauuagagguuuaaauacuaacggauccaaaucuaagcuuaaaaaaaauuaaagcaccacuucugaacuacgaaacagauuuuuuuuugcagagaaaaucaguagcuuauuuuguguuggaaauacaagcuuguaucaaagugugccaaugugucuguccuuauuaaggcuauaagaaguauuaggcauuaccugcucuccaauaaguguaguucuagcucuaaauuuugaucuuuauggcuucuugcauguucauugaagaagaauuuuaauaagugauuauuuggucaaauuucacauaucuaauauuauagcauauccacgaagauaaaauuauggcaaauaaaacugaaaacaaaaguggcgaaauguccucguaaugguaauugaagaucacaucaucagcucucgccagcaugugcauguguuaaaccguagagagaaaccuguaauuauuguaauugcucuuuuugcuuuauacuaacaagcuucaaaccauguuucaaaguaguuguuuugaaauaguuauuugucaaaucaucaaaucucggaaaguaaaugguaaugagcuuuuuauguuuauauucugacuguuggucauauuaugcagcuuuucaaguccauaaaguucagagaugaaacuggauguuaauuauuucugauaucaaggccaaagaauaaaauaauguuacgaguccugcuuaaggugaaaaauuaggaauauuugaauaucagaaucucucaauugggaaacucucuauucuuagaagaaaguuuuccuguaaauaagugacaauaucagucagcaaccuaaauuuuuuaaagcugaaaauugggguaugaagaguguagcuuuuucucauuuaucacaggaagugcuaagauaaaaagaucaauauuuaaaugacgccacuaauaacauuuuucaguacauuuuacauauggcucuuuuuuuuccccccaaaccucacaguugguuggaacagccacacauaggacauagguagccacuggguuuuaaaguuuccaguagagugucaacuaugcaaauuacauuuggcauuuuaaaaauauauuucuuauacuuacuauuuucagaaccaugauuauaaaugaaagcagccaguauaaaugcuuuuauuuuuuuuaauugcuguuuacuugcuauuacacagcaaaaauuugcuuaggccacaaaguaaucaaauuuuuaaauuccccacugguucaauaaaauaaaacauaucaaagagaaagcauguaggaaaaacugcuuuuuugugagcuuauuuuuuaaauauaguuggcacuuuaauuuacccauuuaaaaauaacaaugaaauuuuuuuuuaugcuucauuacuuuaaaacaaaauuauguugauuuuguucuuuauguuuaagcugauaaaaauucaccagacacuuaaucuugacauuguggcuacaucuugccuuccugccucugauuaaauuuucaaaaucccugcaugagauucacagauaccaguuugaacguuucugugaggcuaauuucucagggaaaaaauauggaucaguuacaucuuugguuaauuuuaucuaguuccuaauuucugcuaggucuaagcauuuuaaauauaguguugguaaagcauccuucugucgcugggugauggcauuauugcaggcagaauuaggagaaaggacauuggcauaggagaaagaggguuggggagaaaaguggucaggaaaaaagaucuaauaguugaugcagucuuuuaaauaccuuuccaacugaucuacaggaaauugugcugaagaaucauuuguuuccuguuccacuauaaaugugguuugcauuacauccccuguucggcuuuuuuuguuguuguuuuguuucuacuaaauuguaguaccacgauggaggcuugagaauaagugaugucuuccuuuauaacuuaucuuuuaauggcuugaucauaguuggauuuuagacacugucauauuucauuauaugaauuuuguauguguguguuuccaagccuacuugaaacuucuauuacugcucugccacuaagaaaaacaaugcugcagucuaaguucuuuagaaucacuauuguaggucaaauacauggucuacaugcugccaucagggaucuauuaaaugaaucucuuguuuacucauucagaaaauuuagagauuuuagaugugguucuggcaauuguaaaaguuguuagaauucagauuuacuuuugccuuaagaagaaaauacaguggagacauauauuugcucugcacagcugaccuaaaugcaugccuuguaccugugagaauuucaguaugcggacacauaaaagauuacugggccuuuuuucccccuccaauauuaucagaguuacaaaauaaauaaucuuucacagucaacauaguuuaaaaguaauuuuaguuuuaagcuuuuucaaguuuuuauauguuuaauugcacuuuauuagcccuuaauacuucaaacauaacucuaagaugacacaggcuaaaguuguauaugauaaacauuauugauuacuuaaaaaaaagggauaucuguauauucauaaaacauuuauaaucuauuuaggaaaucaucauaguccuaaaaaaaaagcaguuguuuguauaccaggaaaaagagaucaguagugacaaaaguggaaaagauacuuguauaaaauugucuccuuuagugugaagugaucuacugaaaguuauacuuggaauuuucagaaaauguccauaguuguaggcuuuauaacauuucaaauucuguaauaaacuauuuggcacauuaucauaucauuuuagguauauagauaccauggcauuuuauuaagcaaaacaauuuuuuucuucugaagaauacuuaaggugaaauuuacugguuuugagcuugaaagugguuugagaauuauacaugaacuccacuuaaacuuuggagacuuuccuuuuugcagugcuaaagauccaugacuugguuccaaacuacaaccuuuuauuugcagauguauuuauggcacaguaccacauucugauuagaauuuaagaguucacauuucugauauuucugucucuaaaugcuguguugcuucuguuuaccuaguuuucuuccuauucuuccuaauuucuuaaagaaaucugcacauauucauugagguauuuaauccaaaaagauuuaaaagagacacuacgccucuaacauucuguuuaggagaguauacuacuuuaaacuccguucuccccaccuaaaaaaggggggcuaaagaguggguuugaacaccugagaagucagaggugggaacaguguagaugauggucuaauuucaggcucaaccaaaaaaaaugcaggcuuuggcuggcauccuccagggaccuagcucugugcuuuccuagagaccaaauuacacucaucuugagagagggcauguugagguaauuggugggagagaguggggagaguugaauuccagcugcuuccauuguagcuguccugaaaaugaauaggggauguuaacaauggaggcuaacauuugacuuggcuuuuucaccuccacaaaccuaagggugagaauuauagaguacugaaugacugcaccaauaaugauccuguuuaagugggaauugcuauguugggaaaaacucacaccauuuuaaaaauaguugaugcauuuaccaaccacaguccuauuacuguagcccaauaaaguuuauccacaguauggaaacacuccuuuuuuuuauugucagccaucuaguguguguauuggaucuucaccucuuugguuaccauuuuaaaaugcuccuacugaaagacauuuggaaggcaccagaaucccaucuccaagaagggaagcaagauacaagugcccuguacucccuuucuccuagaauguguggucuuuuuuuuuuuuuaaggagaauaaauacuguaugacucaauagcuuuucuaacgaauaaaacaaauuaaauugauguuacaugcguauuuaaacccuauccaguuaaguacugaugugauuaaaauaaucaaauguauuacuuaaaaaauuaaaaaggauaaauucugcaccccauuauuuuauugacuuuuaaauauaaauugcagaaauguuuacauuccuaauggcauuauuaagcuaaacugacaaaucagaggaaaaaguugauuggccagcacauuauuauuucugcaccuguuauuacagaaguggaggcucagcauuaaaggagcuggauggaugcuguuuucuuaggcuuccuuugugugauguggggguugggauaaauguguaacaaguguaguuucacuuuguagugccuuuuuguguguugaugugauuaaaagacuacaguguuuuucaugucgcuuugaaauuaauaugcaaauaauaugggauauuagggcuucccucuaccugcugcacuaagcuucccuaagccaaaugggguggggauuggugucaacuuuuuucauacaaguuguuuaguugcaaauaucgccaacguuuuaucucuacucugugaauuuguaagggggggagggaaaugucaaacucauugaaguaggauugaagaucugggaugaaaauacuuuaaauuuuuauuuucuacuuauauaucagccaggauguuaggagaccuugaaaacauuuugaaaaaguuguguaacauuaccaaggcuuugguauaagauuauacuuuucuucugguugaguucuuccuuguauuaaucaugcaauaucauuucucagacacuugagcccggcucuccccuggagcauagguggcaauaauuguuuguuauuauaauucuagaauuucuuggguguucauuguccguaauucauuucacacagagaaaucuaaacuuucuucagccaguagaauaaauaaugccuucccuguccuuuccuuuucuuuuuuaaauuuugaguucuuuaggaaugucauuauagucuuugaaacguaaugacauuaaauuuggauugaaggggaagggagaggaacuuuuauuucaugccauccaguggcuaguuugaguuugcaaagaaauagauacaaugccauuauuuucugcaagauacuaguuaacacuauucucauaucaguuuagacuuuguccuguguaauaauuuaaauuccuagauuuuaauaacacuuaauauguagcauggaucccacuuaaucuccccccggcuucacaacaaaauguuuacauaaaugaacucucaauuuugauaucaacuauuuaacucacucuuuccugaguuaauacuuccauaauuaaacauguuccacaguugccauaggaguguaucuuaaaaaugauguucuucucuguucuuuugagccaucuguuugcuaggucaguaaagaaaugggagccugauuuuauuuuaaagccaauaaguuauuacucuacuauuguauuagacauucagcuucagagggaguaaaagauaaaauuccaucacauuuccacuuucuuacauuugcagcagaaacuuguaugcucaaauugguuauuuucaacucaugacagcugugauauuuaaaaugaucacagcuguugugacuuaaaauugauuuuucuauuaacaccugagaaaaagaccugugccguauuaaaaacuuaaauaagguaacuguaaaauuagauguguugaugugaaucugguaauccuacuucccagagguugcaaagugcagcacaccucuugcaugcuuccagggaaugagcuaaaacugcuagaaauagaugcaugauuguuaaaagcguuuacauuuuaaaggauuccuguaauagcagauccucuuggcccaacuuuacagugucacuuuugcugauaaaaucauuuaggauucaguuuccuuaauuaaccccaagaaagaugacuuacaugaaucauuaugauauccuaaccucuagacuagagaagcugcuuuaccuuucagauaugacauugaaaaaugcaaaaccauacggaauuguuucuuaugaaggaaguuuugguuuuauggugcuuuuccuccauuaucuuuagaugacgaaaaaggaaaaacagaugagaaaggacaaauagaucauggcuaaguagcuuuaggcuagcacuuguuuuuggaaucuuuaauacauuuuuaaucuucauguugaagauccauuuaaccuguuuuaaaguuagauggugauuccuggguucaguuggucuguuuaaauguuuaccuuuucaggauaauccguauuagaaucuugcaucucucaauagauuaccuauuuaacaaaguaaccaauuuaagaaaaccuaaacacauuuauacauuaagauauuuuccuguuucgaguuagaugauguaguauauaaaauauauggcuggccugauguggaauuauguauagacaacagugucuucacagaugcauugccaauagggagcuauguagauuaaacucuuuggccaguccuaggcuuuuuaccuguguaacucaaucagaauugaaagcaugacagguuuuaugaugaugaauguauggcuggauuggagaaaguaugguuggguggguagauagauggauagauuucauaacuagacaguaauagauaaugccaauuauuuauuacucaaacuuguuuauuccucagaaauuuuucugcagaguauuauuuugauuauugcauguaguucagaacauuuaguugaaaaugauaaaauauuugcugucacauaaucaagacugcuauagaguugguucuaaaaguuccagagugaacauacauuaccugugucaaaguuagaggcuaagacuauggagggccauaagaucacaaagucagacuaucacauacuaagugaucaugggugucaauggcuauuuccuuguuuaguugaaagaagauacuccucgagauggacauuguuuauaugaagauuuaagaaaaucaaaguggauauuuguugcugacagacuaagauuacaaacauauaucuuuagaacaggguguuccccaggggacauacggcaauaucuggaaacgcuuuugauugucacaacugugggggucaggcaggagcuugcuacuggcaucuagggcuggaggccagggaugcuacuaaacaucuuaacagcgugcaagacagacccucagaagugcugagguugggaaguccugcuugcaaagugauauaucuggaccuuaagaauuaaauaaugucauaauaaguuccauaauuaaaucuuggcauugugaggcauuuauagaggauaacauuuuuuuguuuuuuuucuuucccuuucuauuucccuuuuccuuuucuuuucuuuccuuuuuucuuuuguuuccaaaacauuguuuuuuguuuguuuguuuuggcauagcacacuauagcauugcccagguauuucuacguuuuaccaugaaaacgugagauuuuauaguguauuaaauauuguacauuauuugugaaccaacuggaauggcuucaaagcagcuguuagaauauguugagucaguaacacaacaugucugcauacccuaaacauauauuugucuuaccuuuuaaaauguuuagaacccucuaucaguguaacuauugguuugucuugaaucauccuaaaugaggaaguguauuaccauuuuuucccuacaggacauaaaguggaaagaagaaauuagcauaaagaaacuaauuaauaauuauguuuuaaguuuuuuggcauuacggacauuguuuacaucaucauuaacaucauaacaucauaucgucuguuaucaagaaaagauuaaaauuuaaagccaacauugaagauguucuuuccagcuuucccaauaaugcaacuccuuuaccuccucacaacuggggaccucucucccugccacugcugcgcuucuccucaauguggauaauucuuggccaugauacggaagugauuuugaaaccucaguugccuucuguagcacccuguggaggaagguggcaggaucugguggcugagucuuacaucugccaacuucuagaccucacuccuuaggugccacauuuuggagcuaguugccaagccucacaguaacuugagccacucuucaauuuccuccccaugauauacaaaguucuccaagguuuaaugagaguagauauggaggcugggcacgggaauggcagcucugauuugcaguauaucuuugguguacagauaugcuuucauuuauugcuuagcccauuagcuaauggaauuucaauuccuucccacaggcauucucagacccugcacuucacucuuccuguuucccuguccagcuugguacaacacauucuaguaaaaucacacugauguguuuagguuuacuuuguacaucacaucuguaaccaucuauaaguuugcccuaaacuggcauuuauuuugaacugucuuccaccuuuuauuguacagcguugucuguacucaaagugagcaacugaaaagaaaauuuuaacauucuuuuugugugccagacaaguaauaaagauuacuauuuuuaugguaauuuuuuuauuugaauauuucuguuucuggaagaugguaauuuuuuuaaaucaugaauuuccuguaagugaaacuauuugagggaguauugaccuuuuuuugaucaaucauugauuaucuguguugcacucucaguauuucucuuauaguccauaugucccucugaauaauuguagaacaauaacuugcuuacacaguguuuuuagaauaugcuucaggaagcuugccugugugguauuuaacucagacauuuauggaguauaaaaccaaucuuacugugacuuuuaauuauuaggaaaguggcuuacaguuaaaauaaagcuuacagaaaauauuguagcaauaauuaauauccaguaaaauacaguuguaagcuucgguucuuucagacauuuucucaacccaguucuaauuugaucguuacugcaccucaguaagauaggugaugcaggagucaucaucccauuucacaggcaaagccuggccuguucagugagguagccacuggccccauguggcuauuaacauucaaaugaaggccaggcacaguggcuuaugccuguaaucccagcacuuugggaagcugaagcgggaggauugccuaagcccaggaguucaagaucaacaugaucaacauugggacacccugucucuagaaaaaguuaaaaaaaaaaaaaaaauuagccaggcaugguagcgcucaucuauagucccagcuacuuaggagauugaggcaggaggaucauugagcccaggaagcugaggcugcagcaagcugugaucaugccacugugcuccagccugggcagcagagcaagacccugucucuaaaauuaaaaauaaugauaauaauaauaauaauaaauaaaugaugucagucaaugagaauuaaauaaaacuuuaaaaagaucacuuccuugguugcacuagccaaguuucaauuacugaguuuucauauaugaucaguggcuacuguauuagcacagauacagaauauuuguaucauuguagaaaguuccauggggaggugcuggccugggaaauggaagcauugagggauuaaaacuugcugaagaucaugugggucaugacagaauagagucauugcugcuauauauuccaauaggauauuuuuacauuuuucuuagcuuuauugucaaauaucugauguaagaauugacauuuuaaugcuaccuuguagcacuuuacugaaugcuuaucucaacugaauuuaaauuuagagcuugaguuacacaaacuuuucaaaggauacagcccuuugccugucugcacacaauggggaccuugaauuuccagccagugauacccuccagaagggaccaugucuuaaugcaucuuuguagaccuuuuggcauauuguagacaaccaagaaauguuuaugcagccuaaugaaugugucacauccaccauacgggcauauguccauacauacaguuagacaagaccuuuggguagaaugcucccgagagagcuggugucugccaaauuuuacagagcucaugccucugcucuugcuguuuuaguaaaaaguaguauuuuaucaaaaguuaaauuggguucaauauucaccauuuggguaauggguacauuagaagcccaguccccagcagcaugcaauauuccauguaacaacaagcacguauaccccuuggaucuaaaauuuuuuaaaaauauguauuuacucacauaauccaaauauuuuucauaguaaaugaaaacgucuguccaucuuguccuuagcagucauuuagucccuaaccugacuuuguguuguuauaaaguugugucacuuaaguaguacuuaaguaaguacauaccuacauccauacuaucuuuccauuuccugcaucacugaguuggacaaaugugcccaguuagcguugguagugcugaagaccauguucauucauacaugcacucaaaaucauauuaauuacuuuucagugauaaccauagguggcaacagaugaaugggcuagcccuaggcuauuauuaagcacugggaaugagauuguuggugccuuguaccugugcuacuuuaacaggugagacaauuccagagcuuuccccaucauccucucguugcuacagucuagacauugggagcacuggaagccuauggugacacagacuggcagaugccuugggcuucuaaugguguauauguaagccaucauuuuguuuguaauaauuaugguguugagaagcauuugugugcugugcacucuuucagcuugugccacguuuaguuccuguuaugcaaauaccacuuuaaacuuagaaauuccaauuugcauuaauauuuugguuucauagagcuaacuauugcauuucacaaacaagugcauuuuaaugaguaccggcagaaugauuuaaaaauguuauuuauuaaauacuauuguagaaaaugcagucuuugguugccagaaacuauuaagacgaaauauaauguguguugaggccacagaguacaccucuucaagaguauuugacccuuauggcuuucagugauacaacagccaaugcucuucaugcaggcuuggagggcagagguaauuaauauaaaauagaagccagcguaccauugacguuuggguuuacuuuuaaaauguaaacauauuuuuacuauuugacauuugucauaagaccauaggucauuuaccucugaguuaaggugaaggacuuuaccagucauaaacacccaaguuuuaaagcaguguuuucuuauaucuuacaucuugauguuaaauccugaaauggaguuuguugcugcuuuauaauuuuuuucccucuuccuaaaagccuuuuuuuaaaucagaauuguggauaaaaaaauuuugauguacaaugugugggaaaauaaaaauuuugcaacuggauuuucagaaaugaacuauuuuaacacauggacuuugaaugcugcugucaugguugucauagcuugugguuccuaauuauaaugagcuuuuuuggugguguuauugcaguuguuuuauucccccugcccccacccagucuucaacucacuuuucccagaaggagaguuccaagccuuugaaaauucucaugauuuugcaaauccacucuauuuuugucuagaauacaggaaaguuaaaacuguggcugguaugaugccauguuuugaauccaauuuuaaagcaacccuuugcaacccagggaguaaagcugacaucuuuguaucuguaaugaagauaauuauaccugcaaggugacaucacuagcaaaguaacaaauacccuugaaaacggaguuccuggucuucucugaauucuguagaccacauuuggcauuuaacaccagacaccucuuucaugccugucguuugagaaguugcuuucagaugaauuuacuaaagcugacugacacaggguuaaauuaauucuuuucuuuauuacucaaagugauacagaccuuucuuggacuaauguagcuuaauuaguggucaauuaaaacugaacauugcugaauugaaguucuuugaucaaacucccuggcaugggcuugcuuucuuuaacuagccaccaucuugaauucauuuggaaucaguaguauaaacaaguuaaaaacugguucuuuuauaagaaagucagcaggcuuguauagcugugguuucuuuuuuuacuucuguaggcggcaauucaaaggcaugcuaaaugaaaacaguacuacacccugaaaaaauuacauuuuuaaaaguaacacuaagcagucagaaaacagucaacacccuuaccuguuuauucuagauacauuuaucuucuauguagaacaaauaauuaauaauucacuucccaauuucagugguugauuuuguuguuacauggaaggugaaaacuccccacccucccuugcaaagucuauaguuauaacaaaaagugaagcaaacaaaauccaaccugguuguugggaguagagucggaaggggcacgguaaaugaaggugugcccaguugcuccuaaauucauucuuugucacucuugggaaaauaguucaccucuguaucuuuggagugggagugacacacuacuucauuuacuuauugauuucaucauuuauuuugaagggcauuauccuaucaguauggaaacugauaauagcauauauuucauaugaaucacuugauuaaaaauacacauugcuuuuguuagaauuugggugaaguuacaaaaaaagagaauuaggggagcugaaaacuggggcagaggaaaucguaagcauugguaauaagaucacccaccuccauuuauccaguuacaugucuuaauauuuaaaguguauauaccauucuugucuaaacauaaauugauaccauuccguaauccuaguuuuugaaagcuuaacaaccaaaaacauacauccuagcuggcauucaguuagugcugugcauucuggaguauuaauugaaacugguacuuuuguacuggaaauaaaaguaauagauuagguuuaaauagauaauuugcuuaguucauagugauuucuucugguuuuuggaaauuuucacagagaaagaguuaaaggaaauuuggaagugaccauguacaguguucccccuguaagugacagaauuuuugugguuuucauuacuuagaucgaaaaauuguaguuauaaucaauaauuaaaauuaaaaauuuuaccaguugacagaaagagaaauuguuuauagucaaugugccuuucagccuucucucuugccuucucccuaaaaggcugauuaggauguaauaauuggggaugauagcgggaggaagacgacaauuccauuuaauuaaagauaauuuauuuuacuucaaauuggugaugucccacaugaauaagaguagcuuuagcagauagauuuauuaauggguacugacaucucaguugacagaaaaagcaaacauuuucuuuccucauuguuuuuauugugucccgucaccugaaacugcugucaccaugcuuccuuugcugcuugacagagcuguagacuuuuccaccaaauaugcaauuauugguuuaucauugaaacaaaguugauccucuucugaguuaaaaacuaggccaggagcuugaaaggcgguucaggcuuucagagcuaaugcuacaaaugcucucuucuuaaaucacauuuucucaacugauccuucccauaucuaguucaugaguagauugaaccuuuugaauaaggaccaaagauuuccuuuggucuugggugaggugcuugcaugaauauuccuuuaauaccuugaaugucuuggauaaugaaaugugccccaaaaaacuaccauuugcauuacuuagguucauuccugacaaggaauucugcccucgugugauauguucguuguugucucaugcaaucguaaauggaucuuggaaguugggacaguuuuuuuuaauuaggaaguagauucaagaaaugcaugauauuguuuuucauauaaucuccucagucuauagugguuguaaaggugugcuguuuagcauaccuuuagcaaaacuguauuuauaauucuauguaucuuaaggcacuuuuuaaaugcuucugacaaacugcauucuguuuuuccaaugucuauuugaucucuguuacauuaggcuuauuugucuuacucucacaucgaauuccuauauuuuuguuuauguuuucugguguucagucauuucuguaugcuugccuaguauguuucuuucauaccgucuucuucacugaaugaaaugcagaccaccuuggccacuuccuuccuucugggcuucuuuuccuauucacaacuuccgccauucacacugacccucuagcuuuacuuauaucuauugcuccugcugcuuuguugcucuaauuuucauauauauuuccuuuaugcuaauauccuuuccuuaacucuuuggauuucacugguuugucuuuccagcuuuauuuagaaaauuaggccauauaacuaauguuuacaccguagaaaggaaaaugagauucuuucuuucuuuuuuggaagugaagaggugagaagguugugguagagguuuucuuuuauuuuaaaccagauggauuuauuuuguccugcuuugcuauuucacuauuucaaauugauuuuaaaucagugaugguguuuucaaggauuaauuuuuauuaaaucuugauuuucaugucguguuaaccuuuuccuuccccucagccaaagggucuucuuccuuuuuucuguccauuucacuuguuuguuuuaauaaccugaucucuccagccauuauuuuauccucaaauccugccacuuuuauccaucuuuuuuuauugcacuguuguccuuacuucaccuuauaucuuuucuucuucuguaauuauuacagaauccaugauaccuucuccaaaauucuaacaaagaauucuggaaaaggagaaauugggaaagagaaaaauugcaaguaauguucuuugcugagcccuaggaagucugcuuggauuuuuauauucgacugauauuccucccuagaguugcagucaugauucuauguaguagggacacgaaggcaaaaguuuaaauagacuaacacugacccuuaauuggaggugauaauccuacauauaaacuuucaggagggaaagcgauccugcauuuuacaucagguaaacucaguugcacccauugccaguagcugggucagguguguagggguguguguguguguguguguguguguguguguguguguguguacguacugggagccagguuggaaguaggaagagaaggagguucuucuuuccucucccacuugcaagcuauuuucuuucuuuucugucuguuuucauuauuucuauggcaaguuuacuugccacgucuuaaacaccuucaaccuuuuugucucuuccuuuacuuuuuugcuuuacugcuaucaaagaguuaaggaaguccauuaaauuggaggccauuccucaccauaagagaaaucuggaugggaugcuuuugacaacugggcucucuuuaguagcuucucucuacuugggaaaaugucagauauuuugagaaauaaaugcauugccccaaacugaaaacaccacuuuuauucuguaaaagaggcauucagggaaggagaccuccucuauucccaggaggucacaggaacugggaguggcaagaaggaagcugcuaaacgggcuccagaugcagcuuuauccaggggacgccucaugccuggucauuuggguggcugggcuugucccaccuccccuucuucaugcccuccucccggucucauccuaggcccucccaccccuaggccagccacaggccucacagcggacaucugcgggucugaguuucauauauccagcaugaaguucccucucucccucccauuaugaauucugggcugugguccugcuugcuccuugugugucagauugaaguucugaugcugucagccaugucugaccaaucagcaaacaacaccacaggaugaaauuuaaacaaugcagaugcucagauacagggcuauguugccuggaccacgaagggaaagcagagguaaggucagagucuccccaaaguggucuauccugagccugccugacuugacaccucuugggcugcacugugcugcuuugacuuguauguuacccauuugcuuugcacuacuucugucuucccuggcauucaccagaacuuucauuuuaauucgcucugcccggguuacuuuaccaccuucaucugcucacguccuuuucuuuuggauuggugcugacugucauuacgaauguuccuggauugccucguggccgaggguccuuggcaagugccaccuuguucaggucuuuuguggccagacuuuuaggaauagaggacugcugaggaucagggcaaacggacggaguuaauaggccuuauuaauuuucccucugcaggacaguggaauuuaucauucgguuacaaccacgguuuuguuucuuaccauugugauguauugaauuguaaauugagcuuaaaucaucuuuuuuucucagaaacgguuuacuuagaaaagauauaaauagauacaaccuaaacgaggaugaaucagcucaucuuccaagaguuuuggagggggagaaagggaauugauaacucucccccacccgaauccccccccacuuuuuuuuuuuuuuuuuuuuuuuuacaguuuuugguguuagcucacuagauuacuguuugcaaaagaagaaucucaucaucauccucuucuguuuuaaguguuuacuuggcccuuuuauaauuuaaaguguuuacacgguucugugcucccuaggcccaucuggaaaauauuuaaacuucauaagaucuauaagacuagaauaucacauauaaugggauagggggaaggaagaaaaauuagagccguugcguguguuuagaauaaguuaguuguuuguucagaagcggcugcuggaggaauuggaacaaauagcugugugcggugaacgauuggguccagagcuguacauuucaccacagaaugagccuugguuugugaaacugacauucuguugugacuucuaaauccaaacaaaucucugcaaauuucugcccgaucgaguuaauaagaaaauauauacaugcagaggcgagagccguaugcuacuuguacuucugucaguguugguggaaauaagagacggauuuuaccuacuguauuacauucaaccagcaauuggcagaacccccagcucagcggguuuucuugacuuuuuuuucugcugugagaacaaugggaugcaaaagggcuucagaaaaggagagcagcagauacgggauuggggucacuuuucuucuaauugccuuguaauuggggagugguuuccacuuucccacuaucucacuggugggaggggaggaagacagauguggcuuagcgguaacgagcuuucuccaggccggaugugcugagggaccaggggggucauucccugcucugggccugugaucugcuucacaccugugcucauuuucccccaugaucgaugaccuuguauuaacccagagugaccuuuugccuucgccuguucucugggacgagcucuuggcuaguggacccuccuuucucucugauuuacaggugguuacuggagccacauacacuuguuuuucauggugcacugugcacuuagcagcccggcaagaccugcaauuucaucccucucaaggggccaagcaggggauuggaaggugggagggaggagggugccgcgagagugguugcuguuugcaugugcuuuucuauuuuguggcucauaugguaucaauuaccauuugauggcaacgccaggccugaggcccuucgcauguuuguccugugagaaagaucuggaagaaccgacauaugguuuugauugcagcaauugcagguugauagaaugaacgcaggggugagguggguggguuuuccuuccggcccuuuccacucuggguugcuaaugugcuucgcuuguggaacuggucuuuucaucauccagccccucccccacuuaccccucccccacccccaacucccugccacuuugcauucccugccccugccuuccaaaugaccgccaggaacauguggcccacauuaaggaccuucaauuaaaacaaacaaaaaauuguccacucuucuguucagucccagagcaggucaguccaucaagaugguuggaaguguaccacaguuaagaaacaaaugguuggcauagggggcagauucccuccagaagcuugggacauguuuuaaaauggcuguuaguucagauuguuaaacaucgaaaugaugcugaaaaauagcagcaauagagauuaaugugggguguguguguguguguguguguguguauaucuguauguguguguauuucauuuaagacaccucuuggaaucugugcaucugcugcauagggacaggaagaugaugauaauggauaggaguucuuugggguuccaucuuucuguacaucccaggccauaagaugauggaaaagcaagugaggcaugugugucucuaugagcauuucccuucagaaggaagauguuggagacucaucucccaugcacagugacuucucucuuacuaaauuugugaugguaggggguacuccucauuacuguggcucagcagggauugcaucugugaauaugccaagggagggucuacuauuggggaauggugagaggcaaagaggagaaaagaacauuauaggcacuuugaauguuacccagcaacauuuuuuuuguuguuucaaaguaacaucuuucuauaaugcuuucaaauuuaccugucugguaaucuguucuaagaugggcagcccaugagguuuugacuuuuuucacuuuggcuauugcauuucaaaauauuacucacaauuaggaauuuauaccauuugaaacaauaaugugguaucucaugaguaaaugcugccauuaacaucuuccuucuuuuaaacugaaaacaagcaaaccagacccaaaaaaaaaaaaaaaaaagcagaaacaugcucccccaagaaagcuuguuuuuuucuuugagauggagucucgcucuguugcccagguuggagugcaauggugcgaucucgacucacugcaaccuccaccucccagguucaagcgauucuccugucucagccucccaaguagcuaggauuacagguguccaccaccacaccuggcuaauuuuuuguauuuuuaguagagaugagguuucaccauguuggccaggcugguuucaaacuccugaccucaagugauccgcccaccucggccucccaaagugcugggauuauaggcgugagccaccacaccuggccaagaaaguuuuuuaaaugugagaugaauuuuuaguuuugaaggccagcuauugaaaccuaaucacacugcuugacauacuucuucauauuuaucuuuauauuagagcugaucuuuaucaaaagguaguagaaacuaaaaaacuuaaguuauugaccuaaauuguagggaaaugucugucugaucgacucuagagagaaaauuggccguaucuuuauaaugguuacugaauguauaucuucaugaggcuacaguuuuuuuuucuuugcuccaacuuucuccuuaugauguagagauugguguauuaaauaaucacuuuuucaacagucuugaugacaauuuuauuuugcuauuucauaaucuucauacaaugggauaaguguuuucagagauacguuugaauucagagcaacuggcaauuaagugauuugcucuagucacauguuuuaguaguagcuauuugguuauuugccugauauuuaaugcacacauauguacccuuaaaucaucauucagugugauagcuuaagacaacauuucuguuugcugcucaugccacuauuagcuacguuugaagagugauauacugagaaguuuaauuugcugggguuuuuuucuaaaaacauugcuuuccugaaauauauaguauugggggcucauagcaaaaaaaccguaguauauggguugugagccugucuucgaacauggugggucacuuaacagcagcugugcuggagagauauuugauuugagaagacuguuuugaaucuucucagcccuaacaccauucugguuuugaaaugggaaaauggaaaagaguuuuagggaauagagauaucucagccuugaaaggaagcauagguagaaaucuuucaguucucacucagaugaaccagcauuccuaaucuggcuacccucacagaggacaaagagucugcugggaaauguggguuuauauuuguagagacacacuucagaggcaugagauaguguuagauaccgacuggaugcuucgugcccaacaucaauuugguuugcagauugaaauuuaggaaagcuugcagaggagccaaucuuuuuuauauacagcaccuuuaaaaaaaagacuguccacuacuauuaaaaucugauucagucuucuaaaauauuacuacauucaagacaacuuuuaaaaugaucaaauuuagauagacaucaaugauguuaaaagauaaaagcccuccuacauguaauauauagugucuuaaaccuuauuuuuuaaaaaagggauaccacuuuugccaaaaguuucaauguagggauacucaaacuguccuuggaaguccuaaaaauugcuaguuuuuuuuuuguuugcuucuuuuuuuguuguuuuuguuuuuuguuuguaguuauucacaaauggagaaauauuuauaaaauuauauuauaauuuguaaugcacgcaaacaaccaucagaccacacuugaaucagagaguuacaguuauaaauugaggaaagaggaugccagcacaaugccuaauggagugaaaaauugugcuuauuuucacaggacucucuuggagaggagcuaacuacuuuccucucucuuaauacccagacccucucccucagcccugacagcacguuacagaaugcauucacuuagugugugaagagcuagcucaccaccucccuuuaagaucuauucuuguuauucauacauugcaaauuuguacuuuuguauccacaaggaagacauuacuaacuucaagaaaggcagugucaaugaggagcaggaaaauacaguaugauacaagccugccaaugaaagaauuauacucagacucuaugcgcucuguuaaacaaaauuugaaccuuugaggaaaaaauauuggggauucugaugaguguuuuuacucuuucuuuccuuuuuuuuuuuuuuucuauuuggaaaucauggcuuccugauccuaagggauaaaaaaaaaaaaaaaaaaaaaaaccucaaagaaaagacucaacaggcuuucuggacaucaaauaguuccuacaaaacaacauucugaugacuugcauguaaagaaaucagaaacauaugaauuaagcuucucucgaaauacauauggguugaaaaauagagagaagugcugagaaaauguguuuuggguuuugcugagcccaugacguuugaaaaauaguaugagacauugaacaaacacaaagcauggcuuggcucacccauuccuaauauuagccuucuaguucaacggcaaaucaguuuaccaugugccuaaaugugagccaccuuggugcacucccccacacuuaauuauaugcaguuuaaauuuuuucaauuaggagcucaaaaauaacauugcauuucaaggaaaugcaaaucuuagcauuuucuuaccugguuuguucaccucagaccauuuuagaaaacaccacagauuauuucaccuuaggagcagucacacugauguggcccucuuugauguggcuggcauauaacagaagaaacguaucauuuuuaagaaacuggcuccaaagacaauauugcuauuaaauugaagccaaaaaccacugcagguaaaacaugaugaagaugaaggacgcccucucuuagccauauaguagaagcccgaucauagacucucacccuuacaccaugacuugaguuccugcucauuuuuaucccugagcucugcagacuucuaagcaguggaaguuuucauucucuuucccacauugcacucaagagagcuaacaugagagauucuaaauccugggauuccucugcaucuggcuuuaaguacaggagcagaacacagggaauuuaaggaacaaaaauagccagagcuucaggcuucuuccacugaugguaagucauugacaugcacuuggaugaaauccuguaucuguucuuuggacuagcacuaucgccugagauuaucaguuucagagaguuacagagaggcaguagauuucaucuuuccuauuucaggaggaguuauuuugguuguuuaaaaaaaaaaaaaacacuuuaauguacuuuuccuaacuccuucacucagaugguggcaagaaguuugacagaauaaaguaauucagcuaauauuuaucaaaugccuacuaugagugagcuguuagaauauaacccugaacaagacaagcaugagauaggcaaacagacuauuaaaaccuagacugauaaugcauugauugggguguacaggcuccuuaagguagauauacaaaggacaacuaguccacauuuggccuuagaggaagugaagugcaaggaugaaugggaauuaagcuggcaaaaugcaaggguuauaacuggaagcaggggugagcauggcauauccggugacccagaaguaguucagaaugccagaagcuuaugguacaaaaggauaacauaaaagaugagacugaaaagguaaacaguggccugaucaaaaagcgacuugugagcccuauuaaggaguugagauuuuaucaugaaugugacgaggagccuuucaaauggguaugccugagaaguaauugaauuuaaaagucaagacggauaggaggaccuggaaaacuuagagucagagaagccaagggaggcagaucugaccagaaggaggaaauugucaacagugucagauguugcugaaagauagaagugacauuuggcugcagcauccaggaggucuugagcaguuucauugaaguagugaguguggaaggaagguaaagaaguggagaacaggcauugcaagauaauuuuccaucaucgucaucaucaucguccucaucaccggaaaaugagcaucaauuaucuuaucuaccagacauagagagugaccagguaaggaaugacacaccugcagccugggagauuucagaaaacagaucauaaauauaaaacagaagacagcaacacaugguacaacacaugcaaagggcaaaaugagcaguguaggccaacgggaugaagaacagaaagaauuagggggcaggugaaaugggagaguuuuucaagcagucagugcgcuugagguuugcauucuggauugugccuccuuauaagucaguccaaccuguuuuugauucuccauccaguggaaauaggaaacaccaucaaagaugaugcauagucuuaacuugccugugacuucugauuauguuuccgaauuuugggaggaagauuaaagucauaaacugacucuugguuuguuauaauuucuugcaacuguuauuuuaaaaauccggacacaggccaaggcaggaggauucucugaggccaggaguuugagaccagccugggcaacauagugagacccugucccuacaauaauaaaaguaaaauaaaaagaaaaucuggaugcagaaacugagguguagauaaauauagcaagucagagauauucguaaauucuacaucgaugaguuucuugagaaauucugcacacccagugcuggacaacuguggaauugcagcgugauaccuuucacaucugggucaucuccauaugauaucuucuuccugguacaaggccagaaguucaccccacgcacaacaccuauggaagccacuuacgauucaaaggacaguuuuucugaaaaagggugcaugauguauacuucccuucaacacuaaaauucugcugcuuaaacuuuguaagugaaggaaaggacugguucucuucuacuuuggcugucuuccuuguuuccuauuuauugggugcuugcuuugggcaacccauuguauuggaugugcucuaaaccacaaucuuugcuccuaaggaguccguaguauuuaucgggggauacgaccuggauaauucauauaagauaugaauuucuuucuuuuucuuuuuuuucuuuuuuuuugagacagauucucacucugucgcccaggcuggagugcaguggcgcgaucacggcucacugcaaccuccgucuccuggguucaagcaauucucaugccucagccccccaaguagcugggauuacaggcacccaccaccauacucagcuaauuuuuguauuuuuaguagagauggaguuucaccguguuggccaggcuggucuugaauuccugaccucaagugauccgcccaccucggccucccaaaguccugggauuacaggcgugaaccacaaugccuggccaagauaugaauucuaaaaaaaaaaaaaaaaaaaaaaaaaaaaaaaaguccuuggaaaguuuagaagaugaaauacauuuaaugaaaauugagcucauucuuccccaauauuuguuccauauuccucuccauauuauacuauuaguacacaauccuguuuggacuuacuggaaaaaagagcugaauagcuuauccacaugucaagaaacuuucuguuuaagaacacugagguucaucaacaucaaaaaauauuuucagcaucauucaggcacuggacaugcucuacaaauuaaauaccuuagggccccuacuauuucaguguuuucucagugucuuguugcaguggcaaaugcuaugaacuacauuuuucaaaugaauauugaagauugagaaagagguuaagaaccucuaucuauuaacgauagaaccaaaucuagaaagaugucuccugcucuguagagcacauuagggaucauuauuuauagccauuuggcucucuuaagacauuuuggcaaugagggaaaaaucauagguugauuuucuugguggaaugaagaacauugaguuugcuaacaaagagagcaugagugacuuugguaagagagcaguuuuuauuucaguggaaaggcagccuccucuccuaauaauagcuacauuauuuaccuaaauguuccauguagcaacugauaacaaggcuuacugcuuaagaaauuuggccaucaucuuguccucucuacuagaauuccaucugccuacagaugggcccuugcuaauauuuuuuuucugaaggacaacauguaacuuaagggcccacuacuguguguuauuuuguuuuuuuaauugaggugaaagucacauaauguaaaauuaaccauuuugaaguaaaccauucaguaauauuuaguacauucacaauguugagcagucaccacaucugucuaguucuaaaacauuuuccccagcccagaaggaaacucuguauccauuaagcaguuccuuccuaucccccuacuucuaggcuuuauaaaccuuuaauuuuaauguuauauacacacacaggcauacacauacauauaugcuauacacacauauguauguauauauguauaauguguguaaauaauguguaaauauagacguauaaagauguauaauguggguaaauaaauggauguguguauguguauauacauauauguacauguauacauauauacguauauauguauacauauauguaucuacgcacauguauauacguguauacacacacacacacacauucaugucuauuuauagauuaggaaguuccaaacagaggaccuaauauuuccuaauuauguaaacaaagaacuaucuacuuuaaugaauguuucuccaccaggaaaaagaaaaauaggaaacauuccuugcuucuuuuaaccugucuguauauuucucuuaaauucucacuagaugcuaauuuaucaaggaagacaaaaaagacagaaauaauccugagccuuuuguuguguaaaacugcugcucuucuuguaaagacauuuucucauuaauuucaucaacacugagaauuuuaaacugcuucucaauuuuaagcaauuguauggguuuuacauuucuauuuuugaaaauccaaaauuauugaacaaaguaauuuaguuagcaaaguuuacauuucuuggaaagaaauaugaaagggucauucuuacuauaauuuuuauuguuaaagaaauugcuguuguucacauguauuuaugcccuccucauuccggaagaauauuugagguagccaguagcacauuuuuuugaauuaagaaaaaauuagaucaaaugaaaaaauaccuaaaauuuaaauauuuagagaaagccaacucaauuauauuuuaaauaugccugaagucgugaacuaacuaauguugaucauuuagucuucugguccuaucucaggaauauuauugcccuucuuaauucaucuuucaccuccuuuaagaaguauuucugaauaacccuauaggauaacuuccuuuacauuucuuuagcucauaugguuuauacaaaaggcuacucacuuuaucacauuuucuaguugcuuauuguacuucauaaaucucccaacuaguuccuagugaaaauucugcccuucuaauuuuuuguauguaauuuaccaaagcaccuagcuuugugcuagcuaaaagcucugcucugaguuaaauuagugaaauauugcugguugauuucaccuaaaaguuugccccgggcaggagggaagagggugggcauuugaauggguaacagacagagaagcagcugauuggacauagauguugacaacuugcauacuuauuuuuuucauuucaaucugugccacagagucauacauuugguaauuauuucaugcuuuuguuuucaguugaaaguaguuagggccauauguuuugacagaaaaaagauaauucguacuuuuuuucagcuuuaugaaagggaagaugggguaacaauuuuacaguguaccauggcagugauuccuguucaaaacuuuaccagauuggaaacucacuguucauaacaauucucuugguaagcagaagaugaaggcaucuguuuaaagcacccagaguuaaguuugaugcuucaaagcacagcagaguucauuuauaacucuacuuagcacuauuagauaucuuuaacaaauaugaaaaguuguccaccagauuccuuagacuguaggugauuuggaaggauauucuggucaagugcuaacuucugacugaggauuucaaaugaaaagaccuagguuauaaccccauuccugcccuuacucugucuugugacucauggaaaaggaaggcacuuaacccgcuccaagcuuauguuccugaauguauaagauggguagcaugguugaccacuuagacagauaauccaucucaaaaugaugauuaaagaagauaauggaugagaaaaguccuuuugauuuaaaauacuaugaagaugugaacuuuuaauaaugacuaaugauagaauuuugucaaauuugcuuuacguaauuaaguucaagaucaaagaauauaucuagagaaguaccuauguauuuugugaaauguuucuuugaguauuauuauuaucauuuuaugucuguuagaaucuuggccucacugucuuuucauucuugcuugaaugucgacucuucaaagugugacuuucugcuugugucugaugcaacuuucuuccugaucgcucuugcuuccugagaaggaauagguacuuaggaaugauggcuuuuuggcugucugugcuuauuagguacaaacacagcacuaaagacauuugggacuggagaaauaagaagagcgccuuuaggguuguaugcaaaaggucaaacuauaauguaguuagcauuuuucuuuguacugcuuucccuucuuguaacaaccucucaauacccucauaccuucucugcuuuccagaaaugcuuucuaaaaauugauuauugggaaaagaucugagaccucauugcccugaaguguaauuacugcugacaaacugugacagcauuucccaaagacagggagugauuggagaugugaugaaaaguggguuugugacuguggaaacucuuucagggauguaggcuuuuaccccucuugguaauguaccuugacaaaagucugcagcaaugaaauuaacuuguucacuccaaucgcaucuaaaguuauuugagcuuaaguccuuucuuaaggaugucagcuuuaggcuucaggcaucaaccuguggacuagaauucaaagggaaaaggguagggaauggugcucuuaaaaucuuuaggaccauuauagguaauuccauauccuaaagaaagcucagcccuaaacacauuagagaaguggaaugcacuaaaauauauuuuggcagaaccaaugaauguuuaucuuucucuguguuaugauguuauucuuaguuugacguguaucccaugugugguguguuuauucauucaugcaugcaugcacuuaguaaaguuuugagccuauucugugcccggcauuacaugcacacacacauauguccaagcacaccugcacauuuuuuuuuuuuugguaaugccuuuuuuaccuuauuguuucugcaacuggcuauccuuagcaggccuucuuaauguacaauaggguauagaagaaauaacaaucaacauuggaguaaaccuaaaauuaauuucugucuuuauuguagagucauagaauuuguuuuccucuggaagaugugcugcccucauuuaauugauaaaacagugcuuucagaggucacaaagcuauuuuuuggcagauauaaccaaaccuauuuugauguuccagcaccuccuaaugaagcaguagucgucaucuaaaacaaaaagcagucgguugcuaaaggaggagaaaguguugagaugugagaugaucuguuagacauaauugacaaucaugaauuugauaugauagguguaaacagagauagaaauaauuuaguuacaucuguuuaagauuuaagauaaccagaagcaauaauguuuaauugaaauaauauaucagguucuccuuaacauuaccuugaauuucuucacaugcacaucaaugcauuugguaaauaaaaguuuggaaacaacuuaguuaaguguuuagaacauauuagaguugugaugugcuuagcauccgcagucuuuuaucugugccaacccugagccugguaaugaagccaacucccacaugaauaaguaacauaaggaguguaaccaggaagaagucaggguuucaccuggaccaaauuuuaggcaauuaaguguuucaagagaucuuuagccagguguaacuuaaucaguuuaaggcacucucagcuagggccaagguacucauaauguuggcagugggcauucgucugauacaccacguugaaaguaauaggaaacauagagugucugcucaguuauugccaagagcaagagaaaugcagguguaaaaauauaaagaaguauuuggagccagaggcuaguacacauagacaagacuguauuuacacuuggcuuuaauaguucagauaauaacauggugguuuuuaaucaguuuagugugcugauauuuagucgugggucugguuucaccacuaaacccuaguguaacucucagccgguuacuuagccucucucugucucuaguaauauuaaacaaguguauuaauaccugcugcaucuuagcucaacuucaugucuggaagacagaugaaugguccugcuucuugcaguaacacacaagaaccuccuuugugcugcccugacugagaugaucuuguguucuucucuacgggcaaaacagcccuaggcugcuaaauggccaggcaguauaggggacuuaggacucuacaaagcuggguuuugguaggaguccaugagcaccgcggagagaauucuuaguuaucaggagauacgguuguaguacuuaaaaacucaaacuccaaaacaagacuacgugguuuugaaucucaguuuugccaguuuauuagcugugugacuuuaagcaaguugcuuaaccucucugugccucagaucccuuagccauaaaauugggaugaucaugcaacaauaggauuaguauguaagcaaaaugaguauauguacaguuuggcugcaauagagcugauagguguaaacagauauaaauaaugacuucuuuucugaaaaugacuucuuuucuguuuuucucguuggugaucccugcuuaugucacugggauggcugcgggaauucaguaggauaauauuggaaaauagcuuaaaucucaaauguucuauagcuaugauaacaucacuaugacgucauagcagagugaguccacucacaucucuccuggcaguuuugcugccucagaguuggaauaauaacucacugaaaauacuuccaaaauagugagccacucugcagauuuaauuuguaauauuauucuuucuaauuauuaguggcucugucuuaaguuccuuuguuuuaauugaagcaggguuuuuuuucccccuuguaaauuucuauacaugucaaaggcuaccaacucauuuuuauuuagaguuugaaauuugauuugaaaaauauacugcagccagcuauaugaaaaacauaagaggauauuguugacuuuugaugaagggaagaaagaacaagguagagcugccuagccaugaagaacgccaggguuuuuguaaccccuggugugcuuugcacgcagaaggcacacacuuaaauuggcauggcucacuuuuuuuacugugccuuugcugagcuugcugcaggcugagugcacugguagaggagugcagggcuguguucuggccaucccugccugcucaggccucuccugcuccuuuguggaucgcccaggucucugcugcuuccuggugccgucuccuggauccucuugacauuuuuccguucuguaauuugauugacaguuacagacaaggaaggggacugaaauucuuaccguuuugugacuuccuaaaacgggaaaggaaauuuggugaaugagaaggggaaaacgccucuuggcugaaauuauuuacaggauuuagccccagguuuaauguacucaugaaugaauaaugacucagcugauauuuagaagccgggaaaauuaugcgauuuuugugaugggguguauagauauggauguauacuugaagugguuuguguucuaaauauauuaacaugcucagggaauuucuuuuuggggaaauacauauauucuuuuucauagauuuuuguggugcauucugguagacggaagaugggucauugcucaguuaguaaaaaugaaauaugaauaucauacacauaagugguacauuuuacacuuuuugauaguugugaaauacucuuuuuuuuucagacuaccaauaaagagaauuugaggaguaaaacucuucuuaccaugaauuguuuuggggcacuuagaacuauuuaguuaauucuuuuaaauacuccaacugauuuagauagaauaaaagugucacaauuuuaacagcuuacaccagugaaauguuuccacuuauaagaaauacccucuuauuugucagcauacugaagacauauauguguuauuucuaagcacauuuccuauuuaugugauaauggagaucgcccuuuaaccaucacuuggacgugaaggaggauucuucuuccuccauuaguaaauauuccuugacuugauaauacugaaaauaugugaggugaaugagcuuuaauccugugguuugguuugguuuuugguuguuugcagucuuggacuguucaccugcacugucuugugccuuugaguaugauuaacugccuugacgccuuacagugcauuacacaacucuacuucuuccauuucuugacuaaucucucaugcuguuugacugcccauuggaaucuuuaaguuagcuacuuaggaaagacuuuaggaaggagaaugcuaagagaacuggcagagaagucaggagccugggcucuguccaggcccuggcguaaguccuuucaccucuuccuuugacuccuuuacaaaaugaaguugaacucauucgagcuuuaaaaagaugacgccaagaggcaagacagagggcaguagaugugaaaguaacaugaaagagaaaggaacaucugaaaaaaaaaaaaagguagaaaaagauuuugacaaauaguacuaaaaacaaagaauauagaauagagagacccaauuauacugauaauuacaauuaucaguauuguaaaaacuacagcaaaaaagcuaaaaacauauucagcuuuuauuguccauaaaaagugaucacaccaugucuaacuguaauucguuugucaaaaacacuagaggccaaggacuaaauugcggauuaagaguuucuuccuuuuauuuccugcauauccagaaaccuggggucauagauacucuuccaugguguguuguuuggcacaacuugcaaguauuuuggcagaugguuagaaaaaaagacuuuaagaaauaugcaauaguacucaggacucuaaauauaauaaauaaagcuaagauaccaguauccugccauucauuacaaucaacauuuauugaacagcaguuauaugccagguagcagggauaccuagaacuugccccucccacuagcacuccagaagaguuccugcuuucccagccuaaagcaacagcaagucuuacaugagcuaggcuuacugugauagcuguccugacggcgaguggcaaacauggcccagugccuuccucauggaugaacaugacucuacacugggacuccccgguagaccuuuuugugaugaugagaaaguccuguguuggugauguucaguaugguaacuagugacuguaugugcuguugagaacuugaaauauggcuacugugacugagggacagaacauuuaauuuuauuuaacuuugguugaguuuaauucaaauaacuacauauuacuaauggcuacugauuggacagcagcuuucuagacccauuguuaaaaauaauuauaagcaaugaguaccucuuaugagauagaauuaauaaucccauuuauugagggcccaugacagauuaagaauuauguuugacauauauuaucccuaauccucacaagaaugguucauuugacaaauaagauaacugaaguucugagagauaaauugcuuuguuauguccucgcaaggaauugugagagcuggaauuugaaccuaauuggucagacuccagagcugggugauuucuaguaaucugccaaaucuguguauguacuguccggaugcugugucuucugaguacaucuucuccuugcuuuauggauuaguuagcaaugucuuuaucuuggucacauaggacaguuacaggguccaucuuaucucuucugaauauggacguaucacugcacuggaaccauucauuuuucuuacugaggccuauguccuucaaaaaauauuaagaguugaggguccaacccagcuucuugaguaguaagcuaaucaccuacaaguauauuuccccaguagaugcugagagaagcaucaaaguacauggguaguucuguggacaucaguggcacucaguaaacucuuggcauuugaguguuuaacugucacaguugaggauaucugugaacucucccaaggccugagucacugaaugagcccagccaguacuugggcgucuguggcuccauucugcuuugcuguuuucugcuuuccauggaacauacaguaacucucuugaagggucugaaagccucaauuacaacguuucagugauucugaacugauuuuucuuuggaaaguauauaugcagaugguacuugcagaaucaccaggggguaguaacguggaggagugguaaaggucuacuggacaaucagguggcuaccacccaaccacacauggugaugugauaugaagccacuuuucuuuauuccuucagauuuaagguuuccccuucaggaagcagguuacuuaacaaguacuugauuucaccauaacaugcauuaugacauuaucuuuuuuucuuuuuucuuuuuuuuuuuugagacggaaucuugcccugucgcccaggcuggagugcaauggcacgaucucggcucacugcaaccuccuucucccagguucaagcaauucuccugccucagccuccugaguagcugggauuacaggugcaugccgccacaccuggcuaauuuuuuguaucuuugguggagaugggguuucaccauguuggccaggcuggucucgaacuccugacuucguuauccacccaccucaaccucccaaagugcugggauuacacgcaugagccaccguuccuggccgauauuuuauuuucuuaaaaggucauuaucagaugccacaagaguauuucuauaaacuaugacccaaguauagccuaauguuaauagcuuaaaauagguuuuauuuaccuuuuuugcccuuuaaaagcaaggaauuauuuuuuaauggaaagaacauagacuuugaugaucaguucacauccuugcuuuaccccuugaaaaaugugcaaccuggaaagacagcuuaacauuccugagucacauuuguccaaauaauacaaacaauggcaacaagacuucagcacuaaugucugauguuuuuuguaugauuaaucugugccagguuccauucuaguuucuuuacacacauuauaccaucuaauucucacaacaacuuugcauagcaggcauugucauuuccacuuuacaagcaggaaucugaggaccagaguuaaaaguaacugguccaagauugccuaguuaauaaaugguggaauuugcagucagacccaagcugguuugggccaauacacuugaccuucuuaugauacgucagccuugugaaauagggcagauacuauuaauaauauccaccuugugugaucauuaugaagguuagauauaauguauguggaacucuugccaccaaagugguuccacaagaggcccuaaacaaaugaguaaucauuauuauuuuaaaauguccguaagugaaaccgauaugccaagaccaguaaaaaugagagcuucuuaaggaaaagaguaggaggcauaccuuuguuucauuuuguuuguugguuucugugcuugcuuuuuguucuuuucuguuaggcacagguuuuauuuagaauaaauuaaauuuuuuuuucuuugaugagugcagaaauaauaguuggaaacauugaauggaacagcuaauguaccauaguaauacuucuuggauuaccaaaaaaaaaaaaaauuaaaucuguaaaaugaaaacauuuuuguuuacuuuggucaguucaagguucaguguuaucuagagauuuuuguuaaacucaggauuucuauauguaugauugucugcuaaauucagaauuagaagagaagagauaauggcgcuaacuuugcauguuaaauauacuguguuacuaguuuuccaugaaguuuuuacucaacaaauagguuacuaaaagagcugugaccuaugaguuucaccaagucuuuccauuuccaauucggcaacaaaaguuucacacuucucaauuacucuugugggaggaaucagaaugccaacagucaccuugaucuaagcguauuauuggagaaaaauucaaggauagauauuuguuucucauuagauuuuccucauauuuuaucauuggggucacucuaguacaugguacuagaauuugggauuuuuauuucauuuuagauuggacugauuuucugguguuagucauuaaaaauaauuccaacucuuugaagagaucugggauguuuguuauuauucuauugauuaaauaaagcuauuuuauuuaacaauuguguuguuaaacuuucuauauacuuagaauaauaauacuaaaaacugaauggguaugagcuuuucuuauugaauuuaaugucaguauuaaauaccuuauugaaacccauacuuugaaagcuugauugagaaauuggcaaaagaguugacugaaguaaaaguaaugaagcaguucacuggucauccagguuaugaaaaauuaaaccauuagagauaaacugaacugugaaaauuaugaucaugguguuuucauaaauaccaucuaugucuccgccaccauucuaaaaaaaaguacccuaucaaauggugaaaaauaagagugauguuucugugaccauuucauuauucaguuuucuuauauuugaaaugugggagguugaacuaaaauuuguugguucccuucuuuaaaaaaguauaguuauaugugauauuuauuuauuuauauaaacaaaaauauagagaucuuaccuugaaaauaacuuuugagguaagaaugauaaaguaucuaaauggaagaugaauaacauuguaucugauuuguaaauuaugauauaaagaaaauguauaaaauauguagaaauugucuguauaaaaaacuauaaacagugguccguugccuauuaacaaagaguuucauguuaucuaaaaagucuucaauuggcuaaaacagcagaaaaauagaaauuacauacuauaauauauccuaaaaacauuucaauuccauagauacucuucuccaugcagccaauauuuaugaauuuggaguaagugaccuacucuuagauauuugagcuugauuauaauucauagucaaaguagccuccuuguaaauaaccaaaauuaaccaaagauuuuuccuuaucuuccaaaagcaaugccaaguaauucuauccaaauuggaaaaaaaaaaagaaaaaggauaaaccuuauuaggugucaucaaaugguguugacauaaugauauauauguuuaaggauaauguaauagaauauguaauuaaaauuaaaguauauaugaaaagaauugauuuuaauuguuuuaaaacauaagaugauuuaauaauaugggucggagauucuuuuuaguuuuauaauaaauauauugauuucugaaauuuggguauauuccauaguacacuuagcuuauguuaauacugaggccagauugcugucaggcuaauagcguguagauauauuauagucacacuacaaucauuccgucaguuuucaguuucccuuuuuccugugauguuucuuucaucuuguuagauuauucucaagaccuucucuaaauaccuucaguaguaauucacaaacucuuuguuaguuaauaguucucaagaaaauucugagaugugguugacagaacuuagaucauugguuuguuuuuggauuccuagccaaaguuuuauucuuuguuucuuaaaaauacucaaaaaaguuuuuuuuccuuauuguaagcccucuggaaauagaagcaaaucacuguuuauacauuuaaaaugugaugaaaauuacaaaauaaaguccagugaaauauagggcuuguauccauuagugccuuaagaaaaaucccuguuuucugaagugcgagugggcuuuucugguuuguuuuuguuuuguuaaagcuccaggaccucccaauuuucaagggcacuuuggggcauguguagcauuuauuugauguauggauguagaugcauauuuucccacaucugucucuguggaccuauccuuugugaaauccuaaaccuuguauuaaugcuuaguuuaugauucaugguguucugagagcaauuauauaauuuuucugggguguuuauucgaugugcacuguaaaaaaaaaugagaguuauuuuuugguaacccugcacuugccuuuuuauuggugaauuucuuuuccuuuuacugugaccugugaauaucacuguaggcucacugccaauuuugugagccgcugccugcuucaaaauggaggcaggaagguauccauuuucaucaagaggaugacaguguuucagucuuucugaccaucuggagagaggaacuuugagagcaaaagaaaauggggauuaaaaaaaauuauauuuagcagaaaaggcaagggggaaaaccaauuaaaguuaaacuauaccuuaugaauuugugcuuuucuacuaugcuguccuguuuaaaaaaaacauaaacaagaaaauacacaggcuauuuguauaaagaauugguuucccaagucucaugaguauuaguaaaugaauguaaguaaauuagguuuuuggcacacuuuuuaaguuuauuguacacacaaauauaauaagcaugaaaaaggagggcucccuccucccgcuuccuaugcacacacugauuguugguggucuuauguagauccaggcuuuuaauggccuuuuucaugcaucucugcaaaaagcugacacuaugggaauuuaauauucuaagauauauuuaucacuuucugugguuuggauaguucauuuguguucucucugucuccccccucccuaccuccucucuguaaaagugaaaauuuuaauugaaagguagaguuuuuacucuaccauuugaaagagguuugaugcaugucuuucuguuuuuaccauuuucacaugcuuaugggccaucuguguuuagaagaaaaagaaagaagugcuuagacucacaggauuacccuaugggcauuauacaguguauuuacaacuagacaugguuuacaucaacuggaauauaacacaccugguuauuuucuguucgcacaaauacaccgagcuuuuguuucguuuuguuguguuuguuuuaguguguucggaaagggcacuguuucuaggguuuguucagauuuaaacuggaaaggguagaaauguagcacuuucugccuacuucuuauauaagaauggagcuugggcugcuguggucaaugcaaaaagcaaaacucaguugguucuuucuccucaggucuaugcuccaucagcaagcacugccgacuacaauagggacucgccaggcuauccuuccuccaaaccagcaaccagcacuuucccuagcuccuucuucaugcaagguaagaugcugcugcuucugagggaaaggccacuggauagcauuuuccugggucacuuaaugucacagauggggcagaagaaauggaauaguaggcaaguguagaauuuuugaagucaugcucuucuuaggaauugaauuccuuaaaaauugauguauuaauuaaaacuguacuaagucuuucuuuacaauuaaaccccuuuaagcaguaauggguuaagauuagauugaucugcuucacuuagagccgaugcuuaugauggucuuccacucaugaccaaccauuucagcaucuucaccauccccaagacgauguagcuguuuguuuagaagugguucagcuccauguauguuuugaacauccuggauuuagccaacugggaacaaguuggccuaauguauaaccuuauguaaaauuuucacccacuuacuaauuuguagguaagaacaaggguccaagaugaaguaaccuaccacagacuggaauauuacauggugaaagcucugucccaacauaguaacugguuuaggauaaaaggcccaacuuuugggggagaagacaaauauaggaaauuauggaauuguccaguauguuuaaauacauggaugugugcccccacccugagcuuguagucuugcuacugauagcguauaccuuucugcugcucaaaaaagaccaagauguggccgagugcgguggcucacgccuguaaucccaacacuugggaggccaaggcaggcaaaucacaaggucaggauaucaagaccauccuggccaauauggugaaacccugucuguacuaaaaauacaaaaaauuagccaggcgugguggugggcaccuguagucccagcuacucgggaggcugaggcagaagaauggcaugaaccugggaggcagagcuuacagugagcugagauugcaccacugcacuccagccugggcaacagagcgagacuccaucucaaaauaaauaaauaaauaaauaaacaaacaaauaaauaaaugaauuuuuuaaaaagaccaagauguuugaaaugauagcagcuacuucaagaaugaaccacuuggaggaugccccuaagggcuccauccugauauguguguggcacuuauuuucuaauguaauuaucuuguuaccaaguuaaugcccugaauuuagauguggaauuuaccaagaaccccugugugcaaaauguuaacucuuuuugcccaggugugaaaaccuuauuuguauaagccuugucuacgggccaugggguuuccuucuuuaugcaucucuaggaagggccaugucacaggaaggggagcacauuuggggcaaagaguaccagggaagcagccugauauaguggacacacucaaaaucauucucauuaaaagauacuaaucuuccuucccuucaguguguuagcucuuuuaguuuguuaguucacgugugaaauuccauggaaaucuauaaaauuggauggaauggcucuguuaggaauagagagaauuuguuccacgcauaauagagcccgugugucagaaguccuuuaacuuugugacccguccuagguguaacucaaagggacacagcaggcuaugucaccugggugcguuuugugccgugacaaaaagcuaaucaccuucaguuauaaacaguagcuaccucagcaucaguccccuguuuugugagcagugggagauauuguccuacaggagcuuacagagauuggcaacucaaggauccaucacucaaaacagauuucgauugaaaacauugacggaaggauauauuuuuucuaucugcccaggaaaguggcuuucuggaagggugcacauugcaggagaggccagguagauuauaucaguaggcuccuuucccuagcagaccacacaaaauauggggaacaaauuuguuuaucugcauaugcauacccgaaaagcaaaaaaaaaaaaaaaaaauugaguugacauuuuugaugagcacaauuaauuugcacacaucuaauucuauucuuucuuucaaaagaacauuaugccaagaucaugggaugugauaaauauuaauuuacugugaaaagcauaauuuauguaaaauauguauuuuuauaagucugcaucaagcagaguacucuguguuaacaguccuaaacgcauugccacccaggguaucacauugucaggagacucuuguuuagugauauauguuuucaauuuauuugucauaugugccaucuauuuaaaauguuagugaucuugaacuucauauuugaauuuaaggugacauuuaaaccucuguaaucuaaggacuaaagcucaaguacaugaaugauaacuuuaaaaaaaaucauguguuuucacaugauggccacagaaacaguugcaucaugguccugucccacaucagcuuccuuucaguagagggguacuuggugcccugagaauucaagacuugaaggaauaugcaauuaaggugaaagauguucagaaacugucuggggcauauuguaaacucacuacuguggccucuuauuuguaacuucaauuuccaucuucuaguuaaaacucugaaguugucaaaaucacagacaugauuuugcuugcaugguucuuaaagagaggaaucugcaaacuauuccucccaauaugaaaugaguccaguuacaaaauucuaacuuccggauuuaagaacucaaugaaaaagagcuucacgaaauacagugucagauuuaacuuuucuauugccuaacuuuuuaauaggccuuuacuauauaaaauguuauggugaaaauaaucuuauuuucaaggaagcaauaucugcuauacauuuaacagccagcugauggccuaguguauaccuaguacucaauacuuuuuguuaaacuauugaaacaaagaaaaaaugaaugaauuuagcaguaauguagaucaucuuuucccuuaggcuugggaaaccaaaccuaaacauuagcaaucauuaauaauaaccuguaggccaauaggcccagagaaugaaaaaauccguagggauguuuuuaauaagaauguuaacaaaagguuaaccuuauguugaaagauacuuuauauaauuuuaaaccucuauaauucauaaaucguuuuauaaaauccagagacucucaaaaauaucuguaauauaauagcuaccuagggcauguuuguacccuuuggauugcuacugaagguuuaagauagcuauauaccuauacaccaaaaaauaaaaauaaaauauccuaagaacuauauauuugagauucaucuucucugcaugccguaauauaauuauaauuccaacuuuaauucuauuuauuguauauguuaaaaaugaaauuaaacauuuucaaucugagauuuuuuaaaauuaauacuucuuuacaugcuuuuaaaacuugucaacuuuguaauuucucaaguacuuuucaccccaaaguuuaggaacaauuuaacuuuuuaguugguuuucauagaaaaaacaguuagaagacuucuaagaaauguuuccuuuagcaguaauuaccuugcgacuugacauaauucaugguagaaauauacucuguuguucuuuuacaguucaauuuuuaccaagaacacuuuaacuuuuuuaaguguuuauauuuguuugacaauauagagccacuugggaagaaaugaugacugucuucugauguaaucagcuaaccaacacaaagaugaauaacacaacaggcagucauuuucaaguauaugaaaaaacccuauucuauaaggcaaggcugaaugccucagaaagucaugguugucuuuguccuuuacagauggccaucacagcagugacccuuggagcuccuccagugggaugaaucagccuggcuaugcaggaauguugggcaacucuucucauauuccacaguccagcagcuacuguagccugcauccacaugaacguuugguaaggcagacauacacgguaacgggaaugucacagcuaguugauuaaaccucguccucugucuuuccaugcauauacacaaggacucugcaaauaagugcaaaaauggcacacacccauuauucuuaaguuguauuguuucugugaucaaagacauaacagguucaaaucaccuuuguaaauucuuccagauucucucuggcauuguucuuuuguuuauuguguuuugcucugugccuucuuuaucacaaugucagcuuccuuggguacauaaauagauaccuauuuaaguuguagaaucuuaacauggugguuccugguuuuuuuuuuuuuuuuuuuuuuucuaucuguaguuucaaaagauguacugcagagggcagagugacagucgguagauuauaugcaucacccaggagcauuucauuucccauugacuggccuaugucagcuuuggccuguugugauguauccaaaagaaggaguuuguauuuucuguagacuuccaucaguaagagaaaccaugagguuucuacauagaucagauucccauuuuucaguauuuuaacuuuaauucccaucccagccugccacucauacuguguuuugcgucacuccaggugaaaacuggugggcucuagaauguuaggucuuucauuacuaaacauuuccacucuguccaucaccuacauucaucuaucauaguaugucucuuuauccuggaggaaacaacucagcugacuuucuucuagccuuaaauaucaccacagcccagaauccacuguugaacuuaagucugucauuaaagagaggaaagagccuagaucuugagugagauuugggaugcagauaagaugaaacuugaaucccuugugcaagaacauagcuuaaacaauauguggaccucacauccuacaaaugcgaaagcauaugggaaauccagugaucccaggugauacuuacaucacuacuauucaucuugcauuugccccuuuuucuucuucucauaucuacacuuagguuucuuucucuguucugauaaaggaaaucauucuggauucauguggucuuugcucucuuuugcucaaccaguacagauaagaaacaggaucugaucuccuacuccaauaaucaaaaaaauuccagaaguuaagauuucugauauccuugaaaauccguauuuaguugguccuagugguagagaugcuaaguagucaauuagccuauacauuccugagaggcagacaguggaaaugguauuggccuuuuuguaucaccucccaagauugaauguguaaaucacaaacuaucucacauuucagcacauuuccaguaaauagcagaugacuuauuuucaaauuuucucuuuucccaccuccuauuuggagauauuagagugaaagcuuagagaaauaucaacuauaucaacuauuauuaugcuagaauccguuuuggcuaaaauuuucauuucugcaccaucauuuuccacuucugugggaacucauggucaaaacuguauguguccuaugagcaaggaaaguuuugauuacaaauaaaaguuuuaggcacuauaccgcauguuggaauuucaguucuuuuaagaguugcccauuugacauuaauuuuucuucccuucuguguuucuuucuuucuucuccuaucaugcucaagaguuuugaguuaggcgauuugauuuuauccuaguccaguucacugcaugggaaguagcuuuaaaaugugcuuccaugcacaaaaaguauaauuucaaaauggaaaccaacuauauuccuuuuagaaaaaauuuuacagaaccaaaacaauauuaugaacuagagagaaaauaucauuuugaaguaguaacccaguaggcuauaucagaagccauauuugcaaugccauuuaccuaucacgaaacacaggauuuucauuuuucaucugaacaguuaacagauuucagagaguagaguuuuuguuuuaaaggagacaugaauaagcuaucuugcaauguauacuaaugaauuuucccacuguuagugaaacuauugaauuauuauaucuaguugucauuguacuuucaguauuuaaccaugugaaaaucuuuuacugaagugacuuagaagaaucugacacugacaauacuuugaauauauaguagcaguugguguccuuucaguugaaaauaaugguaguuccuuauaauuuuauucuuagcaucuggcuagccccauacugaacaaagggauaguuuaagaaaaagcuaagcgcuguuccuggauuauuugggguauaauuuggccaaguugauauuaucuguaaagauaaaauauuuuaaaaacaucauugccuucaucacuuuaugccauguuauaacagaauguguaauuauaaagcuuaagauccacauauuucaguagcgacugucaaguuacugauguuuagucuuuaaauccccuuuacaguuuuagccuguccaacagaaucccacagcuaaucauuacuguguuacacauacccacacaaaaucacucagaugaauggaguuugcgguuaaaguuuggaauggguuguuguagaugauuuuauguuuggaaugacuuggcagaguucuuuuuaagaacaggauagaguccucacugucuggcaugauuuaggcauggucuuugcacuacagggcgaaacaguccuaggagucuggaauuuuccuuuaaaggaaguucuguuuucuuuuauuuuuuuguaacauaaacccuuacuucaguaauucucaacugauggcaguuuuucccuucagggaacguuuggugaugucuggggacauuuucauuguuacaacuaggggcuagaugcuacuggaauccagugcguagaggcuaggggugcugguaaacaugacgucauguaugggagagccuccacagcaaagaauugucuggcacaaaagaucaguagugcuaagguugugaaauccugcccaaacccaaagcaugauuuuauucuuauuuaugugcaccaguuauuauauuuuucuaauguuugaauuaucaaccaguauaucaguaauggaaacauuuccaacaauuacucuguuaauagacacgaaauacaggacucuugggcaucauaaguuaaaaugaacgaauagugggcauguaaagccucgcacuuugucacacuccucauguccuuuguagcaagcaggaaagacaguaauagcuggaguaagagacuaagaggaccucuuauaguuuaucccuaaauccucuaaaagagacauuauucucugugguguauuuauuacaucucugaaugacaguaguuuucaagauaguuuuuaauguaaaauaaucuaguuauaaaucucguuaguuuauuucaacaacuaauuuucuaugagucucuaaaaauaacugauuuacauggauuccauugguucacuccuuuauaaucuauggggauuaauuuuucuuuuuauucugugaacucagcguuaacccuuugucaaaucccaaauuacugcccauuuuacauaaaguuaaaagggcccaaagauucucaccgaugugauuaucuguuuuguuucaucuucugauuauuauaguuaguuaaauauuuauaauucuucuccucuuuuuuugauuuuugcacauuucaggcagauuuguaguucgucuguucuucagaaauuccacauggaauaggacuguguagaagugagguuaaaguuagucaucucuuuuuuuguucuuuuuuccacauucuguuucuuuuccuccauuuuguuauagugcuuaccucuauagcagaaauaccucuaucccugcuaagcuuucagaauagcuguacuauggaaugggcccacuauauuuuucauuggagaaaauuccauggacuaccuuggguguucauuagguggcaaguagaaaugaguuuaacagguggccuaaggaauuuuggggucaaggaaagaaagagguccauggaauuuaaaaauuugaaaggcauucucaggaacuuggaaagauuuaaaggcaucaucucaacuuuuuuacggaagucuuuuaaguugggcuauuuuggucauacagagguaauauuuucaaaaacauucaugcgucuuugaaaauccuaccucuaauacguagauucauuuccuuagacuaguuggcucucaaauaaguuauacuucaauccacuguuuauuaaauucugacugauaaccaauuguucauugagcguauaguauaauuauguguucaguaguuagccacaaguugugggaugcagaacuauaagcucuauuccuuuaaagaguuuacaauacaggugaaaauacauuagaaaaagcaagaaaugaaaggccaaauauaauuaaguguuaaagacaauagugcagaauguaagugcauuagggaccuagagagaagagaugguggaagaguuggagguagucagggacucuucaagaaagagguagaauucaagacggaucucacagaguaaacagggcaacacucaagagacuaugguuucauuccucgugagcaaaugcuuggguuuuaaauacccgugacuaucagcaucauauucaaucucuuauuuugaaauaaacaauuuuuaacagcauuuccaauaaugauauaauaaagacucauaauccauuaauauauugcauaugaagaaaaaguguauuuuagcuuuaauauauugccuuuacauaacacauucagaugccuaugagaauaacuuuugaagcugcuuuuuaucuugaaaauagcucagcacuuuuuuguaaauuacuauguccauuuuagugagcuguucauucccaagcagauggguggauugcaacuaauuugccaccuuacaggcacuguggcauacccaagaaacacagcuuauuuggaaaacuaauauaauaauuaaacucaaagcagagucuuaaaccaagugauucuguaaagauguuguucuuucauugccagcuaugugaggauugcuuguagguggggcauggaaagaaaguacucaaaccaaaauaagucaugugguccuaauuuaauucaguauagucaauaguuacauauugaugaguaagagagauauuuaaccauuagugcuuuuuaaauuuuuuauuuacuaaauuuuauuguugcugggguucaaaaaaauuuaauuugggaggaagaagauuugagacugguuagucuuugccauuuaguuucaagaagaucaggaugaaauguaauauaagcccuguggaucauaauguuguuuuauucauuauauaguggaaucuuuuucacuugaucaauaggccacacaaaaaaauuaauaguagaguggucuuuuauguugccgaaacccuggagaugauuuuaagcaguaaucuguagauuucgagauugugaucauuucucaaugucccucauugccauuauaucccuccacaguugaugcaaacccaagcuauguuucuguauaacuuauuauuugaaaaaugaaagcugucagaucuaaacaagauauauucuuggcuauuuugaaauucuaaaagcugucuccauuguaaaauagagaguugugagaaaaguauuugaaaauaacucacuaaauaccuuaugauuaaauauggccaccuuuuucugcuucuugcuauagagcuauccaucacacuccucagcagacaucaauuccagucuuccuccgauguccacuuuccaucguagugguacaaaccauuacagcaccucuuccuguacgccuccugccaacgggacagacaguauaaugggugagucacagaaaugccaauucugauaccaacaauuggugucagaguuuaaucaucaaggaccucuuuuucccuuucauaacugaauagcaauuaggcacuaaauauuagucacaugacagaaugaacacacaaauguaccaaacagaaguaaaaucacuggcuugagcauaaccauauuuuucgucacaagacacugaaauuuagcuacguucuacguugcaagucauuagauugaacaaggguucaaacagaccaaaacuaucuuguuccucacauucaaaaagagugaacaaagucauaagaugagccaucagugacuagugagcuacaaagcagaauagcucuuaaugguaguuauugaccacuucccaaaauuccagucauugugcuaggcucuuauccaugaugugccacugucuuccgaggacugguuaaugugaaauucucaggugacugcuaauaacuacaugagguuaaucuccuggagaaugugacacuguggagucccucagaggggaagaaguauuuguucacuuaugagagaggagaugcgugggcaucaguuggccagaaauuauuugcugcuuuuuuaaauuaauuaauuaauuaauuuuuaccaaggacauuuacuaaugaguuaagguccaagaagaaugcuguucccaugaacugagccaucauccucucauuucuugugauguucacuguagucuuuuccauaggugguuccccagucaguauucccacuuugaggaaugaacugggcuggauguccagcugccccuggagggaagagguggaguugguggggagauagcuaccugcuucugaaccagcuuugacaccuuguuguucagaugagcagcacagcuuagugccccagggucuuauuaaaaccucagacuucucagguagucacuuucugcgguuauagcucaaacuaacuccuugcuuggccugaaugucacugucagagcgucgguggggagaauacucaguguaugucuuugagagaagauggcgcaacagaauaaugcugcuguugaguccucuuagcucuuugcacuuguuuucuuuagagaguguguagaauuuggggaaguggcgugaaucacuuauguaggaaaguuuuugauguuggaggagagauguguuuugaaauguuggaaauauaauuucugccucaauaaugcccucccugcguauucaauaauauaucucacacuugagaugagcuaucucgcagccucuccacuccgcuauccugucuaagaagcaaauugaggagagaguuuccauuuuuuuuaacuuuuccuaaccaagcuucuacaaauauguugcaucaguuugaccuuggagagcuacagacagaggucacauggggaaguuuguuagcuaucaaugcaguuuuggcagauuugaaaaacaagaagaaagaaagcagugcagaacugaaagagugagaaaagcauauuucacuucagugugguuugacaaauggaaagccccuuucugcagucaugaggucugguuauaaagaaggaugaccggucauucauccuuuuacaagacagauuuccugucuacuugugguuugaguaauuuucuuuuuuaggaagguaugaagguggagcagaaccuugaguugaggaaaacauacuuaggcucuguuugaaaaaaaacuuuuucugauugauuugcaaaacaguccucuugagagagaggcacuaugacuuggaagggacauaucaggaaauagggugguuaucuccaugagcuguagacagcuuagccacagcucucagugggaaugaguuuugcuugguuuuagcuggucaucuucauuaguuuguggaugaacaggagaaucuacuuguuggucuagccagaguggagcaauaggugacuucuauaugcugagaauagacuuaacuuguuaaaaaccauagggccuuauuuaagggucuugacaauaauaaaggagcuauaauuuaaaaacaaaaguaugagauuuuuagaacccagaaaagggcuuuuuagaaauuuauuucauacauuauuuuacaauaauggaugcacuugucaaaauccacuagcggaaugagaaaaagaugcauaaucuuuaaggaaauagguagacaugguaauucagcauuuuggaggagcaaaccuuuauuauuaugcauagauacagauauuacuuuaagguuacuuuaagggagaacauucuagaauguuuuucuuuaaaauaauauguucaccaauugcguacgugaaaaugcagaggaaaauuuaagcauaauaagccuuaguauugcgugaugucugaguggcccauguuuuuucacacuuaaguucucuuaggcuuugguuugauuuuuugagugugguagaagucagugauggcagcgugucuguauaacaagaagagaagcuuucucuucugauguuagugauacuacccuaacaaacaguauggauuaauaggauacaucugcagacuuuugaaaauauuuggcauauacucacucauucugaaacgcaggaaguaaagaaauauuacguugccuguaucucaaagaacaaacagagcuaauuaaauaauuggcaaauagggaacacauagccugacacauguuugagauuacacacgauucuguagaaaaugacuguaagcaauacuaaugccuuaagaaugggguucgagcacuaacacauggacaucacauuuuucacguuuuccugguaaaaaguugcaagacagugcagucuuuucauacaugguguugaugucuuaggaagcugcuuuuucaguucagaagagggcugcugcccuucgucucagugucauguuauaauaugucuuucugguggucagcaguuguccugaacugacacuagaacaacgcagugcauguggggugagauacaagcucuagaacucucggaagggaaccucucuguaaccacauucccuuucuucuucuguucucugcaucucaaagguggaagaugcccacugagguuugcuguuuguuuggcuugggggagugaccagguguuucuuguuuuguuuucuuuugcccuauaauacccaauaucauuuuuugagaaauccauaagaaggauaaagcuuacuuggauuacauuaaugagagauuuuuuuuuuuucaugacacauucauccauggauuuucaagagaauuguagaacaagguauuuuacucauugcauacaguccacuacuuuucucaagccuugcuggcaaacucuggagaucauauuagaccuuucugaauugaaaaggucaucuaauuagcccuccaauuagaggaauauaauguaugggacacagcauggauucacaguaguucagcugguggcgcacccaguuaaggaaagaagcugucaggggucuuugggaguuaccagcaucagcaccuucuacucaguucuucaaacuuuuucaauguuaugccacuggguauucucagaagcagugcaguucagugccucugcaucugagcauacauacggaggaggaaguguaguaaguuauuagauaccagcuauagagaauaggaaugucugcaggauauuaaccauacacauuugguuagccacauacuuccuuccuauuugcaauaauauccaguagcccuuccugauggaaagaaguaagaggaccuccuaccauagcacagaccacugagacugcucaagggugagaaugcgucgucuccccauugggacauaccaucuguauacauucacagggugugacccuuugugguuugaggcuacacacacucccuugcccucagagagaacuggucauauaacuaacauaaugguuauaauaacuauuauuguuuuauuagucuuuaacuggccugcauucuaauacguggucuuuuccacguuuuuaaaccucaaaccaaacaggguugaaggaacagacuaccaagauugauuuaauacaccauaugcuaaagauuacccuggaauaucuaucugguucaugaauuaaucuggcuuagaacuuuaacuucgaaugacauguuaguauguggcuugucuaguagaaacauuauguccuuuucucuuugaggacuugguuucacaguaauuuuauuauuagaguagucacauaauguucacuuuauauuuuacaagaauauugagccuugaaguagucaggcgaugaacaagcacagagcauaagaguaauaagaauuguauccagcaaugugaaggcaucuuaguuaccaagaccaccagcagagaacaauaaacuaguuugauuuaaaucuccuccauuuccugugcacgaucaggaagcccaacuucccccugaauuccuaggaaucccuccuguuaaaaaauagugcauuguagucuauauacuugcguuuguauuuuaaaaugguuguaguaggagugcuggaaauguuccuucuuuuugucaucuuuauagauaagcacauggcauuguuaugcuguuucuaaugguuuaauaacacgagggucacucggacacaguuuagaaaaaccuacuuugaaagcagucaucuucucucaggcaaacacagugugaauugugcugcuuauucuuuugaugccuucaugauguucccagccuuagaugaugggugugcauuaaaggggcaacacauuuuccaaauucugauuuuuaguaguugaucccaaggcaccacucaucccaguguuuuguugaggguguguucuaaugggaaugaacauuuccccaaagcugaggcugagacagaggguggucuagcauguaacccaagauacaaaaccuuucuuucugcuucaucuucuagccagcaacaccaccuguguucaagccaucugaacaauacuuggguggcaggcagugucgaagccuccuacaaaaauuacaguuccucuuaauaacugcucaucuuccauucauauuuguauguuacagcucuacuuagggacugauuauauuucucuugggcaagauaaauugauuagagccaaaauuagaaaucgauaaagucuuuaccaagcaaaugcauuaguuuucaucuuucuguuacauggacauuuugaucaucucuaauaugaauugacaaaaaucuugggccucaaagaguaaucaaguccuguuacaucaaacccacauuuucagcuuuaauguaucuugcuaaacauggcccacuucucaaugcaaaaaaaaaaaaaaaauucugccacuugagaauuaaaauauauuucuuuuccaguuauacccuuuguuauaucugucacacaaauaaaaagagaaaucuguaagagaaagacucauguagcuuaacauguucaggcaaucuagaaaauguagcuucuccaguguuuccuggaccagaacaaaaggcauuccaagugaaagggcaaacuggccccaguaaacugcuuugaaauuuaagcccuuggguuuggcacuccagcuguugcaagguaaaaucgcuucauguuaaaaaauagucuguucuuaucagugguuuccauggguagccuuuguaguuuucugaaauauuuucaugacgcgaugagguaagaaguugauucuauuuuuaauucuauuuccugagucauaauaucucccugcauaaaacaggcacugauagaauguuuaguuagaaagguguaguucuaaagaaaucagauuggucauaauaucuugccucuucuaacgugugauuuuuggggcguauauauuuaguuuuuaaaugcuccuaaaauauuuguauugguuuucaauacuuuguuuaguuucauaaaaauauauauauuauuuguaaucuucauuuuaaaguuguuuaaaggaagaauuaaucuuuugaaagccacuacuguagcagauauuaucuguagugaagcaauaucuuguucuuuuuuggcuuagguucuuuguuagauaaugugauuuuuccaauguagcucugaacuuuuugugaaaaucuauauucaaaucaagcagauaucacagauuauuuugacugauagaucuaauuuuuagguauauaauaaugaaaagaaauaucgcuucuaggaaaaaaaaaaagauaaguacccccaaauaccaugguaauacauacugaaaaaagguuaguaucaucuauauuucacaucauuauuauuuucucuuuagaaugguuuuuagguuuguuuguuguucuuguuguuugaggcagaguuuugauccuguugcccaggcuagagugcaauggcgcaaucucaaucucggcucacugcaaccuccgccucccagguucaagcgauucuccugccuuagccaggcauaguggugcaugccugcaauccauguuuuuaguuuuuaaaggacuccuuaaugcagaaauucuucucauuuucacacuagauauaauuuguuguauuuuaucuuauauuaaauauuuuuaauacucuugauaucugagcugcucccagugguccaauuguaugaugucagacccucauuucaaagaacuugcuuauacaauaccuaucaugaguacuaaugacucauguauuuuaauaucauaacuuugugauauggaaguuuauuuugucacgagauaauuguguucuucuuaucaugugccagauuucuuucaguauuuuagcaauuaacaaauaaauauggguguggguuuuguaaaccaaauaaaguauauaucaaaacauuaucggcugggcaccgugacucaguccuguaaucccagcacuuugggaggccaaggugggugguucaugaagucaggaguucgagaccagccugaccaacauggugaaacccugucucuacuaaaaauacgaaaauuacuuggcgugguggcgugugccuguaauccuagcuacucaggaggcugaggcaggagaauugcuugaacccggaaggcagagguugcagugagccgagauugugccacugcacuccagccugggcaacagaacaagacuccaucucaaaacaaaaaagaaaacucaucugacaaacucaacauauaaauauaugaaaauaacaagcauaaauuagcuaugcuaagcagaggucaggagaauuaaauuaugaccuggaaaagccauagaauuggaccacugaagauccgaccccacuacugcauuuuacaaguguggaaggugaugacaacacauuuguaagaaagaaggcucucuuaguucaagaauggggcuggaaagucuuugaaauuauauaccuguuuaaugaaguuuugcuuggauucauugggugauuuaaccuuuccuuuucuuauuucacaaaauagugaaaaacaaucuucccucagaacuuuaauagguuuuauuuagauacuaugucuauuugcuaauguugaggcuuuaguaaauacaacauaccccaagugcuaggcauucuguuaauacugaagaccacaagaauccuggaaaucccauuuuaucacuuaguucuaaaggcaagauaccuuccaaugauacauguuaaagaaagcuggcuuugaauuguauacuguaauauaugucuuuuauuauucacaauacucuuuguucuucucuuuuguagauaaaaauaccaguguuuaaggcaguagagauaagcuucaugaauauguagacuuacuuuaucucuggaauucgaggccauauugacuuuuaguagcauaccaguucacuuuuuuuagugugaacacagacuuuuaaauauguggagaauauauguuauuuaaaacauuaaaaauauuuucucuccuuguuagccagaccuguuguggaaauuuuuguuuguuuguuugguguacuguaggacugugagacgaauaccccguuuugcuauguaucaaauuucuauuuauuugaaaacagauggaaguuauuugugaagauaauuccauuuacuauaaaauaauauaaagaaaagccagacucugaggacuccagagaccugaaaguagucuauacuugucagcaaugaccgucacauagcuugcuacauucaccagcucaucaacagcaaggggaaagucauagcaaggaaaccacuuuaucuuuaaaccaaggugucagguuuauauuuuaucuguaaaaaaguaacaugaauauauuugacaucuaccucagcaaacaaauuaaugcuaauuaaagauuaauguguuguaauuagcauuaaaaaugcaauuaaauugugaguaaauggaccaggaauagaaaauuguuagacgucucacugccugguuuucauauucugccuuuuguuuuugcagcaaauagaggaagcggggcagccggcagcucccagacuggagaugcucuggggaaagcacuugcuucggugaggaaauauugacuuuggacuccauauguaccauuguaaagggugaacuuuaaucagaaguggacauuuggaauuuuagaaaaugaauggcaaauagcuuugauuuuuggaaaaugcuagcuuucuugcauaacagucacuggaaaauuugagaaggcucugaagcuuccaguauauagucucuuucucucauccucaaaaugguacuaagcugcacucaauuauggaugugggaauauucuccuggucuuuggguuuauagguuuuuuauacugaugucuuauuuuucucuaaaguaauaugggugcacauugaccagcuaagacugucuuagcaaggaauaguucuaaaacacuuugaaagaggcauuugaaaaaaaaaaaaaaaaaaaaagacaauaacugagguccaugaagaacugucacauaauuggcaccugggggacucagcuucucugcuuugcccaccuacugccagaaagcuaaaauugaacauuucuugcauguucccugaugacaaaauggcauaccuucauugucucagagaguauaucugguauuuuagucaaaagcuaaacauggucauuuagaaauguaaguggagggccagguaguguggcucacacugguaaucucagcacuuugggaggccgaggugggaggaucacuugaggucaggaguucaagacuagccuggccaacacggugaagcccugucacuacuaaaaacaugaaaauuaacuaggcauggguggcacaugccuguaaucccagcuacuccggagacugaggcaggagaaucgcuugaaccugggagguagagguugcagugagcugagaucaugccacugcacuccaacuugggugacagagcaagacuccaucaaauaaauaaauaaauguaaguggagauuucuuucucuaagauuuugucucuucaguuggcuuuuaccauugagagcauuaaaaaaguucacacuguauuagcauugugcccuaaguaaaaguuuuuguuucaucugggccuucugaugcuaugcaaucaaacgccuagaucuggcaaaagaguggcaaaauaucuuaggaaugauccuguucaaccucucauuguguagaugaggaaaggaaaguucaaaguaucugcuuggcuugcccauagccacacagccaguaggaacgaagaguugguuugaagucugcugaccccagccuggcucuuuucccaccaucccauaccacaucaguaauucuuguuuugaaaaauuaaaauaauuguuaaguucuucauuugacaauuuugguacuguaguugauuauuacauguaugcuguaacuuguaaguucuaaaugaauugcguugacaacuucguaguuuagaaaagugugaauuauuuuaaugaaugaggguguuuuuuuuuucuccuuauuguuuuaagaucuauucuccagaucacacuaacaacagcuuuucaucaaacccuucaacuccuguuggcucuccuccaucucucucagguaguguauuucaaaucccauuucaucauauaacaguuuauaagaaugauuccccccuuguacuuccugauuuuguagguggaaacucacuuccccccaaaucccaaagcuuuaacauuccuauaacagacaaauacaaagggugggagagacaaauuaccagauaacaguauagucguuuacauccaaaccuuuucuuaaaaauuagauuaucuuuuuaaaauauacaggcauauggaaaauguauuucuuacacuuuucuuagcucugcagaagacacccaacggcagaauaauguauuccaauaaaacgucucagaugaaaaaaacucaguuaauauagucaugaauaugaauauagacuagauagucaucaaauauagacuauuuaaauggaucauuuccugcaggaauuucaggcuuuccaaauucccucuuuaaaguacaugccauugggauguuuagagaaaacuauaauuuuguaaauaaauugugaaauaauugugugggguagaagggauguuugacuucaaaguauaauacauucguaugaccuguggcuucaaauugaauaacuauaauuuguagaauuaugucaguaaauaauuucacuuuucagggguccguuuaagagacucauugucuuuccaauauaaaugcuuccagaaagccuuccuugguucaugucucugcucuuugguaaggagacagguggcuuauuaaaaaaacaaaacaacagcaacaaaaccuaaaucacaucuguaccugauggaaaccuuaccuuacuguaauuuauaguggaguuacuugcguuuguuauuuccugcaugcagcucucauggcccaguguaaacucagcuccuuggucgaggacaggagguuucacauugccacaaaacuuucagaaaugauggccauggcuuagcugggauuuaaugucaaccucuuccaagccuccgugguaugagaagaucacagaauagagagggcagugggauucugaagucucuauguccagagagaccgcguugaaacugggaagcgauugaggugauuuuaagaggauaaucaaacguucccccugguggaaauagaaacuagaguucaguauuguuguacuccucggguucuguaccagauucuuacacucugaaaaaugauuucaauugucaguaacccccuuucgagacaacaagagauacaacaagggauagaggaaucugagcagguggaacuccaguuuccacauuucaaacaaaguagcuuucauuuuauucauuuucuaauuuagaaaaagaaauguucuaugguaucauaauguuugagaacgacuaauguagucugauacccugauuuuacagaugagaauacugagucccaaaaagggaguugaguuguugaguuuauuaccagugguaauagcagagcuuggacaaaaaucuggugcucacaguucugccauccauuucuagauuaauggugggaaagaaaaauuaggaugcacagucauucuagaaaacaucacaaauucccucgaccugaguagcaugaucucagugaaaggcacagaaacaaggcuagagaugccacuuuuugggucuugguaaugcaucauggaagaccacauguuaggaagaaagaacuuuuaugaagaugcaaauauggggacagauugcuauuuucacaccgacggcucuguccaaauucugucaagaaaaguaauugaacaaaauauucuauuuuuauuuagcauaaaaauauacaugcacacccagaaaagacaggaagaguggauuuuaaaagugcuaacagugucggggcaugagauuucagugagaucauagcuauuauuuuuuccuuuuuugaauuauguauuuuccaaguuuucuacacugaauguguauuauuuuacauuuaaaguguuuuuuauuuuguagguuagacauguaauauguauucuaacagcaaucuuuuuuuaccuucaaguuuaaugaaucauaaaaaaauuauuuucuucagaagaaacuuuuagucauugcuguauauugacuuuaaauuucuggcuuaguggaucacugauaacuaaucuuauucccuuaaaaaguuuuucaagauuuaucuuuuucuaaagauuguuuuaaaaacaaguggcaaagcuguuuuccacuggugcgagaauuuugguuuaacauaaacuagccuugcaugaaggucuaacaaaaucccauuuuuguacccuuaaaaguaccuugauuccauggugauaguuuuucuuccacaggaacccuucuuaccaaaauucagaaucaauuaaauguucucuuuuaggagacagccagccugggggaauugugagucuauguaaagucuacauauuuuacauuuaaaauguuuuccuugucccaaaauucuuauaugggaaguuuacauguauuuacguuguuguuuaaaugaaaaucaucauugccauugccauuuccaaaaggacuguuuaaaauauuggcaagcgucuuuuuacaugugucuagaucugauuguaauucccacuuuaauaucagcaggcacagcuguuuggucuagaaauggaggacaggccucaucgucuccuaauuaugaaggacccuuacacucuuugguaugucucauuugcuaaucucugucccacccauuuucaggucauguucuuucuuguucagucuccuuuacucuccaagauuuugauuuucccuguuaguaacuuuaagucagcauuaagcacacagguuugcgggagccagagucauuagccuaugcuugcuccuauuuggagaugggaacccagauacuacuguaauggcagccccagggcucuaaauaucuaguagcagauaaaauccuggaagggcaauggccuucuccccaucucuaggaaagaucccugucaaugauuaaaucacuuuccugcuaucagagugcuggaacuccagccagguccuauaccuggaacauuugauucccucuaccucugcuuuacuuuccagaauaacagguuuacaggagcuuuccuucucguagaaacccagugguauccuucgugguagagaaaugccuacucuuccaggagugaauugcugaaaauuuccauggauguaguuaauuauuauaaauacucacaugaugauucagugucugacacuucagucuuucucuccucaugauggugggggccagaaauaugcaggaaacaaugcugguugugcagcauuuaggcuguacaugaauuuagcgggaaggaauagcaguaagggagaggagccuuuuaguuccucgggguugagguuuucuuuucucccuccuaucuugagaugacacauggaagaagacauagauuuaucuaucugcuuuaguguugucuuauauucuucccuuucagcuuaaucuuaaggaaaaucugaaaagaaaagcaaagguggauuucccuccuuugcuguguucuuccuugcuauaguguaugaaucauucagcuaugcauuuuaaccaguaaaggaaaccagacagugaaacauauaugcacuacccagcccaauuaaucugcggaccacauccacauaauuaguuguuuuaguguuuaccuucaucaguuauucucuggggccuauucaucaaaaccaggcuucguccaacuauagaacuguaaagacgggguguauaguuaugggccacagcuuccauucuguuugaauucugaacacugaagaagagauuuacaagcagaaacugcugucucuaccaggaagcugugagccagaaacugugauaggcacauguaugauuucuuuuccugcauacauuuacacucagaaguaaguauguauuaucauucccauauuuauaaauuagaaagcaugcacuccaagagguuuaguaacuuuuccaaggccaaauacguagcaaagcuagcagucuaggggagguaguuuaacucccaaacccaccaaaucagaauguucuguaccauagacuacuauauuagacacacauucuuccugucaguauaaaauagaaauguuuuuucucaugcaauagagcugguacacuuguuugcacagccgauucaaaaucaaagucaauuguagcaugaucuagugcaaagagucacuagauuuaaaauaaaaagaccuagauuccaacucugacuuuaccauuuccuagcagugugacacuacguaacuaauucacuuugugucuuugagccucauuuucaugucuguacggaaggaaucauaaugucuucccugccugcccauacacacgugaaacaaggaucaaugagaugguauauuuuaaaguguacacuggagagugguauuugauaucauuauugaucaguuuuuaaaaugaauacauaccuuuaaaaugaauacauacauuuucuucacuaaaaacuauacgcauugucuaguugugaaaaacuagaauccuaauggcaaggaugaacaaagguugguugguuuuuaaugguuuaaaguugcgaauucuaugcuauaguuggggcuuugaacucaguuagaugcccccagugaacaguugauucaaguguuugugauucuucagucuuaaaaucuuauacuacuuuaguugacagaauuuauauaauuuuuuucuguaaccauuuugaggcccuuacacgcauaccaccacacacccacugguuuugaugacaggaagccagaaacaccgguaaaaacucaacaagaaauuaucauccauuugcuuuucccugucucugauuugguacuuagcacugggucauauaccacagggaagaccaaagaaauauaccuucaggaaaagaauuuaauuaagaaacuauaaauaggucaucuuuccagugguaauuguuuaaaacucuuuaacuuaauaccugccagaaaguuccuuaaauucagugaauguuuuucucuucuaaaauaaauuuaaauugccuuucaaaaggcaguaccguauauagcacauguauguuauaauguccuggaauaauuauugaauuuaguuuguucaugaaaaauaacacuauaauuuuaacauuaacacguucuaccaguuuucuggaaacaacacuauuuguauuauuguuuuaaggaaauacauuuuauuggaaacauguauuuagaaacacaguguguuuuuugucgacuaaaauuuuacuuguauaauuuaggcaccccuuuugaacuaaaucaaauuuuacaucauuuguuaaccaacagcaaagccgaauugaagaucguuuagaaagacuggaugaugcuauucauguucuccggaaccaugcagugggcccauccacagcuaugccugguggucauggggacaugcauggaaucauuggaccuucucauaauggagccauggguggucugggcucaggguauggaaccggccuucuuucagccaacagacauucacucaugguaagugaugaaauuuauagacucuauaguuaucauauagaguuagaauuucagauauagauacuauuguugcuguuuuuuaaaaaaucagcuuuauugagauauaauucacuuaacauacgaugagcccauuucagguguacaauucaaguguuuuaguguauuuacaagguugugcaaccaucaccauagucuagguuuugaauauuuuugcccccugcaaaaagaaaagaauccccguugcccauuaagcagucauuccccaucccuccacuuccagcccuuggcaaccacuugucuacuuccuaugucuauagauuuaccuauucuggauauuuugaauauauggaaucauacaacaugugguggucuuuuuugacuggcaucuuuuacuuagcaugacuguugcaguuuuucuacaguuugccacguauuagagcuuuauucauuuuuauugucaaauaguauuucacuguauggacauaccacauuacacaguuggguuguuccaacuccuuggcuaugaugaauaaugcuucuauaaauauucauguuuaaguuuuugugcagacacauguuucccuugaggaugaauugcugggucauuguugguguuugaaauuauucauuuuggugacccuggccaaaguguacaauuugaguucauauuauaauaugacauugcuaguaauucaaauauuaguguuuuuuuuuuaauuaaagaagccaaaauagugucugucaauucugagucugggagauagaaauauaugguauguuuauuuguauaaauacauugcaugugacuguguaauuuaauagaguagcuuuacuacuaccuauuuagaauaagucuuuauuugaauuauauuuaagcagauuuguccauauuacaauugugauuuuuuuccucauuacuuuugaaaggauuuuggagauaauucuuuuugaggaugauuaugaagauucagagacucuucuuaauagaauauuaagugaugacaauuaaugaggugaccagagugguggagaauguaacuugaccagugauucucuguaguucugauccucacaagcucuaccucgucucuaagcaccuuaguguccuauuuugccccuuacaggcucgcuaaaaguugcuuggaugaagguauauuuuccauuaucacuguagcauuucucguuuaagcauggucccaaaaggaaaugcaaaauacauacaaauuauuaugagguucuuuuaaguucuugcucaguaguauucuccuguccaucuuucaguuucucuuaauaaaagucuaagauuaagaguaccauucugaacgguguaguauugaaaucugcaaccaauuugaaaccaaaaauacugguuuauaaauagaagcaacgaacucacaucuaaaauguggaaagauauuuuugaaugccaaagagaaaucuuuuuuucuuucccuugaccucugcccuaaaaauucaucauugaauaaaaauuguuuauauguucauggcaguugcuuagaguuuacaaaagaaaagucuagauuuuaauuuagcuuggccucagguaauguguuaaauacacuugggaugcauauaauaugagauuuucguuuguacagcucuuuuuuuucuaacuacaauguuuaaacauacugcuuuuaauuaagaaaucuggcuuuauuaaaagccagaucugugacuuauaaccauuucuguauaucugcucucaaucaacagaaaaauaguuuaauuucuguagcuguguucauuuugcauauguuaaacggauguaacaugcacccagggcauugcuucagagacuauuuuuuccauaaauauguaaaguuuuucuuaaauaccauauguagguuaagugguucuuuuaaauauuaaacuauacauaaauacuuuuggggacuauuugaccuuugaauugacuccuuuuugagucagauucagaggugggaugggaggaaaagacuagaauuauuuuuggagaugggaaguuggacugaccucaguagaaccgaaagugagacgacugaauagaacgguagaaaaaaggaaauaauuagccaauauuacauagaaaccccuuuaauuugaucuugauauacacacacacacacacacacacaaaagcaauaaagccgccaguuuugcugauaaggauaaguuccuguuuucuccucugaagacauuuaauauucaaucaaggacagccacagagccaagcagaucauagcguaacuccaaagauauggcaugucaucacccugcugcccuuugaaccaaaugggguuuugcagucucucuccuuucuuccugaaaaccauucaacguguccccagaaucugagcuccucagccugaaacacuaaugugugugaaaaggauugguuuggccuaucuuucccgugcaaacugguaugaauuuuaaaacaaaaacauaagaacaaaggaaauaguuuuugaauuuaaucagucugaaguuagccuuugaccauuugauacauuccacaauaaaaaggaaguuuaaggggaaggcaaaaaaaaaaaaaaaaaaaccucaucccccuuccccacaacaacaaaaaaauucaaggaggauacugguaauguuuuccacauuugaauuuuaauacaugaaacaggcuauaaaacuuuggccagcugcaguaaauaaaguagccgugggagguaugcaccggaaacuucagcagagagcacuggugagagucucauucccaacuacacaccuucguuuguuguucugggcggaagcgaguugcaguaacuugauacucaucccagucccgguuuuguauugagcacaucgccuuucuaacucuccucaguaauuccuucugauuaaagaguagacagcucugaauccucucgaccuccguacgcuucucauuuccuuucucccugccuuccaaaaaucaaaacaaaauggcuugauaacuuggaaggugauauaagcauuucuuucugcagcagcuugaaguugugguggggaaaacugugguucugccucggcuguuauguuaucucauuuaauugcuaacauauuguccuuagcuuuugauucauaaaauguuuuccuuggaguucugaaguaggucuucagugauuuacuaaguauuaguauaaugaaagggauuuuuuuuuuucacagcggcauggcucauaacacaagagcgaauguuuguauacuugcaagcucucuggaugauauuauugagcuaugcuuauuuccugcucaaaaaccuucccugccuuuccauuuucuacaagauaaagaccaauuccuuagcucagcauuugaagccuauuaccauuuaccgaaagccuuauguugagcucuuccaaucugcaacaagucuuccagcaagacaaggcugggcauauuaccagaauucacccuguauguucuccuucggaacuuuuguaucucuuugucuuguccagcccuaucugcuuaucucuguacaccuaauacccacccauucucaaagcacugacucaaaucauucuucuuccaggaagccuucccuugcuaccccacucaugcuagccauuuuuuucucuauucuuacagcccuaugaaucauaccauuucuagauauuuaucuuaaccagcuccgcauagcugugcaucuuuuauagauaugacucugccuuaccaacuguuguaaauuccucgagucucacauauuauauuuugucucucuccccccgaccccuguaaauagaucauccauagaaacgggagaaaagaaacgaggaaacuuaacauucugugagugugaguuggcagccccucugcuaggcgcucugcauguguugucuuaggcagucuucacaacagcccagugaggaugauaauaguggucauuucaggugucgguaaagugagccuuagaaguuugagcaguuagucucaaguccugcagcgggauuuaaacucaagcacaucaacuccaaauucaaugcucuuuuuuacuaccaggcauacucuccagagauuaucuaugagaacaccuuuucagaacuuauuuuaaaugcuaggagcuugugauuuucaaaacuugauaaguguugguuggcaaaagaaguuuccagguauuccauggcuggguucccagagcagcucucuucccaaauguauagacagagaacuuucccuccaaagugguggcaugcuuggauuaaaacccacauuaucuaugcacuuauucuuaaaccaacauguuugcgcugagugccuaagaggugugaacucucccuaccaggguccuugagguagcaaauuuuaaguuaucaaguuauuuuucuuacuauaaccacccacuuuucuuccaaaauuaaagcagaaaucucugaaugugggagaauaaggaaauagccaggucuucacuacccuaguuagaaacucuuaccaaguaugauucccucucugccucagagaccuccaugauuaauccugauauuaaaugauuagauuucuuauaaauuauggaaagggcaauuuuccagauagaauucucucuguuacucauucaguauucacauccacagaugaggccugaaaagaagcguuucaaaugaccuaaccgcuuuuuuaacugacuaagaacaaaacccacaucaaacuugucuuuaugugacucuauguguucccguuuauuuguugguagagucagcaacuacgugaucauugagcuaaaaauccccucuacuauucauauaucgcauuaguguagcucucagauccuucuuguuuaaagucuauuuauucauuucaauaacauuuauccgugguuaccaaguguagguucugugcucucaaggaauucacaggcuaguaggaaaagauguguacuuaagcagauugcucccugccagucugcuaugcccucuaaaagaccaggggccugacccuuauccaguagugaaagaucacaugguuguuuaguagaggaguggucaucuccaguugacuuagggaugggggagucaugugcaacucaccccacacaccuguccuccacagcaucccuucagaguccugcaggugggggauguggaacccauuucagaaaucaccaauaaaaguggaucuuugcccaguuuuccucuuuucaguaacaauuuuuguuuuacuuuggauuaaaugcagucuaucaaaagagcauuccuuaggaaaagugguaucuuuuuauuuaacugacauuauauacaugagaacuuuuaccucuuagggcuucauaggacaaacaacuucaguuaguuuuccuuguauaguuaagagcucagaccacugaauuuuagauucuaaaaguacccuggaaaucagcccauugcccuucuuugaagacuaaggccuaggaaggggaagugaccaaaccauggguacucacuaguagaauuagaaaccagacaaaagaggcuggacacgguggcucaccccuguaaucccagcaauuuaggaggccgaggcggguggaucacucgaggucaggaguucgaggccagccuggccaacauggugaaacccugucucuaccaaaaauacaaaaauuagccgggcaugguggugcacaccuguaaucccagcuacucaggaggcugaggcaggagaauugcuugaacucuggaggcacagguugcagugagccaagauugugccacugcacuccagccugggugacagagagacccugccacacacacaaaaaaggaaaccagacaaaacagcaagcagaccagcacuccuugugcuauauccuacacugcucagccgacuuccucuuuacccuaauaccauaaccauuucaaaacugugagugguagaaauuagaaaccauucuguuacucugacuuaacuaaugaaauccaagaaaacucuguaguuggcccuaggcugccugcaaugaguugcuauuuagcucuaccaguaauauuuggcaaaaagagaggguagugggcauugaugugauguggcaguuauugguacauagucaugggagcagcaggagucagaagauucuguuucuaugugggccucuucaacaaagauaugaucaacagaggcaucagcaucuucaguugauaaaguugauaaaauagaaaacuauuuucuaaauagccuguuacagaauuucagcgaagcuauugguggucagcaucaucuuuuaauagcuacuaucuuguuuuucuuuaaauuaggauauuugccuucucuaguguucugucaucucuccuaaucuccacaacuaucagguauuucggagagcagauuaguaaccucaacugaaaguuuugaucuuuaucaauuuaucaguugcuccucuugggcuuucacagguuuugauuccauaaaguucugugucuauuugagugcauacuucauuucuaagcaguuauucccauggacucucagggaauuuaagagauuaucucuacugaaaucucccuacagauuuccugccaagcagucaacaagucuugaucagccuccuuccuucaagggugacuagcuccaaaugcccacaaaguccauuuucaucaaauauuugaaaguucuuccuagguccagcccaaauuugcuuuuuucuacaguccuuauguuucugcccaauagaauugcccacaaaucaaguccaacaagcacuugagaaacucaguuauuugaagacagucugcugaguguuuuuucccucuagacgaaacaucacuaucuucaaauauuuaaccugaaaaaaaguuuggacucccugucaugaacuccauugcuucccagugcauucucccuaguuuagcaaggaugccuuuuucuccacaagaaccuuuuaguguguggaaccgcaaacugaacacagugcuuaagaaaggaucaaguggacuaggguggaucuaucuccucccccauucaguaccuuguaucuucauuaaggccaccuaacaauauccuguuuugcuauguuugaugcuuucauuguccugcugacauauauucaauuuguaaucaacugaaauccauaagccaccuaucuccccagucucauuguguacuuuuuguugugucuguacaaaacuucaugaaaccccauugaauguuauguuguagccucagucugauuccuguuuaaugguuucccugaagcccucauucagucacauacucugccaucucuguugcuggcaaaugugaugggugugacuaaugcccacaucaaagccaccaauacaauauuuucaggggaggggauugaccagaaggccaugaggcucaguguuacagacauucuuucuacacgagugcugucuucuauccuuugaguuuaaucucagcugguucugucucccuccuuauacaccguauggcccaccuuugcucauuuuguccguagcguugucacagaagccgggcaugcagcacucacugugaagcaggaaaugaggcuuguccagaaugccuugcucugguggaaccaaacugaguuugagaggccauuccuguguuucagagcacuuucaaaacuauuuucuaaauacccuguuacagaauuucacccaagcuauugguggucaacaucaucuuucaauagcuacuaucuuguuuuucuuuaaauuaggauauuugccuucucuaguguucugucaucucuccuaaucuccacaacuaucaaguauuucggagagcagauuagcaaccucaaccgaaaguuuugaacuuuaucaauaucauacuuuauuuuuuuaaaacugaaaaaaaaaaggacagaaagguaaaagaacuugaagaaauucuuuuagccauggaugagugauaacagcugagaauccuugagcuuaccauuugauauuucuauauuaauuuaaagaaaagucaaaagauuuugaaaacagcaauagaaguaagauccuuuaagcucuauucagcagccccuaagaaaagugaugaggacacugugcaugcccauaugugaacaugguuggccaccuuagguauuuccccuucucuccacaugaauacauauuuuacucaaauucagacucuaugauguugaaacagucuggcauuggauguuuaccucaaaacccugcucucucugcaccuaggacaaacaaauccuaguucucugguguuuagcaucuuggagccaugaauuuuaaauaaaucaaagacaaaaaccuugucuuucccaguuuuaaaauauaaaagauacacacacacacacacacacacacacacacguguauuuaaaauagacccuauaaccucaucauauucuuacauccuuacaugguuuucuucuuaaauuguggaggaaaaggcaggcagacacauuuaauagcacagugaucaucauuuuuuaaaugaacuguuacagggacauaaucuuaaacuauccauaauuuggaauaggcacaacugugcauuuaaaaaaaugcaauauuacccuuauuuucucaggaaagcagauuuucuggagggaaaaguauauauuguauauauuagaaaauauacauauguucauucacucuuucugcaucugcugugcuucagaugcuuuuggggaugcauaaacguguaaaagaaaguaucugaucuuacaggccuuuuauccugguagagugauaauacaaauaugggucuaacuauaaugcaagguagaauuaugaaaugaccuaaggagcaauucagaccgcuaggaaaagcuucccggagaagaugccauugagcucauauucgaguccacauagaauuucaacaauuagagacaggauagaaaaggcguuucagagccauauaauaaacaugauuuaaaaccaaaaacagaaaauaaaggcucaugcaccuaaauggaaguaagaaaacugccugaugauaccaguccuugcagcuugccagccagggcugcauugggugaaaagccccuccacagcacggcagcuccagcaguuggcucgaauauuucacaugagaguccacaggaagagcgagcuuucauguauauuuuuuacauccaaauuaaguuaacucauggaauuuuccacccuuaggaauuaaaguagcaacucaugaaguaauucaguuaugucauucauaccaaaacagaaaauacuggagcaacuuggcacuguuuaaaagccaagauuaggccuuggccauuuuauauuuuuucacauuccauggccguuguguuauuuuaacuuuuauuauggcuguaaauuuuucaaaucaaaaguaucuuaauugcuuagaaaacagaaguugaaaauggguucauaguaagaagaggguuuaggcaaagcagcuuuaggagugagaacugaaaaaaagcuguagcauuacauuuucuguaaugcgaggguucuaccuauuugguugacauucacaguugugcauaauuauagcuuccucuauauccauaaaucaucuuagaacuauaaaguugaguuuaaccaaaagaucuguccaauauuagugaaaugacaucuuuagggaagcauuguccugauacaauagccacauucauuuuaaagcaguuaauuggacacauugucaaaaaccacgguauugaguuuccacauuuuaauuucacauuugccuucucccuggcuucugcacacggacgggucucuuuuggagcugaaagugugugaaaguuauuggagaaugguagucucuggguaauguuucuguaagcugcccaaaauuuucccccuguagucuagaugggaaacagcugguauuuguuuaaaaagcuguuuugcaaaaugucuaaaccuugagauauagaacugaggucaccauuaaagcaggugcuuaagagcaagugagaaagacuucagaggccgacuggcucuggaaucuucugcagggcacuuccuauuagaagaaaaaguguugaaguuugcuccuuuauuuaggacacggcuauaaguauuaauaaguaagugcacuagcaauacuacuagaaauugaguauuuuugaacauagccagcccucaagugaauaauuagcucaguaugaaaggaacuaaaauggucauuuuucucacagggcuucaagauacaagagcccaaggcgcucuagucuccuuuggguguuugaauuuccucuuuaaacacaccaacaguaaaagaacuacuauuucaaauaagcaguaccauaacugacuauaucuuccaagguuuuggaugcaaucuaagggaaagggggaaaagagacccgacuuggcaagacccguaccgaagcagucuggaaaaaaagcaaagcaaaaaacauguggaaccacuaaaggccagugcacgucagguauccaccagucugaagaugaaaggaaguaagccuccuccccugggagcuggagguuauuagcagcuguuuauccagucgggaauagagauuaacauuguacuuuuuuuuuaagaacuagaagaaaauuuguuugggaaguuggcuuuucauaucaagucacugugcuuugccaaaaaaaacuuccuuucucagaacucauguacuagcauugagcaauguuaugauucucugagaaacucugaauuaccaaaaagucuuucuccauuaaauagaacagaaaaggacagagaaaugggugaacguuugccauugacacauugcaguuguacucuuuaccaugugaaauuugccguuuggucuauuaccuguucuccaaccugacucuaaaugggacacucugcccucuaccccucacacguacccucacaacuuaaucauugccacucuaaggugcacacaauggguucugcagauaccuacugcuugcaaaaagaccuuucaugagauauuggggaaacugccuaguacucugggugcuuuauucucaaaaaacaaacaaacaaacaaacaaaaaacgaguuggauauagguauuuuuccccugauuuaaugcuacucuuaaugucauuuucuuuuauuaaauccuuucuucugcuuuugaucuuauuuauagcagagccacuggucauauggaaacuauuacuguauagcugcgagaugaaagacuucauggcaauuaaauaagagugaaucauuugggccaauaauacacacauacagugagguaccauuuguguccaaaaugcccuguguuguucacuuuguagcaaagccauugagcuuuacaaagggcuuuacaaaaaucugcuuuuugucagaaauauguagucugacaauaugaaaacacauguuaacacacaguccuuagcugcuugcuucuucacacauacacaguaucuaaaucaugccacuuauugauauaaaaugaaauuuucacuuaaauuugggauauuauuuaguuguguuaagcgucagcucuuuaaaaauauauuuggauaaucuauaucaaaauucgacccaucacucaaaaccugccuaaaaugucauguucuucuuaaaguagucccugguuuccuaaacggguaugacuucaucauuuuuuaaaacccuacaugaccuuguacuccuuuaugacauucaucguauuuugccuuguauaguaauauuaucccaucauuaaaauaucagugccugggcuaggcgcggugguucaggccuguaaucccagcacuuugggaagccaaggcgggaggaucacaaguucaggaguucgagaccagccuagccaacauggugaaaccccgucucuacuaaaaauacaaaaauuagcugggcguaaaggugcacgccuguaaucccagcuacuggggaggcugaggcaggagaaucgcuugaacccgggaggcggagguugcagugagccaagaucaugccacugcacuccuuucugggcaacaaagcaacacuccaucuuaaaaaaaaaaaaaaaaaucagugccugcaaagucauagacguguuuauuuuuccuugcaaaugcccauguagugccuugcauauaguacacuuucauaaggcgcuugucaaauuaagugaaauguuuauuugauagaaacaugcuaaauguauauuuggcaauaucaaacaauuaaauuucagacauagucucacagauccauagcauuugugucaucauuugcuaagcaucuaacugcacauuguacuauuacacucccgugcagugaccugugcaguuccuguccuugggaugggaugcccacaaauggagacaaguauaggcuuuacgaauggcagcaaaacaaacuuauugaaguuuaugcccugcaccauucaacaaugaccuugaauguguuuuaaggguggugucuguaaugcauagugagcucgugaggugacaagaaaguggagauuucuggagauccacucagcccugaagggucagagagugaggggaucugugaggcuaauaaaagagaagcaguuggugaguuaggaggaaaaaacuagcccagcagacagagcagggagggcuuugcucaagccuuagugaugugggcguuaacccagcagaugagaggccaugcguagguaauugaacauugauagugaggaauuuaaaaauaggagggaacugcauugguccugggagucuaggugaaggaugcaucagcacaagguggaccucuuagacuggauccauacagcaagcaagagccaggcugaagccuuaauauugcaucaacugauggagagagaauauugcauuuaaaagaugaguauuuggaaagugauggggaagaaaugguucauucguuuaggugagcuucuuuauacuucuacucucuuuucaaauauauuacaguaagcauguguuacuugaauaacaagaaaagcauuuaagaaauaaaggccaauggguaaugguaaaucccuagggauccuuagggaugggccaccuggacuggcuaaaaacuguguggaggucagcagcaugacugugcacucucacagguaugcuugcacuucaggcauucagaauuccaaguguaaaucaaguguccaguugucuuuuccuuuaaacaaaagcuguuuacacauaauugcuagacuucaccauauucucugugcuagauauguuugguucacuaggauggauuaacuuuaguuccauaccaucuacuuacuagccugcuauguggagcaaggaagagauagaggaaugggcucuguuaaucugccaguguccccgcuaggugagcucucuccaguuaugguuuccacuguauaggaaaaugaugucgagaauugagggugugggacacagaagagagaaaugaaacaguuuuaauagauggaacguaugaguuaguacaagaaagaugaacugaggucggcucacauccguuugcauuucuugaacuauaucauagaaucauucauuuaaccauuuuggugaacauccaggggaguuucagcccagcugaucauaugauagacaagcacugccaaggucaggaucauuuagaucauguuuaaauccucuugaaaauuacuuuauuaucuggagaaucaauauuaaauaaaucuccaagaauugcacaauaaggaauuaccuuacauuucauacagaacauaagagaagcugugauguuucuggaaaacaauguagguguucucaagacaguuaugaaaucuucucccgacauacauguuaagaaucaaguaaaaauccaaacaaaagaauugaauccagaucugauguuaaugaaaagucucuuaaagguuuaaucacauguacuaaagaaaaaucaucugauaauuuuuuaaacugagaaauauggaaauuauguuugugguuggagugucccagauguuagcucuuucucccacaacaggugguuauuagagguaggucuuguuuucugcagagccucugugccucuaguguuguuccucacaguaucuaucuacugcugccauuccaugaacuuccuaauucccaucugugagccauuaaaaaaguuugcaugaccgcuucccaccucuuuaaaagaugcacuuuuguacuaaaugguguuuugcacauuugagaaaauaaguuugcuuuccucuaauaugacagaggucuggcaagauaauugaaacugaaaucuaguacucuacaacugucauguauaauugauauuucauggggagauuacaguucagacaccaaaacuguuuucuguaucaauggguuucuaauuacagugaaaacccaucagcuuuucuuuuguguuaauggaaaaacaacagagaaaaguaacaguaaguugcaguuaccaggacuucugucuuugucccauuuuguuguuguucuucuuucuaaaaaccaaaaaaaucuauguccaaaauuggaaaccagaugccauuaauagcaaacuuuaauuuugauguaccaaaauguuuauaauaguauauccaguuuugugucauuaucacuuggucuagaaacugaugacaaguuuccuaaaguucccauuguauacucuuuuagaaggauuaugguagaauagaagugacugaggucugaaagccuguuuugaagcaguuaucucuggagauaacauuaacuaggauugaauaacugccaaaugaaauuuaauacauuuucccauccaugaaauaggccucuuaaauacaacagaauaauuacuuucacaauacucccuggaaacaaagagagcaaaaauauugaaugucuuuuuuguuugugguguuuguuguuagcuagaggauaaggacaaggauauuuaccacaaugcugaaugcaucuccauauaaaaacagccuugccaacagccaccuaauuugaaucugcaugucuuuuaaaucuguuuauguuggagggaucguggcaaauauuaaauuuuauaauuuaguuagacaucuuggccuuggccugaguuaaugaacuaugauuuucccccugcaauaaagaaaaaggaaaugauuuuccucuaucuauauauguacguauauauauguauguuauaugcuuguaccuagguguguguauacauguauggacacacacacacacuguuuuaaaacaaaagcucugggaaauaaacgcaucuugcccccuaacucuccuccccucuccuauauaauuguucaguguuguaaguuuucugaguucaaaaucuguuuuagaucuccaacuaagcaucgaaaguuggaucuuaagucacuucaccauucuuggccuuagcuuucuuuguaaaaugaagaguuugaccuaacugauauauaaccaagguccuccaagcccucgacgucuaaguucugugauuuaaaaguguuucuaucaguuugucaagcccuuucuuggaaacuaagguuauuuaaaauuauauggugcuuacgugauucaaaauaauuauugcauaucuaaugacauuuaauuauuuccauugacaaauucacacaggagaauucaaauagcuguguuggaauuugaauauaauuugaccuaagauacaauguaacucagacauuuacaccuacauguaccagucaauauguggacgggacaggccaagccgccuguguuuggacuacaugaucuuauccccccuuccucguuuguagcucucuggaccgggaaaaugccugucauuaagguggcccauucauaguaugaccuaugucugcuucaaaaugagcugggccauccagugaucuuggcauucugagcuuagaaauacaaagacaaagaggaaauuagcaggagguacagaaccagaaagaaugcaccaagagguaucaugaagaaagaguccaaucugucaucaugagagggcagaagccagagagaagcagagguccccccagagagaggagagaggcugaauagcccagcagaggcgaggaguggcauucgguucccaagagcucucugaguccaaaaccuaagcuacagaaaacuauuuaugauaaaucuuuuauuugaacaaacucaaauagguuucucuuccuuacuauuaaaacuaccccacuaaauugaucagcauacaaaaauccccccaagaaucauuaugaguuccacaaaaaccaggaccacaucugaguuauuucucauucuauccccagugucucccaaagugacaggcaugagcuagauuagaaaauguuuguuaaauuaguaaaugcauucucugaucaaucaaugaauaaucauugaauaauuuuuaaauuucacuucuaucuucuauuuuuagcauagauaucacuaaaacugcauuauacgugacuaugggaagauucacauuuacaaugaguauuaauaaaauuuucauaagcuggcuuuuaacuuuagacuauuguuaucucuaugaaaagguuaucaaaauagagcuuuaacgaaguauggauuuucuaaaaauagggacgaaaugucaugcuuagaauugacuugugggaaucuccuuucuccuagucacauuaugacguauuuaaguucagaaugccaagaucauuggaugccccagcucauuuugaagcagacaugggucauucuaugaaugggccgccuuaaugccagugggcaaaucccugacccuuguauauacagagaacagugugaguuucuccaucuauuucuguguuauucuagcgauggauuugugccgacaguccacuguguuucuucccuugucucuuaugugaccagaaauaauguuucugaaagagaagaaaacaggguuagaauaugccaucuguggccaaggaaacaagcaaagccaagccaauuauucaaauuggaauacucuuccacagccacaggcaauggaguugauccuauccuggagaaucaagcucauuauuacauggcucuggaccuaucagagggcauucacaugaccuggaauagacacaaggggagucuuaaaacaucacgacaaauuagccggcgugguggugggcgccuguaauuccaguuacuugggaggcugaaacaggagaauugcuugaaccugggaggcagagguugcagugaacggagauugcaccccugcacuccagccugggugacagagcaagacucugucuccaaaaaaaaaaaaaaaaaaagucagaacaacuuugucucuaacauucuuuauggaaaaugauugauauuauuuaagaugaucuauagaaaauagauggaguuagguaacauaugggccuaaaauccaaacaaaaauguaguuggaacaacuauauccucagauauauuuauaauauuuaagaguuuacagucauuguauaggggaaagauuuaaaauuaaauggauuuuaacaaaauagagacaaagaucaccguaacugaagauagcuugaguuuugaggggguucuugaacuacacaggcuauuauuucuauauaacaugcaaguauuuucagucaaaacacaugauucugucugcaguuauuauguaccuauuacauaccaguugucauguacgauugcauggguucucuuuuucucuuuugagaacuuaccucaaugugaucuagagggaaaaaauuucaggagcaguaacugaauauauuuuaaguaaaaagcaaaacauuacucuuaaguuaugucacagaugcuugcaaagaaaucuugagaguguuaaugauucugaaauaggaguacacuucuccucuaugcucaaaucugugguuaccuucagugauuuugacuuagagucauccuuuguagaaauucaagaaauuagauccauugggaauacaaauaaauaugaaucagcacgaagaauuauuuagguuuauauugauugacagacauaaagagccaccauuugaucaaggccuguaaaaauucaugcuuacaaguugacaucuuagauugaaaggauaaucauugauugaauccguuuucuaaugcaugaauauaaaaauagcaaaucaaaaccucaauggaaaauagcuaucaugcuucugaauaaaaauuaaaauauauaagagagugaguuacaaaugguugcuggagcaggugggcguggucugccuauaagagagcagacuucagucacagaggaaaggagugguguggcaggcaacaggguugaauauguuuaaaaaaaaaaaaagguuuguacuuaacgccacagagcucuagaagcugaaacuagaaucagugagugaaaucuacaaagaggccaauuugugguaaaaauggaaugggcuucuuugggagauaucagucucaguacauuugaagcaccccacagaggccaaauaaccaccauucagaaaguucuguguugcgacacaggcaccggggagcagugcuggacuuccuacaucucucugcugaaacauucauuuauacuuccugaggcucauaagccucaaguguugucuuauucuugcuguauuuugaauccaaacaauuaauaugauuuaugugaucaucuccacccaaaauuuaaaaaaaaguuggagugcauacacacacacacacacacacacacaugcacacaugaauauaaaaauggcauacuucaggaucaauuacuuaaauauauuuucaguaaaaagcaaaauauuauaggugauacuuaauacauggcugccuuuaaauagcaugugcuuauuagguccugugaauuuguuguugguucagauacuuauuguugaugcauucuuuggaaauacccuuuuaaaauauauugguaacacaagagugaugauucuccuuucugguuucauauuuuugacuggaaaaaaaaauaaaccugauucauagcaguauaaauguaugguuaauuuuuuguguuuuagacccaccguccuguguaaaugcucacuuaaccauaggcuaagaaaauacuuggaaauagaaaagaaaaugugaacuacugauuguccucuuaguugacaaaugcuucauguuuucgcuugaaggcaugugcuaugaaguaggcaguugcugucucagugccacaaguucaaugucucuggaccccagagucgauaguaguaguuaauaaaaagcucagcaguauuuuuuuaaugaaguaaucaugcuguacucuauaauuuuauucuuggaagcauaaagaguauuuacaauauggugucuuucuagggucagaauagugaggaaaaaaauggaaaaauguccaaacauccuuccuugcauggcaaugauggcauuacugguguguuuaauaaaaccuuuauugguacauuuuccggugugguggcauuggcagaaaccaucccccuuuggauuuggaacucagcagcugaugaaauacaguaaacauuaauuuggaaugggcugccaguuuuggaaagccaggugacauuuuauuauauuuguaccaagcagaggcugugucccauacugcuguagcuuccgcugucagaggcuuagcuggcauuauggaaaaaaaaaaauggcaggccugagaaucuuauccccugaaaugaaagucgaaugccaaauugaaauuccuguaggauuuccgauagcaaugggggaauugagaagcucacaauuaagcauaugggcauuaagauaauugucagaucuguuggcggacaugauagaagacagauggguacgaaucagugcgcuccacugcagcacccugggaggcaauuugacguuuuaccugccugagcuacucugccauauuugucacugaauguacagcacggcaucuuacugaguguuaaguguuuucgccgggaacuauaggugcaugugcgguccuucagcgcccucuagugaaacgcguuugggaguaugguuuuugaaaagccagccuucaucagguccucuuggccucuggaaauagcugucgcaccuccgguuccugcucaccucucugguuccucucgcccuuucagguggggacccaucgugaagauggcguggcccugagaggcagccauucucuucugccaaaccagguuccgguuccacagcuuccuguccagucugcgacuuccccugaccugaacccaccccaggacccuuacagagguagguuggccucaccagggcacuucugaccucacuuucacaauaggaccaguguugauacccagccucuugguguucaucccucaagaagcacuggcagaaacccaggaaucaaauugggcacaaaaaugguaaggaaauggcaaaguauuuagaacuucgcccgcuaauuguguuucuccagggacuguuuuccucaaacauccucugaaauccugguccuauaucagcagggaaugaggccacagacugaugagaggaaauuuuauuuuagcuauuuccacauuuuucucauucagguccucuaaugugguuaguuguggccugaaaaugauauuuccaaaugaauaggaaggaaggaaauuguuuuuguuguuuaagauggaaggaaauauaggugcauuuaaaaaauggagcuugguugcaugauuuucgcucuugagucaucuagcccucuaaugauugccucauaccggugauuacgagcggcuuuucaugaccccaggaaguugggcuauugcuggccagcugacuaggagucgcuuagauaacaucuucucagucccuucacauuuaauauaaaaaugauaacauugccacaggaauacaugugggcauuuuuucagcuguucaacauuguacagaucugagugucaauuauauguauggguaugucugcccauuuuuuaugaauaauaaucauuuuauggacuuuuuuuuuuuuuuuuuuugacagagccucacucugucgcccaggcuggaguacaguggugcgaucucagcucacugcaaccuccaccucccagguucaagcgauucuccugccucagccucccaggggguagcuaggauuacagacaugcaucaccaugccuggcuauuuuucguauuuuuaguagagacaggguuucaccacauuagccaggcuggucuugaauuccugaccucaagugaugcacccgccucagccucccgaagugcugggauuacaggugugaaccaccacaacuggccaggaccuuucuuaucaggaggcuuuggauuuugcccucuuuguccuaaaccugugcuucucaaacugcacauaagcacaaccugagcaucuuguuaaaaugcagauuccacuucuguaggucugggauuguccauuucuaaugggcucacagaugaugaggccgcauggaccaaaguuugaguggcaagguucuagaauacacagauuacaaauaaagaggaauacuugacagauaugcuucuaccuuuaaaaaaauuacuacauuagggucguguuuuaaaaugcagugugacuuggaaaguugagcaaugauaaagcuagaaauuucuaaaaugaguagcaaacugccuuccauauguaccauuuuaaaaugcugauuacuucuugagaauaagagaagccuaauuucagaauaucauuaggguaccuauugaagucuugacugcacauauuuagcauacucccugggaauuauauuuuaaggacauuuuucuauuaaaucauugcauauggaagaaacucaauauaauagcugauauuuacuuggguucuuaaucagaacauuggcugugugauuuucaugauuaugauuuucauugcaauuaaguugauguuuuguagacagugaaauuaccaucuacuccaaaagauugcaaaauagaauuuaaccuuagagccaaugcagggaaaacuuguuucugcaggugcauuuuuugaaacuucaacagauagcagggggaaaaaaaagugacagaaggaucacaguucagcaguaugaauugucugcuggcagccuugcaaucuggugugcaggcagugagauugugguguacaugucaccugauuucucuuuuucggcaggcaugccaccaggacuacaggggcagagugucuccucuggcagcucugagaucaaauccgaugacgagggugaugagaaccugcaagacacgaaaucuucggaggacaagaaauuagaugacgacaagaaggauaucaaaucaauuacuaggucaagaucuagguaacaguauauaauacugucgcuucauuuaauuccuuuauuggacuuugaugaagugaacagaacgggaagaaacuauucaguuuuuuccuggcagguaaauuuacagcugaaaagaaaauuaaaggccuacucuagaaguacuaaaaguaucguuucagauaccuguacucuauuggagccuaaacuguuuuggcauuuaugaaucuggacccaaugcuaaugacacacagugaaaaaauuugucucugauucaaguacaguuuauuuguaaaacuauacuuauucuacaaauuuggucagaaauguugugucuauaauauuucuaaaaagagauuguagccauguuaaaaacucaacugauguaugugccaacuauaacucuuuucuuaccucuaaaguaagaaaauaauuuccuagauuuauccuaaacaugcugauguauauaagaguaauaccuuaauuguuuaugguuuuucuuccuggacacucuuuucuacagaaaacacaacugcaggaaaauagcuucugucugguuuucuuaaauaucugcuaucuuuaaauucaaaucuauaucuccuugaacuuuaaucugguaaucagaugguuuuugaauaccaacacccguguacuuugccucaauucccugagguuguuuuuauucacaaauucaaccaauuguccuaagacuacagcuuuccuucuaaaggcugugguucucaagguucuaucuggaaucuuuugugaauuaagaacaugcugccucuuuauguugcuguuguaauuauugagauaaauuccgugucuugccacaaguuuaaaaaugccgaauacuucuagauaaccccuuuccuuccuuguugucuuuuucugauucuuggccacuuuggcaagaaaucccaaggaggggauuucauaccuuuagcagcuucuguguuagaccagucaguucuugguaauuuaacuuauuguggccaaacuuaugcauguuaauggauucuuugaaguuuuggaacaacauuuucauucgcuguugagaaccuucuuauuuaaaaaggucacucuuaugacauuuacuuauguaugccuccaaaacuguauuauaaggcagugcuuuuucaaaucuaggcaguuuuauuugcauaacuaguuuauuuguaagugaauaaccaauucuaauuggucguuagccugaaaaucuuuggaagaaaaguuccuauuuuccagucuccuuuguguaagguguagcauuuguuggauguauaaaaauaucacccaaaugcucagcuuccggacaggccuggcagagacuguuuucauuugcuuuuuacagccuauuugcauaguagaauauaggagugaauuaaucauuacugauuuccuuggcacuggcagcaguugggggugagggcagaggagggauccgcagaaggcagagaaagagggccuuuuccaguggacucaguugacuuccauguuuaccauacacaccuguggcagacagugccaucuggaaaggcgcuuacgcuauggagagagaggagccuggucuuacagcauccuucuguggugucauccuccuugccccuaacuuuucuccuucacccaaguguucuugacuuacgugcauuaucuuuauguguaacguauacuugcaaccgaagaauaccacucccacuuuugauugauuggagcuucucaaguguaauugguccuuauugccacuuggaaguuacccagagauucuccaaaauggaacaucagagucauauauuuuaaaccagcauucauuaaauauacauuuaauugaguagauaauuucccacaucuuccaacuccgaaauguugugauuaaucaucuuuauucugugaacauuuccaaugugugaaauuacccuuuagguuaauuguuagucacuuccauggaguuucuugugauggggagucuacugauguucagugaaguuuguuucauuuucugugucucucauaagccccccaaaaguccucacucauguuuauucacaauagucauucagagcuuuauagcacgugcugcucugccuucuugagacaagacgucgugcacacuucucuuuuuuacaugacagcccuuggaauauuugaacccugcugcugugacgacuuccucauaugauaugcuuuccagguggcucaucauccucuuugccuuccauucaaaaguuucuaauuugucacuguaacacucagaaauggacagaaccgaucuuaucuuuucagacuauucugggcccggccaugcauuuguuaugaaucauggaauauuuugguuuucacaauuagaaauuaccuuuuggcuuuuuuuuuuuuuuuuuuuuguaagagacagagucuggcuguguugcccaggcuggagugcaguggccugaucacaucucacuguagccuccaccuccuagauucaagugagccucccaccucagccuccugaguagcugagaccgcaggugugcaucacugugcccagcuaauuuuuuuuuauuuuuuguagagacgaggucucacuauaucguccaggcugggguuauaggcaugagccacugcacccagcuuucuggcuucauuuuugacucacaaugaggucauggucauucauaagcugcagguguuugguuuguugaaucguuuugcaugacugauaucaguucagguuucccaaacuuguucuguggaucauaaacaucuauaagauuaaagaccauggaagucauguuuuuguaacuuuuuguuuaauacauagagaaaaugagacucacauaguggguugaccaggccuucaaagcaagguaauggggacaccugaauaaaagccucacugucuucacucccauugcucuggugucuuacauauaggccuuucuucuuacuccuguuaagcugccuuguauuuuuuugaccuaucaaaaucauuuuucaauuacuuguuuccccuagauuucagaugucacgguaugaaagguuuuauauauauuuaaaaaauaaaguauaaacauaaagucuuuuugaagcgugguuaugcaacauaugcuaggcguaaguuggugaaugccugcuuugcagaguguaaccccauugaauaaaaaaagcuuuguuuucccuuucugccccccuguaucaguaugggcacacccugcacucuaacuuuaaucuacgucacccucaccuguuugguuuggguuuaaugucugcgagaaaaccaaauaucuuguguauugugaacugucaaagccaucuaaaccaaucccaaggucaaguggauauaaaaauucugccaaaaacauggcauaagauggaaaaguucccugaaaacucuggaagaaaacaaaguaauguagacaccuucuuuuuccccacaccauuagaaaauguugcaucccuuuugucccacagcaauaaugacgaugaggaccugacaccagagcagaaggcagagcgugagaaggagcggaggauggccaacaaugcccgagagcgucugcggguccgugacaucaacgaggcuuucaaagagcucggccgcauggugcagcuccaccucaagagugacaagccccagaccaagcuccugauccuccaccaggcgguggccgucauccucagucuggagcagcaaguccgaggucagugcaggccagccuccuugcagagcucgugaggagcuuguggcaggcacaagcugagaugggcacgccagucuugagcaguggcagacaguagacuuucaagcaucauuccaaagaauuguuuccauugcagacugugucuaaauccauaaggcagcaucccuuucuccuguaauuaaguugugggauucucuuauaacuaagauuauauugcaacuuucccuauauccuuucaguaauuugagcuuaguuuauuugcuuuaccaaccuuugcuuacuguaaaguggcuguacacacucacaugcaguucaccuuuuacuagugacugaccaaauggauugccacaguacuuaguaacuguuccuuuuguucuguaauauaaacacugagaaaaaggucagacacgcaagaagagugcauugcugcccucugccagaagccucagcauuaaacaaagguucugugcuuuaauccuccacagaaaggaaucugaauccgaaagcugcgugucugaaaagaagggaggaagagaagguguccucagagccucccccucucuccuuggccggcccacacccuggaaugggagacgcaucgaaucacaugggacagauguaaaagggcaaguuuguuuucagccauuucugagaucgaucauucaaaacucucaucaguguaucagccauaaaagugaauuucacccaaauugacagauauuuucuuucauggaaaaagaauuuuuuuuaaaaaaagcauacuuuuucuguuacaaauauauuaaugaauuuuuucucucuuuuuuccuuucucagguccaaguugccacauugcuucauuaaaacaagagaccacuuccuuaacagcuguauuaucuuaaacccacauaaacacuucuccuuaacccccauuuuuguaauauaagacaagucugaguaguuaugaaucgcagacgcaagagguuucagcauucccaauuaucaaaaaacagaaaaacaaaaaaaagaaagaaaaaagugcaacuugagggacgacuuucuuuaacauaucauucagaaugugcaaagcaguauguacaggcugagacacagcccagagacugaacggcaaucuuuccacacuguggaacaaugcauuugugccuaaacuucuuuuggaaaaaaaaaauauaauuaauuuguaagucugaaaaaaaaauauuuaauuuaaaaaaaauuguaaacuugcaauaaugaaaaaguguacuucugaagaaaacuacaugaacguuuuuguugguauucaagucagcuaguguuuauaauuacuggauauugaauuaggggaagcucggcugcccuaguaacaaaaccagcaaacguccugaugacaacgaagugaugacauuagccauuccuuaggguaggaggaacagauggaucuuauagaccuaugacaaauauauauauaaauauauauauaaauauauauuaaaaauuuagugacuaugguaagcuuuuguucauuuguuucagacuuuuuucuccuguaaaaaaauaguacugauuaacuuuuuuaaaagaaagauuuuacuguaaauauggauuuuuuuuuuuuuggucuuauuucugucccuuucccugguuuguuaucguaaccuguagugccaacucugcuuccagagggguagugcaggaugaaaugcugacccugauguugcuucucauucauaaauaaguagaaaguuguuucuccagucuuuugggaacacaggacuuaaaagucacaucauguguagauauuacaagcagcauuaccaagacauggcaaaaagaguuugucugaauuguaauguugcguuugugaaccuauucugggauuuucagagguacaagguuagaaugcuacaauguuaccacugugccuuccaauguuuauaucaucggaaacauaacauaaucaaaguggcugugauuuaacaaaaugauuaaaguguuaccuaccuguguagccgaaguagugugcagugaggcguuucugaauacauggucagauuuuuggaaaaaaacaaaaacaaaaaaaacaaguaaaguucaaaaaccgucaaaugagaaaauugcaaguagugugacagagcugauugauuuuguugcuuucuugauuuuuuuuuucaaaauggguuuacuaaaauguagaugacuuaacugccuccuccuucgucugaaaaaugccaauauucaaucaucaugcagcauuauaacaagccuuauaaguccuaaagcauuaaguugcacuuuuuugaggagggguagugcaguauuucucuggccaguaugaaugaaguuuauacuuaccauauuugauagaaacauagaucaagcuauggcacagcgacucaucagauagcuagcuuugacgucugggcacaauugaaccaacuuccaucgugaaucuuuauaaugauugacuuugguguauagugcaguaaacaaauagugcuccuaguuaaguauuugucagcauccuuuugucucuaacuuguuucuauuuuuacagccacacaauucuuggcauguauuaagaaaaaaaaaaaucccuguucaaguaguuuuuccaccuaucagcacugaguaaaugccauaaauccauugaaauggucuaaauguuccaucuguucuccuguuuugccaguuauauaguaaugaaauacauuuguaaauuuuaugcaacaaauggcaaacguaucauuauuuugaaauuguguauguaaaaguuauauuuuuacauguagacucuuguuauuauguguuuuaauacauuguaucaguuuuuguuuuuuuuuaaaaacugugguuuaaaaagaagucucauuuaaaugaaauagcuacaagaaucagaauuuuauguucauuucugaaaauguaagaacaaauaagauaguuaccacguggucaucuuuuacaaacccauaaacauuuugauuagcuguguguguguugaaaaacuguaaauauguucaguagcgauaaaacuaaaauaacuuugauuuguugauaaguuccuaaaauguggagguggauuaaaaccuuaggagaauagcagaaaucaaacuucaugaaaaguuauuuuggggcuuuccugugaaauguaugaacaaagaggcucagagaaggacauggaagacaauaauguauacucucuccuccucccugaauaaugaaaaccauguguauuuguucccuccguauguuaaagauuuccuuuuagugguacauucugcacucauuuuguauagucuaccaaggcggguaucccuaggaacaauauuauauaggaagcagguauacucugaucacauucaggauaaguguacagaagaaaauacgguguuuacucuuuagggaacuggaaacacucccugcauugauguacauuuuaagaauggcacuuuugauacauguuaucauaaaggugcuuaauagagcugaauuaaaguuuuucaaaucuguaaacaaagcaaaaaaguaaauuguagucauuugauuauuuuuuaaauuggugcuuuauauuuuguucucacucagaguaaaagcugcaauuuauuguucaccagcuuugauguauucauuacucaguaaugcaauaccucuauuguugaauucccuuuggaaauaagugaaaauucuaacggccacugaaagcugcucgcuagguuuugcuugguggagaaacauaaucugcaccuauccauauuaauuggguuguauccccauuaaaaaagaaaaaaagggaauguggccuuuuuaguguguuuuuuauuguuguuguuuuguaauuaucaaacccagguaagauauugguauccugcacuggauuuucaaaugaaguucagcagaagacaguuaagauuaaaguacuauacaaaaauuucaaaaggguccauacuacgcuaucuguaugacgacacuuaggcuggggaucucuuucagaaacucggacuuuaaaagcaacuuggagcaguugauccaccuccacauucaaguaauuuaugaauaugcagaauagggaucuguucaucuagaaauuuuuaccauuugucuucuguguagcugcaaggaacacuaauguuuauacaacugucaguccacccaguggugcaacugguucugauucagucuuccgauuccuuuuuauuuuucacuuuuuccuauuucugaauuuuuuuuuuuauuugugaucuugauuuugaugagggguuggggaguggggagggagucgaaccaagacuuggaguuaagaggauuuucaucuuuugcauccaacaggcagaauaugaucuguguccaaaagugaacuugagucaggaaugaaucaauuucagcauaaacaagcacaaaaauuuagucugcuggcugacuggaagcaaaaaagucaagauggaauaugaugaauuccaacacaauggggcaccaaggccuuuaggccucucuuuuuauuuugcuuugguuuuguuuguuuuucuuuagagacaugcucuuucucaugggacuugaaguggacucaucuuugugcagugcugguuuugccauacucauuucaaguauuauagacauauguaauggugaaaauauaugaacuguggccuuuuucauucuuguuacuugugaugcaauuaagugaagauaagaaaaaaaaaaaaaaagcagagauuuaccauguaucagugccuggcuuuuuguuauaaagcuuuguuugucuagugcucuuuugcuauaaaauagacuguaguacacccuaguaggaaaaaaaaaaaacuaaauuuaaaaauaaaaaauauauuuggcuuauuuuucgcaggagcaauccuuuuauaccaugaauauuacaaaaaaauugucagauucugaauauuucuucuuuguagauuuuuggaaucauuaugaguaaaaguuuguuacuuuauuuuacuauuuaaaagauguuauuuuaccauguguuaccaagaugaaacuguauggguagcuuuuuuguuuguuuuuuguuuuguuuuuguuuuuguuuuuguuuuuaguuguaggucgcagcggggaaauuuuuugcgacuguacacauagcugcagcauuaaaaacuuaaaaaaauuguuaaaaaaaaaaaaagggaaaacauuucaaaaaaaaaaaaaaagauaaacaguuacaccuuguuuucaauguguggcugagugccucgauuuuuucauguuuuugguguauuucugauuuguagaaguguccaaacagguugugugcuggaguuccuucaagacaaaaacaaacccagcuuggucaaggccauuaccuguuucccaucuguaguuauucgaugaagucauguacaugaccguucuguagcaauaaaugugccauuuuuauaaacuguuucugacacuuguuucauuucauuuugcauuguccauauagcuaugauucucuucuguaaguaaaacgcaucuauauuucauuuuccaaguguuggagguauugacagcuuaacaaacaaaacauacaaaaaaaaucacaaaaacaaauugaaaagcaaagcacaugauugaucaaggaagagaugcccuuaaugaaaauggaacgggaugcaugcaaaacaaaaagaaaacugucuagaggauuaacuaauugaaggaauauaauuaauguguguguaacacugaagcuaugcauuugaagagcucugaacugcaccaguguuuucgguugugcugcagguugcuaagucaagucagccuuaaccuuuugcaccaguuggucggcuguuuggcagaacauucucagaucuuuucagucaaaaaucuaagaugauuuauuuuguaucacuuuguuaaaagcugaauauuguuaacuacaguuaauauuaacacuguauuuauacuuucucaaacuacauccgccccaccacuucugguugccucuguugacuauuaauccagauguaaacaaccagauguuuuuuucuaacuuguacaaacugacgugugucaacuaucauggaaggaaaaaaauguacagauuaaaauuauucaguguuauguacuguaaguuaauauuuuuguagaauggacaucaaucuacuuugcaaaauuuggaggcuauuucaacauugcacuguagaaauguaaaguaauguaugcaauguaaaggaaagcccgcgguagcugagcgcuucauaacagaauguucuaaucaaguacgugguauuuggggaugucuccaauauugcucuuguauucuuucuaauuggguuuagugacuaguugaaggaaaauguuauaacgccauuugguucacaugugaagugcccuccauagccaaauguugggauuuuuuuuuuuuucguuuuugguuggacuguuugcagauauuuaaauuuuaugaaauuuccaaagauuuugguugauaacccccuuuuaccuucuaaaugauuugagauguucuuauguucuuacuguguguuuuaaauauauauaaaagagccacaagcauuuagucuuuuaguauuauauuugaucauauaacuacuacugaaaaggggugggggggaaugugccugugcaccccuacaguaucuuguguagugucuauuaacauuguucucuuuuagaggaccacauuaaaagg

SEQ ID NO: 6331 - RNA, 55119 nt, Homo sapiens
gaagggcaacacggggaccuugaagcggggucgcggcggcgccccagcccgggccagggagucccggcagcggcaccucccagaaagggcggagccgacgacgccuucuuccuuccugaccggcgcgcgcagccugcugccgcggucagcgccugcuccugcuccuccgcuccuccugcgcggggugcugaaacagcccggggaaguagagccgccuccggggagcccaaccagccgaacgccgccggcgucagcagccuugcgcggccacagcaugaccgcucgcggccuggcccuuggccuccuccugcugcuacuguguccagcgcaggugagcggucgccggccaccgggacgcccuguggggacguggcggggccgagagccggggaaggcgacgggcccagcgacggcucaggcccggguccuggggaaguuggucuggcgauggagagcucggagguuccucacuuguccuguuucugucuccggccacgcucucuuuccuguggucuggaagaggguggcagugggggcuugggugaccuguucugagcuuguuccaucuguggucaccuaauuucucuguguaggauguggcaccagaagaagggaggaaaguggguagagugggauagggacacuacuugcuuuuuaaaaaauucugcuacaugcgcacgaacuccaaaauuuaggagcucuaaccacuuuauuuccucuucucaucaccugaggauggagguggaagcagagguaaagagacacaaacuuccucaagcacccggugaaacugccuugaguacuugacauaagucagcuuggucuucuaaagagggcagguuacuuuucaucaacuccuuuuuacaccucaggacacugagacucacagggcgguauugaauuuccccuugucacuauuagccagcgacaggauggggccuggaacucgguguccugcugacuccuucugggggcuuuugcuugguuuaauagcuuugggaaagagcaccucaguauuugugugucuguaguuuccucuuuuaaaacuggaguggggcagugucacgcugugacucguuaaaccaaaucaggaugagagugccuccggggaauuguguccuugugcacauuaacgccccucacauagguguggcgucaauaggaaguggugaaucaggggagaggggguuccguggacuagaaaaaacucuccuucgacuucuauuuaguucucagaaggggauaggugauguugauccaauaauggacuaagagccaggagaagggcuccgcgggaggaucucuugagcucagcaguucaagaccagccggggcaacauggugaaacaccgucuuaaaaacauuuuguuuuucuuuucauuguugagguugaggcugcugugagcugugaucacgccgguguacuccagccugggcaacagagcaagacccugugucaaaacaaaaaagagagagaaauaaauaauagcaauuaugugccguagagaaaauguggcuauucuguuucccuagaguuuuuuaaaauuuauuuuuaaaauuuauuuauuuuagagacagguucuugcucuguugcccaggcgugggggcagugucgccaucauagcucacugcagccuggaacuccuggccucaagcaguccuuccaccuuggccucccaaagcacugggauuauugugagcaccacuccuggccccuccuagaguuuuagaucaggaccuuaaauaggcuucccuuuuuuuuggagacagagucucuguugcccagucuggaguguaguggcgcaaucucggcucacugcaaccucugccuccuggauucaagcaauucuggugccucagccucccagguagcuaggauuacaggugcccaccaccacgcccagcuaauuuuuguauuuuccguggagaugggguuucaccguguuggucaggcuggucucgaaauccugaccucuagcgauccgcccuccucuuuuggggauuacaggugugagccaccucgcccagccaggcuucacauuauuaaguagccaucucuuaaguauuuuuuaaaucucaaguacccaaggcugauggccaaugagugcuucuuuuaugacauuugggauaggucagagguuuguuguaagucucuugcaaaaaugccuggaggccuuuucaaggucuguaaaccuuaacuggaaauaauccuauuauuauuuuaaaaauuccucaugucugaaagcuuucagugcaccugaacagauugggguggagccaugaagccaaacagauugggagagagagugugucugcuuuuagaauucguaccgaugauagcagcucauuagcuucagucugagcgcuaguagaguucuaucauggaauuauggacuaguuguccuguguaagaucugaaauacauguuggggggauuuuugcuuuuucuuaauguucaauauguacagaugauguaauaacauuacuagacugccuuguuuuuaaaacccuguagucaucuaaaaacuauaugcaguuuugagacauagccuuuauuuuucccggcuguaauuuugguaagcuuuaucuugagggacuuggaacauagagaagccuggguagaaauuaagcauuaaaauggcuuuuccucagaagacugggaaugguuaaucuuuugaccugugagugauuaagaacaaccaucugaaauuggaaugacugugggaaaucuuuccccaucuuucccacuccuugacugaugcugugaucagaaauuuuacuaacauaaguaaucaaggggaaaaugagauuuuuuuaaauuugagccagugggcagagggaaaaggacucgcugaauaggccuuuguauuccuccaguguuuguuauauuacccagaacaaagaaucacucuggucaugaagacagugugcucucucuuuccuggguaacccuccacuccuaaaagggaugcaguauucuaagcauggcagauuaccuacagcggaagccuggaucagucaucucugaucucgggugccccuuucugcccuuugaccuccagcucugugaagggcaucagcucuccagucaaauugaacugcuugcuagcaaaauccugcccaucuuccagggccccauuucacaugcuacauuaucuacgacauucuuguccuguuccccuaacuagaaugccuucccucugaaguucugaaucuuuauuuaaacugcugcaacagcauuugcugccucauuaaaagaccuuggugugggucuugacucuucucuguucccaagagugaucuuggguaagccaguuauccucuggagccucaguuuccuccucuguaaaauuggauuaacugugccaacuaugcuugugaaagacaaauauuuccuaauugaacuaccgaauugcaggcuccuuaagagcaauaacuguugcucuccaauaucaucuacaaauguggccaggacacuugacuugggacucuuuuuuuuuuuuuuuuuuuugaaacagggucuugcacugucccccaggcugaaguguagugguuugauuguggcucacugaaguguugacccugggcucaagcuauccuuccaccucagccucccacguagcugggacugcaggugcaugccaccaugcccaacuaauuuuuaaauuuuuuguagacacaaggucuugcuguguugcccaagguggucuugaauuccugggcuggagauccucccaccuuggccucccaaagugcugggauuacaagcaugagccaccgugcuggcccuggaaucuuuuuuuuuuuuuuucaagaccaggucuuacuuugguugcccaggcuggagcgcaguggcacgaucuuggcucacuacagccucgaccucccgggcucaggugauucucccacaucaagccucccgaguagcugggacuauaggugugcaccaucaugcccugcuaauuuuuuguauuuuuaguagagaagggguuuugccagcuugcccaggcuggucucgaacuccugagcucaagugauaccauccaccuccgccucccaaagugcugggauuacaggugugagccaccaugccuggcccacugggauucuuugaucauaagauauuugggccuugaaauggauuuuggggagagacuuagaaacuaguggcaaucaaaauuggauuugcaguugguuucuaggugauggcagugaucagcugcggccagccagguuuuucuucaucuggacugugccucucacuuucaaauuuuuggaacauuugcuuuggcagcaaaacuuuuaaaaaaccaacucucucuggugcagguguucuguuggaggauuugagagaagcuuuaaaauuuuaucuuauuacugucccuugcuuaggucacaagaggagcucaaaauaauuucauaaacaugaauuggcuucccuagacacaacaaaggauaagaucaaaagaauuaacccauuuaaaaaaaucagucuaggcugguccuaagguaguguguuaucaauugaucaaagucaguuacagaucgaacuccuugaucuacucuuuccuccugcucacuacugcacuugacuaguccaaaacaauaaguaaguaguaaaaaaaagaaaaaaaguccgucuauacacuguaaagugcuguguaaauguucauaauuacuaucacugucuucuucauaguugauggggggaaggcuggauacauaaaaaaaugguaauacaguaagaagugcucagauaagaauaaagauaaaauguuauggagaguccauuuuugagcugagcuauggaggaugaauuaauguaucagguggacaagaggaaaacuagagaaaauagucgggagaguugccuaauuguugcccuaaacuauugaacuguucacuugaaaagggugaauuuuaugguauguaaauuacaugaguaaagcucuuaaaaaaauuugcagggugcuauauacuagauuacauaagacuagagacaaaagcuacccaaauuuugcauaguacuccauugcuaucacauccgaucuuguuuuauccucacagagccccuuuaagguagguguaaugcuguuuuuccuauuuuauagaugcagacaucaagggucaaauuugucccaaggucacauagcuaguagauggcacauugggugcuucaacugccaucuucugacuucugugcccuaguuuuuugaaauucaaggcuagauuauugguguuuagcaagcuuaauugaauggguguucagcagauauuccacuugguuaguagagcagucucauucaaggccugguuccguccccaguguggcucuuccaguaguccguaauagaucaggaauggguuuagccugcuggccugaccccugauucagucaccacacugugaacauuccauagggaaaaaacugcagacaguguauacuggcacccacuuucauaguuuuguuuuaguuuuguggcuccuaaaugucuaagacuaacuaguaauaugaccuugggugagucacauaaaaaaccagaagcuaaagggguuaucuguaaaacgaagaguuggacuagcugagcacaccuagcacucaaaauauaugacuuaaacacccacaugcaggcaggccuggugcacacacaaauuauccuuuguuauguagauacguucaugccagguuggcuauaaaacacuuccagagauuuccgucaauagaagucagaccagcccggcagccuccacccuaaaugcccugccauauuuguuuggucugccucccugacuccaaagaagcagcaggcagcuuaaucucuggacaggauucuucaugccacucccuccacuccagccuguguuguccugacuggccaggccagccucugcucucuggagaagcaaugagguagggaaguuaaccagcaagccccucuccuccaucgccucacuggagcuugagcuggguaucucuccauguuuugccauuagcuuuacccauccaggacaggggcacaaguguuggugccaagcccugcacucccagcucugguggauggccaaguccuacccugggguugaggacugucagugauacugaguaagggagucauugcuugacaacugccuagagagauacuuuaaaagauaggaaugggaggcauuauuucuacaagugaacaaguuuauauugaaggaacacuuguauaggaucaucauggaugggacaguucaucuccagugcauucuccaauucugaggauacaucacugcacaaacuggacuagaguuuaaaugguacagaagcuggggguaggggaggcaggaggacaagggggauggguggagaaugcuuaacuugguguucaaaaucauguuauuuaugagccaugugaccucagaguaucuuugagccugaguucacuuaccuguaaaauucugcugugcuacugcauagaguaucugagaaaaugaggcaugcagucgauguuugguauuuuuguuucauuuauuuauuuuacugccaugccucgagaacaauagauguucaguaaguauuugaauauguuaguuaaugcuuuaggauuuccuaaaggcaguggaauagaauucucacugaguucagagcuuuucugauaauaaugugugcuuauggagcuccugaaugggguccaauuuagcaguugcuauaguugcugagauauagcacaaggggcauuuuuuuuuuuuuuagauggagucucucucuguuacccaggcuggagugcagcggugcgaucucagcuuacugcaaccuccgccucccggguucacgccauucuccugucucagccuguagcugggacuacaggcaccugccaccaugcccggcuaauuuuuuguauuuuuaguagagacgggguuucacuguguuaggcaggauggucucgaucuccugaccucgugaucugcccaccucggccucccaaagugcugggauuacaggcaugagccacugcaccuggccuagaaggggcuuuuuuuuaaccuuuccugaacuguuccuaucguugaaagaagcuucccuauccagucauuuucuuaguaauuaaacucuagagcauguugugaaauauccauaugaucuaaccuuuaaaaauagaaacucuuuagcuguguaacuacuaaauucuggguagaagccaaaacaaucagcacuucucauuucugaacuuagauaauccaguuguacucccucagcucauugugaguuuugacaaguucugcauccaugaacaccagauguaauacaauagggaauuucaaaggaaggauuacacaccuaggcucugcccucuaggauuuuaccgucuuacaagggaguugagacaaaagugagaaaauacucuggcaacuucucccaacaucacaacuuugcaauucucauaaauuuugcuugauccuagggcaugaccaaggcagaggcaggcagguccuacuucaugugggagagaaggaaggaaggguaggcaguuagagugauagguuuggaauacuguagaaaggagagugggcagagccagagugaggugucugaagcuugucgcacaggcagugggaaggguggguuggagguuucugagcaccagaaaacuuugagcauuguuccggaagaggcaagcggcaggcaucugcaccagagacacugccggguccgagugagggcaggaggcugcacgagggagccucccugggagugagcgauagguucgcuaugggagguggguucgaaaggugccugagauuuucauuugaaacucuguugaagaggaauuggcaauagaggaggaaauacaaauagaggaaagauugguuucgucuuaagcacugaggcuguugggcagcuaguggaaagugcugcuggagagaagcuggagaucacugaagcugagagagggguuuguggauauaauuagagcaguguuucuagggaggugcaggugaagggacugagagagagaugagguuaaaaacacagaagagaaagagauggagguguggaggccccugagguggagcagcugcagaggcaggccugggggccaggaggcuggcucuccacuuucagcuguuggugagaagggagugaaggcugagcagcucccauugugcagcuguugagugcacaggugcucgugcucuugcacacggugggguuuggggagggugugaugcuacagggaggacuuucaugaugcagcugauucucuuuuauugagagucuguuucuggagucaccugcucuguuuugaauccuggcuuugccacugugaccuuggacaaguuguuuagccucagugccuucguuucugcaucuguaaaagggguauaauaacgccucccucaucaaacuguuguaggauuaauuggguuaacauauugagaggugacagcgugcuggcaguccucagagcccuugcuugcucucggcaccuccccugccugggcucccacuuugguggcauuugaggagcccuucagucccccacugcacugugggagccccuuucugggcuggccaaggccggagcccacucccucagcuugcagggagguguggagggagagacacgagcaggaaccggggcugugugcggcacuugcgggccagcuggaguuccgggugggcgugggcuuggugggccccacacucggagcagccagccagcccugcuggccccgggcaaugggggacuuagcacccgggccaguggcugcagaggguguacuggguccccccagcagugccggcccaccggcgcugcgcucgauuucucgcugggccuuggcugccuucccacggggcagggcucgggaccugcagcccgccaugccagagccucccacccccuccguggccuccugugcagccugagccuccccgacgagcgccacccccugcuccacggcgcccagucccaucgaccacccaagggcugaggaaugcaggcgcacggcgcaggacuggcaggcagcuccaccugcagccccggugcgggauccacuaggugaagccagcugggcuucugagucugguggggacguggagagucuuuauaucuagcucagggauuguaaauacaccaaucagcacccuguguuuagcucaagguuugugagugcaccaaucaacacucuguaucuagcugcucuggugaggacguggagaaccuuuaugucuagcucaaggauuguaaauacaccaaucagcacccuguguuuagcucaagguuugugagugcaccaaucgacacucuagcugcucuggugaggacguggagaaccuuuaugucuagcucaaggauuguaaauacaccaaucggcacucuguaucuagcucaagguuuguaaacacaccaaucagcacccuguguuuagcucaagguuugugagugcaccagucgacacucuguaucuagcugcucugguggggccuuggagaaccuguguguggaaacucuguaucuaacuaaucugauggggacguggagaaccuuuguaucuagcucagggauuauaaacgcaccaaucagcacccugacaaaacaggccacucggcucuaccaaucagcaggauguggguggggccagauaaaagaauaaaagcaggcugcccaagccagcauuagcaacccgcccggguccucuuccaugcuguggaagcguuguucuuucgcucuuugcaauaaaucuugcuacugcucacucuuuggguccacacugcuuuuaugagcuguaacacucaccgcgaagaucugcagcuucacuccugagcccagcgagaccacgagcccacugggaggaacgaacaacuccagacgcgcugccuuaagagcuguaacacucaccgcgaaggucugcagcuucacuccugagccagcgagaucacgaacccaccagaaggaagaaacuccgaaaacaucugaacaucagaagggacagauuccagacgcgccaccuuaagagcuguaacgcucaccgccaggguccgcggcuucauucuugaagucagugagaccaagaacccaccaauuccggacacaaugugaagagcauuuaaaauagugccuaagccuaggacaccgccagugcuuuguaagucuuuggguccugcuggcuuagguugcuucuuucggcaggaugacuuuuuuuuugagaccaguuuucacuuuguuguccaggcuggagugcagaggugcuaucucagcucacugcagccucaaccuccuggguucaagcugaucuucccagcucagccuccggaguagcugggacuaugggcaugugccacuaggcucggcuaauuuuuggcuguuguuguuuuuguuuguuuuguuuuuuuguuuguuuuuugagacaguuuagcucuuguugcccaggcuggaguguaauggcacaaucuuggcucaccacaaccuccgccucucggguucaagcaauucucuugccucagccuccuaaguagcugggauuacaggcaugcaccccccacaccuggcuaauuuuguauuuucaguagagacaggguuucuccaugucggucaggcuggucucgaacuccugaccucaggugauucaccugccucagccucccaaagugcugggauuacaggugugagccaccgugcccggccuguuguuguuguuguuuuuaagagacaggguuucacuguguugcccaggcuggucucaaacuccugggcucaagcgacccaccugccuuggcuucccaaagugcugggauuauaggcgugagccaccacuuccagccaggaugacuuuuuuuuuuuuuuuuuuuuuuuuuuuggucuucucugcugugucucuagaagaugaccuuuugagaagcaaaccugaauguugauucaagcccaaauuuccugggcucagguguuaauuuuuuaagucuuuggaaccucuuugccgaggucucaagcagguagaagacauuaauaauaauuccuuauauuugauugcguggugcucuguaguuuacugaguacuuacuauauauguacagauaggcccuuauuugaucuucacaggaaccugugagguaggcagagcuuaugagcuucauuucccagguaggaaaacuccuacgugguuacguaaccugcuccaggugugaucccaggugcaauccagcucaacaagcacacugagccucaggagcucuugggaucagaacccaggacucgaucccacuccgugccgccuucucacccaccccucuuccaccaaguggguggaaauagcacuugcuuugaaauaaguaacgaaugaucuuugugaaaaggaaccuaaacagcagugggccaucuuuauucacaucuauaguaccaagugcugaguaaggggauuuuagacuccagacacccguccuguuugucaggccagagcugcaguguguugacugcacaucugucucuugucacuccugcuccuguggguaaccagccagagugccccugaggcagagacaggccaaucccuggagaguucugcgaggucuagggaagaguucuuuguauuuaaaauuucaugugaacuucagcaguuuccucugccucuguagucagcuuuugccuuuucaaacuuuaguuagauggauaaugacuuuuacucauuaggacuuuuuuccauuaguuggaaacccagaguugcaauacguuucuuuuuuccuuagaaucaccggguuuaugggaauaacaauugggauucucuuuauauaaaaauagugguggaaucuuggcacaggguucauauguggcuuuguugaaggcuuguugucacuuccuuauuuguauaauuucccuccuuuguggccuaaacaugacuuucaaagagucaagaggaguuaaguccuaauuuuuauuuuagaacaucugaaaaaugaauucagagaaaagugauauugaugccuuggauuuccccacacauacaaaucccaaucuccugcugacuuuuucucauguuuuugggcuucagggacuguugugggauuuguauuuugauacugaaggaccaacacagacugacuuagcuucuugccugugugcaggucaugugccacugucacuggagagaauuucauguugugacuucuguucagauuuguuuuuuuuuuauggcuuucccaucaggguucuugggagccauggcugcuucuugauaucuucuguuucccuguagaacagacgauugcaggcccggggcccuggcaagcugggcccucuguggcuuucugaguccauugugaggcagaggaucaggugcguuuugggcagcagccuucagagcaaggcacugaccugaugauucacacugaccccuccccuccgcugaauuuucugacaaccuugugacucucacaugggaaaugugagugguuuuugagaaaucuuuacauaagagguuuuaaaauuuucuuuugagauugccucgguguuuuuccuuaaaguuagcacauucuuugcuuucuacuucagccucaaggacaggaaguucauucucgcucuuuacauugggguguugauguuugugguuuuguuguuuuguucuucauguuacucaugauguauugauauuaauuaaccuaaauacauauggaaauauucuuucauuacuuagagcuuauauaguuccuggugcagaugugcaaaaauagugcuuuaguaauugcuaagucacuaucuugcuuuucucucuacugugauugaguauuucuuacauggaacuauagcuuccucuuaucaacaaauaagcaggaaauagaaauuauguaaauaagcaauuuccauuaccuacuucacugacuugacaaauaggcauuuggucugcuuuaauuaauauuuuucaaaauguuaagugccuguugcuguuacuuaauuuugcagguagcauuggaaguuucugugauuguacuugagugggcacuucuuguugaaauuuaccauugagacccugguaacacugaaguuuguguugacuuucuguagguguuuucacaguccuguguuugguauggagaguguggaauugcauauggggacaagagguacaauugcgaauauucuggcccaccaaaaccauugccaaaggauggauaugacuuagugcagguaaguucauuaucuuaggcacugggaacacaaaaugcugaucacaagauccucuguaauuauuccuuaaauguuauugcaggguggagguggagaugagacuaacaggcuuaagucuuaucccggacucucaaacucuaaccuguggcauacagugcagagaaagaacaccguaacuccaaaggcuuaauuuuucaggggcugacuuuauaccucucauaaaguuucccaauagcagguugcuauuuagagacugaccuugguacuucguauguugcccuugcagcaucugcaaaauauauuagaaguuagcugguuuugauuccuagauuucaggacucaaauggacucuguugcuaaguggcuuugacguccuuguccccuggucauuucaguguuuucucuguguuccacugagagccugugaauuuuggcugcuaccaggauucugauuccuguucuuuuuuuaccauccugugauacacagggauauuagaacuggaaaaaucaugugaaaagccugguuuuagaggcuuaaaguaaucaaaagucaagucgacaugauaacagaguuccuaggcucacuuguucguuucuuuucuguuuuugagacagaaggagccuugcucuuuuauccuggcugaaggcuagagugcaguggcacaaucacggcucacuguguccucgaccuccugagcucaagcaaucucucaacucagcgucccaaguagcugggacuacaggcacaugccacaaccccuggcuaauuuuuuaaaaauuuggggagauggggcuucaccauguugccuagccuggucucaaacuccuaggcucaagcaauccacccuccucagccuuccuaaguacugggaguacaggcaugagccacaguaccuguccucacuugcugcuuucaucauaauuauuaaagguuucaacuuucccuggaauuacuaauagaaauaguaaguagcacucugguugaauugaaucaaacaaacaaaaaacccuaagaagacauaaaaugauugucaggagaggagagaaagcuuccaaauaaaaagaaaauuagaaacaucucuacuugugaauaaauaguaaauguguagccuuuuaaaauaauucuauaauaacuuugcaaauacaggaugugucuuacccuuuuguacuucaaaaggauuacaugaaugaaugugucuuaguucacugaggaauguugaccuuacucuaacuguugccuacucccgugucugugcucuuucaccugaaaggaacucuguccaggauucuucuuuggcaaugucagucucuguugugauguucggcagcuucagacacuaaaagacaaccugcagcugccucuacaguuucuguccagguagguucugcuggggaaacagaacaacugggcuguagauacuugugaacugguaaugcucagcuuuccauuuauucuuuguuuacauauuuuuauuuauuauaugucuauauuauauguauauuauauauuuauacauauauguauacauguaaaguaggugaauauauauuuauguauuaaaaauacauguauguauaauguguaugcaugcguguguguauaauagagacagagucucacucugcugcccaggcuagagugcagugguuuguggugugaucacagcucacugcagcuuaaacuuccuaggcuccagugauuguucuaccuuagccuccugaguagcuaggacuacaggcaugcacuaccaugucuagcuaauuuuauuuauguuuuucuuuauuuuuuuuuuuuuuugagacagacucuugcucugucaccgaggcuggaguacaguggcaugaucucagcuuacugcaaccuccucccggguucaagcgauucuccugccucagccuccccaguagcugggacugcaggcacaugccaccacaccuagcuaaguuuuauauuuuuaguagaggugggguuucaccauguuggccaggcuggucucaaacuccugaccucaagucaucuacccgccucagccugguuauuacaggcugggauuacaggcaugagccacugcaccuagccuaauuuuuauuuuuuucuagagaugagggucucacuauguuggccaggccuggucucaaaugauccucccaccuuagccucccagagugcuggauuauaggugugaaccacaguucccagccaguuuuuuuuuuuuuuuaaagucaguuuuuguuuuguuuuaagaaagcacucuuacaauuugucagaaauaaagagaaaaacaauaauuaccagacuugguucacuucccaguugcauucagaguugaugcuugguuuccucugcgauguucucacccugcagggugucugcacugcggccaggcuccuuucaaacuugagcugugcacuguggggaagagagguuccuagggguccugcucaggugccuggccugagacucucaucaugcaguccuuccucuccccccaugcuuugcuuugcacaucauucuugucccucccucuggugaaggguugugauagagucagguccucaguagagccggccucggggagcuguuaaaaauuuuguucugcuguagcuggcugguuuugucaaacuuaguuuuuuaucuguucuguuggcuaugacccugagcagugaaaaagggcuugguaauagauguucuucucuaggccuagccagcaauucucaaauaugcaaaagagcaagcugguaguggucuuuagaacagcagauugugguaucuuucuaaauuuuucagacuucagcacacugauaaagauguuugggaagcaaauauuaaaaagggaaaaugcuucucugcacaaauaucacugcagguggugauagggcacaaguuggcuuccagugaagaaauucugcuucuuaccaaaaguuaacaauagagaauggaaaaccaccacuaaauuguuuuuucagaacaacaaaaguugaggcuguaauugggccagcauauccuaugaaaggcuugugaacauugauggaaccaaauuggagccuuguacacucagucaaaacacauuuauuuaggauccaccguaggugaggcauuauggacauacggacauaaacauaaaaagauagccaaccuuucuccauauuaucagagguaccaaagcuugauuuauaauagcaaacaggagaaacaaccugauauuuggaaaaauauacagcugucaaaauuagugauugugggcauuaaauguaguaacauggaaaagguuugaaaacuguguaccccaagagugauuccuauuagaauaauacaauugugguuucuggcuuuguugcaguaaagcaguggggcuccugaaagaaagagagucugugcuucucugucuccuucacuagaacagagacucuugaaggccaggacacacuuuuuucauucuuugucuuacauggucacugggacugaaucggagucuaaaguaaucuugauugcaagaaugcaagucuaaugaaacagcuuuugcaaguaacaguggaccaaagggaaaagagagcucuuuuaucauguaacaagucaacauuaggagcuuaaacuuugaaccugaaggauagcaggcagcuuaugguucuugugcaguugugugcuccugaagugcaugcagccagagaacaacauugcuguucucuaucuuuacaaaccauggggauuucuccuuguguuucaggagggccuagugauuuuccggggcuugaaagaaaaccuuucaauagguuauaagaugaagauucucauaauucucauuauuuuauuuucuucuuaaucaaaacugucagcuggugcagcgcucaugucgauaaucccagcacuuuggaaggccaaggcaggaggguugcuugaguuuaggaguuugagaccauccugggcaacacagacccacaucucuacaaaaacauuuuaaaaauuagccaggugugguggugugcaccuguaguccuagcuacuugggaggcugaggugggaggauugcuugagccuaggagcucaagguuacagugagcugugaucacaccacugcacucagccugggcgacaaagugagacccuuucucaaaaaauaauaauaauugucuuccugaugcuccaaagucccuuuacucuaggucagagaauguaugucucuaaauuauaaagugcagaauucagagaagcaucucucucuuuuugaaauuauaauuggacacaauaaaugcagaaaguaauuagggcauuuuuuaaaggugugccuuuauuuuaacaugaaguuuuaaguuuagaauugcugguuuuuaauauguucucuugguaauuugucacuuuacaguaaguuuaaaauauucuuugucuauuuaaaaucguucuugcuggcccuauuaugugugagaucaugcagaauauaauuuacuuuuccuuuagauguccauccuguuuuuauaaccuacugaaccuguuuugugagcugacauguagcccucgacagagucaguuuuugaauguuacagcuacugaagauuauguugauccuguuacaaaccagacgaaaacaaaugugaaagaguuacaauacuacgucggacagaguuuugccaaugguaaguaaacuuuuaauuauuccucuuuuacagcuggcaucaggacagcagagcaaauuguuccuuuuaguuguccugucaacucuggaaaaucacaauuuucaguuccauuggccaggaaauaagaguuguugcuuugcuuguauccuaggacuugaacugcaacgaauauaaaaaucuccuuaaagcgcuugcuuuaacucccccuaacuuuaacuucccacauggaaaauuuuaguaugugcaaguuugcauccauacacuucaguaaccauuggaucuuugacucuaacagacaugaguuguguaaugucauaaauuacugcaagacugagaagauagaacuguuaauaguuggcagagaagaggucaugacuugcaagaaucagaucaccauaaaggaaagucagcaggucuaacagauagcagaaaugaucccccagcauugaccaacauacaacauuuaauuauaaugacaaaguaaaaagguaacaaaaaaauuccauagaaaaaaggucucauucacaaaagcaacaaaaaauaaggcacuuaggaauccaaaagaugugacauacaaggcaaccugacugaauggagagaggucauuuuguccagaaacagaagccugcauguauggaaaguggauguguaacacgugugucauuacaaaucauugagagaaaaggugggcuaguugauaaaugagaugagaaaauagauuauauuuaucuaauuuuaauuuuuacagaaaauaaaaaaaucaauuguguagauuaaaaaucccaauuggaaaguuuuagaaguaaauauggaaagauuucuagacaggagaggaaaagcagaaaccauaagaaaaauauuuaugaauauaaacaacuguuaucuagagcagacagcgaaaugcaaauuugaacaguaaacuaccauuucacaccucaucagcuuggcacaaauuaaaaaguuggucaauuucaacugugggugaaaaugugaagcaauaggaauacuaauguacuccaccacuuacaaccauaauuugguacaaucguuucaaaacuacuugaaaaacaacuuugcaguacguaguaaguugaagcuaacccuccucccagaaauuucacuuauagaugccugccuuagagaaacucuaaaugcauauaaaccuggagacccauauaagaacacccacuguaacacuauugugauugugaaaaauugaagaccucaagaacgagaagacaagacacagacugggagaaaguauuugcaaaagacauguuaguaaggacuguuauucaaaauauacaaauaacuccuaaaacucaauaagaaagcaaacagcccaauugaaaaauggacaaaacaaccugaacagauaccucaccaaagaaggcauacagugguaaauaaguacaugagaagagaugcucaacauuaugucauuagagaauuacaaauuaaaacaacgagauaccacuacacaucuauuagaauggcaaaaauucaagacgcuuucaacaccaaaugcuggcaaugagcucucauucauugauggugggaguacaaaacgguacagccaccuuggaagauaauuuagcgguuucuuacaaaacuaaucauacuccuugguauuuacccaaaugaguuaaaaaugugucuaccccaaaaccugcacguggauauuuguagcagcuuuguccauaagugccaaaacuuguaagccaccaagauuucucucaguaggugaauggguaaauaaacugcuacauccacacaguggaauauuauuuggugcuaaaaagccaugaaaauucagugcuaucaagccaugaaaguacauggaugaaccuuaaauccuauuacuaagcaaagccaaucugaaaagacuacucacuaugauuccacuauaugacguucuacaaaaggcaaaaccguggagacaguaaaaagucagugauugccauggguuaggagagaggaaggcauaaguagagcacagaagauuuuuagguggugaaaauacucuauaugauacuauaauggugguuacauguuuauaugacauuuugaaacaaaaguacuacauacuuaaaacaaguacacaaacaugcaugggaaggauaaacaucaaauucaggauuguguuuaccuuagggaaggggcuacugucagggagggguaauuggggagcuucaacugaaucuauagaguguguguguguguguaaguauuuuauuuuuuggaagagacgggccucacuguguuggugaggcuggucuugaacuccuggccuuaagugauccuccugccucggccugccaaaguguugggacuguaggugugagccaccacaccuggccuauagugcauuauuauuuuuauuuaguuuuuaaauuaugccauagccaguuguucugaauagugcaguacuacaaaacagagucaaggucucaugcugucacccaggcuggaauacagugaugcaaucauggcucacugcagccucaaccuccuagguucaaguagucccccuggguaguuggaaccacaggcauaugcuaccacaccuagcuaauuaaaaacaaauuuuuuuuuguagagauagggucuugcuuuuuugcccaggcuggccucaaacuccuggccucaggagaucuucccacagugcugggauuacaggugugagucacugcaccuggccgaguccauuauuuuuuuaauguugaggcaaauguugugaaaugguaugacugauaguuaacuggguaaugaggaaaugagaauuguauuauucuccauguguuuuguaugcuugaaacauaaaauaaaaccugaaaaccaaauggugagcuggaagauacgagggaauuacucagaaaacagcauacagauacaaagaccuauaaaucauuaaagaaaugacauauaacaugagaagcuccagagaguuggggagagacaauaauaaucaaagggauaaugaggauuuuccagaguggauaagggaugaacccugagaacuuagagaaaauucagcauacaaaaaucaguuguauuucuguacacuugcaauggacaaucucaaagugaaaauaaaacaauuccauuuacuuuaguaugggaaauacuuaggaguaacuauaacagaaggcaaaacacuuuaaagaacagccgggugcaguggcucacaccuguaauccaagcacuuuggaaggccgaggcaggcagaucacaaggucaagagauugagaucauccuggccaacauggugaaaccccaucucuacuaaaaauauaaaaauuagcugggcgugguggcgcucgcuuguaaugccagcuacuugggaggcugaggcaugagaaucacuugaaccugggacgcggugguugcaggagcugaaauugugccacugcacuccagccuggcugacagagcgagacuccaucucaaaaaaagaaaaacagaaaaaacacacuaaagaacauuauucagcgaaauuaacgaggaucuaaauaaauggaaagacauuccauguuuaucaaucaaaagacuuaauauuguuuagauaucaguauucuccaaauuguuuuauagauucagggcaaucucuguuauaaucccaacugacuucuuuguggaaauugacaagcugauucugaaauucacauagaaguuugagggacuuagaauaguaaaacaacccugaaaaaagaacaaaauaggaagacucacacuucucaguuucaaaacuaagcaauggaaaucaagacagugguacuggaauaaagauagacauauagaucaauggaauauaacugagaauaaauaauauaucuauggucaacugauuuuugacaagggugccagggccauucaaugagaaaagaauacucuucaucaaauggugcugcaauaacuggauacacacaugcaaaaauaaauaaauaauaaugaaauugggcccuacuucacaccauauguuaaagaaauuaacucaaaguggaucgaagaccuaaauguaagagcuaaaaacuauaaaacaauaaaacauagggauuaauuugcauggccucauauuuggcacuugauucuuaaauaugacaccaaaaacaagagcaauaacagaagaaaagauuaauuggacuucauuaaaauaaaaaaguuuguauuucagaggacgccaucaagaaaagacaagaaggccgggcacagugacucacaccuguuaucccagcaguucggguggcugaggcaggaggauugcuugagcccgggaguucaagaccagccugggugacaaagugagacccugugucuacaaaaaauaauuagccaggcaugguggcauguaccuguggucccagccacaugguuaucugaggcaggaagauugcuugagccuaaggaggcugcacuaaguaccucgcacuccagccugggugacagagugagacucugucucaaaaaaaaggacaagaauauauuugcaaauuguauauuugauaagggacuuguaucuagaauacauaaagaacucuuggccgggcgcuguggcucaugccuguaaucccagcacuuuggggggccaaggcggguggaucaccugaggucaggaguucgagaccagccuggccaacauggugaaacccugucucuacuaaaauagaaaaauuagccagguguggugaugugcgccuguaaucccagcuacucaggaggcugaggcaggagaauugcuucagccugggaaguggagguugcagugagcugagaucacaccauuggacuccagccugagggacagagacuccaucuccaaaaaaaaaaaaaaaaaacucuuacuacucaaugauaaauaaauaacccaauuuaaaauggcaaaagaucugaauagaguagacauuucucuaaggaagauauacaaaugaccaacaagcacaugagagaugcucaauacuaugagucaucagggaaauacaaaucaaaaccacaaugagauaccacuucacacccaccaggauggcuagaaucaaagucacauaacaagaaguguugacaaggcuguggaaaauaggaaccuuuauuaaaaagaaauccaaaaaccaaaaacagcugggcacaguggcucaugccuauaauccagcacuucggacggccaaggcagguggaucaccuuagcucaggaguuugagaccagccugggcagcauggugaaacuccaucucuacaaaaacuuagcuggguaugguggugcacaucuguagucccagcuacuugagaggcugaagugggaggaucacuugagccugaggggcagagguugccagugagcugagaucacaccacugcacuccaaucugugugacagagugagaccccacuuuggaaaacaguuuggcaguuccugaaacaaacauagaacuaccauaugacccaucaguuccacucacaagacgaaaguauaggucaacacaaaaacuuauacacaaaugcuucuagcagcauuacugauaauagccaaacuguggaaacaacucagauauuuaucaccugauauauggauaaacaaaacauauguccuugcaaugaaauguuguucggccguaaaaagaaaugaaguauugauacaugccacaauaugcaugaaccuugagaacauuaugcuaaaugaaagaagccggucaugaaagaccacauauuauaugauuggauuuaugugaacugucugaaauagucagauaaauagagacaguucagugguugcuuagggcuuagggaaguagggagguaguugugcauagcuagaauacaggauuucuuuugaggugaugaaaauguuauaaaauugacuauggugauaguugcauauaucuaugaauaugcuaaacuccauuaaauuauauaguuuaaggggguaaauuguaaauuacauguaauuauauuguaaauuauauagcgccaccacaccuggcuaauuuuuuuuuauuuuuuuauuuuuuguagagacgggguuuugccauauugcccaggcuggucuggaccuccugagcucuggcaguccacccaccagggccucccaaauuacugggauuaaaggugugcauaaccaccccuggcccaaagacaaauaucuuaaaagcaaauagagacaagacacaaaucaccuuaagacaaugauaauuggagauuuucuuaccagccaugauagagccuggaaggcaauggaauaaucuguugagaauucugagggagaugacugucacccuaguuaaccugucuuuccagaacaaggguaaaacaaaaugaauguguaagcaucuccuugaagauuagggaaagaagauccugggaaguuucuagcaagcagagacugguaaaugagaaucgacaguacaggacccauuccagcuauuuucuuagguguaauacacugauacuauccuuauauaauguguuguguguauguguaagaaaauaaaauccaaaaagauaacaguauuagggguuuuuuuuguuuuuuuuuuuuguuuuuuugugauggagucuugcucugucacccacgcuggagugcaguggcgcaaucuuggcucacuucaagcucugccucccggguucaugccauucucccgccucagccucccgaguagcugggacuacaggcguccgccaccacgcccggcuaauuuuuuguauuuucaguagagaugggguuucacuguguuagccagguuggucuccaucuccugaccuggugguccgcccaccucggccucccagagugcuggaauuacaggugugagccaccgugcccggccaacaguauuagguuuauugacacgugaccucugcucuaaaaccaguuuuccaaguaaguuccauaauucucuggcuguguagcuuccugcggcagagguuuucuggaaccagcuuuguuaacugaagaaguacugaggcucuuagcugcgucuuccugggccuugguauacucuucuauauaguggggauuugacuucuccaagcuguugugagagcuaugagauaacgugugccuuucccuuuccugucuguuuuuuacuuuuaaguuacuuggaaucgggccuccauauuauuugcagggugauaagccaauuuaaagggaaucucuguucgugcccuuaguuaguguuugcuguccagcauuccagcauggugcauauggaguucguguuucccuucaagaggccuuuuguaagaucuugccucgugaauuacagcaagcaucuugucuccuuuuuccuuuggguuuccucuucuagcaauguacaaugccugccgggauguggaggcccccucaaguaaugacaaggcccugggacuccugugugggaaggacgcugacgccuguaaugccaccaacuggauugaauacauguucaauaaggacaauggacaggcaccuuuuaccaucacuccuguguuuucagguagguauaaagauuccaaguuugguguguuuaugauauuguuuuaaagccaaggaacuggcugggcacaguggcucaccagugcuuggggagacugaggcaagagaauugcuuaagaccaggaguuccagaccagccugggcaauguagugaggccccaucucuaugaaagaauuaaacauuagccaggugugguggcaugcaucuguagucccagcuacuugggaggcugaggcaggaggauugcguggguccaggaguucaaggcugcagugaguuacgaucaucccauuguacuccaaccuuggugagggcaaagcccugucucuccaugaaugaaugaaugaaucuuaguugaggaagcauaaucuacaauaggaagauaaacacauucagguaacuaguucauaguuucucccaguaagagagguaacugguacauuuauccugcuguggcuaauuuagggggugcugggagugggaauggaggaggaaaugaauugccuucaggcauugcugucauaauugaaagaauaagcaguuaaaaagggggugggaggcagcuuuucuagagcucugcuauaguauuagcuccugagaauggagaugggacaugauugaaggguugccuugguaugugguguacuuggaggauuccucuaucagugacaaaccccuacgcgcaaguuuauugagguaacuuaaaauuccauaggacgaagcagcaaaacauaauuuaauuaaacuaaaaccuccaauucuuuuucuucuuucaguuguuuuauguauuucagugggcuuuucuuugaguuuaaguauaauacaaaauuuuggauguuuuuaauugagauuuguacucaacacaauuccuuucuguagauuuuccaguccaugggauggagcccaugaacaaugccaccaaaggcugugacgagucuguggaugaggucacagcaccauguagcugccaagacugcucuauugucuguggccccaagccccagcccccaccuccuccugcucccuggacgauccuuggcuuggacgccauguaugucaucauguggaucaccuacauggcguuuuugcuuguguuuuuuggagcauuuuuugcaguguggugcuacagguaagcaguuuuguuugucauccagggcaaaaagagcaaaauugcccacuggcacuuugagcuuucauuugucagagcuugguuacuuaggacaagaaacaaauaccuccaugaauaccauugcauggauuauuguguccuacagcuauucuauaguaaaccaucaaaguucuguuuaacacugcaacaucugaaaugaauuuuacugauuuauucaaaaugaugugugauuuaaagcacugugcauuagccacugauucuuuuuuuuuuuggagacugagucucacucuugucgcccaggcugaagugcaguggugugaucucagcucacugcaaccuccaccucccagguuuaagcaauuccccugcaucagccuccugaguagcugggauuacaggcauccgccaccaugccugcaugccugacuaauuuuuguauuuuuaguagagacgggguuucaccguguuggccaggcugaucuccaacuccugaccucaggugaucugcccgccuuggccucccagagugcugggauuacaggaguaagccaccgugcccagccggccacucauucuuuagaaagucagagucaaggccaggcucaguggcucacaccuguaaucccagcacuuuaggaggccaaggcaggagaaucaugaggucaggaguccauugcaaacagcccuggcgacagugcgagacugugucucaccaaaaaaaaaaaaaaaaaaaaaaaagucagagucaaaugagcgaaaucagauucaaaucuaauuaaauggaguacuauaguccuuuuagauauuugcaucuuaauuuaggacaguacuuuuuuuacuuuuuauuuugaaauaauuguagacuuaaccaaaaaguugcaaaaugguagaauuuauguguauccuuaacccaguuuccccgaugauacaacuuacauaacucauaguacaucuagaacuagaaauaccauuugacccagccaucccauuacuggguauauacccaaaggauuauaaaucaugcugcuauaaagacacaugcacacguauguuuauagcggcacuauucacaauagcaaagacuuggaaccaaccuaaauguccaacaacgauagacuggauuaagaaaauguggcacauacacaccauggaauacucugcagccauaaaaaaugaugaguucauguccuuuguagggacuuggaugaaacuggaaaccaucauucucagcaaaauaucgcaaggacaaaaaaccaaacaccgcauguucucacucauaggugggaauugaacaaugagaacacauggacacaggaaggggaacgucacacaccggggacuguuguggggugggggccugggggagggauagcauuaggagauauaccuaaugcuaaaugacgaguuaauggguacaacacaucaacauggcacacguacacauacguaacaaaccugcacguugugcacaugcacccuaaaacuuaaaguauaauaauaauuaaaaaaaaaacucauaguacaaugaucaaaaccacgaccaugccauuauuauuacauuauuauuagcuaaaccagagaucuuaaucagauuucaccagcuuuuucucuaaugcccuucccuguuucaaggucccauauuacauuuuuguguuuuaugaguccccucuaaucugugacagaaaguuccucagucuuuccuuuucuggccuuaacacucuugaugauacuggucagguauuuuguagcauguccuuccauuuggcuuuaucugguauuuucucaugaugagauugaaauaagguguuuugacaaguacaucacagaagucauguuaugucuuucucggugcaucaugucagggaucccugauguugaugcgucucuuuccuggugauguuaaccuugaucacuugcucaaggugaugucugcuggcuaucuccacugugaaguuacugcuuuucccuucguaauugauaaauaucuugggggaagaugcuuugagacuauacuaauauuuuguuccuccugaaacucaaccacugauuuuagcauucauuguugggucuugucugcaacaguuauaacuaagguguuugccugauagugauuuuuuucucuuucccucucuuccucugcauuuacuaacuggacuucuguacagaaagcuaucccuucucccucauuuauuuacucaguuauuuacaucauggacuuuuaauucuguggguuguauccaacacugucauuuaucuuguuacucaaaguuuuccacuuugggccauugggagugccuucuggcuggcuucuguguucuuacauacaccucccauccccagcuuuaucuuacauauucccugucccugcccugcaaggagcucugguuccuuuuauuggagaaugguauguagaaacgaagaucugggcacuagguaugcucauugcugcuggaaagaguagcauguuuuuguuuguuuguuuguuuuuuugagauggagucuugcucugucaccaggcuggaaugcaguggcgcgaucucagcucacugcaaccaccgccucccugguucaagcaguucuccugccucagccucccaaggcacgugccaccacacccagcuaaccuuuuuguauuuuuaguagagacaggguuucaccauguuggccagguuggucucgaucucuugaccucgugaucccgcccaccuuggccucccaaagugcuggguuuacaggcgugagccaccgcgccuagcccaguaguguguuuuuaaaggaccuaaaaguuuuaaauaaaaugagggccacaaggugaaauuauccuuuauuaauuguucucuuaacaucuucuuaaauuuucuccugagacuggugagcagagggacccagagcaaggggacuuaggggaaagaaggcaguaauuagggaggaggaggccaggaggaggaagaaagcauuucaugggauuacaggaaugucccaaaaacaaccucacugugaugaaguccacuaaugcuauuucuucacuucuguuuuucagaaaacgguauuuugucuccgaguacacucccaucgauagcaauauagcuuuuucuguuaaugcaagugacaaagguaggcauauuuguccaugaauaaaaggguucagaugaugcugucugucaugagagcauucguuuccucagugggguugcagcagugggugagguggugugccagugccgaggacacggcugcgaccaaggcagacaugguccuugccuuuguggcccuaccaucuagucaggguggcacagcagaaccaaguaauuaaucauagcuggggaggcgcgaaagcagcaggacaagagugggaauagcagggcaggguugaaccucacccuucagaggcuccugugucggcaucuccucuguggggugggaauagcgcucauugagggcagccaacaaagguggcuuugcugagcagauagguagcugagggcaggggucucauauguguccccaggugggcuugauuccugccaugagauagcaacuaaugcuuucccuguuccgacuuucaggaacggcuuggcucuuaaccuccaccuucccuuccucucccguucuuccaggagaggcguccugcugugacccugucagcgcagcauuugagggcugcuugaggcggcuguucacacgcugggggucuuucugcguccgaaacccuggcugugucauuuucuucucgcuggucuucauuacugcguguucgucaggccugguguuuguccgggucacaaccaauccaguugaccucuggucagcccccagcagccaggcucgccuggaaaaagaguacuuugaccagcacuuugggccuuucuuccggacggagcagcucaucauccgggccccucucacugacaaacacauuuaccagccauacccuucgggagcugauguacccuuuggaccuccgcuugacauacagauacugcaccagguaaccugcuguuugaagaaauaagucacucuagaugaccuugugguuugcuggcuuuuacauguugacuacugcuagauggggauuuggggcugaaugucaugguauaucuugaaaaucuuagcguauaauggcaaagcugccuuuaaguuagguuucaagaaagugaaugauguugaacuuaauggaauauuuauuguugcucacuuuuguauuuacuucagauaguagaccuugccuuuuucuugaaauugagaugagcagagaaagaagacuucaguggcguuucucuauugaggcaggauauauuuauuaggaagucaccuuaggaauuugugaaauguuuucuguugguaacugaaaguaauaugcaaggacccagaggcaugaagcccuuacugcuguccugggggcugaggaaggagcugccagauuaccaucccugauccaaccuguaggaaugaacuuaucacucacugccugaacaugggcacccagccuguuuuuggugagaggcgcauuuggggcaagauccaucccauugcuccuagaaaggcauguaaaccuucccauugucccugucacacuugccuuggagaacuguaccugugcauaaacuguaccggcuucuuuuuuaaugaauguauaaucacaugguuuuuccuuuaaacauugcucaugucuacaagaaagucugcaaucuugaaaagcauuaaaauggucccaagacuugaaucuuuucucuacccagugacugucuguugcuuuuuccagcuuguugcugaaggugaacagcauagucauuuaccuccaagaucaucuucucuguuaggaaauaaggggacauauauaaauggcuguagugcagagcaaggcaggagguuauguguuacuauugagaggagggucagggagaccaggagucccccuccacucuccccucuggccugcuggccaccacuggagaacgguggaggggagaugguuguguguccuauguugauagcuguucuggucaugguguucccccuaccccucgccgccucuguggacgccucuaacuaguuugcuguuagagugggccuguggccugaccaguuuucuuacuguauugcaucuuaauucucucccucaucuuaggaaguauuuuccccaaauacucuuugucuucugacccucagggcaaugcugauuaaucaagaucugagagaaaugugacguguuucuggguuugcuuauuuuuaaaaucuucuuucagguucuugacuuacaaauagccaucgaaaacauuacugccucuuaugacaaugagacugugacacuucaagacaucugcuuggccccucuuucaccguauaacacgaacugcaccauuuugaguguguuaaauuacuuccagaacagccauuccgugcuggaccacaagaaaggggacgacuucuuuguguaugccgauuaccacacgcacuuucuguacugcguacgguaaguggcaagagacaaucauugguagacaccauucuugggucugacuuaggguacaugggcaaaagcuuguuuuaugagcauaacccagaggugagcaaacaacaagaccuugcccugugaaguuuacaucaucuuuuuuuuuuuuuuuugagacagggucucgcucugucgcccaggcuggagugcaguggcgcaaucuuggcucacuguaaccuccggcucccaaguucaagcgauucucauaccucagccuccugaguagcuaggacuacaggugugugccaccacgcccagcuaauuuuuguauuuucaguagagaugggguuucgccauguuggccaggcuggucucaaucuccugaccucaggcgauccgcccaccucggccucccaaagugcugggauuacaggcgugagcuuccaugcccagcuggaagcuuacaucuuaauggagggagacgguugaugaacacauaacaugugcuaucgugccagcuagagauuagugcuaugaggagaaaaauaaggcuggacagaguggggggugcauugcuuaagcguggagaugugcacaaagggagaggaaaggacagcugggcacaucacagggaugagaguucccggcagaaccagcagcaagugcagagcccuggcaggaagcucucguggugugugauugaggagugcagcugccucucacccuuuaccucgugccugggucgcuaacacagugucauguaucacaccccccacaagauuuaaagauagaagagccuuuggugccuuuuguucugucucagauauauagcccaguccccuguagugccccagcuauuugggaggcagccucccucugaggaguugaggcaguauaggucugcagcuccgcagcuuuagauuggagggcccugcagcugcuucccuuaggaggcaugucuagcugggcagggugcguuuauaauugggaauagucaccccaggaagcggugcuuuggugaccuguaggggaaucuuaaggcuucucccaguaggggaagaguagcaugaugccggaugggccuacucucccugaaugcuagggaccuggccuagggacauuuguucagccaguugagcaaccacaguggcuauuucuucagcaugggaacagagaaauuauuccuuuuugccuuuaaggacacugcucagccgacuacuucucaagagcuaaggacucucacuucugguucuaaagaacuuugaccuugaguucuguuuguuuguuacuggaguaagacuuuuuaugcaguugggcuauauuuacucuguuucaagaauaucaccccuaaaaacaugaguuauacucaugaaaacacaauagcuuaugcuccauacccuaaaccggcauucuccacaggguagacggugcagacgagccauggguaauuugaagaaacaaaaaacauuuaauguuacauaauuuuuauaauuggacaaccauuuaauguuacauaaauuuuauaguuuacucucuguggcacaagauaaaagucaacaaaaaugaugggggacagaggugcgugagccuuguguuuccucaaagcggacgugguucccaccaguguggaagcgguacagggaguggcaggcuccugguggcagggaccugaauugguuuguaguuaugcuugugcgcguccucauaaccccagucucgcccuagcgcuguccccuuuccucucccuccagcuuuuccuggacuuuuucaccugaggguccugcaguaauggcagguggccugcccagaaccaugcccuuaccugcuucuucuccccauuuuguuuaaaggcagugacagcuaccaguuacucaggcuugaggcuuuaucccugaauucugccucgcccucgccuuccucaugggguucuuacgggucugagccucuggaugcucucucagauuucugcuguggaugaagggacucagcugcucgcugcaggucaccugaccucccucaugccgucacccauccacucugacgggugggucauaugcagaagcuucucagcaccuggccaaguuguagcugauggucuguccgaaaaugcugguucacucuccacuggccaacugucugucugcacugcacugccaguugccucuugccugcgccauugcgcuaacaucuccacuuacuguuccaccugcuuccuguuucuuugccguuuccagaccuuccacuuugccacgcaagcuaucuuuguaaaacagcucaugacauuucuuucccggaaaucucuaauuguuccccagugccuccagaauaaaaauccaaacuacuuaacuggcacugaguccuuuuauuuugcauuugucuguccauuacucuucccagacuggcccccuccuucaggagcccccuuggugggcaccccaugcucuaggacaggacaucuuuucuuugaauuauuauuauuuuuuuuuuagagaugggaucuugcuauguuguccaggcuggacucaaacuccuggguuauagccauccuucugccucagcuuccugaguacuugagauuaggcgugccaccauacccggcauacaggacuugccaaaccaccaucuugcucucauucccucucacuguucucucucccucccuuuuuccucccacaguuguaauugugugagacacccuuuuguccucccucuuuggugaaaucccccucauccucggagcucugggucuguacagucucuuccucuuggcuauaauuuugccuuuuaguguuugcucccuccucugugccugcauagcgccaugcaccaugugccauugauggcacugggcuguauuugccugccucuugcccagugauucugagcucccaaaggugagugcugagcuguauuacucaacugagaaaccucagggcccauguuguccuuagaauacagccagccucaucaaauguucacuguguaaauguuuaggucccugaugucuugaggcccuucuaacugggagguguuuucuaaacuuuuuggcagggcuccugccucucugaaugauacaaguuugcuccaugacccuugucuggguacguuugguggaccaguguucccguggcuuguguugggaggcuaugaugguaaguaagagaagcuuugacuuuuccuuuuagauaaagucaucucgguuuugucauuagcaucaagugguaauuaugaagauuucauaaauugggcaguuuuguuaauuucuuaccucuugaaucccagaauaguaucuccuuuggcuuuggguuuggguuucauuccagauuuaaaagaaguggauuggguuagccauuuuuaggucacacaugccuuugagaagcugucgaaggcuaaguaccuuuccccagaauaaugcaauugcaaaccucugcauuguuguucagcuugaaggucaugggccuccgaaguucauuuauagacccucuagggagcucauggaccucagguaagagccucugugauagagaaaagauaguaugugagguauguggaaaaagaaacaaaguugauggauuuuuuuucuucuaagccagucaguugaguauuuggacacucuuacagugugaagagcagcugguuugcucuuuccugguuccuguagcacuuuagaaccaauuguacuugacaaaaugaggugauuauucaugugacaccuuuggcaucuuaagccaaauuacaggcucaacagguuuugcccaaccaguuaagaauccagauagguuuucuucuccucacuugguggcaggggagaaguugcaaucuguauuuaaaauuuacugugcaucagagaggaaaaugccauuucuaauuguuggagaagggauggugucagcaacugacuagccauaggggaaacaauugacuuugaucucugacuuguucauuucaccaaaauaaauuccagauggauaaaagauugaaauguaagaacugggccaggcgugguggcucacgccuguaaucccagcacuuucggaggccgaggcggguggaucacaaggucaggagaucgagaccauccuggcuaacacagugaaacccuaucucugcuaaaaauauucuuuaaaaaauuagcugggugugguggcaggugccuguggucccagcuacucgggaggcugaggcaggagaguggugugaacccgggaggcagagcuugcagugagccaagaucaagucacugcacuccagccugggcgacagagugagacuccaucucaaaaaaaaaaaaaaaaaaaagaaauguaagaacuggaagaaaauucaggaggcauuuuuaaaaauaauuuuuaaguggaaaagauauuucuaagcaagacacaaaacucagaagcccgaaaaggaaagacugaugaaguugaguacauguucauuuguggagaacaaacauacaguuaaaaaaacaaaacugggccgagaguuauucaugccuguaaucccagcaauuugggaggcagaggcgagcacaucacuugagcuaggaguuugagaccagccugagcaacauggagaaaccccgucucugcaaaaaauacaaaaauuagcugggcaugguggugcaugcuuguagucccagcuacucgggaggcugaggugggaggaucacuugagcccaggagguugaggcugcaguaagcgagauugcaccacauuccagccugggugacagagcgagaccuugccagaaaaaaaaaaaaacuggacaaaaauauuaguaugcauggcagucagcauuuucuuaauaaauaaagaucucaucucagccuggccaaaaugugaaacccugucucuacugaaaauacaaaaaaaauuagccacacgugguggugugugccuguagucccagcuacucgggagacugaggcaggagaaucacuugaauccuggagguggaguuugcagugagccaagaucauuccauugcacuccagccugggcgacaagagcaagacuccgucuuaaaaaaaaaaaaaaaaguugugaaaaaaagaucaacaaccugaaagaaaagugggugaggucaugugaaagauaacaaaagaagaaauacaaaaaaaaaagguuuuuauuuuauuuuucagagacagagucuugcucuguuguccaggcuggagugcgguggugugaucucggcucacugcaaccccugccucccagguucgagcaauucuucugccuccaccuccugaguagcugggauuacaggcauguaucaccaggcccagcuaauuucuuguauuuuuaguagagacacgguuuugccuuguugcccagacuggucuugaacuccugaccuaaggugauccacccaccuuggccucccaaagugcugggaucauaggcaugagccaccacgcccagccucaguaaauauuuucuugacuaaaguaaugaaaagggaggccaaggcaggaggauugcuugagccugagaagucaaggcuucaguaaaccaugauugugccacugcacuccagccagggcaacagagugagauccugucucuaaaaaagaagaaaaaaaggaaugaaaaauaguuaagcuucuuuggaaggcaguuugggagaauuuaucaaaauuggaaauauacauaguuuuugauucauugauuaugcuuuaagaauugauucuagccaggugcaguggcucaugccuauaaucccagcacuuugggagggcaaagcaggaggauugcuugagcccaguaguucaaguccagccugggcaacaugacaaaaucccaucucuacauaaauacaaaaauuagccagcaaugguggugcacaccuuuagucccagcuacugggaggcugaggcaggaggauuaauugaguucggguggucaaggccacaaaaagccgcgauugcaccacuguacuucagccugggcaacagaacaagacacugucccccugucaggcccccaccccaaaaaaagaaaaaagauuuauuucuacaaguauguguuuuacacauuaaaauauuuauaggcuauuuauaguaacuuuguaauagaaaaaauugcaaaacuacucaucaguugggggggauuggcuaaaguauaccagaaaauacuguaggaaaagaauaaggaaacucuuuauggagcagucuccaagauacaaaauuuuaaaauguaaugugcagaauaguauuuuacuguuugugugguuaagagggaaaggggaagaaucuguguguuugcuuguguguguguggaguggcucuggaaagauucgcagauggucacaguauggggaggagaacuaagacaaugaaacagauguuggagaaggagagaauuuucgauaaacacuuuucuguucuguuugaaauuguuaacaugcauguacuguauccuuuaaaaaaaaaaaaaaaaagaguuacucuuccugaaugauaaccaugccuaccucagauaaaaaauccuuuuuauucauuaacugaaguacauaaagacuauuucagcaaacucuuguuuaauucuuagagcccagagauacaguccauagcuccagugagaaaucuguguugugauuuuuccccugguaugugucuaauuuucugcaugcuuguaaucugcuuuuugaugucacauuuuuccuuucuagaucaaaacuacaauaacgccacugcccuugugauuaccuucccugucaauaauuacuauaaugauacagagaagcuccagagggcccaggccugggaaaaagagugagucacucaugggugugagcagacuguccuugcauugugggaagcuagacacuugcggcaagcacuuaaacuucauuuucuaaauuaaccaauggcagaucugaguuacguaguuuuguucacuugguacuaaugaugcuaagaagaaacuguaaacacauuuaccuuugagcaggugcuuuaaacagcucucccuccacaggaaugcaaaagugugcaaaaaaagguuccuugcauuguuuuuacuuauuucauuuauuuuuugagacuggguucacuuuugcccaggcuggggugcagugacugaaucucagcucacugcagccucaaccuccuaggcucaagugauccucccaccucagccuccugaguagcugagacuacacgugcaugccaucacacccagcuaauuuuuguauuuguuuguagaaacaggguuuugccauggugcccaggcuggucuugaccuacuaaccucaggugauucacccuccucggccucccaaagugccgggauuacaggugugagccacugcacccagccaccugcauuguuuucuaacagcaaaacuugggagcaugcugaauguauuuaauaaggaaugaauacaauagaauauugugcugucauaaaagacagugaaguaaaugguccaugauguauauuuguauaaauauauauuguuuaugcugcuguccaugcuuagaaaaaaauaucaagcaaaugaccucagaaauuaacuguguuugugaccucuagagaaugggaagagaggacuuaggaggccagguugcacuuuaugcccuccaguacuuuuaaaaaauuguuuuacugagauaugguauauguaucaugcaguucacccacuuaaaguauacaguucaggcugggaauggugguucacacuuguagucccagcacuuugggaggcccagacgagaggcucacuugaggccgggaguucaagaccagccuaggcaauguuugcaugucucuaaaaaaaagaaaaaagagaauuuaaaaagaaaaaaaagcguacaauucaguagcuuuacuauauucacguguaugugcagccaucaccacagucaauuuuaggaacauuuucauuacuccacaauaaaacucuguacccuuuaacuaacacccuccaucuuuucauccuccuauccacagcccuaggcaaccacuaaaauacugucucuggagauuuuccuauucuggacuuuuaugugcauagaauaauauguggacuuuuuugucuggcuaucauugaacauaauauucucaagguucauucauguuguggcauguaucaguacuccauuccuuuucauuccauuguauggauauaccacauugugugcauuuaucaacugacaaacacuugggcuguuuccauuuuggcuauuaugaauaaugcugcuaugaacacuugaguacaaguucuuguggaugugaguuuucauuucuuuuggguacauaccuaguaguagaauugcugagucauaggguaaguccaccuugaauaguuugaagaacugccagacuguuuuccaaaguggcuauagcgcuuuacgucaccaccagcaguccaugaaacuuccaauucguucgcauccucgucagcacuuuuuauuaucugacuuugugauucuagcuaucuucaugggugugaagugguaucucauugugguuuugauuuaguagacugaaugcauuucuuuuuuuuuuuuuuuuuuuuuuuuuuuuugagacagagucuugcugugucauccaggcuggagugcaguggcaugaucucagcucgcugcagccucugccuuccagguucaagugauucucgugccucagccucccaaguagcugggauuacaggcaccuuccaccacgccuggcuaauuuuuguauuuuuaguagagacgggcuuucaccauguuggccaggcuagucucgaacucuugaccucaggugaucugccagccucagccucccaaagugcuggaauuacaggcauaagccauugagcccagcccuaaacuuacuuuaauucagcauguauggaaccuuagcuguaaucugauagucuccaguguggaagacccuaaugcaguggcugggcauggugccugucaucccagcacuuagggauguggaggcaggaggaaugccuugaggccaggaguuugagaccagcuugcacaacauggcaaagaccccaucucuacaaaaaauuuuuaaaauuagccaggcauggggauacgucucuguaguaccagcuacucaagaggcuaaggcaggaggaucccuuaagcugaggaguucgaggcugcagugagcuguaauagugccacuguacuccagccgaggcaacagagagagacucuauuucaaaacaggaacaaaagcaaacaaaggauccuaaugcaggauaaagguuaagaaaacauggccuuugagccgggcacaguggcucacgccuguaaucccagcgcuuuggggaggcugaggcagguggaucacuugaggucaggaguuugagacuagccuggccaacauggugaaacccugucucuacuaaaaauaccaaaauuagccgggccugguggcgcacgccuggagucccagcuacucaggaggcuggggcaggagaagcacucaaacccgggagguggagcuuggagugagcugagauugcgccauugcacuucagccugggcgacagagcgagaaucagucucaaaaccaaaaaaaagaaaacguggccuuuguaucgugaaaguuagggagaaguuucuuacuuagcugucaguuaguuuaacuaaaaauauaacauuuugcuuaccuuuuagguuuauuaauuuugugaaaaacuacaagaaucccaaucugaccauuuccuucacugcugaacgaaguauugaagaugaacuaaaucgugaaagugacagugaugucuucaccguuguaauuagcuaugccaucauguuucuauauauuucccuagccuuggggcacaugaaaagcugucgcaggcuucugguaagccgggggggggugguguauguucuagagguuaacagcagugcacaguguaacgucauauuuuugccucuuuauucuuauuccauuauguuuaaaacugccauaaauucccccauguuuuaauuguauguaacguuucuguugccuacaucuauuuucuucauuccaacuuuuugguuuaucuuaaaguuuauuucacauaauccaguuuuuucuuauuuguccaguccaucaccuaagaaugcaaacucauaacauguguugcccgagcagaccuagaaauguuuacaaguccucucugaaacacagaauuguacauucaacucuagguuuaauacagcccuguaaaguaaaaaggaggaccuuuuaguaacaagugggacagacaacccuguaacuaauuggugauugugucugucgccucucucagguggauucgaaggucucacuaggcaucgcgggcaucuugaucgugcugagcucgguggcuugcuccuugggugucuucagcuacauuggguugcccuugacccucauugugauugaagucaucccguuccuggugcuggcuguuggaguggacaacaucuucauucuggugcaggccuaccagguauacuuccauauucucacagggcucagcaucuguucaaguuucagggacugugaauggcuccugggcuccgcauucgugagugugaccugugaggguguuuuguuuccuuucccuguguggcucaucggucgucuugacuugcuguggacaucuuaggaccaagaauuucaccccucuuuuugguuguugaaauaguagauauaaaguaagaauuguguuuuaaauuguaucuuuaaauagugucuuuuaauaguaucuuuucauuuuaaauaguaucauguguacaagaagggcuaacacacuuuuggaaaagauuuuggguacgacugcuguuaaaaugauguucagcauaguauagaauguuagauucauuuugcccaaaggugccacuaaaaaggcaaaaggucaacacgugucccgcugcuguagaagguggucucagucguccuguagacccgacgugggcggagacucagugcacgugagagugauguucacugguccaguccccugccgccuguguuccgaguguuuuccugauaauguggcuggcucagcuuucccuuuaguuucucacuugguaccuagcucuguagugcagaaauacucugagaacauuggagucccccaccgaaguuuauaugcuuagaagacacugcuaaucgucuacuaaucauuuauuuuuacccuugaguuaacacaaggcagcaagaaauggcguuguuauugagaaauuuuaaugucgcauaauuuuuuuuuuuuuuuuuuaagagagaugaacgucuucaaggggaaacccuggaucagcagcugggcaggguccuaggagaaguggcucccaguauguuccugucauccuuuucugagacuguagcauuuuucuuagguaauuaugcuuucaauccuaccaguccuguagucugcugagccuggagaaagaaggagcuggcuaccugaacaugucccuuuguguugcuuccuuuuuuuuuuuuucuuuuuuuuuuuuuucucugagacggagucucacucugccacccaggcuggagugcaguggugcaaucucggcucacugcagccuccgccucccggguucaagcgauuuuccugccucagccucccaaauagcugggauuaaaggcacguaccaccaugcccaguuaauuuuuugcauuuuuaauagagaugggguuucaccauguuggccaggcuggucucgaacuccugaccucaggugauguaccugccucggccucccaaagugcugagauuacaggcgugagcccccgugcccagcccguguugucuccuuuuuuuaagcuuuguucugcacugggaaaguaucacuggaccacagaaaaauuggcagcaguaacuuaggugugauuuugcaaguggcuuccuucucauuuaacugucaggacagcauugauguugggguucagggugaaagagaccuagaguucgucuugccacuuuccccuuuuaguagccacugggaauguugauaguugaaaauggcauccuugaguagccacugaauccuucuccacaugacacucuaagcagcagcucccaaauccacaggcacucgcuuacaagauguuugccguuguuuucaaaggcagucuuucucuucugugcacacaacucauuggggaagcagccuuguuaaugaccagaagcucuugacucaccacauuacaaggagccagaauaagcuggaacaaagucagcacuucuguguuucuuucacauagagaaucaucaaauagacccacuaguggggcugucugccccaugucugaaguguaguaagagcaaagugacucuguccacuauaggggaggcuggacuggaaucacucaguccaaagaagaccauccacgggccacaaacugcaaugccuacauggcugggaggucagcuuaaucagggccauuguaaggucauuguaggugguagucuuucaccacagauacacugcuagcuuguuauucuucaucuccacaaagccaugugcuuuugaaaccuguagcccuguaguuccuuuugacaaacacaggugcagaaaaaaaaaaaaaaaagaaaaaacuuucuuuuuuucacuacuauuauaagaaaaccagugcaagugugaugauaauagcagcagagacugugccucaagguuggagugaccuugggacaguaggagugaguagggauuguggcaccccaacugcacguguccuaucuaaaaagacaguuauguguguggccaacccagugcuacaaggucuguguuguuguuguuguuuuucuuccaagcaaagcugugaaucuagauuuuuguguaaaaugccauuguuaaauauuggcaacuuauaaaaaaaaguuuuuuaaucuuaagauggguugauacagugugggcuaaacaggaaccaucugauucaugggcugccaguuugcaguuuccaagucuuacccucaugccuuugauccucacucgauuguagauuaccucuuaacuaaacugggaggcuaguaguguugauguaauaaauggaaaauacuguccauuucuuacagugaagcacagaaaguacuauaagaaauggccuguauuagugguucucaaauuuuaaugugugugaauuugcugugaaccugaguauaguagaauugggguugaauuccugucauaacuaggauggggcuucccaaauggucuggugcugagugugcuuugaaaagcacuggcuuaucaccuccugucccacuucugguguaauguccagccgcagcaugccuucucaugcguuuggccugugcuggcuccuuguaucuguacaugcacaugaacauaagaccugcagagagcccccggcuguaaacagaagugacgcagagcccuucucuccccgacaggagcauuguccgugaugccagccgugcacaccuucucucucuuugcgggauuggcagucuucauugacuuucuucugcagauuaccuguuucgugagucucuugggguuagacauuaaacgucaagagguaaguuggugccaggauuauagucuauuuaauuugagucuagaaucuagaggaagcagcuagcggguauaaccuuuguuucccucuguccccucagaaaaaucggcuagacaucuuuugcugugucagaggugcugaagauggaacaagcguccaggccucagagagcuguuuguuucgcuucuucaaaaacuccuauucuccacuucugcuaaaggacuggaugagaccaauugugguaugcgcuuaucugugguuuuucucuuuccucucacugaaacagauuaucacaugccuucuaagaagccagacagccugggaaggagauucuuaaagcuguuaaaauguaucuaaaaaaaaagcaaaagcaaauguggaacaguagauaaaauguuuuuccugugagcuuuuaucaguccauauaaacaagaguuuuaaguuuuuuauuuugaaauaguuucagauucacagaaaguugcaaagaaacuuuuauuuuuccucuuaauaaugaggaaauagaagccaagagaggugaagugguuugccccaagucacucagcccguaaguggcagagucaggauuugcacccaggaauuuggacuccuggugcuguggucucacccacugcccuguacucccuauuagccugucauuuaagcuuuuccauuuuaaaaaauccugcuuuuugugugugcuuaagauuuuauuucuggucguaagcuuauuuacuaagcagucucugucuuaugauucauuuguuguuccagauagcaauauuuguggguguucugucauucagcaucgcaguccugaacaaaguagauauuggauuggaucagucucuuucgaugccagauguaagaugacuuccuuuuuuuuuuuuuuuuaacuucuuuagcugaugaugaauacauuuuucaaaacaugcacguagguguuucaagcaagugccugcuucuaacugcaaauggugacaggguuuccaggguuaggagaacugucgcagugcacugcuggugugggcugucuggcauucugacugagccccucugggcacagcugcagaacacgaauaacuagucuuaugagguuacuuuaugagaugcucuccugauuguggggcuagcaggaggagcacccuggggcccuggggggaagacuggugguguuaggaaucaugaguccagcuggaggcaucucagccaggaaccuccuggcacccucuuauucuccaugauccucgccuugcuuaguuacuaucagaguguucacacucucuccuauucuuuuaucuuucuuucaggacuccuacaugguggauuauuucaaauccaucagucaguaccugcaugcggguccgccuguguacuuuguccuggaggaagggcacgacuacacuucuuccaaggggcagaacauggugugcggcggcaugggcugcaacaaugauucccuggugcagcagauauuuaacgcggcgcagcuggacaacuagucaguaccaccuugucuuguacuucagaagcagcggaggaggcucucagccaggcagucagcucaggccugaaaugucucacugaaaauagacuuucuuggaaaaguuguuuuuaugcaaaauguauguuaaaucuggcuuuaccuuaaaaaaccuuugaaaggacuaauuuaccaccuaauacuuugaaggcuuuuuucauuaagugcucauguaguuuuucuuuugacuguuagcaguauaaaacguagaaaaggaaguuagguuuuaagaaaaaguacugaaacuaaagacuuccucccuguggagcaggucaguaacccugucuguccucucuaguacccgaauaggcuucgcccccucguccuggaucgacgauuauuucgacugggugaagccacagucgucuugcugucgaguggacaauaucacugaccaguucugcaaugcuucagguaccuucuccuuuaccaaaucuuuccuguuuugcugaaaaauuuucaaauuaucauuuaaaaaucauuugcaucgugccucaguuuauaccuauuuguauaucaaagcugggucucccugugucaucauuccuuuccucagucauucauucugaaauugucauguuguuccuggcucagacagccacccucggggcugcaagcugaacaagguccacauguucggagugugguuuccacauaagguuucucauccuguucuaacuccagcgauugccucucaggauugguaucuggccuuagcuucucagaggagggcuuuucuuuaucacuuuacccugugguuuuguaggagcgucgagguugcccuggaauuuucuuaauaaaaacauagaagccccgggcucugaccagucaaggccauacuugaaggaggagaucuacuucagggcagaaaaugaugcauaguaugccuaagaugaaaaugguauuucagauucauuaaacugugaaagugacauguggcugaagcuuuuagauaaggggaaagauuaucccucacuaguaaggaaaguaaucgauagagaagaaaguaaugccccucacugucaguauuuuaaaauguuuuacaaaaaaucuggagaccuauucuucuaacaguccucccugcaugucuccgccagugguugacccugccugcguucgcugcaggccucugacuccggaaggcaaacagaggccucaggggggagacuucaugagauuccugcccauguuccuuucggauaacccuaaccccaaguguggcaaaggguaagugcugcugccauugcagauaagcauccacugcaacuuuaauuugcaguagaaaacuaggagaggacugggcuaagacaguugcaugggaacgucucuucuccgccccacccuguccugguccuuugguggaagcaggaaaaccgaaaacaccuuuuuaagaaaaugccucauaguguucaacugauucugucuuagcgugggcauucacaucucaugcucucucuguguccuggcccccugggcaugagaaugaacgcagauuccugugcacauuccaagcggggcugagggagaggacggccugcugguaauccaggccugaaggaacuuggccuguucacuuguacugauggcagcuggggcgugaucuuagcuuuaguaacauuaucccacauuaagguugcgauucuuuuagccucgucaugcuccuugccagcccauccauguauaggguuaugggcuaucucacucccccauccagccaggcagccaguuacccacggaagccagauauauggcccaaaaauagugaugaugaccggaagucucuggccuugauuuggaagcuuugggagguggaagaugaguauccccauguauguuagguaaacccugaacuuagguuuuucauaagaacauacaucugaccagagucauaucagugaaucauuuauaucaugcaugugcuuugagaccuauucgagguaucaugggaugacuccuccuaaaaguuaaguagaaaugaaucuugcagcuugauuuacucacugacuggaugcuuuggccuacguaaaauaaguugaaguagauucaguuuuucugaaggcaguagccaccguuccuggggagccuccagggugccagcgucaugccaggcacucccugacauuauuccauuucucaucacgcagccuaugaguagguggugguauacccauuuacagaagaggagacuggggcucagagguggucauuuugcucgggguuacaugaccaguaaguggcagggcugagguuguucccagggcccuugcccuuuccugcuuccuauuacacaacaggacugaguaaacccuguaccuuugauuauacaugaaaccagguggagaaacagcagcuauguaccaaagaacccagagcaaucgagaaaagcccaucuggccaggcgaaguggcucacaccuguaaucccaguacuuuuggaggccgaggugggcggaucaccugagaucaccucaggaguucaagacuagccaggccaacauggcaaaacccugucucuacuaaaaaaauacaaaaguuaguugagcgugguggcaggugccuguaaucccagcuauucgggaggcugaggcagggagaauugcuugaacccgggagguggagguugcagugagccgagaucacgccacugcacuccagccugggcuacagagcaagacucugucucaaaauaaaaaaaaaaagaagccagucugggagagaacaagcuaaaccuuugguguucccuuaucugggggccuucuucaucccugaaauguacagcugggucugaccucugaguccagggucaggugauuuugcuuagccucaagugcucagauucugcugauauuuugcaagaccuggacucucuugacacccaggauucuuuccucaggggacaugcugccuauaguucugcaguuaacauccuccuuggccauggcaccagggucggagccacguacuucaugaccuaccacaccgugcugcagaccucugcugacuuuauugacgcucugaagaaagcccgacuuauagccaguaaugucaccgaaaccaugggcauuaacggcagugccuaccgaguauuuccuuacagguaaagccugcccuuuuucaaugggguuuacccagcaaagggccuacacugggugggaguggggaggguucccuuggcaagaugcugauuuucagguuggguucuggccccugcuccauucugagcacagggcaguauaucaaaggaaaugggugcugggcaaaggaguucagaaucuaaagucucugugaaggccugagggcuagagacgcaaaacuugaucucugcgccacugcacagcugcaagagacacacacuggaaaauggcuuaaggcagggggcgcuuggagagcaggcggcucagagcagggcccggcccacauucuuggccaacaaugaaccagaaucccuaacugcugguuauuugggaugcugccuguauguagacuuuuuauauuguuagggguuuuuuuucccaggaagaaaaguauuauguaugaacuacugaauuuagaaacuguagaaagguaggagaaacaagugauuuauuuuuccugccuccccaugaucucgcuuaaagcaggaaggccuggauuuguuuggaagaaguuaagagccgguuagcucuggcagaaaauaaaugaaagcauguuuuccucaggccuugcacggaccccgcugagccugagguagugucucaggauagaucaggauucuuuguuuuuuuguguuuuuucagaaugcuguggaaugcucucuguaaaugucuauaaaauagcauagauugggcuuauaaacagaaacuuuaucaaaaauauacauuuugcaucacugcugggcccuucucuggguggucaguggccaugagaggucaagugaguugcuuucggugagucuuguagacagccagcaagguuuucugcaagggauguuucccaaaggagucugaccacuuggcaguggugacaggaugaacacgcaguguucgggagugagagcgagcuuuaaugaggccuccccucuccccuccaguguguuuuaugucuucuacgaacaguaccugaccaucauugacgacacuaucuucaaccucggugugucccugggcgcgauauuucuggugaccaugguccuccugggcugugagcucuggucugcagucaucaugugugccaccaucgccauggucuuggucaacauguuuggaguuauguggcucuggggcaucagucugaacgcuguauccuuggucaaccuggugauggugaguccucauacagucucaguuugucccuagcuccuguuucacuugggggaauuggcugucuuagauuccauguaaacccuaaagauggaguaagauaccaagucuggcgcuugcucuuggcacacauggagaggcaggaugagugcuggaggagugcuggaugguggugggacagggcauagagggagcgagcauugaguuggacaucugggagcauaggcacauuacaggcaauuucuguucaauuuuuucucuugucccauuccuugcggcuauacuaguauaccugauggugccucugaccauggaaaugugauuuccuggccuaguucugggcuagucugccuguaauuuguuauucuuuagagauugcacaagccuguagccugaugacagcaggauguucacuuuuuacuuagaaaauugcaccccgccccaggagcucuccgaccagugccuuuugccuccuaugugguuaucagguacuuuuaaucauuaaagaugagagcacuugagaagguauucauggaaaauagaacaguguauccguacucucagauaugagcccugcuucagauaggggagcacugagguccaagaaaagaaguugugacaaugcgccagcucggugcggguggggugaccuuaacggguuccagcaauuucuccuggucaacacaaacgugccacagaaaaccaggcuuuuggcuguguguagagagggccccaaaaaguuccugguacaguaagauuggugugauggaggccuuguaaguccaaugggaugcuuggccuccucuagcacccagggugcccuggguaauuagcacccauccucagaacgggguggcugccuagggucuucaacaggaagagagccauccuaaaggaagugcuuuauuucagagcuguggcaucuccguggaguucugcagccacauaaccagagcguucacggugagcaugaaaggcagccgcguggagcgcgcggaagaggcacuugcccacaugggcagcuccgugaguacccugagcagggccacgccggcagagucgcaccacaaaguaauccuccucagugacugaagagucuggauccuguacuuacaaagcagcuucuaaggauugcaagcuuucaggcaauucaugaauuagcugccacaucguggacagaacggacguucuguggaacuguaccuguugguacggcuccuuuuuagguggcagugugcugaagcaggaaaauaacagacaaguuaaacaugagacagcuggcagucuuucccauuuaaaaugcaggggagcccgggccagaacccagcgugugaugugcgguuggugccuggagagucgucuugguucaacucuacacccuggcuuagccuaucucuuuaccacuguagaaaauaccugguaaagaguaaaaacuaaaacuuuguuucguaacacuuuuaaauauuuaaguuuucaccugagaauauaaagaaagauaaucaauugggagacacgaugcagugucugugcagaauacacagcuuuuaacuuggucauaccucucccccaggaucauaaggcagcaaauaguguuagguaguagaugaugcuaccuggguucaguucccauugcuuugaaccuugaauauuaagaaauccccauaagggcuggccacgguggcucaugccuauaaccccagcacuuugggaggccaaggcuggcggaccacuugcggccagggguucgagaccauggccaacauggugaaaccccaucucuacuaaaaacacaaaaauuagccaggcaugguggcgugcaccuguuuaaucccagcuacucaggaggcuggggcaggagaaucacuugaaccugggagaaauccuuguaaggaaguguuuuuguucaauuacagguugguaaaagugguuucuaacacaguaucucuucuuuuagguguucaguggaaucacacuuacaaaauuuggagggauugugguguuggcuuuugccaaaucucaaauuuuccagauauucuacuucaggauguauuuggccauggucuuacugggagccacucacggauuaauauuucucccugucuuacucaguuacauagguaagaguucucaucuuaaaaggguggcacaauagaaggacauuacugaaagggaauucuauccugaggcauucuuuucaaguauuugaacucauacuaauggucauuugauaaugauaaaugauacugaguaaaaaaauuucuucuaaaagaaaaaacccauccaggggauucaugauggugcagacuacuuuauuaggaaguugucgauguuuuuucuggaggccugaucugucugcuucacaaaggccuggagccaguccuugaauggaucugagugucagcaggcagggcagcuccucccugccacugagaugaaggaguccaucuggcagccagcucucacaccagcagugcugcagaacagcuuuuuaugucccucauggauuucccguuucuuagcaaagugcuugcugccuuucuucaucucgagacuguccuugauccuuuuacuucuauggccacuucaccuugcacaaaaaugacccacgguugaaagaacaauacugauuugcuucauuuauagcuuugucacuaaauugaagcacugaaguagaagauuaagaaaaugaggggcuuuuuaucaucuccgggggauagaaaguaguucuauuacaaucuaauauacuaguuccuuuuaagaaaaaaaaaaaaaaaaagagaugagcacuuuggaaggcugagacaggagaaucguuugagaccagccuaggcaacauagugaggccuccaucucuacaaaaauaaaauuagccaggugaaguggugugcgucugcagucccaccuacuuguuaggcugaggcaggaagcuugcuugagcccagaagggugggcuuaggaugcagugagucguguucauaccacugcacugcagccugaggaagaaagcaaagagcccaucuccaaaagagagggagagagauguggucucacucuguuguccaggcuggucucaagcaauucuccugccucagucuuccaaagugggauuacaggcgugagccacuaugcccagccaacuagcucccuuucuccugcagaaauaagaaaaagucucucucucucauagggccaucaguaaauaaagccaaaaguugugccacugaagagcgauacaaaggaacagagcgcgaacggcuucuaaauuucuagcccucucgcagggcauccugacugaacugugucuaagggucggucgguuuaccacuggacgggugcugcaucggcaaggccaaguugaacaccggauggugccaaccaucgguuguuuggcagcagcuuugaacguagcgccugugaacucaggaaugcacaguugacuugggaagcaguauuacuagaucuggaggcaaccacaggacacuaaacuucucccagccucuucaggaaagaaaccucauucuuuggcaagcaggaggugacacuagauggcugugaaugugauccgcucacugacacucuguaaaggccaaucaaugcacugucugucucuccuuuuaggaguaagccaucccacaaguucuauaccauauuuuuagugacaguugagguuguagauacacuuuauaacauuuuauaguuuaaagagcuuuauuaaugcaauaaauuaacuuuguacacauuuuuauauaaaaaaacagcaagugauuucagaauguuguaggccucauuagagcuuggucuccaaaaaucuguuugaaaaaagcaacauguucuucacaguguuccccuagaaaggaagagauuuaauugccaguuagauguggcaugaaaugagggacaaagaaagcaucucguaggugugucuacuggguuuuaacuuauuuuucuuuaauaaaauacauuguuuuccuaa

SEQ ID NO: 6332 - RNA, 300019 nt, Homo sapiens
gaugucccgagcugcuauccccggcucggcccgggcagccgccuucugagcccccgacccgaggcgccgagccgccgccgcccgaugggcugggccguggagcgucuccgcagucguagcuccagccgccgcgcucccagccccggcagccucagcaucagcggcggcggcggcggcggcggcgucuuccgcaucguucgccgcagcguaacccggagcccuuugcucuuugcagaauggcccgcuucggagacgagaugccggcccgcuacgggggaggaggcuccggggcagccgccgggguggucgugggcagcggaggcgggcgaggagccgggggcagccggcagggcgggcagcccggggcgcaaaggauguacaagcagucaauggcgcagagagcgcggaccauggcacucuacaaccccauccccguccgacagaacugccucacgguuaaccggucucucuuccucuucagcgaagacaacguggugagaaaauacgccaaaaagaucaccgaauggccauauccuuuugcccgaaccccagcagcagcugcgccucccccuccucccuccgccuccccucuuccaggcugggagagagacccggggguugaugggagguggggaggaggggggucuuccaggggcugggagagggggcaccgggaggagugugaaagaaucucuccaccccgagcuggguugagcuacccuggaggcuugggaauggguuuguggggggcuggggggugggcagcggagaguggauccuucccaaggaccgacucuagaaugagaucuggggccuggggucgugcaggagccuuggugggggcuuucgagccaaguccggaggguuuggaguucuacggagugagcuuggagcgggcucgggccugggcgcuucuggccagggcaggggaacuaugggggccuugguuggguuuucuuggccgucgcucacuggaguccacgcaggggaagcuggacagccucuccacuacugcuuuccccaagguggggggccgccgcacuuuuagggcagggcgcuugggggcucccagggcuaagagcaagagggaguccauguggccuucacacugagaagccagcacuggccgaagugaguaccccagggugggccgcuguuccuaucuggagaggauagugaugggcuggggggcgcuuauguuucccucaugugugcaggucccauugccuuuaaccgcugauuggggaaccucaucaucuuugggggugucgagaaagagaucccacuugcuuuaucugggccccuggccugggaagaccugaucuggacacuuucaguaagaaagacagggcaacagcaaaugaggugguggguccauuuuagagcaccauguccagcuuuuccuaccccgaguagccgagagggaacaccaggagaaucagcacccauguggacaucuuagguagguaaaugccuuuuaaauuuuuuuuuuuuuaaucaaagauccagaggaaaaaggugaagcccacauuuucuucuguggagaugcuaucaaaaugcagaucuucuguguuucuuuaaaucccugccugcuugaaauaaaccuugaggagggcuuaacaucuaucgagauguaggcaggcaaggguggguaauuagucgggcuuucuagcaguuaucuaagcaugacccagauuccaggaggggggacacacccugcugcccaggcuggcuggccacugugccaugcccagaugugccgcuucuccgcacaguuccaaccagcugcccucuguguaaaaaugaacgggcuggaugggucccuggggcucagcgaugaguccccuaucccuuuuguaugugguuuugcaguuauagacuaaacggggcugggcccuguguggucuccggggguugcuguuugaggagcauggcgggugguagagggacucacuucagggggguucaaaaucgagccuggcgcuuggauccugggugcugggauugcaacagagggcacugagguuuuggagugugugaguggucuacuuugaggguggggaaaauuaagaaguucagcagaggugcuuuugaggggagcauaccucuaacuacgaugccaucuccguuggugcccaaagcaggugccaggucuuugcuuccuaaguuucagacucuuaaagaggcugguucuuaagguuagcaauuccucaccaucccaggcccauugaagugcucagggguggcuugauuacucugccuaucaacagagugaggagugggagugccuugcaggaggacaggguauucaugggugcacacccaguuagcuccaggagugagagggcuuugcucggcugacagguuuccucauugaaaauggcuuuagaucgccuucuggagccuggauuuggagacuucuaagaggaaaggaaggagguggggagcccuucugcuguguccuuagcuuaccucuguccagccugaauccugcagauuggagggcuguugggggagagggggauugcaguggccccucggaagggggaaucgugggagagggaggcaggugaauugcgaguguugcuugccacuucaucuauucucuggccagcucgcccggggcuuucuugcucuuaugaugaguuugugcauuaugcucucugcagacuguuuuuguucucuuugacccgagguaacaaacacauuauacagcccuacucuggaagggaaaacuccccaccucacaaucugucaucgagcugggucauccaggacugagcuuucucuguccuggauggagcggagggcgguggcggggugggugggaggguuggagaugagaggggauggacagagaccuggggagggagguagugaauaaaagaauucaggccaguguaaagagaaagacacguggaaugucagagucacgauaccagggcagaacauucuacuuuuuaaucuaaauauuucugccauuaaaaaaaaauguuucagcauauccugagagugaaaaaaaaaguguguagguacuuaaauaaagucuaauauauguacaggcaaguacauauauucagaugcauagauuuuuacaaaaugaacacacccacguauccagcacccaggucccgaucagugcccuggaagucccccuccccauaccgccuccuaguugcucccccaacaaggguaccgcucaccugacuucuaagguucauuuugccucuuuuaaacauguaaauggagucacacaguacguucuuuugccacuggcuucuuuugcucacaucuguguaugugacucuacuacaaucuauccauucuacuguugaugggcauuugugucauuucuguuugugccacugggaacauucuugugucuucuauuauuuuuuucccacaguucucuuagauaggaguggaaucgccccugcuacuuuuugaugcauguguugugggauguguauuuggaaaugguguugacuaaggguugcaggucgauauggaaagcagguuccucccugucuuguuuaagagaagugagugaaugauccaugaacuugucgguaugcucacagggccuaagagugcuacuuccaaauguaaauucuggcaugguacacuggugaaggaugcagucuugcuuucuccacacucggggcaauuugucacuaugauuucuuccucuuucaucccucagugggucaaacuugaagccaucaaugacaauuaagaauccucauuuauuucauuuuuuccccucuuccuaagugaggaaacccaaauggaagucuuugauguucaaauuuacauugccguguuuuucucaugccaggcagcaagccgucuugaccacacaccuugguuucauguuuucauugacuggaauugugauucaaauagggccaugagggucucugaugauugccgaagagcucagaucugucagcucaaaaaggagcaucugucagccuuccuagaguucccuccccacuuaaugccacucacuccuucuaccaagugccaaggugaaugucaucuuuccagcccucccugugccaccaggucucccacugaacaugauguagaaacucaggccaucggaggaacacuggaagcaggucaguguauuaucacgcacaguugccugaauuacacguagaauuccagcuuuucauccgguuugcagaaaucuuaacaagacaccuaaagucacauugacaucaggugacaucacuuugacaucuguggacauuggcugauuggcacuccucucauuuuuuuuuuuuuuuuuuuuuuuaagaaaagcucucuaaagagaaacuuucugcaugagaagcgcugggagacaugggagcagguuaucagacucuuggccuguccugagagauagaauguucuagaagguacugccguagagggcaggauggugucacuuacgugauccuuguacuagaccggcuuggcugguauuuccagaggagcaaaauucugcgaaguaaaauuuagcacggcuuuuccaaugggaguauuuucaaaaagggugcaauuucuuauccacaauuccccaauccaaaaagcuccaaaaaccaaaagacgagcucauauagagguaaaaccuaaccugaacugacuucaguuugaagucuuaauuuacaguuuucauucauucuacuuggugugcauuugaguauguuuugcagcagaaauguuagaugugcuugaugaugaggugcugcuucagcuccugacuguuaggucugcauuguaguccugucaaacuuucagguguauggaaguugucuuguuaacaggaugguucugguccagcaggauuuggguggggucugggauucugcuuuucuagcuagcuucuagggauuccccaugugguaaguucaugggcuaggguuggaguauccagguuagaucauagagacaucuuguuaucauuuuucuuuuccuuaaaaaucagguuuauaggggccgggucuggugguucacgccuauaaucccagcacuuugggaggcugaggccgguggaucaugaggucaggaguucgagaccagccuggccaacauggugaaaccccgucucuacuaaaaauacaaaaauuagccaggcgugguauugugcgucuauaaucccagcuacucgggaggcuggcaggagaaucauuugaaccugggaggcagagguugcagugagccgagauugcaccacuguacuuuuuuuugagacucugucucaaaaaaaaaauagauuuauugauguauaauuuauuuguagcaaaauucacccuuuugacauacuggucugcaagcuuugacaaauggauguaguuguggccaccacccaaaucaagauaugggacaguuucaucaacccuaaaauacccccacagugccccucuugagucagcaccccacuucuccagccccuucaaccacugaucuguucuccaucccuacagcuuugccuuuugccgaaggucauauaaauguaauuucacaguauauagccuuuugaauguggauucuuuuacucagacuuugagauucauucaugcuguugccugugacaguagcgccuuccuuuuugguguugagcaggauuccaugauauggauggaccagaguuugcuucccagccgaaggacauugggaugcuuccaguuucaaugauuaugaauagagcugcuauaaacauuggcuuauggguuuuagugggaacauuucauuucauacauuucauuucucuuggguaaauuaacccaggagugagauugcugaguugugugguagguguauguuuaauuuuauaagaggcucucaaacuguuuuccuaagugguuguaccauuuuacauucccaucuuugcaaugcgucuaaaagcccugaguucugaauuccaaagcacgucuggccucgauggcuuaggauuaaggauguggaucuauggaaaggaguggaaguaauaguguuaaaucccggucagagaaauaagaaagauuaaggaugucauucaaagcuaugugccugcacuagagagagagaaagaagggguucucuugggugggguuccaccccucccugguaguucuaccauuccccaggaaaaagucaagcucugaggcugugagacccaugaucuuuacccuguucuucaccacugcaaccccagugugugggacaaagcaggcguccuauaaacguuugcugagcaaaugagaaaagguaccugucuucacccauuaacuaaauuguauaacaucuaucugaucuacccuugugccaacguuuuaggauuuugauggguuuuaguugcaggggguugagagacuguccaugagauuaucagaccaaugaaaguuucugaaauguuagugcuugaguagauuggaugcagcggccccuugagaaugaagucuuucuucagggacuuggagugggaggcaucuguugggugcguagggcuuaugcuucccccucccuguuucccccccaguagcaagcacacauauacacuuucucagcaauaaaaagcaccgccgggaagguggacuccauccagaaaugaucagagccuaagagccgugcaguaacgcauuuccgagaaugccagcucagcuccugagaaaagggccggaugggauggugccugcucugaaagagggcagagaggagagggaaaacacuccggacucugggucagacuggcccagguucacauuauucaccagccauguuaucuugggcaccagagccuauuucuugacaugcaugaugaggauauuccuucuaguagcaucucccuuggagggcucucaggagauuaaauggggucgugcgugaaaaauggccagcacagucuccagcacagagaaaaaccccaaaacgccagagccguaauacuauggagucauuuagguuccaguguucuuuuuuuggaaaccggccagaaaagaggcuuucugggugggaaugggagcgaagugcccccccccaccacccccugcgacuggucaguguggauugauuaaccugaucguggcgcucuuuaaagccaccuuuggacauuuugcauucuccguucucucuggaagcuuucaggggaaaaaaaauucguggccacuugacccauuuuucuauucccuugagucuaagguaaaaauuaauucucuuuccuccuuuggucccucccucucucugugggugacaaggugagggaguuuuaaaguauauaauuagcuucccucuuccccuuuugcacucccugucucuuccuuuggggccggucgagagugcagcccaggauggccaccccagguguccacugcaaacuccacagaaaaacuuugcucaacuuuugguuuagaauuuagguaccccccuccccuuccaaacuuuggucuucuuucuccucacucccuaaaaaaauaggaaaaacaaggaacauuccuggcgagggaaccaugagugggcacagcaacuuagguuucaaaaaccacugggccucaguucuuaucugaguagggugacccuucagccaggguugccugggacuauccuggguuuagcaucucuggaaacucacaguccugggcaaacugggacgcuggucacccuaauggugaguucuuaacaccugagagagaagaauggugcaagagauggugccguugaccaagaaagggggagagucaguuacuuauucccucugaaaagccaagacuuuuuauuggaaugaaugcagcuuuuagaagccgucuuuaaggcagcuaauacaagagagauuccagcuaugaagggaaaugccugaguuaaguccggaucaaguuuugacaucucgcuucggucagacacggcuuuaucugccguucagacugggagcagccgugagucuuccuuaaaggugccuguugcucaggcggcaccugcaguuagaaauuagcagccucccacccccagcccccaaauaacaggauucaagaguccccucucugaagccaugagggaaacccaacuuagucacccacuugccaguaaauaauauucaugcuguuaaguucuguucucauuuuaggccuauguguaaaaaauauauguaauuuuaaacugauuuuuaaaguauuuucauacgaacagcauuugcaggagggcgaagucuggauguuaccuuuuuguaaaaguggauggauuugucuucaaugagacucuggggcagacuuaaaacuuggcccgcagugguguuacauggauucugaucuuccagagucugucacguucuuuuaucuccaugaucuuuauuaucuucuuuauugagaaugaugggcauggugugugugggugggagggcuaugcugaccaucacugcagugaaauguguucguggcauguuguggcgucugcauaggaaugugucuguuugauuaacagcacaagcaguggaggcuguaaggaggaaaagaggagggaaggugauauuggauggaggggagacauauagagcuugggaacaguccacccuggcugcaaaucucagcuccagcucacaguuguggagccucagucuucuccucuguaaaacggggacaguaguccuauguccgaggaauuguaagaagguuaaaagauacuguacccagaaagcacauggcauauauaaucauccugugaaguagccaacucaaugaauuuuauuuuauuuauuuugagucagagucucacucugucacccaggcuggagugcaguggcaugaucauggcucacuauagccucgaccuccuaggcucaagcgauccuccugccuuagccucccgagaagcugggacuauaggcaugcaccaccguacccagcuuuaacaacauaaauuuauauauauauauauauauauauauauauauauauauauauauauauauauauauauauuuuuuuuuuuuuuuuuuuuuuuuuuuuuuuuuugagauggaguuucauucuuguugcccaggcuggagugcaauggcgcgaucucggcucacugcaaccuccgccucccggguucaagcaggacgaugggcauuugggauguuucuaguuuggggugggggauuguuuguuuguuugcuguuaugaacaaugcugcuguaaggaaucaauaauuuugaaugaaugaauucgagguguuaauuuuagucuguguacuuggaaaucuagcuucaccuagaaucagcugagauucaucagcauuuauggcaggagcuaagacauuucacagcuuacucaucauuuucucuaagaggcugggucaaccgguuagcucuugguccugcuuguauucugagagucagaaccugugguuuagacacuggcaauugauaugguuguagagaagcagcaugguugaguugagagcauggauucuggagcuagguggcugggguucaaaucccagcucuacuagucacuggcugcgugaucuugggcaagucacuuaaguguucugugcuucaguuucccagucugucccaguggugauucuaauagcuccauggggauccuaauagcuccuaucugggaggauuaaaugaguuaauacaucugauguuuagaguggugccugacacuuaggaagcacuauauguguuuauacauggaagaguggauagauggauggacuuauguggguggccauauuugggcuucucugauccacugcugagaauaguguguggcacacaguaggugcugcauaaguguuaauauucugcucuuucuugccaagucucucaacucccuugaucucuguuauuuuuggcgucuguguuguuaacccauucuucugaaugaucagcugaaucacuguugcuccaauauauaagccaaggagaacacaaucacaaggucucauugauuguccauacuagaauuccaugauuccuaggcccaaguaggauuuuccccacgucucagcaauccuucuuccauguuucuaaucuuuuucucucauuuguuaugccccauugccagacucuccaaucuccccacagcuuccccuuccucuaacuauacugucucuagucuuaccuucucccuaagggcaccgucuuugaagacaucaaauacuucagagcaccaaauauagguuagcuucucugagggccuuacaaggacauggaguguuugggucuuacacaaauuggaauggucagaaauguuuagagacuugaguugucuuugaaagaguugucagaaugcaaauuuuugacuuguggccuguuucugaucacaacgcagucuuuuaaguuauggaucauagcuggauguuugugguuuagaggggauggaggcauccucugcaguuaguguuggaugucuggguggauggauggauggauggauggauggauggauggauggauggaugguugaacagaugcauggaugaguggauggauggauggaugggaugaaggaaggaaggaaggaugggugauuggaggguagguggguggauaaguagauugguagaugacucgauggguggguggacaaauggaugggugaauggaugacuggauggaugacuggauggauugguguaugagugaauauauggcuggaugaauaaauaggcagaugacuagacuggauugagggguaaaaauauggaugacuggauggguggaugaguggaugauagaugguugaauggguggguggauggguggauguuggauauaaggguguaugguaggguagcugucuaugugugggucucccugauauuugguguucuguuugacuugggaaugaccaagucucuccgcuuaccaccuuauuuguaccuuuuccaguaucaagugaauuuugcacacuuuuguaaaaaucaauaagauuguauguuuaggacuuugggaggccgaggcaggcagaucacaaggucaggagauagagaccauccuggcuaacagggugaagccccaucucuacuaaaaauacaaaaaauuagccaggcgugguggcgggcaccuguagucccagcuaccugggaggcugaggcaggagaauggcaugaacccgggagguggagcuugcagugagccaagaucaugccacugcacuccagcuugggcgacagaacgagacuccaucucaaaauaaauaaauaaauaaauauuauaugcuuagguuuuaccuauguaauuagaaagcuccuugaggguaggggacagugauuugccuuccucacauccccccaaaguuccugcacuauaucaugcauaaguauuuaauugaguaauggugaggaaaguaaacaguguuauugaacaaagauuauuaaaauucuggaaacaccugguuuuguuucagcacugggacugaaaguggaauuccuuggauuuugcuccauugguggauaggauagcauguggugguggacugguagacucuuucucuuccaagcagauuggguaaaugccccagauucuuacccacuagucagagauuacagauuacugauugauaugguuuuucucuguguccccacccaaaucucaucucaaauuguaauacccacaugucaugggagggaccuggugaaggugacuggaucaugggggugauuucccccaugcuguucuugugauagugaguucucaugagaucugaugguuuuaaacuugugugggccucuuuccucucucuccucuccugcugccauguaagacgugccuugcuuucccuuugccuucugccaugauuuguaaguuuccugaggcguccccagccaugcagaacugugagucaauugaaccucuuuucuuuauaaauuacuuuuauagcagugugaaaacggacuaacacacugauguagcaagguccuuuaaggccccaugugaucuggucccuguuuugucuuugaucucaucucuuucauugucuaccuuccuuucauugucuauucugucucagcccugcugaccauuuuacucacacccaugucauuugcauuacaugacauuccuucuguucagcauaagcuauuuccucugccugcaucacuguuucuccaggucuccccauggcuaacuccuucucuucauuuaggucucagcccaaaaguuaccuccuccaagaggccuauccuuuucauuuacugaacaucucauguacaaaaaagaauauaaaauauauguauacucucucauccacaaaaaaaucucugaagacauuuuaauguauuucaucccauaccuuuuuaugcauguaaacuuuuaggaacacauuuccaugccacuagguauccuugaaaaaauaagggccaccauguauaguugcacagguugugcacugcacaaagauagcaugucacauaucuuaaguaucauggagcuuguaugucuacuauuucaguaccccagcugauaaaagcuuaaguaucuuguucuagcaagaugaagcuauuaugacaauuuuugacagagaaagggguguuuuguuuaaguucacaaucagagaaaugggugucuuguuuaauuucacaaccagagaaaggggugucuuguuuaaauucauacaguggugcuguauggguugguggcaaccccagaaaagacuguuguuaauaucugauaauguuccacuuuauacguguauuauauucauguaacaaucucuggcuguuuguuuugccauuauaaauaacagugcaguaaacaucuuugugugugaaucucuguccaagguucugauaguuuucugaaugaaauuccugucuauauauggcacuccaagcccauaauugaaacucugcuguuaccacuuucuuugaaucuguagaaggaauuuugagaacaggugacugguauauucaggauguugaugacaaggaacagagaaagaacaguuaaaugguuuggaauuuuuccugggcugcauguaaagcagugcuuuugaacugggagcaauuuuucccccaaggggacuuuuggcaaugucuggagacguuuuugguugucacgaauguagggggagggggcaagaugcuacuggcaucuggcugguagaaaccagggaugcaguucagcaucuuaaaaugcacaggacagccuuucucaguaaagaauuauccagcuccaaaugucaguaauaccaagguugagaaaucuugauguaaucgaugucauggguuucuucaagaggaguggguggauuuaggguuuuugggugacuuaaauuuaauuuacaguuugucuuccuagcugggugucuaagccagcuuucugugaacuuuagaucccacacaagaagcaacaggcuugcuaccgacagauucguugauguaaauauagaugaguguauagaaggaaaucucacccagagcuggaaaauguuggaaugaaaacugcggcggccuccccuucucucuccuuccccuucuguugcccuguuugaaaaucgugccuuacuuucuuuggucuccuggcauggugaaugcugcugguauggacuguguuucuauauccccuugauccccacacccuuaggaacguacaggagagagacccuggagcauaucagcuuagagauggaggggaaugggaaggagugcguucauucauucauaaauguugacugagcaccuacuguaugcuaggugaaugggaggacgugagggcagggaggugacaagguuggcuuauucugggcuuugugaacuauggugaggauuuuguuuuuuuccaaaggaaauggaauaaccacuccuuuuuuccccccgauauaccuaaacuuuuugauuuucauaacaaaaaugggcuuccuuuuguauauuuguuuugagaccagccguuuuuccaccaacacugaucacacugcagugagcauccugguagagaagucuuugcacacuucugucacuguuucccuaggacagauuccuggaaaugguauggcaagguuguaugucaggcuuuugggccagguugcaagaaacaggaagucugugcccuuucaaauuccaagguccccuuucccugacgacguggcccaaucaggcuugcccucccuugauuuuacaucuucaccaaucagauaagugaaagugaaauccuguugugguauccugugcauuucuuuggugacuuaagacauagagcauuuuccagaucucugugggcuguuuggauauccuuuccucuguuuucucaggcacauucuuuaccgaugucuuugagggauugagcaaguuucuguugaaauugaggcaugucauggcucuguguggggcuugaggcaguccaguguaguggagggagggaggcuguggagccuggcugccuagguucaaauaccaacucugcuuauuuccauucauaucauuuuaggcaaaucacuuagcccccugggccugccuuuccucaucaguaaaagugguauaacauuagugccugcauuguggggugguugugaggaaagcagcacucaaaacaguaccugacacacagugggugccaaauaagagucugauguauuaguguuauagguaucggccuccucccuccccagugcaauagugugugugcgccucuguguaccucuguuggugcugacaagcccuuuuuaaaauuuagaggugaggucucacucuguccccuaggcuggagcacaguggugcaaucauggcucacugcagccucaaccgccugggcucaagcaauccucccagcuuagccuccugaguaguugggacuaucggugugcaccaccacaccuggcccuuagacagccccuuuauuucaaagcgaaauggcagccacaagauuuagugcaagcucuccaagcuuuaggaccagcugcaacuccucuaacugaccaaacaggaucccccauguccccaacccccaaaaccugaugaaaagcaaacagaccauuuuccacauucaugacggaaaggcccuuuucuuggcuccugcccuugcucaugucaggauuucacuccaucccugauaaagaggaagcaccaugucccaggaggacauggaaacucucugcuuuguggugaauaguuacaguaacaguagcuccucucuguggggagcuuaugagccccuaagcuuuauagaacugcccuggcaguuuaugagaacuucaucccagcccccagagcucauggcacuuauuuuugcccccaguuugcagaugugcacacugagacucagagagcuaacacugcuugccaaggucacacaucuagcaaauggagaaacuuuaugagacaggugaaggcacagcaaggauaaaaacccagagggaaaaauacucaaguuuucuccgggaaaccauuugcauuccagagagguuggugugcgagugggcaagagaugucgcgggacgaugguuaagggacagagucugagcucaacuaggacuagguuucuuccuuuccuuccuuccuuccuuucuuccuuccuucuuccuuuccuuugucuuucucucccucccuuccuucuuccuuuccuuccuuuccuuucucuuucccucccucccucccuuccuucuuccuuccuuacuccuuuccuuccuuccuccuuuccuuccuuuccuuucucuuucccuccuucccucccucccuucuuccuuccuuucuuuccuuccuuccuuuuuccuuucucuuuccuuucuuuccuuuccuuccuuccucucuucuuccuucuuuucuuucuuucuuuucucuuucuuucuuucuuucuuucuuucuuucuuucuuucuuuccuuucuuucucucucucucucuuucuuuccuucuuucuccuuccuuccuuccuucuuuucuuuucuuuuccuuucuuuucuuuuguuuuuugagauggagucucgcucuguugcccaggcuggagugcaauggcacaaucucagcucacugcaaccucugccucccgguucaagcaauuuuccugccuuggccucccaaguggcugggacuacaggcacgcgccaccacacccagcuaauuuuugcauuuuuaguagagauggaguuucaccauguuggccaagcuggucucgaccucuugaccucgugauccuccugccucagccucccaaagugcuggcauuacaggcgugagcuaccacgccugggcuaggacuagguuucuaucggugguguggcuuuugggaagcuaccuaaucuuaaccacucuguuucgucaucuauaagauaagcaguguagcauuuucuugcaggaauguugcaaggauuaaguggauggugacuguaaaacaucaugcguggcacauaguaaauucucagcagguagucauugcuggucauuuacuuuucucuaaugaccagcaagcucuuaauuuccuccuuggcaugggcacugggacguagauggacaaaacacagagagaaauaaacacacggacaaaaauccccgcccugguguggcugauauucuggguggggagagagagggaguccaaggaccagauaaacagguaaaggauaguuugagugugguaaguacuaaggcucaaaaauaaagaucucccaggugaucuuagcugcauuuggaggugacaggagauacaacugagaaacugagauaggaggaaacccaaggggagaugugggcuugauuuagggugaucugaggaguaggagaagucaggggcugguguggggaggcucugaugguucucucuggggagugaagcagggauucguuggggagacccaaggggacaggugaaggccccugaacagguggccagugcugagaaaggaaagguggaggacccaagugaguuccuaauuucuucauugcuccccuaagguguuugucucacccuuggccauagucuuggaucacuuacagaugcagaccaggcugggcucaauggcuugugccuguaaucccagcacuuugagaggcugaacccaggaguuugagagcaggcugggcaacauggugaaaccccgucucuacaaaaaaauacaaaaauuggccgaggguguuggcacaugccuguagucccagcuacuugggaggcugagguaggaggaucucuugagcccgggagaccuaugcugccaaauaagguaggcaguagccacacauggcuauugcaauuuuagaaauuaauuacaggccacaugugguggcucacaccuguaaucccaacacuuugggaggccgaggcgggcagaucaugaggucaggagaucgagaucauccuggccaacauggugaaaccccaucucuacuaaaaauacaaaaauuagcugggcaugguggugcacacccgcagucccagcuacucgggagacugaggcaggagaauugcuugaacccaggaggcagaggcugcagugagcugagauugcaccacugcacuccagccugggcaacagagagagacuccgucucaaaaaaaaaaaaaaaaaaaaaaaaaagaaaagaaaagaaauuaauuacaauaaaaacagucccugaguuucacuggccacauuugaagugcccgaugacccuguguggcuuagugaccacugugcugaauagugcagaucuagagcauccuacuggacauguugccagggucccugaaccaacagaauuagcaucuccugggagcuuguuggaaaugcagaaucucauccccuaccccagaccugcucaaucccaaucugcucuucagugagauuccucaggugaucuugacugcaccuucuaaucacuuggaagcuuuaaaaaugcugaggcugggcacgguggcucacguguguaaucccagcacuuuaagaggccaaggcggguggaucaccugaggucagaaguuugagaccagccuggccaacauggugaaacuccaucucuacuaaaaauuacaaaaauuacccaggugugguggcacacaccuguagucccagcuacuugggaggcugaggcaggagaacugcuugaaccugggagguggagguugcaguaagcugagauggcacugcugcacuccagccugggugacagagugggacucugucucaaaaaaaaaaaaaaaaaaaaaaaaaagaaaagaaaaaggaaaaugcugaugccccaagcuccacccccacagaugcuggagagauuuguccagggcuuccccuggaguggggaauguuugaaaacuccccaaggguuucuaaaguucagccagaguuagcagaaagcccauuagguggcuaagcagguagacugaaguuggagcugugugaccuugggcaagccacuuacccucucugaaccacaagcucccuucucucuaaaacuagagaccugcuggcaccucccucccagggcugugagaaguaaaugaugggaugauucaaagugcugaguagggucagaugcaguggcucacaccuauaauccuagcacuuugggacgcugaaaugggaggauugcuugaagccaggaguuugagaccagccugggcaacauuuaaacauuacccagguguaguggugcaugccuguaguccuagcugcuugggaggccgagguggggggaucccuugagcccaggaguucaaggcugcagugaacaaugauggugccacugcacuccagccugggggacaagagugagacccuauuucuaaaaaagaaagaaacccaaaaugcugagcgagugccuuggauugauaguaagcagugccuguguaauaagcaugaauuuuaaaaaaugaggucagcagccuuagagcuaaugguuaauggguuugggugugggauuuuuuuuuuuuuaauuuuuaaaacauugagauaaaauucccauaacauaaaauugaccauuaaccauuuuaaaguguacaguuugguggcauuuaauacacucaguguugugcaaccaucaccucucuguaguucaaagaccccaaaaaggagaccccguacucacugagcgcucacucccugucucuccccgcucccccagccccuggcaacuacuaaucuucugucuguauagauugaccuauucugauuuuggggguuuuugaacucgccuucccuggcugacaaccucucgccauccaggugagacugugugaaagcccagcucccugcauuucugggucuuccucuccccacugggggcugcccccaccuguuucccccucugggcacccugguucuacucaucagccuggcuuaaucccagcagcagguccauguucugcucuccuguggcugccacaaaugagagguuucaucucagcuggguuucuccuaguuaaauauuuaauaaauaagaccuacaacuugugaugcugggaguguuugauagugaaauuaaugauggggagagaguggcaggcggcccacagguccaugcuggagcugggaugaggcgcccugggcaggcguccgugccacugaugcuugggaaccacggugggccaugccaucccauuucccccagccagggccucuuuuuuagcacuguguccagcacaggguagccaccugauaaauaaguguuaaaagaaagagaggcugcguguguagggaagaaggaagagacagaggagacaaagaggagacacagagagagagagagagaugagagagaaagaaaaguggaaggugagaaagagacagagauggaaggggagagaaggaccuggauggaggaagugcaaggaaggcaauggugagggaaaagagagagagacaaagauggaagggaugaaggagagggagagauauggagguagagaaagagagacagaaagaagagagagaauauugcuucuuguaucuuccccuucuccuguuauccuugaccaucuuauuauuuuuuucuuuuuucugucucuccaguucucauuuccuuacccucgccgucuugccaacucgucaucucuuuucauuuccugugucuauguuaucuuuuaauuuucugucuggguauuuuccccuuuucucuuucucagcauaaacuguugguugguguaugugucuucuuucuuuuuuagucuuuaacugacguguguguguaugugugugugugagagagagagagacagacagacagagagagagagagagagacagaacaaaccuagagagcaguguaggaacauagaugaacauuuuaaagaccaaaccaugaagcguacacccauuuuacccaggucaagagccacagggccaccaucagauucucccucaugcucauccucaaucacagccacuccuucccuccuggaggaaccacuauuggagauuguaugggaaccauucgcuugcuuucuugugugguuguaccaccuaaguacgcauccugaagcaauauagucagauauuaugugguuuugaguuuuauaugaauaaaaucaugugagaggaguuguuuuguauuuugcuucauugguuugcaguuaccuuugugagauuucauccucauuguggucacugcagcuccuucaugaucuuguuuauucauugaugaugagcaugugacuuuguucucuuuugggcacuggcauaagcagcuuuguugguuguuuauggauucugcugcucgcuugcaggggucucucuggagcacaucgcucugugugaaauuguuggauacuaagauuuguacauuuucaccuugacuaaacacugccaaacaauuuuccaaagugcuugugcuaauuuacacuccugccgguggugggugagcauucaagaugcuucacaaccuugccaacacuugguauugucagguuuuuaaguuauagccuuucucauggugauuucucauugugauuuuaguuugcaucccccgauugcaaauuagagugaacauaguuuaaaauauuuauugacuauucaagcuugcuuuuuugugaagugccucuacaugcucuguccauuuuugauuaggucacuuuuaaaaaaaaaauauugauuugugggugauccuuacauagccuggaaacugauucuucaucauuauauguugugcaauauuuucucuuggcuuggcuuuugaucuuuuuuauaaugucuuuugaucaccaacaguucuuaauuuugaugugguugauuuuagaaaucuuuuccuuuauaguuugugggcuuuguaucuuauuuaagaaaaucauuucuacccugaggccauggauauauuuuauguuauuucugaaaguuuuacaguuguguucacuguaugucuuuaaucagcuugggauugauuuuuauauguggugguagguagggguccaauuuccuuuuuauuccauaagaauugucccagcaucauuuauuaaaaagcccauucuugccccaaugaucugcaagacaaccucuugacuguuuaacuuuuaccuucuuucaucuggucuguuuuuauacucaaccuuugaagccacaaauauuuauugagugccaacugugugccaggcacugaguuacagugacggauaugacagaugcaaucauggcuuucauggaguuuacagucuggcaaggaugacauguaaauaguuauuacuacuuauaauuuaaaauguuauaggccuugcaaaaagggacaagucuggcuugcucuaaaagaaacaugugaaacaacaucuuccagggaagugcugauaaacugagucuuuagugggccucugcuauuguaggggugggaaugguggaaaagauguuuuggccacagggaacagcaugugcaaagguccuguggaaggugcuuaggaguuugauauuuauccuaaaggcacugucaggcuacugaagcaguaauacaaugauuuuaugucugugaauaguuccacugguugcugcauggagaauguauuggaauacagcaagaauaaaaagccaugagaccaauuaggaaaugauuucacucauucagggaagugugccuugggcuggcaugguggcuguggagauggaaaucauugaucagauuaaaagaaauuuugagcuggcaugauuuuuccccucucuccccucucucuaucucuguuucuuuucugguuguguuuucugggugagaaaagcaguuugugauccugccaaggguaugugcucuggaggauguauuugccacagauggucuuuggaauucuggccaagagagucacuggacagccccuggcccccaggguuucuggagccaauucaacaaugacuguuuauuaacaacagcaaggaugaguugcuagccuuuccuucagagcaccuuuuaacuguuaccuuacuuuguuacccaaaccgacacuauggaauuggugggggagaaguggaaggguuuuuaucuccauuuuuuauagaacgggggaaguuaauuggcacucuugaaaucauacaaaagauguugguuucaggauugguuucuggacuuucagcccaaucccaauuacucaagcucacacacccaauccccaaacauacucuuuugcaaauaauuucccuacugaggugcuccuggccaauuuaaaagguccccauuuccuugccuauaaaaugggaauuaaaguaaaaauaucuaccuguugacuugcugugaggucagugggccugacacaugguguggacucauuauauuuaccuaugugaaucccuuaguucccuuuacuuggaagagguggaaaacucaaaggggcuuaaacaagaaguggggauuguauuggcucaugagacugaagagucucaggaguguccagcuucaggcuuguuuggaucuagggaucagauaacaccauuaggccucuguuucuguuucuuggcucuacuuuuugcagcuggcuccauuauccaugacuuagcugcacuuccagcccuccagucugcccaagaccauauucagagagagauucuucucucuuuuucagcuaucuucccggaauuuucagcaaaugcuuucuugcuuuugauuggcuguugcugaggucgugugcucaugccagaaccaaucacuguggggaaaugggagguggagaacggggugcucugauuggcuuaggcuugggucacaugacuuuauggaguugggguggagccaacuucuccaaguggggaagagcagucuucuuaaagguguauuaggauaugcuugcugcuguaacaagcaacccccaagucugcaguagcuuaaggcaauacgaauguacuucucacucacccuaaauccaaucagauaaucagcaaguggcauuccauguggugauuucaggacccggcucuuuccaucuguggcuccaccauccccuaagaucagaaaguccuucacuuccggccuguaggaaaagaguaugaaggcucacacaggaaguuuugggaggccacauauagaaguagugaaccuuacuucugccugcauucuguggacuggaauuucaucccaugguguaugagagagggucccaguaggaaacggaagacacagaccaagaaucaaauuaagagauagcuuaagaaucaaauuaagagauagcuuacaaaggugugggcccuuacugaaauagagaaggaggaagagaggaaggaggcagagacagagagagacugagacucacaaagacacacacacacacacacacacacacacacacacacacacacacacaaguugagagaaagaaggggggagagaaagagagagagggagcauuuccuaacaggaagcuggcagaauaaaugucccccauuguccaaagccagagggcugggagcccagugagcccauccacacaggucagccccccaugugacaguccuagaaggguaaagaaggaaggagaguggauuugggguaauggaagacagccaauacccaugguccaucugacugcagggggaacugagaaauucaguccauggagaagaagguuuaguggacacgucacuuugucuuuuucacaaagugaaacuagguucucagguggaaaaaagaaaaagaagguuugccuugcugcuauucuuuuuuuuuuuuugagacggagucucacucugucacccaagcgggagugcaguggcacgaucucggcucacuggaagcucugccuccuggguucacgccauucuccugccucagccucccgaguagcugggacuacaggcacccaccaccacgcccggcuaguuuuuuuguauuuuaguagagacgggguuucacugcuagccaggauggucucgaucuccugaccucgugauccgcccgccucagccucccaaaaugcugggauuacagacgugagccaccgcacccggccuccuuacugcuauucuuauuauuggugguagcagugguggugaugguuauugguucuuaguucccucuacaugccaguaucugcucucuucuuuuuuucucccuuacuucuuuccuuguucugcaaauucuuucccuuuaagugaaaaucuuuccguguucuccaagggagauaaauucuaugccaagcuugagugugggguccucugcuuggauagcugucuucuccaggagaugagguagaacugagauagugggggucucugcaggcagucugugccccuggcaagccccucaccuuaaccugaggcuggguggggaaagaugccuugauggagucagaacagaaagcaagugaucgcugccugaaccaagcagucacuuuccuggaggugaaaccuagaaacggucccucaggcuggguccagggagguggacuugggucccaggggcaggaagcaaccugccccucaccugcuccuaccucuuuguagccuaucuuggcaaccagaaguagguauacaagugacguugaagcugggcauguuaacaauggugugagcccgccugacuccaaucugguccagcuguacuggccgugcauccucaucuccagcccccagggucagcccagcggcuguaacaauggucuguccccuccccgccccacccacuucuuugaacuccuccaaggaucugugaugauagggcugucacugucuuagcuuccaccauucaagcuuaaccggccuucuuccccuccauggagaacggaagagcaaccccucauugccucuggcagcugaccagcaggucccugccuucugcccacucccaggucuaggacaaugaggugagagguagacaggaccaaguuccccagugcugucuucuagguccaccuaucaugagagccgugauuccuaguuuuuaucacccucuccccaacuuugccagcucuccacuucuggcagugguggcugcccaugacuucaccuucccgugccucaguuuccucaucuguaaaauaaggacagccaugguaaugagaguucuggucaauaugccaggcaccucgcuugcaucaauuuagcucauccuuucagugcccugagggguggguacuguuaucaucccguguaacaaaaagagaaaaccgaaacagagagagagacucacuaucugaggucuugcaccccucaagcaacaaaagugggauuucagccuaggcuaucuagauucggaguccacggucucaaugaauaauaacaacaauaauaauauuguccuaaucugaugaguuuuugaucagauucaauacaagagcauaggcagaaaagcuuagcccagugcccagcacaugguaagaacucagcauguuauuuauaauaguaauaaaccauuuuauguuauguaauuauauauucauagauaaauauaguugacucuugaacaacauagggguuggggcaaugaccuccugugcagucaaaaauguguguguaacuuuuuuucucuauuuuuuagaaauuuuaaaauuagagacaaggucucgcuuuuguugcucagguugaucucgaacuccugggcucaagugauccuccugccucagccucucaaagugcuaggauuacaggugugagcccccgcacccagccuguguauaacuucugacucccccaaagcuuaacuacuaacagucuauucuugaccagaagccuuaccaguaacauaaacagucgaugaagacagauuuuauauguuauaugcauuauauacuguauucuuacaauaaaguaagcuagggaggagaaaguauuauuuuaagaaaaucauaaggaagagaaaauauauuuacuauucauuaauuggaaagggaucauuauaaaggucuucauccucauugucuucacauuaaguaggcugaagaagaggaggaguuggucuuguugucucagggguggcagagguggagguggaaggggaggccagaaagacaagcacgcuugguguaacuguuauuggaaacaaaucuacauaaguggacccauaaaauucaaaccugaguuguucaggggucaacuauauaugcuacaaauacguaauaugcuaauauaguuguauguuauuguuauaguacggggaucagaaaauguuuucugcaaaggauuagcuagaaaaugucuaguaaauacugucucuuugggaccacucuacucugccauuauagcaaaggcagcuacaggcaauacguaaaugaaugggcauggccauuugccaauaaaacuuuguuuacacaaacaagccaugggccagaguuugucaacggcugguauaguauauguuauuauauauuagcuuuacuuuuucuguugcuuuguuuauguucuucuuugcccuuccuuucuuaaaggccagccuuucuuucucucuguuggucugucuuuuaggacagcauggcaggccacugggacaugggcucuccugacuccaggcuuguuugucugauaagacaugaagagugaagguggcaggacucugagcucaggccuguccuccuccucuucccucucuucguuuuuucuuuccucuuuccucuuuucuucccaagcuccagaaguugccauuuuccuuucccauugcugauuuucucugccuugggagaaagcccgagaagaucacuuggaaaagcccacgagcaucucuggccucacucacccagcuccugccauugucuuuacucuuccucagacacaccaggcacaguccuaccucagggccuuugcacuggcuguuuccucugucugcauuguucuucucucaggugaccucauggcuucucccuccucuccuucaggacuucacucaaaggccaccuucucagcauuugccucccgcccuucugccuuauuuuccccuuuggaacuuuucaccuucuuacuuacucaucugucugcuaucugucacccuacaucacuaugaucuccacaagggaaggugauuuuauucguuuuuuguucuguuuuguugaagaugagguuuugcucuuguuacccaggcuggagugugguggcacgaucugggcucacugcaaccuccaccucccggauucaagugagucuccugccucagccuccugaguagcugggauuacaggcacccaccaccaugccuggcuaauuuuuguauuuuuaguacagaugggguuucaccauguuggccaggcugaucucaaacuccugaccucaggugauccacccaccucagccuuccaaagugcugggauuacugugagccaccacaccugaucuuuugguuuuacccaccaauguggacuagaacagccuagaucagcagguggcaugcaguaagcaguugauaaauauguguuggaugagugagcacuguggcuucugucauucuguugcucaauagcauucaucuggaaauaaccacaguuuguuuauccauuuaccuguugauuggcauuucuguugauucucguuugggccauuaugaacaaagcugcugugaaauacuuauaccuuugcccaauucuucacuuggugaacccuuauaaauccuuuaggccaggugugguagcucacgcuuguaaccccagcacuuugggaagccgagguaggaggaucgcuggaggccaggaguucaaaaccagccuggguaacauagcaagacccgucucuacaaaaaaauaaaaaauuggcuggacguggcaaugcaugccuguaguuccagcuacuuaggaggcugaggugggaagagugccugagcccaggaguucaagaccgcagugagugaucgcguccugcacuccaggcugggcgauagagugagacccugucuguaaaaaugacagcaacaacaacaauaauaaaaccuuuagguuuccucuuaaaaggaacauccuuagagcuuuuccugacccagcaacucaccccaagucugaauuagacuucaccccauuucuuucauaacauuuaucacaaugacauguuuauuuugugggggcggguggcauucuggccagaacugucgacuuccagagugaaaauacggaagaaccaaauaaaacacaacacacacauuugcacagcagcucgagggaggugcuuaguucuuugaguuuccaagaacagagagacgaagauuugucuggggaggaaaaaucagggacugcuucuuggaggagguggacuguugcugccccauccacccacacauuugcagauguggugaugagaagaugacugucacgaggucucugagcccagggggcccaugguugagugcaaagauagugggguugacaaauaaucgucguauaacaaaagaaaagccaccacaguugcauaauggaaaggcggcuucuauagaacauucagaucauaguugaaggcaugucacacuguguuacucagaggccacugucagagccaaaagugagaguggaugagaguuugggcaggaaacaacugaaccagauacagcaucaccuccaugagggcucagcuuuaucuauuuugucuucuguugcauccccagcccuuagaacacugccugguccaucuuugcugugugaauaauaauaaggaacgaucgcuguguugaguuugggcugugaauucagacaguuugcugcugcauaccugauuaugagucucaguuuuccuccuccauaaaaugggcaaaacaguccuugccucauggggcugugcauuuguuuagcaaacacugaaggaguauacaugguggccaaggcacucuucaagacacaggaagcagacaaaagucccugcccucugggagcuuacaugcucauggggagagauguaugauaagaaacaaaaauaguagguaaguugcauaguacuuuagaagauuauaaggguaaugggaagagaacagcagagaaagggcuggggaggcaguugcuguauuagauagagcuuuaucgaggcgauggcauuggagccaagacuugaggaagcugugaggaugucuagagaaagaaggaacagcuggugcaaaggcccugagguagggguauaugugacaugugugacagugaggaggcagauguggcugaagccagugagcaagagagagggaaggugcaaggauaaggacagagaggugacgggacagguuuuggagggccuuaugggcugcggggaggacuuuggcuuuugcucugagggagcugggagccacggagggcuuuugagcagaggagggacgugaccugacucagauauucauaggcuccucuggcugcugugaaaagaacagacuuugaagguugggggcaggcagggcagaagcuggggaauuaggaaggaggugacaguguugguccuggcagguaauaguggggguggaaccagguuguugucuguggagauaauaaugaguggcuggauucugguuauaauuuuuaaguuuuuuuauugugauaaaaugaauuuuuuuauugugauaaaaugaaauuuaccacuuugaggugugcaauuccacagcacuuacuacagucacccuguuaugcaacagucaccucuauuuaaucucagaacauuucauccccccuaaaggaaacccugcacccauuaguaguuacuuccaguuucucccuucccccagcuucuggaaacuacuaauucuggauauaaguugaaaguugaccaguaggauuucuaggcagacagguggugagggcucaaugcauucaugcacagaaaguacucagguggcauaucauaggugcucaaaacugaaauggugaugaugaguuggcaaugauggugaguccuuccagaaucccugcucuagugcuaaacugaccuaccuggcuguguagaauucucaccugcuggccgggaggguggcagaaccaggaucccuucuuacuuccagucuggcuuggguuagggauaggggaggaaugaucagaagaaccaagcuagcaccaucuguucuggaacaucauccaacucuuguccagauuucccagaacugagcaggaaaauguccagggaggaacagugcagcugauggaaguccugguaagcccuggccccagcuuccugagcugcuguugcaccaacuagcauuuguuggaccuucagucugagccaagauggcagcuucagaggaagaacaagaaguguacaaguuucuuucaugguuguguccccgccuccuuauauagccucauauaaaccccugcacuaucccguuacuguuugccucucccugaaaagaguguaaaacucccccacuuuuucccuacuuuucacaauguguuuugguuucuaaagaugaaacuccuuuaauuauguucugguuguaauuuucuggcuccuuuuauuucucccuuacuugauguauuauuuucccuuguuccuucugcccccugccuccauugauguuucucuucacugcuaucuagauuuaauucucaacuccugccaaguucagggugauagugcaaaaagacauggaccauuuagucuugaauucaggucccacuucugacaccuucaaagcugcuuuacuuugggcaagucauaugaucuuccugaggggguauccuuuaccuuguucagcuaacauuucuuguuuuucucugggcacagaguagagugucauuuuccccaccucccugaaguuagguauggcugugugauuugguuucaucaaugaaaugugaggggaagugacgugaguccuuccggacagaagccuuaagggugagcaugggauucaccauguuuccuuuuuccugccuccacugucauggaugcacaaagauggacccucucucaaaguaagugcuggagagaggaugacauagaucaguccccaucccacuucauagcaugaguagaaaaauagaccugggguguguucaaccacugagaucuggggauuguuuguuacugcagcaggacauagacuaggcugacuguauaccucauuaucugcauuuuggggcugauaucuaaucacagugucuccaggaagauuauguugauguauguuuuagggauggauauucauauuuuccuauaagggcucaauagguuuggaaaugucacaugcauguaaacuucugauuaacaaauauuucuugcuuuccaauuucuuccuauagugcuucuaauuuuccuguuuuucaaucuugaauaaaaugugagaaguguuugacuucuccuucgaggagauuaaugguuucuaaagccuggggcauugauuuagucauucucaaccuccuuguuucuaugaccuuuuuuucuccuucucuggucacuuagugucugcuaaggggugaaggaaugucuguuuuaacucauugcauuuuuuuuuuuuuugagacggagucucccucuguugcccaggcuggagugcaguggugugauguuggcucacugcaaccucugccuccuggguucaagugauucuccugccucagcaucccaaguagcugggacuacaggugucugccaccacucccggcuaauuuuuguauuuuuaguagagacgggguuucaccauauuggccaggcuggucucgaacuccugaccuugugauccgcccgccuuggccucccaaagugcugggauuacaggcguaagccaccacaccuggcaaacucuuugcauuuuuaacucuugacaucuucaucuucuuuuucccaccuccccuuugccuguuccuccccugcucaccccaccagggaguuuauaaucagguucuagaaccugcaauguuuuucuguuguugucuuccaucuuccuugagucuuaugggaaucggccauagucgcaaauuaacaaauagcucugaagcgccucaagcuuggaggcauuuccuuuugcucaccuaagcaagauccuggagcuguugcaaauauccugcccccuacuguaaaucugucuucaugguuguaagagauucagucggggucagugaagacccgagcaggagaucuuggccgaggcuccuugauguucugucugcgcuggguguugucauauugauuaagcuccugggacugcugccagcagccucuaggauuaaaucaauagaguuugcaaaaguaaaagcuucuuuuggagacacagaauauguggguuuauuuuuuaaugauaaagcuucaaggagaaucuucauggauggcagaaccagugauggaaaaggcgaggcagacccaaauauuuggggaagugcaguggggagcaagugagggagguuucauugggaggccggggcuuuccagaaaaucuguuuaacuggaguugcuaaugcaacagcucagaguuagaagugaagguggaagaugcaagaaggacugccgcugagauguaaagagaaaugaaggagagguggauccauuugcucauucaauaaacauuuugggaggcaggggggugggggggagccugccaugugccuggaacugggauguacaugguggggacaugacagugggcaggacagaugugguuccuccuggcccuccuggaacuuguaacaggaaaagaaggcauaaaauaaggaauaggcaaauacagacauaauuacuaauugugguaaguguuugggagaaaaccagcaggguccuguguuuguuuccuagggcugccaggacaaauugccaugaacuauauggcuuaaaacaacauaaauauauugucacccaguucugaaggcuggaagaccaaaaucaaggcaucagcagugcugagcucccuuggacggcucuagagaagaaugcuuccuugauucuuccaguuucugguaguuguuagcauacauuggcuugauuggcuuguggcugcaucacugcagucucugccucugucuucacauggccuucuccuucaugucagugucuucucuuccucuucucucucucucuuuuuuuuuuuuuugucagggccucacucugucacccuguacaagaguacagcagugcaauuauagcucacugcaacugcugcuucccagcaucaaacaauccucccaccucagccuccugagcagcugggacuuacaggcgugcaccaccauacucagcuaauuuuuaaauuuuugauagagaugggaucucacuauauugcccagacuggucuugaacuucugggcucaagugauccucccuccucagccucccgaagugcugggauuacaggugugagccacugcaccuggccucuucugucucuuauaaggaucuuugucgauggauuuugagcccgucagauaauccaggacaaucucaucuugagaucucuaauuuaauuauacuugcagaggccguuuuacuaaauaaggucauggccagaggcuccagaggcuaaagcauggguaugauugcaccacugcacuuuaggcugggugacagagcaaggccccaucucugaaaaauaaaauaaaauaaguaaccuacuacaggcccuuugcguagaggauaauuagaaguacagggguaccacguaagugaagaccugaagguuguuaagcacagagcagagugugaacagaaugagacagagggaggaagagaaucccaggcagagggaacagcaugugcaaaggcccuggggaaggaacaaguucaucauguuaaaaaugagccaguguagcuagagucugaugagcaaagggacucacaggugggaagacacccaagaaguuggcagagacaggucacacaagaccuucuaggucaaguuccggaggugaacuuuauucuacaugcaaugagaaguccucagagaagcuuaagugggaugggacagaacugcuuuacuuuaaauauauauacauauauacaaacauauaauauuacauauauaaagcauauauauguauacauauauacauaucuaucuaccugucuauauauuuuuuagcugggcaugguggcucacaccugugauccuagcacuuugggaggcugaggugggaggaucacuugagcccaggaguucaagaccagccugggcaacauagggagaccccaucacuacaaauaaaaauaaaaauuaaaaauuagcugggugugauagugugcaccuguagucccagcuacccgggaggcugagguaggaggauugcuggagccccaaagguugaggcuccaguaagccgugauugugccccugcacucuagcuugagcaacagagugagauccugucucaauaaaauaauuuuuguauugaggugaaauucaugcaacauaaguuaaccauuuuaaaaugagcaauucaguggcauucagcgcauucacaauauuguacaaccuccaccucuuucuagugcugaaauauuuucaucaccaccccuccagaaaacccuguauccaugaggcaguugcuccucauccuccccucccgguauccccccaacccccaccacuccugguaacuacaaauuuguuuucuguuucuauggauuuaccuauacuggcucuuucauauaaaugaauucaggcacugugugaccuuucgugucuggcuucuuucacuuagcauaaugcccuggcuucucucuggagaaugaaauggauagaccacuuuggagucuacugagauuauagauauuucugugggaagggacaguggcuugaccuuggguggugcugaagaggcaaugcugagcaggaggauucaaagucuaauuucggaaguagaauugguggggucugaugauacaucagcuguagggggaggaagauguaggaacugggaaggucucuuaggguaaccuuaccugauugagcuccuuacuaggcagcuggugguacaauucauaacaaagguuaauagagaaagagacaugggauuagggagggaauggaagaguuugggccuuggacacuguagugguuugaauccuguccaccaaaaauucagaugcauuuggaacuucagaaccugagaccucauuugaaaguaggaucuuugcagaugucauugagucagggauugagaugaggucauccuggauuacaguggacucgagauuccaugguaagugcuuuuauaugagaagguacaggggagaaagucauguggcaauagaagcagagaauggagugcugcagccacaagccaaaagacauguagaggcaccaaaagcgggaagaggcaaggaaggauccuccccuagagccuuugaagggaaacccccuaauuucagaaccuugccuccaggaugacgagagaauaaauuucuguuguuuuaagccacccaaucuguggcaauuugucaugacugcccuaggagacuaauauagacacuccuaugagaugcucuaagaagacacagagugguauagcuauugcuaagaccacacacuguagcagggaggaaaucaaauggagaaaugccccaacucccccuccucucugaucucuugcuggugccucccguuggccaagccaacccagaaggcagaagaugugguggagggcagcguugcagggcuuggaugaugcagucacagaagucagcccugccucuaccaggaugccaaacagggcaaugaguggauauuuuagggagaaagggcaacaagagaauggcaaaauacaucgaaaugcaugcaagcucuagaaagaggauagagauagauaaagggugauuaccuaggauuaagccccagggaagaccaacauuuagagauuggauagaaaaagaggagcaaaaagggaagauugagaaguagagaccaggaggauaggaggaaaacuagaacaacauuaagaagggcauggucaaguaaucugggcacagaaaaauggcccugggauuuggcagccugggggucuuuggugauccucuuuggaagaguuuugguugagugaugggggcuagaaaccagccuggggaggguaggagaagaaugugcagugaggaaguggcaggaacacgugaaggcaacucuucaugaaggggaguagagaaauugguugguggcugaaggaaaauuuucagucaaggguggagguuuuaaugauggaagaauauugauuucuguaaauugggucauucccauccauuauaccaauaugcacgggugucuucucugauauaggaugcugggauucucaaaugcccauuugaguuuagcaucaugaauuuaaugucaccagcccagauaguugaucucauucaggaaugcuccacugcccagguauggggaaggcaacuaguugaguucaugcagggauggauuuuuuccaggagagaaacaggaggcaagaaagugcgauauaaucaaccuauguaagguugacaaggcaggagaggguccugagaaauggcggggucaguggguugcagggcucgaugggauggacguugguuugcauuuaagggaguuagugagcugggaggugguuaaagaggaggugguucagccgggcgcgguggcccacaccuguaaucgcagcacuuuggggagccgaggcgggcggaucacaaggucaggcgaucgagaccauccuggcuaacacggugaaacccugucucuacuaaaaauacaaaaaaaaaaaaaaaaauuagccaggcgugguggcgggcgccuguagucccagcuacucaggagccugaggcaggagaauggcgugaacccgggaggcggagcugcuguacuccagccugggcgacagggcgagacuccgucucaaaaaaaaaaaaaaaaaaaaaaaaaaaagaggugguucaagacaaggaugcuggaaacagguguuuuggagguggcugguguagcuucugagcaugcauagcuggaguggcuuggaggagacauugguuauugaugaagagguagggacauccuccagugaucaaggaagcaggggaccagcauggacaauggucucuccacagggaaauuggaggucaucaaauguuaacagguuccgucggagucuuagcucccagcuucuguuuuccuguggaucucaggaucuuggcugcuggugcuaccucugacuuuggacuucccauugagcccagcagcacugggagggaccuucauggcauuggcugguuuaaggaagacuuccuuggcuuugcugacuuucuugggggccuucuuggcuacaccugcuuuugagggagcccuccucaccucaccugacuucuugggggcaccuuuuccaccuuaucugaguugggaaggucuuucuuugauucucuugcuuucuuggggcccuucucacugguuuuucugggggccaugaugguggacauauuccagagcugagcuuuccuuuuguucuuaggaacuaauuugaggcugccaguggccccaccuuggucuuagaguugauggucugcagggaauuuccagguuaaagguuuuuuauuuguuuguuuaauuuugagacagagucuugcucugucacccagguuggagugcagcggcacgaucuuggcucacugcagccuccgccuccuggguucaaacaguuuuccugccucagccuccuaaguagcugggauuacaagcacgcaccaccaugcccagcuaacuuuuguauuuuuaguggagacaggguuucaccauguugaccaagcuggucucaaacuccugaucugaagugauccggccaccuuggccucccaaagugcugggauuacaggugugagccacugcgccugaccuccagguuuaaguuuaaaccaugaaguagauggacuguguagagagagaccagggaaauggaggauuuuacugaccacugaacagggaugucacuauugccagagaggaaaaggauucccccuugguagagugaacauauaagggaaagugguugaaaauugaaucaggagacagagaccucacaccacucagaggucccuagagaacuuuacugaccuagaaaaaaagauaaacagggagaaggucuucaguucuuguuuggaaucugacacugaagcauccucacuccucacucucuucccgaccccgagagucugaaauugauuaauacuuuuuguuuaaaacuuggcuuguuguuuuguuuuuucuuucuguuuucaucaagggaucuuuauuuuacuuuuguguauuuguguguuuuccaugagucauguuaauucuuccauguuuaaacuuuuuggcccagaggaauuuauacauuuaaauuauggauuuaauuucagaagguacauacacacacacacacacacacucacucaucucacuuuuuaaaaacuguaaaauauagcccuguaaauauccagaaaauaucuaaugugggccggguaugguggcucaugccuguaaucucagcacuuugggaggccgagguggguggaucaccugaggucaggaguucgagacuagccuggccaacguggugaaacccuauccucacuaaaaauaaaaaaauuagcugggcaugguggcaggugccuguaaucccagcuacucgggaggaugagacaggagaaucacuugaacccaggaggcagaggcugcagugagccgagaucaccccacugcgccccagccugggcgacagacugagacucugucucacaaaaaaaaaaaaagaaaagaaaaagucagugugcauccccucugacauccagcaacuucacaucuuggaauuuaugcugcaggaaaauuaucacaagugcacaaggauguauggugagauaguuauuauuaucauuuuaaaagauagggucucacugugucacccaggcuggagugcagugaagugaucacagcucacugcagccuugaccuucugggcucgagugauccucgugccucagccuccccaguagcugggauuacaggugugagccaccaugccuggcaucccccuuuuuuuaaaaaaagguuuuaauuaugaaaagaauaugggcuuguuguuuugugugguuuuuuaaaagcuuaaaaaauguguagugugucauuuagaaggugaaaagcccuuaccccaucccaccucccagagauaaccucugcuagcaauuucguguuugucuuucaaauuuuuucccacacacauucuuuguacuggcugcuuccccuccuggguuacucuucucccagacagaaacagggcucauucccuugccuccuccagcuuuuauuaaaacauuaacuucccuguagcuggaugcaguggcucacgccuguaaucccaguguuuugggagguggggaggcaggaggauagcuugagcccaggaguuugagacuagccugggcaacauagcgagacccaucucuacaaauaaauaaauaaauaaauaaauaaauaaauaaauaauggaaauuuaaaagagagagggaaggacucuugaaaaccguccauaucaugcuucucuaaaugguugagggcucagaggaaaaaaaaucagcaauuucacaucacggaauuuauucugcagaaaaauucucacaagugcacaaggaugcguggucagaugaugaugaugaugauuauuauuauuauuauugaagaaaguagcagcagcagcagcaguauuuuaaaagacagagucucggaugggcaugguggcucacgccuguaaucccagcacuuugggagguugaggugggcagaucacuugaggucaggaguucgagaccagucuggccaacauggugaaaccccaacucuacuaaaaaugcaaaaauuagccagguaugguggugggugccugcagucccagcuaccagggaggcugaggcacgagaauagcuugaacccaggaaauggaggcugcagugagccaagaucgugccacugcacuccaugcacuccagccugggugcugacccagguuaggugcaagacuccgucuuaaaaaaaaagaaaaggaaaaaaaaaaaaaaaggacagagccucacugugucgcccaggguaaagugcaaugaguaaaggcccaugaugggaacccugaggagagagucaaggggaaagaaaaaaaaaaaagcaaaaccaaaauggaauuuaaaaaaaaucaggugcaauuugcauaacagaaaauuaaccauuuuaaagugaacggcucuguggcauuuacugcacuccaacuguuauguaacuaccaccucugucuagcuccagaacauuuucaccaccccuaaaggagaccuuguacccauuaagcagucucucuccuucuccccuccccaccaccuuccuccagccucuggcaaccacccaucugcauucugucucuauggauuuaccuauucuagguagucaacaggaugagauaucccaaaaguccauccauggaugaacagauaaaccaagugugauaugccuuccucagauauuagucugccuuaaaaaggaaugaaauacuaaucuuugcuacaacauagaugaaccucaaaaauaugauguggcuggacacaguggcuuacaccuguaaucccagaacuuugggaggcugaggugggcggaucgcuugagcccagguguucaagaccacccuggguaacauagcaaaacuccaucucuacaaaacaauuuacaaaaaacuagccagguguggugacaugugccuguagucccagcuauucaggagacugaggcgagaggaucgauugagcccaggaggccgaggcugcagugagccaugaucauaccacugcacuccagccuaggcaacagagugagacccuaucucaaaaaacaaaacaaaacaaaacaaaaaaguugaugcugagugaaagaagccagacacaaaaggcaacaucguguuuaauuccauuuacaugaaauguccaaugaagauuuuuuuuggcaacauuuauuuugaguauaauauucagugaguggaccacacauaugcaugcacugcaguauguucuuggaaacauuucagauuugagaggucuguucagcuaugaugacgguagguauugucccuucccucccuccuugaagaaaaggaacuaaggcuggacgcgguggcucaugccuguaaucccaguacuuugggaggcugaggugggcagaucacuugaggucaggaguucaagacuagccuggccaacauggugaaaccaugucucuacuaaaaaauacaaaaaauuagccagguauggugcugcacgccuguagucccagcuacucgggaggcugaggcaggagaauugcucgcacccaggagguggaggcugcagucaaccgagauugcaccauugcacuccagccuggguggcagagcaagacucugucucaaaaagaaaagagaagagaagagaaaagaaaagaaaccaaaagaaaaggaaagaaaagaaaaggaaccaagaccuagaagggcaaaaauaggaaaaguuggccgggcgcaguggcucacgccuguaaucccagcacuuugggaggccaaggugggcagaucacaaggucaggagaucgagaccacccuggcuaacacggugaaaccccgucucuacuaaaaauacuaaaaauuagccgggcgcgguggcaggcgccuguaaucccagcuacucgggaggcugaggcaggagaauggcgugaaccugggaggcggagcuugcagugagccgagauagcaccacugcagucuggccugggcgaaagagcaagacucggucucuaaaaaaaaaaaaaaaaaaaaaauuggaaaaguuauuuacuauuagcagcaauugucauaaaguaaugaacauuuauugcaugauuacaaugagauaaauuguauccuguuuuuauaagcauauuaaguuuucuuuuuuaaaaaaauguauguauuuauuuauuuuaagagauagggucuugcucuguugcccagacuggagugccaugguaugaucauagcucaaugcagccucaaauucccagguucaagcaaucuucuugccucagucucucgaguagcuaggacuacaggcaugugccaacaugccuggcuaguuuucuuauuuuuaaauguauuuuuguagagacaggaucuugcugugucgcccaggcuguccucaaacuccuggccucaagcgauccucugccuuggccucccaaagggcugagaugauaggcaucuaccucugcauuuggcccacauuaaauuuucuagucaucaugggaaccaaaauaaacaauauaaaacacucacauuccuugagcacuuacuauaugcagggcccuguaauagauuauuguguguaucagcucauuccauucucacacaaccuaugagguugaugcuauuuucuaccuuuuauauaugaggaaacugaggcucagagaaggaaacugccuugcccaaggucaaggccacgucugauccccaaauccuuucaacuccucugcacuacuauuuuuuagugcagauauugccaguuuucuaagcagaagcaugauuuagcagcccugaguagacuucucauuucagaaccaaaguguuggacauuguuggauaauaugaaaaacaaaugacacacaaaccuauuugauacuguuuuuaauuuucucuucauuugauuuuccugaugacaugauuaaucuuuuuugccucuacccuguaugugaaauguaggucuuugcagaugucucagagaguguuaauaguugcugcugguuuuguuuucucuccccggggauucccaucccugggugcaagugaaauuaaacuugugccucuuugccgcuggccguggugcugaaaacaucccgggcagcgcuaggguugcccuuguuagcaugccaucccugcuaagagucuuaggcugaucagcgaguggagagaucuuuuccaggcuucauuuugguuagaacuguguguugaagauuuuaaagcccaugucugggaacuggagacuguuuggauuguuugaaguugaaauagucaugaauaauuccuacuugagaugggcuuaugagggcguggacuagcaugcaaugguuggccuuuacuaaacuguggccauugguugggacuugggugagguguaacccauuuggucuaauccauaugguuagggccccaagugcaccugcauucuauuuuuuuuuuuuuuuaaauaaaggcaaacccaucuaucuucuaaccaggauagcuccugaguggucuuuggggaccaccagcuuaaaagcauagacugugggcugggcacaguggcucauaccuguaaucccagcacuuugaaaggccaaggugagaggaucgcuugagcccaggaguucaagaccagccuaggcaacauggugagacccucaucucuacaaaaauguuaaaaguuagccagguguguuggcaugcaccuauagucccagcuacucaggaggcugaaguggguggaucgcuugagccugggaggucaaggcuacagugagcugugaucgugccacuguauuucacccugggcaacagagcaagacccuaacucaaacaaacaaacaaaaaaaggcauagacuguggaguugggcagaccugggugugagccccagcucugccaguaccuccuaugugaccuugaaaauuuguuuaaucucucugagccuggauuuucuuguguggaaaaugaggcuuaccacagaacccaccuuguagaaauguugcaaggaauuaacugaaacaaagugcuuaccacgguaucugcccaaagaagcaguuggaaacaaggcagcuguaauuauggucgcugugcuuguuaauggccccauaauaguugaucauauugcagagugaaauugggguauguguuuaauggaccaaggaauaugucuuaaacccauauaucuaggguucugguacccucuacucuuuuuccuggugauugugaugagcauggaacuuacaugaaaaugaggucuguuuggcuucuucacacaagcucaaugaccuggcuaacugcuacaaguaucuguuuccuuagaacccacccaucagcaguccccauaguggagacaaggucacaaagaguugacaaaccugauuugauuuccgcaccaaccacaggaggcuugaaaugagaugagggugaagggcaccacagagggaugcaaggauuacuuggacacugcaaggucuugcuaagggaugggaaccaucagccacgcccacuuugagaauuuuccuucauguucugaaucugaagagcaagguccuguucucagaugcaagcccuccuucuucccuacgcagagucaaacuuggucuuuuccagggucacauacagccucucucuggggccucugcagguccugaucaauuucauuguguauagagcucugugucuccucaccugccugcagggcugucugcuauccugacuuccgagagccauuucggaagccagcuuuuccucccaucagggaugcuucucuucuuucagcccccgccccgcuuuggccuccuaggauggcugauuuuucuggaucccgcugacacaggugcuuucucuccgagccaaucagggagcagaaaggcucagcucagcuaacagaggcauugcucaccgcagcugugaguuagaacucaggcuuucuaaaucgggaggaucaggcaugacuugagguugggcugagaaagccucgccugccccccagcucgacuacccagugaaaccuuuggcuucugccucgggcgaggcaucucuuaccaugccaagaacucagcagcccaucuuucuuucaucugggcaccaaguacaucauugcauauuucaggggguuucauuguguccuuaacaugcucauggagacuuggcuugagaugaagucgggguuucuaggcagcaggacccauguccccuuccuucauuuccuccaccggugauuuuuguuuuguuuuguuuuguuuuguuuuguuuuguuuuguuuuugagacggagucucguucuguuguccaggcuggagugcaguggcguuaucucggcucacugcaaacucugcuucccggguucaggugauucuccugccucagccucccaaguagcugagauuacaggcgucugccacuaugcccagcuaauuuuuguauuuuuaguagagacgggguuucaccauguuggccaggcuggucucgaacuccugaccucuggugauccacccgccucggccucccaaagugcugggauuacaggugugagccaccgcaccaggcccuuccacugguguuuuuugagcaucuacuauauagagaaugcucuccugggcacagaggaugaagcagugaacaaaguagacaaaaaauccccacgugcauagagugugcagucucgugggagagacagggaacaagauaaagaaggaaaaaaauagcagaugcuugacuggggacggggacuaaagaaagaaaaaaauaagcaggcuaaggggguugauggaugugaccuuugaguaaaggccuaaaggaagugagggagggagucauguggaugucuggggaaagacuauuccaggagaaugaacagcagguacaaaggccccuggguacaaaugugccuggggaguuuggggaauaaaagggaggccggcguugcuguagcugagugacuaagggagagaauagaggagaugaggggagggagguaaugggagcaggucaugcaccuugcuggugcuggaaggacuuuguuuuugcuuuugagugagaugggauccaugggaaggcuuugaauacuuccacaugcauuaggcugaaauuuucuuuucugcuuuugucgcauuccaacauugcuuuuauuucaucaaaaucuucgguuucuucucaggcucuuuacccaagugggagcagaaggcugguacccagggcuguucaguucucccccuggggucagaacguggaggagaaagcuuggaggagaaacaggaacccccaccucuuucuggaugacucaaaaccgcaauuaccugagcuccuccuccuaucccugaaauagaggcacuuagcacuuccuaaacuucccggugcacacaaauccccuggcgaucuuuuuaaaugcagguucugacucagcagguggaugcaaggucuaaggcugcauuccuaaccggugcugguucugggaccacacuuugaguagcaagggucugaggucauuguugcagauguccaucuggggcaugucuguggacacuugcgggggugcgggugagcagagggaggggggaugauguuggaaaagcagugugaguaucuguguuugauaagaaguaagaaaaugaagcaaggugggagaguagaaccucuuuauuuuugccuacgugcuaagguuuuauugccauacccagagagcccugggucugaaauccaggcaacacuggccaguugaaacccugauauugcagcccauaaaagugcugcaugcugcaugguggacuucugggacucuuccuggaaccuucagugccagagccgguccaaaggaagucacaucccugccauugaggggcaggagaccagggaaccggaggagugggauggcagaagcgcguguaaggaggcugaguuggcagggagagaaagcgaagucagcuucaaaucauagcgagaggagaccagggaagggcuuggcguugcugcucuguguacaaauauugucucuuauuuuccaggcugcagggugaggcagaguggaguauuugugcaacacagcccagcuuuguucucugggcuccuaaugccugucagcucagaggcagaaagccaaucagagaugaucgucggcaaggccggcuuuuguuggcuccccaaauugcccugagucucggauuuugcuuuucagagugugcuuucagcuggaggcaaaggcugaagcuggugacaaaaggaagccugguuuuccuggcuuuccgagacuuuuacugaggggguuucuauuucagacuccguuuucccaccuggaaagcagguuccacucucccuccggccuggaagggaugguuuuauggugcuuccaaaaugccaaaccuaacuccagggcagaagaggagacugaaaccaauuaauuuuccaaagguuagagcuacgaggaggggagagguuuagcauggucaaguuccccaagacauacuaauugaucucucuacagaaugcgggauuucagugcccccaggggacacucagcaauguuuagagaccacuugagguugucaucacuggacaggaggggcugcuacuggcaucuagcacacacaggccagggauacuguugaacaugcugcagugcccagacagccccaccaaggagaaugauccaccccuaaaccuagugcugagguugggaaauccugcuccggaguaaccaacacccuauggcuuuuucacucaagcagccgcuucuccagcgcuuacaccuccucagagauugccagauccauaugcagagccuguuggcgugggacacuucugagggguguggcagggagacagcggacauucccauuuaccagcugaucagcagguuaggagcuaauaugaaaugaacaagauagacccuccccaccugcccugcagauccucuggugggacacuagggagggaggccuccuaaacccaaaugacaguucccaggaugcagggaggaguuuaccuaugcaaacuggagagaaugcaaauggggcaucuagagauacuuacuggacgaccccuccccugccucgggucuuggaagaacagauucucagaggucugcccugaucacuguaauuuuuuuuuuauugagguaaaauuaauauaacacaauuaaccauuuuaaagugacauuuagggcugggcacaguggcucaugccuguaauccccgcacuuugggaggcugaggaagaaaggucgcccaggaguucaagaccacccugggcaacaaaguaagacucugucucuuacaaaaaaaaaauuaggcacacaugguguugugcaccuguagucccagcuacucaggaggcugaggcaggaggaucguuugagccuaggaauucaaggcugcggugagcuaugaucaugccacugcacuccagccugggugacagagcaaaauuguguuucuuuaaaaaaauaaaaguaaaaauaaauaagaaaagaaaggagaggggaggggagaggcguuuaguacacucacaauguuguguaacugucaccuucaucuaguucuaaaacauuaagcagccacucccauuucccuugccauuccccaggaacaacaaaucugcugucugucucuggauuugccuguucgggauauuucauauacauggaaucauacaauaugggguauuuuaugucugcuucuuucgcuuggcauaauguuuucaagguucauuccuguucuaucauguaucaguacuucauuccuuuuuuuuuuuuuuuuuugaaacggaguuuugcuuuuguugcccaggcuggagugcaauggcacaaucuuggcucacugcaaccuccgccucccggguucaagcaauccuccugccucagccuccugaguagcugggauuacaggcaugcgccaccacacccagcuaauuuuguacuuuuuuuaguagagaugggguuucuccauguuggucaugcuggucuugaacucccaaccucaggugaucugccugccucggccuuccaaagugcugggauuacaggcgugagccacugcacccggccuacuucauuccuuuuuauggcugaauacuauuccauucuaugaguagaccacauuuuguuuauccauucacccacuggugaaauuuagguuguuuccaucuuuuggcuguugugaauagugcugcugugaauauuuguguaugaguguucguuggaauaccugucuuacgauccuuuuguguuuauaccuuggaguggaguuacugugugucacaugguaacucugugauuaacuuuuugaggaaccaaggaaugguuuucuauggcaguugcacugguguuuuuuuguuguuguuguuuuuguuguuguuguuuugagacagggucucacucccauugcccaggcuggagugcaguggugcagucaugguucacugcagccucaaccuccuggggcucaagcaauccucucuccucagccucccaaguagcuggcacuacaggccugcgccacuaugcccggcuaauuuuucauauuuuuuguagagauagagucucaguuuguugccuaggcuggucucggacuccugugcucaaguaauccuccuaccucggccucccaaagugcugggauuacaggcaugagccaccgcaucuggccagcuacaccauuuuauauucccaccagcaugaggguuucaauuucuucacaucuucaccaacacuuguuuucuguuuguuuguuuguuuuuaauagcuauccuaguggaugugaagcaguaucccguugggguuugauuugcacuucccugaucacuaauacccucauguacauauuggccauuugacugucuucuuuggagaaaugucuauuccagccuccuguccauuuuucaauuggauuaucuuuuuguuguuguguuguaaauguucucucuuuauuuuuuauuuuuuugagacagagucucgcucugucgcccaggcuggagugcaguggcacgaucuuggcucacugcaagcuccgccucccagguucacgccauucuccugccucagccucccgaguagcugggacuacagaugcccgcuaccacgcccggcuaauuuuuuguauuuuuuuaguagagauaggguuucaccguguuagccaggauggucucgaucuccugaccucaugauccacccgccuuggccucccaaaguucugggauuacaggcgugagccaccacaccuggccguaaauguucuuuauauaguacuagacccuuaucagauacaugauuugcaaauagcuucuccuauucuguuacuugccuuuuaacuuucuugauaacguccuuugaugcacaaaagguuuaaauuuugauaaagcccagcauaucuguuuuuucuucuguggaucaugcauuaggugucaaaucugaucauaauguuuuauuuauuuauuuacuuauuuauuuauuauuuuauuuauuuuugagauggagucuugcucuguugcccaggcuagagugcaguggcaugaucucggcucacugcaaccuccaccucccagguucaagcgauucuccugccccggccucccaaguagcugggacuacagguguguaccaccacgccuggcuaauuuuuguauuuuuaguagagacaggguuucaccauguuggccaggcuggucucaaaguccugaccgcaagugauccacccaccgcagccucuaucuauuuuuaauuuaucucuuuuuuuuuuuuuuuuuuugagacagggccuccuucugucacccaggcuggagugcagugguauagucauuguacacugcagccucuaccuccucggcucaagcaauucucucgccucagccucccaaguaccugggaccacaggugccugccaucaugcuggcccugccaccauauuugaaauugcagcccugaccccuuccacugucuauagucuucaccaucuuacuacauaacauagcauauaugauguacuguauaacaugguauaugcaguguacuguauagcauaguauacaugauguagucaucucauuuauuugcuucuccucugggaagcaggaggaagcuucuccucuugucugcuuugcucucaacugugucccuagcccagaacagagucuggcacacagcagguacugaaugaauauguguucagugaauauugugggugagauagaaggugaauauccacauuucccuuuagaagucaccugaucuggguuugagaucugcagggaucuacuccagacaggagaacgaauaauuccaccugugcugaugaguuggaaggaucuagagggcuugagaucuuuccacuggggucagugggggugggugcaccuccaacacccuucuuuucuuugaacaagauuuuuccuuaauuccccaauacucccuuugaauauaugauuuuagccaccaucauagcgaauugcaucguccucgcacuggagcagcaucugccugaugaugacaagaccccgaugucugaacggcuggugagugaugucuuuucucagggucuucuccuuggcuuuagcaggacauuaauuuuugggggaguggagcagggcacagaggaggcucucaguccuggagcccagagccagaucaugggaagccuaaauuuccuuuucauuuuuucuugaaccagagucucgcucugucacccaggcuggagugcagugguucagucauagcucacugcagccuccaccuccugggcucaagccauccucccacugcagccuccugaguagcagggacuacaggugccaccaugcccaguuaauuuucuuauuuuuaucuuuuuuuguagagauggggaucucacuagguugcuuaggcuggucucaaacugcccacuuuggcaucugacauaauuucaggcaguauacucaaaugaacauuguuaauguuaauaauuaugucuuggccagacacuguagcucaugccuguaaucccagcaguuugggaggccaaggcagguagaucacuugaggucaagaguucgagaccauccugaccaacauggugaaagcccgucucuacuaaaaaaauacaaaauuagcuggauaugguggugcacaccuguaaucccagcuacuugggaggcugaggcaggagaaucgcuugaacccgggaggcagagguugcaguaagccaagaucgcaccauugcacuccagucugggcaacaggagugaaacuccaucuuggugggggggaggcgaaaaaaaagaaacaagaauauuacaaaggauacagaugaagagaugcaaagggugagauauaggagaaggguguggcuggcagcuucuagguagcuucaggagggggacuggucaccagaaagaccaaggcaugauucgaggguugcgacuuucagccccaccccccaaccucugggagggcagaggggcugaaaaucaaguugaucaccaacggucaaugauuuaaauccaaaccucuaaucaugccuugguuuucccggugaccaacccccauccugaagcuaccuagaagcugccagccaucagucaauccuuagccugcaaaaagacaucccuuuggagaucccaaggguuuuaggagcuguacaccaggaaacagugucaaagaccaaacauacauuucacaaugucacagucuucuaaaaacuauaacuagccuagcaaaccuaugauuucuagaucuuugcauuuucacuuaaaauaaagcuaaauaaaaagcguccauugaaagacugguaagcaaguagaaguaccaguggcaagcuaauguggaaaaaaaaaaucauucaggcagagugaaaaugauuguagcucgagaaacguugcuguaacagaugggaaaacauucacauuggggcucugauggagaagagcuuguagcuuaauuucaaauaugauagauuagcagcuggaagccagaaccagccggagguucugcagaggaacuggaggugaggauacuggccacuuaucagccaguacagaaguccuauuccaaaccuuuaacaaucuacaugccagcugagaaccauccuaaggggucagauuuaggagugaggucaaugcacaagcucuagccucaaauaccuugaacgcugcaugugacaaguaaauucucuaaaccaaugcuuuccauuagaacuuucugcagucacagaaaugaucuccaucugcccuguccaauaggauugucacuugaaauguagccagugugacugcagaacuguguuuuuuauuuuauugcauuuaaauuaauuuuaauugaaauagccacauguggccugugacugucguauugaauaagacaggugcaaacaaauaauucuguuuagcugagugauaugugagguuggcccaaaaggaaugaaggaggaaggugccuucucuaggcauuggcuuugcucgcaaaaggcuuuggacaagagaacucugcaagaggcagugagggguggugagugcaggagggucaggggaagugagagggugauagguacugauuucuaggugggcugguucccugaucuugucaacaucugcccagcccaagacgcugaccuugccuucucucccuuccaggaugacacagaaccauacuucauuggaauuuuuuguuucgaggcuggaauuaaaaucauugcccuuggguuugccuuccacaaaggcuccuacuugaggaauggcuggaaugucauggacuuugugguggugcuaacgggguaaguggcgcgugcuauacgcuuuggauuuaacuagcugaaggauuacgaggcuuuugguuggugugguccgggccaggcucaggaaggcugagcccuuguguucucccuccccuuguuaugcgccugccuccuuucugccaacaccccaccuccaugucucagcuguauauuacagcagaugcuuucuguuacaauuaaaauaauagcucauuauuguuggcugcuuccagagugcuuuaugcccauucucuaauuuaauccuugcaacaacccacugaauuaggaaauauuaauauucccaucugaccacugaggaaucagaaacucagaguguaacuugcuuaaggccacccagcaaguaagugauggaacugggagaugaacagaagauuaugcauuccagaacucaagguuuuaaguguuguacgugcaugggucucuugauuugcuugaggauaucuugcuuuuauuucaacuuggugaauguuuuuugagaaugucugggugcaagggauugugauuaugacaaaggagaaaagcaagcuaaauaagguacaguuacugucuucaaggaguuuucagauccauauaugaugaacugugguugaaauguguauaugcuuuccucuaagcacccuguaugagguagcacuugcugguauaacaaaagauccaaagcuaggaaaugacuuaaacacggcagaaguuuauuugucacucauagaaaauucaaaauugagcugggugugguggugcaugccuguaaucucagcacuuugggaggcugaggugggaggaucacuugagcucaggaguucaagaccagcuugggcaacacagugagaccacccccccaucuguaaaacauaaaauaaaauaaaaauuaaccaggcauggugguacaugccugggagaauugcuugagcucaggaguuggagggcacagugagcuaugaucauccaaccgugcuccagccugggcaacagagcaagaccccaucucgaaaaaaaaaaguccaaaauaauuguuccuaguugacaggcucaucuccuccaaugacugacggacccugacccuugccauauuguggcucuucauugucagcccacaucauccaauaacuccaugcuugucuguaucaaaccaggaaggagaagugagcauagaaggugauacuuggaaagguuuaugaguuuggaaggggugugacccauaccuguuccauucauauccuauuggcuagaacucggucacaugaccacacaucacugcaagggaagcugggaaguaucagauugugcuuagaagaaaagggaaauggauuuggagaaugaccuacuagucugucagggaccuuaaaaacuuuuauuagauuccaguagggacauuaguaucugguaccaauggcugguuccuccucuucccacucucuacucuccucucagcuaagucugggcucuucuauucuaagacccuucuucacuggacaccuuuuucauaguaaucauuuacaggaucauagcuuuccauguuuuguugcugcuccagguucugucucucuuggcggaugugauggguugcagcacccacacugugcuggccgggcucucacaaugcagauuuguuucagagcaauguugccucucacagaaggagcuguggccuauugggcuguuucuguagaggccuucagaugucagcagucuguuguaaggacucugggcuagcucucaugggcuuggguguucacagagggaucuuuguuggcugugcucacaguucgguggcuugggaccuugguggguuccaagggcauauuaugguacugggcacuuuucucuuagucuacuaggaaacucaucuagaaacagccuaguggcuaacuuuuuuauuguuuaaaaaauguaaagcugggcaggguggcucaugccuguaucccagcacauugggaggccaaggugggaggauugcuugggcccaggaguuugagacgagccugagcaacauagcaagaccacaucuccacaaaauaaaaauuaaaaguguauaaagcuggguacaguggcacaugccuguaaccccaauuacucaggaggcuggagagagaggauugcuugagccuaacuaguuugagaccagcuuggguaaccuagcaagaucccaugcaaaacuaaguagagaauaauagagcaaacaccuguguauacauucauuuauucaaugacuauuuauugaacacuucugugugccagguccuguucuaggcucugggacacagcaguaaacaaaauagaaaaauccccuguccucauggagcugagagucuacugauggagauggacacaauugaugaaugaaucuagugugucagauggcggugagggguacagaggaaaaauaaagcaggggagggaugggauguguggcaggcaggggugaggggugcuggaagccagggaagacuucacugggcaugugacaucugaaugaaaaccuaagggaggugagugagugagccaugaggagagcuggaacagagugucaggcaaagggaacagccagugcaaaggcucugaggcuggacuguaucugacauguuugaucaacaguaagaagacccacauggcuagagaaggugaccagaagaauggggagaauuggggauagagaaguaauggaguaaccugcuaucaaaacacaaccuuucucuuuuuuuuuuuuuuuuuuuuuuugacaagagucucccucugucacccaggcuggagugcagugguacaaucucagcucacugcagccucugccucccaguuucaagugauucuccugccucagccucccaaguagcuuggauuacaggcguguaccacaacaucuagcuaauuuuuguauuuuuaguagagacggguuuacgccauguuggccaggcuggucuugaacuccugaccucaagugauccaccuggcauggccucccaaagugcugggauuacaggcguaagccacugugcccagcaaaacaaaaccuuucuaaccuuucuaaucccuguuuucucccucccuagacccauuccuuucucucccccauccaggggcacuuuccugaauuuuauguuuauuauuugcauuuauguauucacacuuuggcugccuaaguauauaagaaauauaugcuaccuauuuuuacacuucaaaauauuuuuuaaauagcaucagagugagaauaguuuacacuuugacuacaugcauagauaagaaauaugugggcugggaaugguggcucacaccuguaauccuagcaauuuuggaggcaaagauggaaggauuacuuuaggccagaaguuugagaccagccuggccaauguagugaaacccugucucuacaaaaugaaauaaaauguaauaaaauauucagcugggcaugguggugugcuccuguggucccagcuacucaggaggccaaggcgggaggaucacuuaagcccauaaggucgacgcuguagugagcuaugacugcacuccagcuugggcaacagagcaagacccugucccuaaaaaauguuuuuuguuguuguuguuguuuuuuguuuuuuuguuuuuuuaauaaaggccaggugugauggcucacacuuguaagccuagcacuuugagaggccagggcaggaagacugcuugaguccaggaguuuaagaccagccugggcaacauggugaaaccccaucuauaaaaaaaaugcaaaaaauuagccaggcaugaugacgcacgccuguagucccagcuacucaggaggcugaggugggaggaucacgugagcccaggaggucgaggcugcagugauccgugauugcaccacugcacuccaggcugggcaacaaaguaagaccuugucucaaaaaaauaaaauaaaauaaaaaauaaaaaaaagaaaagagaaagaaaaaaagagauaugugguacuguuuuucaaacuucacauuucucuaaccugacuuuuguguucaacaugagauaaaucugauuaauaaaaauaguuuccaugcauccauuuucaugacugcauaguauucugugguaggaguaugcugccguguauuuaucuauuuggauuguuuccagcuuugggcuauuuugacccaaagugucccugcuuucucccaagugaguuucucuagggcacguacccaggaguggaacugcugaguuguauacugugugcauccucagccccacuagguauugccaaauugcucugcaaagugguugugccaauucaugcucccugggggcuggcuucugcuggcugaggcuggcuugaccuugcuggcaggaaggagccuuaaaaaucccugugugguuuuuuuuguuuuacuuuuauuuuaaguuuagggguacaagugcagaucuauuacauggguaaacuugugucuuggggguuuguuguacagguuauuucaucacccacguauuaagccuaguacccauuaguuauuuuucuugaucaucuuccuccucccgcccuccacccuccaaaaggccccagugcguguuguucaccucuguauguccauguguuaucaucauuuagcccccacuuagaacacgcaguauuugguuuucuguuucugcauuaguuugcuaaggauaauggccuccagcuccguccguguuccugcaaaggacaugaucuuguucuuuuucuuggcugcauaguauuccaugguguauauguaccacauuuucuuuauccagucuaucauugaugggcuuuugcagcccuguuuuuuuuuuuuuuucauaauaacacgguuaugggaacacuuagggaagcucauauauuauugagcagugugaugguuaauauugagcaucaacuugaucagcuugaaggaugcaaagucuuguuccugggugugucugugaggguguugccaaaggagauuaacauuugagccggugaacuaggagaggcagacucacccccaaucugugugggcaccaucuaaucagcugccaguguggccagaauaaaagcaggcagaagaaguuggaaagaguagacuugcugagucuucuggccuucaucuuuguccugugcugaaugcuuccugcccucuaaaaucagauuccaaguucuucagcuuuuggacucauggacuuacaccaaugguuagccaggagcucucaggccuuuggccacagacugaaggcugcacugucagcuucccuacuuuugagguuugaggacucugacggauccaccacuggcuuccuugcucuucauccuucagaugggcuaucgugggacuuuaccuugugauugugugagucaauucuccuuauaaacucccuuucauauauacaucuauccuguuaguuuugucccucugaagaaccuugacuaauacagacaccuagugggucccaauaagugaucauuaaacugaaggcagucauucaguaggucaguuugucacuuguguuuguaucucccugcuuacaacaagguggccuuucuucuaguuuccugucaucugauggaagagauucuagacucauuccucuagaggagaaauacuucaucuagaacagauagguccuaagggugagagcucaucguugggaugaaugaacccacugaaauuuuaugcaagaagaaaauuguguauauguauauuuuuuuuucuggucuguaguuuuuauuagauucucagggaauccugauccuaucaugaagaccuucuauucuagauuggguuccuuucacauccccuucuccuuucuuguugaauucuccaugcauuucuuucacuugcuuuucuugcucuuauuucucugguagucaguuauccuuuuugucuggugguucuaucuccuucaaaugaggcacauugcucaaauuuuauuacuccaaauuccaaggugcuguuuaguguccuguuggguuguaagcuaggaacagggaggggaaaguaaaacauucugcaugagcugggugcagcgggcaagcaccuggaauuccagcuacuggaagcugaggugggaggauucccugagcccaaggguuuaaggccagccugggcaacaaagugagauuuugucuuaaaaaaaaaaaaaaucccagcugggcucuguggcucauaccuguaaucccagcacuuugggaggcagaggcgggcagaucgcuugaagucaggaguuccagaccagccuggccaacguggugaaaccccaucuguacuaaaaauacaaaaaaaaaaaaaaaaaagccuggcauggugguguggugugcacugguaaucccaguuauuugggaggcugaggcagcagaaucacuugaauccaggaggcagagguugcagugagcugagauugugccacugcacuccauccuggaugacagagugagacucugucucaaaaaaaaaaaaaaaaagaaagaaaaaacacgcgcgcacacacacacacaucaugcagaccuagccuucugccaaugucaaugguagagaaacacaguagacacuuaauucuauguuucagagaggaggggacucaaauauauuaauuugacauugagacagugaugacuuuaaugaguacuuucuuuccuuuuuuuuuuuuuuuuuuucgggacagagugcaguggugggauuuuggcucacuguagccuccaccuccuggguuccagcaguucuccugccucagccuccugaguagcugggacuacaggcaugcacugcugugccuggcuaauuuuuguauuuuuaguagagacgggguuucacacuaucagccagacuggucucgaacuccggaccucaggugaucugcccaccucggccucccaaagugcugggauuacaggcaugagccaccgugcccggccuaaugaguacuuucugauuaaccuguugcccucucagauuccugaagcaaaccacagcguuaaaacgugauucauuuuguguggaccaccacgguguuuaccuucuucuugggugaaguuugguggaaaagaucuuaccccggacaucuguuuguucuuuguaacucagagccucagagaaauccuaacuuuauaauguugucaaacccuuguaaggcauguuuuuauuguauuuguguucugaucaugaaacugaaaauguguaagaggaagauuucagaagcuuggcuguaugucugagaugacaguucuuuuacugucauucucaaauauauauaaauauugaagagaucaaauaacacaaaucgugcauguuaagaaaagagacugugaaccucaccagagaggggugagcacaauuuuuuuucuuuuuuauucacaggguuagcacugucccuuucacauaauaaaugcucaguaaaauaaaugguuguuaagccggaaaaggguaacacuucugauaaugaguguccugggaaauuuacuaagcuguuuagaagaugggaccaacacacugauagaaauagucagauaguccagaagucuauggcagaugcccugaacaucagaugagauauaagacagagaagcucugggucuuugccagcucugacauuuuaugacucuaugaaacggaagguuccuuuuuagaagggucuauaaacugucucaggcuuugggccauuuuguugaagaucagaggcaaggaaaagacacaacuacacaggaaccaucagggaaagauguuguuuuuuggucuugaagcaucauugaauuuuuuuuuuuuuuuuugagacggaguuuuucucuuguugcccaggcuagagugcaauggcaugaucucggcucacugcaaccuccgccucccagguucaagugauucuccugccucagccuucugaguagcugggauuacaggcauguaccaccaagcccggguaauuuuuuuguauguuuaguagagacgagguuucuccauguuggucaggcuagucuccaaguccugcccucaggugguccgcccaccucugucucccaaagugcugagauuacaagcgugagccaccgcaccgggccgcaucauuggauuuuaaggcuccauggauucuggcagguccagcccuucuguuuuacucacaaacaagugguuuguccaaagucacacagagaugguggcaagagaucuagaauaagaaggugucuucaagucauggagccaggaacccuggcuuuuugggcaauggaagugguauaaauguuuaauaucaccccucagguucugccacuagagcccagcucucucuuccuuccucuugcccccugacuagccuauggccucuuuccagagaauaagaaagggauccucagagaauaaucccaguuccucgcuuuuuauuauauaguugaggaaaccaagucucagaggggucagugucuugaccauacaccucucauguccucucuccuuuuugauuaauugaauaaauacauguaguugcuucuuaccuccuuucuuucuucaccccugccccaugcaccugcucuuaguugccuucacauguaaacagcauuccaacaacaacaacaaaacacaaccagcauucuaacucaugagaccagcaacaguuccuauaaauaccagcagcauuuuauuuuaaugucucucugcaguaguuucuccccuccauggaucagucauccuugguaccaaaaggauuccccacugugacacaaaugcuuuuugucauucucagugaguuauaccauugagagagcaucgaucuuuuuauuguucaaagcuuuugguugucaugauauuugcuggaccauguuucaccaggaaccacaucacuuccuagcagcaggagcuauuuucuuccaucuucuaacaacaccagcagugacagugauaauaaugauguuagcugccauggucguuauucuuaucauuuauugaguacuuacuaugugccagggacuacauuaagaguuuuauguguauuaucacauugagccucgcuagccuuuguacagaugaaucugaggcucagagagguuaagcugcucacaagggagucacacagcugguaagggguggaucaggaucucagccucucugcuaggacacuucucuaaaccuagaauaauacugggccuguguuaaguucagcaaagagcuguauucaacccaguguccuuaggaauguaaugccuguuauuaacaacaguggcaacauugauaagcugaaacuuaugaggugcuuacaauaugauauacuauauauuauauacauacauaggcacccaccuauaaucucagcacuuuaggaggccaagucaggaggaucacuugagcccaggaguucgagaccagccugagcagcauagcaagauccugucucuguaaaaaguuuauuuuuucaguuggccagguauguugguacaugccuauagucccagcuaaugaggaggcugaggcaggaggauugcuugagcccaggaauuugaggcugcagugaacuaugaucacaccacugcacuccagccugggugacagagcaagacugucucuaaaaauaaaaauaaaaauaaaauuauuucaacucucaagguuaaauaaauacuauuauuauucccauuuacagauggagcaacugaggcucaaagacauuaaaugcuuacugucuuagucuguuuucuguugcuuauagcagaacaccugaaacugaguaauuuauaaagaaaaagcaauuuauuucuuacaguuauggagacuggaaaguuuaagaucaaggcugcaugagcuauaaugcacacacacuauugcacuccaggcugggugacagggugagaccccgugucaauaaauaauaauauaaaauaaauaaaacaaauuucaacaugaguuuuggaagguuugaaauauucaagccagagcaucugucucauaagugguggacccaggauuugaacuaaggcagaucuggaucuagaacccauuuucuugaauccuacgcuauuucucuaaggucaaguuugccaaggaaaauaaacuugagaauuugaauagagcucucugacaugggaagucagggugauccuuccuuccccucccugaucuuggguuccacuauggcugggggaaaacaggagcagaagagauuucaagaaaugagagauuggccuagcgccaugguuaagaccuggacuucagagucagaggaagcuccucccucuaugacagugagaauguggguugaacucacugaaccucaguuuucucaccuggaaaaagggaguaaaacuagugccuagcuccuaggguuugcaucacacacgaaaguuggugaacugaaggaaaaaaacuuaaauucuugugggggagcaugugauagaugcuacaaauucuccaugccuuauuuaccuagcuuacgucuaaguucaccugcagcuuccucuugguacacucccaucucucuacaucucuguuggagggcagucucuggcaucacagaguuugcugagccagaugcuuaacaaccucgguagcaucccucaaccagugagcuagggagucaguguauaaauacccuggcuuccccauugcucagugggaaaacacugaaauauguuauacagcaucauagaggugccucaguaaaauugaauccuaguuguucacauaaaacccauucacuaguguacccuuuaccaaucucucucuuccucauuccucacuuguaauuccuugcauuaccucccaaauuaaccauuggacccuaguuuuugccuuggggucuacucggcgcuaacucaaggagcggaaguuggaagcuuagcggguuacagguuucagcacccuggacagcucccagcacaccguauugugcuaaaauguucucuucccucccucugccuccagcugggguggagagggacugaguaaaggccagauggccaggugaccuuguuccauacugagcuucuuggccauuuucccuguggggcuggagaagaccuugccauccaucucuccgcagguuugggggccgacugaggucuuguuuucucgaauugcuaugacaaaugccagccugccuccaaggggcaucugucccacugccucuacaguuugcaugccuaaugacuccucuccucucaccagggcagggagguggcugccuggugggccgcuugaagccgggagaccaagaucaugccacuggacucgcaacaaaccgagacucuuuuuuuuuuuuuuuuuuccucgagacagggucuugcucuguugcccaggcuggagugcaguggcgcgaucuuggcucacugcagccuccgccucccagguucaagcacucccaccucagccucccaaguagcugggauuacaggcgcacaccaccaugccuggcuaauuuuugcauuuuuaguagagaggggguuucaccauguuggccaggcugaucucgaacuucuccccucaggugauccacucgccuuggccucucaaagugcugggauugcagcugugagccaccaugccuggccaacagaauaggacucugucucaaaaaauaauuuuuuuuaaacauugcuuugcaacccagcugcuucuugugcaggcaucucuaaaugaggacagccagucuacauagacacguaaggaagcauagugguuaagaccuggucuuugggguuagaguggauucccaaccugacuccacuguuuccaagcugugugaccuugggcaaguuacuguaccucccugaaucuuccauuucuucaucuggaaaaugagaguaguagcauccccugacuugguggggcaugguggcugaugcuuguaauccaaacacuuugggaagccaaggugggugaaucgcuuaaacuugggaguucaaggccauucugggcaacauggugaaacuccaucucuacaaaaacaaaacaaagcaaaaauuaucugggugugauagugugugccuguaauuccagcuacucaggaggcugaggugggagaaucacuugagcccaggaggucaagucugcagugagccgugcuugcaccacugcaguccaacagagcgagaccuugucucaaacaaacaaaacaaaacacaaaacaacaacaaaauacuaccaccuuauggaguuguuuucaagguucaaugaguuaaugucugacccaugcugggcuggguuuauggauguuacuugcccagggacagucugaagaaagagaaagugauauaguccauugggccucagcuuccucaucuguggaaugggaauaauaauugcaccuaccucaaaagguaaaagucagugagauacauauaaggcauucagaacaaaaacuggcacagaauaagugcucaauuauauuagcuauuguaagacuaauaacuaucauuauaaugaugauaauaauuauuacuacuuccccaggcccaguuccauagaccaguuaguuaacuguagggaacguuugcuauuauuaguuggguucccaauaucugaccucccuuuccaauuuagggagaauccuccccuuucuauaaaguacugcuggucuaugggaucccacccucacuaauaaguugaaggugaaagggauucauugucaccccaucaccugguagucagggcaugugauuuaaacaaccagggccaggcgcaguggcucacgccuguaaucccagcacuuugggacgccaaggcaggaggauagcuugagccaagcccaggaguuugagaccagacugggcaacauagugagaccccuaucucuuaaaaauuuuuuaauuagcugggggugguagcacaggcuuguaguccccgcuacucaggaggcugaggcaggaggauugcuugagcccaggaggucaaggcugcagugagccgugauagugccacuacacuccagcccagccugggcaacagggcaagauccugucucaaaaaacaaacuaauaaaaaacucaaccagucacguuuuccuacccaggaauuugaaaauggaccaagugauccaaacaugaugguuuggacucuuucauggccuccugcuacaggagaaggucaggcuggcuacauuguuccugcugauuucccaaauccccucuucuggcccccuguugauuaucugaguuuccuaaaaaucccuuuuaugccuaagauagccggucaguguuugguuuugcaaucaagaacccagacugggccaggcacgguggcccacgccuguaaucccagcacuuugggaggccgaggcgggcagaucaugagaucaggagaucgagaccauccuggcuaacguggugaaaccccgucucuacuaaaaauacaaaacaaaaaaaaaaaaauuagccaggcaugauggcggucaccuguagucccagcuacuggggaggcugaggcaggagaauggcgugaacccgggaggcggagcuugcagugagcugagauggcaccacugcacuccagccugggcgacagaacgagacuccgucaaaaaaaaaaaaagaaaaaagaagaacccagaacccagacugauccugagacaaagauuugagggcaacgaaucacgaggucaggaaaucgagaccauccuggcuaacauggugaaaccccgucuuuauuaaaaauacaacaaauuagcugagcgugguggugggcgccuguagucccagcuacucgggaggcugaggaaggagaauggcgugaaccugggaggcggagcuugcaauaagccaagaucgcaccacugcacuccagccugggugacagagcaagacuccaucucaaaaaaaaaaaaaaaaaauuugaggacaagugguuuguuuggcaauaccaggaaacaggggaacaggauagucagaaaagaaagagaaagcugggcaugguggcucacuccuguaaucucagcacuuugggaggccaaggcagguggaucaccugaggucaggaguuugagaccagccuggccaacauggugaaaucccgucucugcuaaaaauauaaaaauuagucgggugugguggcgugcaccuauaaucaaaauaaaauaaaaucaggauauuuuauuuuaaaacucugucuuaguguaacucauauuuaccucuucuguaugcuccuuugcaucaguuauauauugccauaauacggcuguguaacaaacaauccccaagacccaguggcuuauaaugacaagcauuuauuuagcucaugauucugaaggguggcaguuuaggcugggcccaguugggugcuuuaucuggucucaguugagcucauucaugcaucuuuggucagcugcgggucagcuggguggcucuucuguuuggcuguuagcuggcugcagacugguccaggaugaccucggcuggaaugacugugcuccacucccuauggucuuucacccuccagcaggcuagccugagcuaguucacauggcagcuuuucauccuccagcaggcuagccugagcuaguucacguggcagcaaugggauucuaagagaaagaggaaguguucagccuucuuaagggcuagucccaggaauggcacaacaucguguuggccacuguuguccaaagcaagcaaugaagcugguccagauucaaggaauggggcaacagagcccaucugguauuuaccuggggccacuggggccccauuccuguucccuggggccuuuugcccugacuucugugggcccucagagcauauuuucagauuccuuuccaucccugacccucagcaaucaauguagaugacgugucauuacugugucacuugcacagagaaaaggaggaaaaaaugucagcaaaaacucugcugagagcagagggcccaucauacagcaagcuggaaagaaaagugggaaugauuacacagccuccucagaugcuuccagcuuuuaucaaaucucacugugauaucugaguucugaacccucacaggugguuggcgugcaagggaagagauuucuugucugccaugcugacaugcacagacacgcaaccuggcucccucuguccacuggggcuuuggauuuuguuuguugaaauguuacccacuccugaucagagcuggauggaaaccuggcucugauuccauuggcucaggggcucaggugggggcagaggccaggcugguugggugucuauguggagaccuuaacucuucucccucccgccccaacucuuuuuguuucuuuuuuuuuuuuuuuuuuuuuuugagaugggguuucacucuuguugcccaggcuggagugcaguggcgugaucuuggcucacugcaacuucugccuccuggguucaagcaauucucccaccucagccuccugaguagcugggauuacaggagcacgccaccauaccuggcuaauuuuuguauuuuuaguagagacaggguuucgccauguuggccaggcuggucuugaacuccugaccucaggugauccacccuccucagccucccaaaaugcugggauuagaggcgugagccaccacaccuggcccuuuucuuuucuuagcugccuccaccucucuucccuucugcaguguuagguuuauggaaaccgaggccggcguagagaucaacuucagagagcaugaacugagcaucugcugggucuuagauccuuuacauagcuuaucaucuucaaaccuucucacaguucuguguggcuagagccaggauuuggacacagcucugccccacuguagaaccaggcuuccuucuguccacugucaaauuuuagagggagaaaauagggaaagggacaccagccuucuccacgagcagcuucugcccacucaccccagggacuuugcacaugcugugugccugugucugagauaugcucccuccucuguaucugcuuaauucuuacccagacaugauacauaaaguauuuaacauccagguggcagggacaccagcuaaccugaaaagagguuccccuguugugccacauguguacucauuguuugcugcauugugggggcaguccaggggccuugaagaggggccaaggugccaaaggggcacucucaggccucaaggaaguacauguuuacugauaugauacugucucuuccuccaggaaggaagccuucccugaucuccccacugcaugcccacuaugauaccaguuuagguccccucuuuauggccaucuguggcaucagugugaauccucuuaauguugucuauuugguuaaucaucugucuccuuccucugggggguaaagacagaaccacagagccucguguagaacuugagaaugggguucaguaaaaaucuguugaaugcauaaaugggugauugagugaaugaaugaaugagugaaugaaugagugaguggaugaaugaaugagugaaugaaugagugagugaaugaaugaaugagugaauuaaugaaugaauucauagcugauaauacaggcuucauggcuuuuguuaggcuugcccagacauugcuaggggauggacagaaggaagaagagcuauacuuaauuccaguccuguuguucuguagcaggaggagaaaaacagggacugcccagccugcucuggguggauucaggagcagcugagguuccucucuuauuugcaaacagggaauucaaaaagccccaaccucagaaucacacucgccucagcagcuguaccagccaaggggacaaugugggaagccuugggcaccaggaaugcugagugcuucgaaaaagcgaaggcucagggaacaaucccugauuuuucauucccuuguccuuucugaagaaacaggcaaaggcaggccaggcacgguggcucacaccuguaaucccaacacuuuaggaggccgaggcuggugaaucacuugaggucaggaguucaagaccagcguagccaacaucaugaaaucccaucucuacuaaaaauacaaaaauuagcuggguuugguggugcaucccuguaaucucagcuacucgggaggcugaggcaugagaaucaccugaacuggggagguggagguugcagugagcugagucugcgccacugcacuccagccuggaugacagagugagacuccaucuuaaaacaaaacaaaacaaaaacaaguaaagccuuguguguuuuuaaauuguagguucagcagcaaagcucuguaauaaggagcuggacccugcagucagacagucaugggcuucuccagugcccagccgagugacccgagggaguuaugauaaacaccaacauucauccacaauuuguaccuagugcuauucucaauaucuugaguaaauuaucucauuuaauccuccaggcacaucuuucuugguaggugccgucauuguccccaguguacaucugggaaaaugaggacaggcuggcagagcacccuuccugcucaccucugcugcucugcugaccucuggcaagacuguugucucucugagccucaguuuccccaucugaaaauuggggccuguauuagcccguucucacauugcuauaacgagaugcuuggcuggggcugggcgugauggcuuaugcuuguaaucccagcacuuugggaggcugaguugggcagauugggagugugagaccagcuugggcaauauagcaagaccccaucucuucuaaaaaaaaaaaaaaauuagccaggcauggugauaugcaccuguaauuccagcuacccaggaggcugaggcaggagaauugcuugaacccaggaggcagagguugcagugagccaagauugcgccacugcacuccagccugggagacagagugagacuccaucucaaaaaacaaauuauuuuuaaaaaauuaaaaaaaaaaaugccuggcugggcacaguggcucacacccauaaucccaguacuuugggaggccaaggugggaagauugcuugagcccaggaguuccagaccagccugggcaacacagugaaauccugucucuacuaaaaguacaaaaauuagccaggugugguggcacgcgccuguggucccagcuacucaggagggugaggugggaggauugcuuaagccugggaggucaaggcugcagugagcaaugauuaugccacugcacuccagccugggcgacagagugagaccuuguaaaaauaauaauaauaauaauaaauaaauaaaaacccugagacugggguaauuuauaaagaaaagagguuuaauugacucacgauucugcaggcucuacagaaagcauggcagcaucugcucagcuucugggaaggccucaggaaacuuacaaucauggcagaagguaaagcuggagcagguguccucacauggccagaacaggaggaagagagagaguggggagaugcuacacaccuuuaaauguccaaucucacaagaacucacucacgaucucgagaauagcaccaaggcggaaaucugcccccaugauccaauuaccuuccaccaggccccaccuccaacauuggggauuacaauucgccauaagauuugguugcggacagacacagauccaaaguacauuaaaaguaauggcaaaaaccacaauuacuuuugcaccaaccuaauaucucaggggcucauuguaccuauuucacaggacaaaugaagguaucaguaauaacaguagccuguagucccagcuauucaggaggccgagacaggaggaucacuugaacccaggaggucgaggcugcagugagcuaugaucacgccacugcacugcacccugggugacagggcgaaaacuuaucucuaaaaauaauaauaacaacaacaauagugaacacagauauaacauguguguggccaggcugugcccuuagggcuuugcagggauuauuucauucacucucaaucuccccauuuuacagaugagaaaacugacguucagaaaagcuagaggacuugccccaagccacacggcuaggaagugguggaauugggguuuaaaugaggaagcuugacuucagugucgaagcucuuaacugccacacucaauacauggaguagagguugcugauucugugauuaucugauucuggaaaguaaagacccuguuuccagacguuugcugcuugacuuaguucccaggggauggccacuggaugaugcaguguugcccaggagagguuagcuagacacacugcaaccauuccauugcuaauacuuauacuugcucuuguucugcugggugcuaugcagggaagggcugucugagcccuuugcaagaauucucccauuggugccucccagagauucugagguuggggcuuuuugcaucccuuauuagcagaugagacaccaaagcccaggucaauaaucugaccugcaucccccgccuaccagccagaccaaggucacuuccccacaaugcaggcccugauccaaggcucugggugcaaaccaguuuccaugucccuggggguccaucuucuucagcugacuuuuuuuuuuuuuuuuuuuuuuugagacagcgucuugcuuuguugccgaggcuggagugcaguggugugaucauggcuuauugcagccuugaccucccaggcucaagcaauccucccacgucagccuccugaguagcuaggacuaugggcacacgccaugaugccuggguaauuuuuuuuuuuuuuuuuuugagacagagucucgcacuguagcccaggcuggagugcaguggcgcaaucucggcucacugcaagccccaucucccagguucaugccauucuccugccucagccucucgaguagcugggauuacaggugccugcuaccucgccuggcuaauuuuuuguauuuuuaguagagacgggguuucaccguguuagccaggauggucuccaucuccugacuucgugauccgcccaccucagccucccaaagcgcugggauuacaggcaugagccagaugccuggcuaauuuuuaaguuuuuuuauaaaggcggggucuugcuauguugcccaagcuggucucaaacuccuggccucaaaaagucuuccugccucagccucccaaagugcuaggauuacagacaugagccacugcacccagccugacuuuuuuucuaacugaaaaauuaauuauauauauucauggaguacaaugggauguucugauauauguuuacauuuuugaaugauuaaaucaagccaauuaacauauccacuacaucgcauacuuauuuuuuguggugagaacgcuuaaaaucuacucuuuuagcaauuuugaaauauacaauaccuuauguuguauauuacauuauguuguauaguacguugaaacauacacuacaauacguuaucauuaauuguggucaccaugcugugcaaaagaucucuaaaacguauuccuccugucugacugaaacuuuguauccuuugccuaauaucuccccaaucccuccaccaccagccccugguaaccaccauucucucugcuuccauggguucaaauuuuuuauuuuuugaaauuuuuaauuuuuauuuauuuauuuauuuauuuauuuauuuauuuuugagauggagucucgcucugucacccagucuggagugcaauggugccaucuuggcucacugcaaccuccgccuccuggguucaagcgauucuccagccucagccucccgaguagcugggguuacaggugcuugccaccaggcccggcuaauuuuuguauuuuuaguagagacgggguuucaccauguuggcuaggcuggucuggaacuccugaccuccagugauccacccaccucggccucccaaagugcugagauuacaagcguugagccacugcaccuggccuaaaauuuuuuuuuuuuuuuuuuuuuuugagacggagucucacucucuugcuaggcuggagugcaguggcaugaucucagcccacugcaaccucagccucccggguucaagcgauucuccugccucagccuccugaguagcugggacuagaggugugcaccaccacgcccagcuaauuuuuguauuuuuaguagggacaggguuucaccauguuggccaggauggugucaaucucuugaucucgugaucugccugccucgggcuuccaaagugaugggauuaugggccaccacgcccggccucaaauuuuuuagagcucacauauaagcgagauuguguacuauuugcguuucugugucuggcuuguuucaucuuaguauaauguccuccagguucaugcacguugucgcaaaagauggaauuugcuccuuuuuaaagacugaauaguacuucauuguguacauauacacgccauauuuucuucauccauuccuuuacugauggacauuuggguuguaccugcaucuuggcuauugugaagagugcugucaugaacaugggugugcagcugacucugagguguuagagggauuacagcuccuccaaaagaccaccgucacccaaaccugcuccuccugcccuauuuucuguuuagguaaaggcggcuuuaacccccugcagugcucuggccucagaccuccagaucuuccucuaugccucuaugccucuuuuucuccacccccugcauccaaucuguuagcacaucuuauuggcucuaccuucagaaucuacccagaauccaccacccaccucucaccaccuucacagccccaccccgguccagcccccaucuuugcuggccuggacuaaaccaguugccccuccaccccaaucuggucucuuaacuucaguccuugccccacccccaggacuguuccccacacagcagccagagggcaccugugagccacugagucaggaccuggcuccucuuugcucacaaccucacuuggagaaaaagcccaaauucuccucacagggacccacaaacucugccccugugaucccccaucccccucuauucccacucuccucuccacucacucggcuucagcuacacaaguucccugcugucccuuacacaccaagcacuccccagccucagggccuuugcacaggcuguucccucugccuggaacacucuucccccagauaucugcuuggcuccccccucacuuccuuugggucuuugcucaaguguccuucuaacauguaacugccucaccugcacugugccaccccacuccccgccucuaggcuuaauuucccucuacaccccugaagagcaucugccaagcuauauuuacuuguuuauugguuauugccaauccccugcccccacuagaaugccagcuccaugagggcagggacuucugucuguuuuguucacugcuauucccccagagccuagaacacagccuggcacauaguaaguauucacuaaauaauuuguaauaugaauugugccaguaaaaucuuccaggggcaucaagccccugccaugacuaggugguaacauccucacccccuguccaugugcuaucuccuccugaccugcuugucucauuguucuaaugguggcucacgccuguaaucccagcacuuggggaggccgaggcgggcagauaccugaguucaggaguuugagaccagccuggccaacaugaugaaacccugucucuacuaaaaauacaaaaauuagcugggcguggcauugcacgccuguaguccuagcuacucgagaggcugaggcaggagaaucgcuugaacccgggagguggagguugcagugagcugagaucaugccauugcaauccagccugggccacaagagcgaaacucugucucaaaaaauauauauauauauuucauugugguaacauaugcauaacauaaaauguaccauuuuuuaaguguuuaguugagcggcguuaaguacauucauauuguugugcaaccaggaccgccauccaucuccagaacuuuugcaucuugcaaaacugaagcucugcccccaggaaacucucacuccccgcucccccuuccccucuccccgacucccccuuccccccuccccacuccccccacccuacuccacacuccccacucccccagccccuggcacccgccguucuaguuucuaucucugugaauuuggcuacuuuggguccccccugugaguagaaucauacaguauuugucuuuuugugacugguuuguuucguggagcauaauguccuccagucucauccauauuguagcaugagucagaauuuccuucuuuuccaggccgaaucguauuccauuguguggauggaccacacuuugcuuaucuguucauccagaugggcacuuggcuuccaccuuuuggcuauuguaaauaaugcugcuguaaaccuguguguacaaauagcugagucccugcuuucaauucuuuuggauauagacccagaaguggaauuuuuuuuaaaucaagauuugacccacuggggcccuuagaggucucauuggcucugaagcuuuuuuuuuuuuuuuuuuuuggacgcuuugaaacuaaaaauaggagugaggggcacagugaggggggcacacaucucucgugucagcguuuuuuaaaaacaccccgggaggaagaugugugaaaucccucccuuccccccgcucccacccccuccaagaucucaaaauaccucuuguuuuaggaagcggcugugacaucaggcaggcagcguguggcaucugagacacaauaucgcaaguggcugggagcccagagaaaccaggacaggcgugcuggggauguggacuagagauggagcuaauuuuaguggcugaagaggcugcaagaagagagagaaagagggguguguguguguguguguguguguguguguguguguguguacgcacagugauagaggcuggagggggagaaaugacagauaaaucagcuugggcaaagaaagcuaaugggcagaggagcgagacccagcucagaagguggucagcaaaucuaaagaugugugcccgagggucaaggugguggggggauucauaggcaagugguagagaggcuauuccauuugcagaggcucucucuguuugaggcgugauucaccugugccguccucaaggccauucugagaacaccacuguuguuuuccuccuuuuaugaguagggaaacugaggcauugaacugcuucuauucuucaguaagaagcagggggaacauaugguagaagcaaagaaauacaaacaugagggcucucggggucuacgugauuggcugugacauccaugagagcggaucgcagguugaaggaaacacugguggcagaaaguagcugaacauuuggauuugggaaucccaguggacguggcgaaaauucuggcuuuucccuucacaggcugcggggccacucugaccugcgguuuccuuaucugugaaauggaacgaugccaccugucucagcguuguuuugaggaugcgaggagaugauccguguaauaugcccacuagggggccugcuccaggguagauucucagcaaaugguagucaugguuuuuguuacauuuggggauauuggcagguaaaaaggaaauacuucauucauuccaaaauugcucacugagguucuacuaugugcuaggcccugaugacacaucggucaacaagacaggccugcuuucugcccuuguaaaacuucaguucaacugcauugcacucaucagccuaauaauccagguaaauugugaugagaauaacaacuagcauuuacuaugagcccuuuacaaauauuaacccauuuaaucuucuaaagagccuauaagauaagagcucuugcccugcgcaguggcucacgccuauaaucccagcacgucgugaggccaaggcagguggaucaccugaggucaggaguucaagaauagccugaccaacagggugaaacccugucucugcuaauaauacaaaaauuagccaggcaugguggcaggugccuguaaucccagcuacuuggcugagguaggagaaucgcuugaacccaggaggcggagguugcagugagucgagaucacuccacugcacuccaagagugaaacucugucacacacacaaaaaaaaacaaccuguuauuauccacauuuuaccuaugaggaaaccgaugcccagagagguuaaguaacuguccaaaggucacacagcuacggagugguagagcugggauucagacccaggagugugaucccagaguguguguguauguuuguuuguuuguuuguuuguuuguuuguuuuuaccacuguguuuuccugcuucugcaauagaaguaaucaccaguaacacugagcaguuguuaugugccaugcccuuaacacacaucuccuuggaucuuuggaaagaauccuaaaaggguuguuuuucaugauccacauuuuauggagagagagagaucaaagcauagagagaggaaguaacuugcccaagauccugcagcugaagacucuaggguugcaaauuugggacggcccuggacccugcauuccagcuucuagcagcucauagggggaacucuuuauuuauuuauuuauuuauuuauuuauuuauuuauuuauuuugagauggaguuucgcucuucuugcccagccuggaaugcaauggcaugaucucggcucacugcaaccuccgccuccuggguucaagugauucuccugccucagccuccugaguagcugagauuacaggcauaugccaccacgccuggcuaauuuaauuuuuuuuaguagagacgggguuucuccauguuggucaggcuggucucgaacuccugaccucaggugauccgcccaucucggccccccaaagugcuaggaauacaggccugagccaccacgcaugcccugggggggaccacuuuuaucggugcauuucuuccauuuucccugugucuguguaaagauaaacacccccaagccccuugacuaugaacugugggccauaauuaguuaauggaagguaaauguuuuagagacggaaauugcugugccauuuuuccccgcuaggcauuguugccugcaugcuaaugcaacacaaugugccuuucuucugucaggcauuuuuagacaaauucuauuuucccuaaaauauuuugccaaagaaaauagcaaauggggaagacauucagaggcucaggcagagagaggacaccauucccuuggguuuaaacagaauggcagaguggauaacagcacagaucuugaguuagguggaugccaauuugugauuuauuucccagcaaaccaagaugcuggcucucugugugccucaguuuacuuauuugucaaaugaggagaauaaugguaccugucucucaccagcuuaccaguugccucuuuagcuaugucuaaucugcuauuaaccacgcccacuaugucuuuaauuccaaguauuagaauuguuuucuuccuacaagcugucugaucuuuuuuaauccugcuucaucuuuugcaguauuguuuuccuacagcaggauuucucaaccuuggcacaauugacauuuugggcuagguaauucuuggccgugagcuaccacccugugcuaagauacuuagagcaucccuggccucucacccuacuaaaugccaguagcagccccuccccaguuguggcagccaaaaauggcucagacauugccaaacgaaaugucccauggaggguagaaacgcccccacuugagaauuguucuauagguauuuucaagcaugucuuacauuucuuuaaguauaauaugcaaaagaaaaggcuaaaucuaaaaaaagcccauaauaugcgaagaauuuuuauaaucaguguccaauaacuuaaguaucuaaaauuguuauggcuuuuuuucugcugucucuuguuuccugugauuccucauucuggugccuuguuuucuugaaugucuuguuaucuuugguugugugaagcucauuuuccaugggacacuauuuuuuguuuuguuuuguuuugagacagagucucgcuugguugcccaggcuggagugcaguggugcaauaucaguucacuacaaccucagccucccaggcccaaaugauucuccugccucagccuccugaguagcugggauuacaggcgugugccaccacacccagcuaauuuuuuuguauuuuuaguagaggcaggguuucaccacguuggccaggcugguuuugaacuccugaccucaagugaucaacccgccucggccccccaaagugcugggauuacaggugugagccaccgugcccggcauccaugggacacuguugaagggaguucauugaggccugcgaugaaggcgaacccuccauggacaauuugcauuuacuuuuuccaggugucugggaaacucccagucuaggaccaucuuagacuuuuagaccaacaauguguugagaauuuaggucaccagugucugcaaaagccagcuugugguuauaauuucucaaaaacuuuuguuuuucuccuuuucugcaaagugccaaaguaacuuccucaaaaaucucugggaauggaaagacgggaguaaauuaacuucagguuucuuaccugaaagugauagccuauuggggccccauccuacuuggggaguggugugucuccuuugagacuuucuaacacguguguacccuggacuuugccccaccccugcucccuaggaggccauaaaacuugaagcagcaguuccauggguuagacagaugcccuuggggcaaaagugguuuuaaugcucugguagaugcucagguuaccucugggaaauucuugacuucacuuauuuauuuggggcugauaacuacuaauugucaggccuuucuuguuucaacaacauggacuucagauuuuaugcaggauuugucaucguuuucagcaagagagucagucuuauuacccagcuuacugcauuagaaauagaugucugggccaggcgcaguggcucacaccuguaaucccagcuguuugggaggcuaaggugggcggaucaugaggucaggaguucgagaccagccuggccaacaugguaaaaccccaucuauacuaaagauagaaaaaauuagcugggugugguggugcgugccuguaaucccagcuacuugggaggcugaggcaggagaauugcuugaacccgggaggcagagguugcagugagccaagaucgcaccacugcacuccagccugggugacaggacgagacucugucucaaaaaaagaaauagaugucuguuguguggauuauuuaaaagaguagauggccaagaacuaugacuuaugccugucaucucagcacuuugagaggcuaagguggagggaucacuugaggccaugaguuagagaccagccugggaaacauagcaagacccccaucucugcaaaaguaaaauaaaauaaguuagugugcaugauggugcaggcauaccucuaguccuagcuacucaggaggcugaggcaggaggaucacuugagccuaggaguuugaggcuacagugaucuaugaucaugccacugcacuccagccugggugacagaucaagacccugccucuaaaacauaaaaauaaauacaaauuaaguuaaaaaauaaaauaaauaaguaauagaacauccagcacaguucuuggcaugcauugacuguuguuguuuguuuguuuguuuguuugugacggagucucacucuuguugcccaggcuggagugcaauggcaugaucuuggcucaucauaacuuccaccucccagguucaggugauucuccuacuucagccuccugaguagcugggauuacaggcacgugccaccacuccuagcuguuuuguuuuguuuguuuguuuguuuuguauuuuuaguagagaugggguuucuccaaguuggucaggcuggucucaaacuccugaccucaggcgaucugccagccucggccucccaaagugcugagauuacagacguaagccaccacgccuggccagcuguuuugauuguuaaaugaaggugguaugaaagggaaggaagaacagugacauuugcaagggacacucccuggagggcagggcaagggggcuguggaggggagaagucagagaguaugauacagguugccuugggugauguuuuagauuuuagccaacauuggcaaagagccucauuuaucucucagaguagcucuggcuacuggaaaugcugcacaacuucaggcggacuuucuagaagaaaacucuuggccaggugcagugacucacaccuguaaucccaacacuuugggaggcugaggcagguggaucacuugagcucaagaguuugagaccagacugggcaacguggcaaaaccucaucucuacaaaaaaaaauacaaaaauuaaccaggcgugguggugcaugccuguaucccagcuacuugggaggcugaggugggaggauugcuugagccuggggagguggaggugguagugagccaagauugcaccacugcacucccauuugagugacagagcaagaccuugucucaaaaaagaaaaaaagaaaagaaaagaaaagaaaauucucucugggauucaauccuggcccacacagcauuggcuucacuucaccuccuucuccccugagauacacagcaccauucccccaagcuucaucaacuuaaucucugaucugggugcugugacuuguccccauuccuggccagaauuuaagguagggaugaacccacuagcccuccaucacgcacucugccauaaaagcacaccacgugcugauugcugucuuuggucuccuuucugccuugcccucuagacucugagcugcuuggagacagaggccaguuuuguccaucuccaaauccccuaaaguccuguggccagcaagcagguaggacaucugaaaguucgucagagagggaauugcuuuucucuugagaugcaacuagaacaagaaucuuauugaccuggaguagcuucaagguuguaagaguaugugucaggguucuccaagaccacucucagguuugaagguuugcuaaaagggcucacgggacccagaaaagcugugaaauucaguuaugguuuauuacaguggaagaauacagauaauacagauuaaaaucugcaaagcaaaagaugcacaaggcaauguccaggggagaucaggcaugagcuuccagcuguucacucccaguggaguuaugcaaacagugcucaauucucccagcaauggugugugacaauguacaguguaccgccaaccagagaagcucaccugagccuugguguccaggguuuuuauuggggcucaguuacauugacauggagcacccaugugacugacuuuaacugcugggucuccagcacacuccaagaucaaacugauaccgugugucccagggccccagcugaacacaaacaggcagucaccauagaucccauugugagcauaagcuaccaggcauggcccaaagcccuagauauacagauauucuuuccaggagccagccaagggccaguccuuccuuuggaauaugcagaguuugaacuccccaaccccaaggaguuaacucuuuacuacacagaauauaaaucucaccaagucuuucuucuugucaaguccucucaaggugacccauugcuuuuagcagugucuuugagacccugcgucaucuggccuugacccauaucaccuguguuaucucuccacucuagcuacauugaacuuuucuuuuuugagauguggucucacuccaucacccaggcugaagugcagugguacagucacagcucacugcagccucaaacuccugggcucaagugauccucccaccucagccuccugaguagcugagcccacaggugcaugccauuacacccagcuaauauuuuuauuuuuaguaaagauggguucucacuauguuucccagguuggucucaaacuccugggcucaagcaguccucccaucuuggccucccaaaguauuggcauuacagggguuagccaccacauccagcccauugaacuuuuuaaggauccccuagcauccuauacuuucugucacuggauagccuuggaauuauuuuuccuucuuuuugaaauacucuucuucuuuccacccuuugcugucaagucucagaauaggcauuauuuccuccaaaaacccucuccugacccuccaaaucuggaugaggacacuuccuuugcccagagagcaccuguuuuaauccucucagguggcuauaauaaaauaccuuaaacuggguggcuuauacaccucagaaauuuauuuuccacaguucuggaggcugggaagaucaaggcacugacagauuuggugucugaugaggggccauuucuuguuucguagaaggggucuuccuacugcaucuuuccauggugaaaagaguugaggcagcucucugaaaccucuuucaugagagcaugaaucccucugucuucaugaucuaaucaccucccaaaggccccacuuccuaauaucuucacauuggugacuagguuucaacauaugaauuugagaaagacacagacauucagaccauagcagugcucuuccaccagguuuuuuaucccccuguauuauaauugagguuuaaauuaucugcuuuccuucccuuagauuguaagcuccaugagagcagggcccuacccauccagucauuguccuaucccccaugacuacaacuuccuggguacauaauuaauauuuauuauauuauguagcaaagguaugcugccauacuaagagacccaaaaggccaccggauuaaaaccuuaaagaaaaaaaaauaauuucucuccuauaauagcugcaagguuagccaugcagguuggcagggaagcucacuuccacaaagucacucagggauucaggcuccuguugcccucuucuuuucuaccaccaaaugaucuucagcaccauuugcacaaucaaaacuuaacuggucuugaauaggcagaccuugaauuucugaagucucagacccaaaaguggcagcugucacuuccacugacauaucacugauggaaacuuaaucaugugaucauaccaaacugcuagggaugcugggaaauguaguuuuguugggaacuccaugacuuggcuaaaauuccauuacuguagaagauggugggggaugggggagugguggacauccagugguugcuaccauauuuauugaaucaaauugucaaacaggaccuaucugauaagggguucuuuuccagaauuaacugaaguauuaaaucaggggcaaaggcaugucaccucaucuuucucucccuauauuggcuuucuagggcuguuauaacagaguaacaugaacuuggcggcuuaaaacaacagaaauuuauuuucucuuaguucuggaggcuagaagccuaaaaucaaggugucagcagagccaccuugacaacugcucuaggaaagaauucuuccuugccucuucugguggcuccuggcaacccuugguauucuuugucuggcauccacuucaaucucugccuccaucuucauuugccuuuuuucucugugugucuauguccuuuccucuucuuagaaggauaccagucauugaauuuagggcuuacucuaaauccaggaugaucucaccucaagauccuuaauuaguuacaucugcaaagagcuuauuucaaaacaagauugcauucugagguuucgguaaacacgaauuugggggaaauaguauucaacucaauucacugcuuuacuuaagaaaagagaccaugaagugagccuccuucugcuugagagagagagcgagccuuucugugcaauaggucaaugaauggaugcagcugaauuccacauaacuuuauaaaaauagauggccagcccaugggguuugcugaccccugcccaaaaauuccaaagucaacagcagucucuuuuuuaaucauuucucuauuuuuuaauuuauuuuuauuuuuauguugagauagagucccgcucugucgcccaggcuggaguguaguagucucggcucacugcaaccucuaccuuccagauacaagugauucuccugccucagucuccugaguggcuaggaguacagguguccgccaccauacccagcuaauuuuuguauuuuuaauagaaacaggguuucaccauguuggccaggcuggucucgaacuccugaccucaagugguccacccaccucggccucccaaagugcugggauuacaggcaugagccaccaugcccggccaggauuuucuucauuuuaacagcauucuuacuugucccacauccauucuauccugggucuaauuagauaacaaaaucuacagaucuuguuuaacugacauuguccugggggauacuuuuuaucuuuugagacaaggucucacucuguuacccaggcuggagugcaguggccugauaacagcucacugcagccucgaccaccuggguucaagcgauccucccaccucagccuccagaguagcuggaaccacagaugcaugccaccacaccuggcuaauuuuuaaauuucuuguagagguggggucucccuauguuaccaaaggcuggucucaaacuccugggcucaaaagagccucccaccuuaaccucccaaagugcugggauuacagauaugagccacuguuuccagccuuggaaauauagucuaagaacugagucaauaggcgauuuugucauuguguggacaucauguagagaacuuaacacaaaccuagaugguauaaacuacugcacaccucaguuauggggcauacccuauugcaccuaggcugcaaaccugcacagcagguuacugucuugaauacuguaggcaguuguaacacaaugguaaguauuuguguaucuaaacauaucuaggccgggcacgguggcucacgccuguaauuccagaucaccugaggucaggaguucgagcccagccuggccaacauggcgaaacuccuucuuuacugaaaaaugcaaaaauuagccaggugugguggcaggcaccuguaaucccagcuauucgggaggcugaggcaggagaaucgcuugaaccugggagguggagguugcagugagcugagaucaugccacugcacuccagccugggugacagagcaaaacuccaucucaaaaaaauaaaaaauaaaaaacauaucuaaacagaaaagguacaguaaaaauacaguuauaaccauaugggaccaccauuguauaggcaguccgcuguugaucaaaacauaucaaaacaucguuauguagcacaugacuguaccauaaaccacacggcuucaaacaagggaaauguauucucucacuguuuuggaggccauaggucugaaaucgaggugucaccagggucccuccaaaggauccgggggaggauccuuccauuggauuuggaguugcuucacuccagucucugccucaguggugacagggcguucuccucuucccucucaaaguucccucuucugcugugucauaaggauacauaugacugcauuuaggccccacucagaaaauccaggaauaaacucuugcccucauauucuuaacuaaaucguaccugcauaccuuauuuuuucuaaauaagguagcauuccagggauuaggacaucaacauaacuucuggaggguucacuguucaacccacuacagccagaaugcgcuuugaauucagguucugacaucugggacugccucccacguacacacaccacuaccuuguacugaaugccugaaggguucugcccccaccuccacucccccaaauauuugcuguggaccugagaaagcugacuucauggaagcuucauuccauuguucuaaggacuuuucauacauuaacaaaugucuucucucuauggggaaaaccacagagaaaucaagacagagugggguuaaguaacucaccugaggaggaacaguaaguggcagagccaggauucaaaccaacaugguuuugcacaguuuugacaucauuugcaacacaaauauugucacagauaccuuuuugagcaucuacugugcuaaccgccaggaaggaaaagaacauggggccgggagagcucuugacaggggacagggcuggccauggaggucugugucuugguggaagaugcuaugguucucuuuuuuuuuuuuuuuuuuugagauggagucuugcucugucacccaggcuggagugcaguagugcaaucuuagcucacagcaaccuccaccucccggguucaagcgauucuccugccucagccucccaaauaucugggauuauaggcacacaccaccacgcccagcuaauuuuuguauuuuuaguagagaugggguuucaccaugugggccaggcuggucucgaucuccugaccuuguugugauccacccgccucggucucccaaagugcugggauuacaggcaugagccaccacacugggcaacuaugguucucuuuuaacuccuugugcugaaauuauugcagaagcccaggccaguucauccccagaaagugaggcauaaacaggcagagcucuacagaaacagagaauccacgacugguuugauggaggcugccucacuaccuacagaaugggcucuggguggauuguucuaucuggggagccagcccacccaccagucucagcccuuggcgacucuuuccugcugucacagcagcuggacauucagaaaccgaaacaugacagccuucccucccuguuccugcccaguggaguggaaaccccucgggacccacauaccgagcgugcacagcagcacagaguugcacaguuaacacagcgcuucuucuccagcccuccggaugcaagcugacagauuggcagcuggcugacuuccaagguccagugaguucuuggcagucgcuuucugaccuggacgaguggcugccaccuccuggaacaucaggcugcccccuuggggagagggugacggucucucuggaaagacugugagcuuugagguggucaucaaaagccauucuuggaaacauucuuugagcuguaccgugcaauucggucaccaauugcacguauuuggauauuaauauccguauguggauauuaaauugguuuuggguuuuguuuuguuuugauuguggcaaaauauacacaacaauccuccugccucagccucccaaguagcuacaggcaugcaccaccauacccagcuaauuuuuggauuuuuuaaauuuguuuguuuguuuuuguuuuuugagauggaguguagcacuguugccugggcuggagugcaguggcgcgaucucagcucacugccaccuccgccuccuggauucaagugauucucuugccucagccuccugaguagcugggauuacaggcgcccgccaacacgcccagcuaauuuuuuguauuuuuaguagagaugagguuuuaccaugucggccaggcuugucucgaacuccugaccuugugauccacccgccucagccucccaaagugcugggauuacaggugugagccaccgcgcccggccgauuuuuguaguuuuaguagagacaggguuucaccauguuggcuaggcuggucccgaauuccugaucucaggugauccaccgccucggccucccgaagugcuaggauuacaggcaugagccaccgcacacagccuaaaugcugugccucacgccuguaaucccaacacuuugguaagcugaggccagaggauugcuugagcccaggaguuugagaccagccugggcaacauaggaagaccccaucucuauaaaaaauaaaaauaaauuagccaggcgugguggugcaggccuguggucccagcuacucgggaggaugaggcaggaggaucgcuugagcccaagaggucaaggcugcagugagcugugauugugccacugcacuccagcaugggugaaagagcaagaccuugucucaaaaaaaauuaagcgaaauuuaaaauucuguuucucacucacacaggcugcacuucaagugcuuaaucaucccuugugggugguggcuaucauauuggacagcauggauagagaauauuuuuaucagcguaggaagcuucaucagagaggaccgcucagaggccuguggggaccagcacagugcaguagaagacacaggccagcuggugagagacuggucuucugaucccagaucugucccucacuugcuaggugaccuuggacagcucccucagucccucuggaguuuucucuucauuguuaaaucaggaaauuggccucagugaauucugaggccccaucuacuuuuuuuuuuuuuuuuuuuuuuuuuuuuuuaauugagacagagucucgcucuguugaccaggcuggagugcaguggcaugaucuuggcucacuguaaccuccgccucccagguucaagcaauucucugccucauccuccccaguagcugggacuacaggcgugcaccaccaugccuggguaauuuuuguguuuucaguagagaccggguuuugccauguuggccaggcuggucucaaacucccaaccuugagugauccucccgccucggccucccaaagugcugggauuacaggugugagccaccacgccuggccucaucuaguucuaaauguuaugacccacucagcucugaagacaagggaggaacauccucucagucuagcucugacaugcagaagccucucacccugucccccaggucauaaaggcaggcguguugugaagagcacagaaugggcugagaaaaauaugcagggauugcgucuaucucccuuccuuccgcacguuuccuugucggcaccaccugccucuauuccgcgccgcacacacacccgccuucucucugucucggaggaagacaggaucuuccaucccccaaauccugcccugauuccuacucugaagccucugcccugacuccuuuaagcucccugggaauacagcccaucuccuaugcccuccucaucccaguaguuccuaccuuccccaaaaucgcuuugggaaagucccccaaugaguaaccagcuguccuacaugggcaucucagaacuucucuucuguuguuguuguuguuuguuuugcuuuuguuuugagacaggaucucucuuuuucacccaggcucgagugcagaggugugaucucagcucacuguagccuugaccucccaggcucaggcgauccuccccccucagccucuggaauagcugggacuacaggcacacgccaccacacccgggcaaauuuuuuuuaggacuuuugguagaaauggaguuucgccguguugcccaggcuggucucuaacuccugggcucaagcgauccgcccacuuuggucucucaaagugcugggacuacagacaugagccaccacacccggcagagcuucuauuucuugaguguguucucagccaugcuaagacauuuucucuucucagccugaugaugcuuuuggcuuguguuucuuuguuuuuaauuaccccuucccagucgcugucaugggaucaugagggucuucuguccaucuagaugacaccuuucuugugccacgugucuccaacauucccugguuuuuaaacccuuauugcuuucaagauacuauccaagcuccuuaauguggcacauuguccuucgcugcuaucugccugcuuuuuuuuugagacagagccucgcucuauugccuaggcuggagugcaguggcgcaaucacagcuuacucugcagccucgacuucuugggcucaagcaauccuccugccucagccuucugaguagcugggaccacaggcaugcaccaucaugcuuggcuaauuuauuuuuauuuauuuuuauagagaaggagucucccuauguugcccaggcuggucucaaacucccggacucaaaguucauugcaguuucaauuuuuuccuuggcucaaggauccucccacuucagccuccugaguagcugggacuacagacgggcaccaacacaccuggcuaauuuuuguauuuuuuguagagauggggucccacuauguugcccaggcuucuaucugcuuuuaucucaccuuccacucuuccauccuuccuuucuuuucuuuuauuuccuuucccuucccuugccuuccuuuucuuucuuucuuucuuucuuucuuucuuucuuucuuucuuucuuucuuuuucuuucuuucuuucuugacagagucuggcucugucacccagacugaagugcaauggcaagaucuuagcucacugcaaccuccaccuccuggguucaagcaauucuccugucucagccucccgaguagcugagauuacagguaccuggcaccacacccggcaauuuuuuuuuuuuuuuuaguagagacgggguuucgcuauguuggccgggcuggucuugaacuccugaccucaggugauccucccaccucagccucccaaaguguugggauuaacaggugugagccacugugccuggccuuuuuuuuuuuuuuuuuuuuuuuuaagacaggaccuugcucugucacucaggccagagugcaguggcacuauaaucacuuucugcagccgugaccuccugggcucaagggauccucuugccuuggccucccuaguagcugggacuacaggcaugugccaccacacuggcuaauuuuuaaaacuuuuuguaggccgggcacgguggcucacaccuguaaucccagcacuuugggaggccaaggcgggcggaucacgaggucaggagauugagaccauccuggcuaacacagugaaaccccaucucuacugaaaauacaaaaaauuagccagguaugguggcgggcgccuguagucccagcuacucgggaggcugaggcaggagaauggugugaaccugggaggcggagcuugcagugagcugagaucacgccacugcacuccagccugggcgacagagcgcgagacaccaucuaaaaaaaaaacaaaaaaaaaaaacaaaaaacuuuuuguagagauggauucuugcuagguugcccaggcuggucucaagcuucuaggcucaagcaguccucuugccugugccucccaaagccuugggauuacaggcgugagcccccacaccugguccuaacccacuuucugaacuuccaaccacaccauuuuguccuaauauuuaagucacaccauaacaugucccacuucagaaaugccuaccaaaguagucuucaaaucuuuuuaaaucaguggacccuuucuaccaaacaaauguuauuuuuuaaauauuuauuuuagaguaauuuagacuuuuagaaagguuguagcugggcgcaguggcuaacgccuguaaucccagcacuuugggaggccgagacagguagaucaccugagguugggcguuugagaccagccugggcaacauggugaaaccccgucucuacugaaaauacgaaauuagucagguaugguggcacgcgccuguagucucagcuacucgggaggcugaggcaggagaauugcuugaacccaggaggcggagguugcagugagcugagaucgcgccacugcacuccagccugggugacagagugagacuccaucucaaaaaaaaaaaagaaaagaaaaaaaagaaagguuauaaauauauuauaaagaguucccacauacccuucacccaguuucuccuguuguuuguaucuuauauuaucaccauaugcuugucaaugcuaaggaauugcugggugcagaguggcacauggcugcagucccagauacucaggaggccaaggcaggaggauaucgcuugagcccaggaguucaagucuagccugggcaacacagugagaccucuuuucugcaaaagaaaacaaauaaaacaucuaaaaaagaauacacuggaggcggcguggaaacaaggaucucauuugggaguugucugcaauguucugagcaagcaguaacggaggccucaagucagggcuguggucauggagguggggaggggugguugguuucacuaucuguguugacuuaauuuuagauuugcagacucaacugaguaugaacuuuaagagaaagagagaggccaggcacggugggucacaccuguaaucccagcacuuuaggaggccaaguggggaaggccgcuugagcccaggaguuugacaccagccugggcaacauagugagaccccugucucuacaaaaaaaaauuuuuaaauuagccaggcagggugaugugucccuguaaucccagcuacucaggacagugaagcaggaggaucauuugagcccagaaaguugaggcuguagugagcuguaguugcaccauugugcuucagccugggagacaaagugagacccugucucaaaaaggagaauggggagagagagagagagagagaaggagaaagagagagaaagagagagagggaagucaaggagaaccccacauuuuuugacaugguguauuagucucuucucacacugcuaauaaagacauaccugagacuggguaauuuauaaaggaaagagguuuaaugcacucacaguuccacauggcuggggaggccucacaaccauggcagaaggcaaaggagaaguaaaggcaugucuuacauggcagcaggcaagagagcuugugccauuuauaaaaccaucagaucucaugagacuuauucacuaccacaagaacaguaugggggaaacugcccccaugauucaguuaucuccaccuggcgccgcccuugacacguggggauuauuacaauucaaguugagauuugggugggaacacagccaaacccuaucacaugggcaagugaaaggauggguuugccaucaaauaaaauggggaaggagacugacuaggugggcagauuaggaacucagcuuucuaugaagugccuacugauggauagagauauuguguuggccaucuauuagguuggugcaaaaguaauugcgguuuugccauuaaaaguaauggcaaaggaaauaaccuuugcaccagccuaauaggaauuggagucuaaaauucaaaaaagguaagucagagcuggagauccaaaggcaggagucagccuccuguggaggcuauuuaaggaacugaauaagggcauagaugcaggagagcacccaggacugagcccagggcuuacucuccaucauuaaagagguuggggaagaugaggaggagccagcagagaagacugaauuggagcaaaucagaagaaugugggugcuggcugucaugcaaggaaagugcuaagccauuucaaguaugagggaaugaucaaugauguccacugaugcugauguguugacucaaaugaaaaaugagaaucaaccauuggauguaguggcauggagaucuuucgugaccugagccagagcugcuuaggugaagaggugaaggcaagaggcuacuggaaggauuacuacuagcucuuuuaaagaguucugcugugaaggguagaggaagagagauggggcauguguuagcuggugggggaaguggauuucagagguuuguuucccuuaaaaaaaaaaaaaaaaagaaaaaagaauaaagaaaaaaaaaaggccaggcacaaugacucacaccuguaaucccagcauuuugggaggcugagaccucgggaauuugagacuagccuggacaacauagugagaccccaucucuacaaaaaaaauuuuuuuuuaauuagcugggcaugguggugcaugccugugguccuagcuacuugggaggcugaggugagaggaucucuugagccugggaggucgaggcugcagugagcuaugaucacaccacugcacuccaggcuggacaacagagcaagacccugucucaaaaaaaaaagaugggagaccuaacagcagauuuuaugcugauaggaauaaccuauuaggggagaaaaacaugaggaugcuggaggaagaagagugucaggaggacaucucuugguggacgagaggggauggcauuugguguacagguggaagguuucacuuuagaugacagcacacacaguuaucuauagaaacaggagaaaaugcacuauaugggcauacaugcugggagguagagaguaaauaauaguggugguugcuuguggaaauucucuucuaauguuuuuauauuuuuaugguuuaucaaggacaauuuauauuuuuacaguuuacugcaaacaacaaguucuaauuuauucaauaauuauuuguggguagaccgagugcaguggugcaugccuguaauccuagcacuuugggaagccaaggugggaggauugcuugaacuccugauucacuucugagcuugaaucaggaguucgagaucagccuaagcaacauggcaaaacacugucucuacacaaaauacaaaaacuagccagguauaguggcaugcacguagucccagcuauucgggaggcuaaaacgggaggaucauuugagcccugaagguggagguugcagugagccaagagcgagccacugcacuccagccugggugauagaauaagacccugccucaaaaagaaauucuuauucuucuucuucuuauuauuauuugaggagacauuuacuuuguaccaggcgcugugcuagaugcuggagauacagacaucaacaaugacaaggcuaagugccuggcguauuuguacuuugagucuaauaaaagacaucacacagacacacaacacacacacacacacacacaggauugucaaaggaucaaccauuucacaugucaagaucaggaaugauauuggucuacuacugccuuaccauaucuccuaccaugaccucaucuuccucuugccagauuuuaagucuuuauaccucaacucccagaacucucuucgccucacacccuaucacaaugucauccguaccccacggccaauacuccaucauucgggaaagcaaaguuccaaagcgucaagauuguaucaauggaccugucucuauggcaacaguccugaaugagccaagcaagguaacccuggagauggcgugaaugagaaaguggccuguugccacggagacgugcugaaugggaaggcccccacgagccaggcuaugucacgaagccgaaacagucagcaugaagucgguaugucuauuuucaacucggaauuacaaaaauacauuuuaauagagcucaugacccaucuccuuccucgucccugccucccaccccacucuucagccuucauccuacaacacaaucgagccucaccaggaacccuucaaaccccucaaggacaccuuacuguuccuucaguacacaguccccuuccugggcugaggugguauuccuuugaccaacuacugucuccccuuugggaccaacaguauucucaaaagccaugagcuuaugggaagaacauuaacuacauucuuuggggcaagaacaguugcucaccugugaaccagcucagcuugcaucugugagaaugauugcaauggguagaccaguucuccaucaaagaauggcccuagcaccccacacacagugguauaaucugaucaugcugguguauugaacauauaauguuagugccacaugaaaggaauuuguaaaaggacuuagugccuagaaagguaccuuugaagaucuuggaaucucugaaacuuacccagguuccuuauacccugcucaaaguauuccuccauuuauuucuucauucauuaguucuuuuguuucaccacauauauauuuuugaaacggggucucacucuguugcccaggcuagagugcaguggcaagaucguggcucacugcagccucaaccuccccaucucaagcaguccucccaccucagcuuccugaguagcugggacaccacagguacaagccaccacgccaggcuaauucuuguaauuuuuguagagacgggguuuugccauguugcccaguguauucguuuguucucacauugcuauaaagaacuaccugagacugaguaguuuauaaagaaaagagguuuaauugacucacggcuccacaggcugugcggaaggcauggcugaggaggccacaggaaacuugcaaucauggcggaaaaugaaggggaaacaagcacaucuucacaugguggcaggagagagagagugagggggggagugcuacaaaaccaggucucacgagaacucacucacugucaugagaaaagcaagggggaaaucugcucccaggauccaaucaccuccuaccaggucccucccccaacauuggggauuacaauucaacaugagaucuggguggggacacagagccaaaccauaucacccaggcuggucucuaacuccugagcucaagcaaucugccugccuuggccucccaaagugcuaggauuacagacgugaaccauauuuauuaagcauuguuacagcaaagagaagcauuguugcagcauaacaauuggaagacuccauugauggacgucuccaucaacaagaacugucggauaaacuaugguacacccaucccuuagcguguuaugaagucauuacaaaaagaagaagcagaucucugagugucaauaagagcuaguacuuauagggugucuacuguauacaagugcuguuagaaagugaguauuaacucauuuaauucuuguaacaagccugugagguggauucuuucauauccccauuuuacagagaaggaaauaggaaucucuauauccaagauauguuaucaggugacaaaagcaguuuuugaauggugccgccauuuucucguaagagcaaaucuggaagauuccaugagaaauuaauaauuguguuugccucuguagcggcacccugaaagauuuggaaguagguguggaaaggaaacuuacuuucuugugucuuucugaauuuuguacugucuacgcguuuugucuuucacaaaaccaaacagaaaaugaccauuuggugcauuuugugugucaggcauucuucuagucuagagaagcacaggagagcaaaauauuuuacugacgagaaaaaugaggcauggagaaguuaagugacuugcccagguagcagagcugggauuccacaucauaggguuuauacaggaaacagguaaacagagcugugcuuguguguggguauguguguacacaugcauacaugugugcauguguguguguguuugugugugugugaaugugcuuguguguugggagagggaaauggcaagagaagaaccuacagaaggucagcaggaaccaacccauguuuugaggaguuuggacuuuauccugaaggcacaagggagccauggaaggauuuagacaaggggugguugugcuuagcuuuuuauuuagaaggaugacucuggcugaagggugauggcccagaauacagguauaugugaaggacuccuccugcccuaguaggaggaugcccacccacccucucugcccagugcaguaucaaagggcaaauuggguacagagaauucucaccaagcuggguagaauccacucugaugcuggggaguggacacugaaugcaccagccucuccuccugcucaaucccugaauugaagcuguuccacuaauguuagggaucagauucccuucauauauauauauauauauauauauauauauauauauauauauauauaauuuuuuuuuugagacagagucucccucugucacccaggcugaagcccauugucgcgaucuuggcucacugcaaccuccaccucccagguucaagcaacucuuguuccucagacucccaaguagcugcgauuacaggcacccgccaccacaccuggcuaauucuauauuuuuaguagagacagggauucaccuauguuggccaggcuggucuugagcuccugggcucaagugaucagucugccucagccucccaaagugcuaguauuacaggcaugagccaccaugcccguccuuuuuauauuaccuuuuuuuauagagaugugguuucacuauguugaccaggcaggucuuaaacuccuggccucaagcgauccucccuccucagccucccaaaaugcuaggauuacaggugugagccacugcaucuguccagacucuguucuccauaaagcuggcauauggaaagagggaagaccauccaggcaauaucgaagucccauuggugcugauguggcugcugagaccacaugaauggaugcauucugacucugccaccucucagcuaugugacccugggccagucagcaagucccucuauaacucaguuuucucaucuguaaaauggcgucaacaguagccaaccccagcaaauacugugaaauauacagaacaucauuauaauggugaggaugauagagaugcuauguuaucagaauaccugggcuugaaccagcuccccuucuugcaagcugugugacuuggagcugaugcccaaaccucugugggccucauuuguuucaucuguucaauggggauaauaacacucuuacuucauacaguuauggaggauuuauugaaauaauugacauacagcucuuagaacaguauccggcuccuuguaagcgcucaagaaauauuacagacuguugauaauaaugcaauacuacuaccaauaauauggccaggagcaauggcucacaccuguaaucccagcacuuuaggaggcagaagcaggcugauugcuugagcacgggaguucgaggccagccuggguaacauagggagacucugucuuuacaaaaaauaaaaauaaaaauacaaauaauuagccagguaugguggugcauaccuguaguuccagcuacuugggaggcugaggugggaggauugcuugagcccaggaaguugaggcuacagugagcugugaucacaccacugcacuccagccagggcaacagagugagacccuaucucaaaaauaauaauaauggccgggcgcgcuggcucauaccuguaaucccagcacuuugggaggccaaggcgggcagaucacuugaggucaggaguuugagaccagccuggccaacauggugaaaccccaucuacuaaaaacacaaaaauuagccgggugugguggcggggugccuguaaucccagccacucaggaggcugaggcaggagaaucgcuugaacccgggagguggaaguugcagugagccgagaucacaccacugcacuccagccuaggugacacagugagacuccaucucaaauaauaauaugaguaauaauaauaauaucauuuuuaucaucauucuuacuaacagucucucacuccuugcccugcaguuuugccuguuuucuuggaauaacacucuuccacaccuuuccccucagggaugguucacguuuagcaucaugacccaccccuggggauuaguuagcucauuucuggaaagcacuuuggagcuguaggugcuuugcaggcuggaaacaucacgggacuuguaccauauuuaagcaaugccagauuauucugccuggcagggggaggacacagaggauacggcccugguaucuuuucucccugccuaccucagcuuugcucugaaccauuuucuguccuguucagggcagccugggccacuugccacuuccagcuuucucgggagaggaugccuuccugauggcacgccucuuaacacacaccuggugcuguuguugaaaaagcaacaauugacuccagcgccagcacugagaggcuuguccuuaaaauuagcaggagcuguuggaaggucgcuguuagcucuuuugacuggaacacacuguuccccagguggcaugaggcugaauacagugcagggauuggcucugcucucagguggccugcuccacgcuccugagcuccggguggaagcugugaccauuauuuccuuaacagaaacauauauagcagcauuaacuaugaaccuuauuacuguguguguguguguguauauguguauauauauauaugcacauaugugcauaugugugccuaugaaccuguucugagcacuuuacaaaugucaauguauuuuauccucccaacaacccauuuuauaaauaagacuugaggcacagagagguuacguuacugccccaagaucacacagcuggagaguggugaggccaagauuugaacauauguaccauuguaccauauguaccaacuuuuuuuuucuuuuugggaugcauucuugcucugucacccaggcuggagagcaguggcaugaccacggcucauuacaaccucaaccuccagguucaagcuauccucccaccucagccucucaaguagcuaggaccacaggugcauaccaccaugcccagcuaauuuaaaguuuuuuuuuguuuguuuguuuguuuguuugcagagauggggucuccuuauauuacccaggcuggucuagaacuccuagguucaagcaauccccccaccucggccuuccaacaugcugggauuacaggcaugagccacugcacccagguccucccuccuuauaaaggucgccaagcacaaucuugugagccuggcccuauccacacccauacgcaacaugguguguauuuuucaaacaaaaacugaaugaacaccucugguuuggguuccccucacacuugucccggguuuguugacucuguguugugggccuagacaaagcagugucuggagcuccuagacccagggaccagacagucuggguucaaauccuggcucuuccacuucugccugagugcucucucugaaccugucuuucuuuaucuauaaaauggagauaauuuuuuuaaacucaucacuuggucaaacugcuuugagcaugcaaaugaguucauauguauaaaccucuuagaaugucccaggcaaagaacaacacuucacucagaucaacauuuauuuagcaucuacuguguacccaugacuauucuaggugaugaggagacccucugguucuuaugagguagugaggugggggagggugagaacccuaaacauuaacgaugguguguucgcaggugggaaaaucaguaaagucggguaaagggaauuugggagugcugugcucaaguccuggcccugccacuuucuggggugcaagauacagcauugaauaggguggucaggguaggccuuauugggaaagugauauuugagcagacgaucuagaugucggcacauauugcuacuguuugaugguacuaauaugaguuugaguuucacuugcaaguauauauauauauauauauauauauauauauauauauauauauguguguguguguguguauauauauauguguauauauauguauauauauguguguauauauguauauauauauguguguauauauguauauauauguauauauauguauauauauguguguauauauauguguauauauauguauauauauauaugaaauuugguccauuuauuuaugcugaucaauuaauugauguugaaauuauaauugaauguuuuauuaauaaacagauacccacauacuauuuuuucagaaauuguuagguuuugggguuuucuuuagauuuugauuauuuuuauuugcuuaauuuucuuuuuucuuuuuuuuaauuuuauuuuuccauaaguuauugggguacaggugguauuugguugcaugaguaaguucuucaguggagauuugugagaaccuggugcacccaucacccgggcaguauacacugcaccauauuuguugucuguuauccagugcucaccuccuacucuuccccccaagucucuaaaguccauuguaccauuauuuuacucacccacauucuuuggccugagaugcugaguggucaugacucccagaucccuucuuguuucuguaucaaagaucuuuacuaagauccuggccuagggaaccuauucccuuuccucauccccaaugggagaaggggcuucuuccccagcuuauuugccaacucauaggaaagguaugaaggagaggacuguaguugucuugaagcuggucagauguugaagagaugauaauauuugcugaucaagagagacaaagcaaugcuggaagaagaggcuguguuaguuaacaccagcugcaauaaccaauaaaaccaaaaaucucuggcuuaagaguaugcaugagugagaaaucaacuucuaaaguacaacugguggccggaugugguggcuuaugccuguaauucuagcacuuugggaggcuguggugggagggucgcuugaccccaguaguuuaacgccaaccugggcaacacagugagacaccaucucuacuaaaaauaaaaaauaauaaagugaaacuggugaggggugcaaugagguggaguggugggugacucaaauauggcucgacuccaugcagucacucagggauccaggcuguuggaggcucucccugcuuaaacauguggcuuccaagguuguucuaagagccuacauugagacagcagcuggggaaaagggaaaguggagugggagguacuuaugaggguuccuggaaguggugaacaacacuucugccugcauucuauuggguggaauuuagucauguggcccaggcuagcugcaugggaggcugggaaauguagucucugauuaggcugccauuucccagucccacuugugaaucuuuagugggaagcucaccauguuugcaccagggauucagucuaccucccacucaugccucaacuauguaucaggcacugucguaaguacuuuacauaucagccuaccuaaugcaaacaacuacucagugggugcuuuauuggucacauguauuagugagaacauggaaacccagagccguuaaauaucuugcccaaggucacacagcuaggaaguggcagaguuggaauuugaauccaggaaaucuggcugcagagccccacgcuuaguauaaauucauuguaguuuagaaagaggcagaaggacccuaaaauuggcauaauccauuuuuuggucccuaaggaacugacugaauugacuacuuguaaaagugaguccuggacaggcaacaguggcucaggucuguaauuccaggacuuugggaggcugaggcgggcagaucaccugaggucaggauuucaagaccagccuggccaacauggcaaaacccugucucuaaaaaaauagaaaaauuagcuggguguggcggugggugccuguaauuccagcuacucaggaggcugaggcaggagaaucguuugaaccugggagguggagguugcagugagcaaagaucacgccacuuuacuccaacuugaaugacagagcaagacucugccucaggaccgccauggcccccuggguucuaggucagaguuucuccgccacagcacugaugacuuugggggcugcauuauuagcuccaaaaugggagcuauccugugcacugccucaacuuacuugaugccaguagcgcccgcgccccaguugugagaaccaaaaaugucuccacacauugccaaauguccccugggaggugaaaucaccccugguugagagucacuguucuagauuguuaaauauuaucuuacacucuagcacaaguccaaggcaaacugacuuagaaauuaccaaccuugcaaaaaauagaagauuucuuaaagucagugagcaugaugguggcaagcugcugaaaucacacccccagacauuagcagaugggaucuggacaguauucaucuaguuaaaaauugacaaggacugggacacugcaggcucuucaaaagagaaucauuugaauaacaaggggucaagacagggguaauuggugaaagccccugcucauaauuugaaaauauaaauaggcaucaugaaaauucauccugcaaaagucaaaagucgaaugugcaguguuauacaugaucaguugauuugggaggggaaauugcaugcacacacaugagagcuugcacacccacacacacacaccuguucaagugugugugccagugcucagugaggaccaucuccccaaccugucugaucaucuugcuuuggggugacccuaugggugaggcagaaauucuuggaucauaguuuucuaaugaauauuauaauuguuaacuucugaugggugcugacuuuuucaucuuugcaacacugcguagguauuuuuacucuccccauuuuacagaugagacaacugaggcucagaaagauugauuagcucuacacgaagccaggauccaggcuuagccuggcuccaggaaucauguuuugaguuacguagcuucccugauucugagggaccuccccacuucugaaaucuucuacuguuacuccccauggcccuuuccuauugaccggaggcaccccagcuccucacucgucccuuaucuuaugaaacaugaccaugaugucugaauucaaaggagagccugggcuuuguggggaaaacgaagcagaaaaagaaagguggagguuggugguuguuuuuggcauggugaggagccugucguugcuugaggaaagcaagaaaggagauugcuggggcuuggauccaucucugggugccugugggucugucuguaaaaaugagaacuggucgugcucauuagaggauuugaccguuaggccuugggauagcgauuugggaacuuuuuucugcuaagacaaagaauaauaugguucagguucauuuugcuccugcuuucccaagcccuacaucucuucugggcuuuuuuuuuuuuccuuuucucuccuucuucuucuucuucuucuucuucuucucauuuuuggaucuggacuucugcugacucaucucucugagcaaggaaggagggaggaagucagaauugcucauuaaccguuuucuuuagugacucagcugugauucacauuuuaauuaauggaggagaaaaaccugaucaguccuaaggcaucugcccaaucacgcauaacuccaggcuggugauaauaauaauacuugaaaaaagugggguguccugaauuaaacuauggcucauuccccacauuagucuugaggacuccaccaggcccucuaaguuccaggucucaauggggcucccugaaccagagcagcuaguccaagccccgagcagcauuucugcagaguuagucugaggucaggacaagaaacagaggcucaagcccuccugggaucgcaggaggaucaugggaauguaauauuguuuccugagcuggucuuuggcuauaaucccaggcucaagccuggccucccuccccucggggccugaaauuugucagagccuauugcaggggcagcuucugugcuuuuuguuugcccagagaaugagaaaaguccagauaaucaugaccgcuacuuccugagcacuuacuaugcaucagguggugugcucagcacuucucaugaaugaucacguugaauccucacucuguccacaaaaagaaagagcuuuuauauaauucuccaaccucccuaugaggaaacugaggcuuggcaauugcccaauguagacaauuaguaaauaaucaggcaggauauaaacccaacccuuucccaccugggagccagagcuugcaucuacuauacuucucugcuuuccagucagcugcaaagaaaaauuggaagcugauagcucauucaacaaacacuuauugaacccuuccaccugcucagcccuguucuagacaccagagauccaucagugaaccaaagaggcaaauccauggucucaugaaacugacaauuuaccugcccaaguguauuaguuacuguuuauaaguuccuauuaaguguauuagauaugcuugcagcuguaacaaagaaucccaacaugcauaagggcucaaaacaauaaaaauuucguucuugcacagauaaaguucaaaagguguauucuuuuuuuuuuuuucuuuugcgacggaguuuugcucuuauccuccaggcaugagugcaauggcccagucucggcucacugcaaccuccaccuccuggguucaagcauucuccugacucagccuccccaguagcuggaauuacaggugcccgccaccacaccuggcuaauuuuuuguauuuuuaguauaggugggguuucaccauguuggucaggcuggucuuaaacuccugaccucaggugacccaccugccucggccucccaaagugcugggauuacagccgugagccaccgugccuggccaaaaaaaaaauguauucuuaaacagcaggcaccucuccucuaagcaguaagucaggggcccaggcuuguuccauauuguagcuccucaucuucaacccauggcuuccaaagucuccaugcuucuugauaucaagccacagaagggaaaagagcaugagaagggcacaggagaaauguuucugggacagacccagaaguaguccauaugacuuccaucuaccucccacuggcuagagcuuacauggcggcacccacuugcagagcugggaaauggagucuaacugagcauccaggaaggagagacagacaugagucuuugcguggguccucacugagaaucaagcuccacauuuugaucgaugucaccagagcguacauggcggcgcccacuugcagagcugggaaacggagucuaacugagcauccaggaaggagagacagacaucagucucugcguggguccucacugagaaucaagcuucacauuuugaucugugucaccuccuugcaagcccuaccuuaggacaauuuuaagggacauuccuaucuucuuccacccuuaggacaguuuuaagggacacuccugaguucuuccacccaccuccucuguuucuugggcuuccagcucucaggauuugccuuugccuuacaauggggugaagcaagaaucuggaagaaugucucuccccacaauuugaagucuuauuugaaaaaaagcaguagagcaucccucccucuugagguagggaaaucuagaaucaaauccugcuucuccagacuuugaccucagaaacuggggggacuucaaggucuucaggugggcagcuuucaugaaccauucauuccucccaccucauaccaaucaggguccuaacaggaaaaagaauuaacuucuagaugguucaaaagaagaccaugccaugaagagacuccuuaaagagauaggaacaggugagagaaauagauaacggcuguuugagguccucagagagaagccaucgcgagcccuacauuuccuggaacccaguggaggcagagcugugcagaagggacuacugucagaaccagggagggagcagggaagcaauauuccaaucucuuucccuccccucaucuucugccagcgcuuccccucagccaaaccaaaccggaaacggagcaaagcauucugggaguuguagucuucaaggguccgccucgagggcacagagcccgcuggagcauugaccuagagggcacacagggaaugacuaguuugcaccaucaugugacggacugcacgcccucgauuauguaauccacucuauaauucaacugcagagcugcaugguacagcaggauagccacuagccacacgaggcuauuuaaauauaaauguacauucauuaaaauuuaaccaaaugaaaauuuuagccacugagccccauuucaaaugcucauuagccacacguggcucuuggcuaccauauuggacagaucagaauagaacauuuccaucaucccagaaaguucuaggggccggcgcagcugugguguaaccugagcccaugcauguuauggaauggagaagagagaaaacagcacaagaggcaguuuugaagggagacagagagcuguggaucaguagggaggagacucucuaggcaaaggagcaguugagaagcaagaaaguugagugagcugcuuugcugcgauggaggcuucccucacggggaagaguagagucagaaagcuuuaguucaaguucagcucugaaaugaaccaaugaguguucugacaagacaccuggccuuccggaaccuugguuuuguaguggccaagggcuugacccucugaagguucacugaaaaaaaucaacucacaaggcauauuaauuggagaaaaggcaggcagauuuauuuaauguguuugcacgagagccuucagaaugaagacccaaagcugcaggggaaauuguccguuuuuuaagcuuagguucaacaaaguauggacagcgguguagaaauaugauugaacaaaaaguguacaauguaaaugcuaauagacugaguggggaaacccaaaaagggcugucuugauucuccuuggucucucugagcaugcauuucuuccggguaugggacaagacccucucuggaauggagggggggcucucuugguucuccuuggucucucucagcaugcauuccuuccggguauggggcaggacccucucuggaauaagggggcugucuugauucuucuuggucucucagagcaugcauuccuucuggguauggggcaggacccucucuggaaugggauccuuauaaccuacggucaaauaacguaaguuagauaauuucuuuuuuuuuuuuuucuuuuuuuugagacagagucugauucuguugcccaggcuagaguacaguggcacaaucucggcucacugcagccucugccuucuggguucaaaugauucuccugccucagccucccaaguagcugggacuacagguaagcaccaccaugcccagcuaauuuuuguauuuuuuaguagagacaggguuucaccauguuggccaggcuggucucaaacugcugaccucaagugauccaccaccugggccucccaaaguccugggauuuguaaucccagcaugagccacugugcccagccagaucauuucuuuuucuuuuucuuuuucuuuucuuuuuuuuuuuuuuuuugagauggagucucacucuguugcccaggcuggagugcuguggugcaaacucagcucacugcagccucugccuccuggguucaagcaauucuccugccucagccuuccaaguagcugggacuagaggugcgcgccaccaugcccagcuaauuuuuguauuuuuaguagagacaguguuuugccauguuggccaggcuggucuuaaacuccugaccucaagugauccacccacgucggccucccaaagucccgggauuuguaaucccagcaugagcuaccacagcuggccagauaauuuuuuuauaacuaguuuuuacaaagaaagguggagggaaaguuagaguaacauuuuuagguguuagggcugacuuuggggaaaagaggucugguuucuacgacccgccuuagggaagagggauucuaguuuuuguggcuagccccaggggagaaugggacuaagagauagaagggcaggagaaggucagagaaaaacuuuugcuucuguggcugcuucggagaacuucauuuugggguauuguuuucugagccccaacaguuugcuuaucagugaaguggguauaggcgcccaccucccacagugacgaugcugugaacagggcuuuggaagaguagaacuaugaaauauuuguuguugccuuguggggaaauggucguuaaagccaaaauuguucaagagaagaagcaggaagaguuccuuucuuuccugcagguauccucuuaagcugagucuucagaauccccugacaacguuuaaucaacacuuuauuaaauucaccccaacccugcuucaaaccuucaccugguccucgagaucuuccaacuguuucuugaugaaguuagcaggcaauuguauggcgggaucaucaucucauguuuuguuuuguuuuuuuccuuuuuacccucugacuuugagaaauccuuguccuuuuacuuuuccaaaccugagagcauugcagagaaguuagaauugagcaggacaugggcuuaagacccagcccagccaugugcuagcugugugaacucgaagcagugaccccaccucucugaccuggaaaguagagggaaugauaggacccaccaccgccacacuuguagggucaucauggggauugaauaaaauaaugcauaagacuuggcccacagcaagcacucaagaaauguuagcuacuuccuaaauauauuuuuaaccuuuuauugaauauaacauacauacagaaaagcacauguaucauacaaguagagcuugagugauuuucaaaaacugagcccagucauguaaccagcgccuaguucaagaaacagaacauagccgagugaggcugaggcaggagaaucacuugaaucugggaggcagagguugcagugagcagagaucaugcuaucgcuccccagcgugggcaaugggggcggaggggaagagagagagagagagagagagagagaggaaggagggagggaaggaaggaaggaaggagggagggagggagggaagggaaggaaggggagagagagaaaaggaaagaaaagaggaagacagaaagagagagagaaagguaaagaaagaaaaggaaagaaagagaaagaaagaaaagaggaagacagagaaagaaagagaaagcuaaagaaagaaaaaaaggaaggaaggaaaauagggagggaagaggaggaggaagaagaagaagaagggggggagggagggaacagcugcagcuucgaggaaggaaggagggagggaaggaaggaaggaaaggaaggaaggaaaaaaaaacagcaccaacguuuagaaacccccuugugccucugaggucaccaguaacuccauccugacuucaaacagucuagauuaguuuugcuuguuuuugaacuuuaagcacauggggucauacagcaugcaugcauugacuucuuucccuugacguuguaugugugagauucaucugugcuguugcuguucauuuguucucaucgcugugugugcugaaccaccuguucauuuacucuacuaauggugggcaguuuggugcuuucuacuuuggggcuauuccagagaaagcuacuuugaacacacucagauaugucugugggugaccacucuucauauuucuaugggagauauuccuaggaccggaacaucugagucagagggaggaauugguuuagcuuugguaggaacugccuaacaauuggccgggcacaguggcucaugccuguaaucccagcacuuugggaggcugaggggggcaaaucacuugagcucaggaguucgagaccagccuggccaauguggcaaaaccccuggccaacauggcaaaaccccgucuccgcaaaaaaauacaaagauuagccgagcaugguggcgugugccuguaaucucagcuacucaggaaacugaggcaggagaauugcuugaaccugggaggcagagguugcagugagcagagauugcacuacuguacuccagccuggguggcagaauacaugaaacuccaucucaaaaagaagaaaggaaggaaggaagggaaggaaggaaaggaaacugcccaacaguuuucccaaguguuugggauggaaggaaggaaggaaggaaggaaaagaaacugccuaacaguuuucccaagugguuggaccaguuaaaacucccaccaccugugaaugagaguuuguuuuuauuuugcuccuggagugccucuccuguagcagguucccacugaaugucugggaauucaaauguaaugcacuuguucauuuccucaagagcuucacuccaucaauuggauucauccauuggcucucccaucuccacugacacuauguucucaccucuauuuggaagacauccugccuccaccugcccaagucacauuaucuucucauuccagccucucaaggagaguuuucucuuucaccaccuccucuagcccuggugauuggcaaggucucgcaacaguacccuucaaaacacucaugacugugaaugcacuggccuucacuaaguuucccauucuucucuuucuuucuuuuuucuuuucuuuucuuuuuuuuugaacagaguuucacucuuguugaccaggcucgagugcaguggcacaaacacagcucacuguagccucaaccuccugagcucaagguaucguccugccucagccuccuuaguagcugggaccacagacaugcaacguugugcccagcugauuuucuuuuuuuucuuuuuuuuuuuuuuuuugagacauggucucacccugucaaccaagugcaguagcaugaucacagcucacugcagccuugaccucccgggcucaugcgauucucccaccucagccucccgaguagcuggggcuacaggcacaagccaccaugccuggcuaauuuuuguacuucuuguagagaccagguuucaccauguugcccaggcuggucuugaacucuugggcucaagcaguccuccugccucagccucccaaaaugcugggauuacaggugugagccagcacgcccggccauggcuaauuucuucauuuuugguaaagacaggucucacuuuguugccuaggcuggucuugaacuccuggacucaagcaauccuccugucucagccucccaaagugcuaggacuaccgaugugagccaccgcacccggcaauuuccccuucuugacuucuccagagcucucaucccucucgagcuccugucucuucuagaaucacuuaccucaccaccuuaugggguuuuugccucuguuccuacuccucuuuauuuaagaaaacacuguacuuuaagagggcuucagaaaccacccgaaauagaaacauguccuuuuguucaauccuuuacuuuaaaagacaaauaaaaugaagaauugcucuccauguagaagguuaaggagcuugggaggaccuucugugaguggggagaacuuuacauuaaaggaaaaaaaaugcuggagaauagcugugaacccaggaagggagaaggacuuccuccacugaacuuguaaagcacaaacucuaaggcaaaaaaagacaugauuacaugaaaacuaagauauuuguucaaauaaagaugcaauuggggccaggugcgguggcucacgccuguaaucccagcacuuugggaggccgaggcaggcgaaucacgaggucaggagaucgagaccaucuuggucaacauggugaaaccccaucucuacuaaaauacaaaaaauuagccaggaauggugucacgugccuguaaucccagcuacuugggaggcuuaggcaggggaauugcuugaaccagggagguggagguugcagugagcugaaaucacgccacugcacuccagucuagcgacaaagcaagacuccguccaaaaaaaaaagaugcaauagcaggugguucgggaaccaaaccuuacauccagaugcugguugucccauuuccugugaauccuugggugaguuaucaaccucucugagccucaguuuccucgucaauaaaauggagaaaauaguaucuaccuauggaauuguugugaguuuugaaugaguuaauauuuauaaaucauuuagaauaggaauuagcacaugguaaauaguggauagaaucauaaaaaaaaaauugaucagggguuaacuucuaacugcuguuuguuauagaggucccuagcacuguguggucauuuuaaauuuagaugauuuagaauuaaaugaaauuuaaaacucaguucuucauucacacuagccacauuuuaagugcucaaaacccacaggugacuaguggcuaccauauuuggcagcacagauugagaacagauuuaucauccagaaaguucugucagacaguguugaucaaggcuacaugagggucugggugcaguggcucacaccuguaaucccagugcuuuggaaggccaaggugggaggaucacuggaggccagggguuugagaccagccugggaaacagagagaccucaucucuaccaacauuuuaagaauuagccaggcaaaguguugcaugccuguagucccagcuacucaggaggcugagacaggauugcuugagcccaggaauuugaggcugcagugaacuaugagcgcaccgcugcacuccagucugggugacagagugagaccugucucuaaacauaaaaaauaaaaauguagguggggcauaguggcucccgccuguaaucccagcacuuugggaagccgagaugggcagauugugaggucaggagaucgagaccacccuggcuaacaugguaaaaccgcguccguacuaaaaauaaaaaaaaauuagccaggcaugguggcgcaugccuguagucccagcuacucgagaggcugaggcaggagaauugcuugaaccugggaagcagagguugcagugagcugagauugcgccacugcacuccggccugggcgacagagcgagacucugucucaaaauaaauaaauaaauaaauaauaauaaaguaaaaauaaaaaugcaaagacuaccugagggaaugucugcaagucaaccagaauaacacagcaaccccaauaggaaaacaggccgaaaaugugaacaggcggaucagggaagugaagucugaaaagcuaaucagccuaugacaugguacucaaagucauuuguaaccagaaagauggaaaugaaagcaguaucucuguacaccuuuaauauuggggaaaaaauaugugaauaagccaaggguuuccagcgaugcgggcacagaggaaagucuugcaccacucaaagggguguggcccagggaggccacucuggagacauaucgguaguacucaguccagugagguccagcaccaucagcgcuuauguccccaggcauccaucccagggacauucuuaccaggucuguuaggggcagguacgagaaugcuuacuccagcaccaucuauauaaggggagcugaaggccaccuggugucccuccuggagaccaggaggcggcaugugacagcggcacccauggagcaccagaaugagugagagcuccagaccgcauauccgacagauacuacgggauggggcuuuuagaaauaugguuguugccgggcacgguggcucaugcgugucaucccagcacucuggcaggccaaggcggguggaucaccugaggucaggaguucgagaccagccuggccaacauggugaaacccugucucuauuaaagauacaaaaauuagcuggacgugguggcgggugccuguaaucccaacuacucgggaggcugaggcaagagaaucgcuugaacccaggaggcagagguugcagugagccgacaucgugccacugcacuccagccugggugacaagagcaaaacucugucucaaaaaauuuaaaaaacaaaaaauaaaaauaugguucugggugaaaacaggaaacaacagaaugugucuaacuucauccugcuuaugucaguuaaaaauagacacacucaaaauaucgcacguguuuuugcgagaaugcacuccuauaaggccaaauuaaacauucucucaguugucucugggagggagaagaaugaaaguaggguauagagagauauaggggaauuaaugcaugaaugaaugaagguauaaacaagagacaggcgucauacagaccaaagguaaagauaucccguaaccugaggagagcaaagaacuugacucugcauuugaagauucagaaaaugaauuucagaaauaguuuucucgccaggggguggcucacgccuguaaccccaccacuuugcgagggcgaggcagguggaucacuuaaggucaggaguucgagaccagccuggccaacaugaugaaacccugucucuacuaaaaauacaaaaauuagccaggcaugguggcaugugccuguaaucccagcuacucaggaggcugaggcaggaaaaucacuugaacccgggaggcagagguugcauugagcugagaucacaccauugcacuccagccugggugacagagcaagacuuugucucaaaaaaaaaaaaaaaaaaaaaaaaaaaagaagaggaagaaaucguuuuuucaagaaggggaaagcugggugauuuaagaaugaacuugaagaggaucacucaguccucaaccuaggaguggcaagaauauagacuguaugggaagugguucugcuccuugguacccaucuuagaaauauuuggccugagucuguaagaggcagguacuuuaucuaaccugagguuagggggccacuacauccccauccccuccccugcuuucuaaccaugcuaacaucuucucacucuccugucuccucuccuucucacuccccuaaucugccuauucacauuuugggccuguuuuccuauugggguugcuguguuauucucacugauuugcagacauuccucugugucaucuuuuuaauuuuguuuuaauuuuuagaggcaggaugucauucuguugcacuggcuguagugacguagcucacugcagccucaaacucuugggcucaaacuccuguccucugccuccacuucucaacugguaaccucacuucucuucaugaggucucuccagccccagggccuuugcacauguuccccucucuucugaguggcauaugguaguugcuccucuguaaauauuuauugacauccugacuuccaaccagcagagaauugaccuccuucccaugcucaggcuagugaaggcaugaguuuggcugaggucccaguggggaaggugagugggguggcagaguuaaccaggagcagcaugguagaauggguaaaaccagacguagcacgcaggcaccacauguuagcuggacaaguaguuuaaccccaugggucucaauuuccccaucaaugaaagggagaauagaacaagucccugguaagcagcauaaaaugagcucucagaauguaaaguaacaagcacacaaccuggaagagaauacauuuagugaauauuggcuccuuuaaucagcagguucugauaugacuuagcuacaauuaagaaaauaaaaauggaggccgggcgcaguggcucaugccuguaaucccagcacuuugggaggccaagacgggugggguggaucaccugaggucaggaguuugagaacaggcuggccaacauggugaaccccaucucuacuaaaaauacaaaaauuagccaggcgugguggcgcacgccuguagucccagcuacucgggaggcugaggcaggagaaacauuugaacccaggagguggaaguugcagugagcccagauugcaccacugaacuccagccugggcgacagagugagauuugucucaaaaacaaaagaagucuggaggccaggagguugguugcaggguugguuccuuggcucaacaaugucuccaaagaguccuuccaucuuuccacucuaacaucgucacuguaaggacuuuuuuuaacauuuaccacucacagccccaagacgacugcgucaguucuuucuuuuuuuccuucagacagagucccgcucugucgcccaggcuggagugcaguggcaugaucucggcucacugcaaccucugccuccuggguucaagcgauucuccugucucagccucccgaguagcugggauuacaggugccugccacugcauccggcuaauuuuuuguauuuuuuuuaguagagauaggguuucaccauauuggucaggcuggucucaaacuccugaccucaggugaugcaccugccucggccucccaaagggcugggauuacaggcgugagccacugugcccggccgaugacugccucaguucuaagguacuuacccagccauccacguagacagacacaaaagcauccggccaaagaagagggagaggaagggcugucucuuaccaugugacucaucucacggggaaaaaauccuuuuccagaagcacccagcagauuuuucacccagauccuguuaggccuacgaaugggucaugugacaagugcucuuauugcaaggaaucuugggaaaaagagacuauuaggcauuuucugccucuuugaugggaggugggcucugccaguaaggcggguaguggugguggcucuuggauggacaacugugucuuccauucuucuucuucuuuuuuuuuuuuuuuuaagagacaaggucucacucuguugcccaggcagaaaugcaguggcacaaucacagcucacugcugccucgaccugccaggcucaggugauccgcccaccuuagccucacgagcagcuggaggaguguaccaccauggccggcuaauuuuuauauuuuuuguagagauggggucucuuuauguugcccaggcuggucuugaacuccugagcucaaacaauccuccugccucagccucccaaagugcugggauuacaggcauaagccaccacgccuggacucucuucuuuaaauacugagccuuccaccucuucuagaauauacucuguuaauuaucaaccacacuuuucuacauuuuugcuucauuauucauucaguaaacauuuauugagugccuacuguaugccaggcacagcuuuaggugcuggagaugcuaugaacaaaacagaugaaaauuucuaaaaaauaaaauaaaaaauaaaaauaaauuuugcaaagccaggcacaguggcuuaggccuauaguuccaccuacucaggaguccaaggcaguaggaucucaugagacugggaguuugaguccagccugggcagcauacuaggacucugucucuaaaaaagaaaagaaggccgggcgcaguggcucacgccuguaaucccagcacuuugggaggccgaggcaggugaaucgcaaggucaggaguuugagaucagccugaccaacauggugaaaccccgucucuacuaaaaauguaaaaauuagccaggcaugguggcaagugccuguaaucccagcuacuugggaggcugaggcaggagaaucgcuugaaccugggaagcggaggaugcaauaagccgagaucgugccacugcacuccagccugggcaacagaaugagacccugucucaaaaaaaaaaaaaaaaagaaagaaagaauagaaaauaucugcccuacggggauggacaugcuagaacaucaaaguccaauggaacuuucugcacugaugaaguauguauguaugcaccagccacauguggcuugggagcacuuaaaacgugacugguacaagcgaauuuuucauuuaauuuaaaugaauuuaaaucuguauuuaaauagccauguguggcuagugguuacuuuauugggcggugcagcucucuaaaggccaagagauacaucaucaacuucucucccuugacccauauucaguucucucccacccugaaaaucuccucuccuacccaggcucacauuuccaguucuucuccucuuguucucccucaaccaucagcccccgcaagacugacgugacccugaugccguaugaaaugcauucuucauccuuuacucuuacucaccucugugcggcccuggagaccagugaccucuccuuucucaaaauacuuuauuucuguguguuuuuguuguugcuauuguuuuugggggguuuucuugagauggaguuucacucucaucaccuaggcuggagugcaguggugcgaucucagcuuacugcaaccucugccucccagguucaagcgauucuccugccucagccucccaaguagcugggauuacaggcucccgccaccacggcuggcuaauuuucuuguauuuuugguagagacggaguuuugccauguuggccaggcugaucucgaacuccuaaccucaggggauccaccugccucggccuuucaaagugcugagauuacaggcaugagccaccgcacccagccucaaaaugcuuuugaacuugacugucagguaugccauucuccacaccagucuccucccaugucugugucuucucccucuccacuggggacccuuggcuuuuuccacuucacucaucuacccuggguuaucuggucuuccauaacccuguccucugccacaccucacuuauucacccaccacaauauuuauugaguacucacuaggccaugaaagaugcuauacaaaaaaagccccuguccucguggagcugacauucuagaagaaagcaugaauaauaaauacgacuuaauaaacaguacggccaggcaugguggcucacgccuaucauccaaacacuaagagaccaagaugagaggaucacuugaauccaggaguuugagaccaccuugggaaacguacugggacccugucucuacaaaaaaaauauuaaaaauuagcuggauaggguaaugcaugccuguaguuccagcuacuugggaggacaagguggaaggauugcuugagccugagaggucaaguccgcagugagcugugacugugcacugcacgccagccugggugacagagugagauccugucuuaaaaauaaauaaauaaacaaacaaacaaacaauauaauuccagagagugaagaggcaggaucucuuuagcuaggaaguugagggauguucucucugagaaggcagaaucugaguuucaaccugaagaauucgaagaggccagcuaggcaaaagaugagaguugaaggaauggggacggcagaggagacagccaauauaguaauucucaauaaagcagaaagugagcuuuuccugcuggcagaacagaaaggaagucggaguggccaggguguugugggacaagguggucagcaggagucacaucacgcaaggucauguggucaugguagacuuuaaauuuuacuccaagccugauggaagccauuggaagauuuuaacuaaggagugacggaaaacuggcaucucaaacucaacaugucuacaacccaguucuugaucuuugaaaccuucuuccuccaucuuccccaucuccauugacagcaacuucauccuucaguuagcucaggccaaaacccuggagucacccuugauaccucucuccugcuccacacucagucuuuccauuggaagcccuaggggcugccauauuguucuccauagcacuucacaccgucugacauacuauaucuuuucccacuauugcuuuguccuugguagcaucuuuaggcacucucugaauaucuggcacauaguacgugcucacuaaauccuuguugaauaaaugaaugaacaucacuccgugguccuuucagaaccagagccauucuucucuuucuucaccaccguugccccucaccccgcccaacuagucacaggaguugaaggaugacacaguagagaacugggauucuggaguccuguggcuggucugggguucgaguucuuacucagugguaggaaccuccaugugggauuaacuuaucuggucuuuaguuuccuccucuguaaaaugggccucaaacugccaaccgcugggaugcagggaggauuugaugagcccaggcaggcucccuggagcacagcaaucaauggcagcuauauauaaaccggggccucuuuuguacucccacugccuuuguccuaguuccagcccucauuacaccagccugcucuugcggcucccuccuaacuucugcuccaucaccaccaaucuguccuuucagcugucaggcuugucuucugaacgccaacccuaaucacaucccuuccugcuccaaaaccuuacaugacucucacuguccacaggacaagacccagccucuaguugacagccuccacuguccagcuuacccaaccucuccccuaccacauacccugaguggagccuucugccuccauagggcuuucuuagccagagaagccucccuuaucuuccuguucuccuccuaauuccuucuuauccuuccagggaggaggcugugagguaaugcaucuugggagccagcugggauugcacaggguggugagauuaucugcauuuccgaggcuugaacaaguuaaggcaaugggaaaggucacacaaugagaaaaugcagggccaggauuuaacccgucugagauguucugacugugcuaugcugccuccccggacaugagcucugcgauaaugcuguccccaggcuguaaucauucccucuuucaucccugccuccucuaucccuggggucagagggacuuguaguugaaucucucacucacucauugguguggucucucccuaaagcaggguggaguuugucuuagcguuaucacugcauccagcacaaccucccugguccaggcuuaucagcguucaacugcgucaaugcaguugccuccuccucaaucucccagcuuccggccuugcccccuagagagaucauauuuuaauacaagucagauuacaucccuccuccccucagaacccuccauggcucacaccuuacucagagaaaaagccaaaguccucuccacaacccacaaagcccugcaccauccaucaccucacugccuucguccccucacacccucccccuugcucgcucugcuucagccacaccaacucaucucuguuucucaaauacaccaggcauggccuagcuauuaaaugcacgguccagccuggugcauuugaagaacacggaugaauugguguggcuggaacagagugagugagggggagagcgggaggaggaccuuugcaccagcuggaccuuugcaccggcuguuccauuugccuagaguuuucccugacauauucauauggcucacucucuugcuucccuugcuuucucccagucuuuauucaaaugucuauuucucugcacuugugcuguuugauacagucaccgcuggccacauguggccuuugagcacuucaguugaaacacaugaaaguguagaauauugaccagauuccaaggaaaaccaugugcaaaauaucuuuuaucucuuaagauacagggucucgcucugucuuccagccuggaaugcaguggcacgaucacagcucacugcagccucaaaaucccaaacucaagugguccucccaccaacagccucccgaguagcugggauuacaggcacacaccacaaugccccgcccauuuuuuuaauuguuauuauuuuuuuuaauagcgacaaggucuugccauguugcucaggcuggucuggaacuccuggccucaagcgauccuccugccucagccucccgaguagcugagauuacaggcaggagcuuuugugcccagcaggucuacgaucuucuuagaaugcuucaggcugggcauaguggcucaugccucaaauaccagcacuuugggaggccaaagcaggcagauugcuugagcucaggaguucgagaccagccugggcaauaugguaaaacccugucucuccaaaaaaaauacaaaaauuagcugggcuugguggcucccaccuguagucccagcuacuuaggaggcugaggaaggaagaucaccugagcccaggaggcggagguugcagugagccaagauugagccacugcacuccagccuagacaacagggagacccugucucaaaauaaauaaauaaauaaauaaauaaauaaauaaauaaauaaacaaacaaacaaacaaaccaauaaaugaauuuuaccuguuucuuuuuacuuuuuuaauguggcuacuagcaaauuuuaauuuuuuuuuuuuuuuuuuuuuuuuuugagacagagucacgcucugucacccaggcuggagugcaguggugugaucuuggcucacugcaaccuccaccucauggguucaagcaguucgccugccucugccucugaguagcugggauuacagaugcccaccgccacgcccagcuaauuuuuugcauuuuuaguagagauggaguuucgccauguuggccaggcuggucucgaacuccuggccucaagugaucugccugcgucggccucccaaagugcugggauuacaggcaugagccaccgcgccuggcuauaaaauuucauaaguagcucuuaauagauuucuccugggcagugcuggucuaaacacuuuuuuuuuuuuuuuuuuuuuuugagacggcaucuugcucugucaccaggcuggagugcaguggcgcgaucucugcucacugcauccucugucacccggguucaagcuauucuccugccuuagccucccaaguagcugggacuacagacacccgccaccacgcccagcuaauuuuuguauuuuuaguagagacggguuuucaccauauuggccaggcuggucucgaacuccugaccuugugauccgccagccuuggccucccaaagugcugggauuacaggcaugagccaccgcaccuggcuauaaaauuucauaaguagcucuuaauagauuucuccugggcagugcuggucuaaacacuuuuuuuuuuuuuuuuuuuuuuugagacggcaucuugcucugucaccaggcuggagugcaguggcgcgaucucugcucacugcauccucugucacccggguucaagcuauucuccugccuuagccucccaaguagcugggacuacagacacccgccaccacgcccagcuaauuuuuguauuuuuaguagagacggguuuucaccauauuggccaggcuggucucgaacuccugaccuugugauccgccagccuuggccucccaaaguguugggauuacaggugugagccaccgcgcccggcccuguaacacuuuuaacacugaacuguuugccuuccaggugguaaagagcaggugccuuuacugauagaaaugucaccacucccuucaucccgccagccccaugucacugacgcguccuuuccccuugcucugugguaacuuucuccuaagcacucaucgcccuaacaucugucauacagguauaccucagagacacugcugguuugguuccaggucgccauaacaaagcgaauauugcaauaaagggagucgugccuuuuuugguuucccagugcacauaaaaguuaugcuuacacuauagucuguuaagugcaugauagcauuaugucuaaaaaaaaauguacauaccuuaauuuuaaaauccaucaaggcugagcacaguggcuuguaaucccaacacuuugggaggccaaggcaggaggauugcuugagcccagggauuugaaaccaggcaacaaagugagaccccguuucuacaaaaaaauucuuuuuaaaaauagcuggguauggugacgcaugccuguggucccagcuacaugagaggcugaggugggaggcucacuugagccugagagauugagacugcagugagcugugaucacaccacugcacucuagccugggggacagagugagaccguaucucucaacaaaaauuaaaaaaaaaaaaaaaaaaggcugggcacaguggcucaugccuguaaucccaacaguuugugaggccaagguggguggaucacuugaggucaggaguucaaaaccagcccagccaacauggugaaaccccgucucuaugaaaaauacaaaaaaauagccgggugugguggugcacaccuauaagcccagcuacucgggaggcugaggcacgagaauugcuugaaccugggaggcgggggggagauugcagugagccgagauugcacugcugcacuccagccugggugacagacugagacucugucucaaaaaauaaauaaauaaauaaauaaauaaauaaauguuuuauuacuaaaaaaguuaacaaucaucugagccuucagugaguccucaucuugcuggugaagggucacuggcucaguguugaugggugcugacugaucgugggggugguugcugaagauuggggugccugugacauuuucuuaaaauaagacaagaaaguuuuccgcauccaucgacucuuccuuucacgaaagauuucucuagcaugagaugcuuguugacagcaauuuuacccacaguagaacuuuuuucaaaauuggagucaguucuuucaaacccugccacugcuuugucaacuaaguuuaugucauauucuaaaucucauguugucauuuuaacaguguucacagaauuuucaccaggaguagaauccaucucaagaaaucacuuucuuugcucuuccauaacaaguaacgccucaugcauugaaguuugaucaugaggcugcagcaauucagucacaucuucaggcuccacuucuaacucuaguucucuugcuaguuccaucacuucugcagugucuuccuccagugaagucuugaacuccucaaagucauccaugaggaucggaauugacuuccucaaaauuccuauuaauguugauauuuugaccuguucccacgaaucacaaauguucuuuuuguuguuuguuuguuguggauuguuuuuuuauuuuuaauugaguugaggucucacuauguugcccagacuggucuugaacucuuggccucaagugauccuccugccuugaucucccuaagugcugggauuacaggcaugagccacuggaacagccacaaauguuccuaaugguaucuagaauggugaaugcuuuucagaaaguuuucaauuuccuuugcccagaugcaucaaaggaauuuaucuauggcagcuauagccuuaugaaauguaucccuuaaaucauaagacuugaaauagagaauuacuucuugauccaugggcuacagaaugaauguuguggcugggcaugguggcucacaccuguaaucccagcacuuugggaggcugaggcagguggguaacuugaggucaggaguucaagaccagccuggucaauauggugaaaccccaucacuacuaaaaauacaaaaauuagcugggcaugguggcguaugacuguaaucccagccacuugggaggcugaggcaggagaauugcuugaacccucuugaagacagagguugcagugagccaagaucacaccacugcagcgacagagugagacucugucucaaaaaaaaaaaaaaauguuguguuagaagucauaaaaacaacauucaucuucuuguacaugcccauuagagguccuggauaaccagugcauugucagcaguaauauuuugaaagaaaucuuuuuucuggcuggguacaguggcucgcaccuguaaucccaccacuuugggaggccgaggcguguggaucaccugaggucgggaguucaagaccagccuggccaacauggugaaaccccaacucuacuaaaaauacaaaaaaauuagccaggcaugguagcaggugccuguaaucccagcuacccuggaggcugaggcaggagaaucgcuugaaccugggagucagagguugcagugagcugaggucgugccauugcacuccagccugggcaacaagagugcgacuucaucuaaaauacauauauauauauaacauguuauauguaauauaaauuauauauauaacauauauguaauauaaauuauauaucacauauaacauauaucauguguuauauauaucacauauaacauauguguuauauaucacauauaacauguguuauauaucacacauaacauauauuauguguauauaugucacauauauuauguguuauauaugucacauauaacauauuguguuauauauaucauauauaacauauauuauguguaguguaucauauguaacauauauuauguguaguguaucauauauaacauauauuauguguaguguaucauauauaacauauguguaguguguuauauauaacauauauuauguguuauauaucucauauguuauauauaacauauauuauguguuauauauuauauauauauuuuuuucugaguagaucucaacagugggcuuaaaauaucaguuauccaugcuauaaacagacgggcugucauucagucuucauuguuccauuuauagagcacaggcagaguagauucagcauaauucuuaagaccuuaggacuuuaggaaugguaagugagcauugguuucaacuuaaagucaccaggagcacuagcuccuaacaagagagucagccuguccuuugaagcuuugaagccaggcauugacuucuccucucuagcuaugaaaguccuagauggcaacuucuuccaauagggcauuucaucuacauuaaaaaucuauuauucaguguugccagcuucauuaauaaucucagcuagaucuucuggauaacuuacugcagcuucuccaucagcacuuaucacuucaccuugcacuuuuauauuauggggacaccuucuuuccuuaaaccucaugaaccaagaucuucuagcuucagauuuuucuucugcacuuccccaccucucucagucuugcugugggcuugcuguggauuaggcuuuggcuuaagggaauguuguggcugguuugaucuucuauccagaccacuaaaacuuucuccaugucagcaagaagccugucuuacuuucuuaucauucauguguuuacuagaguagcccuuuuaauuuccuucaguaauuuuuccuuugcauucacaacuuggcuaaccucuagcuuauggccuuuuguuuguuuguuuguuuuguuuuugagacagggucucacuccguugcccaggcuggagugcaguggugcaaucaccgcucacugcagccuugacuuccugggaccaagugauccucccaccucagccuccuaaguagcugagaccacaggugugcaccaccacacccagcuaauuuuuuuauuuucuguagagauagggucucccuauuuugcccaagcuagucucaaacuccuaggcucaagccauccucucaccucagccucccaaaaugcucggauuacaggcaugagccaccaucccuggcccuaucucagcuuuugacacgccuuccucacuguguuuaaucauuucuagcuuuuaauuuaaagugagagacgugcaacucuucuuuucacuugagcacuuaaaggccauuguacaguuauacacugaccuaauuucaauauuguuaugucucggggaauaggaaggcccaaggaaagcgggagagauggggaaauggccaguugguagagcagucagaacacacacaauauuuaucgaucaaguuugccaucuucuauggaugugguucguggcacccccaaacaaugacuauagucacaucaaagaucacugaucacagaccaccauaacagauguaauaauuauguaaaaguuugaaauaccguaagaauuaccagagugugacacagagacgcaaagugagcacacgcuguuggaaaaaaaauggcccugauagaccuccuugacacaggguugccacaaaucuucaauuuguaagaaacacaauaucuacaaauugcaauaaagcaaagcacaaugaaaugaagucuuccucggccggugugguggcucacguccauaaucccagcacuuugggaggccaaggcaagaggaucccuugagcccaggaguuggaggccagccugggcaacacagggagacuccaucucuagaacaaaacaaaacaaagccugcuuauauuuauuggguuuacucucagucucccccacacagagauagggccuggcuuguuauuagugcucaguugauguuugugaagugaaauacuaaggacuuaaccacugccuguucuuugcuguucaugcccugacagcuuuuaugugccagcacagaagaaaacaaggugcaagaagagaauagugaucucuaagucagaauuugaggaacccaaauuaguaccagaaagcugggaggagaagagaaaaauaaaguaaaucaaauuaaaaguugaaugggccaagugcaguagcucauaccuauaaucccagcacuuugggaggcugaggugagaggaucacuugaggccaggaguucuagaccagccugggcaauauagcaagaccccaucucuacaaaaaaaauuuuuuaauuuucugaauauguuguuguacaccuguagucccagcugcuuaggaggcagaggugggaggaucgcuugagcccaggagguugaggcugcagugagcuguuguugcaccacuauacucaagccugggugacagaauaagucccugucuccaaaaauaaaaauaaauaaauucauuuuuuguaaaguuguaugucauggccccugccuacucuggcuucaugacuugcugcuugaaccucaccauccaaaucccaguggugacaccaugucauuucuugaauuugccaagcccucuuucagucccaagcucucugucauggccacucucagccuggaaaguucuuuccccacuggccagauuucucccccucaucuaugggaacuugacuugaaguaggggguaucccaggcccuggacuaguuaacacgaccugcugugugccccucaaagccauugucuuccuagcugagaaggcaucacaccugcaacagauucacucauugugugcauguuuuucuuaaccacuucucuucugcaucagcuccauggggcagggauagucucauaugucacucuacccagcacauaggauacgcucagacgcccacuuguggaugguggaaaaggucagcccaaccuaauaugcccaucucuccucuagggguaaucuugagaaaaaaaguugggaacuugcuuuguguuaguuuaggaugacccagaauagauccugaaacaagaauuuagggcaauccuugugcaaguaguucaucugagaggugaccccagaaggguuggagaaggagaggggagguggggcaaggaagggugaguuguccuguaggcaacugagcuccguccuacugggagcccacguggaacucaccucuuaagugauccagaaugaagggugagggagcugcgguauugauccaccaacucccagcaaucuuugguugagggcugcucccuuaaaguucauucccugggccugccccagauuuggagacagcccuaaggcaagagguacagauaccaguuggccacagacugaaguguuaagacccaagccccuggauaaaacugaaaaaucaagccagauguggugguucccaccuguaaucccagcuacucaguaggcuaaggcaggaggauugcuugagcccaggaguucaaugcuguagcgagcuaugauugcaccacugcauuccagccugggcaucagagcaagaccccaugucuaaaauaaaaauaaacugaaaaauccccaaguuauuugcugugaccaaccuuccauuaaccacagacccucugguauucagcauuucuuguccauuauaugaaguucugaugacagucucuuuuauuguauugugccuugaccacgcacuguacaucacuuagcucugaaauggacauguucaggaaacagggccaggugggacccuguguuucaacagcaauacuuuuacaaaugaggucucaugacagggucuugcucggaggguuucuauggaagccucaucccaccuacugcuaucauccuuacuaacuugcauuuacaaaagggacucuuuuugaccagaggcuuggggucuguagcugccuucuagccagcugaugcuggcugguccacacaagcaggaucacacccauuuuuuuguuuucuuauuuauuucugaauagguuagcauaccgguaaccugugugccuggcauugugcugaccacuuuuugucaacuuacugaauccucacaacccuuggagguauugauacuauuguuauccagguuauacaaaagggggaaacugaggcacagagcagggaugucccuugcccaagguuacccaacuggaaaguggcagaucugggaucugaacccaugcaggcugggcucuuaacacugaacuacuuuccugccauuuguuaaagagccacaaaccaggccaggcaccauggcucacgccuguaaucccagcacuuugggaggccgaggcggguggaucaccugaggucaggaguucaagaccagccuggccaacauggugaaacccugucucuacaaaaauacaaaaaaaaguacccgggcaugauggcgggugcguaguaaucccagcuacucgggaggcugaggcaggagaaucccuugaacccgggaggcagagguugcagugagcugagaucacaccauuggagaucgcacuccagccugggcaacagagugagacucugucucaaaaaaauaaaauaaaauaaaauaaagagccacaaaccccgaaaggucugccauucccccagggccccaggccaccccacaaucuauugucauuguagguugugaaauauacugaaugucaccccaaccuugagccauggggaagauuccauuucucucauugcaacauuugugcaacaugaaccaucuguugggggucuucguaaaucaccuuuuaucccgugaggcagguacuguuaagaccauuuuacaggugacaaaacugaggccaguggugucgagucaccugccuguggucacccaaccaauacaggacagcuuggaaucccaagcacccccgcccugcugucugacccccaaaacccacccucuguucuccauucuggcuucuuucuuucagcaucuuggcgacaguugggacggaguuugaccuacggacgcugagggcaguucgagugcugcggccgcucaagcuggugucuggaaucccaagugcgugaguuuccgacccugacaagggguuugcucacgggccccaggagcccucaguuuccccuaugcagagcaucucaggaggccacauccugccaccagccugugugagggcagucucuucuuugggacucccuauagggaacccccuaggaauaugacuguagcuccccaugagcuccugaaagcaaacuaggagccacacccauuuauugagcaccuacugucuaucgggagccaugcuaagcaccacgugugaucucauucaguacucacagcccuaugaaguugauaggacugaugucucuauuuuauggagggggaaacugaggcucagaguggcugaaacauuggagcaggguuuuguggcugagaaguggcagaacuaggagugagcaagugugacuccaagccugggccguaccacugguggcaaugaccauucccauuuaaugagugccugcugcgugcagggcacuacagaaggacuuuacaugaauuaccuuauuucauccucacagucacccagcgaacacccauuuuacagaugagacgguugaggcuuaaggagguuaaauuacucaccugaauucuuagaguggacaguaaugagcucuaaaauucauacucauuccuugcugcuuucucauucuccacagauacaucuaguccccguuuaaggguggcugccauaugcagggucaagauuaaguguagguugagccaaaaaaaaauguaaaaagcaaaaauaaaacagggcuguccuuuuucuaucuucuugucuugguuaauaauaauaauuuagccaggcaugguggcucaugccuguaauuccagcacuuugggaggaucacuugaggccacaaguucgagaccagccugggcaacauugugaggaacaccacccccacccccccgccaauaucuacaaauuuuuuuuuuuuuuuuagaaauuagccagguugacugggcacaguggcucacaccuggaaucccagcacuuugggagaccgaagcgggcagauagagcgagcucaggaguuuuaagaccagccugggcaacauggcgaaacccugucucaaaaaaaaaaaaaaauuagcaggcaugauggugcacaccuguagucccagcuacuuaaaaggcugaggcaggaggaucugagcccaggaggucaaggcugcagugagcugugauagcaccacugcacuccagccuggacaacagagugagaccuugucucaaaaaaacagacaacaaaaaguuuaaaaacaaacaauuuauaggcugggugcaguggcucaugccuauaauccuagcacuuugggaggccaagguggauggguggaucaccugaggucaggaguucgagaccugccuggccaaaauggggaaaccccgucucuacuaaaaauacaaaacuuagccgggcgugguggcgggcaucuauaaucccagcuacucgggaggcugaggcaggagaaucacuugaacccggggggcggagguugcagugagcugaaaucacgccacugcacuccagccuggaugaaagagugaaacuccgucucaaaaaaagaaaaaaaaaaauuaaaaagcacuuacuaugugccagacauuauucuaaguauuuccauuuuuuuaaaguccuuuauccucccaacaagccugugaaguagucucuuuuauuaucaccauuuuacauuuuauuggcuucguucuuccgguucauugcuacccagguuuaaagaguaagauuucccagaggaucaccagcaggaucuuuuuguagaaagaagacacuucuauccaaggucucugcaagaucccagcagaugccugcaucauauuaaauuaagggccaucccaaaucuaauagucaaaagagccaggugcaguggcucacaccuguaaucccagcacuuugggaggccaaggcaggacgauugccugaggcuaggaguucaacaccagccugggcaacaaagugugacccugucucaaaaaauauauguauauuauaauagcaguaguaacaagagucucuguuuaaugaccaccuaugacuuaccagguacuucacugugugugaacucucucaucuaaucguaugagggagguacuauugcaguccccauuuacagauggagaagcugagguuuggaauucacuaguaaguggaugacuaggucagguucccuugaagcggauacuuagguggguguucagaugcaccugcuuuauugggggacggcucuugggagagacagcaggagaucagcaggguggggcuggggaauggauagagcagggacgcaauuucagcuggagugugugugacaccagaguuguccuccaaugcauggcaaggaugccggccuuuuguacuucuauagucagucacuguggaugggagguagagacgcaguagcucccaggugagauagcuuuugaucaccaagggcaauucuacuaagaagagaggcagcugggaggcauuagcaaccaacauccauagcagcuggagggcggguacaccagaaagaaaaugggaucuuggccagacaccaagaguauccagcaccuuaaccacugcaccacacugcaucuguuagcacccacauuacauuuuuuuuuuuuuuuuuuuuuuuugagacggagucucgcucugucgcccaggcuggagugcaguggcgagaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccagcacccacauuacauuuuuaagcccuuggaguggcauggccccucgagcuauccugacagcuucccucucuuacuguggucuccacccaucaagagccaugggaaguuccugcaaucaagaagcaaagccucaggcuauauguuugaaccuucauuuugaucauagacuuuccuaguagauaccauagugguuacaaacauaggauguugucaucguucagaccugaguuaauagccucaagaaaaaaaugguaguggaaccagguauggugaagugugccuguagucccaccuacucgggaggcugaggcaggaggcucgcuugugcccaggaggucaaggcugcagugagccgugaucaugccacuguauuccagccugggugacagagcaagcccaucucaaaaaaaaaaaaaagccaaugauaggcagagaaauacuaacuaaggcucuugcucugucgccaggcuggagugcaguggugcaaucacagcucaguacagccucaaccuccccagacucaagcaauccuaccaucucagccucccaaauagcugggacuccaggcacacagcaccaugcccaguuaauuuuuuuguauuuuguagagacaggguuucaccacgcugcucaggcuggucucaaacuccugaguucaagugauccacccgccucagccucccaaagugcugggauuacaggugugagccaccacgcuuggccagcuauuauuauuauuaacauucuucgagucuuacaacaguggaacuuuuagugcaggaugcgaauuucaguauuaaccccuuccucucccaaaaggauuugaagcccagaguaauucagccgccaugaaugaaccauuuguuagaugagaggcuacuggaggcugagcuugguaggauaagagcuugcauggggucccugauugaugacaauacccccagauuuaggucuucagaugcccaguugggugugucuucuguuccacugugucccuucggggacuguucccugccuucuuucuuuuugagauggaaucucgcacuuucacccaggcuggagugcaauggcgugaucucagcucacugcaagcuccaccucccggguucacaccauucuccugccucagccucccgaguagccaggacuacaggugcccgccaccacgcccagcuaauuuuuuuguauuuuuaguagagacgggguuucaccauauuagccaggauggucucgaucuccugaccucgugaucugcccgccucggccucccaaagugcugggauuacaggcgugagccaccacaccuggcccccugccuucuuauucaccaccaucuuucugaauuggguugcucagaacagagaaagcaacaucagcacaugggcaaacauggggcuucauuucagauggaccuggguucaaauccuaguucugccuuuuuuuuuuuuuuuuuuuuuuuuugagacagagucuugcucugucacccagacuggaguacaguggcgucaucuuggcucacugcaaccucugccucccaaguucaagcaauucuccuuccucagccucccaaguagcugggauuacaggcgcuggccaccaugcccagauaauuuuuuguauuuuuaguagagaugggguuucaccauguuggccagacuugucuugaacuccugaccucguuaauccgcuggccucggcuucccaaagugcugggauuagaggcgugaaccgccgccgcgcccugccuaguucugccauuucucaugcauucucugggugaaucacagcaucucuguuagccuugcuucccacuucuguaaaaugagagugacuuuacauguauggccaccucaggggcuugucacuagaagccagugaaauaauguugagucugguuccuugggguugaaauugggaccgccaaccgcuuuccuacccagagcagcaacuagccuauauggcggccuuuuaugaaugaggaaaagacaccgccucuuggcagaaaaaaaaaauuaagaaaauggcucccucuucugggugcaaguugcccaacacccaggaauauggcuccaaaagcaauggacucccaccccuuucuugcccaaaagaucaucaaauggaacagcaugucaaauaccuuuauuaaguacuuuaaaguuggcugggcucuguggcucaugccuguaaucccagaacuuugggaggcagaggcuggaagaucgcuugaggucaggaguucgagaccagccuggauaacauagugagacccugucucuauaaaauauauauauagauuuauuugagacagcgucuugcucugccacucaggcuggggcgcaguggcacaaucauagcucacugcagccuuaacgauccuccugccucagucccuagaguagcuaggacuacaggcaugcaccaucaugccuggcuaauuaaaauaaauaaauaaauaaauacuuuaaaguuaaaagugcuuuuuaaaaaauaauaaggccaggcguggagacucacgucuguaaucccagaacuuuggaagaccgaggcggguggaucacgaggucaggagaucgagaccauccuggcuaacacggugaaacccugucuccacuaaaaauaugaaaaauuagcugggccuacucgggaggcugaggcaggagaauggcguaaaccugggaggcggagcuugcagugagccgagauggcaccacugcacuccagccugggcgauauaacaagacucugucucaaaaaaaauaaauaaaauaaauaauaauaauaauaggggccagguaugguggcucacaccuauaauccuagcacuuuaggaggcugaggaguuugaguccuuggagaccagggguuucaggccagccugggcaacauagcaagaccccaucucuacaaacaaguuuuaaaacuuagccaggcaugguggugcaugccuguaguccuagcuauugcagggacugaggcaggaggaucaccugagcccaggagguugaggcugcagugagcugugauugugccacugcacuccagccugggcagcagugcaaaacccugucucaaaggaaaaaaaaaaccuaggaaguguuguucccaugauaaggaucagccuccguguggugcuuccuucaccauugcccaauccccaggcuccugggugcuuaauauucccucaggaacacaccugcuuugucugggagagaccugggcgucuugguggcgggguuuggggguacuugcucaugggcuuauggggccucucucuguguccccccagguuuacaagucguccugaagucgaucaugaaggcgaugaucccuuugcugcagaucggccuccuccuauuuuuugcaauccuuauuuuugcaaucauaggguuagaauuuuauaugggaaaauuucauaccaccugcuuugaagaggggacagguagguccacggagcaugaugcaucuuuccaguuuucuccuucagggacaagcucuugggaggauuaggcaggggugugcuucuuucuccuggcagcugggaggaccgucuccuucagagagcacuacaggagaggcagugagugaaauagccucugagaucuuagcuguugaaaggggugggguuccacagaaggugacccagcagagaaagaguuuauuugggaaugaucccaggaagcaccaucgggggaaugaggaagugagcagagaaagaagggaucuuuuaaagagugugcuaucaagcggguuaccacuuaaaacugggacuggaucccccugggcaccucugggagacagcaaagaacacacaacucagcuggucacgguggcucacgccuguaaucccagcacuuuggggggccaaggcggguggaucaccugagaucaggagucagagaccauccuggccaacauggugaaaccccaucuguacuaaaaaauacaaaaauuagcugggugugguggcaggcaccuguagucccaauuacucaggaggcugaggcaggagaaucacuugaacccgggaggcagaaguugcagugagccaagaucacaccacugcacuccagccuggcgaaagagugagacuccaucucaaauaaauaaauaaauaaaaauauaaauaaaaaaagaacacacaccucagagccgucccagccaaggggcaagggagcugggguauuuauacacuggcuucuuuuugacauuggugaggacugcuccuagagugggaauuaaugccuggcacaucuggcugaguggaacagguauucugggugcuuucagaccucgaccaguccugacuucuaaagcaagcaagaaguggggagaguugggccagaaaaggguuauugccucaaugcauugugagugguaccuuguggaaggugagagacagagaagauuccaggcacaggugccaugcuaaacgauaguucucauuuauuauaggaacccauggauuuauuuuguucucugcccugagugcugggugagaguacuggaugaguccuccuggucucccccaacccccaggauguaccagagauaccccaauugggaguccuggcaccaaccaaucagaaccuagcacucagcagcauucugccccucccugacuaugcccacauuaacccuucaguggcugggucuggggguagggugagccccggaaaagccaggcagcgcagagacacucucccagggcucagcucugaaccagcaguguggaagcaguguguccaccacgauccacacucaggaaccaaauagcccuuggauacguuuucaguuaaaucuuugccauccaaacucuagcugcuugcucucuaaagcuccagaaugaaauggaaucaaguaggaagggaugccuucaguauuucaguauuuggaccacuggccaucugggugcagacagacugaauagcaguucugguucugaugauuugggucaagggagcugugaauugaaggaguggauagaaggaaucaagaagcccaaaggggaacccaggugggcagagaaagagguuucaggccccuuauuugggaaaggcagccacagaagaagauucugucugggaguggauuuccacccacccucuccacccagugacccccaaguggauccgcagaggcagccccugagcccucccuccccacuccuccccacggggagggaaaacccacuggggaagguuuauuugcaaugguuggagguuuggguuuuuuuguggguuuugguuuguugguuuuuuuuuuccucuuuuucucuugcuccuccugucucuuucucuccugggcuugugaaguuugcucaauauggaauguccuaauuauuucuuuccccgaugaagaagguguuaauugaggcagagcuauuucugcuccuggccucgucacccaggcggaaaugcgagagagagagagagagagagagagaaugaauauggggcagggccucuuggaaaaaucagccgugagcagagaaaccaggacuccuggauccuagguuucugugaaguuuuauuuuauguuuuucuacccuagacuagcuaaaggagaagaggccaugggguuggcuuggguccgagugggguuuugaggggacagauguggguggugccaccagaggggaggaagccucgauuuaggagaaagacugaaaagcuagcucacgauuaaaaauauaagacgugugaguaagagacagauauauacagacacccaggcaguggguuaauuuuaaaauguauuuauaaccgaauuccucagacacucuggacgcuuguuuuucuagaagcaacgcucagaguguuucgugucggugguugggggguugagggggauugcaaagcugcuaaagauagacccguuuucaguagcauuccucagugucgggagcccaguuccugugugcccagcaccgugccaaucgcuuagaaggaagcaaagauaaaguggaaggcuuccugcuuucuaagagcuuccaaaauaguuagaggaaacaagaccccucauuugcagccauuuuuaacagugaaggcuaaugugugauuauacccacgccccccuaaauaugaaaauucaguagcuauuguaugccugaaaggggccaggugcaguggcucacaccuguaaucccagcacuuugagaggcugaggugggaguaucccuugaggccguuaguuugagaccagccuaggcaacauagccagacccugucucugcuaaaauaaaaauuuaaaaauuggccgggugcaguggcucacgccuguaaucccagcacuuugggaggccgaggcaggcggaucaaaaggucaggaguucaagaccagccuggccaacauagugaaaccccgucucuacuaaaaauacaaaaaaaauaaauuagccgggcaugguggcgugugccuguaguaccacauacuugagaggcugaggcaggagaaucacuugaaccugggacauagagguuacagugagccgagaucacgcuacugcacuccagcuugggcaacagagugagauuuugucucaaaauaaaaaaauuuaaaaauuagccaugaguggugguacaugccuauaguccuagcuacucaggaggcugaggaagaaggaucacuugagcccaggaauuggaggcugcaaggcugcaguaagcuaugauggugcccgcacuccagccugggugacaaagugagacccugucucaaaaaaaaaaaaaaaaagagagagaggaaggaaagaaggaaggaagggagggagggagggacuggggcuguguuaacugggcuacacaaagaggcuacauggagggugggaauugagccagacuuggacauggcguggagacagagaagauuccaggcacaggugccaugcuaaacgauaguucucauuuauuauaggaacccauggauuuauuuuguucucugcccugagccuuauguuuaaaagauuuuugccuuccaaccuguauuuaucaaauaauaguucauguaccaaguccagcauaagugaggaaggcguuuccaacaacuuaaguucauggcgaggcuagacuuggaguuucuauucagccagagcuugaaaggccaacaagauucauucauucagcauugguuuauuucccucugcugugugcucagucaagggagcagagaauuggugcugcgaagucuguagcacauacauugagagauauuuuuguugaguaggaagcuugaguuuacacacacucagcuguuuguuuucuuguccgacaaugccacggucgucuuugaaaaccuucaaaagcaucgcucacagaauaagguccucucagacccgcugugcugguaaaaugaggacacucccagaugugagcuuuccugccucccuaccccaucaauaccuuaagauuuggacugaccuuuagcguucagccugacugccaccuccccaggaagcugucuuugguuuccagcaaaaggggugucuguuggcacguuucucucuccuuguggcauuuucacagccugccuccugcuauuuggggagaaagcucagcuccuguuccuuacccuuaggcaaggguaggaacuguguguacuggugucccucacccccagaacagcucccugagcccaguacaucccaagaagaaaaaaaucagcaaggcuuauaggagaauaacacaaugcgcuugacaaauuuguccuaauggaugucggaagaaggcugcacuuaccagcuacaccaugcacacggcacauuuacuaaaacugacuauauuauggaccauaaaguuugucucaacagaggucaaaaagcugaaaaaaauacaaauacaaaacauauuuucugaccguaaugcaauuaagcuggaaaucaguaacaaaaagagaacucuaaaaguguuugcagauuaacagacaugccucucauuuauggaugaaaugauaugaugucugagcuuugcuuuaaaaauauucuaggcugggugcaguggcucacgccuguaaucccagcacuuuggaggccgaggcgggcggaucacuugaggucaggaguucgagaccagccuggccaacauggugaaaccccaucuccacuaaaaauacaaagauuauccagguguggugguggccaccuauaaucccagcuacuugggagccugaggcaggagaaucccuugaaccugggagucggagauuguagugaggugagaucaugccauugcacuccagccugggugacagaaugagacuccgucucaaaaaaaaaaaaaaaaaaaaauucuaguggcaaggcaaaguguuuggaggggauacagaggaauagaugaaacaaaauuugccagaaguaaauagguaagugucuaaauuggugauagguacauggugaaucauuauauuguuuuauacuucucucucgcucucucucuccccccguucucucccugucuuccucuccccucugucuucauauauauauauauauauauacacacacacacacacagacaccuaauaaguuuuuuuaaaaaacaaauacaucuaaauuacccauaggucaaagaagaaauaauaauggaaauuagaaaauauuuuacuugaacaauaaugauaaugcaugacaaaauguugagaugcagguaaagccacacuuaaaggcaauuuauagccuuaaaggcaguuaauccauccaucucaaaaguuuaggaaaagaauagaaaaaaaaaaaaaacucauggaaaacauaaagagaaaaguaguaaagcucagagaagaaauuaaucaauagaaaaccaauaauagacccccaaagccaaacauugaucucuuugaagacugaucacguuugucccaaaaguuauucguuccaacagcauuauagagucacuggucccuauuucucagagcugguuuucccugcuccuuccccugacuuuucuccccuucccuuuuguagaugacauucagggugagucuccggcuccaugugggacagaagagcccgcccgcaccugccccaaugggaccaaaugucagcccuacugggaagggcccaacaacgggaucacucaguucgacaacauccuguuugcagugcugacuguuuuccagugcauaaccauggaaggguggacugaucuccucuacaauguaagugaugcugggacaguguguguggacaaucagagucucagggagguggccuccugggaccagugagacuccaaggcugcaauggagggacccugagcugggaaaggcagcccaaggacaacacagccccacugaagcuggccugaggcucaggcuuuugaagauuacaggggcucaugagcagaacucuaacuauagggcauagaagucuggagggcccccagaugcaacaucauuuuucauugugcaaguguuuagauauaauuuuagauuuuugaauacggaaagguuaugugauccaaaaaccaacacagauaaaagauagaguaauaucuuuggacguaggcgaggggucccugcccugaggcucacccaguccuucuccagccauaccacuccccgugggaugagaaguuccuggagccaaggggaugugucuaccaagagcuugugccccacuuuguaggccauguuuuaaguuaccaggauccuggaauucccugcccauggccagauuccaugaacuugcgugcaauucucauauggaucuguucguaacccaacugagggccaaggacauccgagggguggcuguuaacacaaauguggccagagcuuggauguacaagcuggaaugcccacacauauguguggagccccucuggcaggacagagccaugacuaagaagagaaagggacaggacagggcuggcucuccccacaccuugacccagugcagauauccggauucuaaauuccacccugaccuuccaaaguguaaaggaagguauauuugcaaaguagaagcacacagcauguuuuauuuaguuaccuuuucaauauuuccccguaguauguggucugcuuuuguacucuugcccuagaucuuaaaaauguuagggauguuucuggaaagauguaucccugcccccacuugcaugcuacuuccucuucccacaauaugcaaccccuuuaguuccucagaauauccuuccaauguuuauuuaugcaauuauaauuauaagcauaaucgaaucuauguccuccccccucuuucuuaucccaaggaguagcauucuauacaugcuguucaauucugugauuuuuguuuucucauaaccacacguucuagagaucuuuccacugcaggacauggacagucucuucacgggugcacacuaguaugcccagcuaauuuuuguagagacaggguucuuccguguugcccaggcaggucuggaacuccugggcucaagcaauccucccgccucugccucccaaagugcugggauuacaggcgugagccaccacgccuggccuucuuuauucuuuugcacagcugcauagcauucuauuguguggcugcccauaguuuuauuuguuugccauuaagagaaaugcuugacuggcuuccuguccacugacauggaacaugaugcugcucugccaggagcauguugcacguaccucuucauacuuuugcagauauagcuaggggguuggagggucuccauucccagaagugggauugcaggaucaaagacuaaaugcauuuauaauuuuauuuuuggggaagauuuuuguuuuguuuuuuuggagacaaggucucccucugucguccaggcuggagcgcagugguguaaucauagcucacugcagccuuaaacuccugggcucaggugauccucccaccccagccuccugaguagcugggaccacaggcacacaccaccauaccuagcuaauuuuuaagaacaauuuuauagagauggggucucacuauguuucccaggcugcucucagacuccuggccucaagcaauccuccugccucagccucccaaagugcuaggauuacaggugugagccacugcacccagccuaaaugcauuuauaauuuugauagauauuuaggugugcaaguuuuaaaccccacucuguccucaccacaguucaccuucccucaccuacuaugcagguaagcaguccccaggcaggucacuugucagcagcuggaguggggcagagccaaggauucaggaucaaacacaaggaugccacaacuguagugaccccauagagcacccuggggcugcuccauacacacagcucuguugaccaguggaggucuccucuucaccugcccuaagggcugaaauuaccauugaaguuuaggccagcgguuggccugacccgggagcaauaccuggcuuccuccuccuguacauagagaagcugaacuuuccucuugguccuaguguauguuccuuaacaacccauuuaugccuaguguuccauuauuggaaugcuaauccugugggaguuauuuacauccugcugcucaaggucaucacuaaggucggauuuuucacacacacaaaaauugcaaccuccggcauaaauggguuaaggaauuuccccacuuguggguggagggagauuugcaaaaacucauccuuguaauccugaucaacaaaggcccguuuuaguugggaguaggcagcaaaaggagccacaugaacaguugcgccugucacgcacugcacaagaaugucauucauaucauagacaacauacgauuucuacuguuauccugauaauuuauugacagaaaaaaggauguggggaagggacaugguguucuaauuugcaugaaaaccucgucugaguguagcaucucugggaacaugcagcagauccgagcucaggcccucucuuggccgucaccugcaaacagcuuggacaaagggucagcccaauuggccaaaacucacuggggaauuuuuguggguucuagguuuuuacuuugcaaggcuggugugagaggagguuccagcaggaaaugaacccuccugagagggaaagagacugggaaauggagaaggcugggaacucagggagagaaugggaguggggaaugggagcugaaaaaaauugugagcauaaaaaagggauaugucacaggguuggaugaccagagaaagcgucuggggguucagauuaagaugcugggggcgugcccaguggugggacaggaagcaugaauuuccagagggcucgguuauaaacaucauuguccaauggguguuucccuuggaagccucuaagcuuagagcuaagccaccucuggggacacaaacugagugguuaagagcagagacucaggugucagccugucuggguuccuuccgacucuuccacuuccuugcugugcagccuucggcaaggugcuuggccucucugugccacuauuuccacaugugcaaaacgaagagaagcauagucccaccucacaaggcacgaggacuaaguaagguggauucgcaugaaguguuuagaacugauccuggcccggggugaccuccguguaagucaaauuccccacccugcaugguguuccuuuuagaaaugugcaugaauuuuucauuagaacagcuccagcagugccugaggaaguggagugaggugugagaggucuuacuuuauuccccucgcuggcccugcuauuaaccacuaacucagaguagcuuucuagcacuuuccacacauuuacaucccacccucguccuuugguuagcagcccaugcaaugauuuggccuuaaugugaaccuagaacacagcuucucgcccagggaugauuucugcccccaggggacacuuggcaguggcugcagacauuuuugguugucacaacuggaugggaagaaggaggaugcuauuggcaucaaguggguaaaggccacggaugcuacucaacauucuacaaugcacagcaucccccaccucugccccaccauagagaaugauccaggcccaaaugucaguaagguuucugucaggaaacccugggucagaagaccaagguuccuugaggacggggaugccuuauacugcaaucagcugucacucucugccucucucuggggcugcugugaucaccuggccugcauggacaaccccuaggagcagcccccauccagugccuggagaagucaguggauaaauaccccagcucccucccugucgggcguuuugcucugcccugcaucucuccagugggaucaggcucugguugcccgcaggguuaaccuggucacguacacacccuucacuugccaccuucccuucccugucugguauuuccugggaugaacuuuuagauuuauuuccuggggcugcuauaaugaagcaccacagacugaguagcuuaaaacaacaggaauuuauggucugacaguucuggaagccagaaguccaaccccaagauguuagcagagcugacaacacgccccucaaaagccuccgggggaggauccuucuuugcuucuuccuggcuuuugcugguuucccacaaucuuugggauuccuuggcuucuagagccuucauucuccauuccagucuucugucaucuaauagcauccucccagcccgggcacaguggcucacgccuguaaucccagcacuuugggaggccgaggcaggcagaucacuugaggucaggaguuugagaccagccuggccaacauggugaaaccccaucucuacuaaagauacaaaaauuagccaggcguggugggcgggugccuguaaucccagccacuugggaggcugaggcaggagaaucacuugaacccgggagauggagguugcagugagccaagaucaugccacugcacuccagccugggugacagaaugagacuccgucucaaaaaaaaaaaaaaaaaaaaaaagaaaaagaaaagcauccucccuucgugugucuguguguguucuccucuucuuagaaggacaucaguuguauuggaucagaaccuacccuacuccaguccaaccuaauuuuaacuaauuacgucugcaauuacccuauuuccaaauaagaucacauucugagguaccaggggguuaggacuuaaacauuuuuguguguguagcaggaggacguaauuccauuuauaacuccuccuaaauaaaacgacuugcaugugaacucuugucuggggcuucccaaagugagauaaccccucucucuaccccuaaaacaacgaguagcgucugucaaugccagggugcaggggcuaaggugcccaucuuugaguuucugcugaggaggacacagcugcuacguuggagcacucuuggguucugccuucgugcccagccaucucccuugggcuagcccugcccugggucuauccuagaaugagccucgaucuguuuggccauaggcaagcagagugucuggaaaucuuuguccuccaugacuggugcuggagccgaagccaguggguguggccuugccagccaacuccauuuacccagcucugaacaagcuaguaguugagaucaacggagaguccagacagucgcuccaagcaucuuggaauccauggacacagguguaccgcagaggcuucccaccuggguaggcagcccuuuguaagauccuggcaccacauuuauucucuuaacauccuuucaguuauccaguaaucauuuauugagcaccuacugugugccaggcaaugauuaggugauuggagacacugcaacgaagaagacagacuaaaaucuccacccugguaggagagacagaugcaaaugguaaacaugauaaauaaucaaucacccagaaagcaggagacacuaagcaaauguguauguacuaugggaagcccaauaggaacgaaagcuacacaagagaacaagugaugggugguuccuuagucuaggucaggcaaucagggagggcuucucagaggaggugauguuugagcagagaaggagggagccaggcagauguuuuggaaacagcauucucagcauggagaacaguggcagcucaccuacaggauguguuugauucccuuccagauuuuguauucguuucuuguuuuucucccuuggcuuccugguuuaaaugccuuuugaagaaaucuaagcucaacuaaucagcgaugcuguugaagguuuauaucaggauaugcaucccagaguuauuuacaaaauuagaacaaaacuggaagcaauugaaagccugacaauaggagaucaguuaaauaccguaugguccuuccguaugauggcauauuaugucaucauuaaaaaucgucugcugggagaauauuaaggauacaggggaaaggcucaccauauaaugaugagugggggugcugggcgcagugguucaugccuguaauuccagcaauuugggagucugagauggguggaucacuugagcccaagaguuugaggccagccugggcaacacagugaaacccaaucucuacaaaaaaaaaaaaacaaaaauacaaaaaucagccaggcauaguggcguacaucuguagucccagcuacucaggaggcugagacaggaggauaggaucacuugagcccuggagucagagguggcaauaagccgugaucacgccacugcacuccagccugggcaacagagugaaacccugucaaaaaacaaaacaaaaaaaaugaugagugggagaaacaaguuuuuaaacagggaucaaggaggccaggcaugguggcucacaccuauaaucccagcacuuugggaggccaaggcaggcagaucaccugaggucaggaguuugagaccagccuggccaacauggcgaaaccucaucucuacuaaaaauacaaaaauuagccaggcaugguggcgggcgccuguaaucccagcuacuugggaggcugaggcaggaaaaucgauugagcccaggagguggagguugcagugagcugugaucaugccacugcacuccagccugggcaacagagcgaaagcugcacgagagaagaagugaugcaugguucccuagucuaggucagccaaucagggaggguuccuaagaggaggugauguuugagcagagaaggaggaagccaggcagauguuuuggaaacagcauucccagcauggagaacaguggcagcucacccugucuagaaaagaagaaaugauaagaggggaaaaugaguuuuuaaaaaggaaucaaggggagguaaaccuuaugaucucaaagguacaaauaugaaaauauaaguaaagaaaaacuggaggacacuguaccaagcugaccuucggguggugggauuugggaaucuugauauucucaauacuucuuuguaucuucaaauuucucuaugaugaucacaguuuacuuuuuuuuuuuuuuuuugagauggagucucacucuguugcccaggcuggagugcaguggugcgaucuuggcucacuuggcucaccucugggguucaagcaauucuccuaccucuuccucccaaguagcugggacuauaggcaugcaccagcauggucagcuaauuuuuuguauuuuuaguaaaaaugggguuucaucauguuggccaggcuggucucgaacucguaaguucaagugauccaccaaccucagccucccaaauuggcuugagccaauuaaacuugucuugcuaaaugguuagcggggagaaagaagaaggucucgggucauuccuagaccaggaggcagggagaaagggaggagaaugaaccuuucuuaggcaaacaguguccuagguguccuuaucuuacauaaucugucgagagagucacacuaaaauaaaucauugauugauugauugauacaucaauaauaaauggccagccuugguggcucacaucuguaaucccagcuacuuaggaagcugaggugggaggauuguuugagacaaggaguucaagaccagccugggaaacacagcaagacucaucuuaaaaaaauuuuuuuuuuuaauuagccagaugcgguggcucacgccuguaaucccagcacuuugggaggccgaggcggguggaucacgaggucaggaauucgagaccagccuggccaacagggugaaaccccgucucuacuaaaaauacaaaaauuagccaggcgugguggcacacgccuguagucccagcuacgcaggaggcugaggcagaagaaucauaugaaccugggaaacagagguugcagugagcugagaucacgccauuacacuccagccugggcaacaagagcaaaacuacaucucaaaaaaaauguuuuuuaauuagccggguguggugguccaugucuguaguuccagcuacuugggaggcugaggcaggaggauugcuugagcccagcaguucaaggcugcagugagcuaugaucccgccacugcacuccagccugggcaacagcaagaccccaucucuuaaauaaacacauaaguaaauaaaugaucauuuuuauuuuauuauuaaauacacaagauaaaugaaaaacaggcaaaucuuucuuacaaaagaauuccauuuaaaguauguaaacuucacuccccacugccccaggagguggagacuaaucuccccuacuuugagagugggcuggauuuagugacucauuuccgaagaauagaguagguaaaggggaaaauagaaguuuuauagcggaggaacagauagauaccacuuuaaccaaaugaugaagauuaguaucccccagggauguggauauuauguaacccuugauuuuaugccuauauagcguucuucccaaaaacuccuaaucccaguuuuuugggguuuugcucugucuucuaagcuggagugcgaugaugcaaucauagcucacugcagcucaaacuccuggucucaagcgauccucccaccucaaccuccugaauagcuagggcuguaagcacauaccaucaugcccagcuaauuguauuuuuuugguagagacauguucucacacauugcccacgcuguccucgagcuacuggccucuagugauccucccaccccagccuccagagucacugggauuauaggcaugagccacugugaccagcccagaauuuuuuuuuaaggaguugugaugucguuuaagagaugugauucuucauaacacaucaacaacaagucccagcgauggguuggauaagucuugggauuucaugggaguauuaagcuuaaaagacuuugcaugauaucugugaacuauaugugauuucuguugguaaugggggucacugauucugcgguuugccaccuccaaucaucauggaagaaaauguuccacuuccagugaaaguaagaggaaguaaagggguaauuauuuucuaucuaaauucacgaacuccuugaauucuguccacagaccccuaaguguuuccuccccaaggugaaacugagagaaucuugccagugccuuccgcagucacuguggcuagaaaaccccucagaagaggugauaguuuagcagguaacuggaguucucaccauccgugucuggcucagcccccaucacaaccaguuacccagcccaaaaugucaguaguacugagguugagaggcucugcucuaggaggccaggccucucagaggaaggaggauugggguacuggcugggccucaagaugaaccuacccccuaagagcuuugggauggcgugaguuucuguccauacccaaggacuacaaaugcagguuuacuggaaauucugugccaaaagugagguccaacucacuucuaacugcuacaaaacaaaccuccaucaacauagcccaucucuguucuugaccuggaagcuccaagguauccacauggcucccaugcccacuagacgggccucuucccuggaccuuccugggccagagaaggcucuggguagccuuguggaaucaagaugggugaucagccacuuccucugugccacccuguuuuggcuacuucccuaggcaucagccugggauuccuugaugguaaaaauauaaaacucucugagcuagggccuuuaauauccccauuuuacagaugaagaaacugagucccagagcugugcacagcgauugagagucagaauucagcucugucucacucagugucaacauccucagauucugccauuuauagccucccacagcaaauaggauugagggcugcuucucugagcucaaggggauagaauggggaaccccaugaguacugcaacaaaacuguuugcuggagacaagagcugguggcucuguguuguucuagugacagguggccucauuucacagggacccccucacccuaugugccccauguggcucagaaaagccagaaauugucuccacucucacaggggaaggucccugacccccucuuugccagcugggccaaggcaaauuggggucacuucaugggguacaggaccuacccucucuugguugcccccaaggaggggauguggaggggcuggggaccuggcaggaccagggugucuugaguuaauuuggggcugccuuuagccgagggcuucugugugccuggcaucagcuuuacauugugucuugauccguaaaacagcccugugaggaaagauauuuuuaaccccaucuuccagaugaggaaacggaggcccacagggugacgugaccugccaagguccccuagccaagagugacaaagccaggguucacacacagcucuggacacaauucaucacccuucauccgucucucucugacucuuucuuuuucccucucucucuuugucucucuuuuuuuuuuuuuuuuuuuuugagacagcgucucacucugucacccaggcuagagugcaguggcgcaaucucggcucacuacaaccuccaucuccuggguucaagcgauucuugugccucaaccucccaaguagcugggauuacaggugcgugccaccacacccagcuaauuuugggggguuuuguuuuguuuugagauggagucuugcucugucgccaggcuggaguacaguggcgugaucucggcucacugcagccucugacucccagguucaagugauuccccugccucagccuccugaguagcugggacuacaggcaugcaccaacacgcccagcuaauuuuuuguauuuuaguaaagacgggguuucaccauguuggccaggauggucucgaucuccugagcucaugauucgcccgccuuggccucccaaagugccgggauuacaggcgugagccacugugccugccaauuuuuuguauuuuuaacagagacuggguuucaacauguuggccgggcuggucucgagcuccugaccucaagugaucugccugccuuggccucccaaagugcugguauuacaggcaugagccaccaugcccagccuuugucucuuuuauucuuguguucucucucucucuuccuucucuuucuccaccuccuucuccuucucucccuucuccucacccuucuuugugcuuuucucugugaguuucucuucuucucuauuucucuccuuuggugaaugucaauuagaaaagcagaaaaacugcguuuaauuugugaucauaaaugcaugucccuggccaggcgugguggcucacgccuggaaucccagcccuuugagaagcugaggcaggaagauugcuugagaccgggaguucaaaaccagccuggucaaaaagcaagaccccaucuuuaaaaaagaaaaauaauuaauuagcugggcauggugguguguaccuguagucccagcuacucgggaggcugaggaaggaggauugccugagcccaaggguuugaagcugcaccgagcugugauuacaccccugcacuccagccugggugacagaaccagacccugucucaaaaaaaaccuaauaauuaaaaauaaauaaauaaauaaaugcguguccccuggccagugguugcuaauguuuggaaucaccuuugacccaugcccuuuuucauucauagauguuugucuugaccaaaaucaaagcauuagacuuuggacuauaaaucacugguucauucaacaaccaucauugaaugccuacuguaugcagacacucuucuggacacagaggaguugacguguugguggggaaagccagugaucaguugggauaaaaagggcagacagcagacauuaaauaguuuaggcuuugugggccagauggucuccaucgcaacgacucaaucugcuccuguagcgugaaaguaacgacagauaaagcgcguaagugaaugagcauggcugugggccaauuaaacguuaaccuauaaaaacagguggcuggcccgcgggcuguaguuuguggaucacugccuuagagauaguguuagaggguggugagagguccgggauagaauaaaacaguagagaguuugugcauugucaagaugagagguugcaguucuucuuauacaccccgaauggccgggcaccguggccauuaugaucuauaauucuaacacuuugggaggcugaggcaggaggaucccuugagcccuagaguuuaagaccagccuaggcacauagugagaccccaucucuacaaaaaaaaaaauuuaaaaauuagcuggacaugguggagcaugccuguaggcccagcuacuugagaggcugagaugggaggacugcuugagccugggagguuggggcugcagugagccgaucaugccacugcacuccagcccggaugacagagcaagaacugucucaaaaaaaaaaaacaaaaaaacaaaaaaaacagaccugaaggaacaaaucauaugaaugcauuaaaguaucacauguauccaaaaaauauauacaucuaucagccuggcacgguggcucaugccuguaauccuagcacauugggaggccaaggcaggcagauugccugagcucaggagugcaagaccacccuaggcuacauggugaaaccccgucucuacuaaaauacaaaaaauuagcugggcaugguggcaggcgccuguagucccagcuacuugggaggcugaggcacaagaauugcuugaacccaggagacagagguuacaguuagccgagaucgugccacugcacuccagccuggacaacagagcaagacucugucucaaaaaaaaaaaaaaaaaaaaaaaaaaaaaaauauauauauauauauauauauauauauauauauauauauauauauauauaaucaauuaaaaauuuuccuuaauaaauaaacauuucucuccuucucucccuuggugaaugucaauuaauaaagcaacaaaacuauguuuaguuagugaucauuaauguaugucccuggcugggugugauggcucacacuuguaaucccagcacuuugggaggcugaggcaggagaggauaguuugaggccagcaauugcuugaggcuuuuugaaagacaugaaggagaugaagggagccauggagauaucucagggaacagcagccgagguagauggaacagccagugcaaagguccugaggcaggauguuccuggcauuugugaggacauguagcugcccagauguccaguggggagugagugaggaugaaggaaggagcugaugaaggaagaugauaaaauacuucauggaucagccaggcaugguggcucccgccuguaaucccagcacuuugggaggccaaggcggguggaucacaaggucaagaguuccagaccagccuggccaacauggcgaaaccccgucucuacuaaaaaauacaaaaaaguuagccaggcguggucaugcacgcguguacucucagcuacuugggagacugagacucgagaaucgcuugaacccaggagauggagguugcagugaguugagaucaccccacugcacuccagccuaggugacagagcgagacucugucucaaaaaaaaaaaaaaaaaaaaaaagacuucgugaacagacagccuauauaauuuaugauccaaaccaggacaguuuugagagugaaaggggaaaaagagcacugaaaaaauaauuagcaggccuggcaugaucuauaacggguauaaagugggacacacagccucucucacggucacugucagacuucagcuuuuucacacucaaauccacccccauguuuaucccauauacuggagaaacggguguucuccugagcugaguuuugggguuuuuuccuuuuguuuuguuuuguuuuuguuuuuuuaacauccuguauacuuuuucucaaugaaccaugcucaaaaaaauuagaggaaaauaaaccauaaaacagaaggcacugaaggauuuugcugggacucagccauuaguuuguuugaugaguauuuauggagcgcuuucuaagcaccaggcaccaccagcgauacugggaugaaucaguaacaucccucacccuugaagcucucuugggcccauuguuauuuacuuaaaauacuaugcaaguacggagaaggggugaagugggaaaaaaucaguugguuguaaaggccagaaugacgggucuagucccacccaugccaucugcacccugugugauccaggcacaucauguugccucucucagcuucaguuucuccauccaccaggcacagagauggcgggaaucgaggaagauguggggaguauuucaucagcccaaaaagacuuggcuaaugcgaccauaauucugccuucugccucuccuuucccagaaaaauagcuuaaucauuuggauuugggauaaacacauuuccuguguuuauuauuuaaaugauccaccaagcugggcaugguggcucaccccuguaaucccaacucuuugggaggcugaggagggcggauugcuugagcccaggaguucaagaccagccuggccaacauggcgaaaccccaucuuuacuaaaaaaauacaaaaaaauuagcugagcgugguggugcgugccuguaaucccagcuacuugggaggccgaggcacaagaaucacuugaaccugggaggcagagguugcagugagccuagaucgugccaucacacuccagucugggcgacagagugagauucugucccuaaauaaauaaauaaauaaauaaauaaauaaauaaaauaaaugauccaccaacaggaaccccaggaacauuuguauugacuaugcaacuaaugcuuagugagcaccuacuaugucccuggugcugaucuggacacugggauuuagacaggaaaaaucucuacccuggaggagcugaugaucaagaugacaaucuugaaaugcauaaguugacaagaugauucagacaguggaacgugcugggaagagaaugagaugucuggcugagcugcaggaaggggcaaguccuuuugauugagagguccaagaaggcuucucugaugggggcacaauggaucuaagguugagugauaagaagaaauuggccaagccaagaccuaaaggcagaguugcuccaggcauagguucagagaauggaaauaauuggcugauugugaucuugaacuugaccuuucuuuucuucugcuaacuuuggguuugguuuguucuugcuuuucuggcuccuugagguacguguuggguucuuaauuuguaauuuuuuuuuuuuuuuuuugcuuuuuugagacagagucucacuguggugcccaggcuggaguacagcagcaugaucuugacucacugcaaccucugccuccuaggcucaagugaaccucccacuucagcauccccaguagcugggacuacuggugcacagcaccacacccagcuaauuuuuuuauuuuuauuuuuuagagauggggucucacuguguugcccaggcuggucucaaaccccuagcucaagcgauccuccugccuuagccccccaaagugcugggaugagaggcgugagccaccacaucuggccucuguuuuuugugauguagguauuugaugcuauaaacuucccucuuaguugcuucuuggcccuuuagcuaaggucaaguguaaacuucccucagcacugcuucugcugcaucucacagguguugguguguugugucucuauuuucauucauuuccaaaauuuuuuaagucuccaucuuaauuucugcauugacccaaugguuguucaggagcauguugcguaauauccauauauuugcaucauuucugaaauucuucuugguauugauuucuaguuuuaucccacgguagucugagaagaugcuugacagaauuccaguauuuuaaaauuuguugagaguuguuuuguggccuaacauguggucugucuuggagaauguccaugugcugaugagaagaauguauguucuccaucagacaugcaagagacagacacuuucucaccugccucaugggauccauaaaagagucaaucagaaguuggcauuuaagaaagaccagaaggaggcugggugcaguggcucaugccuguaaucccagcacuuugggaggcugaaguggguggaucaccugaggucaggaguucaagaccagccugaccaacaaggugaaaucuugucucuauuuuaaaaaauacaaaaauuagcuaggugugguggcgggcaccuguaaucccagcuacucuggaggcugaggcagagaaucacuuggacccaggagguggagguugcagugagcugagaucacaccauugcacuccagccugggcaacagagcaagaccccaucucaaaaaaaaaaagaaagaaaaaaaagaaagaaagaccagaaagaggugaaggagcaagcuacagagauaucaaacuguaucaaucuggcugggcgugguggcucaugccugaaaucccagcacuuugggaggcugaagcaggaggaucacuugagcccaggaguucgagaccagccugggcaacagagacccccucucuacaaaauauaaaaauuuaauuaaaaagauguauuggucagggcagccaaguuaugcugcaguaacaaacauccccaaagccuccaugacuuuugacaacagauguauuuccugcucaugcuacauguccagugcagguuggcaguggggaagaagggggcucuguucagugcagucacuugagaccuagcuaaucaccuagaacauugccacuugcuauuccagaaggaaaaaaggaaugcuagaaggucccacacugaaaguucaaugcucuggcuccaaaaugacagcuauuuccacucacuccucauuggccagcacuuagcaugugguccucagccaaccccaaagggacucaggaaggaccaucccaccauauugcuggaaauauuugauggcagcauuaauggggaacaguguuccaggcaguggaagucuuugagcccuuggaagaaagacaaggcgaucucuagagcacauccuucccaauauuaaugaauuuaacaaaugagcaagccauccucccccacucuccuucccgaauucagacuugugcauaucccucccuuaacuugaacugccaaagaagagaugagaaccaggagaagagaucugugaccccaucuuugcugaugaacuaccacagaacagccauggcaucuccaguccuugugcuuguaaaauguacuuuucauuuugcuccugaacgaaauccacccacccccacccccaaaccagggaaagcucaucuccuaauccaaaacugcacccagccuuccaccaccuucuucccugggaauuguugauuccagaguauggaauugaauaauuggaugaguuuggaagagaaaaagugucucuaaaaucaggcagcagaagcccacuccccagagaggauggugcagaugagaguucaggagggagcuuggcuugggguugacgaucugagcuaugcagggaacuuggacacaccucucaaucagucauucaacagacaccacuuauugagcaccgacugugugccagauguuguccuagggggcugggaauacaggaauacagcagggaacaaaaaggacaaagccccucccucuugucgaauggacauuccagccaggaagacgagagaacaagagaaauaaguaaaguauauaggcggugaaaugcaaaugggaaaaaagaaacaauggggaccagaaaugaggggugcaauuguaaagggccaucaggggaggccucccucagaagguggcauuugaguaaaaaaccugaaggaggugaggggaaaccauguagcaaucucaggaaagagcauuccaggcagggagggacagccugugcaagggccgagguaggacugugcuuggcgugguugagaaacugcaaggaagccagguggcuggaaccgaaugagcgagggaaaaggggaggagauaaaagcaaggagaugggaggguuggaggcccccucugccauucaguaacugaguaacuucauuuauuuccuguagcuugaaccacaaagaaccacaaauagaguagcugaaaacaacagaaauuuauuuauucucucgcaguucaggaggccaggaguccacagaccaucaaggucagcugggccacagaccaucaagaugucagcugggccauggugccuccugagacuuggucugaaaucccuucuugccucccuccuagcuucuggugguuugccaacagugcuuggugguccuugucuuguagacguaucacccugaucccgccuucaucuccauuucacauggccuucucccucugugcaagguugucucugugcccagguuucuccuuuucuuauuauuuacuuauuuguuuguuuguuucuuuauuuuagacacagggucuugcucugucucccaggcuggagugcaguggugcgaucauagcucacuacagccucaaacuccuggccucaagcaauccuccuaccucagccuccugaguagcugggacugcagaugugagccacugugcucugcccagauguccucuuuuuauaaggaaacccgucauuuaggaugagguuccacccuaaugaccugaucuuaacuugauuccaucugcaaagacccuauuuccaauucauagguaccagggauuaggacuucuucaaugcaucuuuuuggagagacccacugcaacccacaacagaacugugggcauguaacuugaccucucggccaggcgugauggcucacaccuguaaucccagcacuuugggaggccgaggugaguggaucgccugaggucgggaguucgagaccagccuggccaacauggucaaaccccgccucuacuaaaaauagaaaaauuagcugggcaugguagcaagcaccuguaaucccaacuacuugggagggugaggcaggagaauugcuugaacccaggauguagagguugcagugagccaagauagugccauugcacuccagccugggugacagagugagacuccaucucaaaaaaaaaaaaaaaaaaaauagaccucucugugccucagcuuucucacccgggaggauggggauaauuauauacccacuccugggguucaugagaggauuaaaugagcucaaacaguccaagccuccacgugugucuguuguggugcuggguagcauguccuguggccagagguucccaagcuugucgaggacccaggcaagggcagauucgggucuuguuggcagcaccugagauggacgggcugccuugguauggaagggccucggcuguuuuucccuuucaguccugucccucucccccauccuccacccugucccugucaucugagccugcuccucgugauggcucagagucucccuacuggcggccggugcagaguuucguucccugggcuauauuuagcccugagaaaugggaacgagaacccucagccgccaaagugauggagagaggagcacaaagccagugcugccuucuguccagcaauguuccgcugacucgguucuuucuuccagaaccuuccagaagcaaagcauuggcauuucugagcucguuaaaacaaggaugugggcugguggcuggcacauucauuguccccagaaccugucuguguccaugauuaaagcugacuuuguuaguuuuauuuucagugcuuuuuuuuuuuuuuaauccauggcaaaacacacaugacauaaaauuuaccauccuaauauuuuuuuuaacuuuguaacauuuuuuaauugacaaguaauuguacuuauucaugggguacauagugacguuucaaugcauauaaugcguagugcucagaucaggguaauuagcauauccaucuucucagaccuuuauuguuucuuucuguuaggaacauucaagcuccuccuucuagcuauuugaaaccauuaauauauuguugucauccuaaccauuuuuaaggauacaguuucgugaaauuaaguauaauacauucacauuguugugcaacugucaccaccauccaucucccaaacuuuuccaucuuccaaauguaacucuguccccacuaaacgcgaacucccuguucccccucccccagcccuuggcacccaccaugcuacuuucuguuuuuauaaaucugacgacucuagggaccuccuauaaauggaaucauacaggauuuucccuuuuaugacugguuuauuucacauagcauaaugcccucaagguucacccauguugcagcacguaucagcauuuucuuucuuuuuaagguaaaguugacuauuaaaaaaaaacuucugccgggcucaguggcucacgccuguaauuacagcacuuugggaggccaaggcaggcagaucaggaggugaggaguucaagaccagccugaccaacauggugaaaccccaucucuacuaaaaauacaaaaauuagccaggcaugguggcgggcgccuguaaucccaacuacucaggaggcugaggcaagagaauugcuugaacccgggaggcagagguugcagugagcugagaucaugccacugcacuccagccucggcaacagaguaagacuccgucucaaaaaaaaacaacuuuuuaagaauugaaguagaauaaacauacagaaaaauccgcggauuauaagugaagagcuugauuaauugucacaaacuaaacacauccauguaaccagcacacaaaugaggaaacagaaacuucucagccccagaagccccccucauauccuguuccuagucacuaccuccccgcaaggguaccccuaccaggacuuugagcaucauucaccaguuuagccuguuuuguauuuugcauaaaugaagucuggcuucuuuugcuugacguuaacuuuuuaagaucucaugugaccuguggcauuguucauugcauguauccucucucuccuauugauaacaguguggauuguuugcaauuuggagcuaugaugaauaccauugcuaugaauguucuugugugugcuuucuguuguguaauuauucagaauuacuauuucggaauuacuaucuaauuguagugaucuuggaucaguaacuauccaagaauuacuggguguuggcaaagguacauacaguuauacacugcacaauggcauuuuggucaacaacagaucaaauauguaacaguggucccauaauggaccgaauacauaacagugauuaucauacaguauuuuuacuauagcuuuucuguuuuuagauucuuuuuuuuuugagacgaagucucgcucuguugcccaggcuggagugcaguggugugaucuccgcucacugcaagcuccgccuucuggguucacgccauucuccugccucagccucccagguagcuacaggcgcccgucaccaggcccggcuaauuuuuuuuguauuuuuaguagagacgggguuucaccauguuagccaggauggccucgaucuccugaccucaugaucugcccgccucggccucccaaagugcugggauugcaggcgugagccaccgcacccggccuguuuuuagauauuuuuagauacacuauagaguuacaauugccuacaguauuccauagaauaacaugcuguauggguuuguagccuaggagcaauaggcgagaccaugcagccuagguguguaguaggcuauaccaucuagguuuguguaaguacacuccaugauguuugcacaacaaaaugaccuagugacacauuuuucagaauguaugcccauuguuaagcaugacuuaauuuuagcauagaaacucucaaccaauuuuucaaguaguuguaccauguguuauggguuuuauugucucaccccaaaauucauauguugaaguccuaacccccaguaccucagaaugugaccuuauuuggaaauagauucauugcacauguaaagguuuugccauuggcaaaacugccguuauuuuugcaccaaccauagcaguuaagaugagaucauuaggguggguccuaaucuaauacgaugguguccauauaaaaaggggagauuuuggcacagagacaggcacacucacaggaagaaugccauguuuaaacaaaggcagagcucaggaugaugccucuacaagccaagaaucagcaaagauugccagcaaaccgccagaagcuaggagagaggcauaaaacagauucugucucacagcucucagaaggaaccagcccuucugacaccuugagcuuggauuuuuggccucuauaacuguaagacaauaaaucuuuguuguuuaagccaccuagguugugguuccuuguuacagcagccacaggagaugaauacagcauggugcccucccauuggcagauuaugaggguuccaguugcuccacagcuucacagacaccugguaguaaugaccucaucuuaacuucuuucucauuuuagccuuucuuccaggcagcagcagugucauacaugcuuuuaaaggugggcuuuuaaagccacacuugagagcccugcauucugcaggugucacagggugaucaacuauucaaaggcuaccccugcccugacagcuggaggcaaggcuucccagcacagagguuaagcccauggacucuggggccaggugguuagugcaaaucccauguccacuagugaauaacucugugaucuugggcugaugauuuugucuuucuaagccucaguuuccucaauaguaacaugggcauuauaacauagaggcaucaugaggauuaaaugacuaagugagcuaacauacauaaugugcuuaggaaggugccagcacaccauaaauacucuguaagugcuggcuuuuaucauucuuuucucucucucucucucucucucucucucucucucucucucucucucccucucucucucugucucucuuucucucuccaccccccaaccuccucuccuugauuuucuuccccucaucuuacuuccuucuugcuauaguguucuauuuucuguuucagagaguauucuauuuguggacuuuuuuccucuugaaaauugagcugaaacuucugagaauuuuuugugauuggcauuaaggcugcagggaauggagcagggagacacuugaggaaagggcucauggaccaucugucuggcuuggugauuucaccaggccaucagacucuguggucaugcaucuccucuaaggggagucuaugacuguguugggagaagagaaggaaccagggauuaauuaauccauuucaauagguuuuguguuuuguuugguuuacuuuuuccuucuccuucuggacuguggucugggaaguccucuuguguuucuuacuccauucccaggucaauuauguuaugugaggagaacauaauuaagagagagcuuuacccuuuggauguuuucuucagaaaacguuccuccauuucccccucugggaugccagagccccagaacuccacaagccaagaacauuuaagacagagccacaagagaaccgagcuuccccuucccucaccugucagguucuaucugagucccagucaacucucaccugcuuucccuccucacacccuacagagcaacgaugccucagggaacacuuggaacugguuguacuucaucccccucaucaucaucggcuccuuuuuuaugcugaaccuugugcugggugugcugucaggguaaguuucugcuacuccccaccccaucccacucacuccucuuugcuaacuucuuuccaaguagaggccauugaagcuuuguuuucauucacuagacagagaaaaggcuucuucccuuguuuggguuaccagacuguuauuagcaagccaugcacaggugcagagguuguguacugcuagggguacccagugagaggguucauaugggcuuuacuuucuuuacauuuuuuuuaaaaaccaauaguuuggguuuacuucucccccauuuuccaaauauaaaaucauagcauaugcucuaacgguguauuuuccugacccauauuguccucuauccccaagauuuuuuuggcuuaaucauaaaugggcuucauuuuucuuaccauaagaagucugggcacuuguaugguggcucuauggcaccaucagcaaccccagauucuuccagcuuuccauucugacaucuuuaccagaggcuuccaaucucguggauaccucauggucuuaagauggcugccucacgcccuccggauggccacuucauguuccaaacaggaaaaggaagaagggaaacaggaagaggugggaccuauggcagagaagccaaccugcugcagaaaucuuucauucauggcuuauuggucuaacuuaaaagagggcugaaauaauuauuagccaaaaguaugaagagaaugagaaugagguaugcagccaguggugguuggcauggcaugguuuuauccuuucgguuuuuuucuuuuuuauuguuuuuuuuugagacggugucuagcuuuauuacccagacuggaguguagggggcgaucauagcucacuguaaccuagaacuccuaggcacaagcgauccuccugccucagccuccugaguagcuaaggcaacaaguguaugccaccaugcccagcuacauuuuuuauuuuucauagagauggggcccacuguguuguccaggcuggucucaaauuccuggccuuaaaugauacucccaucucagccucacaaagugcugggauuacagacaugagccacugugccuggccuuuuucuuuaccuaggcacaguugucgggaaaugugugaagcuggcagaagcacccaucacuauaauaucccagucuuuucccagaaguccugacuccuccuguugaaaacuccugaccuccagggacuucugaauccccaaacacacacacacacacaaacacacacacacacacacacacacacacacaaacacacacacaaacguuuccuaacauuuucaaaacagccauacucuggcuuuucuaugcuucuccagggaguuugccaaagaaagggaacggguggagaaccggcgggcuuuucugaagcugaggcggcaacaacagauugaacgugagcucaauggguacauggaguggaucucaaaagcaggugaggcccuuucauccuggggcccagggauggagaucccaggccacggaguacaaagagagucaugcaguuuggagaaggcuaagcugggaggguuaugaugggaggagaaagagaaccugaauugguagucccaaauuuuaucaacaagaauccagagucugauaugaagaagucuaagaugaagccaggaucugacaucacguaacuugaauucugaaaucagacgcugguuuacaucccggcccugccacuuuuuacccaugcaccacacaucccuguaccuccguuuccucagcuguuacauggaggcgaugguagugccuaagucauaguacuauuggaguauuuaguaaaauaaucucagcugagucacuuggggagagaagugccugauacacgguaggcacauauuuauuuguucagccauuuaacaaacauuuagggagcaccugcugugugccaggcacugaucuaagcacugaggauaugggaguaaacaauacacaccaaaucccugcccucagagcucugauauucuaaugagagagauaaagcaaacaaauacaugucauguugggaacucccaaauucagagaaggaagauaaaacagacuaggaagauaaaacagaguaggaaguuggccgggcgcgguggcucacgccuguaaucccagcacuuugggaggcuaaggcgggcagauuuccugaggucaggcauucgagaccagccuggccaacauggugaaacccugucucuacuaaaaauacaaaaauuagccaggcaugguggcgcacgccuguaaucccagcuacucgggaggcugaggcaggagaauugcuugaacccaggaggcagagguuacagugagcugaggucgcaccacugcacuccagccugggcaacagagugagacucugugucagagaaaaaaaaaagaguaggaaguuagaggcaggguggucagggaaggcuucucuaaggaaguacccucugagcagagagaccugaaggacgugaagaaggaagcuguggggaugucaagggaaggggcauuccaggcagagacagcaagugcaaaggcccugagcuaggaacguauuugagacacagcaaggaagccagugcagcugaaacagagugagagguggggacagcuggaggagaggaagacaggaaggugauggagaucagaucaagcaggggcuuauaggcugugguguggacauugguuuuuauuuugcgcgagguggggagaauguuggcuauugcuacuguugcggagguggggcuugaagucacaaaccacccagcagcauguuuuuuggucgguugagcugucaccaucagucagcagagaauggggguggccgggcagacccuucuuccugguccaagggagaacucauccuccaaaugcaggagcuuaacucugugcucuuccucuucagaagaggugauccucgccgaggaugaaacugacggggagcagaggcaucccuuugaugguaacugcucuaaacccaccucaggggugggucccaggggagaagggagaagcugugguggggagucgggggagagcaggugacugguucuaaggaucuugcagaggguagacguuccucuuggaggaauuuuaggacuuccaugcagaguuucccuauucuggccuccacuuuuuuguuuuaaccauggaccugguuuuuucugcuuugugccuugguuuuucucaucugcaaaauggguaugauauaaacaauacccuagcucacgagauuguuucucagaaugauauucguuauggcaaauagaacaccugggauagugccuggcauggggucagcacguuucuguuugcuaaauaaguaauaauuccaccaauaauccaguuuacugugaacggcugcugucucccauguuagaaacuuaacgagacagaaccaugacuuucuuucuuuucuuuuuuuuuuaauugagacagagucucgcucugucacccaggcuggagugcagucacacgaucucaccucacugcaaccucuggcucccagguucaagcaauucucugccucagccucaugagaagcugagauuacaagcaugagccaccaugccuggcuaauuuuuauauuguugauagagaugggguuucgccauguuggccgggcuggucuugaacuccuugccucaaaugaucugcacaccuuggccucccaaaaugcugggaguguagaugucaauucaugguccccuggaaaccugaauaugaaaggagggaccauuaaaaagguguccaaaagcccaaccuccccagcauagcugggagucaggggacagacuguaagagucacuguguauccaaccugaggcuucaugaaaguaaaguuuccuagaauuuagagauaggguuggaugcggucugucuguggcucacaucuguaaucccaacacuuugggaggccaagacaggaggaacacuugagccugggaguucaagaccagccugggcaacauaaugagguuccgucucuacaaaaaauaaacuuagccagaugugggggcacacgcaccuauggucccagcuacucaggaggcugaggugggaggaucacuugagcccaagaggucgagguugcagugggcaccacuccacuccagccugggugacagagugagacccuguuucaaaagaaaaaaaaagaauuuagagauaggccagaauaauaugucugcaauauaauaauaacagcaauaagaaaaauaauaguacucccugaaaaaugcaacuucuugcuugagauuuaucuucucauacuuuagaaaacugguuagacaggggcugggcgugguggcucaugccuguaaucccagcacuuugggaggccaaggcggguggaucacuugaggccaggaguucaagaccggccuggccaucauggcgaaaccccaucucuacuaaaaauacaaaaauuagcuaggugucauggcacacgccuguaaucccagcuacucaggaggcuaaacuacgagaauugcuugaaccugggagacggaaguugcggugagccgagaucacaccacugcacuccagccuaggcgacagagcaagacucugucucaaaaaaaagaaagaaagcugguuagacagggugaugacuuuugauuaaaaaucugagagauuugagggaaauaaaagaacuggcacugcgucccagaagguuauaaaaugaauuuuauuaucuuaguuggggaggggagauuaccuaacuccccuaaaugaguuagguaaucuaacucauuuaggguaccuaaaucuuuuuauuggaagucuacaccugaacuugucugcuguggagccccugggguguauagcuugaauaugggggcagaaucccaaaauugcagccugccuagcgaguaugcuacaggucaagggguggacuguuuucauaagaaagugagguuucuuagaauuuaaaaauagaggcugaguggggcggcucacgccuguaauccuagcacuuuuggaggccaaggcaggcaaaucacuugaggucaagaguuugaccagccuggccaacauggcaaaaccccaucucuacuaauaauacaaaaauuagccaggcgugguggugcaugccuguagucucagcuacucaggaggcugagggaggagaaucgcuugaacucaggaggcagagguugcaguaagccaagaucacaccacucucugggugacagagcaagauucugucucaaaauaaauaaacaaauaaauaaauaaaccagaaggaaaauaguggcugagggcccagaccuggagucggacugaacccgacuugauucuugucuuuaccccuuuaagcaaagugauagugccaccuugaaccucaguuuacacaucugaaaaauggguauacuauuaguucccgugagaacaguugccgugagaguuaaauccaaggacacacuguguccauauggucuguguugcaaaaaggguaacgucuuuuucucuugccauguuuccauuguuggagcucugcggagaaccaccauaaagaaaagcaagacagauuugcucaaccccgaagaggcugaggaucagcuggcugauauagccucugugggugagucccuuccucugccaccuaucaguuguucaucaccuaucgcccaagagacaugguggggugggggcagagggcuugcaaaccgugcugccuggauuugggucucagcuccacccuuucccaccugugcguguguccugggcagauuacaucauuaugggaauaacauccgugccuagcuucucauuauuuugugggaauucaacuaaaugauccccaugaagcauggcaaaccagcaccuggcagggacgaagcucccagucaaguuggugaauguuugugacucauucgggaaguauucaugggggaccugcuuauauuaggugcuugguugcaaacaagacaaggcagucacgaggcugagcugggaggaucacuugagccugggaaguggaggcugcaauaagccauuauuguguuacugcacuccagccugggcacagaaaaaaaaaaaaagacacaaacugagccaggcacaguggcucacgccuguaaucccaacacuuugggaagcugagaugagcggaucaccugaugucgggaguucgagaccagccuggccaacauggugaaacccuggcucuacuaaaaauacgaaaaaaauuagccuguaguuccagcuacucuggaggcugaggcgggagcaucacuugaaccugggaagcagagguugcagugagcugagaucucaucacugcccuccagccugggcaacagagcaagauccugucucaaaaaaaaaaaaaaaaaaaagacacaaaccaaaucccuaccuacauggagcucacaguccagugcaggaaauagaaauuaaacagagaauuacacaaauaaaccuguaaugguaauggcacuucagggagaggcucugggcuuagcuugcucuagaaggauggggagcagucagggaaggcuaccuggaggaagugacgguuaagcugggaacugaaggauggguaggagaucacugugguggugauagcagaaggaacagugugagaggcagggcucagaccuuugccaccacaagggccagaguucgagggaggagggaacauuuauucuuucccuucucacuccucuguccuauugauucauuggcugugaugauguugauuuugaccuucuaaagugagaauguauuguuauuguuguuguuguucuuuaauggguuuuuguuuuuaauggaaggaagagcauccaggcagaggaaauaagacuggaauaagauugaggggagaaggaauuuaggcugcuugggaaacuguguggccgcaguuuagaggaagaaaggauggcaagagaaagaggaagggaggaagagaaggagggagagaagugaaggaaggagggaaguuaguacauccauguguuucugauccauaguuucugauccacuauuucguauuccccuuuuaucgcucgccccuaguuuauaaccuuauugcugaguuuaggcauaauuuccauugcgaucacauaucucguaggguggauacacuaugguuuguuuagccauagcucuauuauaggguguuugaguuguuuccaauaauuucucuuacgaagaacacugcugugcacauuuacguacaaugacuccccccacccuuugggcguauuuccuuggggauaauuauaggaucaaagauauuaacagcuuuucaacucauuauucaaagagccauucugaguuucaaaaacauggaacccauuuauaaaccugccaaguaugcauauguucauggauuccccacccaggccaucgaauauuaccaauuuaauuuccuuucccaguuaaguggguuuguaaugaaaccuuaaagcuuguuuucauuugcauuuuuaauuuccagccaaaacacgcuuuucuuuguaauggagaacucauucugcuuccacucgugugugcaucuguuuaauuuccuguaagcaaaugucaagaauuggagcgcucaguaggugucuugaguauuugaucaauuaugucugucucacguguuacguuaccuccauuguuuaaaaucuguuuuaugacgagguacagugguucacgccuguaaucccacugcuuugggaggccagugcaggaggaucuccuaagaucagccguucaagaccagccugggcaacauaacaaggcuccaucucugaaaaacaaaauguugaaaaacuuagccaggcauuauggcacacaccuauagucccaucuauuuaggaagcuaaggcaggaggauuucuugaacccaggaauucaagguugcagugagcuaugauugugccacugcacugcaacgugggcaacagagugagaaccugucucuuaaaaaaauaaaauaacauacauucuuaaaaaucuacuuugcuggccgggcgcgguggcucacgccuguaaucccagcacuuugggaggcugaggcggguagaucgcuuaaggucaggaguaggagaccagccuggccaacauggugaaaccgugucuguacuaaaaauucaacaauuagcugggugugguggcgugagccuguaaucccagcuacucaggaggcugaggcacaaaaucacuugaacccgggaggcggaggcugcagugagcugagauggcgccauugcccuccagccugggcaucaagagugaaacuccaucaaaaaaauaaaaaaucugcauauacauauauauguauauauauuuuuaauuuuuuuaauuuuuuuuuuuuuuucugagauggagucuugcucuagcacccaggcuggagagcaauggugccaucucggcucacugcagccuccgccucuguuaacaaggcaggugacauugcagcuuucuaaacagacccaaaacccaggccaguggcuuguucuuucauagccacguuugcuacaggcaaauccaccaaaacccaccucaucagccugauuacucaaaaagacaaagaaaggagcccccaaucuagccagugguuuucuagaccaccccaaaagagaucucuggaauuccaggauucuggcaaggaaucacauuuagcuuuauuuauuuauguaaagaaugcaacaauacaggcugggugugguggcucacgccuguaaucccaacauuuugggaagcugaggugggaggaucguuugaggucaggaguuucagaccagccuaggcaacauagugagacccugucucuaucaaauauuagcugggcauuguggcacacgccaguagucccagcuacucgugaggcugagguggaucaccugagcccaggaggucaaggcugcggugagccacagcaugccccugcacuccagccugcgugacagagacuucaucucaaaaaaaaaaacaaaaaaaaguaauaauacaguaaugcauauuucaaaguaaggugggagcuaugugguauuugcguucacguucacauuauaccacaguaugcacaguccuuuuuuuuuuuuuuuugagacagugucuugcucugauguucaggcuggagugcaguggugcaggcauagcucacugcagccucaaaccccuggacucaagugauccucccaccucagccucccaaguagcugggacuauagguguacacugcuacacucagcuaaguuuuuuauauuuuuuacuagagaugggaucucaauauguugccuaggcuggucucaaacuccuggccucaaacaauccuccuaccuccaccucccaaagcagugggauuacaggcgugagccaccacaccuggcccacaugcagucuuauauaauuggugauucuacugcgcuguugaaucaguugauaaacgcacuauaaagcagguucauuccuaauugaugaacuuacugcugaaauaaggaacuugaaucauuuacaugaaaaguugagccauguugcugaaaggauaucaauuuuuuuuucuuuuuuuucuuuuuuuuugagauggagucuuacucugucgcccaggugggagugcaguggugcgaucucggcucacugcaaccuccaccuuccagguucaagcgauucucccaccucagccuccaaguagcugggacuacaggugcacaccaccacgcccugccaauuuuuguacuguuaguagagaugggguuucaccauguuggccaggcuggucucaaacuccugaccucaagugaucugcccaccucagccuccgaaagugcugggauuacagguguuagccaccgcgccugacaggauaucaaauuucauuuagacugcaggaauacguucaagagaucuauuuuguacagccuggcgacuguauuaauaacaauguauuauauacuugaaaauugcucagagaguagguuuuaagcauucucaccgugagaaaagugauaagcauauguaauaaugcauauguuaacuagcucaacugagccacuccauaguguauacauauggucaaaauaucauguuaugcacuauaaauagauacagccuguaucugucaauuuaaaauaaaugaauaauaacuuuaaaaagaaaaauaacaguauggcugggcacgguggcucacaccuguaaucccagcacuuugggaugccaagacaggcuugaggccaggaguuugagaccagccuggccaacauggcgaaacuuugucucuaauaaauauacaaaaaucggcugggcauggaggcgggcgccuguaaucccaacuacuugggaggcagaggcaucacuuaaccugggagauggagguugcagugagccaagaucugcacuccagccugggugauagagugagccuuuauuuauuucuguaaagaaugcaauaauacaggccuggugcgguggcucaugccuauaaucccaauguuuuggaaggccaaggugagaggaucauuugaggcuacaggcgcaugccacagugcccagcuaauacuugauagagacacggucucgcuauguugcccaggcuggucucaaaacccuggcuucaaaugagccucccaccuuggccucccagaguguugugauuacaggugugagacacuguaccuggccuguauuaaaaaaaaaaaaaagaagaagaagaagaagaggaggaaagaagaagaaggaagaaggaagaagaagaagaggaggaggaggaggaaugggaaggggaaggggaagaagaagaggaggaaggggaaggggaagaagaagaggaggaggaaggggaaggggaagaggaagaagaagaggaagaagaagacgaagaagaagcacaaugauaaauaaguaaaauguggagcauaugaaaacaaaacaaaaaaaaguugauccauuaugaauggaagcugccauuguaacucugcuuuuuuaggaaaaccagaccccauuuagaugauuuuauuuguuuuuaaaggcagguucuugcucugucacucaggcuggagugcagugauaugaucauagcucucugcagccuggagcuccugggcucaggcgauccucccagcuuagccucccaaguagcugggacuacaggcaccaccacacccagcuaauuuguuguuguuguugauguuguuguugagauggggucuggcuauguugcccaggcuggucucaaacuccuggccucaagugauccuccugcccuggcuucccaaaguucugggauuacaggcaugauuuuuuauuaauuuauuugcagcugacaaaugguaauuguguauguuuauggagugcagugugauguuuuaaucuauguauacaucauagaaugauucagucaugcuaauuaacacauccaucgccucaccaccucaccguuuuuuguguguggggaaggcauuaaaaaucucuuagcaauuuugaaauaugcaacacauuacuauuuauuaauaaugcaauauaaauacacaauaauguauuaaugcaucacuaaaugcgaugcaaugcaaugcaaugcaauagaucacuaaaacuuacuccuccagucuaacugcaacuuauacccuuugaucaacaucuucuccuucucaaucccuccuccuccccugcagccuccaggaaccaccuuccugcucuuucuaugagaucaauuuuuuuuaguuuuaagcucccacaugugagaucauacuguaauugucuuucugugccagcuuauuuuacucaguauaauguccuccaguucugucccuguugucacacauuacagaauuucuuucuuuuagggcuguauaguauucuauuuguauacauaccacauuuucuuuauccauucauccauugugggacacuuaguuugcuuccauauuuuggcuauugugaauaaugcugaagugaacgugggagugcagauguucugaaaagacuuaaaugucagaccugaaaugguaaagaugcuccaagaaaacauaaggagaaagcuccauggcauuggucucgggaaugauuuuuuggacaggaccucaaaagcacaggcaacagaagccaaaauggacaaaugggaucguaucaaacuaaaaaauuugugcacagcaaaggaagcguucagcagaggaaagagacaaccuaaggaaugugagaaaacguuugcaaacaauacaucugauaaggagcuaauauccaaaauauauaaggaacucaaacaacucaacagcaagaaaacaacccaauuaaaaaugggcaaagacagcuacucgggaggcuaagaugugacgaucccuugagcccgggaggaggagguugcagugagcugacauugcaucacugcacuccacccugggcgacagaaggagaccgagacccugucucaaaauaaaaaauaaaaaugugcaaaggaucugaacauacauaucccaaaagaaaagacauacaaguggccaacagguauaugaauaaaaugcugaacaucacucaucaucagggaaaugcaaaucaaaaccaccauuagcuaucaccucacaccuguuagaguagcuauuaucuuuuuguuuguuuguuuguuuuuuguuuuuuguuuuguuuuugagagggagucucacucugucacccaagcuggagcgcaguguugugaucucagcucacugcaaccucugccuccuggguucaagggauucuccugccucagccucccgaguaacugaaauuacaggcacacgccaccaugcccagcuaacuuuuguauuuaguuucacuauguuggucaggcuggucuugaauuccugaccucaaaugaucugcccuccuuggccucccaaagugcugggauuacaggugugagacacugugcccagccuagaguagcuauuaucaaaaagacaaaugagguuuguugaaguucuaaccccugguaccugcaaauguggccuuacaugaaaauagggucuuugcaggugguaaucaaguuaagaugagaucaaacuuaauuaggguggguccuaaauccaaugacugcugucuuuauaagaggagaagcaggcugaccaacauggugaaaccccaucucuacuaaaaauacaaaaauuagcugggugcaguagugcacaccuguagucccagcuacucaggaggcugaggcaggagaauugcuuaaacccaggagguggagguugcagugagcagacgucaugccacugcacuccagccugggugacagagugagacuccaucuuacaagaaaaaaaaaaaagacaaaucauaacaagugcuggcaaggauguggggaaacggggauccauuuacaucauuuuaauaacacaggcucuauaugggugguauugaguucccagaguugccauuacaaaaugucacaaacccaguggcuuaaaacaacagaaauuucuucucucacaguucuagaggccagaaguccaaacugaaaucaaggugucagcagagccaccacguucccucagaagguuuuaggggagaaucuguuccaugguauuuucuuaguuucuggugcugccagcgauacuugguguuccucaguucauagaugcauaauuccagucucugccucuguugucauauggucuucuuucuguguuucuguaugcgauuucuuuuuuuuuuuuuuuuuucugagacaagucucacuccaucacccaggcuggagugcaauggcacgaucacagcucacuacaaccccaaccucacaggcucaugccguccucccaccucagccucccgaguagcugggauuacaggcgugugccaccaugcccggcuaauuuuuguauuuuuaguagauacgggguuucaccauguuggccaggcuggucucgaacuccugaccuuacgaucugcccaucucggccucccaaaguguugggauuacgggcacgagcccaccgcaccuggcccuaauuacuuuauuuuuuuguaaauuuuuuuuuguaaauuucauguagccugagcauacaguguuuauaauauauacaggaguguacaauaauauccuaggccuucacauucacucaccacucaacucacucccucaccaagagcaacuuccaguccugcaagcuccauucaugccaaguacccuaugcagcugaaccaccuuuucucuuuuauacuguguuuuuacuguaccuuuucuauguuuagauauguucagacacacaaauacuaugauguuacaguugccuacaguauuaaguacaguaacaugcugggcagguuuguagccgaggagcuacaaaccacguagccuggguguggaguaggcuacaacaucuagguuuauguaaguucacuuuaagaugcucacacaaggacaaaauugccuaacaaugcauuucucagaacacgucucccucauuaagccacacauggcuguauuacaauuuacauauaauuuuaagcguauauaaauugccagaaaucaccagaugaauccuuggcggugacauaccccuucccccaccauagaacauugcagacuggcccggacgcccaguaucucaugccuguaaugccagcacuuugggaggcugcagcgggcagaucacuugagguuaggaguucgagaccagccugaccaacauggcaaaacaccaucuuuacuaaaaauacaaaaauuauucggacgugguagugggcaccuguaguuccagcuacuugggaggcugaggcaggagagucacuugaacuugggaggcagagguugcaaugagccaagaucgugccacugcacuccagcccgggugacagaaugagacucuaucucaaaaaaaaaagaaaaaaaaaaaaaaaggaaaagaacauuucagacugguaccaguuacaccggcucuugaucccuugaauguggcugacccugaacuaggauguacuucauaauaacacguccggcugggaauacuuaguacaaaagaaagaguauaaaauaucuuuugaauccaccuugauauugauuccauguugaaaugguaauauuuuggauguauuggguugaauaaaacaucucaugaaagugauuuuuaaaaaucuagaaauugucugcaauuauaauuccagaccacagagaaaaacgagagacaggaauguauagaaaaagggaacgugggacaaagugaguaugaaauucaacuaacagaagugacagugccuagcaugggguccagcacuuaguagguguucaauuaauauucauuucccucucccuuaccagugaaggguaugccugucguggggaaugugucuucaggcugagugaucaggaaggacuuucucaauggcuggcacgugaaccuagucaugauuucagcucuugagguuguacuagaagauuuauauccaauaaucguaagguaccacuuagcaucacgcuaagauguauuaauucauuuaugccuuuggauggcccuuugagguaggaagugugguugucuccaguuuaccaagguggcuugcccaaggucaucugcugguuggugauuaagccagguuuucaguguggcuccagcaggagugggggcuggggaccuucuaccugcugugguuucucucucucucucucucucucucucucucucucucucgaucuguggaacauccccccugucccccaaggucccaagggucuuauuucuuuuggccaagcccuuuggagaccugcagaucuggacacaucuuugagaguuucaggaacuagggccagaaaugcugggcagggucaugaggagcugccacugggguugagaaggugauggacaugaggggaagggucuuugcagaaaggagaggcgucccuguaagcaggucacagccacugggccuggccaacugcagccgaguggaaugugccccugccccaugaccauaugccccaggugugcaauguggcggcccagagcacacacucugaaccaucuugacacaucuucacugguuacuagaccccccucagccuguuuccuuggcuguaaaauggggaugacgcuggucccuacuuccuagggcucugagcaggaguaaguagcuugucguauaaaacauguucccugcagugccuggugccugcuaaauguuccauaaacgucagcuguuauuuucauucaggggaagcugaaauccauauuuucauggaaaaucucccaguuuuuaaauguggaccaauaauuucagcuuucacaaacccaguaugagucgguauggccccuagggugccaacucaaaaucucuguugagaauuuugcugauaggaaguggccuccuuggagguguuugcuguguccugugucuggcaaguggggugguuuugauaaacgugcuggauggauguaugggugaauggauaaauggaggaaugaauggagaaacaaaugagcaaaugaauaaugaauggauggaugaauggaugagcgaauggauggaugaauggaugagcaaaugaaugauguacacacaaaggaauggauaaaugaugaaugugcuaaugaauuuaagaaugaugaaagaaugaaugaauaaaugaacaaauggauggaugaaagaaugaaugaauguacuaaugaaugaaucaaucaaugaagaaccauuuaaaaaugaaugcaacugaggguuuauaagaaaagguaucuuaagccugggcaugguaauucaugcuggaaucccaaugcuuagggacgcugaggcgggaggaucgcuugaacccaggaguucaagaccagccugggcaacacagggagaccucauugcuaccaaaaacaaaauuguuuuaauuaagcgggcauggugguacgugccuguagucauagcuacuugggaggcugaggugggaggaucgcuugaacccaggaguucaaggcugcagugagcuaggaucaagccacugcauuccagccugggcaacaaagcaagauccugucucaaaaaaaaaaaaaaaagauguauuuuagaagguaaauucaaucuguccaaaacugagcucugaccuuccccuaaaccugugcccauucaguggaugagagcuccaucccuuaagggguucaccaauucauccauuccuuuguauguacaucauucauucaccuuggcucaucccucucucuuacauccacaccguuccaucagcaaauguugaaucugucuuaaaugauucaucccaaauccuccccgcuuaacuaccacccaacuccagcccccauccaucaucaucaucacuugccuggauggguucagucaccuccagccuggucucccagcucccguccucaccucucacugucuacucucccacucggcagccagagggugccugugaacacccaaaucagguuccaucccuccucuacucagaacccuccacggcuccccccucacucaggguaaaagccaaaguccuccuugugguccaccaggccaugcaugaucugccugucaccucccugccuucaccaccuuccucuuuuccccucaaccacuccacuccagccacacugacuuccuugugcucuuccccaaaaaugucgggcagacacauucaugcuucaggaccuuaaauuugcuguuuccucuaccuaagauacuaaagugacaagucaacacacucaccuugaccaugcaauuuaauguugcagccuacccuguggacucuccaagggcucccagucccucugugaugcuuuacuuuuucucuuaaaaaaaaaauuguuauuuaaaagaacuugucucgcuguguugcccaggcuggugucaaacuccuggccucauacaguccucccauuccagcuucccaaaguacugggauuagaggcaugugccacugcacccaucccaacuuuuuuuuucccauagcacuuuucauuuuccaucccacuguuaauuuacuuauuacguccacugucugucuccuccccuuagagggucagaccccggaaguccaggcucuguugccuaauguauccugagccccuggaacagagccuggcacaaaauagguacucaauaaaugcauaagagcaaaacuauauguaggcagaggacacacccagcuuauuccucagugaucacuucuaaaguuaaauguccauggaaaacagucucauccacaucucuuucuggaggccuuccaagcgugcuccaugcagcucuguugccugccccugcaucagggaauggaggcucugcuuuauccugcccuguggugugacucccagaggcaucagauguggcugggagugggagacauggaaaauuggcuccugcaacagagaacuaucagccuucccaucaauugguuacuucuaauucuguuauuuuucaggggcacugucuucucauaagcuccaucuaugcaaaacuaagcccaugggucaugaugguucccucaggccagaggcuugcuggagagacuaauggauccccuggcuaaaaucugugcuugggcugcacauugguuaauuucuucugaaggaacagccugagccugacauucuccaucuuuucccuggcagguucucccuucgcccgagccagcauuaaaagugccaagcuggagaacucgaccuuuuuucacaaaaaggagaggaggaugcguuucuacauccgccgcauggucaaaacucaggccuucuacuggacuguacucaguuugguagcucucaacacgcuguguguugcuauuguucacuacaaccagcccgaguggcucuccgacuuccuuugugaguaucacccagccccaccccugccaacucccugaucccucccucacacccuuuuuccacuucucuuucucugguaguauguguaucuucuuugguccucauugaaucugcccuuuccuuuagccauuucuauaacugucacuggggccaauguuacuguugcuaugacaauggaacccaucucccuuagaccugagagcuggaagcuggaauucagaccaacaaaugcuccugugauuccuuucuaagagagagggacagaggggugcuggugaaggggauguuggaagagagacagagaaagacggagcucauaagauagacagauagaaacagaaacauacauguauuaauaauuuuuauguacaucucuggaaauguucauaacuuaugguuaagagaggaugccuuagaaauaaggaguggcuuauauguugcccucauuuucucuacuuauuucugacucuacuucucucuucuuucaaaccuucugcuucuuuccuguuagguuggugcaaaauuaauugcguuuuuugccuuuuuuuuuuuuuuuuuuaaccacaguuacuuuugcaccaaccuaauacuuccuccccugcccuuuuuggcuuccuuauucauucauagaacauccccuccaguaucugcgagagcguuuugcucccucaagguacaaggcccacuaaggcuuugcccucugggccuauucccagauucuaugugaguuagcaugagauaguaucaaaauugagggccaagugagggugaggaaaagcagcaaaagauggggagaugucugagcaggauuuaaaaaguaaagagcucgaggaaucaacaagagcagcgacuggggccaggcaugguggcucacaccuguaaucccagcauuuugggaggcugagguggguggaucacuugaggccaggaguucaagaccagccuggccaauauggugaaacccugucuuuacaaaaaauacaaaaauuagccagaugugauggugcacaccuguaaucccagcuacucaggaggcugaggcacuagaacugcuugaauccaggaggcagagguugcagugagccaagaucaugccacugcacuccagccugagcaacagagagagugucugucucaaaaaauaaaguaaaauaaaauaaaauaaaauaaagaguagugauugggcagugaggggggcagguggaugcccuggcuuuggcucacaggccccaaguaaggacuucucaaaacgucuuuugccuacuggcugucuaauuuauucacugaccuucugaccugguucagaauugacuuaggacagcaagaagagacagucuagucuuugaccuagaaaggcccgugagccuaguccaggccauugucuucuuauaacccuccuuguucccagucacguuggcugaccccccaggacaccccucaggaaccaguucuccuucccagggcccugaccuaguuucaaacuuaguaauuguuuuuagucccucuggagucucuuauaaaugaggacucuacuucguguuuuaacuuccucuaauacucuauuuuuaaucuccuauauucucucuacuaaucaucuuguacagucuguccugguucaggaacaagggacugagacuuccugccuggguccucagugucuauaaagguccuuuacucauucccacuuucccuuugagaaaacugagacacagagagguuaaguagauugcccaggaucacacauuagcuuggcaugauggcgggcgccuguaaucccagcuacuugggaggcugaggcaggagaaucgcuugaaccugggaggcagagguugcagugagcccagaucaugccacugcacucuagccugggcaacagagcuagacgccaucucaaaaaaaaaaaaaaaaaaaaaaagauacacauuaauuucagagaugucaaaauauaaacaaaaauguauaucuuggcaucagugaaguguaguuguuucucuggaucucagacuccacaucuaugugguagaaaccggauuugaugguccugaaaguucuuccagaugcaacaaugcuaaggauaaguaauucuuucaagucuugugcaucaccugcuaucauguuuccaugguaacugaggaacaagaucucagaaacucuucaguccucccagaguuacuucuggugggucuaggaaugugucagauguuacaaacagacuuccucugcugauauuuugguccuaggaacccuagaguuccccucagacacuaagaucuccuuagcguccuauaaauaaggagaaauuuuggugauaaauacugugaaggacuuugacggucaguucaaaacaccucuuaaaagcaugacauagcaaacacccuuggcaaauaucuuaguucauuuguacugcuauaacaaauuacccgagacuggguaauuugauaagaacagaaauuuauuuucucacaguucuggaggcugggaagcccaagaucaaggcauuggcagguuucccugucuggcgaaagcuacucucugcuuccaagauugcaccuugaacacuguauccucuggaagggaggaacacuggguccuuacauggcagaagguggaggagcaagagggacaaacuuccucugucaaccucuuuuauaagggcaccuaaucccauucaugagagcucuaccguaaugacuuaaucaccuccugaaggccccaccucuuaauacuguuacauuggcaauuaaguuucaacgugaauuuuggaggggacacaaacauuuaaaccaucacaaccaccaaacacaauuagcuuuguggccuuaauuagcuauaugaaauucauggaaguuaguuucaguccucugucucuuuccuuucuguaugcuuucugcuccucagaaacccuccucaucucuccuuucuauccauuaaguacccacgcccuuccuaacuccucaucuuccuacccuaccaagaaagcccucucagaaaaggaucugaugucagccauuuauuugcuggagcaaaugcauauccauguuuuaccccucccugaggcauuugcaauuuuaugcuugcucaucaaagaacaaaaggcuuugucuuacucaagacuuuuuaggucacucacaacacaggauuucuaggggacauaagacaaguuuucugaguuaggagaaaagccauaccuuagguggguugccugugucgcuccaacuaaguacuuaacuucaggauuacaaauaggauaucauuaugauuucuauuuccuuuuauccuuuggagcucagucacguagaaguagauuaaauauaauuguuagaucacagcacccuggcauuauggggccguuaugguccauuguuauuaugugaauuauucaguuaauuaguuuauuuuuuaaaugugauaaacacccaggaacccaccagucaacacaaaaguccuuggcaauaaucuauauccgauccuucucaucgaaccagggcaaaaacuacaagauggagacccacugauauuuuucucauuccuuuuaaaaucggccuaagguugguuagcuuguugguuggaggguagggcauaauuguugcuuuuuuuuuuuuuuuuuuuuuuuagacaaggucuugcucugucacccaggcuacaguaggguggcccaaucuuggcucacugcaaccuccaccucccagguuuaagugauucucaugccucagccucccaaguagcuggguuuacaggcaugugucaccacacuggcuaauuuuuguauuuuuaguagaggcgggguuugccauguuagccaggcuggucucaaacuccugaccucaguugaucugaccgccuaggccucccaaagugcugggauuacagacgugagccaccaugcccagccagcucuuccuuuuuaacagaggggaaacugaggcccaugggaaggacaccuuggacagggcguggccacagugggucauguauauaaucccagcacuuugggaggcugugcugggaggaucacuugaggccaggaguucaagaccagccagggcaacauagugagacccccaucuccacauaaaaauuuuaaaaagaaaaaagauaagucagaaguuggguguggugacacaugccuguaguucuagcauguuggaggccaaaucagggaaacuguuugaggccaggaguuugaaaccagccuaacagcauagcaagaccucaucucuacaaaaaauaaaaaguuuaaaaaugauaauaaaaggaaagucagagccaccuggaaccccuacccucagcaagccuaaccuccucucuguuuccuccuucucccuucuagacuaugcagaauucauuuucuuaggacucuuuauguccgaaauguuuauaaaaauguacgggcuugggacgcggccuuacuuccacucuuccuucaacugcuuugacugugggguaagugcucuuguuucuaagaguucauuucuccagcucuugccuggaaugacagauaccuggacacauuaaagggagaaagguaaagucaccccugaauaugagagacucagauggaugcagaaggaaugagaaaacaaucccaaacacuggcaaggauacaguguacccagaacccucaaccaccgccagugggaggaaaacguauagacccccuuuggaaagcuaagugggggacauaagacaaguuuuccaaguugggagaaaagccaugccuuagguggguugccugugucgcuccaacuaaguacccaacuucaggauuacaaacaggacaucaauaugauuucuauuucuucuuuuccuuuguagcucagucauguggagguagaugaaguauaauuguuagauuacaacacccuggcauuauggagccauuaugguccuuuguuauuuugugaauuacucaguuaauuaauuuauuuuuuaaaugugauuaacacccaguaacccacuaguccacacaaaaccuaaguccuggagaauaaucuacguccaauccuucucaucgaaccagggcaaaaacuacaagauggagauaugacccagcauuccauugcuaggaauucauccuagaaaaucucacccagauaccuaggagacacaggccagaaugucccugcagcuggaagugaaauuaagguuguucgcaaauaaguggagaaugccuggcccagggcagcccuaaucauuuaccauaguccuguuggucucagaaaggcuuaauaauuuauuuauuuuuuuuuauuuuuuguuuuuauuuuuuguuuuugagauggagucucguucugucacccaggcuggagugcgguggcgccaucucggcucacugcaagcuccgccucccagguucacuccauucuccugccucagccucccgaguagcugggacuacaggugcccgccaucauaccuggcuaauuuuuuguauuuuuaguagagaugggguuucaccguguuagccaggauggucuugaucuccugaccucgugauccacccgccuuggccucccaaagugcugggauuacaggcgugagccaccacacccagccagcuuaauaauuuauaauaacugaauguuguacuguuuucugccauuauagaaaauuauguuguuggagaaaacaaaauacauacaaacaagcaaaccuucccuacauaaaugacccaaguaguuaaagaauaaaaccaauuucuuuccauuaaaaagaaaagaaagccgggugugaugccucaugccuauagccucagcuauucaggaggcugaggcagcagaauugcuugagcccaggaguugaaaaccagcccaggcaacauagcaagacccugucucuacaaaaauuaauaauaauuagccaggugugguggugcacaccuguagccccagcuacucagaaggcuaaggugggaggauugcuugagcccagcaguuugaggcugcagugagcuaugaucacaccacugcccuccagccuggacaagagagugagaccccaucucuaagaaauaaaaguaggccaggcacaguggcucacaccuauaaucccagcacuuugagaggcggaggcagguggaucaccugaagucaggaguucaagaccagccuggccaacauggcgaaaccccgucuauacuaaaaaaauacaaaaauuagccaggcgucguggcacaugccuguaaucccagcuacuugggaggcugaggaaggagaaucacuugaacuggggaggcagagguugcaguaagcugagauugcaccacugcacuccagccugggugacagaaugagacuccgucucaaaaaaaaaaaaagaaaaauuuuaaaauguccugagcaaccuuguuuguaauaguuccaagucucaauauccguguaucccuuugcuguagaacagauaaauauuuuguggcauaucuauauaaugaaauacucugugacaaucaaaguccaccaacagcagccacaugcccaacaacaggaaugaaucucacccauguaacauggcacagaaggaggcaggagcuagcaacguaaguccauacaguucaugcaaaguucaaguggacaaaauuaaacucucucucucucucuacauauauauauauauauauauauauuuuuuuuuuuuuuuuuuuuuuuuuuuuuuuuuuuugagacagagucucacucuauugcccaggcuggagugcaguggcgcaaucuuggcucacuacaaccuccaccucccggguucaagccauucucccgccucagccucccaaguagcugggauuagaggcaugcaccaccacccccggcuaauuuuguauuuuuuguagagaccgggauucagcaauuugcccaggcuggucucgaaauccugaucucaggugauccaccugcccuggccucccaaagugcugggauuacaagcgugagccaccacgccccgccuuaaacuguauuuuuuaaggaugauacuugaauacguuaaaaaggcgaggaccuugaaaacacaacgcucgguaaaagaaaccaaacacaaaaggucaaguauugcauaauuccauuuguaugaaauguccagagcaggcaaauccauagagacagaaaguagauuagugguugcuagggucugggugagggagaguggggaguaacugcucauggggacagggccuccuuugggggugaugaaaauguuuuggaacuugauagaggugauaguugcagaauauugugcauguaccuaaaggcacugaauuguguaauucaaagugugaauuuuauguuaugugaauuucaccucaguuuuuuuuaagguaagaaaaugguuauuacaaaauucaggaugguaguuauaucacagugucucuggaaacuuccaggguauccacaugucccuuuuuauuuuauuuuauuuuuuauuuuauuugagauagggucuugcucuguugcccaggcuagagugcaguggcaggaucaugacccucuccugucucaaauuccuaggcucaagcuauccucccuccucagccuccuaaguagcugggacuauaggcacaugccaccaugcuugacuaauuuuuuuuuuuuuuguaaagucaggguuucccuguguuacccaggcuggucuugaacuccugggcucaagugaucugcccaccucggccucccaaaguuccagaauuacaggcaugagccacugcccuagccuucuccuaauuguugacauagguaguaguugcaugacauucacuuuguaauuauguguuucaggaauucucaggccugugggagcucuuaauaaauaaaaaagaggccaggugugguggcucacgccuguaaucccagcacuuugggaggccgaggcaggcggaucacgaggucaggaguucgagacuagccuggccaacacagugaaaccccgucucuacuaaaaauacaaaaaauuagccgggcgugguggcgggugccuguaaucccaguuacuugggaggcugaggcaggagaaucgcuugaaccugggaggcggagguugcaguaagcugagaucgcgccacugcacaccagccugggugauaagagcaagacuccaucucaaaauaaaugaauaaauaaaaauaaauaaauaaauaagaggccgggugcaguggcucaaugcuuuggaaaguggaggccaacaguuggagagaccaaagcaggaggauggcuucagcccagaaguuugaggccagccugggcaauacuagcgagacacuaucucuauaaaaauguuuuaaaauuagccagaugugguggggcacaccuguaaucccagcuacucaagaggcugaggugggaggaucacuuaagcccaggaggacagugcugcagugagcuaugauugcgccacugcacuccagccugggugacacagugagacccggucucuauagauaaaugaauggaugaaugagggggucaaggauccucacccggcuuccauuuggagggaggaguuugguugaguucuugcaagguugguaccuaggaaaugcuugccaguucuggagcccagacacugucccuggacaugagaccagguucucugcccuagguuaucauugggagcaucuucgaggucaucugggcugucauaaaaccuggcacauccuuuggaaucagcguguuacgagcccucagguuauugcguauuuucaaagucacaaaguaagucuuugggguuccuggacauuuguacaggggguggggaugggggacaugguggggccgccuccagaaaguugggaaagugagccucguguuucgagggcugacuccggggcccugccucccccgccuggccugaguccucgccuggccucugucggcagguacugggcaucucucagaaaccuggucgucucucuccucaacuccaugaaguccaucaucagccuguuguuucuccuuuuccuguucauugucgucuucgcccuuuugggaaugcaacucuucggcggccaguaaguccuucacaggaauuccaacuccugguucccuggggucaggcucagggaacacacaguccccuccaccgugcaggcugccuuccucguagcccagacacccauugcggucacccaaaugggcagggcccuggguaccacucaggguuuccuggggacagagaugauggagacguucguuuccuuggagaugagauacugagccacacccucagagcaccccggguggggccaacgugaaaugucuguguccucccugcagguuuaauuucgaugaagggacuccucccaccaacuucgauacuuuuccagcagcaauaaugacgguguuucagguacagccuccaccuggccccacgggccaacaccucucagugucacagaugaaagugccugcuccacauccaaggggcuucccugaacuccuccuucucuaccuggccuuuucacaccacuuugaaacacagauuuuaugguuaucauuauucaauuauggugaggccaacagaucaggagaugaaugucauuggaaagauaguuuguggcugggcacgguggcucacacccauaaucccagcacuuuggccagguacgguggcucacaccuguaaucccaacgcuuugggaagcccaggugggcggaucacuugagaucaggaauucgagaccagccuggccaacauggugaaaccccaucucuacuaaaaauacaaaaauuagccgggcgugguagcacaugccuguaaucccagcuacucgggagaugaggcacaagaauugcuugaaccugggaggcagagguugcagugagccaagaucgcgccacugcacuccagccugggcaacagagugagacuccaucucaaaaaagaaaaagaaaaaaaaaaccacuuugggaggucaagaugggaggacuacuugaggccaggaguuugagacaagucugggcaacauagugagacuccgucucugcaaaaaaauaauaauaauaauuagcugggcauggugauacauaccuccuagcuacuagggcagcugaaguggaaggauugcuugagcccaggagguugaggcugcaguaagcuacaaucacaccacuauacuccagccugggcgagagagcaaagcccugucucaaaaacgaaaagaaaguuuguuauacucacagauccucagagaaggagcacaccaugcaggaccaagcagagaagcaacagggucaagcaggaagagaaggaaaaugugggcaagaggcuugauugugguuuccaugggacggaaugggugaggcagaguaaacagcucgagacuggcuaguuuggaucauuucagugggcucuggggcagaggagcuguuccuacuugucuaggaccuggccuuggggugauuagggcagguggauagugcugggaagauaaaggaggugguugggauaugggcugguugggauauuguuugguuugcuuuuaaaaagccugcucagggcuaaauuguuuacuaccucuagggacuggcuagugcuggaccgggcagucccuccagagucagcaagaccccagaugcaucagaauaaagaaaauaaaaugcguggccaggccaaugaggugguucaugccuguaaucucagcacuuugggagaccaaggcgggaggauugcuugagcccaggaguucaaggcugccgugagcuccagccugcaccacagagcaaggcccugucucuuaaaaaaaaggcagagaaaaaaaauggcuaauacacccaucaaaucugaagauaccuuggucucauauuccagggugaucaacccaaagcaacuucugcacccaugugggcgcauucccugaggcuugggacuggcccagccgggaccuucagagcaucuuugguggauucuuucucuuugagggacugagaguguauagaaaaugugacuucacucucuccuucuccuggggagguaguuucuaaaugagaccccaagacagggaguugaagaggaaaccuuccaugaagggaaguucugagcccccacauaagcgauuuuuuuuuuuuuuuugagauggagucucgcucuguugcccaggcuggagugcgacggcacguucuuggcucacuacaaccucugccuccuggguucaagcgauucuccugccucagccucccgaguagcugagacuacaggugcauacuaccaugccuggcuaauuuuuguauuuuuaguagagacaggguuucacuauguuggccaggcuggucucgaacuccuggccucgugaucugccugccucggccucccaaagugcugggauuacaggcaugagccaccacaccuggcccauaagcgauuauuaauagcacugaucgcuagucauguaucuuuagcucagagguucucacccaaggacaagucuguccuccaaggacauguagcaaugucugcaagcauuguugguugucacagcuagggagagggugcuacuggcaucugguggguggagacuaggaaugcugcucaauauccuacaaugcacaggacagccccaaauagaauaaucuggccccaaauaucagcagugcugaggcuuagaaacccuguuuuagcagauucauguuuuuggaguucuuuaacauuuacuuuauccucauggggauauggauagaaggaaggaaguuggaucuuuuuuaaaggagcauguaggugcuguuugaauauccccuugguucuuucaguaugcaucagcacaacuugcgucugucaacaccuaauccuuugccuuggucuuucucugguccccugcucugcccccaaggaacugcaguccagcaguacugugaauuuuuugugccacaccuuaaaaggagcagccguugguggauaaauaccccagcucccucacccucaggugggaugaccccuagagcuccccagcaagaccaagccccgguuaccuacaguggaaacucgcuugaucacauacuguuuacguuccacccucuuuucccuuuucucacuucuccucuccccuacuggugcuuccugagaucaccucccagacaaaccacuugcacccgaacccuuguuccagggucugccucaggcagggggaccccaaacguguccuugugcuacauuugugcuauccacguaguagcuuguuuaaucaucaccaugaccacaugaggaacacagguaaauauuaaaauccugucuuagucugcucaggcagccauaacaaaauaccacacacuggguggcuuauacaggaaacauuuauucucucauaguucuggaggccgggaaguccaagaucaaaguguuagcaggguuaguuaguuccuggugagggcccucuuccuagcuugcagauagccaccuucuugcuguguccucauaugucaaagagagagagagagaguugugauguuucuuccuguucuuuuuuuuuuuuuuuuuuugagacaaaaaucucaaaaaaaaaucuauuuuuuuuuuaggcaaaucacauuuuuuugucacccagccuggagugcaguggcacaaucauagcucacugcagccucaaacuccuagguucaaacgauccucccaccucagccccuugaguagcugggacuacagaugggcaccagcuaauuuuuuuaaauuuuuuguaaagauggggucuugcuauauugcccaggcuaaucuugaacuccugggcucaagugauccucccaccuuggccucccaaagugcugggauuacaggcaugagccauggcaugcggucucuuccuguucuuauaagggcacuaauaccaucaugaagucccccaugaccucaucuaacccuaguuaccucuuaaaggccccaucuccaaauaccaucccaucauagguuagggcuucaacucaugaauuuggaggcgggcacaauuuaguccauaacaaauccccuuaaucacaucaaguaagacagaguuacaggagggucugugacuccuccagggucccauuuuccuagaagccaggcuaagagccccacgacgcaggaacggcccuuucuacucgcaaacaaagagaaaagccaaggagaagccaacacggagucuggcucugcaaaccgggcaggauuguuaaagaccuccugggcucggggauggggugggcggauuccggcuccacagcugcaucuccaaggggcccguggcugagagggggguuggcuguguguuucuuccuccccuuucagauccugacgggcgaagacuggaacgaggucauguacgacgggaucaagucucaggggggcgugcagggcggcaugguguucuccaucuauuucauuguacugacgcucuuugggaacuguauccuucauggagagagagaaggggacaggccuggaccucuggcagaggagagguugcaggggcucaagggaggguacugagagacccagauacccagggcccaaguggugucccaccagugguugcuuuuccugacucagacauuugcagacacccuccugaauguguucuuggccaucgcuguggacaaucuggccaacgcccaggagcucaccaagguggaggcggugggagaauguuucucuggcaaaguuaccaccugcccauggcagaucaggacgggggugggggugggggugggggugggggugggggcaugggaacaggguuagaacuuuugccggggaugcaccaugcaaagagaaggcgccucuccccccacucccagaaacagacugucccucaucaagcaaauucuacagccaagagggugggaagggggaaggcagugaggucgcugcaggaaacggauggcaaacucaaccaaaaggccguuuacagggaguaagcaggguuuccaaggaaugguguagcccccaggcuaguggaugggagagggagugcuguuauggggacccagucagagcuggggccaaggaaaaagggcugccaccagcccugggaccuuagagaacccagaaccauggcaaggcacagauggaguggccaauaaauguccccaccuucucucuuccucuggcuucccgcuggagccuccccuuagccaaacgcagcauguuaagagcuagccuccguccagccuaagccucuccccaaggacccuauuaaguuaagauuacauguaacagguacagggucuuccucucagcccuggggucucccucagcauugcagccccaccuccagugccucgagguauucaggacauguuugugaaauugaaccaaaccaagcagacguugccaacgcuccaucugccggcccuggcaggagggagagagaguuucccggccccagcucccaguggagggaagcggaagucucugccaucccaagcacacggccacaagccuggccacuguggagcuggcuggcauggcugagccgagggcugauccagccaugagcucauccaaguuccaagaguccauccuuaggggcuggugcaggaggguagcagaaggggagggagaaaggccaguucguuuaucuccugggagguguggacauuccucuccagauccacauucuuucuuucauugauccuacaagcauuucuuggucauuuaauacguguuuuuaauccuauucaguccucauggaaaccuuaggagccaaguucucugagccccauuuuacagauuucaucauucaguaagcacuuaaugagcaccuacugugugaccaaggcccuggucuaggacuuagggauuaagcagugaacaaaaaaaggcaaaaaucccugccuccguggagcagggauucaagaggggagacagacaagaaacaagauaaauuuguaaacauacguagcuugucaguuggugauaaacacaacagagaaaaauucaguagggaaagucagggagaguuggaauuuuagaugagaugugugucgcacagagagguugagagacuugcccaaggccacacagcaguaaguuguggagcugggauuugaacccaggccgucugggucugcagcuugugcucuuaacugcuguguaccaguugcuugaauuugggcauguuuuaugcucacuugggaaccugugggaaaugcagauuccagggcccagcacugguucuauagauuauuuggggagccugaggaucugcauuuuagguguuucugaggcagaugguccagagaccuagcucugaaaaaugcugggaauggugccaggagggguggggguggcccuaugagagcaggguggccagccagaucccaucuccauguugucucugacaguguccugaucugaccauuuccaaggugguaagguugcuccccguuccagugauucggagcacagcgggagagcugccugcaauggcaugacuuuucuuaugggcggguucauuucuggccauuucuuucucguugccuuuucuuugcuuuuucuuuguuggcuuuucuguuuuacgaaugaggcccugcaugaaggcugaagaaggauuuaaaguccaaaaacgucuuuuucuguauguauuuuuaaaaccucuucccccauucuccuccucucugaaccuaaccaccagugagcagcagcacccugggcaguuggcuguagcccaagugcccugcucuccucuccccaccgccuuccugucaugggggcugggaauauaaauuccucuccucauucuccuucugggggcuguugacagugcauggcaggggccaucggaugccaggcucuucugugugugaggguaguugguguuuuuugaaaguugguucagagaguucacauggcucagaaagccuagugagaggaaaaucuuugcacugcuuuccagcucauuaagacaggaugcaggggccaggcaugguggcacaugccuggaaucccagcacuuugggaggccgaaaugggaggaucauuugaggccagaaguucaagaccagccugggcaacauagugagacccugucucuacaaaaaaaaaaaaaaaauuaaauguauacaggcauaguggcaugcaccuguagucccaguugcuugggaggcugaggugggaggauugcuugagcccaggaguucaagguuacagugagcuaugauugugccacugcacuccaggcugggcaaccaagggagacucugucucugaaaacaaacaaaagaaaaaaaaauaggcugcaggaaagucuucauuguaggaagagaagggacauuuuuauuuuuuguuaucuggcuguguguuaaaauaggcuucauaaugaguuagaugucaaacuuauacacagaggggauagcaauacacuuaaccaauagcagguacccauuccaauuggggagccuugguucugauuggucgaaauauuucaaauguugccccuggucagcaacagggucagaagugaguccccaaggccuaguucauguuuugugaacaaagauuccacgugccuuuuaggacgagcaagaggaagaagaagcagcgaaccagaaacuugcccuacagaaagccaaggagguggcagaagugaguccucuguccgcggccaacaugucuauagcuguguaagugccccuaaucccugggaugcuacccuggcuccugaacguccacacuaucccaggcacagauuugggaagcagugggggugguccuugacagaacugagcuuuaggaagagacacuucuuguccuuccacccacuuucacucaauaaauauuugguuagcagcuguuauguacccagcacuguucuaacuucuggggauacagcauuaacaaggaggaaaaaaaaaaucccaccuguguguagccauucuagcaagggaaggagucaauaaauuagauaaauaaguaaauuauauauuguguuagaaggcgauggaacuacagagaaaguaggggagggaaauagcaaaugcugggagugaagagaguugugauuuuaaacgaaguugucagggaaggcaucaccuagaauagggguccccagucccggggcuguggacugguaccaggccgaggccuauuaggaacggggcugcacagcaggaggugaacagugagcaagcaagcauuaccgccugagcuccaccugccgucagaucagcaggcagcauuagauucucauaggaacacaaacacuauugugaacggugcaucugagggaucuagguugcgugcuccuuuuaagaaucgaaugccugaugaucucaggugaaacaguuucaucccaaaaccaccccccacaccuaggucuguggaaaaacugucuuccacaaaacuggccccuggugccaaaaagguuggggacugcucaccuagaagguuacauggccugaaggaggugagggaggagccacuggggggccuggggaagggcaucccaggcagagggaacagcauaggcaauggcccugaggcaggaacaugccugaugugaaggaggccugugugacuagaaucgaauaguaagugugaggaggugaaggcaaggaggugacaagcagauuacacagggccuucugggucaggggggaggacuugggcuuuugccccuagccaggugggagccauggaggguucuugagcagaggaggcugggaccugacucagaugcucacagacuccuagcauucaguggggaguagaggguggagagcaggagugggaggcugagauguggguugguucgccugggucauccauccaagcuacagugccuagcaaugcucuaaguccugugaccaugccacugcaggaaagagcaacagaagaaucaaaagccagccaaguccgugugggagcagcggaccagugagaugcgaaagcagaacuugcuggccagccgggaggcccuguauaacgaaauggacccggacgagcgcuggaaggcugccuacacgcggcaccugcggccagacaugaagacgcacuuggaccggccgcuggugguggacccgcaggagaaccgcaacaacaacaccaacaagagccgggcggccgagcccaccguggaccagcgccucggccagcagcgcgccgaggacuuccucaggaaacaggcccgcuaccacgaucgggcccgggaccccagcggcucggcgggccuggacgcacggaggcccugggcgggaagccaggaggccgagcugagccgggagggacccuacggccgcgagucggaccaccacgcccgggagggcagccuggagcaacccggguucugggagggcgaggccgagcgaggcaaggccggggacccccaccggaggcacgugcaccggcaggggggcagcagggagagccgcagcggguccccgcgcacgggcgcggacggggagcaucgacgucaucgcgcgcaccgcaggcccggggaggaggguccggaggacaaggcggagcggagggcgcggcaccgcgagggcagccggccggcccggggcggcgagggcgagggcgagggccccgacgggggcgagcgcaggagaaggcaccggcauggcgcuccagccacguacgagggggacgcgcggagggaggacaaggagcggaggcaucggaggaggaaguaaguggaggugaccucgaauccgcagaaugacgguaacauuaauaaugacaacagccaaaguagcacgugcuguguauuuguuuauaaaaauauauuauaaaaugcuguauuuggccaggcgcaguggcucacgccuguaaucccagcacuuugggaggccgaggcggauggaucacgaggucaggaguucaagaccagccuggccaagauggugaaaccccaccucuaauaaaaauacaaaaauuagccgggcacgguggcaggcgccuguagccccagcuacucaggaggcugaggcaggagaaucgccugaaaacagggggcggagguugcaaugagccgagaucacaccaccgcacuccagccugggcgacagagugagacucugucucaaaaaaaaaaaaaaagugcuguauuuggccaggagcaguggcucaugccuguaaucccagcacuuugagaggccgaggcgggcggaucacuugaggucaggaguuggagaacaggcuggccaacauagugaaaccccgucucuacuaaaaauacaaaaauuagugguggugcccaccuguauucccacuacucaggaggcugaggcgggagaaucaguugaaccugggagguggagguagguugcagugagcugagaucgugccaucacacuccagccugggcaacagagcaagacucugucucaaaaaaaaaaaaaugcuguauguuuuuguuuuuuugacacagggucucgccuguugcccaggcuggagugcaguggcagucauagcucagugcagccucuaccucccgggcucaagccauccgccucagccucacaaguagcugggaccacagacaugugccacaugccuggcuaauuuuuguagagacaguguuuuguagagacaggguuucacuguguuucccaggcuggucucaaacuccugaacucaagcauuccgccugccuuagccucccuaaagugcugggacuacaggguugagccaccacacucagccuaauuuuuuuaccuuuaguagaaaugaggccuggcucuguugcccaggcugguccccaacuccuggccucaagcaaucaucccaccucagucucccaaaguguucggauuagaggcuucacagauggggaaacugagagauugagugagcuccucaaggucauuccucuaaccaguguccuugaacccaggcucucuggcaccagaggccuugagcauuucagggaaacuauuaagagaagccccacugucguccagaauuauauagucuucuguguucuugcugugugacuuuugcaaagugacuucauaucucugggccucacacaauggaaauagugggaucuaauugggucauugccaggauugaaugagguaauguaugcaaagggccuggaagagcagcugacacauaauaagugcucgguaaauuuagagcauuuuuggccauuuucagccaacucuauuuaccuaaugcuauucuuuggaaguuugaaaagccacucuguugggaggccaaggugggaggaucacuugauaccaggaguuggagaccagucugggcaauagaggcagaccccaucucuauaaaauauaaaaaauuaaacagaugugguggcaugcaccugcagucccaacuacuugggaggcugaggcaggagggucacuggagcccaggaugucuaggcuaugaugagcuaugauugcaccacugcacuucagccugggcgacagagcaaggcuuugucucaaaaaauaaaauaaaaaauaaagaaaaagaaaaggcacuuugggccguuagaauugaagggagagcagaguuucaaagcuuuggaugcagcgggaugugguggcucaugccuguagucccagcacuuugggaggccaaggugggaggauccacuugagccccggaguucaagaccagccugcgcaacauagugagaccucaccuuuuaaaaauaaauaaaaauguuagaaagcuuuugaggcaucuuccaggccagcaacuuauccauucagaaccagcauccucuuuuucauaacgacauuuuguaauacuuucuagcagaugcuauagugauucugcauauagggacucaacaacuuacccauuaaaauagacaucguagacauuguccuauuacaaauuaaccugcucuuaguccucuuuuauauuaccaucagggcauaauauugauuuuuuuaaugauggguuuaagugauccuguuguaugacauaugagguaggccagcacuucucaaaaucuaauguguaugugaauccccagggaucuuguuaaaacacaaauuguaauuccguagggcuaaggacucaguggagccugagauucugcauuugcaacgagcucccagaugaggcugauacuacugguccagggaccacauuuugaguaaugagacucuggaggacauagugaaguaauucugauauguacaccauacacaaaaucaccaugaagugacaggcacaaaugauggcuaacucuggguuguguggacaauucaaaccacaugaggggaguugccagcagugucaagauguuccacaauguugaacaccucuuggcaaaguuccauauacaaaagagucuagucuuucuuccauuuauuuaauaguugcauugcaggaaaaugcaauguauauuaaaaacauacaaaaaauauguuguguucuuauguaaaagaguuagguuuaaacuaaaagcacaggaucaggugcaguggcucccaccuguaaucccagugcauugggaggcugaggaaggagaaucgcuugaggccaggaguucgagaccaaccugggcgacauaaggagaccucgaucucuacaaaagaaguuuuuuaauuagccagguguggcggcaggugccuguaguucuagcuacuuggaaggcugaagcaggaggauugcuugagcccaggaguucaagauuacagugagcuaugauuaugccauugcauuccaaccugggcaacagaacaaguccuugucucaaaaaaaaaaaaaagaaagaaagaaagaaaaaacccaaacaaacaagcaaacuaaaagcacagguaauuacaagcaagauuuuucaccucuuugagggacauuagaaagucaugaagaggaaaagauaagucuuucccauaugggacugucauguacaugguaggguauuuaguauaacugccuaccauucucuaagugccugcagugccccucaaucauuauguuauuagguuuccacguaguucuacaacaguuuucugaaaaccauuguucuaggucauucuuucgcuucaaucuucuccuauggguuuaugcauucauucaguuaguauuuacuaagugccuacuauauucuaagcucaugcugugaguucagucacacaacugcaagugaaguggucugagacauucugagaaauacgaccaagaaacugcucccagggucucagggcagguuuccagaggagcaaucugagaagggaguagaguguuucagucuaacaacagcaugugcaaaggcccugggguggaccagaaggaggccaguuugcaggacaugacuagugacgagaaagugacaaagaaauugaaggugcauugaugagacucuggggcugucagucacucaggggaaugagagaucaaaacgggaguuuagguggaauaaaguguuuaccacagcacucucuguauaguaaagaccaaugaagagccagguacaggccagugugaugguucacgccuguaaucccagcacuuugggaggcagagacagguggaucaccugaggucagggguucagaaccagcuuggccaacauggcaaaacccugucucuacuaaaaauacaaaaaauuagccaggcguggugguggacgccuauaaucccagcuacucaggaggcugaggcacaagaauuguccugcgaggcagagguuacagugagcugagaucacaccacugcacuccagccugggcaacagaacaagacucugucucaaaaaaaaaaaaaaaaaaaaaaagccagguacagugguaugcaccuguaaucccagcuacucaggaggcugaggcaaaggauugcuugagcccaggaguucgagaccagccugagcauuuagagaaugggaggccaguauacuaaauacccuaccauguacaagacagucucauauggaaaagaauuauccuuuccucuucaugacuuucuagugcuccucacacaggugaaaaaucuugcuuauaauuaucugugccuuuaguuuguugguuuauuuaggguuuuguuuguuuuuuuuuuuuuuuugaggcagggucuugcucuguugcccagguuggauugcaguagcauugcucauuuuagagaugagcaagaccucaugucuaaaaaaaaaagaaagaccaaugauuauuaauuacucuugcuauuauuacuaauauuacuguuauuaucagccuuauuaacagaucuacuguuauugaaggaggcagagugacagggacaaaaugucucucccuaacaauaugccaggaagaguuuuugaaagacaacaguaaacauuggaaacuacaagagcagcaaagccugguugugaaaggcaaggacuuuggggcaggcagucacauuccugcccuaucacuuccaggcugugugacuuucagaauuucacuccucucugggccuccauuuccucaucuauaaaaugaagauaagaauaguagcuaccuccuucucuggguauaagauuuaacugagccgggcgcgguggcucaugccuguaaucccagcacuuugggaggccgaggugagcggaucacaaggucaugaguucaagaccauccuggcuaauauggugaaaccccaucucuacuaaaaauaccaaaaaaaaaaaaaauuagccgggcguagguggugcacgccuguagucccagcuacucgggaggcugagguaggagaaugguguaaaacccgggaggcggagcuugcagugagccgagaucgcaccacugcacuccagccggggagacagagcgagacuccaucucaaaaaaaaaaaaaaaaaaaaaaaagauuuaacugaguuaguacguguaaaaugcuuugagugguuccuggcuuauaccaagagcucaauaaauguuagcaauuuuuuguagcauuuuggggucucacuauguugcccaggcuggugucaaacuccuggccucaagaaauucucccacuuuggccucccaaagugcuggauuuacagacaugagacaccaugccuggccauguuagcuauuauuaauaugaauauuauuaaguacucaaugaaugcuauuuuuagcaguaauaguaagcacucaggaagugucagcuaauacuguuaguaauacucucaucaauaaacauaaaaagcaauaaggacccagcuugcccaaaucccacagaugguuccugcucccucucuucuucagaggaagaaacuaucuccccacuuucacccccauagccucagcuggccagacccccauucugaaccaggggaguacugcuaauuccauuauuaauagacacaucaaacaaucuggccgggagagacauuauucauuuggcugauaaagagguucuaaggcucuuuggaaauaaaaguucaugaagauucaugcacuuuaagagaaaaaaauucaagaucagucauucaucugcuuuaaaaaaaguggcaaagauaaaacuuuauuugagaauauaaaauaauaaaaagacauuuucguucucuguugugacaaagccaguggccuucggaggucugccuuguacauuuuuccucuucuucagucauuccuugaggcuuuuugcaaacguacccuguguuuuucauucuccagcauauugauaauuuuuuuuuuuugagacauggucucgcuuugucauccaggccccggaguacagugguacaaucauggcucacugcagccuugacuuccugagcucaggugauucucccaccucagccucccgagcagcugggacuacaggugugcaugaccaugccuagcuaaucuuuuguauuuuuuguagacacaggguuuugccacauugccaaggcuggucuccaacuccuggguucaagcgauccucccaccucagccucccaaagugcugggauuacaggagcgagcuaccuugccaggccgaucauauuuuuuuccuuuuuauucacuuugucuucuccucauuccuaccuucaucugucuuucaguggcucacuccagugaaaaguggacugacgcacauucuauuucauauaauucaauggcugcuggccccagaucccccauaccagguggccgagcccaguggcccugcaggguggacaaaaugaggguggaacuuucccagacugucaguaaaaaucuauggaggacagagcuucugccucucccuugcaaccaggcagugccuucucccaggccuaucugcuugcaaagggaacuuuugccaagaccugcuccacucuagaauucuuaucucugcuguucgcauccuaauuccaccugcaucugucaccaugacaaccugcuccccaaaaggaacaggaagagagaugcuggacuuuugagcuccacaguuuauccugcauggggguagggagugguuaauuacuuagcacucuaauucuuacgguacccccaaugggcccaaguugguuuuuuuaaaaaaaaacagucuugcucuguuacccaggcuggagugcaguggcacaaucauagcucacuguagccucaaacuccuggacucaaaugaucuucccaccucagccucccaaguaacuggaacaacagucucgugcaacuacgcccagcuaauuuuuuuuuuuuuuuuuuuuuuuuagagauggggucucacuauguuccccagacugaucucaaacuccugggcucaagcgaucuuccuuccucagccucccaaagugcuaggauuacaggcguaagccacuguaccaagcugccccauuaaagcuuugaacaccagagagcccagcucagcuguuuuccagcuggguaacucuggguaacuuugccucucugaaccucagucuccuccugugugaaauggggcugaucacuauacccaucucggauggugguaguugcagggauuaaaugaguuaauacgugagguccuuaggacaggggguggggacacgagauaagcaauaaacaggaacugcuguuauuaucacccccacauaauccgaucucagggucugagugugccccaggcaagguguccacagcccucugcagaaggaugcccaagugaucagcuggcacaagaacgccacgcacagcagguguuaugcaacuggccaccuauuccaggcagaggaugccagauccccagggagaaggggguaggggugcagcuucaaaguuuucugccccuuuugaguucuccuuggagacacuuuggaaaugaaaccucccggaaauugauauuaggccucugcaggcugagcuuguuaaaauuucccaacaaacagagccaacagacgcucuacaaggaagcaaaaacaagacaaaacacauuggcagacccuuuuccaucugcucuugguagaugguauuccucuaagaaaaugccgccacgaguuucuccauggcuucuugagcugguggccaaaggauuuagguucucuuugaaauuauaacuuaacugggccugcuuuauggcagggauaucacucucugaaauguguauauauauguguauguauauauauacacauauauacacauauacauacacagggccaggcgugguggcucacaccuguaaucccagcacuuugggcggccaaggcagguggaucucuugagccccaggaguucaauaccagccugaacaacauagugagacccugucucuacaaaaauuaauaaaaauaaccaggcauggcagugugugccugcaaucccagcuacccagggugggaagaucgcuugagcccaggaguuaaaaguugcagugagcuauggucauaccacugcacuucagccugggcaacagagcaagacccugucucuuaaaaauauauuauuauuauuauacacacacagacacacacagacacacacacacauuacagaugaugagaaaauacucucagccagguuuucaugauacacaacuucucaaaaagcaucacaagcagguuagaauuagggauuucuuuguggacuguccaagauguugaggaaauauugguuuagaauuuaccucauuuaggccagaaaugguggcucacgccuguaauccuaacacuuugggaggccaaggccaauggaucucuugaagccaggaguuuuagccuggccaacauggcaaaauccugucucuacuaaaacuacagaaaaaaaaaaaaaaauuagccgggugugguggcacaggccuguagucccagcuacucuggaggcugaggcaggagaaucacuugaaccugggaggcagagguugcagugagccgagaucgugcauuacacuucagccugggugacagagcaagacuccaucucaaaaaauaagauagauaagauaaauauauauaauauauauguuauauauauaauauagaaacuacagaacaagugaucuuuguauguuuccagaauauaacagcgggacaggcauaggauagacguucccauugcaaaagggagaaauuggaagggauaaagaggucaccaguccuaagcaagugcuaaauccagcaagacaaaucccauuagguuucaaggccugagaauaauccucggugacucucagcucauuaacauacuuaguucucagagccagacucaaugagguuacggcccgcauguuaugggucaggaacugaggcuaaguaacucacuggagauuaugugguaaagaagguccaggaucauugcuucagucuccaggauauggggaagguucuacuccuguuaucccaaauuuuaaaaugugggaacuaaggcucagagagguuaagcaaaucacacaggguugcacagcuagugauguugcugagauuucccuguguguaguggcucaugccuauaaucccagcauuuugggaggcugaggcaagagggucgcuugaucccaggaguuugagaccagccugggcaauauagugagaccucaucucuacaaaaagaaaaauuaaaaaguuagccaggcgugguggcaggcaccugaagucccagcuacugggaaggcugaggugggaggauugccugagccugggagguggcgauuacagugagcugagaucgcgccacugcacuacaaccugggcgacagagugagacccugucucaaaaaaaaaaaaaaaaaaagacauugccgagauucaaacccaggucagccugucuucugaaaugucccucuaugacccacucacaaaacugagaaggcagaaaguugcuuggaccugucuauuuccccugugcagucucagagaaacaguggaacugccucgguuucuccuuccgggaaguauucauagaagcaucccacuuaccuacuuuggucugaaaauaaauuagcuugucucucuuccacuuacuaaaaacaccguggguuuuugcaaguuaaaaugcaaaaauaaaaugaggagaauggugcugguaguuuagccagugggaagcccucuggggaaagccagccuuuuauuuauuacuuauuuauuuauuuauucuuucuagauagauuuaugggaaaccagggcuguguuguccaggggucuguaguccagaaggcaucagaugggcuacuaagugagucuuuguccaccuguagauggcaagaggcagggcccagguguccauggcuuggagaggcagggguugaugggagguuugaggcugugggaucucuccuggggccucaguauccucaucuggauaauggggacauucuggccaggcacgguggcucuauauauccagcacuuagggaggccuauaaucccagcacuuugggaggcugagguggguggaucacuguaggccacgaguucaagcagccugggcaacauggcgaagcccugucucuacugaaaauagaaaaacuagcuggguauuguggugcacgcugguaaucccagcuauucgggaggcugaggcacgaggaucacuugaauccacgaggcagagguugcagugagccaagauccugccacugcacuccagccugggcaacagagugaggcucugucucaguuaaaaaaaaaaagaaaaaagaaaaagaaagaaagaaaaagaaaauggggguauucauuuaucauuugacaguaaguuuacccagcauugacugugugagaggcccuguacuaggcagugaaaacucagcuaagaauaagaaaguuaaaaacaagcugggcauugugguuuacgccuguaaucccaacauuuuaggaggccgaggaggaagaaucacuugaggccaggaguuugagaccacccugggcaacauagugagacgccagucucuacaaaaaauuguaaaauuagccagacaugguggcgugagccuguagccucagcuaccuggaggcugagaugggaggaucacuggagcccagaaguucaaggcugcaguaagcuaugauccugccacugcucuccagccugggcaacagaguaagacccugucugaaaaaaaaaaaaaaaaagaggccaggugcaguggcucacaccuguaaucucagcacuuugggaggcugagguggguggaucacuugaggucaggaauucgagaccagccuggccaaaauggugaaaccccaucucuacugaaauacaaaaaauuagccggucguaguggugggcaccuguaaucccagcuacucaggaggcugaggcaagagaaucgcuugaaccugggagccagagguugcagugagccgagaucacgccacuguacgacagagcaagaaaaaagaaagaaagaaagaaaagaaauaagaugauggggaguuguggaaaccuguccaugggcacgugaaggucuugaccucugaccaagaagugaacaggcuccucucaauuccaggcacugcagggaucugggacaugacuucuccaugaccaaacuguacccuuuccuuuucuuuuuuguuuuuuuggugacagggucucacucugucacccagacuggagugcaguggggcgaucacggcucacugcagccucaaccucccaggcucaagcaauccucccacuucggccucccaaguagcuagaacuacaggcacacagcgccacgcccgucaauuuacacauuuuuuguagaaauagggucucacuauguugcccaagcuggucuugaacuccuggccuuaagcaauccuccugccuccgcuucccaaagugcugggauuacaggcgugagccacugcgcccagcccaaauuguacucuugaaagauggaaucuuagcuaggauccugaacuguugccuuuuauccuaaaucaguuguugguucuuuuucauucacuugccuuccucagagagaaccagggcuccggggucccugugucgggccccaaccugucaaccacccggccaauccagcaggaccugggccgccaagacccaccccuggcagaggauauugacaacaugaagaacaacaagcuggccaccgcggagucggccgcuccccacggcagccuuggccacgccggccugccccagagcccagccaagaugggaaacagcaccgaccccggccccaugcuggccaucccugccauggccaccaacccccagaacgccgccagccgccggacgcccaacaacccggggaacccauccaaucccggcccccccaagacccccgagaauagccuuaucgucaccaaccccagcggcacccagaccaauucagcuaagacugccaggaaacccgaccacaccacaguggacauccccccagccugcccacccccccucaaccacaccgucguacaaggugagacccucugcucucacaucacugggcaggggaccuggcgucccuggagccagaggcucugcugagugacccuggacugugaccccaucucucuggccucagucuccuccccuggaaaaugggcauaggcguaguuuccuaccccacagggcuguggaggguucagugagauaauuugugcacagugccuggcacgggguuguguucagucggguuagcaauaucuucuacguccuuccuucccaaggggagccaggaagccaccccauuugaggagcaauaggguccucugauggaagcuugagggggucagaugauugauucucucggcccagcacuguccaaaagaaauguaacacaggccacaugcaaaugucaguuuaaacucucuagucgccacauuaaaaaaggggccagauguacuggcucaugccuguaaucccaguacuucaggaggccgagguagagugagccaagauggcaccucuguacugcagccugggugacaaagcgagacugucucaaaaaaaaaaaaaaaaaaaaaaaauggugaacugcuggguggauuaugucuuaaguucaucuagugucaguucuaugugagagauuuucaugaguuugcuggauaaaggcuuuccaugguccugagaccuaagauccuaaggucuugucacugugcccauuuuauagauguagggacugaggcucagagaggcucagccugcccgugggcacauaagcaggcugggcugcagaauggaagcuccagaggcugauggcuccucccccugagucaagagaggggugcuaaugggggcaugccaugcaguuuaugggaggucucaguauuucuaucuguucagugggucucuuggcacucucccuaccugccugcaagugagggugugaagguccaacgaggauaggggcaggucuguguuaauaucccaugagggccccaccgcacucaaggcuauagagugguugagagcaggcucucgggggccaggccgccuggguuccaaaugccagcucugccacuuccugcugugugaccuuagacaagucacuuuacuucucugugccucaauuuccucaucuguaaacaggagaucagaauauaucaaccucagggcuauacaaggguucagugaugucauaagaugccugguauauacagcaggcacuuuagaaaugucagccgcuucuugccugcccugggaguacacaggaguucccagagacuugugggaaauuguggagggagcccuguguugguucuugucccaacagugaacaaaaacgccaacccagacccacugccaaaaaaagaggaagagaagaaggaggaggaggaagacgaccguggggaagacggcccuaagccaaugccucccuauagcuccauguucauccuguccacgaccaacccgugaguauggcccccagcaagggcagggggggccuggggcucccaccaggguggcggaagucaggccagauagagggcaaugagugaguguugaccaccaugaguccagggauaccuuugaacaaguugaaaauggaugcuccuuccguaagucagguaagaugauuugucacaauauacuuuguuggaagagaccccuguccugccauccacuagaaaaucauuguuauuuaugacaauaaauaaacaaauuugucauaaauaaacaaauaaauuuguccuaaacaacaaauaaauuugucauaaauaaacaaaucuucacugugauguaagaggcacccccuuagaaauggcugccuugugcaguacacagccugaacaacugcacguggcagcccuaggaccugaacucuguuucuaaccuagacucuguaaggguuuagauucugggcggauagugucugaguuccauggccuucugucuugggcaucuuugaaauggauagacuauuuaggggagaaauuuaucccaugaaugucguaguggcucggagguuguuuuagaauugaaugucucccagggauauuucuugaaagccugaccgcucaaaaugcuucuugacaaugaaggaucaugucagauaagaugggggagaagcugcuuucuauaaucugccucuuggcaacucacccuggguaguaauaaauaaaaguaccuuuaaaguacuuuuuuauuuaguugacuuaucgauuuuacuaaggaaacacuuaugugguaucuacucagugccaggcacuguucugagugccuuaaaauuuuuuuuaauuucucugagguuguuacuaugcuuagcuccauuugacagaugaaaaaacugagguccagagacgugaauucaccugcccaaggucacacagcaagccagugggagagcuggaguuugagcccagacacuggcucuagccuccuuguucuuaaccacucagcucugcugccauucacacaaccuuaugaacuauuuauuauuggcuccacuuauuaagagguuaacuggcacaucccauuggcacauucaaggcucugauaaggccugcaauucauaauuucaauaacuaacuuuuuggagccccuaucaugagccaggcauaaauuaagucuugggucucaugauuuugugaaguaagcacuaguauuacggcuauuuuacagaugagggcaccaaggcacagaggggacaaguaacuugcccaaggucacacagcuaauuuuuaaaaagaaagaaagaaaucuacuuaacccauagauucacaauauuguuuggcccugggacauuuaauaucgaaaagccuuuuuaucuccuacagaauuaaggaccguauuucuucaaccuagcuuggggaucaagauacuucaagagggucguuugggagugauaggaacuuugcuaaacagggcaugugaaugucuucucucaccgagguccccucugccuucuugggguuccaggacccagagagggcccccaccuggaggaguuuaauaguuuguuguguaggaggccuuggggguuggagaucucaguagugguagguaacaugagauuauggaagaaaaggguuugugagccuguggucugaguggaccucugcacgcccaucugucuccaacagccuucgccgccugugccauuacauccugaaccugcgcuacuuugagaugugcauccucauggucauugccaugagcagcaucgcccuggccgccgaggacccugugcagcccaacgcaccucggaacaacgugagucccacagagcacaccccuuccuagccuggcugcucugccucaggccacuuucuccugcauccaaaaugcucauagguagggugggauguuggggucaccccuaggcauagcccuuauggcugcugguugagaggggaagcucugauuccuuggggaugcucuugggagcaagacauuccuugaggcaguuucucugugagccuggugggguggagguggcccagagugacuggggcugaaaauugcuggauucucuaauggaggcgugagacuagcaggauauggauguugcacauucucuacauggaauagggggguuacuggggcaggggcggugcucagaggugguccccuccgcaguagacauuucccuuuguacacgaagcuuugaaagaaacaacuauuuggcucagaaacacagccuaagcuuuugguuuuuaugaaagcaagccccuuugcggauggugggucuguugacaaccccuguuaauugagcacuugcugugucccaggaagaaacucagcaugcaguaucucauuuaauccucacaaugcgcccccccaaccccccgcccaggcauccccauuugacagaugggaaaacugaggcucaggggaaugagagagugguaaguggccuguccagggucacacagcagaauuccaacucugcaucccccaaagcucccacugcuucccccaacugucugcauuuacuaaucaccuacuguaugcuacggaugggugugcauagccccuuugaguccugacaagcaggaaugagugcaugcuugugguugagauggggaaaccgaggcaccaacaggcaagggcgugccucagucaugggcugcgggcagaggcuugaccccagggccugguagaggguggacugguggcuccuguuucccuccccagcucccucccccaacccuucccucccaacccagagccaaaaaaguguguuuucugcugguccaaggcucugcugcccuggcuaaguagguuaggacccaggcaaagcuggcgagccccaucccucaagcccgcccacagcuuaccaugcacuuucccuuccuucccaggccuggcaggccccccuggggaccugaugggggagauggaaggaaauaauuagaacgcagcuccuggaggaagcuagagccagugcucagccuccucacaguccgcuuaguugcuucccgcagccugguuucccccaggggccuccaggagccaggcguggggaggaggugucccuggagggguccacaaacccccugcugacgcgaggaugcugaagaaggcguugccuucggcagggagggcacaggcauggaugauccagggggcacggcagcucccagggcugaagggaaucuaggcagugcucagaccaggccccagggacuguuugcaaagagcguucagcuccccggcccccucccucguccaucucgcagucgaaacuucucuacaagaacacuguggccccauaacguucacaccacguaaccaccauccagggcaagaaauagaacaaaaacgccccacgcggcaugugccuccucgaucccccacccccaccgccuucuuucccucuagagcugcuggggacacugucuggagacauuuuugguugucacgacaggaggggggaggugcuccuggcaucugguggguggaggccagggauguugcucagcacccgccgaugcccaggacagcccccacucuagaggaugauccagacccaaauguccacagagcccagcuugagaaacccugccuuaccgguaaccacgaccccagcuucuggaaugagcguuuuuggcuucucucuuuuucccaccugcacaggcuuuuuuuuuuuuuuuuuuuaagagacaaugucucucucugucgcccagguuggggugcaguaacgugaucauggcucacugcagccucaacgucccgggcucaagugauccucccaccucagccccccagguagcuaggaccacaggcaugcaccaccacacccagcuaauuuuuaaaugcuuguagaaacgggccucgcuauguugccaggcuggucucgaacucuugaccucaagcaauccucccuccucagauucccagagcucuggaauuacaggcauguaauuccaauucuuacaugccuguaauuggccaacacuggccaauucuuaaaaacugaauuuauguuugcucuucuguaacauucaauaaaugagacacuucuaugcuucgcauuaaaugaguacauguugcuuuugcaggauugaugggcauucuuuuuuuuuuuuuuuuuuuugagauggagucuugcucugucacccaggcuggagugcaguggugcaaucuuggcucacugcaaccuccgccucccggguuuaagcgauucuccugccucagccuccagaguagcugggacuacaggcaggcgccaccacacccggcuaauuuuuguauuuuuaguagagacgggguuucacacuaucagccagacuggucucaaacuccugaccucaagugauccgcccgccuuggccucccaaagugcugggauuacaggcgugagccaccacgcccggucaaugagcauucuuuaugaugcuguuuugagauuuacuguguggcaugggauguguuauccauccccuguugacagauguuuggguuguuucuaagugugaauacuguccccaugccacgccccucaacauguuuccugagucaccuggacaguaauuucuccaggaggccagaugcaguggcucacgccuauaaucccagcacuucgagaggccaaggugggagcaaugcuugaggccaggaguucaagaccagcuugggcaacauagugagacccccaccucuaccaaaaaaaaaaaaaauuuuuuuuuuuuuaauuaaccgagcgugguggugcacaccuguggucccagccacuugggaggcugaggugggaggaucacuugggucuggaaggucaaggcuguagugauccauguucauaccacugcacuccaaccugggugacagagcgagacccugucucaauaaauaagaauuccuccaggguauaaaccaaaagcgaaguuucuagagcauauaauuugcaagugguuggccucaguaaaugcagcuugaauguuuauuggacaauaaacacagugacccuuugggaggccaaggcggguggaucaccugaggucaggaguuugagaccagccuggccaacauggugaaaccccgucucuaccaaaaauacaaaaauuaucugggcgugguaacacacaacuguaaucccagcuacucgggaggcugaagcacaagaaucacuugaacccaggagguggagguugcagugagccaagauggcgucacugcacucuagccuuggcgacagagcgagacccugucuccaaaauauauauaaauaaauaaaaauaaacacagugggccgggcacagugggccgggcucgcaccuguaaucccagcacuuugggaggccaagguggguagaucacgugaggucaggaguucgagaccagacuggccaauaugguaaaaccuggucucuacuaaaaauacaaaaauuagccgggcgugguagcaugcgccuguaaucccagacacuuggaggcugaggcagaagaauugcuugaacccgggaggcagagguuccagugagccaagauugugccacugcacuccagccugggugacagagugagacaccaucucaaaaaaaaauuaaaaaauaaaugaacgcaguggcccuugcaccaguagcucaugggaacuccuguucuuccacauccuugucaacacuugguacugucgacuguuucauuuggccgaucugcuggguguggagugagaucuuauugggguugugcuuggcauuucccuguaaugaaugagaucaagcacuuuuuuggauuagacugagccacaggaaauaacauuuucaaauagaugaaaaagaucuaaguauuaggaauacuugaaccuaauuuauuggucuuuugauuuccucuugcacagcuuauuaagagcuccagaauuagauucaccugacccccacggccugcccuuucccagcucccucucuuccuucuuuccuuccauucauuccuuuaguaaguauuugauaagcaacuacuaugugccagguacugagcgagccagggaggauugacaggguaugagauggucccugcacucccagagcccacaaaccaccaggccuuugaccaggcugugcccacugccucgugcaccugaaauacucucccaccaccauccccucugcccacccaggucuuucaagccaauccccuugcaccagccccucccuccaggaagucaccucacccugaccccaggcacucuggucucugauuccucuucaagcaccacauauaacaggaauauaaguuauaaccacacagaucacagagcccagcuccuccaggacccaguacagccccaacuguugaugcauucauucaacaaacauuucuugagcaccuacuguauuccugacccuguauuauaagcuggagacgccauggugacagacagacaucccuguccuuguggggcugacauuugggugggggagauggacaaugagauuaucaguaacuacaacaaauguucagggagugauaaguggccggggguguggugggcagagggaaggagagacuucguaaagaggaucucaagcaccaggagauggaauuuaaacagccggucaggggaguccucacugggaaaguguuauuugagcuaagucauaaaggaggagaaagacggaaucaaaugggaugugggggaaagcauuccagagagacagaacagccugugcaaaggcccugagguggaagcaucuuggggaacaaaaggaagugagcaagggagagaaugagaggaagugagggcagggagcugaauggucagaucgugcaggggcuugagggccucggggaggacuuugacuuuuaucccugaaugaggugggagccacggaggauuguaagcaggggaaggaugugccugacuucuuugguguucacagcgcccucugguggccauguucaguaaugcucagcccuugcagcuucuggguggaucugauuuuuuuuuuuuuuuuuuuuuuagacagucucugucucccaggcuggagugcaguggcacgaucucggcucacugcaaccuccgccucccacguucaagugacugucacgccuuggccucccaaguagcuggaauuacaggcacacgccaccaugcccagcuaauuuuuuauauuuuuaguagacacgggguuuugccauuugguuaggcuggucucgaacuccugaccucaagugaucugccugccucagccucccaaagugcugggauuacaggcucgagccaccgugcccagccgguguccaccccaugucuagcaccagccagacacugugccggcgcacccucaucuucaggccugggugacaccagaggugugcuaugguguguccuggacaggggcugggccagaggacauugcucguccaggcagaaacaucaggccuggggaggggcacaggaaaaaucaaccuacccuggcaggggccuggccuugaagcaggaagagaugccguggcaggaaguuggccccaguguuuaaaaaaaccacguagcaacuauuucucgcccaggaugcccaggaaagcaaggguacugggggauuagauccaucaccaagaaggauacagucagcccugaacuucucuggggccgcuucuaauccacuacagggcuuggggcaaauuuuaaaagguacccuucccguggguuagcgaacuggccuaguacagugauuuuuuuguuaggauuugcugccaucugcuggacaauuucauucacaacauacaaaucugcaguaugaaaagagaugggaggggcccuugugcagugcacgcccugcgcaacuguauauagcagcuguguuuccucuucuggguagaaacucugcuccccaguaggcgaucguuaguuuuaccggggcucugcuggaacaggccagugauccacugcucucuugcuuuuaucccuuacaggugcugcgauacuuugacuacguuuuuacaggcgucuuuaccuuugagauggugaucaaggugagugcagauuauaagugagaacacacgguaauuuuuuuuuuuaagcaagugcagggcugggcacaguggaucaugccuguaaucccagcacuuugggaggcugaggcaggcagaucacuugagaucaggagguugaggccagccuggccaacauggugaaaccccaucucuacuaaaaauacaaaaauuagccgggcaugguggcacaugucuguaaucccagcuacucgggaggcugaggcaggagaaucacuugaacccuaggcugcaaugagccgauguggaggcugcagugagccgagaucuugccacugcauuccagccugggugacacagcgagacucugucaaaaaaaaaaaaaaaaaaaagagcugggauuccaggagauccugagccuccaagaaugccccccuugagaggaugagucucccagaggauuagaaaugccugguguguuugaagagcagcaaggaagcugguguggcugggcggagugagagaacaguggggaaacgaaggacagagagaugaguggggaggugagggggcaccuugugccggggaucacagagagggcucuucggcucuuacuuugagugaggugagggccauagaguguucugagcagaggagggacuugauccagguguucacaggugcccuuuggcaucugugggaagccagaggaccugugagcaggugaucacacugguccccaugggcgaugacggggacaggaucaggcuggugaccaaagaagaggugagaaguggacagauucuuggaagguucuggaaauagagccagugaguuuugcugauagagccaccaaugagggauuugggacaaagaggcaucaaagaggaucccaaaguuuggaucuaagagccggcaagccagagcuggcuuccaucaggcaaaggggggccgccucauggggcaggggcuccccacuccucccuggaguccucuggccacugcccaucccugcaagaugagguggccucauuggcuucccugccucuccccgagaggcuagagaguggguggcagcaccccaggguggggaucagguggggguucugagcacccucucuucucccccacagaugauugaccuggggcucguccugcaucagggugccuacuuccgugaccucuggaauauucucgacuucauaguggucaguggggcccugguagccuuugccuucacguaagucuccucgcaaggguuccucuugccucuuuucccccaacccccagccugggccacacaucggauuacaggacauguucucagggucuagggauggggugugugggcuccggggacgugggagauaucagcaugccaccaggaagagcuucgauggcuuuuugcaugauguccauggaggaagaaggagaagggacccccccuccugccaaccuucuaccuccucacacagcaacgggccucagccacaucacuggccccuugcugugcagcuuccuguagacuagccucgccggaacaucucaucccccuacuacuccacaagcgccgcccaaaccgcugucucuuuggaaagucccuaaagagacaaucaggaaacgaaugugcaugagaauucugacccccucccuaugccugaaggccccguaguuguagaccuggugacucccuuugugugucuuucacuucuccuggcaguccuaggauucucugcccucugaaaggccaugugucauccugcagcuccaagauggcgccccaguuguaggcagccauuucaggauggcacccaagcucuuaguagucaucccaagauggcauccaaguucuggguggccauuccaagauggccccugaguucugagcuaucauuccaagauggccucugaauuugggguggucauucuuagauggucccugaguuccaaggugaccuucaaguucuggguagccauuccaggaugguccccaagcucuggguggcuauuccaagauggccccaaguucuaggcagccauugcaagauggccccugaguuccaggguggcccccaaguucugggcaaccauuccaagguggcauccaaguucuggguggcuauuccaagauggccucugauuucugggcuaccaugcuaagauggccucuggauucuugguggccauucuuacauggucccugaguuccaagguggccuucaaguucuggguagccauuccaagacgguccccaagucuuggauggcuacucgaaggugacccccaaguucugggcagccaucucaagguggcacccuaguucuggguaaccauuccaaaauggcacccaaguucuagggcaaccauuucaaaauggcccccaaguucugggugacuauuucaagaugguacccaacaggugaguggccauuagcccuuagggcccugauagcagacuuagcaguacauuccugaaguuguagacauuuggagcgggaugaaaaauaucuaaucagucuuuaaucaagaaacaaaucuuggggacccuggcugugcccaucauggugaaugauucccugacagguuuugaaaggaucuugacacauucacucccaucgugagagaaucaggggcuuccuccugugccucugccucuaggcucccuccugagccaaucuggaggggcccuugaauggucucccucaccaaacaaugaggacuugguuugucaggagggccaaaauaguggcccauuuccaguagaagggcuguuaaguaggccacacuuagauucuucucugggaacacaaugaggucaaguuguguuagaacaaaaaaucuccagaguuuuuggaugccucagagcuggagauguaucaugaagguugggaggcugauuauacuucuuucucuuucucuuucacuccuuccuccucuuucuccucucuuuuuguucguuuacucuuuucuuuuucucuucuccucucccuccccacauccuucccucuccucaaagcuuuucagugucuauuugacuacuagagcaaugcacgguggcuuacaccugcaaucccagcacuuugggaggcugagacaggcagauugcuugagcccaggaggccaagaccagccuggguaacauagggagaccccaucucuaaaaaaaaaaaaaaacaauuagccaggcaugguaguaugccugcacuagcagcuacacgggaggcugaggugggagaauugcuugagcccaggagguucaaggcugcagugagccgaaaucgcaccacugcaccccagucuggggaacacaggaagaacuugucucaaaaaaauaaaaaguuuaaaaaauuaaaaaucaaugaauuugcuauuuagaauauuaugcuuuauaugguuacugaauaauuuuaauagugaugaguacaaaaaaaacagguuuagcaagcuguucuguagguuaaaaaguaaauaaauaaauaauuaauuaaacaaaauacaaugcacaucaaauuaggggacaaagauugugacgaauaagacaaggaguccaugucuuuaaaauaugaaaagcaguuacaaaucaauaagaaacacuacuucucaauggauaaaugggcaaaggacauaaacagaaaucugauagaaugcuggcaacuaguaaaaauggagguaaaucaacccuuggaauucagagaaauguaaaauaaaaacgagauacaauucauucccuaucaaguuagcacuguucccgccgcacccccacacacacacaaaaaaugauuuuuuuagcuaauaaacagcauauauaagaauguauuauaauaggcugggcacaguggcucacgccuguaacccuagcauuuugggaggccaagggagggggaucaccugaggucagcaguucgagaccagccuggccgacaugacaaaacccugucucuacuaaaaaauacaaaaauuagccaggcaugguggcggaugccuguaaucccagcuacucagguggguaaggcaggagaauugcuuggacccaggagauggagacugcagugagccgagaucaugccacugcacuccagccugggugagaaagcaagauuuugucucaaaaauaaaaaaaggaauguauuauaauaaaauauacuuuucucccccucuaucaccuauuuaagcagguccuucaaguugucagguagacaucaugcuaugagaaaauuuaaauccugaaaagccagaauguuuuaccacccucagccuggaaugaauccuucuccuauggaaauaaccuacggguuucuccaccccucucugccuuucagccccuucccucccucuccccuccuuuucuuucucccucuuucucuuccuccuuuccccucucuucccucucucuucuucccucucucugucucuuucuguucgucuuucuccuuuuacccccucucaguuucuaucuuuuuauuuuccucuuucucucucucucucccucucuuucucucucacucccugcacuguugaugaccuauguccuugggugaugugggccuccccuggaccguguagcuuggagaaagcugacccucugucaucggucuggcaacagggacuuggccccccuacccugcauucugaugaggaaugguauucagacaaaggcagaucccaggacacaggaggacaugcucaggcagggacccccgccccuuuccucuggggcaaggucugcucagcagccuccaagauuccuagggcucaagagguggcagguagcucagggcacuagggcaggcaguggggugaauaugucacucauauccaccuguccacacacaaugcuuaccuuggccaccugugcccaggggaauggguuuuauccugugaauccucccagugaccaccacugaguguggcacagauaaaugguaccaagcccaagcuguucaggucuccaaugucacuuuccucucagaccucuguuguagcugacauacuguaaugcugaggagggccgggcacaguggcucaugccuguaauccuagcucuuucggaggccaaggcagauggaucaccuggggucaggaguucaagaccagccugggcaacauggugaaaccccaggcaacaugguaaaacccugucucuacuaaaaauacaaauauuagccaagcgugauagcaggcgccuguaaucucagcuacucgggaggcugaggcagaagaauugcuugaaccugggaaguggagguugcagugagccaagauugcaccacugcacuccagccugggcaacagagcaagacucugucucaaaaaaaaaaaaaaaugcugaggaggugacugucccaccuccauccuccgaguugaccaucacaauuuagggaggggaaugaccuacaaaggacccagaagcaagccuuucaauuguugagcuuuugccauuaugggccaucguuuacaacaugcuguuucuagguucucuggagguaaaauuagccuccucuuuuaaacaaagcuaaucugcaaaagcgaaccaaaaauucuuuuccaccagagaucaauuagcagaaugagcugggugcgauggcucacaccuguaaucccagcacuuggggaggccgaggcagguggaucacuugaggucagggguccaagaccagcauggccaacauggugaaaccccaucucuacuaaaaauacaaaaacuagcugggugugguggggagggccuguagucccagcuacucgggagggugaggcaggagaauugcuugaacccaggaggugaagguugcagugagccaagauugugccacugcacuccagccugggugacggagcaagacuccaucucaaaaaaaaaaaaaaaaaaaaaaaacagcagaaugauucuuuuggggaguugacuuuuuuuuuaauuucugaguuuucuuuuuaaauaucaaguuauacaagggcauucaaauuggccuacaacucacaggaauuuggcagccuguuugcagagucaagcuuuuacauuguucucaugaaauugguacaggcauaaagccacccuucacucuugaaaauccauuuugaauguuguuguuuuaauucuuaugcaagaaaaggaucuggauagggauuucaggccauccugucaacccuggcaggcuuguagaucaugcaggaacugggaggugugagauuuugccaguaggauccuggcaagugccugggacucucccaggguuuuggaagagccgacggacaugaguccaacagggagcaucuuuauaucauggccgaagggaugagagaggagacccucaaaccucacgccuaccacacccuccccaccccacugucaagaguccaucugguacugcuguuccucccccagggcagggcugcaggcccagcacagcuggccaggugccuugaucaagccauuccugcacaccuaagagccaaacugcuagaaaaccagaauaggagcuacugcuuuuuucccuaaaaaguuuuggaaucuucuccccguuacagguuucuggccucuuuugccugagaaggucucucacccuaugaggacuuugcuuauugucuuuccuuguuaucggauaguuggcacauuggaaggagcauggaugcucugagguucucagccugagcgcugaacucuccacccgccccccaccccccaccccaggguccucugcuuauuuccuuucuggucuuuuaacuugcuuugucuguccucugugcauauccccucauagacaaggcugagagccccacaaguauuagauugaccuuauuguuuuaagaaauugucccuccaggucuguuugauuucucucuagaugugcaaguccuuuagccucucugugccucaguuuuucccaucuagaugaggaaacugcggcccagagggacuguggagggaaguaaguccgacaagaucacugagguuggguucagcugucagaugcuacccaucucccagcccugaauacggaggcucacagugagcagaaugaugcucagcagccuggccagccuggguucuuugaggccuggcagggcugcgagauccaggggaagggaauaggggaagggagcauaagguuauucccuuccuuguugaaaggaaccuugccauucuggccuguuggggucaaagcaaggauucuucccccagugcugugauuguggccucgucuccgauaugggagaaaacuaucccuguggucccaccaagggauguauugaagcucuucugaagauguccaccccuccugcaccucacccaaauaucuguguguguguguccugcucaauucacugacugugucccuuguauccaugcgucuaccauaaacaccccauuucaugagccaucacacgugguaucacgcucugugcccaugcaucagggcggccaacugacauuucucagcagcuggcagaucaugauccugcccucaccgccaagaguccaucuggcgcggcuguucuucccccaaaggcaggaccgcaacuggcagagcgccuugaucaagcugcuccugcauacccaggagccaaacugucaggaagccaaagauggagcccucaggcugcuaucucuugauccucaucuucaaaacagcccccaccccugaaggcauuauuuuucuuguguaugaugaaauggaaagaagauuagagugcgagauacccacaccuggguuugaaucuuagucugucuucccagcugugugccugcccuugggcaggucacucuuuuucucuaggccucagcuuccucaucuggaaaauggucauaauggugcugucuucccauaggcaaaugcagugauguccagaagacucccauauuaaaccuaaagucagcagauuaggcaaaaaucacugucauugaaaacucccucaaucauccguaaagaagcuggguguggugucucucaccuguagucccagcuacuugggaggcugaggugggagaaucacuugagccagggaguucaaggcugcgguaagcuaugauugugcuacugcacuccagccugggcgacagagcaagaccacgucucuaaaaauauaaaauaaagccgggugcgguggcuuacgccuguaaucccagcacuuuggaaggcugaggcagccuggcaacagagugagaauccaucaaaaaaaaaaaaaaaaaaaaaaaaaguagaaucuauaugauucuacguaugcaauaauuccuagauacacugaauuugagaaccccaagucagacuacaggaaaaggagaugaggggguguggaggagaauccacuuggaauauuuguagacauuuaaaccauucuguguuuuaaaaaauaucacagccgggcgcgguggcucacaccuguaauccuagcacuuugggaggccaaggugggcggaucacgaggucaagagauggagaccauccuggcuaacacggugaaaccccaucucuacuaaaaauacaaaaaaaauuagcugggcgugguggugggcgccuguagucccagcacucgggaggcugaggaaggagaauggcgugaaccugggaggcggagcuugcagugagccgagaucuugccacugcacuccagccugggcgacagagcgagacuccguuucaaaaaaaaaaaaaaaaaucacuaacuuccagaggggucguggauggaaaauuccauagaguccgcuuggcgacaggguuuccgccauucugauggcggucaagucuuucuaaccuggaucuccagucauuguugaaggcgccuaaugagccccaagccugauuccaaugaaucacgagaggaccagcugcuaggugcugauagcuuuccccaggcccgcauuugcucagagggcuucagaguugcuucuaauuccaucccaagucagaacucuuugcugacccccuccuucauaaagagcaaagccaaggccauagcuuuuguuaaucaaacaucagaauuccacagaccugaguugguugguuguuuguuuuaagagacagagucuugcccaggaugcaguggcucacacuuguaaucccagcgcucugggaggccuaggcaggaggaucacuugagcccaggaguuugagaccagccugagcaacauaaugagacccccgucucuacaaaaaauggaaaaauuugccuguauuuccagcuacuugggaggcuaaggugggagaaucaccugagcccuggagguugaggcuacagugagccaagaucccgcuacugcacugcagccugggcaacagagggagacccugccucaaaaaaaaaggagagaaggagagagacagggucucccuauguuguccaggcuggucucgaacuucuggccucaagcaaucuucccaacucguccucccaaggugcugggauuauagcugugagccacggcacccagucugggccuguuuugcagaugaggauaacgagaggcagagucaggauucaaacccagguccccucaacuucaaagcucacaaccuuuuagacauucuaaaaccuugcagcuccacaacgccuggagaagagggguuucuccggcucuuggcagugacuuuccguggugaauucaccuuugguaacugacagcuuugcagcuguccugcuaccuggaaauuuggcuuucuuagugcuuucuugggcagugccaggugccugccaagggcgggggacugaauggaggugggggcggcuuccagauggaaggauggacaucggccagcgccaugagccugaggcucccccaacugcugcccgggcgggacucgggggugcucaggggugcguguguguacgugcguguucuguguucuuuuuucugaggccacuuacgaucugucucucccuccgaugccacaucaccaggagcaguacacgguaaagucucucucuaucuuucucucucucucucuuucucucucucucucucucauauucugucucucgugaucuguccccuggugcagccucguuaguucugggccuguuucuguggccuuguguccuugcugccgcuguccugucgcuucaaaugaccagaacucacucccugcgaaggaggcaucccaaagggucuugccaaugccuccgcccaugccccaccaguucuugcagagaacagaaggggcagagguucaguuucaauaggcaagcuggguggagcaguuaucagaagcaaugaaagugggccagacacgguggcucacgccucuaaucccagcauuuugggaggccgaggcggguagaucacuugaggucaggaguuucagaccagccuggucaacauggugaaaccccaucucuacuaaaaaugcaaaaaauuaucugggcuugguggugcacaccuguaaucccagcuacauaggaagcugaggcaggagaaucacuuaaaccugggagguggagguugcagugagcugagauugcaccacugcacuccacccugggugacagagugagacucugucucaaaaaaauauauaaaauaaauugaacaauaaaaaaauaaaauggccauggaaucguuuucagaugaggagaugcagaaugcccauggagacaugcucccaauugucacuuguuugggacaucaagauuuuagccaguuccaugugcaaccuggauguacaguuccuugacuuuuuuucuaucaacauguauucuaaaguucaauuucaaaaggaaacuuuagccaggugcaguggugcaugccugcagucccagccauuugggaggcugagacugaaggaucacuugagcccaggaguuggaggcugcggugagcuaugaucgugccacugcacuccccccugagauuccaucucuuuaauuuaaauaaaaaaaaaggaaacuauauuauccacuuacaaccagcauugcuaaccuaagauaaaucugcaacugcaaaaguaaauguaggccagacaugguggcucacaccuauaaucccagcacuuugggaggccgaggcagguggaucacuugaggucgggaguucgagaccagccugaccaacauggagaaaccccgucucuacuaaaaauacaaaauuagccggacgugauggcacaugccuguaaucccagcuacucgggaggcugaggcaaaagaauuucuugaacccgggaggcagagacugcugugagcugagaucacgccauucacuccagccuggguaacaagagagaaaugccaucucaaaaaaaaaaaaaaaaaguaaaucuaacagaaaccagacaauguuguugccuucaagcugggcucuuuguuaaaaggaaaauuacuaaguguuagggagguguuaaaggccuauuagcaucuaccugaggcuuccuuucucgcaaaagcagagcgucugaaagauacguggaaaagaaacuuaaaguauaauaaaaaagaaagaaagaaaaagaaaugauuaugccccucugagauccaauuauuuaaucugugccccuguucugccuaaaauuaucucagugacuguccaacgugugucucacacuugggggcacagccuugagaugauaaugaugauguuaguuuuaaaaagaaaaaaaaagguucagaguucugaauccuggaguauaucucugccuagcaggcuaaaauacaauuaucgucuuuguucccugaaaaaugaaaaaaauggaguccuuuaaaaagcaaauggugugaagaaugauguuuuugcacuggauacugagacccaucgugaugggggucucuggggcagcucugcucaugaccugggaggucacuguagggagauguuuucuaggugaccuccccacccaaauacuccaaccggaggcauucacguguccugagaccacacgccaggcgcaggcuaggggcuaggacaagaaucaagauuaaaggggaaauggccaggugcgguggcucaugccuguaaucccagcacuuugggagucaaggccaguggauuacuugaggucgggaguucgagaccagccuggccaacacggugaaacccugucucuacugaaaauacaaaaauuagccagguguggugacucaugccuguagucccagcuauucgggaggcugaggugggagaaucacuugaacccaggaggcagagguugcaguaagccaagaucaugccacugcacuccagccugggcaauagagcaagacuccaucucaaaaaaaaaaaaaaagauuaaagggaaaaugaacacagagaagaguagauuacacuguaagccuuugaagaguuuucugucuaaaaccagagaccgaagaaacaaacaaagauuaacuccgaaauagcacauaggagcuggcaggagccagagguaggcagucaggaaaugcugucggagggagcaacagguaauuugggcuuugaggaccggguaguucugugacuggagaaguggaggaagggcauuucuagcagcgggaacaguauaugcauaagcagacagaggcaaaagaauguggcuggggcuugagauauguagccauaaaugggaaugcaaaggugaagguaaguuggacuagauuuucaagagcauugaaugccaugcccagaaguuugcacuugcucuucugagaauucacgugcuccagaagaauucugagcaagagaaagagugacaaggucauuggcuuuagccacugugugcauaaaacauggaagaaaaggcagggaaugaggagcaaguugggagacgggugaggggggauggcacccaggaauggauggcgggauguuaaggaaggugacccacuggggauggggauggggauagagggcaggcaguugaccaugacucucagguuucugguguggacaacuggaugggucaugagugccaugaaccacaagcuauucauggucccacucaauacccuccucuuggggggccugagucaugguuggccaagggugucauggcaucucuggggucugcauugcuaagcucaguuccaacagaccuuggacugaacuucugugcaguccucucuggcaaagaugggcucagagacccuuggagcaaugcagcagagaccauggcagcagccacaucagcaucugaaaacagcggcacccgguuauuuucccuccuucagacucagggaauauggugggggaggggagauuugguauaagggccacuuuaaguaucuuccagaaucccauuggaagggggagaaaaucccauuuuuuuaagagcccacugauaccaccuuuaaaaagaauacacagggggccaggcgcaguggcucacaccuguaaucccaacacuuugggaggccaagguggguggaucaccugaggucaggaguucaagaccagccuggccaacauggugaagccccaucucuacuaaaaauacaaaaguuagcugggcaugguggcacgcaccuguagucccagcuacuuggagaggcugaggcaagagaaucacuugaaccugggagguggagguugcagugagccaagaucauaccauugcacuccagccugggcaacaagagugaaacuccaucucaaaaaaaaaaaagaauacauaggggaccacuaaacuccuagaccaagggcuuuuuugaaaauagcugugaccagguguaguggcucacaccuguaaucccagcacuuugagagggugaggagggcagauugcuugagcucaggaguuugaaaccagccugggcaacauggugaaaccucaucucuacaaaaagacaaaacaauuagccaggcgcaguggcgugugccuguagucccagcuacuugggaggcugaggugggaggauggcuuuagcccaggaggcggagguugcagugagccgagaucgugccacugcacuccagccuuggugacagagccagacccugucucaaaaaagaaaaaagaaaagcugugcagaaauggggguggggaaucagccaacccccuugugcugggucucagggacacccaauacagcugcucaggcccagccagauggcaaagggcccucaaccaacccugggaccagaaccacaaaaagccacguacuuacuggcucccgagcccaagcuuaacaggugaaauggaccacucuucaccaggaagggcagggcugugccaagcucaccccagacuucuaggccugggaggguagggucccauggagcugugggcugcccccuacccaaccugaccucugcuuccucucuucccuucuucccaccuaaacauuccuccacaguggcaauagcaaaggaaaagacaucaacacgauuaaaucccuccgaguccuccgggugcuacgaccucuuaaaaccaucaagcggcugccaaagcucaaggugagauugggagaugguggggugcggugggggggacugucaggguuaucauguacagcugagcagguuguacacugcucaaggacaacacauuaaaggaggugcugauaacauccuagccaucguguauggauauuuguauuauuacaacuucccagcagauggcaguaaagugagcugaccuaaaauaaucuguguauuauggcaguuuuucuuuagaugaagugucuugggguuaagauccuuuuuccuaauucgcaugaaggcaucauauggauuuaaaaggguauaaccgugaucugggaagcaggaacuagauuucuuguuccauaaaauuuugacuuuucaucuaccuauucuaggcucuaguaucucccauuccaaaauagcaugaaccagcauuucccaaaagccugucauucaaaaacauauauauauauuaagggaaauaaaauccagucauuagagcacccacuuucacucuaugcuucaccuggggguccccaguauuaucucuuauguaauauguuucuuuaaaucaagucacacccguaaucccugcauuuugaaagaccaaggcaggaguguugcuugagcccaggagaaugagaccagccugggcaacauaguuagacucugucucuacuaaaaauuaaagacagaaaacagauacuguuauggaaaucuaaccaaauauggcugccugccuaaggcuuugugcauugacaacugcucuuucuugguuaaagagggaaaaugucaaugguagguguuaacaugguagcaacuaaguaaaaauuucuccuucacucaaaaggauugagagaguuggaaaggaaguaacuuuguuaccuuguuuuucuguguugggcuccuguaucacuuaaaagcaucucugguaucccaucugggaguuuuagauccauagaaugccaggauugaguccaacuccuccaacgcuuauuucugaaagcuggggggaccuuacccuagugacuugacuuaugaccuugccuguaaaaugggaaugaucauggcaguauuuugguaugaugggccacuggaggcagaagguugggcagguccccagccccucaugcucucugucaacuccaccccacaggcuguguuugacuguguggugaacucacuuaaaaacgucuucaacauccucaucgucuacaugcuauucauguucaucuucgccgugguggcugugcagcucuucaaggggaaauucuuccacugcacugacgaguccaaagaguuugagaaagauugucggugggucuccacuuuccagcacauucccauuggaaccagcaggugggcaggggggaaguggcuagaggcauuggccacuugggcucagagacuggagaagugaugagccuuggaagugacucaguugcaaccagcuuggaucuuggguagaaagaaaaccgguuuuagaauuugagucaccacccagagccacagaaugagucauaagcaaauugauugaccuuucagccaccgccuuugucaugugagggauauuaauacacauccacaguuccuuacuugaaaucguuacaggcagauguguuucaaaguugagaauauuuugagauucccaugugggacaugacacccucagcugggucuaaggcagcccuauaaucaaacacaauauuucugccauaaaauguguaacuauuuacaucaaaugggguaaauaacaaguauaaagagcuucauguccaaucagaucagguuucauuaccaaauaaguuagguaagaggccaggugcaguggcucacaccuguaauuccaacacuuugggaggcugaggugggaggaucacuugaggccaggaguuggagaccagguugggcaacauaaugagagcccauccuacaaaauaaauuuuaaaaguuagcggggcaugguagcacacaccuguagucccagcuacccgggaggcugaggcgggaggauuguuuaaacacaggaguucaaggcugcaaugcacuaugaugguaccacugcacuccagccugcgugacagagugagacccugccucucaaaaauauauacauauaggccgggcgcaguggcucaugcuuauaaucucagcacuuuaggaggccgaggcgggcggaucaugaggucaggagaucgagaccauccuggcuaacacggugaaacccugucucuacuaaaaauacaaaaaccuagcugggcaugguggcagacgccuguagucccagcuacuugggaggcugagacaggagaauggcgugaacccgggaggcggagcuugcagugagcccagauugggccacuguacuccagucugggcaacagagccagacuccaucucaaacaaacaaacaaacaaacaacaacaacaaaaauauauauauauauauauguauauauauauauguacacgcacacacacauauguauuauauguguguguguauauauauguauguguauauauagugauauuguuaccaguguaaaguggcauuuugcaacacaugguagccuguuguuaucuugauggcuauuuauugaaauuaggaggaugccagaugucuggauaggagucuggaacuaacccuuguuuccugccuugaaaaggaguagcaaccucccuuagccugaugaaccucuaaauguccccuaugucucucugccuccuccuaaacucccuccaccccacccccagcaagccugaggcucucacccugaggacuagaaguuaucacguuggaagagggugcuggacccugggucagcucucccaccaggaguaagguugugccaucacccauggauuuaucucaaaguagaugcacacgucauccccuaugaagcacaggaacacaugguggcaggauggggagucacugcuucccaagcagucuaggcugguggaccacucuuccuuucccucccccugucucugauaaccaaagacaagugcaagacagccccucuuucccauuuacuaacaguccccacucucuguggcagaggcaaauaccuccucuacgagaagaaugaggugaaggcgcgagaccgggaguggaagaaguaugaauuccauuacgacaaugugcugugggcucugcugacccucuucaccguguccacgggagaaggcuggccacaguaaguggcccgacuggaaaucuauccaggaggagcccuggggagcaggaggauaaagggccugagagcuuagcaauaagaaaggucuuggaggccgggcaugguggcucacgccuguaaucccaacacuuuaggaggccaaggcagauguaucacuugaggccaggaguuugagaucagccuggccaucauggcaaaacuccauuucuacuaaaaaucccaaaaaaaaaaaaaaaaaaaaaaaaaaaaaagcugccaggcaugguggcucacaccuguggucccggcuacucaggaggcugagacacgagaaucacuugaacccaggaggcagagguugcagugagccgagauugcaccacugcacuucauccugagugacagagcaagacuauggccuccccgccuucaaaaaaaaaaaaaagugaggcugaaucauggacuuagucuuuauuuaaaauuuugagccacuugugguggcucauaccuguuaucccagcuacucaggaggcugaggugggaggaucgcuugagcccaagaguucaaggcugcagugagcugugauuaugccauuguacuccagccuagacaacagaaggagaccccuaucccugaaaaaaaaaaagaagaagaaauugauauuuguucaucauggacuuuuugcauuaauuuugauuuuuuaaaauauuggagcaaaagauuaucuugauuacugagauuuucaguacccccuuaauuugcacccaaaacaaaugccucccucccucaccucguccaaguaauggucuuucucucagaggucuuggaaaugccaggcuggaagcuugguagauuccagcaugugcccucagcauccucaccucccucccucucucagcaaauaugccaaccugaacaugcccuacuacccacucucagacacauccaguacucacacaugugggaauaaugcuaacccacaaggcaccuuugagcaaaguuuuuuuaaacaccuuucucaacagacuucauuuccaucugucugaaaaucaucgcaauagacuuaaaugauuuuguucaaacaaggcacugaaggaccaccugccaaaaaauugucaucaugaauacacaaaucuaucaugccuaucaugugaagguaucgcuuagacacagagccuuugagcagugugcaaccugcacuacuguacagagcugcugugcacuuacccacucucauauauauccccauuguaccuccugagcacccagcaccaccugugcucaaauacccacucuacaugcauacacccaccucuacucccuccauugccacaaccugucuuuaaaucccaacuuggccacuuauaaguggguggucuucagcacgucccuuuaaauugcugaaccucaaguuccucaugugcaaaguggagccaguaauaaccucccugggaggguugcugagccgguggggaugaauuguugaauauuguuuccagcacacagcaagcccuucaugcacagcaguagaaaugacugacauuggccaggcgugguggcucacaccuguaaucucaacaguuugggagaccgaggcagguggaucaccugaggucaggaguucaagaccagccuggccaacauggugaaaccccgucucuacuaaaaauacaaaaaaauuagccaggcuugguggcgcaugucuguaaucccagcuacuugggaggcugaggcaggagaaucauuugaacccgggaggcggagguuguagugacccaagaucacgccguugcacuccagccugggcaacgagagcgaaacuccaucucaaaaaauuaaaauuaaaauuaagaaauaacugacauuguugucagccuuucaaaaaacagcgacuacuuaaauuucuuuuucauuucccucuguuccuguucugccaucucacuuccacccucucuccaccuuccucaucaccccuugggucccugucucucuccuuccugccccuucccucucccugccccauuccuugcaggguccucaagcauucgguggacgccaccuuugagaaccagggccccagccccggguaccgcauggagauguccauuuucuacgucgucuacuuugugguguuccccuucuucuuugucaauaucuuuguggccuugaucaucaucaccuuccaggagcaaggggacaagaugauggaggaauacagccuggagaaaaaugaggugccacuuccaauuccaucuguccuuuaaaaacuggggacacacacaaacuuuaaaacacacacaacacccaggaaccccuuucuagggguaccugggggagggaacagaagcauugucccaaccgaauccagucuucagggcagcccuucauggaguuuccagaggaaacacaucauauaguguauguaucagucaguuuagacuagguuaugccgcaguaacaagcaaccccagauuucauugccaaauauccacaaagggacuuauuuuuugcucacacugcaugucaacaucaguuguggaucuugccaucuuuauucugguucccaggcuggcagagcagcagagcagccucccucugagaugcuccagaugaaaaagagaguaugucagacugagguucaguucuucaggcuugugcucaaaaauuacacaugucacuucugcucacauuucaucagccaaagcaagucacacauccauucugacaucaguggagugggcaaauacaaucuccccuagcgaaggguggugaauauuuaugaaugaaaagccaagccaggugugguggcucacaccuguaaucccaacauuuugggaagcugaggcaggaggaucacuugagcucaggaguuugagaccagccuggccaacauagcaagaccccaucucuacuacaaaucaaaaaaauuagccaggcaggauggugcacaccuuuagccccaguaacaugggaggcugaggugggaggaugcuugagcuugggaguucgaggcugcagugagcuaucauuaugccacugcacuacagccugggcaacagagcaagacccucucucaaaaaaagaaaaggaaagaaaauccaguccccugucuaccagagaguauagacaugacucuuugccucucuggcaucauccaagcuaaauagaggaccuagaauauauccucugcucccuugacccuuaagacuuaauaaccacuauuccuccuucucucucccucaaagagaaggagaagacgcagcaaaguauucaguaagaaagaaugggcugggcgcaguggcucacgccuguaaucuuaacacuuuaggaggccaaggcaggaggauugcuugagcccggaaguucaagaccagccugagcaacauagugagaccccaucucuaugauuaaaaaaaaaaaguuuuaauuagcugggugugguggugcacgccuguagucccagcuacucaggaggcugaagcgggaggaucacuugaguccaggaggucaaggcugcagugagcugugauugcacugcacuccagccugggugacaaagcaagcccgugucaaagaaaaaaaaaaaaaaaggaaggagggagggagggagggaaggaaggaaaugagagagagaaagaaaggagggagggaaggaaggagauagggaagaaggaaugaagaagaaagaaagggagcgaaggaaagaaggaagaagagagaaaggaaaggagaaaggggaaaggguggaaggaaugaagggaaggaaggaaaaaggaaagugaaggagggagggaggaaggaaggaaaggagggagggaaggagggagggaaggagggagggagggaaggagggagggagagaaggagggagggagggaaggaaggagggaggaaggaaggaaggagggagggagcgagggagggaggaaggggaagaaggauuaggcuucaauuugauuuggcacacucgguagcugugucaccucaggcaagugguuuaaccuuucuaagccucuauuuuggugaucugcaaagugaggccauugauaguacccacuucccauguuuguauuagccaugcaauaauggggaaaugucagugcaaguuuuggcaguuggugacaucucaagcaacuguagcuguugggauaagaaagcaauggugagaaggaagagagagcccaggaauccuggcugggggcaagagaggcagagacucaagcagaagcacuugagaaccgcgacgaguuagacagagggugcccgguguacagccaccuuccuccugccucugccgcucucaccacuggccucucucccgcagagggccugcauugauuucgccaucagcgccaagccgcugacccgacacaugccgcagaacaagcagagcuuccaguaccgcauguggcaguucguggugucuccgccuuucgaguacacgaucauggccaugaucgcccucaacaccaucgugcuuaugaugaagguaagugccccacaccagcccccagcacuacuuaacccccaccucguuccugccucuacccugauaaaaugaaaccaucugcaguuucccagacagaccacacucuggaucaccucugagauuuuguuccugcuguucccucuaccugacacacuguucccaccacucccccggccagcuucuucuucccagcuguaccugcagaccucuuccuccagaaagccuucccugaccacccaagacugcuugaggugcccaucuuagcaggcauccuaucuuuaugucgccugccacaaaaaucugcgucagguugcaugacagugucccccacccauuuaugaugaccucagcccugaauuccuagaggccaacaaggaucuggcucagacggaacaagaagcucucuauaaauguuugauuaaugaaaugagggggcugggcgcgguggcucaugccuguaaucccagaacuuugggaggccgaggcgggcggaucaccugaggucacgaguucgagaccagccugaccaacacggagaaaccgcaucucuacuaaaaauacaaaauuagccaggcgugguggugcgcaucuguaaucccagcuacucgggaggcugaggcaggagaauugcuugaacccgggaggcggagguugccaugagccgagauagcgcaauugcacucuagccugggcaacaagagcaagacuccaucucaaaaaaaaaaagaaaagaaaaagaaagaaaugagggagaagggguaggugaggacccuaaaauccccagggcuaaggagcggcuuccaaaaaaaaacucugaaaaccuuucacccugugcuuuggacuccaaagcguggauucaagcccagcucuuccauuuaauucauuuaccuuuguacaagcaaccagugacuuucuggggacucaguuucccugucaauaaaaugggaaugauaauaagagcacauuugcccccuccagaggaggugagaggauugaaugagaaaguucaugcaaggaccuuagcuccuucucggcacuucaaaaacgaucaauaguggccgggcaagguggcucacaccuguaaucccagcacuuugggaggucgaggcaggcggaucacuugaggccagguguucgggaccaacuggccaacauggugaaaucccgucucuacuaaaaauacaaaaauuagcugggcgugguggcgcaugccuauaauaccagcugcgugagaggcugaggcaugagaaucgcuugaacccagggggcggaaguugcagugagcugagaucacaccacugcacuccagccuggguaacagagugagacuccgucucaaaaaaaauaaggaagccggggacgguggcucacgccuguaaucccagcacuuugggaggccgaggagggcgaucacaagguuaggagaucaagaccauccuggcuaacacggugaaacgcugucucuacuaaaaauacaaaaaguuagcugggcaugguggugggcaccuguagucccagcuacuugggaggcugaggcaggggaauggcaugaacccaggagguggagcuugcagugagccgagaucgcgccacugcacuccagcccgggugacagagugagacuccucaaaaaaaaaaaaaaaaaaaaaguauaauucagccaagcacaauggcguaugccuauagucccgacuaucaggaggcuaagguaggauugugaguucaagcccagccugggcaaaauaggaagaccccgucuaccaaaaaaaaaaaaaaaagguugggggagguuuuuguuuuuuuggaugugaaaagaagagccuaguccggcggagagcggggcuuuccugaacugugccuccuaccagugagguugcucagaccuugccuggggcuggaguguugccuggagaacagccaugaagcugccuccccacuucccacuucccaccccugcucgcugaccccugcuacuccugcuucuuuccccuaguucuauggggcuucuguugcuuaugaaaaugcccugcggguguucaacaucgucuucaccucccucuucucucuggaaugugugcugaaagucauggcuuuugggauucugguaaguaccaccuuggggcuacagcuaugggcuugggagaagcccaagggggaacaauggguccuggaugauggucucccaacguggccccaagaaccccaaccucaaggguggcuucaguauccugccaguggccacagauccuacuuaggcauucuuguguuugccaaggagucccagggagacccaaccugugaguguuaccauauggcugcuuauguauccaguuccucaaaaugaugggagucaucauggcugggagucuuuagcauccauuuuagagauaagaaaacugaaaucaggcugggcgaggugucucauggcuguaauuccagcacuuugggaggccaaggugggcggaucaccugaggucgggaguucgagaccagccugaccaacauggagaaacucugucucuacuaaaaauacaaaauuagccgggugugguggcgcaugccuguaaucccagcuacucgggaggcugaggcaggagaaucgcuugaaccugggaggcagagguuguggugagccgagaucacaucacugcacuccagccugggcaacaagagugaaacucugucucaaaaaaaagaaagaaagaaagaaaacugaaaucaggcugagcacaguggcucaugccuguaauccuagcacuucaggaggccaaggcaggaggaucgcuugaagcuaggaguucucaaccagccugggcagcaaagcaagccccugucccuacaaaaaaaaaaaaaauuuuuuuuuaauuagccaggcaugguaacucgugccuguagugccaguuacucaggaggcugaggugggaagauauuuugagcccaggagguggagguugcagugagcuaugaucaugccacugcaccccagccugggcaacagcaagacuccaucuuuaaaaaacaaacacagaggucaggcacagugacucacaccuguaaucccagcacuuugggaggcagaggcaggcaaaucacuugagccuaggaguucgagaccacccuggccaacauggcaaaaccccaucucuacuaaaacuacaaaaaauuagccuggcgugcuugugggugcccaugaucccagcuacucaggaggcugaggcaggagaaucgcuugaacccacaaaguggagguuacagugagcugagaucacaccacugcacuccagccugagcaacagagcaagucucaaaaaaauaauaauaauaaaaauaaauaugucuuuauuuuucaccagccacuaacuaaauuuuaacauuuccuuccaucuuaaagggagauaacaaacccuuaguauuaguauuaucaacccuuaauauuaucaacaugaccugugucacuuauaaacaucagauauuuucauacugcauuauaagagcugcagauaccuuaacauuuaauuugcauucaucauugcuuuaaaauguugcuugugauuaaaccuacagcuagaauuuguuacucaguguuuuuuuguuguuguucuguuuuguuuuguuugagacagucucgcuguugcccaggcuggagugcaguggcgcaaucucggcucacugaaagcuccacccccuggguucacgccauucuccugccucagccucccgaguagcugggacuacaggugccugccaccacaccuggcuaauuguuuguauuuuuaguagagaugggguuucaccauguuggccaggauggucuugauuuccugaccucaugauccgcccgccucggccucccaaagugcugggauuacaggcgggagccaccgcacccggccuacucaguguguuaauggagaaguauauucauuguuagaucgccauuuuuaaaacuuuuuuuuuuuuuuugagacacagucuugcucuguugcccaagcuggaguaccguggcacaaucuuggcucacugaaaccuccaccuccuggguucaagcgauucucccaucucagccuucugaguagcugggacuacagaugcacaccagcaugccaggcuaauuuuuauauuuuuaguagagacgggguuucaccauguuggccaggcuggucucgaacuccuggcaucaagcaaucugccugcuucagccucccaaaaugcugggauuacaggcaugagacacugugccuagccuuaaaaaauauuuugauagcuauuuuauuacaaaagguaaccuugaagcccuugcuauuuuguuaugcauuuacaagccuuuaugcauaaaauaaaauagccagcacuauucucacauggccaagguucauagcacacacacaaaaguauaguuggcugagugcgguggcucacaccuguaaucccaacacuuugggagacagagguggguggaucaugaggucaagagauccagaccacccuugccaacauggugaaaccccaucucuacuaaaaaguacaaaaauuagcugggugugguggcgcaugccuguagucucagcuacucgggaggcugaggcaggagaaucauuugaacgugggaggcggagguugcagugagccgagaucuugccacugcacuccagccugggugacagagugagacuccaucucaauaaauaaauaaauuaaauuaaauuaaauuaaaauuauuuuuuaaaaaauugggggcugagugugauggcucacaccuguaaucccggcaguuugggagcuugaggagggcagaucccuugaggucaggaguucaagaccagccuggacaacauggugaaaccccgucucuacuaaaaauacaaaaauuagccaggcaugguggcgugugccuguaaucccagcuacucgugaggcugaggcccaagcaucgcuugaaccugugaggcggagguugcagugagccaagauggcaccagugcacuccagccugggugacagagugagacuuugucucaaaaaaaaaaaaaaauuaaggugaagaaggcuuauacuagugggcugggacuugaagugaagugaauucuugaagguccccagugaguggccaaggugggacuugaaccaggacaucuguucucuugaccaccagcuuaguccaucccuuugaagagagugaccuacagucugggucucagccagggucucaggaaaccagguucccaccuuggcucacggaggugguuaggggcaucagcuuuagcaccagaguucagaucuugccucguccuauauaagcuuugucaccuccccaucauuaaaaggagccauccucccccuccaccucagcagagcccugguaaacagcaaauggacuaacgugcaucuagaggguugaggaugaagccuggccuggcaugggcacucaauaaaugcuaggggccaggcacgguggcugacaccuguaaucgcagcacuuugggaggcugaggcagguggaucgcuugagcccaggagucugagaccaaccuggacaacauagugagauucugucucuacaaaaaguacaaaauuagccuggugugguggcgugcaccugcagucccaucuacuuaggaggcugaggugagaggauggauucagcccaggaugucagggcugcagugagucgugauugagccgcugcaccccacccugggugacagagcaagacccuguaucaaaauaaauaaauaaaugcuaggaaagggauccuacuaauggaccuuuuuccuccaaaacaguggcuuucauuugguggagaugcuacuuauuagaagcacuugaggccaggugugguggcucaugccuguagucccagcacuuugggacuucugccaaggcagaagaauugcuugaacccaggcguuucagaccagccugggcaacauagcaagaccucaucucuagaaaacauugaaaaauuagccagcauaguggcacaugacuguuguccuaacuacuuaggcgaaggcaggaggauuacuugagcucaggaguucaaggcugcagugagcugcgaucacaucacugcccuccagccugagcaacaacacaagacccggacucuaaaaaucaaaaaagaagcacuuagggaaauuucuuaaaauuaaaugauacccugagcaaaccccuagauguucugauucauuugguuuggugaggugggagggaaucacugaaucuguaauuuauuauuauuuuuuuuuuuuugagauggauucucacucuguugcccaggcuggagugcaguggugcaaucuuggcucacugcaaccucugcuucccggguucaagcaauuguccugccucagccucccgacuaguugggauuacaggcgcccaccaucacgcccggcuaauuuuuguauuuuuagcagagacggggauucaccacgucagccagguuggucuccaacuccugaccucaggugauccgccugccucggccucccaaagugcugggauuauaggcaugagccaccguaccuagccugcaguuauuuuauucugaguugaucuucugcuggugaagugagucuuccacuggggccuggagcugcaucucccucacccugccaauccugcaagagccagcacugagcuuccccucugcuuucucuuuuuuuuuuuuuuuuuuuuuuuugagaugggaucuuacucuguugcccagccuguucuugaacucguggccucaagcaguucucccuccuuggccucccaaagugcuggaauuauaggcaugagccaccacgccuggucuccccuuucaguuuuaaaugaagccacaaguucccuguauaacauuugggagauagaggggagcucucuagccuagggguugaggucugugaccaaacgccuauaaaguugucuuuguuuggacucccccagaagcagagccugagacaaggauugagugcaaggaauuuaucugggaugcagggcaguaagggagagaggaagugacacagggacagaaaggcaaccaggaaagaguguauuauuaagccaguuccugcugugaacaaauggggcucaguuucaguggauaccuccaggaggcaacagagagcacauaccacagagucaucccaccucacagggagggaauuggaguauuuauccuccagugcccaucagacauaaucacaggccacucccaggggagcuauuaauucccuaacacuugugcagccacagagagacccugggcaaaguaguguaccucagguguguaguugagcuaugggcagggccccagcaacaccugccaaaaugccaaaagugccagugggaccugaauuccuuuuuauuuauuuauuuauuuauuuauuuauuuuuauuuauuuauuuuugacggagucucgcucuguggcccaggcuggagugcaguggugcaaucucugcucacugcaagcucugccucccagguucacgccauucuccugccucagccuccggaguagcugggacuacaggcgcgcaccaccacgccugccugauuuuugugugcguguauuuuuaguagagauggggauucaccauguuauccaggauggucuugaucuccugaccucgugauccgcccacaucggccucccaaagugcugggauugcaggcgugagccaccgcgcccggcccccugaauuccuuuuuuaggcaguugugaaacaacaacaucccaucuguugggcaccuacuguauauuccaugcucagcgacgcacauucauugucugauugcuguguuaccacugccuuccagagaagggcgcagaggccccaggcacuucgccuaggagggaagcacagcucuaaggucaggcuccuucucuguaagguagaggggcuacuucagggucacacugaccgccccaaccccugaccuggccucugcuucugcgaagaugcugagaaggcccuguguuuuguguuuugggucccacugaccccagaggggagggccaucucuuugacccagacucuuggauccaaacuggggugccacccaucaccaugucaguacccgguugaggggagucagagauagcaggagaccuugugggacuugaggcugugacuguucuccaaacaauguggaguauuuccauauuuuaacaaaagagaggccaggcgugguggcucacgccuguaaucccagcacuuugggaggccgaggcggauggaucacaacgucaggagaucaagaucauccuggcuaacauggugaaaccccgucucuacuaaaaaauacaaaaaauuagccaggcgugguggugggcgccuguagucccagcuacucaggagacugaagcaggagaauggugugaacccgggaggcagagcuuguagugagccgagaacgugccacugcacuccagccugggcgacagagugagacucugucucaaaaaaaaaaaacaaacagagagguuaugcuuguguuuccccuugagccagcacccagcccaggaaugcagcagucaggauagaucaagugaagcugcaguaacaaacagcccccacaucucagugacuuaaauugaugggaaggguuuuuuacauucagcagggaagcuguuugccucauaguuacccagggacccaggcucacagaguagcugccauucaaaauguuacuggucgccaagcccaggguugagaggcuagagaguccaacacugaccagaaagugaccacacugcuuccacacacagcacaucacugcaccuagacacacauggccccaucuaaacacaaggggaccaggaagugcgugugccugaaaggccccaaagccccguccagugccuguucugcacccuguuacuguccgccuccagaucaggaaauggaggcccagagagguuaagccacuugcccauagccacacagcugugguagcagagcugggauuugaacccagagucuccuuucuuugcgaguaugcugccaaccuaguggggaccugaacacagacugugggcucucugaggccuggguucaaauccuggcuuuacaucucugugcugcuagccucaggcagaugaguggcuugguuaccuccuagaaaauggguauaccugggagugguggcucacgccuauaaucccaacacuuuggaaggccaaagugagcagaucacuugaggucagaaguucgagaccagccugaccaacauggugaaaccccgucucuacuaaaaauacaaaaauuagcugggugugguggcaugcaccugugguccuaccuacuugggaggcugaggcaggagaaucgcuugaacccaggaggcagagguuacagugagccgagaucgugccacugcacuccagccuggaugacugagcgagacuccaucucaaaaaaaaaaaaaaaaaagagaaagaaagaaaaagaaaaugggugauaacccuucccuccaggaucuucaugaggagcucagugaugucauuuauaaagccccuggggucucgggagcccucaaaaaugcuggagagacaggccacagcucugaagagcagccccagcccuguggagcugaagcagggucuggaggcccccucuggggccaggccaaucaugggaaggcccccaggaguucccagggagggagacucagcacagaugaugucgaacagccuuuaccgcagcccuucgaacaaccauaacugucccgggcacuccgcugaugggcaacugugccucuaacaugcacccggccagccuagggggccgggaaccaagcccucuguuggcaucucugucuuguggguccccauucuagaauuauuuccgcgaugccuggaacaucuucgacuuugugacuguucugggcagcaucaccgauauccucgugacugaguuugggguaagucucccuccagcuucucucugggugacucugggcuggacgaggcaggcggcagggggcgggggagcggucccagaggcagugugucccggaagccauagcugcuugagccagcacuuggccaugaccagagagggagaacuggggccccggggacaagggcagccccucaggagggcauuguggggagauggggguaaccaaagcuuggcuguagggccagcacugaggggugggcuuuccugcauccuggccuaggaauuaauaaugcagaugaguacacugagggaacugagacacucaaaagcucugaaagcugagccggcucccaaacaccacccuaugucaggagcccagaaagaauggguuucaagucaauucuguuugaaccaacccucuccuaguuagugggcaggagagagccacagcccucaggccaguguggggacaccacucccagggccauagagggguccccagggugucuucccuccucuagccccgggccugggagacucucaacaugggagucucuggaccucucugugguggccccacaggccacauugcccuucuccuuuucuggaagacucagggccccagagguccuguccuagacccucuccuuggccaucugccaaugagcccaggcuuggggucccucaggagauuggggggaggguagaagauccuugcagggggaagcaauggucaaaaaagggugucaaagccaagggucaagggugauaccaaugucaucuuacuaacaauaaaaauaacaauagcucacgagaaucgcagccuugcugugugccagggaacugugccaagugguuuacguggauuggcucaggguagaggucuuggucucagcucguaagagaauucccucggaggguucaacugaaggcacccaaaugcagaccucacugguggaggggaagggaaggguacccacaaggguggcaagguguccagcgaccacccaccguggggagcugucaccugcccaggugcugaaguggggagggaaccugagccggaggccaggagaagccaccaagugggagcuguccugucaauguggagagacagagaccagggcccaagcaggcagagagcaauaggggagaaacaccccaaccuuucucuccccucaucccuuaucuccugccagagccucccauggcccaaaguaaaccggaagcaagcugaauaugaugcucagagcaggcagggaagucaggagaauagaucuggguguggucgggccugaggaagaggguguugccucauuucacagaugggaaaacugaccucagcugggcacgguggcucaugccuguaaucccagcacuuugggaggccgaagccggcggaucaccugaggccaggaguucaagaccagccuggccaacauggugaaaccccaucucuacugacaauacaaaaaaauuagccaggugugguggugcaugccuguaaucccagcuacucgggaggcugaggcaggaaaauugcuugaacccggaaggcggagguugcagugagcgacggucauaccauugcacuccagccugggugacaagagcgaaaacuccaucucaaaaaaaaaaagaaagaaagaaaacugaucuucaaugccuggggaagugagagacacucccaaggucacaaagccaggccugggugacuccugagaguacacugacagcuccuggggugucccagucagaucccccuacagaaaaggaucuguuugccugcucuuccguccuagaaggccaggaggggcuggggaacuacacaaaagagggggccauucuuugauauguccuacggcacccgcacccaagugauacacacuuauuugccuucagcuccagugagccagaauuuuccccuuccccucacccuaucccugaaaccuuccucuagaggguucuugcccacaugggggcucucuccacuggggugcccccaccuggucauucuccccuguccugaguuucuagagagggcuggagcuccagcuggcaaucaaaauaucuugccauccggcuacauacaagacagccuugaaccaaugucccuuugggucaagagguuagaaggaugguccagcuccccagaagggcaggugggguggaggaaguuagcugaaaccuucaaucaccaguaagagagcuguagggacagacuccaacagccuguucuccuggcuggcaggaagauggggcaugggguguucaugggacaucaggacccuugcaguagccaaacagcccccagcccucccuaccagcuguuugaucuuggacaacuugcgcuaucucuucucauguagaguggggcuaaccauugcaaccaaccucagacacuugcaagacucacagugaugcaugcacucaaaagacauucauugagcaccuacugugugccuggugugauuauaagugcuggagacagaacgagaaggaggggugccaaacaaaacagaccaagaauacagagugucugcucccauagagcugacauucuaaggagagagacgggaacuuuuuacaaguaaaagcaucaacaggccgggcaugguggcucacgccuguaaucucagcacuuugggagaccaaggcagguggaucacuugaggucaggaguucgagaccagccuggccaacauggugaaacucugucccuacuaaaaauacaaaaauuagccgggcacgguggcaggugccuguaaucccagcuacucaggaggcugaggcaagagaaucacuugauucucaggaggcgagagguuguaguaagccaagauugugccacugcccuccagccugggcgacagagugaaacucugucucaaaaagaaaaggaagaaaaagaaagaaagaaacgugaagugcuuggcacagaaccugccaggaaaccaggaguuugaaaauggugguuguuaacuauuacugcuguuguuauuguuauugugaauggguguguaguuuuguuagccagcccugaguuacagucaauuugagggaaagauaggggguggguguuuggguccuucugggacaauuaacucccaaccuggaguagggagaggcauguccuggcaggcaaggaggucucaguugccccuuucugccucccagguaagcccacuaguucugaggccagggcuuggccaggcugagacaggaaaugccagaugcuugggcgggcaggucccugggguuuagggggcagagggcaugcggcaguacuaaccagugcugucucagcugcugcccccaaguggcuggggugauguggguuugcccugugugcaauggauaaugacuguguuucuugucuugucucuuuucaugccugcucuuaaaacuguauauuggcgcaacgccgucugaaaaacucauccaaucaaaaugcacuaugaaauucauuuguucauccaugacauggucuguguguucauacaccaaugacuuaucucccaacccaccgccaccaccacccccacuccccgcccgggaaccgaaacccauugguuuuuuggcacugguuacaaaucaaccuaaaaaaugcugaacacgccuccccaacugcccccgcccgcccgcucccccucaucuucaacaucugcaucuagaauccgguuggucuuacuucuuucugaagucuaaaugccuuacauuaacugugaacgcaucuccucgcgucggcauugcaugccacacccugccucuccaacgugggaugccugacgcucuccucaacccuccgcucuccucugucugucuguccucccgcccccagccccugugccucccacuuccuguagacucugucucucuguuuuuaucggguucugaauggggguuuucuguuuggggugguuugcgucuuuugcagagaaagggauggguuuucccagcgcagcaccucucucuugccccaucccgcacacacauccccuacacucagagacaauagaggcaaauccacucccagccaccucucaccacuccugucccccauucagcuccauggaccccaggccccaggaaagcugccaacugucuccucgccccuccagcucucuccauccugcuguccccaauccuccaucucaagcccacaagaucuuuggccuugaccagcagagacuugacucuccaagucugauaaaggagaccugaaggccaggcagugugccggcaaagacucucaggcagaggaacucagaagugccagacuuggaucugguagcuucauguggggcuggcccacugaggcccucuccuggagccuugaacuguacgugcacacgcagucacacagucacugcacacagacacugcacacacagucacugugcacacacucagucacugcgcacacacugugcacacagucacugcacacagacgcugcacgcagucacugcagucacugcacacagucacuaugcacacacagucacugcacacagacacugcacacacagucacuauccacacacacagucacugcgcagacacugcacacacacugcacacacacaaucacugcgcacacacagucacugcacgcagaaacuggacacacagucacuaugcacacacugcacacaccacuaugcacacacacugugcacagucacuauguacacacacuggcacugcauguagucacuauggacacacacugcacagucacugugcacacauacacugcacacacugucacuaugcaaacacagucacugcacacagucacuaugcacacacacugcacacacagucacugcacacagagccacuaugcaugcacacacagucugcauucacacauugaacacacagucgcuauacacacacagucacugcacacacagucuaugcacccacacacugaacacacagucacugcauguacagacacugcacauagucaugaccucuucucuuuuucucacucauucuccaauucucucucucucucgcucuuuuuuuuuuuuuuuuuuagacagagucucgcucugucacccaggcuggcgugcaguggcacaaugucagcuaacugcaaccucugccuccccguuucaagcaauuaugaugccucagccuccugaguaccugggauuacaagcauguaccaccacgccaggccacuucuuguauuuuuaguagagacaggguuucaccauguuggccaggcuggucucgaacuccugaccucaagugaugcacccgccucagccucccaaaguguugggauuacaggugugagccacuacaccuggccucuaauccucauucacuguuccugucucugugucucucacauacagucaugcaugcaugcacgcaugcacacacacacacacuggcccucucugcuacaucuacccacccuguacccccacuccaguacauacugcacacaucucucucccucccccacuucucagccccuugcacaccccuuguucuguuaaaucucaacugccucugccccucuccuacccaccaaugaggcccuuagagggacgccccaauggcaucuuugcccuggaaucaucccuucccugcuggcaauacacaugcauucacccaccaaacauuuaaugagccccuauuuggugccacagauggaauuaugggcagaagcagacaccauuacuguccccucuuaccacauacagucaggugggggaggcaggcaucggucaaauaaccccuugacuccacuuaaaauuauaccugcacugcgagcugaaggaugagcagcauuaacaaggcagagagagaugcacagagcauuccaggcccaggacagcacaugcaaaggcccuguggugggacggaaccugugaggggucaggaucugcaagcgagggaauguggcugaugcaaagacagccgagaaaggcuggccuggagacagccgaagaaggcagaaggggacaggacccggggcuggggagggcggggcuauauuguggaauaugggcuuucuccuaagcaccaggaagggccugggaggauaggaagcaggggaggcgcgacuggucaugugacuagacaagcucgcucugguugcagggcagggaacagcuugacaggaggcugggcuggaggugggcaccaggaaucgcagcaagagaugacaguggaggagagagaacagugggaggguuguccucugcaggacccagggaaagaucaggucugaacugagaugaggugccugggagcagucgggucuggcuuaaaacugggagauaggcugagcacggugacucaagccucuaaucccagcacuuugggaggcugaggcaggaagaucaccugaggucaggaguucgagaccagccugaccaacauggugaaaccccaucucuccuaaaaaauacaaaaauuagccaggcgugguggcaggugccuguaaucccagauccucaggaggccgagacaggagaaucacuuaaaccugggagguggagguugcagugagccgaggucgugccauugcacuccagccugggcaacagagugagacucucuuaaaaaaaaaauacugggugauagaggugagcgagugcaaggaaaggaccagguugggggaagagaauaggugugggcauagcaaguuugaggugccuuuaggacaucccgaaauaagucagauaggcagguguugugggggcugcagcuuggagcugaggucuacaaguaguaggacuuuucuggagcccuuagguggguggucuccauauccuucugagcacuugaggaacaucugagcacagcacuggaaaagaaaagaccacaaggacgcuguccucaugucuuccaggggcugugucccacccccaucacauucuagccaggaaguucaggggagguguugaagagaggaagcugcaccucccaagccauggauugaaauguggaaggcaggaagagggaacuugucagaaguucugggggcaguggaaagaauugguacugaugcaggaagagauggaggguggaugagggcagacuaguacccuucccccacugccccaaacccuucccgucuccaccccuaccugccucaugugucuccucccccacuuggcuccaagaagggaagcauguuuucugcacgcaucucccugccagaucccuggcuuuuuugcaugguugcaagcuuccccugcucuccuccaaaccccccuccugaggcugcuuccaggguccgccugccuucgcaugccuggccgaguccacauguuaugauccgccccaugaaagggauggcuuguacucugggguugaacgggagggggcuggggauaccugagccaucggccccauccccagguggagcuggguggccaggcagggaugggggucagggcagcagggcacagagagugacucuguuagccaagcuggguuuggggcuuguucgaggcacuggagacauucucacagcacuugagcccaguguggucaggguaggaucccccagcccccuuccccauccuagaggccuaaggacgcacugaugugucccagagagcauccuagacauugccaucaaacccagaggccucagaaauuccuugaacuccaguccuugccucucagcucccaggccaaagccagcacaagacacagaucuggcagccagaaagcccucuggaagccaccaaguaggaugcccaugucacccaaacuaggacacuuuugaaacaggagggaggcugugacuguauggucacccugugccauuuggggggugaagguuagaccaaguuaaaucuugcuacguggccuguagcaaauccuacaaaucccauagaacaagucugauuaagccccuucccuuaguguggagagacccucuacuccuccugccuucacccugcuggguacuggccagcgaaggaggguuuccaugucugccugaggcuggggucucaaacucaaaugccucugggggccaggcagacaccagucaaccaggaaagcaagugccauuucuaaaacgugaggacccuggaaaacuggagaucauguggccugcuuccagggagcaaucgcagcaggccugggguugccagaaagccagauuggugggcaaaaucucuugauuuuuaaacaauggcaauaauuuuuaauuaaaaacaaggacaaaugaaaaaacacugcucgggcccaacaaaacaguuuuauuagcuagauuuggcccacucgugacuucgagagucccaccccccccaccaaggucccuugaagccccacaauggccacuuaacucuagcuggucuccucccugacucuccaacucucuggcccccugguucuucuagcuugggugggaggaggcagaggcagugacuagacaggggguuuuugagcagaggcaguggccacccagggagguccugggggcagggauggccccaccucccggcccccagcacccgccccuuggugggcccgggcugauuucugagcucacccacccaugggagcugagugcuuccugcuuccugcaggccuggucccgugcuacuccacccagccccagaagcugagaagccaucccugagaggggggaaaagggccccaaaugcaucuucuccgacucagcgggcagcgaggacucacccugcagccgaacagucccagcucccucccguccuccccauucccgcucgccaaggggguaagaaaagaugcucuuccgcuucucccaauuggcucgagccgcugcuccucuuggccguggggugaggucagggcgggcaggagcgggugggcagcucggcagggcagggcagggcagggugcccggugagucccgugacagaugcauuucuggcccggagcguaacaugcccucggaacccgcacauguccaccaggccugacugugcuggcgaccuccacccccacccccgcccugguguuugugcaucguacacguaugauagauuccgcaacuugaccggcuuguguccuuucgucucagugcauuugguuguugggagaaacaaaaaccaucucgauuuuuuuccugauuggaugauucggauauauuuucuuuuucuuguucuuuuguuauuucuuccccauccccguuccuuuuuccuccuuucuuuuucuuuucuuuuccccauuguggguggggcuggcagggagggcuuaugcuuuugaguugaugccuuuuccucccucccacccucucucucccaacauuauuccuuuuucgaguuuuuccucugcaucauugcauuaauagugcuuucucucucccuccuuauuuggggucuggcuugcuuuuuuccuguugguuggcuucauguaggggccucugugaguggugacagcucugagccuuuugggguggguggauggucaccccucuuccuccaucuccccagaauaacuucaucaaccugagcuuucuccgccucuuccgagcugcccggcucaucaaacuucuccgucaggguuacaccauccgcauucuucucuggaccuuugugcaguccuucaaggugaguccucgucccugcugcuggcccagggcugagaagacaggugacccucaugcucuggcugaauguagaagucagauuggaagugccucugugauguagucgugcagagaaucuguuaucuccaaggcuguugucaaacuuccugucccuggugugucuucagagcuguaagggccucauccuagagcccccagagaugcccaccagcccuggaaggacucuggcacguggcauauggccacccaacccaguggggcagagcacugggacaagggaggaagacagugcggcugagggacccccagcacucuucuucauugccuuuuuucccaccaggcccugccuuaugucugucugcugaucgccaugcucuucuucaucuaugccaucauugggaugcaggugagugucgugucccuaagguucccagagccucccaaggagggcagccacccuuagaaaggggugggucagaggagccugguucacagaagcagccauggagguugagcuggguuucccagaagccacuggaggaauggcagccccuggucgucacccuccaauuccacagguguuugguaacauuggcaucgacguggaggacgaggacagugaugaagaugaguuccaaaucacugagcacaauaacuuccggaccuucuuccaggcccucaugcuucucuuccggugagaaggggaccugcucugauaauucuguuuccgugggguggggugccugccuucauccuucuguucccauagaggauguacccuccucuuccaaugcaagacgugcccuccuccuucucuucuggcaggggcgcgcccucacccuucuuuuccgguagggggcgugcccuucucuuccgguaggggacgugccggccuucucuuccgauagggggcgugcccuccuccuccuuuucugguguggggguggccagaugugcucuuauccuucuuuucccgugaggcuggaaaugggugucguggggggcccaggaauccuagcagggcagaagcagagggcccugggacauagucaucaaggucauuuuccaggcauuaucucugaaucuuccugaccacccugugaggaagggauucuuggcagcccuauccgacaaauaagaaaacaggcuuacagaccgugaggcuugauucuuugguucaucaucuuggcugcacacaaaaguuccuucacucguucaguguagguuuuuugggggggcuuuuuuuuuuuuuuuuuuuuuuuuuggagauggagucucgcucuguuccccaggcuggaguacaguggcgcgaucucggcucacugcaagcuccgccucccggguucacgccauucuccugccucagccucccgaguagcugggacuacaggcgcccgccaccacgcccagauaauuuuuuuguauuuuuaguagagucgggguuucaccauguuagccaggauggucucgaucuccugaccucgugauccgcccgccucggccucccaaagugcugggauuacaggcgugagccaccgugcccagcccuuuuuuuuuuuuuuuuuuagauggagucucucucuguugcccaggcuggagugcaguggcgccaucucggcucacugcaagcuccucuuguggagguguauugagcaccuacagcaugccaggcagggcugaaaaacgaggaugcaccaggaaauagagaaaagagacauuuuaagcacuuuggaagcuaacauccccauggggaagacgaauaaucaggaaacaaauuauagaggaugcuggaaaaagauaaaauucaagaauaaaggggaauagggccaggugcagugacucgugccuguaauccuagcauuuugggaggccgaggugggaggaucgcuuuagcccaggaguuugagaccagccugggcaacauagugagaccccgucucuacaaaaaaauuguuuuuaauuaacugggcauagugccacacaccuguagucccagcuacuugggaggcugaggcaggaggauugcucgagcccaggaguuccaggcuacaguaagcuaugauugugccacugcacuccagccucggcaacagagcgagacucugucucuaaaaagaaaaauauauuuuuuuaauuuuuaaaaaaaguuacagagguagauaguggugauaguugcauaauaaugugagcuuacuuaaugcuacugaauuguacacuucaaaaugguuaaauugauaaacuucaugcuguguguauuuugccacaguaaaaaauaauaauguuuuuaaucuaacaacaaaaaaagaauagagggccggcagguuaugccucucugaaagugugacauuugagagaaauuggcaagggagggagucaguggguauauggggaagggcaggccaagccgaggggacugccuguguaaaggcccugaggcaggaguauggcuggcauguuugaggacugugaggagcccagcauaccuagaacagagugaucuagggagaauauaguaugagaugacugucaccuucauggaggggagcuuuuuuuuuuuuuuaaucugagacagaguuucggucuuguugcccaggcuggagugcaguggugcgaucucggcucggcgcaacuucugccucccagguucaagcaguucuccugccucagccucccgaguagcugagauuauaggugcccgucaccacgcccagcuaauuuuuguauuuuuaguagagacgggguuuugccauguuggucaggccguucucaaacuccugaccucaggugauccacccgccucagccacccaaagugcugggauuacaggcaugagccacugcacccggccugaagggagcuuuuuuuuuuuuuugcuuuuuuuugagacagaaucucccucuuugucacccaggcuggagugcaguggcgcgaucucagcucacugcaaccuccgccuccuggguucaagcgauuuuccugccucagccucccaaguagcugagacuacaggugagcgccaccacaccgagcaaauuuuugguauuuuuaguagagauaggguuucaccauguuagccaggauggucucaaucuccugaccucgugauccacccaccucagccucccaaagugcugggauuacaggugugagccaccgcgcccagccaagaggggagcuuuuaaagcauaacagugaccagccugagcaaugcagugaaaccccaucucuacaaaaaaaaauaguuuaaaaauuagccaggagugguggcgugugccuguaguccccagcuacucaggaggccgaggcgggaggaucaccugagccugggaaguugaggcugcagugagcagugauugugccacuacacuccaaccuggguaacagagcaagacccugucaaaaaaaaaaaagagagagagagagaaaagaaaggaaaagaaagagagagagaaggaaaagaaaagaaaaaaacauaucaguguccucaaaucccacccuagaccaacugaauccaagucugcugggguggggcacgggcauugguauuuuuucaaagcucucuguggacuucagugcacagccaagaaugugaauucccuucucucagcucccaguaaaaggaggugguccaccuggggcuugccuggccagcuccagagcccaagugcucaacgugugugcuccaccuccuggggaggcguugguacccagucagggcuggguguccgagucucugauuucucccuguccucaggagugccaccggggaagcuuggcacaacaucaugcuuuccugccucagcgggaaaccgugugauaagaacucuggcauccugacucgagaguguggcaaugaauuugcuuauuuuuacuuuguuuccuucaucuuccucugcucguuucuggugagucuguggacacugugagggccgucugggcucccuaagccuggcuuccuuucaggggaguggguuucuguggaauguggcugugucgaaggcuuguucccuccaaggcuucucugaaccagccugggaucaggugacccugagcgucucaaacucagcacuguugacauuuggggguggcugauucuuugggguggggccaucaugugcacugcaguguauggcagcaucccuguccuccccccaccagaugcuggcagcacacgccacccguuccuccuguugugacaaccaaaaaugucuccggacauugccaggugcccccagggggugggggugggguugggagugggggccagaauucccccauuugagacucaaugaaauauuucagcugggcguaguggccgaugccuguaaucccaacacuucgggaggcugaggugggagggucacuugagcccaggaauacaagaccagccuggacagcauggugugaaacccaucucuuuaaaaaaaaaaaaaaaaauugaauuagcugcacacguggugcugugcaccugcagucccagcuacucaggaggcugaggugggaggaucacuugagccuuggaggucgaggcugcagugagccaugaucacaccacugcaccccagccagggcgacagaaugagauccugucucaaaaacaaacaaaaacaaacaaaaaaaaaaaaaacauugcgagggaagaaauaccucacuuuggccuuguugggggcagaugugggaggauuuggggucacagugguucucuugguguuggucccuguuucagaagccuccccucccucucacugacucuguuucuuuccaucauucuuggucuuugucucucucucucuuuuuuuuuuuucuuugaaauggagucucacucuguugcccaggcuaaagugcaguggcgagaccucagcucacugcagccuccaccucccagguucaaccgauucuucagcuucaaccucccaaguagcugggauuacaggugcacaugccaccacacccagcuaauuuuuguauuuuuaguagagacaguguuucaccauguugaccaggcuggucucaaacuccugaccucaagugaucuguccaccucggccucccaaagugcugggauuacaggcgugauccaccgugcccggccagucuuugucucuuuguaucucucucucuccaucucucucuguuucucucuuccucuuccccaucucuccacuugaucucucucucacuggaccuccuugugugagugagcaucaccucuccauuccccagucucuuucugucucugucucauuuccuuuccccaucuucucucuaucccucucuccaucugggccucuguguacaugucuuugggucugucuguccgucugucugucuguauccuucucacucacucauucauucccucggucucugcccccauucucucuugguccccgggguccccacagaugcugaaucucuuugucgccgucaucauggacaacuuugaguaccucacccgagacuccuccauccugggcccccaccaccuggaugaguacgugcgugucugggccgaguaugaccccgcagcuugguaagaagucaccccgaauccuccagccacaauacucaccucucccuggaacuggaacacgggcuaggucaggccccagacucuggagcacugaacuccugggguccuagcaggggucucacagguucagucaggagagaagauauaagaaucaucacccuugcauaccccagauuaaacacguagggugccaacccugcccaaacccuggacuuucugggaaaugagggagggcgucaaccaugagauguccugaagagcccucuccuccuacgagucucuccugucucucacugugaagucuccagauggugaggaugcauuagccaggcuccagggagaaaaccaacagcaucccagccucaguucucuugagaguguggggaggagggcuggccuacccuuggcagacaggauuggcagcaacaucagaguagcagaacucagcucccacugggacccgugaaccugggagugagaggacauacaggccaggggaggacgcagagccucaggggcccaugcaucuuuguggccacaaagggagugggcgcucccaucuggguagacaccagaggggucccucuccacugacgggcaaugguuucagaggguggguuccaccuugugcacguguauugagugcccacccaacaccaagccuugaaggacacucagaggcuuuaucugaauaccuggaacccaccagccacuaacugaggauuuaguucaggcuggucuuggggccugaagaagcauuacuggggggcccucagcagccuaagccccaucuuccucuggccucagcaccagagaggaggccgucacgaggaaggugggcaggagguggucuuggcuauucccauagccucaaacaaguacuccaugagaccgagaggcuggggagagccgugggucuggggcugggcuuuggcugguuccuaacucuuccucuuuugauuuuaggucacagcaauuggaugcuguccccaaggccucuauuccacaagcccccccccaccccuguagcccauguagacuguggaggaggcagaugcagagagagccccaggggaggugcccugcagucccgaacucgacugacauccuacaccccugggucuccccagugucugggaauguacuggggaccuucacuuguccccagucucucccacuccuucaagccagggacaccccagccucgggcaucaugaccucgcugugugcccagggagcccgugugaacccauugccugcacuaacccccuuucuucuccuuucagcggucggauucauuauaaggauauguacaguuuauuacgaguaauaucucccccucucggcuuaggcaagaaauguccucauaggguugcuugcaagguuugacuuccacuaaaaccugcuagcauccauggaaugaguguggcuugggguucuucaauauauauauuucauauauauauauauauauaucucucucucucucuaaaaaaacagagccaucucucuuucuugcauuaaacuagaaaacucucuuagccaacagaaugcagucauguagacucgauaaagcauggaacauauuuccuccuucccuucagccuucagccaucuuugcuugcucuuagcugaagcugcccauccuggggucuccacggcaccccaaaucagauacauccccugggggauuguaacuuugcauuucucccccaaccaucaccuccacucucucccccuccaccccucaccucccaaagccccuagcccuccuccccucccuggcacuggccccugcuccccaccuaggcccccucagagaccagccucagccaaaccagagaacgugacccaacuguagaaauaacagugauggccgggcgcaguggcucaugccuguaaucccagcacuuugggaggccaaagcaggaggaucgcuugagcccaggaguuugagaccagccugggcaacauagcaagaacccccuucucuauaaaaaauuagccaggcauuguggcgcaugccuguagucccagcuacuugggaggcugaggcagaaggauugcuugagcccaggagguggaggcugcagugagcuaugaucacaccacugcacuccaacccaggcgacagagagagacccugucucuuuaaaaaaaaaaaaaaaaaaaaaaaaaggcaaugaacaaaagcauggcucuacgucuuccaaagugagaauucucccuccccuccgcaucccuccagaacuguagcucagagcccacgcugaaucugacuuuucucuuuucucucucucucccugcucccgagcagugaaguaaucuuuuuuuacugaccuuuucuuccauuuuuuuuccuccucuuuuccauugauuugaaauaucuauuuuaucauucucugcaucuuucucucucuauuuuuucggcucguguggauuucuuuuuucuuucuucuguuucuccccaccucucuuccuuugguucucuguucccauucccguuuuguuuuuuuguuuuuguuuuuguuuuuuucauuuucggugcugccaggggccgcaugccuuaccuggacauguaucagaugcugagacacaugucuccgccccugggucuggggaagaaguguccggccagaguggcuuacaagguagacuacccuugccgaccaccgacguccaggcacuggguuuuuuuuucuucuucuucuucuuuuuuuuuagugcugaccagaaacacccggccgacucucuuuuuccaacguuucucuucuuuuuuguuuuugauucuuuuuuuucuuuucucgagucaacugaucaugaccaucccuugauucuaagcagcacacuguguccguccuuucugaugagugucuucguguuuugagacuccauuauggccgacaugccggggggagggggaggggagcgcccagguccccuugcaccuggucucccagguaccaaauuggaaacaaacacgcuucuucagggagucaaaacccaugcuucccacuucugcccacccagagcggcccccaugcccaggcuggggcaggcgccuugcagagaggggcuuuagcccccgaaagcaggcgaggucccggguccccgccccugccacgcacaccugaagcugaucucugaccuagggccuuggggauucgagaccuuccaaggagcaccaagaaccucucuuccccucccuuccuuccccuggaguuucguccccagcccccgucccuaauccccccaagacaccccaacaugccucuccauuguuccagagugggcaggcggccgcagcuggaccccuggacgguggcacacugaugcaggccaugcacgcugccuuggcggggccuggggcgggcaggcaccauggccgacgggggguggugcaugcuggcugagagagcgagcguccugccgccaagcggcuggcccgggccaccccuccagaucccuguccuggaaucucccuuggugcccaaggacagaugcucuguucccuccauucauccacaagaaguucagggaugaccuuuaaagauucuccccacccaaaaaguauuaccccaucauccuauucucccauccaccuugaucuucccugcgucccuauccaucaaugcuauuuguaccugccccguguugccaccucauuccuuuccuuccucugugcaccccuccucaccuaaccuauaugucuccccuccuucucaaucaaagccggggacaagguugucccaccagcaucucagacaaugagccucuccuggcaccugucgcucugugccccucccugccgcccccccccccccccccgguuuuccucaagucgcuucucucagucucugcuuagaugaaugugugcgcaugugcaagagagggagggcgagcccuuccucuccuggucuuugugcaggaccaccauggguccauaagacaacuuugugcaaauuugaaaaaggcacccuuuccacagaacaugccuguuggaaaauuguugcaaucuaccaauguggugagaacaagacacuuuuuuucuaucaccugggaagcuguuauauuuaauauacaaaucgggggcugggcgugguggcucaugccuguaauccuagugcuuugggaggcugagacgggaggaucacuugagcccaguucgagacuagccugggcaacauagcgagaccccaucucuacaaaaagaaaaaauauuuuaauuaauaaauaaguacauaaaucuaucauuuccaagaugggagcccuuugugcgguguacaaccugcacaacugugcacaguggcccagucuauguguguuucucuauuucccaccuccuuccccacccuacccccaguguccccuccaguguccugcucuggauuuaccauaccccuccccaucuucaacucuguguuuccugcccacuugugucugaauccccacccaaguugcccucaccccccuucucugugccacuucagccugggcuggugcacaccagcccagcauccucucccaugccaccaagcaugguggacagagccccugccugggacauggggaaucuuuucuucccugggcuggaagggagugccccucaccccuucccccugccauugcacagagagccaagaucuggacaugccccugagauacacuucccacggagcuaugaaugagucucgagauuccgucugcaugcgccccugucugugcuguucugugucacagccucgcugcaugccugcgaggggccugccccgucaguggggggcugccugccugcugcuucucagaggaaugauguggucugugcccaucugcucuguccuggucugggccaagccagggauuggguguggggagccaguggcaccccccaccagcggcugugguccuggcccccucagccuuggcuguugcaugcacugcucaaauccagcuugugcucuuuuucuuuggggucagacugaaacggggccauccagaagaacucuggggcagggcggggguggggcaaggguugaggcaaacccuggaaaugccagcucucaggucaagcaggugggggaaaaaaggagagggcaggggaccagaaguacaagagagccuuuugugcccucccugcgggccaccaagagaaacugaguacugggacagguaaccuaaguaagagacaccucagccgccacagcuuucagaguucuuccugggacucccuggguaggggcgggcgcggcucacgggagacccaggagggaugccugggaaugacugcgcuugccuuggguuuucuguagcggcuucugcggauggaccugcccgucgcagaugacaacaccguccacuucaauuccacccucauggcucugauccgcacagcccuggacaucaagauugccaaggguaaggaagggacaggggcgggcacagacaggcgugacaggguggaaccggggaucucccucccuaccccaaacuagaggaucugcugucaccacccggaucuucauucacucuuccauucauucguuccacaggguuuuuugggguuugggguuuugguguuuuuuuuuuuuuuuuuuugagacagagucuugcucuguugcccaggcagcagugcggugacaugaucgcaagucacugcagccuugaccucccaggcucaagugauccuuccaccucagccuccccaguagcugggacuacaggcacacaccaccauacucggcuaauuuuuuuuuuuuuggugugacaauuucccucugucacccaggcugaagugcaguggugugaucuuggcucauugcuaccuccgccucccggguucaagcgauucuccugccucagccucccaaguagcugggauuauagguacccaccagcacacccggcuaauuuuuuauauuuuggguagagaugggguuucaccauguuggccaggcuggucucgaacuccugaccucuggucucaaacuccugaccucaagugauccaccugccucgaccucucaaagugcuggauuacaggcgugagccaccaugcccaaccuaauuuuuuauauuuuuuauagagaugggguuucaucagguugcccaggcuggucucaaacuccugggcucaagcaguccucccaccuuggucucccaaaaugcugguauuacaggcaugagccaccacacccggcccauuuggcagauauuuagugcacuccuucaaugugccagagacccguccaagcaggggaggacccagcagcuuacacuuuagauggauggggaggccgccacugaggagguaaggcagugucucauggaucccuggggggaaggugcuccaggcagaaggacuggcaaaggcccugacagaggggugaacacaggacacccggggcauugagcugacucaccuucugagugagggcacgccacgcagguucagagcagaggaggaaccugacccaacucacauuugaacagguucccuccggccacugaggggaugggagaccgaaaggaggccagugugggggcugcugauaucaucuggguggagacagggcggcagcuuagaucuagggguaggcucgacgugguggcucacgccuguaaucucagcacuuugggaggccaagguggguggauuacuugaggucaggaugaccagccuggccaauguggugaaacccccgucucuacuaaaaauacaaaauuuagccagacguggugguggguacuguagucccagcuacuagggaggaugaggcagaagaaucgcuugaaccugggaggcggagguugcagugagccgagaucacgccacugcacuacagccugggugacagagcaagacucugucucaaaaauuaaauuaaauuaaauuaacuggacaugguggcauaugccuguggucccagcuacucaggaggcagagaugagaguauugcuugaagccaggaguuugaggcugcagugagucaugaucgcaccacugcacuccagccugggcgacagaacgagauccuagcucaaaacaacagaaagaaaaagaaaaaaacauuuuuuuuaaagcugagaaggggcugggcgcaguggcuuacgccuguaaucccagcacuuugggaggccaagguggguggaucacgaggucaggaguucaagaccagccuggccaacauggugaaaccccaucucuaccaaaaauacaaaaaguagccgggugucauggugggcgccuguaaccccagcuacuccggaggcugaggcaggagaaucacuugaaccugggagacagagguugcagugagccaagaucgcgccacugaacuccagccuggaugacagagcaagacgcugucucaaaaaaaaaaaaagcugaggccgggcacgcuggcucacgccuguaauagcagcacuuugggaggccgaggcgggcagaucaugaggucaagaaaucgagaccauccuggguaacacggugaaaccccuucucuacuaaaaauacaaaaaauuagcugggugugguggcacgcaccuguagucccugcuacucagaaggcugaggcaggagaauugcuugaacccgagaggcagagguugcagcgagccgagcuugugccacugcacuccagccugggugacagagugagacuucaucugaaaaaaaaaaaaaaaaaaagccgagaaggcuggacaugguggcucacaccuguaaucucagcauuuuguugaggccaggcacagugguucacgccuguaaucugagcacgcugggaggccgagguggguggaucauuugaggucaggaguucgagaucagccuggccaacguggcaaaacccugucucuacuaaaaauacaaaaauuagccgggugucguggcgugugccuguaaucccagcacuuugggaggcugaagcggguggaucacuugaggucaggaguucaagaccagccuggucaacauggcaaaacccugucucuacuaaaaauacaaaaauuagccaggugugguggcggguaccuguaaucccaguuacuagggaggcugaggcagaagaaucacuugaacccgggaggcagagauugcagugagccgagaucacaucacugcacuuuagccugggcgacagagcaagacuccaucucaaaaauaaaaauaaaaauaaaaaauaccgagaaauucccccaaagaccuagcucagggcucacucuccaucauuagggggaaagaagaagaggaggccagggaggcgggcagagaccagggcagugugggcuccuggaggcagcuucuauguuuaaaagggcggcuucaggaggaaggggaccaaccgugucaggcacugcccagagaccaaggaugacaaggaucacaagugacuggucaucauggucacuuugaccagugcagcuuuggcggaggggucagggguccccugucuggagugcauuucggaggcccgaaaggggaugugaugugauuuggcagcugauuaaggacagcagggcagagagacaggcgcacaauugccagaagaaacggggaccugaggcucacgccuguaaucccagcacuuugggaggcugaggaagguggaucacuugaggccaggaauuugagaccagccuggccaacauggcgaaaccccaucuccacuaaaaauacaaaaauuagccaggcaugguggugcacaccuauaaucccaacaacuugggaagcugagcacaagaauuacuugaaccugggaggcagagguugcagugagccgagaucaaaccauugcacuccagccugggggacacagcaagacucugucucaaaaaaaaaaaaaaaaagaaagaaagaaagaaaagaaaaaacaaaugggaccagaaaaaaggagugggugggagaggagcagguggauagucccacacaugggaaggugcugagcccagcugaaaccacuaguaagucaggaggagggaagacugagccucgagacauaugugccuuccagggucuugagggaaagaagggaggaagagccaaggccacguggcaagacucaaggaggaaguggcagggaaggugggggacuggagggguggaggacagauauuguuaaugccaggaacaaagugaagguaaagagagcacaaggaaguugggagcaguggcucacaccuguaaucccagcacuuugggaagccaaggcaggaggaucacuugaggccaggaguucaagaucagccuggccaacacagagagaccccaucucuacagaaaauuuuaaaauuagccagguguggugaugugcaccuguagucccaacuacuugggaggcuggagugggaggaucacuggggacugggaugucaaggcugcagugagcuauaugaugaccacagacauagcagcuuaagacacaccuauuugucagcucacaguccuguaggucagaaguccaaaaagcuggacugggcugucugcugagggucucacgaggcugaaaucaaggugucagccaagcugggcuccucucuggaggaucugggggagaaucuacuuccagguucauucagguguuggcagaauugaaguccuuguggcuguaggacugaggucuuguuuuaucacuggcuuuuuagcuuuuugcuccuggaagugcauguaauccuccaugugcucucauucucucugacuuccccaucugccacccagcagagacaauacugugcuuuucaagggcucaccugauuggggcaggccuacccugaucaucucuguauuuugaggucagcugacuugauauuuuuuuuuuuucuugagacagaauuucacucuuguugccaaggcuggaguauaauagugugaucucaguucacugcaaucuccgccucccagguucaagcaauucuccugccucagccuccugaguagcugagauuacaggugcccaccaccacgcccagcuaaauuuuuuuguauuuuuaguagagaugggguuucacaagguuggccaggcugguuuugaacuccugaccucaggugauccacccgccucagccucccaaagugcugggauuacaggagugagccaccaugcccagcauuuucuuucuuuuuuuuuuuuuuuuugaaacggagucuuguucugucacccaggcuggagugcaguggcgcaaucucggcucacugcaaccuccaucucccggguucaagugauucugccucagccucccaaguaggugggacuacagaugcgugccaccacgcccggauaauuuuuuguauuuuuaguagaaacgggguuucaccaugauagcaggauggucucgaucucccaaccucgugaucugcccaccucggccucccaaagugcugggauuacaggcgugagccaccgcaccgggccuccgguauuuuaauuauaucugcaaagucccuucauagccugggcaauggucccuagauuaguguuugaauaaacagaaucuuggcagaagggcagcuuuugaauucugccuaccacaguuccuucguuuguacaacgggucuaacaacacccccacucuuuguauguaaugccaucguaacucagcuucuguggcacucugagaaucuguguucaggggucccaaaaccacccacagguucagugauucccuggaagaacucagaacugagaaaaguuuuuauacucacaguuuauuacagugaaagaauauagauuaaaaucugcaaagggccgggcacgguggcucacgccuguaaucccagcacuuugggagggcgagguaggcagaucacuugaggucacgaguucaagaccagccugaccaacauggugaaacccugucucuacuaaaaauacaaaaauuagccaggcgugguggcuggcgccaguaaucccagcuacuuggaaggcuaagguaggagaaucacuugagcccaggaggcagagguugcagugagccgagaucccgccacuucacuccaggcuggacagagugagacucuauuagaaaaaaaaaaaaaaaaaaaaucugcaaagggccuggcaugguggcuuacgccuguaauccuggcacuuugggagggcaaggcgggcagaucacuugaggucacaaguuugagaccagccuggccaacauggcgaaaccccgucucuaccaaaaauacaaaaauuaggcauggugccagaccccuguaaucccaacuacucaggaggcugaggcaggagaaucgcuugacccugggaggcagagguugcagugagcugagacugugccauugcacuccagccugugugacaagaucaaaacucuguccaaaaagaaaauuagccaggugugguggcauacaccuguagucccagcuacuccagaggcugaggcacaagaauccuuucaacccaggagauagagcuacauuaagccaagaucacgccacugcacuccagccugggcaacagagcaagacucugucucaaacaaacaaacaaauuccaaaaacauaaaaugcgcaaaggaagggcaucuggggaaggguccaggagacaccaggugcgagcuuccaguugucugccuccaguggaguugcacagacaacgcuuaauucucccugcagugugugacaacacgcaccguguacugccaaccagggaagcucaccugagccuuggugccccaggguuuuuauugaggguuugucauauaggcagggcugacguaguuacucagucuccagucccuccagaggucaaacugauaccacguggcccaagaccccaacgauaaaucgcauuguuagaaugaacuguauggaaaauuauccaggcguggcggcgggcggcuguaaucccagcuacuggggaagcugaggcaggagaaucacuugaaacuaggaggccgagguugcagugagccaagaucgcaccauugcacuccagccugggcaauagagcaaaaacaccaucucaaaauaaauaaauaaauagaaugaacuguauuggccggguacagugacucaugccuauaaucccagcacuuugggaggcugaggcuggaggaucguuugaggccaggaguucgagaccagccuaggcaacauagugagacccuaucucuuuuuuuuaaaaaaaaaaaaaaaaaaaaaaaagaaugaacuauacaguguggcccaaggcccccugcuaaauaaagacacucuucaggcaggacauuucaaaggcuuagagaucaccucccaggagcaagucaaugggccaguccuuucaucggaaugugcaggguuuggacaacacuagccuacugagcuaguccuuacugcuuagcaccccagcuucuaugacaccuacuggauucccuuccugaggguuucaaagacuccuggagaugucucugaauuuggcugucacaguuguuacuuguaccccagaugccacucaguucccugaagacaaugaucccccagauuucucagccaggagccccuccaccucuuguccucagugggugccaggccucauccuggaguuccacagcugagccaggcucucgggguuacggaaggucaagaggguguggggacaacaauggaagagugauaacaguggcagcccuuugagcagaugcgggucucaggagaacauaacgcgcuuucuuuucauaguucagcucacuuucuaagcacacugagcuuccuuuccagcaggcuaaggggcugcaaaggggguacagauuaaccucauucuucagauucucaaaaauggugucaccauucauugcuggagacugggagaaagggggcaaguccaucucauucucucugucucugucucucucucucucuucccuguccaucuguuucucucucccacccaccccucuguucucucugcccagaagaaucucuauuuugguuuugguuuuguuuguuuuguauuguuuugagacggagucucguucugucgcccaggcuggagugcaguggcgcagucucaacucaccacugcagccuccaccucccagguucaagcgauucucaugccucagccucccgaguaguugggauuacaggcgcacgccaccacgcccagcuaauuuuugcauuuuuacuagagacugguuucaccauguugaccaggcuggacccuauccucuuucaagccccccaccccaggcauugagggcagagccaacuaccugccugaaccaauuagcauauuaaacguaaacccaguuagcauauccaaauagcagcccacagugacauucugacugucagaauguggauugcuugagcccaggagcucaaggcuucggugaacaaagauugugccacagccugggcaacagaguaagucccugucgaucgauagauagaugauagauagauagauagauagauagauagauagauagauagauagauagauaaauuuuuaaaaaaaauaauaggccaggcacaguggcucaugccuguaaucccagcacuuugggaggccgaggcaggcagaucaccugaggucaggaguucgagaccagccuggccaacauggugaaacccugucucuacaaaaauauaaaaauagccaggcagaugucuguaaucccagcuacucaggaggcugagguaggagaaucgcuugaacucugaagguggagguugcagugagccgagaucaugccauugcacuccagccugagugacagagcgagacuccaucucaaaaauaauaacaauaauaaaaauaauaauaaaugcucuggccccaaaguggcacauuacauggugcacaccccauuagcaaggacucaucacauggcccugccaaccacaggaggaacccccccauguacucagguaggagggccaggaaacaccgucagagagcuuuaaugacucaccccaugacuggggugagggacgagggacuggcugcaggccaagggcauguccguggcaguggagacuugggaaaggggaaaagaccuccucugagccacgcacaguggcuuucaucuguaauuccagcacuuugggaggcugaggugggaggaucuugagcccaggaggucgagacugcagugagcuauguuugugccacggcacucuagccugggcgacagagcaaaacccugucucaaaaaucaaaauaaaaccaaaaccaaaacuuccucuguuggggaugcuccagggcgucccagccuugaacagaugggucacugcaguaauaauccuauggcagacacugucccaaggcugcacgcacguuacuuugaucaucaaacaaccaggugauagccaggcaugguggugcgugccuguagucccagcuacucaggaagcugaagcgggagaaucucuugaaccugggaggcggagguaacagugagucgagaucacaugacugcacuucagccugggaacagagagagacucugucaaaaaaaaaaaaaaaacaggccagacgcgguggcucacgcauguaaucgccagcacuuugggaggcugaggaggguggaucaccugaggucaggaguuugagaccagccuggccaacauggugaaaccccgucucuacuaaaaauacaaaauuaguugggcgugguggugcacaccuguaaucccagcuacucgggaggcugaggcaggagaaucgcuugaacccaggaggcagagguugcagugagcugagauugcaccauugcacuccagccugggcaacaagagugaaacuccaucucaaaaaaaaaacaaaaaaaaaacaaccagccaggcgcgguggcuuacgccuguaaucccagcacuuugggaggccgaggcguguggaucacccgagguuaggaguucgagaccagcuugaccaacauggugaaacuccgucucuacuaaaaauacaaaaaauuagccaggcaugguggugcaugucuguaaucccagcuacucgggaagcugagacaggagaauugcuugaacccaggagucggagguugcagugagccaagcucgugccacugcacuccagccugggcaacagagcaagacucugucuaaaaaaaaaaaaaaaacacacacacacacacacaacaaccaggugaggcaaguacucuugcuaucaucuccauuucacagauggagaaacugaguuacuaagugguagaguaaccuaagucaugcagccgauaacugggagacaagauugggacccaggucgcccagcuguucuccaugccgggcugucuccugcacagcugcuccaugguccuggccccaccgaaaaccagagcccacaaggucauuccagcagcacugcccagggccuccucugggccaggccguuggggaacuggagaccccauggggaccagaaagauuggggucucguucucgggagccuauggcuuugcagcugacccagaguccagcugacacccaggcaggcagucagggucugucuacacccccauugcaggaggagccgacaaacagcagauggacgcugagcugcggaaggagaugauggcgauuuggcccaaucugucccagaagacgcuagaccugcuggucacaccucacaaguguaagagcugagcccagcccugggauccaauccaccaggacagauggagggggagggaaaggggaggccuggggagaguguuggccugggcugguauacacagggacccaggacaagggccccaaagaggccugcccuuggugagcucaccgugugugugcccccagccacggaccucaccguggggaagaucuacgcagccaugaugaucauggaguacuaccggcagagcaaggccaagaagcugcaggccaugcgcgaggagcaggugcgcuguucgccgcucuggggacaucugggcuggggacaguggcuugcaugucaccacgggaaccaacuggaauaugaggguggcugagccccagggcaggucccugaaaaguaggggcugugcacagcagcucacaccugcaaucucagugcuuugagaggccagggcagagggaucguuugagaccaggaugagaccacccugggcaacacagugagacuccaucucuacaaaauaaaacauuagccaggcaugguggugcacaccuguagucccagcuauuuaggaggccaagaugggaggaucacuugaggccaggagugggagaccagucugggcaacauagaaagacccauaucucuacaaaaaaaaaauaaaauuagcugcauguggcgccaugcaccuguggucccagcuacuugggaggcugaggcaggagaaucacuugaaccugggagguggagguugcagcaagccaagaucaagccacugcacuccagcccgggugauaagagcaggacucuaucucaaaaaaaaaaaaaaaaaaaaaaaaaaaaguucuugccaaggacacaucauguggauucauucuucauucagcugcuccaccaacacuuauugaguauuacugugugcagggcgcuguucucaguccucggggaugcacccauggggaaaauaggccagaaucccugcccucagggagcagacauuccaaguggggaaaugccaaugguagcaaaugacugaaucgugcaacauccagcaaagagaaagaaagugucgugggggaaaguggagaagaauccagaagauaggaguauccaggggaggaggggaugcggugggaaauggguaguuggggagccucccugagaaagugacaugugagcaaaggcuugaaggaaaaggggagagggagugagcuaagcaauaccuggaaggguguuccaggcagaggaaacagccagugcaaaggcucugaggcuggaccgugccuggguuguuuggguaacagcaaagaggccagugugguggaaaagagcagggaggagacaagggcaaggaggugacagggcagauccuucagggccaugggagcugcaggaaggacucuggcuuuuuccccaagcaagugggagccauggaggguucuaagcaaaggagggauaggaccugacucaagugcucaugggcgcccucugguggcucuuguggaacagugggguugaagguaggagcgggagaccugggagaaggugccugcagugagagaugaggacgugggaccaggcuggggcuaugacuuggguggaggagugagaagugguccaguucugcguggaauuggaagggucuagauggaugagaccugagagaguguguguguguguguguguguauacuggggaugucgcaaugccuucuggguaccaccgucccaccaccccacccuuguccacacacugcucucugccccauuccccaggaccggacaccccucauguuccagcgcauggagcccccguccccaacgcaggaagggggaccuggccagaacgcccuccccuccacccagcuggacccaggaggagcccugugagugucaccccugccagggagguggagugugggggugccgugguccccacguucuggaagcugcccaagcgcccacugcuaccccggccucugucccccaugcaggauggcucacgaaagcggccucaaggagagcccguccugggugacccagcgugcccaggagauguuccagaagacgggcacauggaguccggaacaaggccccccuaccgacaugcccaacagccagccuaacucucaggugccucugucccccaacuccccaauggcucccagggcccgggugguucagguggaagggaucugggccccccacacacacacaccugcagcucccucccucugcagacaccagggaucuggaggucaggccccagagcucaucuggcuuugccaucugcuccgcaguccguggagaugcgagagaugggcagagauggcuacuccgacagcgagcacuaccuccccauggaaggccagggccgggcugccuccaugccccgccucccugcagagaaccaggugagggcuuucaccacugcccuggggcuggaccccucacucugcacuggguagggccaggcccccccacaagcagcccagugcauccccucccugccggacucaggccuggguagggacuccuucagucucugaagcagucugcaggccccacccaccaccuggucacaccuggagcaccugcagacccuccucccucacagaggacagagaggaaagugcucccccuggggcagagggcaguggccacugcaaaauggucucuggcugcccugguuggaggcugcagacaggggagguuguggaagauuugugggugcagcaggguucaacagggccagcugagaccugccacgaagaucaccccuacacaaacacacacacacaugcucaacauacaugcacacacaugugcagcugugcgccuacucagaugcuugcauacacacacgugugugcacgugggcauauacacacugcacauguacucacacaugcacacauguacgugcacacgugucugcauaugggaacuuggcagguccuaggauacaguagcagagucuggggugggucugggggcagcugggcucguauuuucugucuggucucugugggagucauuggggggcacaggggugugugcuugaugugugucuguguguggccgcuucacccagcugccaggcccaccugcaggugaucccguugccuuggacucaugggacagagggcccagaggcauagcuggcugcccacccggccugaacagcgggggcccaugcacgcagcccgccucuggaggagaacagggcauggcugugagagccuggcccgggugcguggcauguguggcuguggcgagcuuuccgugugccguguguggcgucugcacggggcaggaggcugugcugugccuggcuggaccagggucaccugagggccuggccucuggcugcugggaacguggguuggggagcacccagcgugcaugcugcugcucccucaggaccgagcugcugggccccaggagaggguugggacaagcccagcugacggccaccacauggaagcuuugagcaucggccggagccagggguuggggugugcaucgcaugaggcagagcccagggccaggggcucgaggcugcgccguccugucuuucggucccaugccucugccauuugucugucugcaucuccugucugucuccucuguacccaugggaauagaggacgcccagccccgggggccugggacacccacccgccaggacuuuaacuuuucuuuuccucccugccuucucccuccgauuucucuugaugccagugccacuccccuccuuggcuucuucuccaugcaccaccuccucacucucccucuugccuuuuauauuuauuuucuucuuucuguuuuuucugugugcaccaucccauggggcugugacagaggagaaggggccggccacgugggaauaaccucaguguauguaccgcgccugcccagcgcccagcagggcuccggcccccucuuccuccccacccccccuccagggagucccgucaucucucaccguccccggaccccacccuuucuuuggcaaucgcacccucuccccuccauggagcccaauccuugugugugguguccugugugugccccucacccauaagcccuggugggcggggccauccccauccucaccccuacccccuuuucuucagggccccccacgccggaggacacuggcucuccaagagccuggcccacucugcaccucuuucuggggggcuucuucuccugacaccaccaccaaccccugguccugcagcuccuaccuggagcagggccaccagcgcucagcugggcuggacccugggaggcgggcgucugccccaucucccuccuucccuccucugccugcugcagagaaaccugugugucagggcuugacccagggaugaagcaccagggaaaagagugggcccccagagccuccagugccuggguaucccccacccccacccagagcucccuagcuugggccucaccagaaggacucagacuugugggggcagcgagcacagccccguuagccgggaggacccaaagcugccaugccgggcaccugguccugagcccauaggucagccagccacagucggaggcuucucacccucccaggagagcaagcuggggcagggaugagugcggcaguccagggcucccagguuugcacccuggauguggagagggcuucccucuggccagccugagccugcccaacuguggcugggcccccaggacuggagagugaggaucagaucuuucuggucagaacccaggaugggcucaaaaggagcaguccugucucugagggacagaggaauccucaggcuccacccucagaggccuggccacacccagagcccugauugaucagggggagccaaggccccauggcauccccuggccccugccccaggauggucacaccgcagucaccgaaggccaccaccaggcugccacaauggggcaggaaggaccgggaccacuuggugcuagcugcugaccccagcccaccggccuguccccucccccagaccaucucagacaccagccccaugaagcguucagccuccgugcugggccccaaggcccgacgccuggacgauuacucgcuggagcgggucccgcccgaggagaaccagcggcaccaccagcggcgccgcgaccgcagccaccgcgccucugagcgcucccugggccgcuacaccgauguggacacaggugggcagcccuguggugcucagggacaagcagaacagaggagaggagaggggaggagaaggcagggcggaggagacacuaaggaagaagaaagggagaggccuccauggagaggggacagagggggccaggcagcagcugcaggaaccuggguacuacccccuccccccaacccacugaccugccucgguucaggggaucucuagggcccccacaccuuccagguggccuccugugugugcaucugccccaccucucccucacgaccaccugugugucugucugacccucacccggcccaggcuuggggacagaccugagcaugaccacccaauccggggaccugccgucgaaggagcgggaccaggagcggggccggcccaaggaucggaagcaucgacagcaccaccaccaccaccaccaccaccaccaucccccgccccccgacaaggaccgcuaugcccaggaacggccggaccacggccgggcacgggcucgggaccagcgcuggucccgcucgcccagcgagggccgagagcacauggcgcaccggcaggugggugcggcugcaagugaccccaggcugggcucggccgggaggcggggaggagagaaggggauaccccauccaacagccacucuaggcaaagguccccggaucccggcugugaccaccucccauccugcccccaagccaccggggugcccggcggccggagcggacacggauccccaccacaccagcugccuaugcuguccccccagcccccuugcccacccgccgcccccuccccgccgcccgcagcugcuugcuccucgguuguggaucauauuugaguucugggccgugccgcccgaccuuucacuuuccuuuaacccggcuucuguuuuuguuucaauuaugauuucuguccucuggacgccugugaguaauuuuugaaacuucugcuauuuuuaaccccgaaacuuacaaaacuccauuucucauuucucuuuucacuuuguuguguugguuuucgacuccuccccucccugucucacucccccuccuccccucccuccucccuguggcuguugcuuuuuuccauucaauguccuguguccccccucuccuccuccuccuccuccucccccucccccuccucccucuccucccggccccucucccuucgcuccccucucuuccucccaaucccgugucuccuuugauuuuguuguaucuuuuuuuuugauuuccuuuguuucaauuuucguguagggcaguaguuccguaaguggaagcccagcccccucaacaucugguaccagcacuccgcggcggggccgccgccagcucccccagacccccuccaccccccggccacacguguccuauuccccugugauccguaaggccggcggcucggggcccccgcagcagcagcagcagcagcagcagcagcagcagcagcaggcgguggccaggccgggccgggcggccaccagcggcccucggagguacccaggccccacggccgagccucuggccggagaucggccgcccacggggggccacagcagcggccgcucgcccaggauggagaggcgggucccaggcccggcccggagcgagucccccagggccugucgacacggcggggcccgguggccggcaucuggcccgcacguguccgaggggcccccggguccccggcaccauggcuacuaccggggcuccgacuacgacgaggccgauggcccgggcagcgggggcggcgaggaggccauggccggggccuacgacgcgccaccccccguacgacacgcguccucgggcgccaccgggcgcucgcccaggacuccccgggccucgggcccggccugcgccucgccuucucggcacggccggcgacuccccaacggcuacuacccggcgcacggacuggccaggccccgcgggccgggcuccaggaagggccugcacgaacccuacagcgagagugacgaugauuggugcuaagcccgggcgagguggcgcccgcccggccccccacgcaccccacgcacacaccccacccgaggagccgcgcagaggccgcgggggcccagcacagagggcccgggagagggccagccgggagaccccagacucuggagaggccagggcugggccacaagggugucccgcagagacccucggccaaaagagacccuccugggcagccacggcgccccccaaccagccccgauccccccacccacgacaggggcucucgggugggaggcagggagcagacaaaccacacagccaagggauuugaauuaacucagccauuuuuggagaacuuuggggaacaugaaaaaaaaaaaaaaaaaaaaaaaaaaaaacauuuuuaaaagaaaaaacggggagaaaaaaauagcuucuauugaugaguuuuaucaucucaauugaaucuuuccuuucccugaugaagacagcugguggccgagugcggcaaagaagccagaaggaaccagaaucccagugcccuacacccaccaccagacacacucacacccacacacguucucagacacacacaagagugcuugccgguuauaccaaacccuacuauuacugccugcagaaaucaauuuaaaaaaauaauaauaacaauaaacaauuuuaaaaaggacaaaaaaauuaaugauugagaaaagaggcauuuuuuucugacauuugguccugcuugaaacaacaaaagaagaagaaaaacccaccaucaccaccgauuccuuugcuucuuuuuuccuuuuuuccuaccuuguuugaaaaccgugggcuugggacugugaauuauugcaugacauucaaaaagaaaaaaaaaauaaaaaaaaguugaaucaaa

SEQ ID NO: 6333 - RNA, 300019 nt, Homo sapiens; identical to SEQ ID NO: 6332

SEQ ID NO: 6334 - RNA, 300019 nt, Homo sapiens; identical to SEQ ID NO: 6332

SEQ ID NO: 6335 - RNA, 300019 nt, Homo sapiens; identical to SEQ ID NO: 6332

SEQ ID NO: 6336 - RNA, 300019 nt, Homo sapiens; identical to SEQ ID NO: 6332

SEQ ID NO: 6337 - RNA, 61792 nt, Homo sapiens
uccgcguggggggggugugugcccgccuugcgcaugcguguucccugggcauggccggcuccguuccauccuucugcacaggguaucgccucucuccguuugguacauccccuccucccccacgcccggacuggggugguagacgccgccuccgcucaucgccccuccccaucgguuuccgcgcgaaaagccggggcgccugcgcugccgccgccgcgucugcugaagccuccgagaugccggcgcguaccgccccagcccgggugcccacacuggccgucccggccaucucgcugcccgacgauguccgcaggcgguagguaccaugggggggaacacggacucagggggacaggcagggcgcuggguggggggucgcuuccccucgggguggccgguggccgcugcugacagacgggcgcgcaugcgugggguggugcggcgcgcagcggcaguuggcgcgggcaggguggcacuuccggucgcgcgugcccgggcuguuuggcgccaaaauggaccguggauucccccguagcucccugguggcuagaaacuaggcgggguggggguucucuuuugauccccaaauacagcaagcuuuggguucguuuccgggguccccuucuucaagcagcggugggccgggcucuugacuccagcuuggucgcacaggaagugggcagcccgcggccaacggacaccccucgggcaccggcacuucggccuccacuuccgguguccggcccgguccccgggggcgcuucugugguggggggucccucagugccuuucccccaaagcugugcaucucgauggcggccuccagagacggaugucacccgucggggccugggcugggcuggcucauguucgagagcccagccuuccgugggguacucauucugucaguugggacugugugguucuugcuccuugggaaaguccauguuuuggcaggaacuuuaaccgugcauugcagcgcagggcccgggaagcgugaaggcugcaugguuggucuuuuccuguaaaucugugccugugagccgugggcaucagggaagucuugcuaaugagaacuggcuacacuuucguguguguuuguguguguucauggguguguucuuuagugugugucuaauguuggaggcccuggcuuuagcaguucaugccucuguccaacuuccgugcacaaggaucagugggagcacuggucccagccccuuguucaugaacgccaucaguucauuccugaaaacuuguucaagugaggugugcgugagucagaggaacccucaccaggcguggacacuuccagcuggauuugugaaagcacucuuugccauuuuucuauuuccuuaggcuuguuaacugaccugguugggccaguccgguucugauuugggucuuuggggagggauggauauuugguucaacccccgcuuuuuuucuuuucuuuuuuuuuuuuuuuuugaaggcugggugcuguggcuuaugccuguaaucccagcaauuugggaggcaguggcggacgaaucucuugagccaggaguuugagaccagccugggcaacaaggcaaaaccccaugucuacuaaaaauacaaaaauuagccuggaguagugccgugcgccuguggucccaacuacucaacagacuaaggugggaguaucacuugagccccagagguugaggcuguguguagcgagcugagaucgcgcuauugcacuccagccugggugacagagugagacccugucucaaaaaaagaaacacuuuuuauuuuuagagaugggucucacucuguuguccaggcuggagugcccuggcacaauuauaacucacuguagccuugaacuccugggcuuaagggauccucagccuccugaguagcugggaccacaggcgcccaccaccaugcccagaugacuuucuuaguuuuuguuucuguauacgugagguuucaccauauugcccaggcuggucuuaaaccccugcccucaagcaguccuccugccuuugugucccaaagguuaggauuacaaguaugagccaucaugccuuaacuacuacuuuuuuuuguuuguuuguuugagauggagucucauucuuucacccaggcuggaaugcgguggcgugaucucggcucacugcaaccuccacuuucaggguucaagugauucuccugccucagccuccgaaguagcugggauuacaggugcacaccaccacgccuggcuaauuuuuguguuuucaguggagucgggguuucuccauguuggucaggcuggucucgaacuccugaccucgugauccaccugccucagccucccaaagugcugggauuauagucaaaccacuucuuaaccaguuaguggguauauaucuucuugaaucaucugugccaguauucucccaaaauaaaacuugauuuaaaauggaauggaagugaaauuaugaaagugccuggcuucaugauguuacacccaauucagagaaguuugggcccggccuuccuuuuuuauuccuuuuuuuuauuuuguagagauggggucuugccauguugcucaggcuggucuucgauuccuggccucaagcgauccuccugccucagcuucccaaaguguugggauuacgggugugagccaccaugcccagccugcccagccuucuugaaaacaugaccuccacuggcucaaugaccuuaaacaagcguaugccaccucuauauccauagucuaggaauaaugacauggguuuucagcugguauuggguuaaaugagaauaugcauggcacauaaagguucacaugcuaguggcuaacuuagcuuguuuuuuucaguuuuuuuuuaagagacaggaucucacugugucacccaggcuggaaugcaguggcacagucauggcuuacugcagccuugaaccccugagcucaagcaauccuccugccuuagccuccugaguggcuggcacaugccaccaugcccaaguuaauccuuaaaaaauuuuuuagaaggcugggcgcgguggcucacgucuguaaucccagcacuuugggaggcugagaugggcagaucaccugaggucaggaguuugagaccagccuggccaacguggcgaaaccccaucucuacuaaaaauacaaaaaaauuagccagguaugguggcaggugccuguaaucgcagcuacucgggaggcugaggcaggauaaucgcuugaacccaggagccgagauugcaccguugcacuccagccugggcaacaggagcgaaacucugucucagaaaaaaaaaaaauuuuuuuuuuuagagaugagggucuugcuuuguugcccaggcuggucuugaacuccuggacugaagcaauccucugcguuggccucccaaagggcugagauuacaggcgugagccacagggcccggccauuauuccucaagaguucuuaaaaguggaugcugcaggaguuaacugccaggaagcaggaauuccugcuaaggucugcugcuugccaaagccuuucccuucaacagggguugccaguaggccacuggcucaggggcucuguuggcccugugcaaauauuuuguuuggcugaauuggaauaccauuaggugagccuuacaauccaccacugacccuggguuccacauuucuuuacacucagauugcuucacuguaggcauuggaguuuuggaggacugcuuuugaccaugugguagacauugaaauuguaguuuauaugacucacuccacagacuuuuuuuuuuuuuuuuacauuuugaaaauauuucauuaaaugaaaaauaaacaugguauccaacaguacuugaaacuuagauuuuuuuuuuuuuuuaauugaggcagggucuugcucuguggcccaggcuagagugcaauggugugaucucagcucacugcagccuccgcuucccggguuuaagcaauucuccugucucagcuucccaaguagcugggauuacaggugugcaccaccacgcccagcuaauuuuucuuuuucccccucgaggcugagccuugcucugucgcccaggcuggagugcaguggccgugaucucggcucacugcaaccuccaccucccgaguucaagcaauucuccuacuucagugucccaaguagcugggauuacaggcgcccgccaccaagcccagguaauuuuuguauuuuuauuagagacuggguuuugccauguugaccaggcugguuucaaacucuugaucucaagugauccacuuaucuuagccucccaaaaugcugggauuacagguaugaugguguccagccgguucauuguuuuuauuuuauuuuauuuuauuuuauuuuauuuuauuuuauuuuauuuuauuuuauuuuugagacagagucuugugcugucgcccaggcuggagugcaguggugcgaacuuggcucacugcaaccucccccucccggguucaagugauucuccugccuuagccuccugaguagcugggauuacaggcaugugccaccacgcccggcuaacuuuuucuuauuuuuaguagaaaccgggguuuaccguguuggccaggcugguguugaacuccuggacucaagugauucgccugccucagccccgcaaaguguugggauuacaggcaugagccaccgugccuggccuuuuaauucauucuuaagccugcucucagacagcuaggcuugcuucuccacaauaaagaguguugaauuuugucgguguaucccgcauggugccauuauaacacugaaauuagugauuauuucagggucuguuaccagagcgugucugccguauucacuguaucugcagcuuggagcacaguagacucaaaugcuugcaugccagcucuuccccuguacagccuggauuaacacugaugcuagcagacuccuuugcacaacugauuagcuuucguaacuaccacagcuuucuuacugcuagucauucugugaugggauuaagcuaggucuugaacuccuuaacuccaguuccuuggcuacuacugaguacauacugaauaaggcaaaauugacuuaccucuuuuguuuugcuccccugugguagaauucuagggguacagacugcuggguuucaaaugccgcccuacuugccagccguauggcuaaguuauugaacuucuuggugccuugguguuucaucuauaaaaaggggguggggcugccugcucgacagggguguuaggaagacugagcuuaucaguacagauauguugagagcagcaccuguccaaagcccuucaucacugguuauuacgugguacuguguguacaguggggaugcuguggguuugguuccagaccacugcaguaaagugaaucuagcaagaaagugagucacacacacauuuugguuuccuaguauguguaaaaguuauuagacuaggccgugugcaguggcucaugccuguaaucccagcaguuugggaggccaaggcaggaggaucgcuugagccaaggaguucaagacuagucugggcaacauaggaagaccccccccaucucaaaaaaaaaaauaaagccaaaagugguggcaugcaccuggggucccagcuacucgggaggcagaggugggaggaucacuugaacccaugaggucgaggcugcaguuugccaugauugugccacugcacuccagccugggugaaggagugagacucugucucaaaaaaaaaaaaaaaucagcugggcgugguggcucacgccuguaaucccagcacuuugggaggccaaggugggcagaucacgaggucaggagaucgagaccauccuggcuaacacggugaaaccccgucucuacuaaaaauacaaaaaaaauuagccaggcaugguggcacacgccuauagucccagcuccaugggaggcugaggcaggaaaauugcuugaacuugggaggcggagguugcagugagccgagaucaugccacugaacuccagccugggcaacagagcgagacuccgucucaaaaaaaaaaaaaaaaucaucugagucuucagcgauucauaaucuuuuugcagguggagggucuugccucaaacuugccggcuuaaaggacauacauuuauuaccuuaugcaggucagaaaucugauguggguuucaccggaugaaaaucaagguguaagcaggcugcauuccuuucugggggcuccaggggagaaucuguuuccuauuuugggguguuggcagaaggugguaguuguaagacucaggucccauuuucuucacugguucuaaacugagggucguugcccgcuucuggaggcggucucaucccucggcucaugcccccuuccucuaccuuuaaagucagcauuugcggguugcaucucucucugacccguccuccaacguugcccgcucucugcagcuagaaagguucuguguucuuaagggcugaagugauuagauugggcccaccccagauaauccaggauaaucuccccaucucaaggucuguauucuuaguuacaucugcaaaaucgcuuuggccacguaaaguaauauauucacagguuccagggauuagggcaugaacauuuuucgguggguccacucuuuuugagauggagucucgcucugucacccaggcuggagugcaguggcaugaucucggcucacugcaacuucugcuuccuggguucaaaugauucuugugccucagccucuugaguagcugggauuacaggcgugagccaccaagcccgguuaauuuuuguauuuuuaguagagaugggguuuugccauguuucccaggcuggucuugaacuccugagcucaggugaucuacccgcuucagccucccaaagugcugggauuacaggcaugagccacugugcccagugggucuacucuuuugccuacugcggaugccuucuugggcagcccugcuccagcugccaugcagccggccugaagaagcugguuugacagagacuuguaacuugucuugcaugguccacuauauuuuauuuuuagagacaaggucuugcugugucacccaggcuggaaugcagcggcacaauuauagcucacugggcucuagugauccuccugccucagucuccugaguagcuaggaccacaggugcaugcugccacaccaagcuaauuacuauuuuuuguuuaggcagggucucugcuguguugcccaggcuggucuugaauuccugagcucuauugauccucccgcuuuggcuucccgaguagcuaggccuauaggcacaugcuagcacacccagcuaauuacuaauuacuauuuuuuguagagacagggucucgcuguguugcucaggcuggucuugaauuccugggcucuagugauccucccgccucagccuccugaguagcuaagacuauaggugcaugccaccacacccagcuaauuacuauuuuuuguagagacagguucucgcuguguugcccaggcuggucucaaauuccugggcucuagugauccuuccgccucggccuccugagcagcuaggaguacaggugcgugcugucauacccagcuaauuacuguuuucucguagagacagggucucacuguauugcccaggcuggucacaaauuccugagcucuagugauccucccgccucugccucccgaguagcuaagacuauaggugcaugcuaccacagccagcuaauuauucuuucuuguagagacagggucucgcucuguugcccaggcuagucucgaauuccugggcucaagugaucuuccuguccuggcuucccgaguguagagauuacaggcaugagccacugcgcccagccauggucugcuguauuucagacgagcauuucuggcguagagguguuagaguaaucuaacauuuuauaauuucuuccuauccaaucuauacuagauaccucugcuggguuaguuuucuuaacacggcucugaugucauugguucuacuuccccuugacugcuuugguguuuguuaacuauggaacaagauggauaagugugaugcuuuugcccucccuccgacuguccccagccaccucucuggaggugccuuucccucccuguauguggccagucucacguuuguuucuuguguguuuccagaaccagccacuucucaauggugccccuguuugagcagcuuccugugcccgguucacacagagcugucaacuucuuccugaggcuguuauacccuuucucuugggaaucccgcaggcgugagcuguauuugccuuauuccucugugguuguuuauauauaucuuuuuuuuuuuuuuuuuuuuugagacggaguuucacucuuguuguccaggcuggagugcaaugacgugaccuuggcucaccgcagccuccaccucccggguucaagcgauucuccugccucagccuccugaguagcugggauuauaggcaugugccaccaugccuggcugauucuggauuuuuaguaaagacgaaguuucuucauguuggucaggcuggucucgaacuccugaccucaggugauccgcccgccucggccucccaaagugcugggauuacaggcaugagccaccgugccuggccagcuguuuauauauaucuuaucuccccucugcagaggguucaucucugagggaagcacuaggaaggaaucauagggucucaggcugggcacuaagccggcauucugaguccucugcuccguccuucacggcugucugcgacccuccuggcuucagcaggugugaucggugucaucacaguuuuaccagggaagggaugucgcuaaaguuacccucccgccagcuccucacugccugccugggaucccaccugccacucuggggccaggcagguuaaauccaguuucuacuggaugaaacauucuagggguuuugaagguuucucuauucucuuugccaggcuaaauaucccaguucauaugagggguugaaagaaagcagacccauucugcaaggacaccuuggucuccgcaaucaguugaaccuuguccuucacaccccaggcaaccucgggaucaggggacuggcuggcuuggucgagguagaagccauguccuuccaguuuucucagcggcgugacugagaagucaaguguaacgcuauuaccacagcgugugugccucuggcuggaaguaccaguuucuguagcccuccugacuuaaggcucuccuuggaccccaguugcuacaaggguagaaugacuuuugccuggaagagguuccuugugcuccuggaaauccugaugucaaagcaucuuuuuuuuuuuuuuuuuuucuuuugagacagggucuuguucuguugcccaggcugaacaggcuggauugcagugguaccaucauaacucacugcagccucaaccucccaggcucaagcgauccucccaccucagccucccaaguagcugguaccacaggugcacacuaaccacacccagcuaauuuuuacauuuuuuuuguagagaugggaucucucaguguagcccaggcuggucucaaacuccugaccucaagugauccuccugccuuggccucccaaggugcugggauuacaggcaugagccacugcgucuugccuggccuuguagcaccuugaguccaagugauacaguauauauaauauacagucuauauuaccacuguguuuguagggugcuaagugucucuucuacagagcagucuuuuuuuuuuuuuuuugagacagaguuuugcucuguugcccaggcuggagugcaguggcaugaucuuggcucacugcaagcuucaccucccggguucacgccauucuucugccucagccuccugaguagcugggacuacaggcgcccaccaccacgccuggcuaauuuuuuguauuuuuaguagaggcgggguuucacuguguuagccaggauggucuccaucuccugaccucaugauccgcccaccucagccuuccaaagugcugggauuacaggcgugagccaccgugcccggcccuacagaauggucuuuccuaaccacacagcaagucaggaagucccugccuagugacaccuacaucuaaucacuuagcucuuugccuggagcagggccuggcauucagcaggugcucauaugugagcggcgcugguggggaaucagggcccgcaugacccagagcagcuguuguaagacauggguccagcaaagcauuccucaugcugcugccugcacuuacccucuaggaaggccagccuggaggagccacuucugcccuucaggcaaaugauaacugagcaccugucugugcgggugcuagguggaaagguccagagauggcaguggccuggucccugccuggggcaccuucucuccaccaacagacacuuacccagcugguuaggccuguucucaccccgcagucuguaguuagcacccaggcugggaacaacagccuguguuccucucccuuuccuugguaccuucucuucuuguuccuuuauuuuuuucugaagagauaggaucgcccuauguuguccaggcuggacucgaacuccugcccacaagccauccucccaccacagccuccugaguagcugggguuacaggcacgcagcaccgcggcacugcaccggcuauuguucuuuuauuuuuuucccucuuugucccugaaagagucaagcuacuaauugucaguaaucaaaucagaccacgauuucccaggcaaacuccuggcaguucuacauuuaggaaugacuagcuagagacauccugaagaaugaguuauucggggaggcgccagccaccuccucuaacuucaccucuaucugcccucuguguggguaccccuugcuucccuggaugcuugacucccccauuucauccucaaaaugccaccaccccccaccaggccuuuaggaacaucagcuggcuguuccccacaguguccuguggcccugggcuacucauucugacacuggccauacuguggcacaccuuguuaugggcuguugucagacccaacuggagaaagaccagcuguaggucauuucccuuacgggagugccccaacuauaugaccugcccccucuuuccugguaucuuuuugagucagggucucacucugucuccuagauuggagugcagugaugcaaucacggcucacuguggccucgaccucccaggcucaggugaucuuccuuccucagccucccaaguaacugggaccacaagcacaugccaccaaacccaguuauuuuuauuuuauuuuauuuuauuuuauuuugagacagaguuucacucuuguugcccaggcuagagugcaauggugugaccagcucacugcaaccucugccucccggguucaagugauucuccugccucagccucccaaguugcugggauuacagccacccaccaccacgccuggcuaauuuuuguauuuuuaguagagaugggguuucgccauguuggccaggcuggucucaaacccuugaccucagguaauccacccaccuuggcccucagguaauccacccaacugcugcuguauguugggauuccaggcaucagccaccacgcccagccacuaauuuuuguauuuuuguagagauggaguuucgccauguuucccaggcuggucugaacgccugggcucaagugauccgcucgccuuggccucccaaagugcugggauuauaagcgugagccaccaugccuggucucugguaccuuuuaaaauauacaggcugggcaugauggcucaugccuguaaucccagcacuuugggaggcugaggcagguggaucgccugaggucgggaguucgaaaccagccugaccaacacggagaaacccugucucugcuaaaaauauaaaauuagcugggugugguggugcaugccuguaaucccagcuacucgggaggcugagccaggagaaucgcuugaaccugggagucggagguugagcugagaucacaccauugcacuccagccugggcaacaagagcaaaacccuaucucaaaaaaaaaaaauauauauauauauacacacguauauauacguguauauauauauacacacacauauguauacauauauacguauguauacacauauauacguauauauacacauauauauguauauauacacacauauacguguauauauauacguguauauauauaugcaugccagacauggugacucaugccuguaauccuagcacuucaggagacugaggcaggcggaucacuugaggucaggaaucuaagaccagcuuaaccaacauggugaaacccugucucuacucaaaauacaaaaaauuaacgaggcugguggcaccuauaaucccagcuacuugggaggcugaggugagagaaucacuugaacccagaaggugaggguugcagugagcugagaucgcaccacugcacuccagccugggcaacagagcgagacuccaugucugucugucugucuaucuaucuguauaauguauauguauguauguauauauguguguguauauauauacacauauauacauacauauauacacacauacucuguuacagagcugcuguguguguguguauauauauauacacauauguauauauacacauauacacauauauauguauauauauacacacauauauauacacauauauauguauauauauacacacauauauauacacauauauauguauauauauacacacauauauauacacauauauauguauauauauacacauauauauguauauauauacacacacacacacauacacauaauuguguuacagagcugcuauguaaucucacaaucaucagaaaaaugacccccaaaaggggaaccuuguucagaucagaugacuucuuagcauuaggcauuccaguaggacacucuagacucuugcggggagacaaaagccagcuuaguuuuuucuaacacucauauguuaaacuuguuuguguccaaaacuucuuuagaacugugauauucuuacaggcaaaugaaguugcuuaacaaguguuuguauuuucuccccuauuucuuccucccaggcucaaagauuuggaaagagacagcuuaacagaaaagguaaucuccaccuuaaaauuuuucuuauuaccaaaucugacugacacacuuuguggcucauaaaaagaaauuuguuuucuuuaaauggauuuugcauuuuuucccauggaguuucaaagauaauuuggauauucuuguuaaaugucagcacuaauuugcugcuaauaguugggugguggugguguuuuuuuuuguuguuguuuuuguuuuuugagacagagucucacucugucacccaggcuagagugcaauggcaugaucucggcucacugugaccucugccucccggauucaagcuguucuccugccucagccucccaaguagcugggacuacaggcacgcaccaccaugcccagcuaauuuuuauauuauuaguagagaugggguuucaccauguuggccagacuggucuugaacgccugcucgugaucugcccaccuuggccucccaaagugcuggaauuacaggcgugagccaccaugccuggcccagguuuuuuuuuuuuuuaaccaaucucaguuccuaaacaaucuacucuggauuguaacuuguccugguaacacuguuuuauuguguuuuuguuauuguuuugagauagggucucauucuguagcccaggcuggagugcaguggcacaauuuuggcucacugcaaccuucgccucccaggcucaagugauuuucccacucagccuccugaguagcucuaacuacaggcucaagccaccaugcccagcuaauuuuuaaauauuuuuuguaaagaugggauuuugucauguugccccaggcuggucuugaacucuggggcucaaagcaauccacuugccucggccucccaaagugcugggauuauaggugugagccacugugccuggccgacacuuuacagaagcacaguauuauucuuauaaaccaugauaugucuccaucucaccuccagcuuucccauuuuucaccacuuuggagacaggagugaagugauccuaauggaaauucccugaacacauuucaugacuguuuaguguuuugacugagacagcauugccugccauucacucauugugaugugaucaggcagcucaauaauuuguguauuaguccacuagugaauagcuugggaauguggguacugcuaaaccuauauccuucccuuaggaaugugugaaggagaaauugaaucucuugcacgaauuucugcaaacagaaauaaagaaucaguuaugugacuuggaaaccaaauuacguaaagaagaauuauccgagguaagucaguucucagcauccuagccucuagaaaaaugucuccuccuaguaacuugucugugaccagggaggcagcaagauccccagcuguccucauugccugaugaugaugaugaugaugaugaugaugaaggaaacacauguguuuccuuguucucugacacuuguuuacauucacugcuacuuaaauuauccuuuccugcuguaggagggcuaccuggcuaaagucaaaucccuuuuaaauaaagauuuguccuuggagaacggugcucaugcuuacaaccgggaagugaauggacgucuagaaaacgggaaccaagcaagaagugaagcccguagagugggaauggcagaugccaacagcccccccaaaccccuuuccaaaccucgcacgcccaggaggagcaaguccgauggagaggcuaagcguaagagcagaugauuccuuuuauuuuuaauuguuuuugagauggagucucacuguguugcccagucuggagcacagugguguaaccucggcucacuguaaccucugccucccagguucaagagacccuccugccucagccucccaaguaacugggauuagagguaugugccaccacacccagcuaauuuuuguauuuaguagagauggggucuuaccauguuggccaggcugguccagaacuccugaccucaaguaauccaccugccuuggccucccaaagugcugggauuacaggcauaagccaccacgccuggcccugcuuaacucucuuucuuucuuucuuuuuuuuuuuuuuuuaaugacagagucuugcucuaucgcccaggauagagugcaauggcgcgaucucggcucacugcaaccuccgccucccaguuucaagcgauucuccugccucagccucccaaguagcuaguauuacaggcgggcaccaccaugcccagcuaaucuuuguauuuuuaguagagaugggguuucaccauguuggccagacuggucuggaacuccugaccucaagugguccucccgccuuagcuucccaaagugcugggauuacaggugugagccaccgugcccggccccacuuggcucauuuucaaccuagaagcaggcuuugguagcauauaagggggcaguuaaacuuggaccccaggucaguguguccagguuccuuucuuuuguacgcauccucacuaguaauuacuggacacuuccuaacuagcuuagauguguacgucuuuaaauuuugucuuagcugggggugugguggcucaugccuguaaucccugcacuuuggguggccaagguggcuggaucaccugaggucaggaguucgagaccacccugcccaacauggcaaaacccugucucuacugaaaauacaaaaaauuugccagacgugguggcgggugucuguaauuccagccugggcaacaagaguaagacacugucucaaaaaaaaaaaaauguuguuuucgaccaaguugcagcauuagaucccaaaacauggcuaugagugugacagguugcagaugacaagugcuacaaauacuuacuccuucuaagaccuuauaugccugguuaaacauuuauucucagacucuugcccaguuuuaggcaaaggaacucuaauggaaauuuuuuuuuuuuuuuuuuuuuuuugagauggagucuuguugucucccaggcugaagugcaguggcgcaaucucggcucacugcaagcucugccucccagguucaugccauucuuuugccucagccucccgaguagcugggacuacaggcgcccgccaccaugcccggcuaauuuuuuuuguauuuuuuaguagagacgggauuucaccauauuagccaggaugauuucgaucuccugaccucaugauccgcccgccucggccucccaaagugcugggauuacaggcgugagccaccgcgcccagccucuucuggaauuuuuuaaaaaacaaacaauaggauaguacuugagcucaggucugguucucagcuacuucauuuuuauuuuguuuuauuuuauuauuauuuuugagagagaaucucgcucuguugcccaguggcacgaucucggcucacugcaagcuccaccucccagguucaugccauucuccugccucagccucccaaguagcugggacuacaggcgcacaccacgccuggauaauuuuuuguauuuuuaguaggaugggguuucacuguguuagccaggauggucucaauaucccgaccucgugauccaccugccucggccucccaaaguguugggauuacaggcgugagccaccaugcccagccuuauuuuauuuucuuuuaauuuuuauuuuauuuuuugagauggaggcaugcgccaccacgcccaguuaauuuuuguauuuuuaguagagacaggguuucaccauguuggccaagguggucucgaacuccugaccucaggugauccaccugccuuggccucccaaagugcugagauuacagguguaagccaccucaccuggcccuuuauuuuauuuuuuuuugagauggagucuuacucuguugccaggcuggagugcaguggcacaaucucggcucaccacaaccuccaccuccuggguucaagugauuuuuuugccucagccuccugaggagcugggacuacaggcacgugccaccacgcccagcuaauuuuuguauuuuuaauagagacgggguuucaccauguuggccaggauggucucgaucucuugaccuugugaucugcccgucuugccucccaaagugcugggauuacaggcaugagccacugcaccuggccuauuucuuuuuuuucuuucuuucuuuucuuuuuuuuuuuuuuuuaagagacagggucuugcucugucgccaaggcuguguacaguggcgcgaucuuggcucacggcaacccccaucuccuggguucaagugauucuugugccucagccucuugaauagcugggauuauagguguguaccaccacgcccagcuaauuuuuuuguauuuuuaguagagauggggguuugccauguuguccaggcuguucucgaauaccugagcuuggauuauuuucccaccucagccucucaaaguuuugguauuauagaugugagccacugugccuggcccacuucaucuuuugauauuuuaacaagaggcucuguuuccuggccuucuuuagcauuuggccccucaaauaacugacaugauauggcucaacaaacuggcaggugcuaacugccaacauuagcaagcugguuguugacuagaauaaaaaugcaaagaugcuuaguccuuagaaccuggcuuccugcaauagcuuaguaauguugaacugcauuauugcugugggcuuucuauugauaguggcuuuuuuuuuucuuuuuaaugcuuuuucuucuuuaaacagcugaaccuucaccuagccccaggauuacaaggaaaagcaccaggcaaaccaccaucacaucucauuuugcaaaggggucaguauacgauaaauuggcggcugccuuuuuuaggggccggcuguuuugggauggaauugguagggcgucacguggcaauucugucuuccguguuguauagguuuucaucuugcgguucuguucucuagacauuuaugaauagcauuucugaaaacguuaccuguuuuuacucauauaggaaaguucaaauguacacaaaaucaugaguuuuguauaaugaacccugaaauacccaucaucuagugccaacaguuaucaaguuacagccguuguuucaucuauacccccauauugugugucccugccccaccuggauuacuuuguccauauauaguuuaguauauuucuagacaaugagaucucuuuugacaacuuuuuaaaaaauuacucauauuuuacaauaauugcuaacauuuagcagucuuuuuuuuuugagacagcaucuggcugucacccaggcuggagugcaguggcacgaucucggcucacugcaaccucugccucccggguucaagugauucuccugccucagccuccugaguaucugggauuacaggcgcgcgccgccacgccuggcuaauuuuuguauuuuuaguagaggugggguuucacuauguuggccagacuggucucaaacuccugaccucaggugaucugcccacuucaaccucccaaagugcugggguuacaggcgugagccaccgugcccagccaaaacagucuuuuuaacaaaccaaaguauaauacuguucugaugucuuuauaaaaauguaagaauucccugcuaucagauauauaguugguauuuacguuuuucccuuuguggugaacaagccguguggcaaacagacagcguuugguugacuuguuccuuaaaguuauagauuccuucccuccuauuuuacuuaaaauuccucacagauuuuaaauuccuucaucucuuaucuucuugccauuuacuugaagaaauucauuuguccaauaguuccuagauugggccgauugcauccuugugguguuccacagguccccuugccuucuguucccuauaaacugauaggauuacaggacugaucagauuccagcuuuuuauuuuuugagacugacuuuuuuuuuuuuuugauacggagucuugcucuguagcccaggcuggagugcaguggcaugauuucggcucacugcaaccuccaccucccagguucaagcgauucuccugccucagccuccugaguagcugggauuacaagugcccgccacaaccccuggcuaauguuuguauuuuugguagagacaggguuuuaccacguuggccaggcuggucugaaacuccugaacucaggugauccucaugccuuggacucccaaagugcugggauuauaggcgugagccacugcaccuggucugaggcugacuuuauggauggugcugugucccuccaucagaaaggugugugaggucucuucucugacacuagcagcuguugaucgguguuuagacccgugauuucuuaggacuuacaagauggcaagacaacauucuaaacccgucauucagagaaacauuaaacuugaagccucuuucaacauccuggugaaugaggguccacuucaggccagcuggaggccuagggucuuguuccacuaaugguuggccucacugugugugacagcccugccaaacggaaaccucaggaagagucugaaagagccaaaucggaugaguccaucaaggaagaagacaaagaccagguagggccagugcuuucauuuccugacucuaccuuaacuugguguauuugaugauugugacuucauauguguucuguccaaguaaauaaaaacccugucuagggcucuauuuagggcucuccagagagacaggaccaauagaauguauauguguguauacagcuauagguacauauauacauaugcacguguauguauauauauauaauucguuugauuuuuuucuuguuuuuauggguacauaguuggaauauauauuuauggggagagacuuuauuuugagaaauuggcucacaagauugugaaagccagcaaauuugaaaucugcagggcaggcuggagguccaggggagaaaugaugucauagcucaaguggcaaggcagucuuacauacauacauguuauauauauguguguguguguguguguguguguguguguguguguguguguguauguauguauguauuuagacuucuuuuuuugagacuuuuuuuuuuuuuugagacaggguuuugcucuuguggcacaaucuugguucauugcaaccucagccucccggguucaagugauucuccugcuucagccucccgaguagcugggacuacaggcgcgugccaccacgcccggcuaauuuuuguauuuuaguagggaugggguuucaccauguugcccaggcuggucucccauguugcccaggcuggucucgaacuccuugagcuuaggcaaucugcccgccucagccucccaaagugccaggauuauaggugugagccaccgugcccagccaauuuguuuuuuuuguuguuguuguuguuguuuuuaauuuuuuuuagauggagucucacucuuucacucaggauggagugcaguggcacgaucucagcucacugcaaccuccgccuccuggguucaagugacucuccauccucagcuuccugaguagcugagacuacaaggcaugugccaucauacccagcuaauuuuuauauuuuuaguagagaugggauuucacuguguuggccaggcuggucuugaacuccugaccucaagugauccacccgcuucagccucccaaaguguugggauuacaguucugucuuuuuucuuuucuuuucuuuucuuugagacaggucucauucugucaccaggcuggggugcaguggcgcagucauggcucacugcagccucaaccuccugggcuuaagcgauccucccaccucacccucccaagcagcugggacuacaggcgcaugccaaugagcuaaguuuuguauuuuuuguagagaugagguuucccauguugcccagacuggucucuaacaaauaaauuaaacaaauuccugacacaagauggagaaucuuugauucuuuuacauaguaucaccaggcgaucucuagugaugggcagugugccugccuacuucucggaccugcuuuuguuuugggguugguggggauuaauaccagaguaagaguuucucagaucuucuccccaaaacccaggccccuucuuuucccacucuugcucuaaccaugucaaauguguuaauauuucaacucacacuuuugguguugaccuucccuugaaaccaguauucuaaucuuuuuuguucuuccuucccuccacacaggaugagaagagacguagaguuacauccagagaacgguaagaauaguuacuauaccuuucuuuuuguucuacgaguuguguaaucuugaucacaaaacuuuuucagaaaguuuaaggccgggcacggugacucaugccuguaaucucagcacuuugggaggccaagaugggcgaaucacuugaggucaggaguucaagaccagccugaccaacauggcgaaaccccgucucuacuaaaaauucaaaacuuagcugggcgugguggaaugugccuuuaaucccagcuacucaggaggcugagucagaaggauugcuugaacccaggagguagaggcugcagugaucugagaucauuccacugcacuccagccugagugacagagcaagacuccaucucaaaaaaaaaaaaaaaaguuuaaaaagaagaacuuuaucguguguuuccauggcaaccauaucguuaugaaguaucugaauuuggggucagaucauuagcguuuagauucaaguagaauucuccuguuuucuuggaaggaaugaaucgagggcagcuggcauucgaaccagguguaaaagucauaucaaauacuaaauguuaaaugaguaugugucugucagggcuccugagauaaugaagauugcuuuugggggaaagaggagcuuuaugaaaacugcuucuuuggggaagcuccuggcacucacacuuggggucuguguuauuuugcuugacagaguugcuagaccgcuuccugcagaagaaccugaaagagcaaaaucaggaacgcgcacugaaaaggaagaagaaagagaugaaaaaguaaagcucuaucaccucuaaguuuguuaauucucccuuaauccuauauggucccaauuuccuuccaggacguggggacaggggguggggaacguggaagaacaagauggguuuugcuagugaucgaaaugccuuugacuuuggcuaaacaccuuucaaacuuguuuucucguggucucuacaugaaagguggguuaugagauugugauagugaggacccuugcuacuuauuugugauauuuuauuuuauuuuauuuauuuauuuauuuuugagacagucucccacucugucacccaggcuggaaugaguacagaggugcgaucucggcucguugcaaccucugccucccagguucaagugauucucaugucccagccucuugagucacugggacuacaggcgcccgccgccauacucggcuaauuuuaguggagaugggguuucacuguguuggccaggcugaucuugaacuccugaccucgagugauccaccugccucagccaccaaagugcuaggauuacaggcaugagccaccacaccggccaaccuaugccacuuaaucaacuagucacagagcuucaguuugucaccucgccuucuugcuucucuggcugaugagaucuuugugaagaucuaauuuucagacguacgaggugcuaaaacuuuuuuuuuuuuuuuuuuugagauggagucuugcucuguugcccaggcuggaaugcaguggugugaucuugucucaccgcaaccucugccucccggguucuugugccucagccuccugaguagcugggauuacaggugccugccaccacagccagauaauuuuguauuuuuaguaaagaugggguuucuccauguugaucaggcuggucuugaacucccaaucucaggugauccaccugccuuggccucccaaagugcugggauuauaggcgugagccaccacacccggccuaaaauacuuuucaaacuuauuuuuuuguaguucucuacauggaagguggguuaugagguugucauagcgaggaucuuugcuacuuauuugugguauuuauuuaauuuaauuuaauuuuuuuuuuuugagacagucucccgcucuaucacccaggcuggagugcagaggugcgaucuuggcucauugcaaccuccgccucccagguucaaguaauucucaugucccagccucccaacuagcuggggcuacaggcgccugccaccacaccuggcuaauuuuuguguuuuuauuuauuuauuuauuuauuuauuuauuuauuuauuuauuugagacggagucucgcucugucgcccaggcugaagugcaguggcuugaucuccgcucacugcaagcuccaccuccuggguucacaccauucuccugccucagccucccgaguagcugggaccacaggcgccugccaccaugcccggcuaauuuuuuguauuuuuaguagagaagggguuucaccacguuagccaggauggucuugaucuccugaccucgugauccucccaucucggccucccaaagugcugggauuacaggcgugaaccaccgcgccuagccaauuuuuguguuuuuaguagagacgggguuucaccauguuggccaggcuggucucaaacugcugaccucgaacgguccaccugccucagccaucaaagugcugggauuacaggcacgagccaccacaccggccaaccuaugcuacuuaaaucaacuagucaguuucagucugucaccucagccaccuucucuggcugacgagaucuuggugaagaucuaauuuucagauguaggaggugcuaaaauucuuuagcaucauccagacauaaaguuguauucuccucucugaagucagaccagcucuuuccccagucccucaucuucuuuguaaaaucugagucuaagguucuaugcaauacagaugcuggguccuguuuuuuuuucuguuuguuuuguuuuuuaauaagaugacugagggccgggugugguggcucaugccuguaauucuagcauuuugggaggccgagguggguggaucgcuugagcucaggaguucagggccagccugggcaauguagugagaccccgucucugcaaaaaauacaaaaaucagcuggaugugguggagcuuacaacaggcagugugccuguaguuccagcuucucaggaggcugaggcaggaagaucacuugagcucaggaggcugaggauacagugagccaugauugucccacugcaauccagccuggaugauaaagugagacuggucuuaaaacaaacaaacaaacaaacaaaacaaacaaacaaaaaaaaaccaagaugacuagaaguuucuuaccaacuuagguaggugacgagugccuuacuugggagcuuaguaaaggauggcuguccauuggggaaucaacuaaaauguacaguaauuuuuuuuguuuuuugagacggaguuuuguucuacuugcccaggcugcagugcaguggugugaucucggcucacugcaaccucugucuccugcguucaaacaaauucuccugccuuagccucccgaguagcugggauuacaggcuuccgcuaccacgcccagcuaauuaacuuuuuguacuuuuaguagagacagggguucaccauguuggcuaggcuggucucgaacuccugaccccaggugauccacccgccucggccucccaaagugcugggauuacaggcgugagccacugcauccggccgcuguacaauaauuuuugaaccauucaguacuugagguuggucuuucuugcuuuuuuucuuuuuuuuuaauugagauggaauuuugcucuuucgcucaggcuggagugaaguggcgcaauuuuagcucacuacaaccuccacccccuggguuccagcgauucuccugccucagccucuccaguagcugggauuauaggcgcccgccaccccguccgccuaauuuuuguauuuuuaguagagacaggguuuugccguguuggccagguuggucuggaacuccugaccucaggugauccacccaccucagccucccaaaguccaggauuacaggggugaaacaccacgcccggccgaggcuggucuuucauugaucaccuuuccuacccugauccuaguuaaauuagacagcaguugcagucagugcauaccucgaauuuguuucagaacaagcaguccuaacgggcuaguucaaccaccaccuuccaaagaaggaaccuggggcaagaucgaaaucccucaccuguaagcauacucucaggauuucuucuuguaguaggaagauuugcuaagcguuuuuuuuauuuuuauuugagacggagucucacucugucgcccaggcuggagugcaguggugcgaucuccgcucacuucaagcuccgcuucccagguucacgccauucuccugccucagccucccgaguaacugggacuacaggcaccugcuaccacgccaggcuaauuuuuuuuuguauuuuuaguagagacgggguuauuuauuuauuuacuuauuuauuuuuugagacggaaucucgcucuugucgcccaggcuggagugcaguggcacgaucucgguucacugcaagcucugccucccaaguucacgccauucuccugccuccaccuccccaguagcugggacugcaggcgcccgccaacacgcccggcuaauuuuuuuuuuuuuuuuuuuuuguauuuuuaguagagacgggguuucacuguguuagccaggauggucucgaucuccugaccucgugaucugcccaucucggccucccaaagugcugggauuacaguagugagccacugugcccagcugcaaaguguuucuuaauauuccugaccuuugcgaucucuucacagacuaccacauguggaguuucugaggguuggauuugacuugccugauucucuggcaagaugugucugguucuuuaaaugcagccucaggcugggcaugguggcucacgccuguaaugccagcacuuugggagaccaaggcagacggaucacuugaauucaagaccagucuggccaacgugaugaaacccugucucuacuaaaaauacaaaaauuagcuggucaugguggugugugccuguaaacucagcuacuugggaggcugaagcaggagaauuguuugaaccugggaguuggagguuacagugagccaagaguacaccacugcacuccagccuggguaacagagugagacuccgucucauaaauaaauaaaugaauaaaugcagucucagaggauguguuguugugucucaguuggagcuacuuuucagauugggccauccuauuucauuccuuuaauaucggaaguagagauuuauaauaaaguuacuuucugugaggcuaucaacacuuaacugaugacaaguaguagaggaauuuugaaguaaaaauacugaaacugcaguguuguaguaucuccuuucuaagaguuucauuuccugucuacuuaccccacugaagaagaaaagaaaauugcugucuugaacaccuggcacaagugauccucucaccucagccuuccaaaguucugagauuacaggcaugagcuacugugcccacugguagacagucuuuacucccaccaguggacucuagaaucaguucagguguuuuauuuccauaggacacuuuaauagaaagauccaaaccaaauggaaaaaauuaacuugucuuuuuucccugcaacuuaggaagaaaagagacuccgaagucaaaccaaagaaccguaagugcagcgaaccugccuuugugcuuuguugugaaacugaauugcuaacauaaguaucuugguaaaauaacggguugguguggaacagugggcacuaaucauaugucucuuaugugggcaaguucugcuugugaaaggugagaccacccugaagugaaggcugaaguuaacuuuuuuaacuuuaauuuaauuuaauuuaauuuugagacggagucuugcugugucacccaggcuggaguacaguggugcaauccuggcucacugcaacccccaccucccgggcucaagcaauucuccugucucagccucccgaguagcugggaguaugggccuguaccaccaugcccaacuaauuuucguauuuuuaguagagacaggguuucaccauauuggucaggcuggucuugaacuccugaccuccgugacccaccugccucgccucccaaagugcugggauuacggggugaaguuagcuucgauuucuccucccaaccccagggcccuucucaggguuggucacacagcugugugucaugugguagugaaaggccaucaggugagcagcugugucacuuaccuuucacugugaaaaugcugugugacaaauggcuccaaggccagaggccuagaacagugagcauuuuucaagcucacuugucuacagcuugguggcugucggcugaucuugagguggcuuaguggggauggcugggcugacccagcucugccuccgcaauuuggccaggcuggguacacgcuuguggcugugccagaccacaagggcagaaaugaaaaguagcacuuuuucaaaccucuguugaaaaaaguugggccaggugcaguagcucgcgccuauaaucucagcacuuugagaggcugaggcggguggaucacuugaggucaggaguucaagaucagccuggccaacauggugaaaccccgucucuaauaaaaauacaaaaaauuagcugggugugguggugcaugccuguggucccagcuacuugggagacugaggcaggagaaucacuugaacccgggaggcggugguugcagugagcugagaucacaucacugcacuccaggguaggugauagagcgagacucugccucaagaaaaaaaaaaaggaaaaaagaaaaagaaaacaauuagcugaagcaaauuuugagacugagccugaauccagaggugggcagaauaccccaccugagcggcagggcccuggcagagugggaggugaagacucggaccccugugugcagucagcuguccacggucacugacugacgcugaucgcacaucagcccagcucucaaccuaggcaggccagacaugggucuuccuccaccgcaggcuggauucccaucaggccacggaaaucaugacaucccuuugucugcuuuuuguauuaaaccacuggcaucucugaccaacauucagaugggguauugaugguguuccugaagaccuugaguccuggaguaguaaaugcccucugggcuuccugcagugaagacaggagaggcagccuguccucugaaccuggggaggagcuugugucagcccuuaggagcuguuggccccggugcagggccccccccgagcugaccagccuguguguguguugucuucugugacagaacacccaaacagaaacugaaggaggagccggacagagaagccagggcaggcgugcaggcugacgaggacgaagauggagacgagaaaguaaaggcggguuauuuguuucugaacucccccucauucuucugcuccuguuugcuugggcgggagugcgcaggguggggcucuggguucaaguccagccccauccacccaggcuccauggggccauccagacucugggaaggucaccuuuuccuccuuuugggggccgggauuuguggcuggaugccugugcuggaugccuagugaacacucaguuguccucugucuuucacacuagagagggucugugugagccugggcugagaugugcaugaagcauccucuccugaggccucacugcugagaagccuugacacacagucagcucugacgcacaugucagccacaccuuugauucuuucccagccuccuacguucugagucuagcucucccccugccagccuccccagucuaguuuagccaagugcaugcguuuaaacccuaaagcaucauguggaacacugcugggccucugucaaaguacaggauggccagguugccugcaggcccuccugcaugaacucuagggaagggagcuaggucaucgguggggggcggcgggucccuaucuaagagaugccgaagaccccaagagggucucuggguuucugccuguuacaaucuagagaguggagcccaaggucacgggcuugcugggugacaagcacccucacuucugacccggucgccagugggcuuccauccccaccccauagcaggggagccuuugguauugccuccagccucccaucccucaccucuucuguccaaauguuggucaccuuacugucagcacuccuucagacuggaguagucacauuacucccugcccucuauuggaaacuggcaggggccugagcucacacugccagcacuuuugccucaugguagaaagggaugugagggcugggcaugguggcucacuacuguaaucccagcacuuugggaggcugagguggguggaucacuugaggucaggagucugagaccagccaggccaacauggugaaauccggugucaccuaaaaauauaaaaauuagccgggcaugguggcaugugccucuaaucccagcuacuugggaggcugagguaggagaaucacuugaacccaggaggcagagguugcagugagccaagauuaugccgcugcacuccagccugggcaacagagcgagacucugucucaaaaaaauaauaugguaauaauaauaaaagcagugcccagagaacaaggauuguuggcuguuccaccccagggggccccuugcacaggaggugccaucucugccucccaaagcucuaagagccacugucccccaucccaagagacagggucuugcuuugucacccaggcuggaaugcaguggugcaaucacgguucacuguagccucgaccucccaggcucaggugaucuucccgccucagccucccaaguagcugggacuauaggcaggcaccaccauguccagcuaauuuuuuuuuuuaauuuuuuguagagauaggguuuugccauguugcccaggcuggucucagucaaacuccuagacucgaguuauccaccuaucucagucccccaaaguggcggagugguaggauuacaggcaugaaccguugcauucagucuguuugguuuguucuuuuuuuuuuuuuuuuuuuuuuuuuuuuuuuuuuuuuuuuuuuuaagauagucucucucugucaugcaauggugugaucucgagucacugcaaccuccaccucccagguucaagugauucuccugucucagccuccugaguagcugggauuacaggcgugugcuacuaugccuagcuaauuuuuauauuuuuaguagagacagggauucaccauguuggccaggcuggucucuaacuccugaucucaaacaauccaccugccucagccucccaaggugcugggauuaugugugugaggcaccacgcccggcguguuuguuuguuuguuuguuuguuuguuuuugagacaggaucuugcucuguuucccaggcuagagugcaggagugcaguggugcuaucauagcucacugcagucuccuggguucaagugauccucccaccucagccucccaaguagcuggcacuacaggcaugcaccaccauggaugucuacuuuuuaaacuuauuuuuuguaagccaggcgcggugucucacgccuauaaucccagcauuuugggacacugaggugggcggaucaccugaagucaggaguuugaaaucagccugaccaacauggugaaaccccagcucuacuaaaaauacagaauuagcugggugugguggcgaaugccuguaaucccagcuacuagagaggccgaggcaggagaaucguuugaaccugagaggcagaggugagccaagaucauaccauugcacuccagccugggcaacaagagugaaucaaucucucucucucucuccauauauauguauauauuaaccauauauauaugcugcuuuuuguauuaaaccacuggcaucucugaccaacauucagaugggguauugaugguguuccugaagaccuugaguccuggaguaguaaaugcccucugggcuuccugcagugaagacaggagaggcagccuguccucugaaccuggggaggagcuugugucagcccuuaggagcuguuggccccggugcagggccccccgagcugaccagccugugucauauauauauauaguauauuuugcagagauggggucucagcauguugcccaggcuggccucgaacuccuggcaucaagcaauccuccugccuuagcuucccaaagugcuggguuuacaggcacaugccacugcacacagccuguaaauaaaguuuuauuggaacagagccacacuuucucauuuacauuuugccugugggugcuuuugugcuaccauagcagagaugaucauccugacacagaccacguggucagcaaagcugaaaauacugauccucuggcucuuacaaaaacaguuugccaagcccuggucuaggagguucuuuagugcccucuuguuaguuucagguggggaauuaagugagggaaagugaagccucgugucuacccgguagaucugcccaggccugccugucuuccagcuccacagugcugggaucccuaaccuguaacuucaguguuugcauuuuaucucacucuggcucagaaacuaauuuuuucccuucuuuaucucucuaccucccccuuauuuuucugucaggaugagaagaagcacagaagucaacccaaagaucuguaaguguuuaaaaugcuugugcuuuugugucaucuggaucaguagaaagccuguucuaggccaggugugguggcuugcaccuguaaucccagcacuuugggaggcugaggugggugaaucaccugaggucaggaguucgagaccagccuagccuggccaacaugguggaacccugucuguacuaaaaauacaaaaauuagcugggugugguggcgggugccuauaaucccagcuacucggaaggcugaggcagaacugcuagaagccaggagguggagguugcagugagccaagauugcgccacugcacuccagccuggacaagagugaaacucugucucaaaaaaaaaaaaaaaaaaaagccuguucuagaaaccuguggugauguagauguguggggacccuggggccucugaaggccucgucucgggaugacaagcuggcagugugccuauagagcucccauggguaucuugcuuucccauggggaggcauuaguuugucacuuuccgugcgaguuggcgaugugguuaguguuucuaagcugcuacuugcuguguaucuguucacccugcagagcugccaaacggaggcccgaagaaaaagaaccugaaaaaguaaauccacagauuucugaugaaaaagacgaggaugaaaagguaaaggucucacuuuucuuucuuucuuuuuuuuuuuuuuuuuuuuccccaagacgggguuucgccauguugcccaggcuggucuuaggaaaaagaagacugggcgugguggcgcacgccuguaaucccagcacuuugagaggcugaagcgggugaaucacaugaggucaggaguucaagaccagccugaccaauauggugaaacccugucucuacuaaaaauacaaaaauuaucugggcaugguggugcacgcccguagucccagcuacucgagaggcugagauaggagaaucgcuugagccugggagguggagguugcagugagccgagaucgcacuccaggcuggggacacagcaaaauuagcugggcgugguggcauaugccuguagucccagcugcuuggaagccugaggcaugagaauugcuugaacccaggaggcggagauugcugugagcugagaucgugccacuguacuccugccuggacaacagagcaagacucugucucaaaaaaaaaaaaaaaugcugggcacagcggcucacgccugucuuuucagcacuuugggaggccaaggcaggcgcaucaccugaggucaggaguuugaaaccagccuggacaacauggugaaacccugucucuacuaaaaauacaaaaauuagccaguuguggugauaggggccuguaaucccagcugcuugggaagcugaggcaggagagucacuugaacccaggagguagagguugcagugagccgagaucacaccauugcacuccaggcuggggacacagcaagacucugucucaaaaccaacaacaaaaaauacaaggacauuggucuuauuggauggggccccaccuuuauuaccucauuuaaccauaauugucucuuaaagacucuacauccaaauacagucacauagcagguuagucuuaacauaugaauuuugcaggggacaugacucggucuguauacccccucaucaauuguuugcuuaccuuuacauuuuaguauuuauuuuugagacagggucucacucuugucgaggcuggagugcagugguacagucauagcuaccauagccgcaaacuccugggcugaagcaauccucccaccugggccuucaagguagcugggacuacaggcagauggcacuacacccaguuaacuuucuauuuuuguagagacaggguuuuacuguguugcccaggcuggucuugagcuccugugcucaagcaguccucccaccugggcuucuucaagugcuggaauuacaggcaugggccacugugccuggccaguuauuuauuuauuuauuuauuuauuuauuuauuuauuuauuuacuuauguauuuguuuuuugagacagagucucgcucugccgccaggcuggaguacaguggugcgacaucggcucacugcaaccucugucucccugguucaagcuauucuccugccucagccuccugaguagcugggacuacaggcaugcgccaccgcgcccaacuaauuuuuguauuuuuaguagagacaggguuucaccaucuuggcgaggauggucucaaucucuugaucucgugauccauccgccucggucucccaaagugcugggauuacaggcgugagccaucgcgcccggcccugugccuggccaauuauuuguuuaccuugagguguccacuuacacaggaaagcuaagguuuuaaaaaauuggcuuuuccucuaaaucuuuucaggaagucuuugguuaugagauuuauuuauucauuuauuuugagauggagucucacucacucugucgcccaggcuggaaugcaguggcaugaucucugcuuacugcaaccucuacgucucggguucaagcaauucuucugccucagccuucugaguaucugagauuacaagugcccgccuggcuaaucuuuguauuuuugguagagacgugauuucgccauguuggccaggcuggucuggaacuccugaccuccagucaucugugugccuuggccucccaaagugcugggauuacaggcaugagccacugugcugggccugacuauaagauuuuguauucuaugacuuuagaugguagagugagucagagcucaccugcuggcccucucacugccucccuccccuucucucuguuuuaugauaaucacuuauacaaaguucuuaacaccgaagcacuaucuggguguaaaacacucucuuagccuuuaauccucuuuuguuuucccuguguaggaggagaagagacgcaaaacgacccccaaagaaccguaagaauuuauucuugacauuaucgaaagcagaugguaauguuaaaaugaugguucuagaacaaaagggaagggguuucaguaauugccagagcaaccuuaggcucauuuuggaucggguuggugaacauaggaccaaggugcgucaggcaggaugccccugcggugaagagccacugugaccacgcgccugggccucacugccacagccggugccucccugugccacaggcaccucaggcagaaaccucacaggggcgauuuugauauuuucugaaacaauuaaacaaacgaucuugugauuuuuuuuuuucccccagaacggagaaaaaaauggcucgcgccaaaacagucaugaacuccaagguaaacaucugccgggaauaaagccgguggcggcgcucacgaggcggcugggagcugcucucugagugccaucaucuguguuccugcucccacagacccacccucccaagugcauucagugcgggcaguaccuggacgacccugaccucaaauaugggcagcacccaccagacgcgguacguacagcucucuucccagccuuccucugccugucccuugucccacugcucaccagccccguguccuucagguggaugagccacagaugcugacaaaugagaagcuguccaucuuugaugccaacgagucuggcuuugagaguuaugaggcgcuuccccagcacaaacugaccugcuucagguaagugcacuuucgugugcauguuugcuucguggaaggaggcacauccccagaggugccugcgggcucacgauucuggugauguuuuuuagugccugaccugcaacaugucuuaagcuaacacuucguggauaagagccaccguggagggcugggcgcgguggcucaugccuguaauccuagcacuuugggaggccgaggugagcagaucacuucaggucaggaguucgagaccagccuggccaacauggcgaaaccuaccgaaaauacaaaaaguagccagguguggugguacgcgacuguaaucccaacuacucgagaggcuuaggcaggagaauuucuugaacucuggaggcggaggcugcagugagccgagguggugccacugcauuccagccugggcgacagagcaagacuccgucucaaagagccacguggaaagcugaugaagggacaauagagcuuugcugauuuuugguuugguuuuuggguuuuuacacuacacauauuaccccuccauucugcccacauccugagggucacacgcucagaugaaggccuacucugugcuagguaccagugaucuaggugucguggauguagcugcucagguccugccuucacggagccagaaaugggugauaccugucggguagugacagccacgacagauuuuaaaagccuggugacaugcagagagaauaagugggaggaggaaguucugugaagacgggagagguaaugauuuucaguaaagaccuugauggccugugagagaagaggccgaggggauggccgggguggggcacccuagguagaaggggacaccauuaccagggcucggaggggccugugccagcuguggaaggugaauggugagucugguguggugguugcuggguuggggcugggccacacagggccuugcaggccucagcacugacucuccuguccucugagggaaggugccuggcguccggcccguaccuucaccgaggcucacgucagcucuugagugggcagaggcccugugcucucaggcauccccagccccauuuugcucccucucccugcgggugcaguuacccuccagggcuucaccuuguucuucgugggaaaugccucagcuccaggaacggcccugccuccuuuuaggccugggugguauuuucccucucugugaagaggagggggaagugccuuggggaccccuguuggaagcacccccaggcagcgguuccuguacccacugggagggcacccacacguuccccgugcuuggcugaugguuguuccccucccucuccuucuaugggauccuucuaucuagaucaagaugcuguugcguccaccagcaaccgcuagccccccgaggccuggcccaaagcagggccacacaccucugccugcuggugugagugaggugugcuguggugggcagagcuggcaaccaugcccgagggccucacucuggccuucaccagggacaaaggcuugggggagccuggggcuggggcugccagaguccugagugucucagcuuccucccuaaguugagaucuaucauagauucguuccuggaggguggaugguggccuggaggacacuuuccagaagucacaugccuucuguccacuggagcuggacugccugaguuauuuaggggcucuccauacugcuguacuuggcuugaaacuggcgauagaagccagucauggguggggucuggccuaccaaccaguggguccugccccugccuggggcuuagagcuucucucccaugucuccccuauggagagagccuccagcccaccugugcagcggggagcgggacccccucuucuguaggcccucccuugauccacgcuggcuucaucucucugucucuucuucugggccuuacauccugaggcagggcugcaaccuauucugucugccaugccugguacgcaguaggggagcuccgcaggagguaugcaguguuuuguuugagccuuucuggcuuccaaggcacuaagcugggugagugugguggagggugcucuccagagaccugugcagacuucauaugggggcucugaggauagcccagcaucuuuggccgggaaagggugguccuugucuagaugagcagguuuguaagcagaacacccaguucaugucuuuuuccuugaguuugacaucuugccucucugucuucacuaaagaacgugcucccgaaugucaaggggcaucuggacaguggggccgcagguguuugagauuuaugcccaaaaggaggcagaaguccuuccuucccacaucccuuuucacacuguucuauaaccugcuuuauuuucuaaauugaggucuaacucguauaauauaaaauuaaccauaugagguaucuugaauaggugaauucauagguauagaaagcagauuggugguugccgggggcugggggcugagggccgguugggaggagacuggagagugacugcuacuugaugggaaugaggcuuuauuaacauuugagugacagaaauguucugcagcugaauagagcuaguggcugcacugcauaguagaagguguucuagaaaccgguauuucccgcacuguaagucugacugaucuuuugguguugcuguugcagacacacauacacuugaugcuuaggugggagaauaagguagaaacucugggugauagaacgcugucuuaauccaguguucccgcaaccaaaaaaugagugucggggccaggcauggugguucagccuguaaucccagcacuuugggaggcugagguggguagaucacuggagauaaagaguuugagaccagccugcuacacauagugaaaccccgucccuacuaaaaauacaacaauuagccgggcauggugguucaggccuguaaucccagcuacucgggaggcugaggcaggagaauuacuugaacccgggagguggaggcugcagugagccaagauuaugccaucgcgcuccagccugagggauagagcaagacucugucucaaaaacaaacaaaaaaagagugucagacuuguacauucucucauugccucgugccugaucugaagucugcacgaagacccgccuucacggcuuagcugguaagcaugugcuuuguuuccugucuaguguguacuguaagcacggucaccugugucccaucgacaccggccucaucgagaagaauaucgaacucuucuuuucugguucagcaaaaccaaucuaugaugaugacccaucucuugaagguaaggaauaguccgggauuauguuuggggcacacuuuaaaaacagccaggcaggguggcucacaucuguaauccuagcacuuugggggucugaggccagaggaucacuugagcccgggaguuugagacgagccuggacaacauagcaagagccugccucuauuaaaaaaaaauauauagcauauauauauaguauacauauauacuuauauauauguauaaauaaaaaacauacuuaugaagcaauagucagcuggaguugcugcugccucuuaaaguuagggugugagacuuugugccaggagcagcuguaggccaagucauugugaugacugaggagcacccgaccuggcugaugggaugucugcugagugggcgcuuagagcgccuccuggguuugggaugugagucagagccuuuaguccauuuccuuuuucugcucuaggugguguuaauggcaaaaaucuuggccccauaaaugaaugguggaucacuggcuuugauggaggugaaaaggcccucaucggcuucagcaccuguaaguguguggcccaucauaggcuggccggggucugaaaggggccuucauguucuccuuccugggggcugacggggcucuggugggaauucucagcaggcuugcagaaggccaugugacugggaaccuuagcagguucaguugggguagccucuuguguuaguuaugacuggcucuggaacugacucuccaguuguaagagcaggucuuggccggauaugguggcucacaccuguaaucccagcacuuugggaggccgaguuggggggaucauuugaggccaggaauucgagaccagccuagccuggccaacauggugaaacccccucucuaccaaaaauacaaaaauuagccacgcaugguggugcauaccuguaaucccagcuacuugggaggcuauggcaggagaaucacgugaacccagcagacagagguugcagugagccgagaucacgccacugcccuccagccugggugacggagcaagacucuguccuccccugaaaaaaaaaaaagagcaggucuuauucuugcaacccaaacccagacugaauuccaaacaccagagaugagcucaaugaaggccuacucagcuagucuucgcucucuggcuggcucagacaggcuucuucagaacaagccagcuaugauguguugugcccuauguuucugacauuuggguacgggaugacuuuuagacuguugggugaguuugguagacuccuccaugcccuguggccacuguaggcgccaucagauuccagccccuuuuccacaccuccucuguucaccccagcauuugccgaauacauucugauggaucccagucccgaguaugcgcccauauuugggcugaugcaggagaagaucuacaucagcaagauugugguggaguuccugcagagcaauuccgacucgaccuaugaggaccugaucaacaagaucgagguaagagaucgaggguccucagcauccgggauucccacuggaaacuugccuucagaaccagcagacacuguucuucaguuggauuuaggccaguuuggcuuaagcaugagagaaaccuguucucuuucaagaccacgguuccuccuucuggccucaacuugaaccgcuucacagaggacucccuccugcgacacgcgcaguuugugguggagcagguggagaguuaugacgaggccggggacagugaugagcagcccaucuuccugacacccugcaugcgggaccugaucaagcuggcuggggucacgcugggacagagguaaggaugcggcagggaccagagugaagacuggagaccggggaggguagagcauggcccacauccucugucccaguccucugagaugcuggaaccucucccguaggcgagcccaggcgaggcggcagaccaucaggcauucuaccagggagaaggacaggggacccacgaaagccaccaccaccaagcuggucuaccagaucuucgauacuuucuucgcagagcaaauugaaaaggaugacagagaagacaaggagaacgccuuuaagcgccggcgauguggcgucugugagguaaccucaccugugggugcucccgcuccccuaagguggcccagccucuggccugaucugaggacugcuccaucuuucucucuguggcuugagacucuggcugcucaaaugugaccccugagacagaaauuaguuaguggucugggaggacccugcauacuucauugaacgucaauaggacagauguccacagaggcaugcuugggugcuuugcugauaaugccacuguccuuaauugaagagccuggcuucuggguggcucugcugugccugcaucucacagucugaaggccccuguuggacugcuaaagggguauucacaucuaagugggcacuuuguccagcuuagauuugaggcccucaggaggcgucccuuucugugaguuuuuaaaauauauguuuacuucacucaggaggaacuaacuuccuaguccuaugacccaaagaccaggacuauuuugauaccuauuaccugacuuucuuuuggauaaagacuggcuucagggcuuugcuuuugauccccgcuggcaucucuuaacaggagccugcauguccucaccauuguuauuuugguuuuauuuuauuuuucuugguuaacacacguguguccaauguuuuauaacuucuaaaaucuuuuuuuuuuuuuuuuaauuuuuuugagacagucucucucugucacccaggcuagagugcaguggcaccaucucagcucaccguaaccuccgccucccggguucaaucaguucucccaccucagccucccgaguggcugggauuauaggcacccgccaccauacccggcuaauuuuuuuuguauuuuuaguagagaugggguuucaccauguuggccaggcuggucuuaaacuccugaccuuaagugaucuaccuaccucggccucccaaagugcugggauuacaggugugagccacugugcccagcccuaaaaucauuuguuuuuauuuguguaacuguuacguguugauacugguagaucuaguuauuucauuuuaaauauucuguaguauuuuguuaaaugaauauccuaacuuacuccucaaugauaggcaccucuucaguauuguaaauauguggcagcauccuugagcaaagcuucucgcgaguguaucugcuuagaaguagcguugcuggguuguggguguguauucuuaacuuugaucuagaagauugcucuccaaaaugguucuaccaacuuaccauuugagcagugugcguucuucuuuccucacaccaccuaucuggcuucuuaacccaucuggagaaugggaagggaauuuuauuucucucacuuaccauauuucuaaugagguugaauauugcuuuuuuuuuuuuuuuuuguagagacaggguccugcuguguugccuugccuggucucaaacuccuggcuucaagugguccuccugucuuggccucccaaacugccgggauuagaggcaugaggcacugcacccagccaaauaggcacauuuuuaaaagucuugguuuuguuguuguuguuguuguuguuguuguugagaugggucucguucugucacccagucuggaaugcaguggcaugauuguagcucacugcauucucaaccuacugggcucaagugaucuucccaccuuagccucccaaguagcugggaccacaggugcacgccaccaugcccagcuaauuaaaaaaaaacauuuuguagaugggauuuugccauguugccuaggcuggucuugaaugccugaacucaagcaguccucccgccuuagcauccugaguugccgggacugcaggaauuugucacacgccuggcuaauuuuaauuuuuuguagaguugggggucuuaauauguugcccaggcuggucuugaacucuuggacucaagugauccaucuaccucugcuucagccucccaauguacugguucagguaugagccaccaugcccagccuaaaagucuuaauucaccguuuguuucauuguugcuaagggcugugugacucacuuuuuuuuuuuuuuuuuaauuuuuugagaccuaaaagucuuaaugcaucauuugucucauuguuaguaagggcugugugauuugcccuuuuuuuuuccuuuuuuuuuuuuuuuuuuuuuuuuuuuuugagauggaguuuuacucuugucguccaggcuggaauaugguggugugaucuuggcuaacuguaaucuccaccucccagguucaggcaauucuccugccucagccucccaaguagcugggauuacaggcacacccuaccaugccuggcuaaucuuuguauuuuuaguagagaugggguuucaccacguuggccaggcuggucugcaauuccugaccuuaagugaucugccugccucggccuucugaaauacugggauuacaggcaugaaccacugugcccagcccugauuugccuuuuuaaugccauuuuuuaggugugucagcagccugagugugggaaauguaaagccugcaaggacaugguuaaauuugguggcaguggacggagcaagcaggcuugccaagagcggagguaggucaggccgagucuuccuccuguggcagaggacuugccagcugguggcagaugcacuguggagaagggccugcaugugugggacagcaccaggauuccuucguuaggcauugucucaggaccugucccuguuaugaagaaaacagccccgguuggucuuacuuagaaaaggggccuuagguauaaccagugacauugcaggugucccaauauggccaugaaggaggcagaugacgaugaggaagucgaugauaacaucccagagaugccgucacccaaaaaaaugcaccaggggaagaagaagaaacagaacaagaaucgcaucucuugggucggagaagccgucaagguaacccuuggagccccuuggucagcucacugccauguucccaauaagcagguugcccucuaguaucucgccaaccugaccucucaggcagccugagccccggcacuaagaaaccugucuguuugccccugagaagagcgggacuggccaagagaccauguuccauggcucaguaccagcaaggcauuuuuguguggccacaaggcucaguucuccuaaugucccaaaaugggcauuugacacaguucuaggggcaucaggcaggugagcccucauagcuuguuuuucuguuuuguuuuguuuaagauggaaucuugcucugucacccaggcuggagugcaguggcacgaucucagcucgcugcaaccucugccucccagguucaagcgauucuccugccccacccuccugaauagcugagauuacaggcgugcaccaccaugccaggcuaacuuuuuuuguauuuuuaguagagacgggguuucaucauguugcccaggccauucucgaacuccggccucaagugauccacccaccucagccucccaaagugcugggauuacaggcaggagccacugugccuggccccucauagcuuguuuccaagagagcugucacagcccccucugguguggggugggucuuuuuggggcaccaacagauggccucccauccguucuguggucauuggcuucacugaaggucaguuccuuuaccacagugugagagagaggagugaguauccucuguguugcuucucugacguccauaaauuaaagaugcaaucaguucacuuaauuaugaggcuugccaccugcuggcugccugggccguggcugagccccugcaggaggacagacauggguacugcugcauggcaugagugccucugcaggguagggggcugggaggaggcuggggccacgaggccuugcagaggugacaccugggcugagauggagaaggucagguaggaccuagccacacgaccugggggagagcugcacugagguggcagucagcuuacuuuguuggagaaaaggaaggaggccccugcagcuggaguggcuugagccaggggaugaugggcaggacaggggucaggguucaggcuguggccuuacagaccauggugagguauugugggcugugcuguuaaaaucaaauccugggacccgaguggcagagcagaagugggagggacauggaugcccuuggccacagcaucuggccaaggaagguggauguucuucuuuuuucuuauuauugaagcccuuguagaacaggauguucucuuuagcagcaacucuucauugacuucuuaaugaaaucgagucaugucuuacuuuaaguaacagaggaccaugcaagucaaggccagcaaagacccucagaaugauccuccaugaacuuaugcucucauuuucagacugaugggaagaagaguuacuauaagaaggugugcauugaugcggaaacccuggaagugggggacugugucucuguuauuccagaugauuccucaaaaccgcuguaucuagcaagguuugcaucuuucuuuuugcuugacuucugcaugcacuuucucaucaaguaggagaugccuguuuugccaaaauagcaccagcagcuuuuugcccuagaugaaaacugaaaaggacgagugcuccugcauagacuuggucacauaucugcuggccaagucagaacuuucuccccaugcccgucuucugauuccagggucacggcgcugugggaggacagcagcaacgggcagauguuucacgcccacugguucugcgcugggacagacacaguccucggggccacgucggacccucuggagcuguucuugguggaugaaugugaggacaugcagcuuucauauauccacagcaaagugaaagucaucuacaaagcccccuccgaaaacugggccauggaggugagugccuggugucccucgugagccccugccuuaucguggagggucacugcugacgugcguucuguuuuguuuugauuuguauuuuuuuuuaauuugguuuuuuuuuuguuuuuuuuuuuguuuugagacugaguuucgcucuuguugcccaggcuggagugcaauggcaugaucucagcucacugcaaccuccaccuccuggguucaagugauucuccugccucagccucccgaguaguugggauuacaggcacccaccaucacguccagcuaauuuuuuguauuuuuaguagagacgggguuucaccauguuggccaggcuggucucgaacuccugaccuuaggugauccacccgccucggccucccauagugcugggaauacaggcaugagccacugcgccuggccugacacgcauucuuaucucccaagggaggcauggaucccgagucccugcuggagggggacgacgggaagaccuacuucuaccagcugugguaugaucaagacuacgcgagauucgaguccccuccaaaaacccagccaacagaggacaacaaguucaagugagcacuggggcuggacucggggucagcaggcacuuucagcccacaucacucccuuuucccgugugcuuccgucugguuggcuuccgccaacggccccccaguuugugucucuugcucgucaaaggccagccugacuaugaaugaugcucaaguguguagauggccuggaguugcuuuaaguguguggaugaccuggcguugucuuuguaagaggguucccuacccaggaacaggguucgucuugccauuucaagacuucccguguguucuucagugugugcccagcucuugcauguuuuuggcuguuucuuagauauuuucuccuguaaaugagaccucuuauuugauucuuuucuuuccuuuuuuuuuuucuuuuuuuuuuuuugagacggagucucgcucuguugcccaggcuggagugcaguggugcgaucuuggcuuacugcaaacucagcuuccuggguucaugccauucuccugccucagccuccugaguugcugggacuacaggcgccugccaccacacccggcuaguuuuuuguauuuuuaguagagacgagguuucacuguguuagccaggauggucucgaucuccugaccuugugaucugcccgccuuggccucccaaagugcugggauuacaggcgugagccaccacaccuguccucgauucuuuuguaacugggugacugcuuugagggaagcuuuuauuuuuuauuuuauuuuauuauuauuuuuuuaauuuuuuuuuuuuuuuuuuuuuugagacagaguuucgcuuuuguugcccaggcuggagugcaguggcucaaucuuggcccaccgcaaccucuacuuccuggguucaagcgauucuccugccucagccuccugaguagcugggauuacaagcaugggccaccaugcccggcuacuuuuuuuguauuuuuaguagagaugggguuucuccauguuggucaggcuggucucgaacucccgaccucaggugaucuacccgcuucggcuucccaaagugcugggauuacaggugugagccaccgcgcccggcgagcuuuuauuuuuuaauguccaaugccccaugccuucuuuuuaaccuccguaccucacuuguuucaacuaaaagcagcagccagcacccccagaggagcagguggcaaccagggaaacccaggaggccaagagggcuccccgggggcaucugugcuucucccauaagucucgugcuagcuuuggcuugaucucuauuuucauuuuauuuuuuacuuuuuugugauggaguuucacucuugucacccaggcuggagugcaguggcacgaucucggcucacugcaaccuccaccuccuggguucaagugauucuccugccucagcuucccaaguagcugggacuacaggcgccugccaccaugcccggcuaauuuuuguauuuuuaguagagacagggcuucaccguguuggccaggcuggucuggaacuccugaccuugggucaucugcucccuucaggcuccuaaagugcugggauuacaggcaugaacuacugcacccaaccucauuuacuuauuuauuuaucacccaaccucuuuuauuuauuuauuuauuuauuuauuuauuuaucugagacagggucucccucugucacccaggcuggaaugcagugguguggucacagcucacuguagccucgaccugcugggcucaagugaucuuccugccucagccuccugaguagcugggacugcaggcaugcaccacccugccugguuaauguuuuaaaaauuuuuuguagagacggggucucacuguguuggccaggcuagucucaaacuucugggcucaagcgacccuccugccuuggccucccaaagggcugggauuacagacaugagccaccaugcugggccuugaucucuauuuuuaaggccaucuucaagucuccuuuaagggcuuacuagucaagaauaauguugaauuuccucaaauaccuguugagccuuuauggagagaacaguaggagucucugcuggauugaguuccucacugagccacucgggacuguugcucgugguguguucuuaaccauauucuagacccuguucauugauaucuuaggguuuuugucucaaugacucaaaaguugccugauuuucuugcuauguucucucugggcuuuggucucaaauaagugccuucaaaaugucaacacaaagcacaagaaagccaccucuuccuucuagcaucugcaaauguuuuuuccucuugguuaccagagucucuggauuaagcuggcaguagcugcugcggccacugccggccaccucagggccuuauguuucugucccuuuguuuccuucagauucugugugagcugugcccgucuggcugagaugaggcaaaaagaaauccccaggguccuggagcagcucgaggaccuggauagccggguccucuacuacucagccaccaagaacggcauccuguaccgaguuggugaugguguguaccugcccccugaggccuucacguucaaguaagugcccccucggagcagccggggccagggcgcuccaggcugagccaggcuggcuuuguggugucccccuccuuacagacauugccaaucccuccgcaccagcuguuguccuagccgucacguuggcauagguggcaaacagacaacauaaaucguguagacugaccaugaugcuauugcagagcaaagcugagcguaaaagucaacucgcugguuuggcugggugugguuucucacgccuguaaucccagcgcuuugggaggccgaggcaguggggaaucaucugaggucaggagucugagaccagccuggccaacauggugaaaccucgucucuacuaaaaauacaaaaauuagccgggugugguggugcgcgccuguagucccagcuacucgagaggcagagacaggagaaucacuugaaccugggaggcagagguugcagugagccaagaucaugccacugcacuccauccugggcaacagagugugacuccgucucaaaauaaaaaaagaaaaaaaaagaacuuacuggauaaagcgcgagggacagcugggggcccacccccaaguucugccucugcccaaggacaccuccucuccguccccuacugugaagugggagagugggaucuugccugcuggggcucgaaggguugagugaguugaaagugcuccauacaguaccuggcuuaaaguaaagguuuaacggacaugaguuacuucuugguuagagggaaucacaucagaugacuucucugugucagaggaucgaggcucuuccaggaaaaaccuaaagccacagaucguuuccacacugauccauucuguguuuuuucuaagaaucagcgugugguuggaauuacagccaacguuuuccagaugccuucccggcucacaauuccauuuccuuagagccccagcucccuugccuuaguucaguuacugugaauuaugagaacuggagaagcagguucccuccagccuuggcacaguuggggcgcguuacccccucugguuguccuuggugggaaggggacaccuccccguaguguuuucugccaguugcuccuggcaaagugggagagucagcacagagacgccuuuggggcccgucagacuccuggggggccuaguggggagaacgugacagcugacuucccuaacggcaggccuucuucaaagaacagcuuuuccacacuagucagaccacacucccauugucccaggcccuguggcgccuuacauuggccuccagugucgcuucuagaucagagccuuagucaggguagcguagguuguaucauagcaacaaccccaaaucacagugacuuaaaaccacagaagcuggacugggugcgguggcucaugccugucaggaguucaagaccaagaccagccuggccgacauaccugucucuacuaaaaauaaauuagccaggguuagcugggugugguggugggcaccuguaaucccagcuacuugggaggccgaggcacgagaaucgcuugaaccugggaggaggaguugcagugagccgagauugugccacugcacucuaaccugggugacagagugaaacucucucaacaaaaaccacgguagccgcugucucgcucauacgaggugcccaucacaggucagcagaggacuccaccuguugugucccuuggauaucugggccgcuggagucagaaguugccaguguuugagcccaagggaaagcacacaggacauuccccaggcagugacauccucuuuggucacuucugcccacgucacaugccaggaaacacaagaugccaaguagucgggaggcaggagccugggguauuugagcagugucagccaccaccguagccaguaaugcgcagagggugaaugcgugcuucaaacugugagacuaaaucugcagcuaaaucuuuuuuuuuuuuuucugugagauggagucuugcucugucacacaggcuggagugcaguggcacaaucucagcucacugcaaccucugccuccuggguucaagcaauucuccugccucagccucccaaguagcuggaauuauaggcauguaccaccacacccggcuaauuuuuguauuuuuaguagagacaggguuuuaccguguuggccaggguggucucgaacuucugaccuugugguccaccugccuuggucucccaaagugcugggauuacaggcgugagccacaaugcccagccuaaaucauuucuuaggguacacaccuaccuuaauucaucaggugcuugacuuuaaaugguuauuuucacuggucagucaugccugacugaccacugcaagguggaagguucauugaugucaagugggugcuucucugcagcaucaagcuguccagucccgugaaacgcccacggaaggagcccguggaugaggaccuguacccagagcacuaccggaaauacuccgacuacaucaaaggcagcaaccuggaugccccugagcccuaccgaauuggccggaucaaagagaucuucugucccaagaagagcaacggcaggcccaaugagacugacaucaaaauccgggucaacaaguucuacaggucagcagaggccucuguucuuccacgaggccacagacucuucuagaaggcucugccugaaacaagguuguggcauagcacccacaguuguucuaagaguuagguugaaguagcuguuuuuccaaguguuucugauuaucggugggcacugauaaugacuagaauucuaguucccagcccucacuuuuagguccuuauuuuaauguugcagagcccuuuuuccaaaagaaauccuuaagcuggcugggcacuguagcucacgccucuaauccuagcacuuugggaggcugaggcaggaagaucacuugagucuaggaguucaagaccagcuugaggaaacguagugagaccccggcccuaccaaaaaaaaaaaaaaaaaaagacuagcugggcgugguggcacacgccuguaaucccagcuacuugggaggcugaggcugaagggaucacugaaacccaggaauuugaggcuguagugagccaugaucccaccacugcacuccggccugggugacagccagaccccgucucaaaagaaaaaacggguagagugccugggcacccccagagaaccucccaagcuccaucuaugacuguccagguucugucccgcuguccccaccucuucccagguccuccuuucugucucugggauuuuuucucuuuccuaagcuuuuggccuauuacguuuucuuuuucuaagacccgaguaacuugcggugauuaggcauuaaccugaaacuagccuguacaggaagcuauacacuugccucaccucuuagcuaacauagaucaaagauuuccugaagccuuuguaauaacaggaaauaaaacaagggcugugagugguacaggugagagaaacacacucgagaggcugcuaccggcaggcggacacagcagggcagggccaggcgugcagagcaagcagccaagcugaccuaaugguuggggggucucuacccugugguucccuaauugggggcgaaucuaccuugcaguucccucauuuggggagggguuaucuuuaccugcgguucccuaaguaggggggucuuuacccuaugacucccuaacuggggaggucuuuacccugcgguuccauaacuggggggucuuuacccugcgguucccaacugggucgggggucauuaccuggcgguucccuaauugugggggaaucuaccuugcaguucccuaaugugaggaggggauaucuuuacccugugauucccuuacugggaggggucuuuacccugcgauucccuaacuugggggaucuuuacccugugguucccuaacuagggggggucuuuacccugcaguucccuaaaugggggggagucuaccuugcaguuccccaguguggggaggagauaucuuuacccugcaguucccuaacugagggggucuuuacccugcgguucucgaacuagggggucuuuacccugcaguucccugagcaccccaggaacaugguacuguuuaauucagcauaagcucaccacaaaggagagcuccuaacgaggccucucccgcucgcaggccugagaacacccacaaguccacuccagcgagcuaccacgcagacaucaaccugcucuacuggagcgacgaggaggccgugguggacuucaaggcugugcagggccgcugcaccguggaguauggggaggaccugcccgagugcguccagguguacuccaugggcggccccaaccgcuucuacuuccucgagguggugccccugcuugcuagagggaaggcuucggggucaaaguuggccagaaggagucugaugucggguuauacacaaggcggcuuggcugcaggguuucagcuuuuguaagaagugggugguuggcugacgugaagcuguucugcaggagcuuuacgggggucugagcaggguucuccagagcacaaguuguaugagauucaaguggucccggaguuuaacacuccugguuuuuaaaaaguacgucauuagagaaccuaacguuuuagugucuuggugcaacugaacguugaggaccaugaggcagcuuccaccagccugacuggugucuuaguaugaguuggagaaggugccccugcuccugggucccuugggccaggcgccuacguccaggcccagcccacaugccugugcggguggcccucguuauggagagggcccacgagucagcugaucaagcucaugacuuguaaauuguuggggcuuggccuuuccguguuguuaccuuaaaacgauacauccacguucucccaggcauggaugagguagcccaauuggacagcagauucugcauagcacuuuuuccuguucuagaagguacucucaagugcuuguaauaggcauuucagugucagccagaucaaauguuaguauuaauaaaauggauuguuuuaaguuucuauuguagcaaagucaaacuacucuuauugguggcuaauuggucauggccccacugagggagaaauuaagugacuaucaaauugccuucuuacuagucugcguuagagaggggacagugcguuucucucccaaacgauugcaguucucuccuuuucaggccuauaaugcaaagagcaaaagcuuugaagauccucccaaccaugcccguagcccuggaaacaaagggaagggcaagggaaaagguacgucauuguaugaguuucuuuucaaguuauucuucuguaacuuggaggcugccugugaaucccucaguguaaaaccaccucugguguuacugacucugggacagcgaggccgccugaguuaacaaggcgcuugagagcaagguggacuuggacucugaggaucggguuuagccucuggccucucucccccagggaagggcaagcccaagucccaagccugugagccgagcgagccagagauagagaucaagcugcccaagcugcggacccuggauguguuuucuggcugcgggggguugucggagggauuccaccaagcaggugagcgcccguaggcuccaucucugaauaccuggugagcccagaccgggcaggugcuaccugaaacgacuuccaaccccggucaccuuccugacucaagaaucuccuuccgaggccaggcacgguggcgcacgccuguaaucccagcacuuugggaggccgagguggguggaucaugaggucaggaguuugagaccauccuggccaacauggugaaaccccgucucuaauaagaauacaaaaauuagcugggcgugguggugugugccuguagucccagcuacucaggaggcugaggugggagaaucgcuugaaccugggaggcagagcuugcagugagccaagaucacaccacugcacuccagccugggugacagagcgagacuccaucucaaaaaaaaaaaaaaaucuucuggagaguugaaagcauggcuucgugcuugaucugccaggcaucucugacacgcugugggccaucgagaugugggacccugcggcccaggcguuccggcugaacaaccccggcuccacaguguucacagaggacugcaacauccugcugaagcuggucauggcuggggagaccaccaacucccgcggccagcggcugccccagaagggagacguggagaugcugugcggcgggccgcccugccagggcuucagcggcaugaaccgcuucaauucgcgcaccuacuccaaguucaaaaacucucuggugguuuccuuccucagguaaacggguagaagccccccaguguugccagacggcccggggcugugccgcaugucagcaguggucauuuucgcccugcacugaggccucugccccccggaagcucacagcucagcucucaccagggagagacuuugauaacauucgugaggggcuuccggcacagugggucguuucuucccucugucuguggaggugacuccugcagucucuccugcccccuacagcuacugcgacuacuaccggccccgguucuuccuccuggagaaugucaggaacuuugucuccuucaagcgcuccaugguccugaagcucacccuccgcugccugguccgcaugggcuaucagugcaccuucggcgugcugcaggugggcccuggggcuggggcgggcagacagauguggccagcacgugacccggccagcagccagccaucccuuacugaaggcaggguucaauggcauaggccugccauccaggcagcagaggcuggcauggugcucugucccacuggcggagucaggggagaugcgugcucagccggcccccagcaaguccaccgcuagugucucuugagcuguguucucgaacaugccugggagggcuggcuacaaugggcuucucgccaugcagcuccuggcuccuuucccucgauggggaagggugagcagcccaccauggagcacuguggaauggcugagucugcacagagcgggaggggaagugaggugcgcagagccauguguaggcggcagcuguucgauugguuuaaaagacaguuuugcucuggguaacugcgcacacaaacccccacagauggccgaggguugcacuccagguggcugugucugcagggacagggauggacauagucuguggggcccaggccuuaucugaaaagcaucccccauccucucuguaucagcucagcaauugagggcauaauuaaaaaugaaacagcuauccagaugcuagcacaggaugucugccuaagugggcaagcacuuggcuacccgguccccuagcucagccucagggcgacucaggcucaccagacaagacuuguugcagccacguucucuguccuugugaccacagccaucagggaagcgacagggcuccuggucuccaguguucuccccgagugcuaagaccuuggggcccuugcagugcuuucagagcuggccggacuuccccgcaggguuugcucccaccuuccccaguggcuguccccugggcucagcugcuuuuguucuuuaucugcuccaaacuccucugaccaggagcacgccugcugagguaacuggggauuucugcaagugcacuccgcauuggccagccacucccgacucaggcugcugacccugggccugggucuggccaguccaguugggagugucccacugacggugggguuguccguccuucucccccacaggccggucaguacggcguggcccagacuaggaggcgggccaucauccuggccgcggccccuggagagaagcucccucuguucccggagccacugcacguguuugcuccccgggccugccagcugagcguggugguggaugacaagaaguuugugagcaacauaaccagguagguggcccccgucgcuccuccacacacugccgagcaggccucaguagcucauggggcccgugaguacucccuggugaggcuuggggaggagaggaugguacagcaucugcccugccacacggugcucugccacauggcacucugccaccuguggucuccaguucugacccugcaucaucugcuucccuaguagauagcaugugcagagcggccagccgcaugcuuggcuguggucauccacaaagcccacgccauagccccauccccccuuccagauggcauccaggcacacugccacccaugugaccucgggcagugcugugaucucgggagaaggccaucugagcaggcaggggguggcaccugugaugaggggacagcugcugcgugcaucuccagagguguugaccuccuccucuguugcagguugagcucggguccuuuccggaccaucacggugcgagacacgauguccgaccugccggaggugcggaauggagccucggcacuggagaucuccuacaacggggagccucaguccugguuccagaggcagcuccggggcgcacaguaccagcccauccucagggaccacaucuguaagguaauggcacccugacagagcggcuccuccucgaggcccagcccagcagccucgugggaacagucagccugcccaagacucaggggagacauggaaucugaucccaggcuccuccucccgaguccucagccuuugugugaccccuggucucucuugcauggucaugggaagugucagagcucccgcaguccuggacuuggucuggaauggugucaagccacugcccacccaccacugccuucccccuugcugccucuccccgcauguuuucccaggaugccaagaccagcccuuucaccauccccuggcaccacuccccuucccccacccuaaaggcucagcuuagauucccacgcucuccuacaccugcgcugccucaggucccugccguggccucgagccaagugcgauaucccugacugucucuuucccgaugggcgugagccccagggggcuuccuggucaccaugguguucccagcucccagcccaccauggaugcucggaugcugcucacaugaggugacagcugggccccccacacucuuucaggacaugagugcauugguggcugcccgcaugcggcacauccccuuggccccagggucagacuggcgcgaucugcccaacaucgaggugcggcucucagacggcaccauggccaggaagcugcgguauacccaccaugacaggaagaacggccgcagcagcucuggggcccuccguggggucugcuccugcguggaagguggguccuguaaguugugguucccggugggcugaggggaaggaaggcagagcccugggccuuuggccugugaaccuggaggccagggcagggcacagacacaccaagccugggugucccagagaagguagcugcugaccauguugaguaguaaaagcaggcuggguucauggcccacaccuauaaucccagcacuuugggaaaccaaggcgggaggaucacuugagccugggagguugaggaggcuacagugagcugugauugugccauugcacuccagccugggagacagagugagacccugucucuaaaaagaaaaaaaaaaaacaauaaauaaauaauaaaagcaggucaggcacgauggcucaccucuguaaucccagcacuuugggaggccaaggcaggcagaucacuugagaucaggagcucgagaucagccugcccaacauggugaaaccccaucucuauuaaaacuacaaaaauuagccgggcguggugucgcacgccuauaaucccagcuauuugggaggcugaggcaggagaaucgcuugaaccccauaggcagagguugcagugagccaagaucaugccauugcacuccagccugggcaacagagcgagacauauaauacuaauaauaaaaacagugcccagagaacgaggauuguuggcugcuccaccccagggggccccuugcacaggaggugccaucucugccucccaaagcucuaagagccacugucccaagccuauaccccaucccacaacugcagccucaucacuguccugucuuccagccggcaaagccugcgaccccgcagccaggcaguucaacacccucauccccuggugccugccccacaccgggaaccggcacaaccacugggcuggccucuauggaaggcucgagugggacggcuucuucagcacaaccgucaccaaccccgagcccaugggcaagcagguagguggggagggggcauccgagggccugggucaggcccuguacuuggcggccuaacuagguggaaguguggguuuagccaagugggggacagcaccccaggaccccaggcaccuggccucugccuccugccccuccacguccacgggacaagcucauaggccaaggccauggccguaugcugucacagugccauuucccucccuguccccgacggugacccggccugggugcuacugcccucgcccaccgcgccucuuucccccagggccgcgugcuccacccagagcagcaccguguggugagcgugcgggagugugcccgcucccagggcuucccugacaccuaccggcucuucggcaacauccuggacaagcaccggcaggucaguggggcggcgcccgcugggucuggacaggaaggaggcuucugugccugucaccagguggggcuggggccagcgcagucacuuccgggaggacgccugcuggcugccggguagccccaucacucucagugggaagacggcccacaggagggacagugcugagacauccgagucaggcugcgucccuaugcugguuccuuacuguuuguuuuugaggcagagauugagccagaaggacaguccgucgcgcuaaaggagcaggcuaaaacccaugguggcgacagcucacucgcuguagguucaaaugaacuagcaccuuaauuccuaccugcuucucaggugucggguuggcuuaacaaguuagucuaugaguuagucucaguuaaguguauuuucaucauagggcacgcgcauugcuuaaaaaccaguguccacgguucuugugaaaaccacauuucaccccuccccccgaaucugguucucgggaagcagccacucucucuuuuuuuuuuuuuuuuuugagauggagcuuuguucuuucgcccaggcuggagugaaguggcgugaucucagcucaccgcaacuuccaccccccugguuuuaagugauucuccugccucagccucuugaguagcugggauuacagucaugugcuaccacacccggcuaauuuuuguauuuuuaguagagaugggguuucaccauguuggccaggcuggucccgaacucuugaccucaggugauccgccugccucggccucccaaagugcugggauuacaggcaugagccacugcgccggccagggaagcagccacucuuaacugggagcgaaacgugucuagguggcccauuugucuuuuuuuuuuuuuuuucugagacagggucucacucuguccccuaggcuggagugcagugacaugaucucugcccacugcaaccuccaccuccaggguucaagugauucuccugccucagccuccugaggugcugggauuacaggcaugugccaccaugcccagcuaauuaguuuuuguacuuuuaguagagacgggguuucaccauguuggcgaggcugcucucgaacuccuggccucaacuaauccaccugccuuggccucccaaagugcugggauuacaggcgugagccacugcucccagccccacgugucuuugucucaagucuuucugaagcucuucaaaggcccagugacuuguggcuguggggcgggaugaugggccaguuggaggguccaaggaucuugugcuggaaggguuuugggcccaugugagcaggaccagaacccuuccccaaggggugcaaugcccagguuguccuccaucugagcaggggcuggcaguacaccugcccccgggccuugggccuggguguccacaucaggcauugcccuucuccccuccugcaggugggcaaugccgugccaccgccccuggccaaagccauuggcuuggagaucaagcuuuguauguuggccaaagcccgagagagugccucagguaugguggggugggccaggcuuccucuggggccugacugcccucuggggguacaugugggggcaguugcuggccaccguuuugggcucugggacucaggcgggucaccuacccacguucguggccccaucuuucucaaggggcugcugugaggauugagugaguugcacgugucaagugcuuagagcaggcgugcugcacacagcaggccuuuggucagguuggcugcugggcuggcccuggggccguuucccucacuccugcucggugaauuuggcucagcaggcaccugccucagcugcucacuugagccucugggucuagaacccucuggggaccguuugaggaguguucagucuccgugaacguucccuuagcacucugccacuuauugggucagcuguuaacaucaguacguuaauguuuccugaugguccaugucuguuacucgccugucaaguggcgugacaccgggcguguuccccagagugacuuuuccuuuuauuucccuucagcuaaaauaaaggaggaggaagcugcuaaggacuaguucugcccucccgucaccccuguuucuggcaccaggaauccccaacaugcacugauguuguguuuuuaacaugucaaucuguccguucacaugugugguacaugguguuuguggccuuggcugacaugaagcuguugugugagguucgcuuaucaacuaaugauuuagugaucaaauugugcaguacuuugugcauucuggauuuuaaaaguuuuuuauuaugcauuauaucaaaucuaccacuguaugaguggaaauuaagacuuuauguaguuuuuauauguuguaauauuucuucaaauaaaucucuccuauaaaccacc

SEQ ID NO: 6338 - RNA, 61792 nt, Homo sapiens; identical to SEQ ID NO: 6337

SEQ ID NO: 6339 - RNA, 61711 nt, Homo sapiens
gguaucgccucucuccguuugguacauccccuccucccccacgcccggacuggggugguagacgccgccuccgcucaucgccccuccccaucgguuuccgcgcgaaaagccggggcgccugcgcugccgccgccgcgucugcugaagccuccgagaugccggcgcguaccgccccagcccgggugcccacacuggccgucccggccaucucgcugcccgacgauguccgcaggcgguagguaccaugggggggaacacggacucagggggacaggcagggcgcuggguggggggucgcuuccccucgggguggccgguggccgcugcugacagacgggcgcgcaugcgugggguggugcggcgcgcagcggcaguuggcgcgggcaggguggcacuuccggucgcgcgugcccgggcuguuuggcgccaaaauggaccguggauucccccguagcucccugguggcuagaaacuaggcgggguggggguucucuuuugauccccaaauacagcaagcuuuggguucguuuccgggguccccuucuucaagcagcggugggccgggcucuugacuccagcuuggucgcacaggaagugggcagcccgcggccaacggacaccccucgggcaccggcacuucggccuccacuuccgguguccggcccgguccccgggggcgcuucugugguggggggucccucagugccuuucccccaaagcugugcaucucgauggcggccuccagagacggaugucacccgucggggccugggcugggcuggcucauguucgagagcccagccuuccgugggguacucauucugucaguugggacugugugguucuugcuccuugggaaaguccauguuuuggcaggaacuuuaaccgugcauugcagcgcagggcccgggaagcgugaaggcugcaugguuggucuuuuccuguaaaucugugccugugagccgugggcaucagggaagucuugcuaaugagaacuggcuacacuuucguguguguuuguguguguucauggguguguucuuuagugugugucuaauguuggaggcccuggcuuuagcaguucaugccucuguccaacuuccgugcacaaggaucagugggagcacuggucccagccccuuguucaugaacgccaucaguucauuccugaaaacuuguucaagugaggugugcgugagucagaggaacccucaccaggcguggacacuuccagcuggauuugugaaagcacucuuugccauuuuucuauuuccuuaggcuuguuaacugaccugguugggccaguccgguucugauuugggucuuuggggagggauggauauuugguucaacccccgcuuuuuuucuuuucuuuuuuuuuuuuuuuuugaaggcugggugcuguggcuuaugccuguaaucccagcaauuugggaggcaguggcggacgaaucucuugagccaggaguuugagaccagccugggcaacaaggcaaaaccccaugucuacuaaaaauacaaaaauuagccuggaguagugccgugcgccuguggucccaacuacucaacagacuaaggugggaguaucacuugagccccagagguugaggcuguguguagcgagcugagaucgcgcuauugcacuccagccugggugacagagugagacccugucucaaaaaaagaaacacuuuuuauuuuuagagaugggucucacucuguuguccaggcuggagugcccuggcacaauuauaacucacuguagccuugaacuccugggcuuaagggauccucagccuccugaguagcugggaccacaggcgcccaccaccaugcccagaugacuuucuuaguuuuuguuucuguauacgugagguuucaccauauugcccaggcuggucuuaaaccccugcccucaagcaguccuccugccuuugugucccaaagguuaggauuacaaguaugagccaucaugccuuaacuacuacuuuuuuuuguuuguuuguuugagauggagucucauucuuucacccaggcuggaaugcgguggcgugaucucggcucacugcaaccuccacuuucaggguucaagugauucuccugccucagccuccgaaguagcugggauuacaggugcacaccaccacgccuggcuaauuuuuguguuuucaguggagucgggguuucuccauguuggucaggcuggucucgaacuccugaccucgugauccaccugccucagccucccaaagugcugggauuauagucaaaccacuucuuaaccaguuaguggguauauaucuucuugaaucaucugugccaguauucucccaaaauaaaacuugauuuaaaauggaauggaagugaaauuaugaaagugccuggcuucaugauguuacacccaauucagagaaguuugggcccggccuuccuuuuuuauuccuuuuuuuuauuuuguagagauggggucuugccauguugcucaggcuggucuucgauuccuggccucaagcgauccuccugccucagcuucccaaaguguugggauuacgggugugagccaccaugcccagccugcccagccuucuugaaaacaugaccuccacuggcucaaugaccuuaaacaagcguaugccaccucuauauccauagucuaggaauaaugacauggguuuucagcugguauuggguuaaaugagaauaugcauggcacauaaagguucacaugcuaguggcuaacuuagcuuguuuuuuucaguuuuuuuuuaagagacaggaucucacugugucacccaggcuggaaugcaguggcacagucauggcuuacugcagccuugaaccccugagcucaagcaauccuccugccuuagccuccugaguggcuggcacaugccaccaugcccaaguuaauccuuaaaaaauuuuuuagaaggcugggcgcgguggcucacgucuguaaucccagcacuuugggaggcugagaugggcagaucaccugaggucaggaguuugagaccagccuggccaacguggcgaaaccccaucucuacuaaaaauacaaaaaaauuagccagguaugguggcaggugccuguaaucgcagcuacucgggaggcugaggcaggauaaucgcuugaacccaggagccgagauugcaccguugcacuccagccugggcaacaggagcgaaacucugucucagaaaaaaaaaaaauuuuuuuuuuuagagaugagggucuugcuuuguugcccaggcuggucuugaacuccuggacugaagcaauccucugcguuggccucccaaagggcugagauuacaggcgugagccacagggcccggccauuauuccucaagaguucuuaaaaguggaugcugcaggaguuaacugccaggaagcaggaauuccugcuaaggucugcugcuugccaaagccuuucccuucaacagggguugccaguaggccacuggcucaggggcucuguuggcccugugcaaauauuuuguuuggcugaauuggaauaccauuaggugagccuuacaauccaccacugacccuggguuccacauuucuuuacacucagauugcuucacuguaggcauuggaguuuuggaggacugcuuuugaccaugugguagacauugaaauuguaguuuauaugacucacuccacagacuuuuuuuuuuuuuuuuacauuuugaaaauauuucauuaaaugaaaaauaaacaugguauccaacaguacuugaaacuuagauuuuuuuuuuuuuuuaauugaggcagggucuugcucuguggcccaggcuagagugcaauggugugaucucagcucacugcagccuccgcuucccggguuuaagcaauucuccugucucagcuucccaaguagcugggauuacaggugugcaccaccacgcccagcuaauuuuucuuuuucccccucgaggcugagccuugcucugucgcccaggcuggagugcaguggccgugaucucggcucacugcaaccuccaccucccgaguucaagcaauucuccuacuucagugucccaaguagcugggauuacaggcgcccgccaccaagcccagguaauuuuuguauuuuuauuagagacuggguuuugccauguugaccaggcugguuucaaacucuugaucucaagugauccacuuaucuuagccucccaaaaugcugggauuacagguaugaugguguccagccgguucauuguuuuuauuuuauuuuauuuuauuuuauuuuauuuuauuuuauuuuauuuuauuuuauuuuugagacagagucuugugcugucgcccaggcuggagugcaguggugcgaacuuggcucacugcaaccucccccucccggguucaagugauucuccugccuuagccuccugaguagcugggauuacaggcaugugccaccacgcccggcuaacuuuuucuuauuuuuaguagaaaccgggguuuaccguguuggccaggcugguguugaacuccuggacucaagugauucgccugccucagccccgcaaaguguugggauuacaggcaugagccaccgugccuggccuuuuaauucauucuuaagccugcucucagacagcuaggcuugcuucuccacaauaaagaguguugaauuuugucgguguaucccgcauggugccauuauaacacugaaauuagugauuauuucagggucuguuaccagagcgugucugccguauucacuguaucugcagcuuggagcacaguagacucaaaugcuugcaugccagcucuuccccuguacagccuggauuaacacugaugcuagcagacuccuuugcacaacugauuagcuuucguaacuaccacagcuuucuuacugcuagucauucugugaugggauuaagcuaggucuugaacuccuuaacuccaguuccuuggcuacuacugaguacauacugaauaaggcaaaauugacuuaccucuuuuguuuugcuccccugugguagaauucuagggguacagacugcuggguuucaaaugccgcccuacuugccagccguauggcuaaguuauugaacuucuuggugccuugguguuucaucuauaaaaaggggguggggcugccugcucgacagggguguuaggaagacugagcuuaucaguacagauauguugagagcagcaccuguccaaagcccuucaucacugguuauuacgugguacuguguguacaguggggaugcuguggguuugguuccagaccacugcaguaaagugaaucuagcaagaaagugagucacacacacauuuugguuuccuaguauguguaaaaguuauuagacuaggccgugugcaguggcucaugccuguaaucccagcaguuugggaggccaaggcaggaggaucgcuugagccaaggaguucaagacuagucugggcaacauaggaagaccccccccaucucaaaaaaaaaaauaaagccaaaagugguggcaugcaccuggggucccagcuacucgggaggcagaggugggaggaucacuugaacccaugaggucgaggcugcaguuugccaugauugugccacugcacuccagccugggugaaggagugagacucugucucaaaaaaaaaaaaaaaucagcugggcgugguggcucacgccuguaaucccagcacuuugggaggccaaggugggcagaucacgaggucaggagaucgagaccauccuggcuaacacggugaaaccccgucucuacuaaaaauacaaaaaaaauuagccaggcaugguggcacacgccuauagucccagcuccaugggaggcugaggcaggaaaauugcuugaacuugggaggcggagguugcagugagccgagaucaugccacugaacuccagccugggcaacagagcgagacuccgucucaaaaaaaaaaaaaaaaucaucugagucuucagcgauucauaaucuuuuugcagguggagggucuugccucaaacuugccggcuuaaaggacauacauuuauuaccuuaugcaggucagaaaucugauguggguuucaccggaugaaaaucaagguguaagcaggcugcauuccuuucugggggcuccaggggagaaucuguuuccuauuuugggguguuggcagaaggugguaguuguaagacucaggucccauuuucuucacugguucuaaacugagggucguugcccgcuucuggaggcggucucaucccucggcucaugcccccuuccucuaccuuuaaagucagcauuugcggguugcaucucucucugacccguccuccaacguugcccgcucucugcagcuagaaagguucuguguucuuaagggcugaagugauuagauugggcccaccccagauaauccaggauaaucuccccaucucaaggucuguauucuuaguuacaucugcaaaaucgcuuuggccacguaaaguaauauauucacagguuccagggauuagggcaugaacauuuuucgguggguccacucuuuuugagauggagucucgcucugucacccaggcuggagugcaguggcaugaucucggcucacugcaacuucugcuuccuggguucaaaugauucuugugccucagccucuugaguagcugggauuacaggcgugagccaccaagcccgguuaauuuuuguauuuuuaguagagaugggguuuugccauguuucccaggcuggucuugaacuccugagcucaggugaucuacccgcuucagccucccaaagugcugggauuacaggcaugagccacugugcccagugggucuacucuuuugccuacugcggaugccuucuugggcagcccugcuccagcugccaugcagccggccugaagaagcugguuugacagagacuuguaacuugucuugcaugguccacuauauuuuauuuuuagagacaaggucuugcugugucacccaggcuggaaugcagcggcacaauuauagcucacugggcucuagugauccuccugccucagucuccugaguagcuaggaccacaggugcaugcugccacaccaagcuaauuacuauuuuuuguuuaggcagggucucugcuguguugcccaggcuggucuugaauuccugagcucuauugauccucccgcuuuggcuucccgaguagcuaggccuauaggcacaugcuagcacacccagcuaauuacuaauuacuauuuuuuguagagacagggucucgcuguguugcucaggcuggucuugaauuccugggcucuagugauccucccgccucagccuccugaguagcuaagacuauaggugcaugccaccacacccagcuaauuacuauuuuuuguagagacagguucucgcuguguugcccaggcuggucucaaauuccugggcucuagugauccuuccgccucggccuccugagcagcuaggaguacaggugcgugcugucauacccagcuaauuacuguuuucucguagagacagggucucacuguauugcccaggcuggucacaaauuccugagcucuagugauccucccgccucugccucccgaguagcuaagacuauaggugcaugcuaccacagccagcuaauuauucuuucuuguagagacagggucucgcucuguugcccaggcuagucucgaauuccugggcucaagugaucuuccuguccuggcuucccgaguguagagauuacaggcaugagccacugcgcccagccauggucugcuguauuucagacgagcauuucuggcguagagguguuagaguaaucuaacauuuuauaauuucuuccuauccaaucuauacuagauaccucugcuggguuaguuuucuuaacacggcucugaugucauugguucuacuuccccuugacugcuuugguguuuguuaacuauggaacaagauggauaagugugaugcuuuugcccucccuccgacuguccccagccaccucucuggaggugccuuucccucccuguauguggccagucucacguuuguuucuuguguguuuccagaaccagccacuucucaauggugccccuguuugagcagcuuccugugcccgguucacacagagcugucaacuucuuccugaggcuguuauacccuuucucuugggaaucccgcaggcgugagcuguauuugccuuauuccucugugguuguuuauauauaucuuuuuuuuuuuuuuuuuuuuugagacggaguuucacucuuguuguccaggcuggagugcaaugacgugaccuuggcucaccgcagccuccaccucccggguucaagcgauucuccugccucagccuccugaguagcugggauuauaggcaugugccaccaugccuggcugauucuggauuuuuaguaaagacgaaguuucuucauguuggucaggcuggucucgaacuccugaccucaggugauccgcccgccucggccucccaaagugcugggauuacaggcaugagccaccgugccuggccagcuguuuauauauaucuuaucuccccucugcagaggguucaucucugagggaagcacuaggaaggaaucauagggucucaggcugggcacuaagccggcauucugaguccucugcuccguccuucacggcugucugcgacccuccuggcuucagcaggugugaucggugucaucacaguuuuaccagggaagggaugucgcuaaaguuacccucccgccagcuccucacugccugccugggaucccaccugccacucuggggccaggcagguuaaauccaguuucuacuggaugaaacauucuagggguuuugaagguuucucuauucucuuugccaggcuaaauaucccaguucauaugagggguugaaagaaagcagacccauucugcaaggacaccuuggucuccgcaaucaguugaaccuuguccuucacaccccaggcaaccucgggaucaggggacuggcuggcuuggucgagguagaagccauguccuuccaguuuucucagcggcgugacugagaagucaaguguaacgcuauuaccacagcgugugugccucuggcuggaaguaccaguuucuguagcccuccugacuuaaggcucuccuuggaccccaguugcuacaaggguagaaugacuuuugccuggaagagguuccuugugcuccuggaaauccugaugucaaagcaucuuuuuuuuuuuuuuuuuuucuuuugagacagggucuuguucuguugcccaggcugaacaggcuggauugcagugguaccaucauaacucacugcagccucaaccucccaggcucaagcgauccucccaccucagccucccaaguagcugguaccacaggugcacacuaaccacacccagcuaauuuuuacauuuuuuuuguagagaugggaucucucaguguagcccaggcuggucucaaacuccugaccucaagugauccuccugccuuggccucccaaggugcugggauuacaggcaugagccacugcgucuugccuggccuuguagcaccuugaguccaagugauacaguauauauaauauacagucuauauuaccacuguguuuguagggugcuaagugucucuucuacagagcagucuuuuuuuuuuuuuuuugagacagaguuuugcucuguugcccaggcuggagugcaguggcaugaucuuggcucacugcaagcuucaccucccggguucacgccauucuucugccucagccuccugaguagcugggacuacaggcgcccaccaccacgccuggcuaauuuuuuguauuuuuaguagaggcgggguuucacuguguuagccaggauggucuccaucuccugaccucaugauccgcccaccucagccuuccaaagugcugggauuacaggcgugagccaccgugcccggcccuacagaauggucuuuccuaaccacacagcaagucaggaagucccugccuagugacaccuacaucuaaucacuuagcucuuugccuggagcagggccuggcauucagcaggugcucauaugugagcggcgcugguggggaaucagggcccgcaugacccagagcagcuguuguaagacauggguccagcaaagcauuccucaugcugcugccugcacuuacccucuaggaaggccagccuggaggagccacuucugcccuucaggcaaaugauaacugagcaccugucugugcgggugcuagguggaaagguccagagauggcaguggccuggucccugccuggggcaccuucucuccaccaacagacacuuacccagcugguuaggccuguucucaccccgcagucuguaguuagcacccaggcugggaacaacagccuguguuccucucccuuuccuugguaccuucucuucuuguuccuuuauuuuuuucugaagagauaggaucgcccuauguuguccaggcuggacucgaacuccugcccacaagccauccucccaccacagccuccugaguagcugggguuacaggcacgcagcaccgcggcacugcaccggcuauuguucuuuuauuuuuuucccucuuugucccugaaagagucaagcuacuaauugucaguaaucaaaucagaccacgauuucccaggcaaacuccuggcaguucuacauuuaggaaugacuagcuagagacauccugaagaaugaguuauucggggaggcgccagccaccuccucuaacuucaccucuaucugcccucuguguggguaccccuugcuucccuggaugcuugacucccccauuucauccucaaaaugccaccaccccccaccaggccuuuaggaacaucagcuggcuguuccccacaguguccuguggcccugggcuacucauucugacacuggccauacuguggcacaccuuguuaugggcuguugucagacccaacuggagaaagaccagcuguaggucauuucccuuacgggagugccccaacuauaugaccugcccccucuuuccugguaucuuuuugagucagggucucacucugucuccuagauuggagugcagugaugcaaucacggcucacuguggccucgaccucccaggcucaggugaucuuccuuccucagccucccaaguaacugggaccacaagcacaugccaccaaacccaguuauuuuuauuuuauuuuauuuuauuuuauuuugagacagaguuucacucuuguugcccaggcuagagugcaauggugugaccagcucacugcaaccucugccucccggguucaagugauucuccugccucagccucccaaguugcugggauuacagccacccaccaccacgccuggcuaauuuuuguauuuuuaguagagaugggguuucgccauguuggccaggcuggucucaaacccuugaccucagguaauccacccaccuuggcccucagguaauccacccaacugcugcuguauguugggauuccaggcaucagccaccacgcccagccacuaauuuuuguauuuuuguagagauggaguuucgccauguuucccaggcuggucugaacgccugggcucaagugauccgcucgccuuggccucccaaagugcugggauuauaagcgugagccaccaugccuggucucugguaccuuuuaaaauauacaggcugggcaugauggcucaugccuguaaucccagcacuuugggaggcugaggcagguggaucgccugaggucgggaguucgaaaccagccugaccaacacggagaaacccugucucugcuaaaaauauaaaauuagcugggugugguggugcaugccuguaaucccagcuacucgggaggcugagccaggagaaucgcuugaaccugggagucggagguugagcugagaucacaccauugcacuccagccugggcaacaagagcaaaacccuaucucaaaaaaaaaaaauauauauauauauacacacguauauauacguguauauauauauacacacacauauguauacauauauacguauguauacacauauauacguauauauacacauauauauguauauauacacacauauacguguauauauauacguguauauauauaugcaugccagacauggugacucaugccuguaauccuagcacuucaggagacugaggcaggcggaucacuugaggucaggaaucuaagaccagcuuaaccaacauggugaaacccugucucuacucaaaauacaaaaaauuaacgaggcugguggcaccuauaaucccagcuacuugggaggcugaggugagagaaucacuugaacccagaaggugaggguugcagugagcugagaucgcaccacugcacuccagccugggcaacagagcgagacuccaugucugucugucugucuaucuaucuguauaauguauauguauguauguauauauguguguguauauauauacacauauauacauacauauauacacacauacucuguuacagagcugcuguguguguguguauauauauauacacauauguauauauacacauauacacauauauauguauauauauacacacauauauauacacauauauauguauauauauacacacauauauauacacauauauauguauauauauacacacauauauauacacauauauauguauauauauacacauauauauguauauauauacacacacacacacauacacauaauuguguuacagagcugcuauguaaucucacaaucaucagaaaaaugacccccaaaaggggaaccuuguucagaucagaugacuucuuagcauuaggcauuccaguaggacacucuagacucuugcggggagacaaaagccagcuuaguuuuuucuaacacucauauguuaaacuuguuuguguccaaaacuucuuuagaacugugauauucuuacaggcaaaugaaguugcuuaacaaguguuuguauuuucuccccuauuucuuccucccaggcucaaagauuuggaaagagacagcuuaacagaaaagguaaucuccaccuuaaaauuuuucuuauuaccaaaucugacugacacacuuuguggcucauaaaaagaaauuuguuuucuuuaaauggauuuugcauuuuuucccauggaguuucaaagauaauuuggauauucuuguuaaaugucagcacuaauuugcugcuaauaguugggugguggugguguuuuuuuuuguuguuguuuuuguuuuuugagacagagucucacucugucacccaggcuagagugcaauggcaugaucucggcucacugugaccucugccucccggauucaagcuguucuccugccucagccucccaaguagcugggacuacaggcacgcaccaccaugcccagcuaauuuuuauauuauuaguagagaugggguuucaccauguuggccagacuggucuugaacgccugcucgugaucugcccaccuuggccucccaaagugcuggaauuacaggcgugagccaccaugccuggcccagguuuuuuuuuuuuuuaaccaaucucaguuccuaaacaaucuacucuggauuguaacuuguccugguaacacuguuuuauuguguuuuuguuauuguuuugagauagggucucauucuguagcccaggcuggagugcaguggcacaauuuuggcucacugcaaccuucgccucccaggcucaagugauuuucccacucagccuccugaguagcucuaacuacaggcucaagccaccaugcccagcuaauuuuuaaauauuuuuuguaaagaugggauuuugucauguugccccaggcuggucuugaacucuggggcucaaagcaauccacuugccucggccucccaaagugcugggauuauaggugugagccacugugccuggccgacacuuuacagaagcacaguauuauucuuauaaaccaugauaugucuccaucucaccuccagcuuucccauuuuucaccacuuuggagacaggagugaagugauccuaauggaaauucccugaacacauuucaugacuguuuaguguuuugacugagacagcauugccugccauucacucauugugaugugaucaggcagcucaauaauuuguguauuaguccacuagugaauagcuugggaauguggguacugcuaaaccuauauccuucccuuaggaaugugugaaggagaaauugaaucucuugcacgaauuucugcaaacagaaauaaagaaucaguuaugugacuuggaaaccaaauuacguaaagaagaauuauccgagguaagucaguucucagcauccuagccucuagaaaaaugucuccuccuaguaacuugucugugaccagggaggcagcaagauccccagcuguccucauugccugaugaugaugaugaugaugaugaugaugaaggaaacacauguguuuccuuguucucugacacuuguuuacauucacugcuacuuaaauuauccuuuccugcuguaggagggcuaccuggcuaaagucaaaucccuuuuaaauaaagauuuguccuuggagaacggugcucaugcuuacaaccgggaagugaauggacgucuagaaaacgggaaccaagcaagaagugaagcccguagagugggaauggcagaugccaacagcccccccaaaccccuuuccaaaccucgcacgcccaggaggagcaaguccgauggagaggcuaagcguaagagcagaugauuccuuuuauuuuuaauuguuuuugagauggagucucacuguguugcccagucuggagcacagugguguaaccucggcucacuguaaccucugccucccagguucaagagacccuccugccucagccucccaaguaacugggauuagagguaugugccaccacacccagcuaauuuuuguauuuaguagagauggggucuuaccauguuggccaggcugguccagaacuccugaccucaaguaauccaccugccuuggccucccaaagugcugggauuacaggcauaagccaccacgccuggcccugcuuaacucucuuucuuucuuucuuuuuuuuuuuuuuuuaaugacagagucuugcucuaucgcccaggauagagugcaauggcgcgaucucggcucacugcaaccuccgccucccaguuucaagcgauucuccugccucagccucccaaguagcuaguauuacaggcgggcaccaccaugcccagcuaaucuuuguauuuuuaguagagaugggguuucaccauguuggccagacuggucuggaacuccugaccucaagugguccucccgccuuagcuucccaaagugcugggauuacaggugugagccaccgugcccggccccacuuggcucauuuucaaccuagaagcaggcuuugguagcauauaagggggcaguuaaacuuggaccccaggucaguguguccagguuccuuucuuuuguacgcauccucacuaguaauuacuggacacuuccuaacuagcuuagauguguacgucuuuaaauuuugucuuagcugggggugugguggcucaugccuguaaucccugcacuuuggguggccaagguggcuggaucaccugaggucaggaguucgagaccacccugcccaacauggcaaaacccugucucuacugaaaauacaaaaaauuugccagacgugguggcgggugucuguaauuccagccugggcaacaagaguaagacacugucucaaaaaaaaaaaaauguuguuuucgaccaaguugcagcauuagaucccaaaacauggcuaugagugugacagguugcagaugacaagugcuacaaauacuuacuccuucuaagaccuuauaugccugguuaaacauuuauucucagacucuugcccaguuuuaggcaaaggaacucuaauggaaauuuuuuuuuuuuuuuuuuuuuuuugagauggagucuuguugucucccaggcugaagugcaguggcgcaaucucggcucacugcaagcucugccucccagguucaugccauucuuuugccucagccucccgaguagcugggacuacaggcgcccgccaccaugcccggcuaauuuuuuuuguauuuuuuaguagagacgggauuucaccauauuagccaggaugauuucgaucuccugaccucaugauccgcccgccucggccucccaaagugcugggauuacaggcgugagccaccgcgcccagccucuucuggaauuuuuuaaaaaacaaacaauaggauaguacuugagcucaggucugguucucagcuacuucauuuuuauuuuguuuuauuuuauuauuauuuuugagagagaaucucgcucuguugcccaguggcacgaucucggcucacugcaagcuccaccucccagguucaugccauucuccugccucagccucccaaguagcugggacuacaggcgcacaccacgccuggauaauuuuuuguauuuuuaguaggaugggguuucacuguguuagccaggauggucucaauaucccgaccucgugauccaccugccucggccucccaaaguguugggauuacaggcgugagccaccaugcccagccuuauuuuauuuucuuuuaauuuuuauuuuauuuuuugagauggaggcaugcgccaccacgcccaguuaauuuuuguauuuuuaguagagacaggguuucaccauguuggccaagguggucucgaacuccugaccucaggugauccaccugccuuggccucccaaagugcugagauuacagguguaagccaccucaccuggcccuuuauuuuauuuuuuuuugagauggagucuuacucuguugccaggcuggagugcaguggcacaaucucggcucaccacaaccuccaccuccuggguucaagugauuuuuuugccucagccuccugaggagcugggacuacaggcacgugccaccacgcccagcuaauuuuuguauuuuuaauagagacgggguuucaccauguuggccaggauggucucgaucucuugaccuugugaucugcccgucuugccucccaaagugcugggauuacaggcaugagccacugcaccuggccuauuucuuuuuuuucuuucuuucuuuucuuuuuuuuuuuuuuuuaagagacagggucuugcucugucgccaaggcuguguacaguggcgcgaucuuggcucacggcaacccccaucuccuggguucaagugauucuugugccucagccucuugaauagcugggauuauagguguguaccaccacgcccagcuaauuuuuuuguauuuuuaguagagauggggguuugccauguuguccaggcuguucucgaauaccugagcuuggauuauuuucccaccucagccucucaaaguuuugguauuauagaugugagccacugugccuggcccacuucaucuuuugauauuuuaacaagaggcucuguuuccuggccuucuuuagcauuuggccccucaaauaacugacaugauauggcucaacaaacuggcaggugcuaacugccaacauuagcaagcugguuguugacuagaauaaaaaugcaaagaugcuuaguccuuagaaccuggcuuccugcaauagcuuaguaauguugaacugcauuauugcugugggcuuucuauugauaguggcuuuuuuuuuucuuuuuaaugcuuuuucuucuuuaaacagcugaaccuucaccuagccccaggauuacaaggaaaagcaccaggcaaaccaccaucacaucucauuuugcaaaggggucaguauacgauaaauuggcggcugccuuuuuuaggggccggcuguuuugggauggaauugguagggcgucacguggcaauucugucuuccguguuguauagguuuucaucuugcgguucuguucucuagacauuuaugaauagcauuucugaaaacguuaccuguuuuuacucauauaggaaaguucaaauguacacaaaaucaugaguuuuguauaaugaacccugaaauacccaucaucuagugccaacaguuaucaaguuacagccguuguuucaucuauacccccauauugugugucccugccccaccuggauuacuuuguccauauauaguuuaguauauuucuagacaaugagaucucuuuugacaacuuuuuaaaaaauuacucauauuuuacaauaauugcuaacauuuagcagucuuuuuuuuuugagacagcaucuggcugucacccaggcuggagugcaguggcacgaucucggcucacugcaaccucugccucccggguucaagugauucuccugccucagccuccugaguaucugggauuacaggcgcgcgccgccacgccuggcuaauuuuuguauuuuuaguagaggugggguuucacuauguuggccagacuggucucaaacuccugaccucaggugaucugcccacuucaaccucccaaagugcugggguuacaggcgugagccaccgugcccagccaaaacagucuuuuuaacaaaccaaaguauaauacuguucugaugucuuuauaaaaauguaagaauucccugcuaucagauauauaguugguauuuacguuuuucccuuuguggugaacaagccguguggcaaacagacagcguuugguugacuuguuccuuaaaguuauagauuccuucccuccuauuuuacuuaaaauuccucacagauuuuaaauuccuucaucucuuaucuucuugccauuuacuugaagaaauucauuuguccaauaguuccuagauugggccgauugcauccuugugguguuccacagguccccuugccuucuguucccuauaaacugauaggauuacaggacugaucagauuccagcuuuuuauuuuuugagacugacuuuuuuuuuuuuuugauacggagucuugcucuguagcccaggcuggagugcaguggcaugauuucggcucacugcaaccuccaccucccagguucaagcgauucuccugccucagccuccugaguagcugggauuacaagugcccgccacaaccccuggcuaauguuuguauuuuugguagagacaggguuuuaccacguuggccaggcuggucugaaacuccugaacucaggugauccucaugccuuggacucccaaagugcugggauuauaggcgugagccacugcaccuggucugaggcugacuuuauggauggugcugugucccuccaucagaaaggugugugaggucucuucucugacacuagcagcuguugaucgguguuuagacccgugauuucuuaggacuuacaagauggcaagacaacauucuaaacccgucauucagagaaacauuaaacuugaagccucuuucaacauccuggugaaugaggguccacuucaggccagcuggaggccuagggucuuguuccacuaaugguuggccucacugugugugacagcccugccaaacggaaaccucaggaagagucugaaagagccaaaucggaugaguccaucaaggaagaagacaaagaccagguagggccagugcuuucauuuccugacucuaccuuaacuugguguauuugaugauugugacuucauauguguucuguccaaguaaauaaaaacccugucuagggcucuauuuagggcucuccagagagacaggaccaauagaauguauauguguguauacagcuauagguacauauauacauaugcacguguauguauauauauauaauucguuugauuuuuuucuuguuuuuauggguacauaguuggaauauauauuuauggggagagacuuuauuuugagaaauuggcucacaagauugugaaagccagcaaauuugaaaucugcagggcaggcuggagguccaggggagaaaugaugucauagcucaaguggcaaggcagucuuacauacauacauguuauauauauguguguguguguguguguguguguguguguguguguguguguguauguauguauguauuuagacuucuuuuuuugagacuuuuuuuuuuuuuugagacaggguuuugcucuuguggcacaaucuugguucauugcaaccucagccucccggguucaagugauucuccugcuucagccucccgaguagcugggacuacaggcgcgugccaccacgcccggcuaauuuuuguauuuuaguagggaugggguuucaccauguugcccaggcuggucucccauguugcccaggcuggucucgaacuccuugagcuuaggcaaucugcccgccucagccucccaaagugccaggauuauaggugugagccaccgugcccagccaauuuguuuuuuuuguuguuguuguuguuguuuuuaauuuuuuuuagauggagucucacucuuucacucaggauggagugcaguggcacgaucucagcucacugcaaccuccgccuccuggguucaagugacucuccauccucagcuuccugaguagcugagacuacaaggcaugugccaucauacccagcuaauuuuuauauuuuuaguagagaugggauuucacuguguuggccaggcuggucuugaacuccugaccucaagugauccacccgcuucagccucccaaaguguugggauuacaguucugucuuuuuucuuuucuuuucuuuucuuugagacaggucucauucugucaccaggcuggggugcaguggcgcagucauggcucacugcagccucaaccuccugggcuuaagcgauccucccaccucacccucccaagcagcugggacuacaggcgcaugccaaugagcuaaguuuuguauuuuuuguagagaugagguuucccauguugcccagacuggucucuaacaaauaaauuaaacaaauuccugacacaagauggagaaucuuugauucuuuuacauaguaucaccaggcgaucucuagugaugggcagugugccugccuacuucucggaccugcuuuuguuuugggguugguggggauuaauaccagaguaagaguuucucagaucuucuccccaaaacccaggccccuucuuuucccacucuugcucuaaccaugucaaauguguuaauauuucaacucacacuuuugguguugaccuucccuugaaaccaguauucuaaucuuuuuuguucuuccuucccuccacacaggaugagaagagacguagaguuacauccagagaacgguaagaauaguuacuauaccuuucuuuuuguucuacgaguuguguaaucuugaucacaaaacuuuuucagaaaguuuaaggccgggcacggugacucaugccuguaaucucagcacuuugggaggccaagaugggcgaaucacuugaggucaggaguucaagaccagccugaccaacauggcgaaaccccgucucuacuaaaaauucaaaacuuagcugggcgugguggaaugugccuuuaaucccagcuacucaggaggcugagucagaaggauugcuugaacccaggagguagaggcugcagugaucugagaucauuccacugcacuccagccugagugacagagcaagacuccaucucaaaaaaaaaaaaaaaaguuuaaaaagaagaacuuuaucguguguuuccauggcaaccauaucguuaugaaguaucugaauuuggggucagaucauuagcguuuagauucaaguagaauucuccuguuuucuuggaaggaaugaaucgagggcagcuggcauucgaaccagguguaaaagucauaucaaauacuaaauguuaaaugaguaugugucugucagggcuccugagauaaugaagauugcuuuugggggaaagaggagcuuuaugaaaacugcuucuuuggggaagcuccuggcacucacacuuggggucuguguuauuuugcuugacagaguugcuagaccgcuuccugcagaagaaccugaaagagcaaaaucaggaacgcgcacugaaaaggaagaagaaagagaugaaaaaguaaagcucuaucaccucuaaguuuguuaauucucccuuaauccuauauggucccaauuuccuuccaggacguggggacaggggguggggaacguggaagaacaagauggguuuugcuagugaucgaaaugccuuugacuuuggcuaaacaccuuucaaacuuguuuucucguggucucuacaugaaagguggguuaugagauugugauagugaggacccuugcuacuuauuugugauauuuuauuuuauuuuauuuauuuauuuauuuuugagacagucucccacucugucacccaggcuggaaugaguacagaggugcgaucucggcucguugcaaccucugccucccagguucaagugauucucaugucccagccucuugagucacugggacuacaggcgcccgccgccauacucggcuaauuuuaguggagaugggguuucacuguguuggccaggcugaucuugaacuccugaccucgagugauccaccugccucagccaccaaagugcuaggauuacaggcaugagccaccacaccggccaaccuaugccacuuaaucaacuagucacagagcuucaguuugucaccucgccuucuugcuucucuggcugaugagaucuuugugaagaucuaauuuucagacguacgaggugcuaaaacuuuuuuuuuuuuuuuuuuugagauggagucuugcucuguugcccaggcuggaaugcaguggugugaucuugucucaccgcaaccucugccucccggguucuugugccucagccuccugaguagcugggauuacaggugccugccaccacagccagauaauuuuguauuuuuaguaaagaugggguuucuccauguugaucaggcuggucuugaacucccaaucucaggugauccaccugccuuggccucccaaagugcugggauuauaggcgugagccaccacacccggccuaaaauacuuuucaaacuuauuuuuuuguaguucucuacauggaagguggguuaugagguugucauagcgaggaucuuugcuacuuauuugugguauuuauuuaauuuaauuuaauuuuuuuuuuuugagacagucucccgcucuaucacccaggcuggagugcagaggugcgaucuuggcucauugcaaccuccgccucccagguucaaguaauucucaugucccagccucccaacuagcuggggcuacaggcgccugccaccacaccuggcuaauuuuuguguuuuuauuuauuuauuuauuuauuuauuuauuuauuuauuuauuugagacggagucucgcucugucgcccaggcugaagugcaguggcuugaucuccgcucacugcaagcuccaccuccuggguucacaccauucuccugccucagccucccgaguagcugggaccacaggcgccugccaccaugcccggcuaauuuuuuguauuuuuaguagagaagggguuucaccacguuagccaggauggucuugaucuccugaccucgugauccucccaucucggccucccaaagugcugggauuacaggcgugaaccaccgcgccuagccaauuuuuguguuuuuaguagagacgggguuucaccauguuggccaggcuggucucaaacugcugaccucgaacgguccaccugccucagccaucaaagugcugggauuacaggcacgagccaccacaccggccaaccuaugcuacuuaaaucaacuagucaguuucagucugucaccucagccaccuucucuggcugacgagaucuuggugaagaucuaauuuucagauguaggaggugcuaaaauucuuuagcaucauccagacauaaaguuguauucuccucucugaagucagaccagcucuuuccccagucccucaucuucuuuguaaaaucugagucuaagguucuaugcaauacagaugcuggguccuguuuuuuuuucuguuuguuuuguuuuuuaauaagaugacugagggccgggugugguggcucaugccuguaauucuagcauuuugggaggccgagguggguggaucgcuugagcucaggaguucagggccagccugggcaauguagugagaccccgucucugcaaaaaauacaaaaaucagcuggaugugguggagcuuacaacaggcagugugccuguaguuccagcuucucaggaggcugaggcaggaagaucacuugagcucaggaggcugaggauacagugagccaugauugucccacugcaauccagccuggaugauaaagugagacuggucuuaaaacaaacaaacaaacaaacaaaacaaacaaacaaaaaaaaaccaagaugacuagaaguuucuuaccaacuuagguaggugacgagugccuuacuugggagcuuaguaaaggauggcuguccauuggggaaucaacuaaaauguacaguaauuuuuuuuguuuuuugagacggaguuuuguucuacuugcccaggcugcagugcaguggugugaucucggcucacugcaaccucugucuccugcguucaaacaaauucuccugccuuagccucccgaguagcugggauuacaggcuuccgcuaccacgcccagcuaauuaacuuuuuguacuuuuaguagagacagggguucaccauguuggcuaggcuggucucgaacuccugaccccaggugauccacccgccucggccucccaaagugcugggauuacaggcgugagccacugcauccggccgcuguacaauaauuuuugaaccauucaguacuugagguuggucuuucuugcuuuuuuucuuuuuuuuuaauugagauggaauuuugcucuuucgcucaggcuggagugaaguggcgcaauuuuagcucacuacaaccuccacccccuggguuccagcgauucuccugccucagccucuccaguagcugggauuauaggcgcccgccaccccguccgccuaauuuuuguauuuuuaguagagacaggguuuugccguguuggccagguuggucuggaacuccugaccucaggugauccacccaccucagccucccaaaguccaggauuacaggggugaaacaccacgcccggccgaggcuggucuuucauugaucaccuuuccuacccugauccuaguuaaauuagacagcaguugcagucagugcauaccucgaauuuguuucagaacaagcaguccuaacgggcuaguucaaccaccaccuuccaaagaaggaaccuggggcaagaucgaaaucccucaccuguaagcauacucucaggauuucuucuuguaguaggaagauuugcuaagcguuuuuuuuauuuuuauuugagacggagucucacucugucgcccaggcuggagugcaguggugcgaucuccgcucacuucaagcuccgcuucccagguucacgccauucuccugccucagccucccgaguaacugggacuacaggcaccugcuaccacgccaggcuaauuuuuuuuuguauuuuuaguagagacgggguuauuuauuuauuuacuuauuuauuuuuugagacggaaucucgcucuugucgcccaggcuggagugcaguggcacgaucucgguucacugcaagcucugccucccaaguucacgccauucuccugccuccaccuccccaguagcugggacugcaggcgcccgccaacacgcccggcuaauuuuuuuuuuuuuuuuuuuuuguauuuuuaguagagacgggguuucacuguguuagccaggauggucucgaucuccugaccucgugaucugcccaucucggccucccaaagugcugggauuacaguagugagccacugugcccagcugcaaaguguuucuuaauauuccugaccuuugcgaucucuucacagacuaccacauguggaguuucugaggguuggauuugacuugccugauucucuggcaagaugugucugguucuuuaaaugcagccucaggcugggcaugguggcucacgccuguaaugccagcacuuugggagaccaaggcagacggaucacuugaauucaagaccagucuggccaacgugaugaaacccugucucuacuaaaaauacaaaaauuagcuggucaugguggugugugccuguaaacucagcuacuugggaggcugaagcaggagaauuguuugaaccugggaguuggagguuacagugagccaagaguacaccacugcacuccagccuggguaacagagugagacuccgucucauaaauaaauaaaugaauaaaugcagucucagaggauguguuguugugucucaguuggagcuacuuuucagauugggccauccuauuucauuccuuuaauaucggaaguagagauuuauaauaaaguuacuuucugugaggcuaucaacacuuaacugaugacaaguaguagaggaauuuugaaguaaaaauacugaaacugcaguguuguaguaucuccuuucuaagaguuucauuuccugucuacuuaccccacugaagaagaaaagaaaauugcugucuugaacaccuggcacaagugauccucucaccucagccuuccaaaguucugagauuacaggcaugagcuacugugcccacugguagacagucuuuacucccaccaguggacucuagaaucaguucagguguuuuauuuccauaggacacuuuaauagaaagauccaaaccaaauggaaaaaauuaacuugucuuuuuucccugcaacuuaggaagaaaagagacuccgaagucaaaccaaagaaccguaagugcagcgaaccugccuuugugcuuuguugugaaacugaauugcuaacauaaguaucuugguaaaauaacggguugguguggaacagugggcacuaaucauaugucucuuaugugggcaaguucugcuugugaaaggugagaccacccugaagugaaggcugaaguuaacuuuuuuaacuuuaauuuaauuuaauuuaauuuugagacggagucuugcugugucacccaggcuggaguacaguggugcaauccuggcucacugcaacccccaccucccgggcucaagcaauucuccugucucagccucccgaguagcugggaguaugggccuguaccaccaugcccaacuaauuuucguauuuuuaguagagacaggguuucaccauauuggucaggcuggucuugaacuccugaccuccgugacccaccugccucgccucccaaagugcugggauuacggggugaaguuagcuucgauuucuccucccaaccccagggcccuucucaggguuggucacacagcugugugucaugugguagugaaaggccaucaggugagcagcugugucacuuaccuuucacugugaaaaugcugugugacaaauggcuccaaggccagaggccuagaacagugagcauuuuucaagcucacuugucuacagcuugguggcugucggcugaucuugagguggcuuaguggggauggcugggcugacccagcucugccuccgcaauuuggccaggcuggguacacgcuuguggcugugccagaccacaagggcagaaaugaaaaguagcacuuuuucaaaccucuguugaaaaaaguugggccaggugcaguagcucgcgccuauaaucucagcacuuugagaggcugaggcggguggaucacuugaggucaggaguucaagaucagccuggccaacauggugaaaccccgucucuaauaaaaauacaaaaaauuagcugggugugguggugcaugccuguggucccagcuacuugggagacugaggcaggagaaucacuugaacccgggaggcggugguugcagugagcugagaucacaucacugcacuccaggguaggugauagagcgagacucugccucaagaaaaaaaaaaaggaaaaaagaaaaagaaaacaauuagcugaagcaaauuuugagacugagccugaauccagaggugggcagaauaccccaccugagcggcagggcccuggcagagugggaggugaagacucggaccccugugugcagucagcuguccacggucacugacugacgcugaucgcacaucagcccagcucucaaccuaggcaggccagacaugggucuuccuccaccgcaggcuggauucccaucaggccacggaaaucaugacaucccuuugucugcuuuuuguauuaaaccacuggcaucucugaccaacauucagaugggguauugaugguguuccugaagaccuugaguccuggaguaguaaaugcccucugggcuuccugcagugaagacaggagaggcagccuguccucugaaccuggggaggagcuugugucagcccuuaggagcuguuggccccggugcagggccccccccgagcugaccagccuguguguguguugucuucugugacagaacacccaaacagaaacugaaggaggagccggacagagaagccagggcaggcgugcaggcugacgaggacgaagauggagacgagaaaguaaaggcggguuauuuguuucugaacucccccucauucuucugcuccuguuugcuugggcgggagugcgcaggguggggcucuggguucaaguccagccccauccacccaggcuccauggggccauccagacucugggaaggucaccuuuuccuccuuuugggggccgggauuuguggcuggaugccugugcuggaugccuagugaacacucaguuguccucugucuuucacacuagagagggucugugugagccugggcugagaugugcaugaagcauccucuccugaggccucacugcugagaagccuugacacacagucagcucugacgcacaugucagccacaccuuugauucuuucccagccuccuacguucugagucuagcucucccccugccagccuccccagucuaguuuagccaagugcaugcguuuaaacccuaaagcaucauguggaacacugcugggccucugucaaaguacaggauggccagguugccugcaggcccuccugcaugaacucuagggaagggagcuaggucaucgguggggggcggcgggucccuaucuaagagaugccgaagaccccaagagggucucuggguuucugccuguuacaaucuagagaguggagcccaaggucacgggcuugcugggugacaagcacccucacuucugacccggucgccagugggcuuccauccccaccccauagcaggggagccuuugguauugccuccagccucccaucccucaccucuucuguccaaauguuggucaccuuacugucagcacuccuucagacuggaguagucacauuacucccugcccucuauuggaaacuggcaggggccugagcucacacugccagcacuuuugccucaugguagaaagggaugugagggcugggcaugguggcucacuacuguaaucccagcacuuugggaggcugagguggguggaucacuugaggucaggagucugagaccagccaggccaacauggugaaauccggugucaccuaaaaauauaaaaauuagccgggcaugguggcaugugccucuaaucccagcuacuugggaggcugagguaggagaaucacuugaacccaggaggcagagguugcagugagccaagauuaugccgcugcacuccagccugggcaacagagcgagacucugucucaaaaaaauaauaugguaauaauaauaaaagcagugcccagagaacaaggauuguuggcuguuccaccccagggggccccuugcacaggaggugccaucucugccucccaaagcucuaagagccacugucccccaucccaagagacagggucuugcuuugucacccaggcuggaaugcaguggugcaaucacgguucacuguagccucgaccucccaggcucaggugaucuucccgccucagccucccaaguagcugggacuauaggcaggcaccaccauguccagcuaauuuuuuuuuuuaauuuuuuguagagauaggguuuugccauguugcccaggcuggucucagucaaacuccuagacucgaguuauccaccuaucucagucccccaaaguggcggagugguaggauuacaggcaugaaccguugcauucagucuguuugguuuguucuuuuuuuuuuuuuuuuuuuuuuuuuuuuuuuuuuuuuuuuuuuuaagauagucucucucugucaugcaauggugugaucucgagucacugcaaccuccaccucccagguucaagugauucuccugucucagccuccugaguagcugggauuacaggcgugugcuacuaugccuagcuaauuuuuauauuuuuaguagagacagggauucaccauguuggccaggcuggucucuaacuccugaucucaaacaauccaccugccucagccucccaaggugcugggauuaugugugugaggcaccacgcccggcguguuuguuuguuuguuuguuuguuuguuuuugagacaggaucuugcucuguuucccaggcuagagugcaggagugcaguggugcuaucauagcucacugcagucuccuggguucaagugauccucccaccucagccucccaaguagcuggcacuacaggcaugcaccaccauggaugucuacuuuuuaaacuuauuuuuuguaagccaggcgcggugucucacgccuauaaucccagcauuuugggacacugaggugggcggaucaccugaagucaggaguuugaaaucagccugaccaacauggugaaaccccagcucuacuaaaaauacagaauuagcugggugugguggcgaaugccuguaaucccagcuacuagagaggccgaggcaggagaaucguuugaaccugagaggcagaggugagccaagaucauaccauugcacuccagccugggcaacaagagugaaucaaucucucucucucucuccauauauauguauauauuaaccauauauauaugcugcuuuuuguauuaaaccacuggcaucucugaccaacauucagaugggguauugaugguguuccugaagaccuugaguccuggaguaguaaaugcccucugggcuuccugcagugaagacaggagaggcagccuguccucugaaccuggggaggagcuugugucagcccuuaggagcuguuggccccggugcagggccccccgagcugaccagccugugucauauauauauauaguauauuuugcagagauggggucucagcauguugcccaggcuggccucgaacuccuggcaucaagcaauccuccugccuuagcuucccaaagugcuggguuuacaggcacaugccacugcacacagccuguaaauaaaguuuuauuggaacagagccacacuuucucauuuacauuuugccugugggugcuuuugugcuaccauagcagagaugaucauccugacacagaccacguggucagcaaagcugaaaauacugauccucuggcucuuacaaaaacaguuugccaagcccuggucuaggagguucuuuagugcccucuuguuaguuucagguggggaauuaagugagggaaagugaagccucgugucuacccgguagaucugcccaggccugccugucuuccagcuccacagugcugggaucccuaaccuguaacuucaguguuugcauuuuaucucacucuggcucagaaacuaauuuuuucccuucuuuaucucucuaccucccccuuauuuuucugucaggaugagaagaagcacagaagucaacccaaagaucuguaaguguuuaaaaugcuugugcuuuugugucaucuggaucaguagaaagccuguucuaggccaggugugguggcuugcaccuguaaucccagcacuuugggaggcugaggugggugaaucaccugaggucaggaguucgagaccagccuagccuggccaacaugguggaacccugucuguacuaaaaauacaaaaauuagcugggugugguggcgggugccuauaaucccagcuacucggaaggcugaggcagaacugcuagaagccaggagguggagguugcagugagccaagauugcgccacugcacuccagccuggacaagagugaaacucugucucaaaaaaaaaaaaaaaaaaaagccuguucuagaaaccuguggugauguagauguguggggacccuggggccucugaaggccucgucucgggaugacaagcuggcagugugccuauagagcucccauggguaucuugcuuucccauggggaggcauuaguuugucacuuuccgugcgaguuggcgaugugguuaguguuucuaagcugcuacuugcuguguaucuguucacccugcagagcugccaaacggaggcccgaagaaaaagaaccugaaaaaguaaauccacagauuucugaugaaaaagacgaggaugaaaagguaaaggucucacuuuucuuucuuucuuuuuuuuuuuuuuuuuuuuccccaagacgggguuucgccauguugcccaggcuggucuuaggaaaaagaagacugggcgugguggcgcacgccuguaaucccagcacuuugagaggcugaagcgggugaaucacaugaggucaggaguucaagaccagccugaccaauauggugaaacccugucucuacuaaaaauacaaaaauuaucugggcaugguggugcacgcccguagucccagcuacucgagaggcugagauaggagaaucgcuugagccugggagguggagguugcagugagccgagaucgcacuccaggcuggggacacagcaaaauuagcugggcgugguggcauaugccuguagucccagcugcuuggaagccugaggcaugagaauugcuugaacccaggaggcggagauugcugugagcugagaucgugccacuguacuccugccuggacaacagagcaagacucugucucaaaaaaaaaaaaaaaugcugggcacagcggcucacgccugucuuuucagcacuuugggaggccaaggcaggcgcaucaccugaggucaggaguuugaaaccagccuggacaacauggugaaacccugucucuacuaaaaauacaaaaauuagccaguuguggugauaggggccuguaaucccagcugcuugggaagcugaggcaggagagucacuugaacccaggagguagagguugcagugagccgagaucacaccauugcacuccaggcuggggacacagcaagacucugucucaaaaccaacaacaaaaaauacaaggacauuggucuuauuggauggggccccaccuuuauuaccucauuuaaccauaauugucucuuaaagacucuacauccaaauacagucacauagcagguuagucuuaacauaugaauuuugcaggggacaugacucggucuguauacccccucaucaauuguuugcuuaccuuuacauuuuaguauuuauuuuugagacagggucucacucuugucgaggcuggagugcagugguacagucauagcuaccauagccgcaaacuccugggcugaagcaauccucccaccugggccuucaagguagcugggacuacaggcagauggcacuacacccaguuaacuuucuauuuuuguagagacaggguuuuacuguguugcccaggcuggucuugagcuccugugcucaagcaguccucccaccugggcuucuucaagugcuggaauuacaggcaugggccacugugccuggccaguuauuuauuuauuuauuuauuuauuuauuuauuuauuuauuuacuuauguauuuguuuuuugagacagagucucgcucugccgccaggcuggaguacaguggugcgacaucggcucacugcaaccucugucucccugguucaagcuauucuccugccucagccuccugaguagcugggacuacaggcaugcgccaccgcgcccaacuaauuuuuguauuuuuaguagagacaggguuucaccaucuuggcgaggauggucucaaucucuugaucucgugauccauccgccucggucucccaaagugcugggauuacaggcgugagccaucgcgcccggcccugugccuggccaauuauuuguuuaccuugagguguccacuuacacaggaaagcuaagguuuuaaaaaauuggcuuuuccucuaaaucuuuucaggaagucuuugguuaugagauuuauuuauucauuuauuuugagauggagucucacucacucugucgcccaggcuggaaugcaguggcaugaucucugcuuacugcaaccucuacgucucggguucaagcaauucuucugccucagccuucugaguaucugagauuacaagugcccgccuggcuaaucuuuguauuuuugguagagacgugauuucgccauguuggccaggcuggucuggaacuccugaccuccagucaucugugugccuuggccucccaaagugcugggauuacaggcaugagccacugugcugggccugacuauaagauuuuguauucuaugacuuuagaugguagagugagucagagcucaccugcuggcccucucacugccucccuccccuucucucuguuuuaugauaaucacuuauacaaaguucuuaacaccgaagcacuaucuggguguaaaacacucucuuagccuuuaauccucuuuuguuuucccuguguaggaggagaagagacgcaaaacgacccccaaagaaccguaagaauuuauucuugacauuaucgaaagcagaugguaauguuaaaaugaugguucuagaacaaaagggaagggguuucaguaauugccagagcaaccuuaggcucauuuuggaucggguuggugaacauaggaccaaggugcgucaggcaggaugccccugcggugaagagccacugugaccacgcgccugggccucacugccacagccggugccucccugugccacaggcaccucaggcagaaaccucacaggggcgauuuugauauuuucugaaacaauuaaacaaacgaucuugugauuuuuuuuuuucccccagaacggagaaaaaaauggcucgcgccaaaacagucaugaacuccaagguaaacaucugccgggaauaaagccgguggcggcgcucacgaggcggcugggagcugcucucugagugccaucaucuguguuccugcucccacagacccacccucccaagugcauucagugcgggcaguaccuggacgacccugaccucaaauaugggcagcacccaccagacgcgguacguacagcucucuucccagccuuccucugccugucccuugucccacugcucaccagccccguguccuucagguggaugagccacagaugcugacaaaugagaagcuguccaucuuugaugccaacgagucuggcuuugagaguuaugaggcgcuuccccagcacaaacugaccugcuucagguaagugcacuuucgugugcauguuugcuucguggaaggaggcacauccccagaggugccugcgggcucacgauucuggugauguuuuuuagugccugaccugcaacaugucuuaagcuaacacuucguggauaagagccaccguggagggcugggcgcgguggcucaugccuguaauccuagcacuuugggaggccgaggugagcagaucacuucaggucaggaguucgagaccagccuggccaacauggcgaaaccuaccgaaaauacaaaaaguagccagguguggugguacgcgacuguaaucccaacuacucgagaggcuuaggcaggagaauuucuugaacucuggaggcggaggcugcagugagccgagguggugccacugcauuccagccugggcgacagagcaagacuccgucucaaagagccacguggaaagcugaugaagggacaauagagcuuugcugauuuuugguuugguuuuuggguuuuuacacuacacauauuaccccuccauucugcccacauccugagggucacacgcucagaugaaggccuacucugugcuagguaccagugaucuaggugucguggauguagcugcucagguccugccuucacggagccagaaaugggugauaccugucggguagugacagccacgacagauuuuaaaagccuggugacaugcagagagaauaagugggaggaggaaguucugugaagacgggagagguaaugauuuucaguaaagaccuugauggccugugagagaagaggccgaggggauggccgggguggggcacccuagguagaaggggacaccauuaccagggcucggaggggccugugccagcuguggaaggugaauggugagucugguguggugguugcuggguuggggcugggccacacagggccuugcaggccucagcacugacucuccuguccucugagggaaggugccuggcguccggcccguaccuucaccgaggcucacgucagcucuugagugggcagaggcccugugcucucaggcauccccagccccauuuugcucccucucccugcgggugcaguuacccuccagggcuucaccuuguucuucgugggaaaugccucagcuccaggaacggcccugccuccuuuuaggccugggugguauuuucccucucugugaagaggagggggaagugccuuggggaccccuguuggaagcacccccaggcagcgguuccuguacccacugggagggcacccacacguuccccgugcuuggcugaugguuguuccccucccucuccuucuaugggauccuucuaucuagaucaagaugcuguugcguccaccagcaaccgcuagccccccgaggccuggcccaaagcagggccacacaccucugccugcuggugugagugaggugugcuguggugggcagagcuggcaaccaugcccgagggccucacucuggccuucaccagggacaaaggcuugggggagccuggggcuggggcugccagaguccugagugucucagcuuccucccuaaguugagaucuaucauagauucguuccuggaggguggaugguggccuggaggacacuuuccagaagucacaugccuucuguccacuggagcuggacugccugaguuauuuaggggcucuccauacugcuguacuuggcuugaaacuggcgauagaagccagucauggguggggucuggccuaccaaccaguggguccugccccugccuggggcuuagagcuucucucccaugucuccccuauggagagagccuccagcccaccugugcagcggggagcgggacccccucuucuguaggcccucccuugauccacgcuggcuucaucucucugucucuucuucugggccuuacauccugaggcagggcugcaaccuauucugucugccaugccugguacgcaguaggggagcuccgcaggagguaugcaguguuuuguuugagccuuucuggcuuccaaggcacuaagcugggugagugugguggagggugcucuccagagaccugugcagacuucauaugggggcucugaggauagcccagcaucuuuggccgggaaagggugguccuugucuagaugagcagguuuguaagcagaacacccaguucaugucuuuuuccuugaguuugacaucuugccucucugucuucacuaaagaacgugcucccgaaugucaaggggcaucuggacaguggggccgcagguguuugagauuuaugcccaaaaggaggcagaaguccuuccuucccacaucccuuuucacacuguucuauaaccugcuuuauuuucuaaauugaggucuaacucguauaauauaaaauuaaccauaugagguaucuugaauaggugaauucauagguauagaaagcagauuggugguugccgggggcugggggcugagggccgguugggaggagacuggagagugacugcuacuugaugggaaugaggcuuuauuaacauuugagugacagaaauguucugcagcugaauagagcuaguggcugcacugcauaguagaagguguucuagaaaccgguauuucccgcacuguaagucugacugaucuuuugguguugcuguugcagacacacauacacuugaugcuuaggugggagaauaagguagaaacucugggugauagaacgcugucuuaauccaguguucccgcaaccaaaaaaugagugucggggccaggcauggugguucagccuguaaucccagcacuuugggaggcugagguggguagaucacuggagauaaagaguuugagaccagccugcuacacauagugaaaccccgucccuacuaaaaauacaacaauuagccgggcauggugguucaggccuguaaucccagcuacucgggaggcugaggcaggagaauuacuugaacccgggagguggaggcugcagugagccaagauuaugccaucgcgcuccagccugagggauagagcaagacucugucucaaaaacaaacaaaaaaagagugucagacuuguacauucucucauugccucgugccugaucugaagucugcacgaagacccgccuucacggcuuagcugguaagcaugugcuuuguuuccugucuaguguguacuguaagcacggucaccugugucccaucgacaccggccucaucgagaagaauaucgaacucuucuuuucugguucagcaaaaccaaucuaugaugaugacccaucucuugaagguaaggaauaguccgggauuauguuuggggcacacuuuaaaaacagccaggcaggguggcucacaucuguaauccuagcacuuugggggucugaggccagaggaucacuugagcccgggaguuugagacgagccuggacaacauagcaagagccugccucuauuaaaaaaaaauauauagcauauauauauaguauacauauauacuuauauauauguauaaauaaaaaacauacuuaugaagcaauagucagcuggaguugcugcugccucuuaaaguuagggugugagacuuugugccaggagcagcuguaggccaagucauugugaugacugaggagcacccgaccuggcugaugggaugucugcugagugggcgcuuagagcgccuccuggguuugggaugugagucagagccuuuaguccauuuccuuuuucugcucuaggugguguuaauggcaaaaaucuuggccccauaaaugaaugguggaucacuggcuuugauggaggugaaaaggcccucaucggcuucagcaccuguaaguguguggcccaucauaggcuggccggggucugaaaggggccuucauguucuccuuccugggggcugacggggcucuggugggaauucucagcaggcuugcagaaggccaugugacugggaaccuuagcagguucaguugggguagccucuuguguuaguuaugacuggcucuggaacugacucuccaguuguaagagcaggucuuggccggauaugguggcucacaccuguaaucccagcacuuugggaggccgaguuggggggaucauuugaggccaggaauucgagaccagccuagccuggccaacauggugaaacccccucucuaccaaaaauacaaaaauuagccacgcaugguggugcauaccuguaaucccagcuacuugggaggcuauggcaggagaaucacgugaacccagcagacagagguugcagugagccgagaucacgccacugcccuccagccugggugacggagcaagacucuguccuccccugaaaaaaaaaaaagagcaggucuuauucuugcaacccaaacccagacugaauuccaaacaccagagaugagcucaaugaaggccuacucagcuagucuucgcucucuggcuggcucagacaggcuucuucagaacaagccagcuaugauguguugugcccuauguuucugacauuuggguacgggaugacuuuuagacuguugggugaguuugguagacuccuccaugcccuguggccacuguaggcgccaucagauuccagccccuuuuccacaccuccucuguucaccccagcauuugccgaauacauucugauggaucccagucccgaguaugcgcccauauuugggcugaugcaggagaagaucuacaucagcaagauugugguggaguuccugcagagcaauuccgacucgaccuaugaggaccugaucaacaagaucgagguaagagaucgaggguccucagcauccgggauucccacuggaaacuugccuucagaaccagcagacacuguucuucaguuggauuuaggccaguuuggcuuaagcaugagagaaaccuguucucuuucaagaccacgguuccuccuucuggccucaacuugaaccgcuucacagaggacucccuccugcgacacgcgcaguuugugguggagcagguggagaguuaugacgaggccggggacagugaugagcagcccaucuuccugacacccugcaugcgggaccugaucaagcuggcuggggucacgcugggacagagguaaggaugcggcagggaccagagugaagacuggagaccggggaggguagagcauggcccacauccucugucccaguccucugagaugcuggaaccucucccguaggcgagcccaggcgaggcggcagaccaucaggcauucuaccagggagaaggacaggggacccacgaaagccaccaccaccaagcuggucuaccagaucuucgauacuuucuucgcagagcaaauugaaaaggaugacagagaagacaaggagaacgccuuuaagcgccggcgauguggcgucugugagguaaccucaccugugggugcucccgcuccccuaagguggcccagccucuggccugaucugaggacugcuccaucuuucucucuguggcuugagacucuggcugcucaaaugugaccccugagacagaaauuaguuaguggucugggaggacccugcauacuucauugaacgucaauaggacagauguccacagaggcaugcuugggugcuuugcugauaaugccacuguccuuaauugaagagccuggcuucuggguggcucugcugugccugcaucucacagucugaaggccccuguuggacugcuaaagggguauucacaucuaagugggcacuuuguccagcuuagauuugaggcccucaggaggcgucccuuucugugaguuuuuaaaauauauguuuacuucacucaggaggaacuaacuuccuaguccuaugacccaaagaccaggacuauuuugauaccuauuaccugacuuucuuuuggauaaagacuggcuucagggcuuugcuuuugauccccgcuggcaucucuuaacaggagccugcauguccucaccauuguuauuuugguuuuauuuuauuuuucuugguuaacacacguguguccaauguuuuauaacuucuaaaaucuuuuuuuuuuuuuuuuaauuuuuuugagacagucucucucugucacccaggcuagagugcaguggcaccaucucagcucaccguaaccuccgccucccggguucaaucaguucucccaccucagccucccgaguggcugggauuauaggcacccgccaccauacccggcuaauuuuuuuuguauuuuuaguagagaugggguuucaccauguuggccaggcuggucuuaaacuccugaccuuaagugaucuaccuaccucggccucccaaagugcugggauuacaggugugagccacugugcccagcccuaaaaucauuuguuuuuauuuguguaacuguuacguguugauacugguagaucuaguuauuucauuuuaaauauucuguaguauuuuguuaaaugaauauccuaacuuacuccucaaugauaggcaccucuucaguauuguaaauauguggcagcauccuugagcaaagcuucucgcgaguguaucugcuuagaaguagcguugcuggguuguggguguguauucuuaacuuugaucuagaagauugcucuccaaaaugguucuaccaacuuaccauuugagcagugugcguucuucuuuccucacaccaccuaucuggcuucuuaacccaucuggagaaugggaagggaauuuuauuucucucacuuaccauauuucuaaugagguugaauauugcuuuuuuuuuuuuuuuuuguagagacaggguccugcuguguugccuugccuggucucaaacuccuggcuucaagugguccuccugucuuggccucccaaacugccgggauuagaggcaugaggcacugcacccagccaaauaggcacauuuuuaaaagucuugguuuuguuguuguuguuguuguuguuguuguugagaugggucucguucugucacccagucuggaaugcaguggcaugauuguagcucacugcauucucaaccuacugggcucaagugaucuucccaccuuagccucccaaguagcugggaccacaggugcacgccaccaugcccagcuaauuaaaaaaaaacauuuuguagaugggauuuugccauguugccuaggcuggucuugaaugccugaacucaagcaguccucccgccuuagcauccugaguugccgggacugcaggaauuugucacacgccuggcuaauuuuaauuuuuuguagaguugggggucuuaauauguugcccaggcuggucuugaacucuuggacucaagugauccaucuaccucugcuucagccucccaauguacugguucagguaugagccaccaugcccagccuaaaagucuuaauucaccguuuguuucauuguugcuaagggcugugugacucacuuuuuuuuuuuuuuuuuaauuuuuugagaccuaaaagucuuaaugcaucauuugucucauuguuaguaagggcugugugauuugcccuuuuuuuuuccuuuuuuuuuuuuuuuuuuuuuuuuuuuuugagauggaguuuuacucuugucguccaggcuggaauaugguggugugaucuuggcuaacuguaaucuccaccucccagguucaggcaauucuccugccucagccucccaaguagcugggauuacaggcacacccuaccaugccuggcuaaucuuuguauuuuuaguagagaugggguuucaccacguuggccaggcuggucugcaauuccugaccuuaagugaucugccugccucggccuucugaaauacugggauuacaggcaugaaccacugugcccagcccugauuugccuuuuuaaugccauuuuuuaggugugucagcagccugagugugggaaauguaaagccugcaaggacaugguuaaauuugguggcaguggacggagcaagcaggcuugccaagagcggagguaggucaggccgagucuuccuccuguggcagaggacuugccagcugguggcagaugcacuguggagaagggccugcaugugugggacagcaccaggauuccuucguuaggcauugucucaggaccugucccuguuaugaagaaaacagccccgguuggucuuacuuagaaaaggggccuuagguauaaccagugacauugcaggugucccaauauggccaugaaggaggcagaugacgaugaggaagucgaugauaacaucccagagaugccgucacccaaaaaaaugcaccaggggaagaagaagaaacagaacaagaaucgcaucucuugggucggagaagccgucaagguaacccuuggagccccuuggucagcucacugccauguucccaauaagcagguugcccucuaguaucucgccaaccugaccucucaggcagccugagccccggcacuaagaaaccugucuguuugccccugagaagagcgggacuggccaagagaccauguuccauggcucaguaccagcaaggcauuuuuguguggccacaaggcucaguucuccuaaugucccaaaaugggcauuugacacaguucuaggggcaucaggcaggugagcccucauagcuuguuuuucuguuuuguuuuguuuaagauggaaucuugcucugucacccaggcuggagugcaguggcacgaucucagcucgcugcaaccucugccucccagguucaagcgauucuccugccccacccuccugaauagcugagauuacaggcgugcaccaccaugccaggcuaacuuuuuuuguauuuuuaguagagacgggguuucaucauguugcccaggccauucucgaacuccggccucaagugauccacccaccucagccucccaaagugcugggauuacaggcaggagccacugugccuggccccucauagcuuguuuccaagagagcugucacagcccccucugguguggggugggucuuuuuggggcaccaacagauggccucccauccguucuguggucauuggcuucacugaaggucaguuccuuuaccacagugugagagagaggagugaguauccucuguguugcuucucugacguccauaaauuaaagaugcaaucaguucacuuaauuaugaggcuugccaccugcuggcugccugggccguggcugagccccugcaggaggacagacauggguacugcugcauggcaugagugccucugcaggguagggggcugggaggaggcuggggccacgaggccuugcagaggugacaccugggcugagauggagaaggucagguaggaccuagccacacgaccugggggagagcugcacugagguggcagucagcuuacuuuguuggagaaaaggaaggaggccccugcagcuggaguggcuugagccaggggaugaugggcaggacaggggucaggguucaggcuguggccuuacagaccauggugagguauugugggcugugcuguuaaaaucaaauccugggacccgaguggcagagcagaagugggagggacauggaugcccuuggccacagcaucuggccaaggaagguggauguucuucuuuuuucuuauuauugaagcccuuguagaacaggauguucucuuuagcagcaacucuucauugacuucuuaaugaaaucgagucaugucuuacuuuaaguaacagaggaccaugcaagucaaggccagcaaagacccucagaaugauccuccaugaacuuaugcucucauuuucagacugaugggaagaagaguuacuauaagaaggugugcauugaugcggaaacccuggaagugggggacugugucucuguuauuccagaugauuccucaaaaccgcuguaucuagcaagguuugcaucuuucuuuuugcuugacuucugcaugcacuuucucaucaaguaggagaugccuguuuugccaaaauagcaccagcagcuuuuugcccuagaugaaaacugaaaaggacgagugcuccugcauagacuuggucacauaucugcuggccaagucagaacuuucuccccaugcccgucuucugauuccagggucacggcgcugugggaggacagcagcaacgggcagauguuucacgcccacugguucugcgcugggacagacacaguccucggggccacgucggacccucuggagcuguucuugguggaugaaugugaggacaugcagcuuucauauauccacagcaaagugaaagucaucuacaaagcccccuccgaaaacugggccauggaggugagugccuggugucccucgugagccccugccuuaucguggagggucacugcugacgugcguucuguuuuguuuugauuuguauuuuuuuuuaauuugguuuuuuuuuuguuuuuuuuuuuguuuugagacugaguuucgcucuuguugcccaggcuggagugcaauggcaugaucucagcucacugcaaccuccaccuccuggguucaagugauucuccugccucagccucccgaguaguugggauuacaggcacccaccaucacguccagcuaauuuuuuguauuuuuaguagagacgggguuucaccauguuggccaggcuggucucgaacuccugaccuuaggugauccacccgccucggccucccauagugcugggaauacaggcaugagccacugcgccuggccugacacgcauucuuaucucccaagggaggcauggaucccgagucccugcuggagggggacgacgggaagaccuacuucuaccagcugugguaugaucaagacuacgcgagauucgaguccccuccaaaaacccagccaacagaggacaacaaguucaagugagcacuggggcuggacucggggucagcaggcacuuucagcccacaucacucccuuuucccgugugcuuccgucugguuggcuuccgccaacggccccccaguuugugucucuugcucgucaaaggccagccugacuaugaaugaugcucaaguguguagauggccuggaguugcuuuaaguguguggaugaccuggcguugucuuuguaagaggguucccuacccaggaacaggguucgucuugccauuucaagacuucccguguguucuucagugugugcccagcucuugcauguuuuuggcuguuucuuagauauuuucuccuguaaaugagaccucuuauuugauucuuuucuuuccuuuuuuuuuuucuuuuuuuuuuuuugagacggagucucgcucuguugcccaggcuggagugcaguggugcgaucuuggcuuacugcaaacucagcuuccuggguucaugccauucuccugccucagccuccugaguugcugggacuacaggcgccugccaccacacccggcuaguuuuuuguauuuuuaguagagacgagguuucacuguguuagccaggauggucucgaucuccugaccuugugaucugcccgccuuggccucccaaagugcugggauuacaggcgugagccaccacaccuguccucgauucuuuuguaacugggugacugcuuugagggaagcuuuuauuuuuuauuuuauuuuauuauuauuuuuuuaauuuuuuuuuuuuuuuuuuuuuugagacagaguuucgcuuuuguugcccaggcuggagugcaguggcucaaucuuggcccaccgcaaccucuacuuccuggguucaagcgauucuccugccucagccuccugaguagcugggauuacaagcaugggccaccaugcccggcuacuuuuuuuguauuuuuaguagagaugggguuucuccauguuggucaggcuggucucgaacucccgaccucaggugaucuacccgcuucggcuucccaaagugcugggauuacaggugugagccaccgcgcccggcgagcuuuuauuuuuuaauguccaaugccccaugccuucuuuuuaaccuccguaccucacuuguuucaacuaaaagcagcagccagcacccccagaggagcagguggcaaccagggaaacccaggaggccaagagggcuccccgggggcaucugugcuucucccauaagucucgugcuagcuuuggcuugaucucuauuuucauuuuauuuuuuacuuuuuugugauggaguuucacucuugucacccaggcuggagugcaguggcacgaucucggcucacugcaaccuccaccuccuggguucaagugauucuccugccucagcuucccaaguagcugggacuacaggcgccugccaccaugcccggcuaauuuuuguauuuuuaguagagacagggcuucaccguguuggccaggcuggucuggaacuccugaccuugggucaucugcucccuucaggcuccuaaagugcugggauuacaggcaugaacuacugcacccaaccucauuuacuuauuuauuuaucacccaaccucuuuuauuuauuuauuuauuuauuuauuuauuuaucugagacagggucucccucugucacccaggcuggaaugcagugguguggucacagcucacuguagccucgaccugcugggcucaagugaucuuccugccucagccuccugaguagcugggacugcaggcaugcaccacccugccugguuaauguuuuaaaaauuuuuuguagagacggggucucacuguguuggccaggcuagucucaaacuucugggcucaagcgacccuccugccuuggccucccaaagggcugggauuacagacaugagccaccaugcugggccuugaucucuauuuuuaaggccaucuucaagucuccuuuaagggcuuacuagucaagaauaauguugaauuuccucaaauaccuguugagccuuuauggagagaacaguaggagucucugcuggauugaguuccucacugagccacucgggacuguugcucgugguguguucuuaaccauauucuagacccuguucauugauaucuuaggguuuuugucucaaugacucaaaaguugccugauuuucuugcuauguucucucugggcuuuggucucaaauaagugccuucaaaaugucaacacaaagcacaagaaagccaccucuuccuucuagcaucugcaaauguuuuuuccucuugguuaccagagucucuggauuaagcuggcaguagcugcugcggccacugccggccaccucagggccuuauguuucugucccuuuguuuccuucagauucugugugagcugugcccgucuggcugagaugaggcaaaaagaaauccccaggguccuggagcagcucgaggaccuggauagccggguccucuacuacucagccaccaagaacggcauccuguaccgaguuggugaugguguguaccugcccccugaggccuucacguucaaguaagugcccccucggagcagccggggccagggcgcuccaggcugagccaggcuggcuuuguggugucccccuccuuacagacauugccaaucccuccgcaccagcuguuguccuagccgucacguuggcauagguggcaaacagacaacauaaaucguguagacugaccaugaugcuauugcagagcaaagcugagcguaaaagucaacucgcugguuuggcugggugugguuucucacgccuguaaucccagcgcuuugggaggccgaggcaguggggaaucaucugaggucaggagucugagaccagccuggccaacauggugaaaccucgucucuacuaaaaauacaaaaauuagccgggugugguggugcgcgccuguagucccagcuacucgagaggcagagacaggagaaucacuugaaccugggaggcagagguugcagugagccaagaucaugccacugcacuccauccugggcaacagagugugacuccgucucaaaauaaaaaaagaaaaaaaaagaacuuacuggauaaagcgcgagggacagcugggggcccacccccaaguucugccucugcccaaggacaccuccucuccguccccuacugugaagugggagagugggaucuugccugcuggggcucgaaggguugagugaguugaaagugcuccauacaguaccuggcuuaaaguaaagguuuaacggacaugaguuacuucuugguuagagggaaucacaucagaugacuucucugugucagaggaucgaggcucuuccaggaaaaaccuaaagccacagaucguuuccacacugauccauucuguguuuuuucuaagaaucagcgugugguuggaauuacagccaacguuuuccagaugccuucccggcucacaauuccauuuccuuagagccccagcucccuugccuuaguucaguuacugugaauuaugagaacuggagaagcagguucccuccagccuuggcacaguuggggcgcguuacccccucugguuguccuuggugggaaggggacaccuccccguaguguuuucugccaguugcuccuggcaaagugggagagucagcacagagacgccuuuggggcccgucagacuccuggggggccuaguggggagaacgugacagcugacuucccuaacggcaggccuucuucaaagaacagcuuuuccacacuagucagaccacacucccauugucccaggcccuguggcgccuuacauuggccuccagugucgcuucuagaucagagccuuagucaggguagcguagguuguaucauagcaacaaccccaaaucacagugacuuaaaaccacagaagcuggacugggugcgguggcucaugccugucaggaguucaagaccaagaccagccuggccgacauaccugucucuacuaaaaauaaauuagccaggguuagcugggugugguggugggcaccuguaaucccagcuacuugggaggccgaggcacgagaaucgcuugaaccugggaggaggaguugcagugagccgagauugugccacugcacucuaaccugggugacagagugaaacucucucaacaaaaaccacgguagccgcugucucgcucauacgaggugcccaucacaggucagcagaggacuccaccuguugugucccuuggauaucugggccgcuggagucagaaguugccaguguuugagcccaagggaaagcacacaggacauuccccaggcagugacauccucuuuggucacuucugcccacgucacaugccaggaaacacaagaugccaaguagucgggaggcaggagccugggguauuugagcagugucagccaccaccguagccaguaaugcgcagagggugaaugcgugcuucaaacugugagacuaaaucugcagcuaaaucuuuuuuuuuuuuuucugugagauggagucuugcucugucacacaggcuggagugcaguggcacaaucucagcucacugcaaccucugccuccuggguucaagcaauucuccugccucagccucccaaguagcuggaauuauaggcauguaccaccacacccggcuaauuuuuguauuuuuaguagagacaggguuuuaccguguuggccaggguggucucgaacuucugaccuugugguccaccugccuuggucucccaaagugcugggauuacaggcgugagccacaaugcccagccuaaaucauuucuuaggguacacaccuaccuuaauucaucaggugcuugacuuuaaaugguuauuuucacuggucagucaugccugacugaccacugcaagguggaagguucauugaugucaagugggugcuucucugcagcaucaagcuguccagucccgugaaacgcccacggaaggagcccguggaugaggaccuguacccagagcacuaccggaaauacuccgacuacaucaaaggcagcaaccuggaugccccugagcccuaccgaauuggccggaucaaagagaucuucugucccaagaagagcaacggcaggcccaaugagacugacaucaaaauccgggucaacaaguucuacaggucagcagaggccucuguucuuccacgaggccacagacucuucuagaaggcucugccugaaacaagguuguggcauagcacccacaguuguucuaagaguuagguugaaguagcuguuuuuccaaguguuucugauuaucggugggcacugauaaugacuagaauucuaguucccagcccucacuuuuagguccuuauuuuaauguugcagagcccuuuuuccaaaagaaauccuuaagcuggcugggcacuguagcucacgccucuaauccuagcacuuugggaggcugaggcaggaagaucacuugagucuaggaguucaagaccagcuugaggaaacguagugagaccccggcccuaccaaaaaaaaaaaaaaaaaaagacuagcugggcgugguggcacacgccuguaaucccagcuacuugggaggcugaggcugaagggaucacugaaacccaggaauuugaggcuguagugagccaugaucccaccacugcacuccggccugggugacagccagaccccgucucaaaagaaaaaacggguagagugccugggcacccccagagaaccucccaagcuccaucuaugacuguccagguucugucccgcuguccccaccucuucccagguccuccuuucugucucugggauuuuuucucuuuccuaagcuuuuggccuauuacguuuucuuuuucuaagacccgaguaacuugcggugauuaggcauuaaccugaaacuagccuguacaggaagcuauacacuugccucaccucuuagcuaacauagaucaaagauuuccugaagccuuuguaauaacaggaaauaaaacaagggcugugagugguacaggugagagaaacacacucgagaggcugcuaccggcaggcggacacagcagggcagggccaggcgugcagagcaagcagccaagcugaccuaaugguuggggggucucuacccugugguucccuaauugggggcgaaucuaccuugcaguucccucauuuggggagggguuaucuuuaccugcgguucccuaaguaggggggucuuuacccuaugacucccuaacuggggaggucuuuacccugcgguuccauaacuggggggucuuuacccugcgguucccaacugggucgggggucauuaccuggcgguucccuaauugugggggaaucuaccuugcaguucccuaaugugaggaggggauaucuuuacccugugauucccuuacugggaggggucuuuacccugcgauucccuaacuugggggaucuuuacccugugguucccuaacuagggggggucuuuacccugcaguucccuaaaugggggggagucuaccuugcaguuccccaguguggggaggagauaucuuuacccugcaguucccuaacugagggggucuuuacccugcgguucucgaacuagggggucuuuacccugcaguucccugagcaccccaggaacaugguacuguuuaauucagcauaagcucaccacaaaggagagcuccuaacgaggccucucccgcucgcaggccugagaacacccacaaguccacuccagcgagcuaccacgcagacaucaaccugcucuacuggagcgacgaggaggccgugguggacuucaaggcugugcagggccgcugcaccguggaguauggggaggaccugcccgagugcguccagguguacuccaugggcggccccaaccgcuucuacuuccucgagguggugccccugcuugcuagagggaaggcuucggggucaaaguuggccagaaggagucugaugucggguuauacacaaggcggcuuggcugcaggguuucagcuuuuguaagaagugggugguuggcugacgugaagcuguucugcaggagcuuuacgggggucugagcaggguucuccagagcacaaguuguaugagauucaaguggucccggaguuuaacacuccugguuuuuaaaaaguacgucauuagagaaccuaacguuuuagugucuuggugcaacugaacguugaggaccaugaggcagcuuccaccagccugacuggugucuuaguaugaguuggagaaggugccccugcuccugggucccuugggccaggcgccuacguccaggcccagcccacaugccugugcggguggcccucguuauggagagggcccacgagucagcugaucaagcucaugacuuguaaauuguuggggcuuggccuuuccguguuguuaccuuaaaacgauacauccacguucucccaggcauggaugagguagcccaauuggacagcagauucugcauagcacuuuuuccuguucuagaagguacucucaagugcuuguaauaggcauuucagugucagccagaucaaauguuaguauuaauaaaauggauuguuuuaaguuucuauuguagcaaagucaaacuacucuuauugguggcuaauuggucauggccccacugagggagaaauuaagugacuaucaaauugccuucuuacuagucugcguuagagaggggacagugcguuucucucccaaacgauugcaguucucuccuuuucaggccuauaaugcaaagagcaaaagcuuugaagauccucccaaccaugcccguagcccuggaaacaaagggaagggcaagggaaaagguacgucauuguaugaguuucuuuucaaguuauucuucuguaacuuggaggcugccugugaaucccucaguguaaaaccaccucugguguuacugacucugggacagcgaggccgccugaguuaacaaggcgcuugagagcaagguggacuuggacucugaggaucggguuuagccucuggccucucucccccagggaagggcaagcccaagucccaagccugugagccgagcgagccagagauagagaucaagcugcccaagcugcggacccuggauguguuuucuggcugcgggggguugucggagggauuccaccaagcaggugagcgcccguaggcuccaucucugaauaccuggugagcccagaccgggcaggugcuaccugaaacgacuuccaaccccggucaccuuccugacucaagaaucuccuuccgaggccaggcacgguggcgcacgccuguaaucccagcacuuugggaggccgagguggguggaucaugaggucaggaguuugagaccauccuggccaacauggugaaaccccgucucuaauaagaauacaaaaauuagcugggcgugguggugugugccuguagucccagcuacucaggaggcugaggugggagaaucgcuugaaccugggaggcagagcuugcagugagccaagaucacaccacugcacuccagccugggugacagagcgagacuccaucucaaaaaaaaaaaaaaaucuucuggagaguugaaagcauggcuucgugcuugaucugccaggcaucucugacacgcugugggccaucgagaugugggacccugcggcccaggcguuccggcugaacaaccccggcuccacaguguucacagaggacugcaacauccugcugaagcuggucauggcuggggagaccaccaacucccgcggccagcggcugccccagaagggagacguggagaugcugugcggcgggccgcccugccagggcuucagcggcaugaaccgcuucaauucgcgcaccuacuccaaguucaaaaacucucuggugguuuccuuccucagguaaacggguagaagccccccaguguugccagacggcccggggcugugccgcaugucagcaguggucauuuucgcccugcacugaggccucugccccccggaagcucacagcucagcucucaccagggagagacuuugauaacauucgugaggggcuuccggcacagugggucguuucuucccucugucuguggaggugacuccugcagucucuccugcccccuacagcuacugcgacuacuaccggccccgguucuuccuccuggagaaugucaggaacuuugucuccuucaagcgcuccaugguccugaagcucacccuccgcugccugguccgcaugggcuaucagugcaccuucggcgugcugcaggugggcccuggggcuggggcgggcagacagauguggccagcacgugacccggccagcagccagccaucccuuacugaaggcaggguucaauggcauaggccugccauccaggcagcagaggcuggcauggugcucugucccacuggcggagucaggggagaugcgugcucagccggcccccagcaaguccaccgcuagugucucuugagcuguguucucgaacaugccugggagggcuggcuacaaugggcuucucgccaugcagcuccuggcuccuuucccucgauggggaagggugagcagcccaccauggagcacuguggaauggcugagucugcacagagcgggaggggaagugaggugcgcagagccauguguaggcggcagcuguucgauugguuuaaaagacaguuuugcucuggguaacugcgcacacaaacccccacagauggccgaggguugcacuccagguggcugugucugcagggacagggauggacauagucuguggggcccaggccuuaucugaaaagcaucccccauccucucuguaucagcucagcaauugagggcauaauuaaaaaugaaacagcuauccagaugcuagcacaggaugucugccuaagugggcaagcacuuggcuacccgguccccuagcucagccucagggcgacucaggcucaccagacaagacuuguugcagccacguucucuguccuugugaccacagccaucagggaagcgacagggcuccuggucuccaguguucuccccgagugcuaagaccuuggggcccuugcagugcuuucagagcuggccggacuuccccgcaggguuugcucccaccuuccccaguggcuguccccugggcucagcugcuuuuguucuuuaucugcuccaaacuccucugaccaggagcacgccugcugagguaacuggggauuucugcaagugcacuccgcauuggccagccacucccgacucaggcugcugacccugggccugggucuggccaguccaguugggagugucccacugacggugggguuguccguccuucucccccacaggccggucaguacggcguggcccagacuaggaggcgggccaucauccuggccgcggccccuggagagaagcucccucuguucccggagccacugcacguguuugcuccccgggccugccagcugagcguggugguggaugacaagaaguuugugagcaacauaaccagguagguggcccccgucgcuccuccacacacugccgagcaggccucaguagcucauggggcccgugaguacucccuggugaggcuuggggaggagaggaugguacagcaucugcccugccacacggugcucugccacauggcacucugccaccuguggucuccaguucugacccugcaucaucugcuucccuaguagauagcaugugcagagcggccagccgcaugcuuggcuguggucauccacaaagcccacgccauagccccauccccccuuccagauggcauccaggcacacugccacccaugugaccucgggcagugcugugaucucgggagaaggccaucugagcaggcaggggguggcaccugugaugaggggacagcugcugcgugcaucuccagagguguugaccuccuccucuguugcagguugagcucggguccuuuccggaccaucacggugcgagacacgauguccgaccugccggaggugcggaauggagccucggcacuggagaucuccuacaacggggagccucaguccugguuccagaggcagcuccggggcgcacaguaccagcccauccucagggaccacaucuguaagguaauggcacccugacagagcggcuccuccucgaggcccagcccagcagccucgugggaacagucagccugcccaagacucaggggagacauggaaucugaucccaggcuccuccucccgaguccucagccuuugugugaccccuggucucucuugcauggucaugggaagugucagagcucccgcaguccuggacuuggucuggaauggugucaagccacugcccacccaccacugccuucccccuugcugccucuccccgcauguuuucccaggaugccaagaccagcccuuucaccauccccuggcaccacuccccuucccccacccuaaaggcucagcuuagauucccacgcucuccuacaccugcgcugccucaggucccugccguggccucgagccaagugcgauaucccugacugucucuuucccgaugggcgugagccccagggggcuuccuggucaccaugguguucccagcucccagcccaccauggaugcucggaugcugcucacaugaggugacagcugggccccccacacucuuucaggacaugagugcauugguggcugcccgcaugcggcacauccccuuggccccagggucagacuggcgcgaucugcccaacaucgaggugcggcucucagacggcaccauggccaggaagcugcgguauacccaccaugacaggaagaacggccgcagcagcucuggggcccuccguggggucugcuccugcguggaagguggguccuguaaguugugguucccggugggcugaggggaaggaaggcagagcccugggccuuuggccugugaaccuggaggccagggcagggcacagacacaccaagccugggugucccagagaagguagcugcugaccauguugaguaguaaaagcaggcuggguucauggcccacaccuauaaucccagcacuuugggaaaccaaggcgggaggaucacuugagccugggagguugaggaggcuacagugagcugugauugugccauugcacuccagccugggagacagagugagacccugucucuaaaaagaaaaaaaaaaaacaauaaauaaauaauaaaagcaggucaggcacgauggcucaccucuguaaucccagcacuuugggaggccaaggcaggcagaucacuugagaucaggagcucgagaucagccugcccaacauggugaaaccccaucucuauuaaaacuacaaaaauuagccgggcguggugucgcacgccuauaaucccagcuauuugggaggcugaggcaggagaaucgcuugaaccccauaggcagagguugcagugagccaagaucaugccauugcacuccagccugggcaacagagcgagacauauaauacuaauaauaaaaacagugcccagagaacgaggauuguuggcugcuccaccccagggggccccuugcacaggaggugccaucucugccucccaaagcucuaagagccacugucccaagccuauaccccaucccacaacugcagccucaucacuguccugucuuccagccggcaaagccugcgaccccgcagccaggcaguucaacacccucauccccuggugccugccccacaccgggaaccggcacaaccacugggcuggccucuauggaaggcucgagugggacggcuucuucagcacaaccgucaccaaccccgagcccaugggcaagcagguagguggggagggggcauccgagggccugggucaggcccuguacuuggcggccuaacuagguggaaguguggguuuagccaagugggggacagcaccccaggaccccaggcaccuggccucugccuccugccccuccacguccacgggacaagcucauaggccaaggccauggccguaugcugucacagugccauuucccucccuguccccgacggugacccggccugggugcuacugcccucgcccaccgcgccucuuucccccagggccgcgugcuccacccagagcagcaccguguggugagcgugcgggagugugcccgcucccagggcuucccugacaccuaccggcucuucggcaacauccuggacaagcaccggcaggucaguggggcggcgcccgcugggucuggacaggaaggaggcuucugugccugucaccagguggggcuggggccagcgcagucacuuccgggaggacgccugcuggcugccggguagccccaucacucucagugggaagacggcccacaggagggacagugcugagacauccgagucaggcugcgucccuaugcugguuccuuacuguuuguuuuugaggcagagauugagccagaaggacaguccgucgcgcuaaaggagcaggcuaaaacccaugguggcgacagcucacucgcuguagguucaaaugaacuagcaccuuaauuccuaccugcuucucaggugucggguuggcuuaacaaguuagucuaugaguuagucucaguuaaguguauuuucaucauagggcacgcgcauugcuuaaaaaccaguguccacgguucuugugaaaaccacauuucaccccuccccccgaaucugguucucgggaagcagccacucucucuuuuuuuuuuuuuuuuuugagauggagcuuuguucuuucgcccaggcuggagugaaguggcgugaucucagcucaccgcaacuuccaccccccugguuuuaagugauucuccugccucagccucuugaguagcugggauuacagucaugugcuaccacacccggcuaauuuuuguauuuuuaguagagaugggguuucaccauguuggccaggcuggucccgaacucuugaccucaggugauccgccugccucggccucccaaagugcugggauuacaggcaugagccacugcgccggccagggaagcagccacucuuaacugggagcgaaacgugucuagguggcccauuugucuuuuuuuuuuuuuuuucugagacagggucucacucuguccccuaggcuggagugcagugacaugaucucugcccacugcaaccuccaccuccaggguucaagugauucuccugccucagccuccugaggugcugggauuacaggcaugugccaccaugcccagcuaauuaguuuuuguacuuuuaguagagacgggguuucaccauguuggcgaggcugcucucgaacuccuggccucaacuaauccaccugccuuggccucccaaagugcugggauuacaggcgugagccacugcucccagccccacgugucuuugucucaagucuuucugaagcucuucaaaggcccagugacuuguggcuguggggcgggaugaugggccaguuggaggguccaaggaucuugugcuggaaggguuuugggcccaugugagcaggaccagaacccuuccccaaggggugcaaugcccagguuguccuccaucugagcaggggcuggcaguacaccugcccccgggccuugggccuggguguccacaucaggcauugcccuucuccccuccugcaggugggcaaugccgugccaccgccccuggccaaagccauuggcuuggagaucaagcuuuguauguuggccaaagcccgagagagugccucagguaugguggggugggccaggcuuccucuggggccugacugcccucuggggguacaugugggggcaguugcuggccaccguuuugggcucugggacucaggcgggucaccuacccacguucguggccccaucuuucucaaggggcugcugugaggauugagugaguugcacgugucaagugcuuagagcaggcgugcugcacacagcaggccuuuggucagguuggcugcugggcuggcccuggggccguuucccucacuccugcucggugaauuuggcucagcaggcaccugccucagcugcucacuugagccucugggucuagaacccucuggggaccguuugaggaguguucagucuccgugaacguucccuuagcacucugccacuuauugggucagcuguuaacaucaguacguuaauguuuccugaugguccaugucuguuacucgccugucaaguggcgugacaccgggcguguuccccagagugacuuuuccuuuuauuucccuucagcuaaaauaaaggaggaggaagcugcuaaggacuaguucugcccucccgucaccccuguuucuggcaccaggaauccccaacaugcacugauguuguguuuuuaacaugucaaucuguccguucacaugugugguacaugguguuuguggccuuggcugacaugaagcuguugugugagguucgcuuaucaacuaaugauuuagugaucaaauugugcaguacuuugugcauucuggauuuuaaaaguuuuuuauuaugcauuauaucaaaucuaccacuguaugaguggaaauuaagacuuuauguaguuuuuauauguuguaauauuucuucaaauaaaucucuccuauaaaccacc

SEQ ID NO: 6340 - RNA, 61711 nt, Homo sapiens; identical to SEQ ID NO: 6339

SEQ ID NO: 6341 - RNA, 95045 nt, Homo sapiens
ugcgcuucccgcgggcgcgcggagugaggacggugacagccacgcgcgcgcguacgcgcccgaugcagcgcggccccgugacccuagucggccgcugagaggcgcgcggagucugggccgcugccgucuaggggucccgucccgaggcguccccggcaucuccggcccgaaucccggagugccgggucgcgccugcaccgaaggucccggcuccugugcccucccugcagccgucagggcccgucccccaacuccccuuuccgcucaggcaggguccucgcggcccaugcuggccgcuggggacccgcgcagcccagaccguucccgggccgggcagccggccaccaugguggcccugaggccugugcagcaacuccaggggggcuaaagggcucagagugcaggccguggggcgcgagggucccgggccugagccccgcgccauggccggggccaucgcuucccgcaugagcuucagcucucucaagaggaagcaacccaagacguucaccgugaggaucgucaccauggacgccgagauggaguucaauugcgagguaaccggccggcagccccgacugcugcggugacagucgagguggaagcucgagagguucucuuuauaucaucuuauggguguagcuagagacgggcagaaccggaagggccaacuaggcccaaaaccucauguuaaagaugauugcugcuuuuuuucauaggacuuuuggguuuuggcauuuccugaagguuauuuucauucauuguuauuggaagaagcuggaugcuccugugauagaaaauucaggauuucagugucaggcuuaaguuaggcuuacgcuuaaaagcuugaaaguuuauucuuucauuagguaauauuguuauguacccagguauuagaaguugcgucuuguuuauuggaaagccaauacuuguuucccuuuucuaaagcuugcauauucugggaaaaaaaacccuuugaagaacgauauaacaucucauacuuacuuuccacauaguuuccaacaugaugauaacagcuaucaauuguucaguauuuucaaagugcuagacauuugcacauuuaauccucagaacaaacccauuuaucuaguaaauggcaaggugggguuuugaaccaagcucacagcccguacaguacugcuucucaaguaauuuaaguucuugcugcuaaaagugugguuuguggaccagcagcauuggcagcaguaagcaaggguuggcaugcuuuuucuguacaggaccacauaguaaauauuuucaacuuuguagacuagagaaucucuguuggaguuauucaacucuucaacucuaccauuguaacacaaaagcagccuuagauaagaucagcuuccagcaugacagcuuaaggaacccauuccucuguaaaacuggugaaaauucuuuuuuguuuuguuucguuuugagacagaaucucacucugucaccgaggcuggcaugcaguagugugaucauggcuuacugcaacccugaccaaccucccuggcucaaucaguccuccugccucagccucucgaguagcugggaccacaggcgugugccaccacaccuggcuaauuuuuuuuuuuuuuuuuuuuuugagacggagucucgcucugucacccagagugcaccgggcuagagugcaauggcgcgaucuugucucacugccaccuccacuuccagguucaagugauucuccugcuucagccuuccagguagcugggauuacaggcgugcgccaccucgucuggcuaauuuuucuauuuuuaguagagacaggguuucaccauauugggcaggcugaucucgaacuccugaccucgugaccagccgaccugggccucccaaaguggugggaaaguggugcgauuacagaugugagccaccccgcccagccucaccuagcuaauuuuuguaaagacaggguuuugccauguugcccaggcugaucuugaacuccugagcucaagcaauccacucgccuuggccucccaaagugaugggauuacagaugcagccaccacgccuggcccaaaaauucuuuuuuuaaaaucaacuauuuaaacccuccggcaaugguccugagggcaaacaacaaaugaaaaaacaccuauucaagaaaaucuacaaauucgguaagaaagaugagaggguaugguauuugaaccaagaucauucccuccuuacucacuccuagcuuagugagguggagcuucuacuccagacuauugcaaacuguaauaccgggcacugcucccccagcucccaaucaaaugcuuucuucccaggaaaagcaggacaucagcauuucucauccuaccuagagcuacuuguugcugagguuaaaaccugugugagugcaauugaaaguuggagcucucuuuuuuuuucuuuugagacggaguuuugcucuuguugcucaaacuggagugcaauggugugaucucgccucaccgcagccucugcuucccggguucaagcgauucucccacaucagccucccaaguagcugggauugcaggcuugcgccaccaugucuggcuaauuuuguauuuuuaguagaggcaggguuucuccauguuggucaggcuggucuugaacucccuaccucaggugauccaccugccucggccucccaaaguguugggauuauaggcgugagccacugugcccugcgaaaaguuggagcucccuucuuccaccuagucccuacuuguggaacaggacuguaccuuggacaugacauacugaaauuacuggugccccaauugcucaucccccaguucuugcaggcugagccucagguuauugcgguccccugccuccuuccaccaagugcucaguuccuagagugaggguauuucucagagagaaucuuuccaggguccuuccccacagcuccagagccuuggcuccgggauuuugccucaggagagaagcaggcccuaaaacagauagcuccuaaucucuuuccaauggcagugacuucauuugcaacacaguguggagaaauucaugccuaagggcaaucuggagaugugaagguuuugguaagaggcaacugggagaucugcggauuuaauggagaugcagccuagacuguaggccuccugguuugcuggaaagaauuggggaauaagacagcuggaagaagccauucuaggaucagaagaaggaucaaacauugaccgcagcaugguggcucacgccuguaaucccagcacuuugggaggcugaggcaggcagaucaucugaggucgggaguuugagaccagcuugaccaauauggugaaccccaucucuacuaaaaauacaaaaauuagcugggcaugggggcauacacuuguaaucccagcuacuugggaggcugaagcaggaaaaucacgugaacugggagguggaaguugcagugagccaagaucacgccacugcacuccagccugggugacagugaagcucuguccugucacaaaacaaaacauugaccacagaccucugaggugguggaugucccuccuguccugguuguaucauuauacauuguauauuaauguaucgaaauacuacagguacccccaacauguguacaacuauuaugaaucaauaaaaaacaauuugaaaaguaagguauguggcagagguggaaaaaaaugcuuuccuccaaacagccacaauuugauuguaucaguuuguagaguaagagcaaguuaugccucaguguguuguugaaaauaauagaacaauaugccacaauuaguggagcuucauagcuggguguggucaaggagagaauagaagagaacccuaccaaaaccacugucaucccagggugacugugagcauacccaaagcugcaccucccugaagagcaauaucauaggccuuaacacuuuucaggggaaauggauuucacucaaauaauccagccagucgcuaaacaaauaaauaacaauuggcccuggagaggggguaccaauccccagaguugcuacaguauauuaucuaaaauguccaguuuccaacaagaaauugugagacguacaaagaaacaggaaaauaugacacauacacuggaaaaaagcuggcagcagcaacugccugugagacaaggggccaaauuaaugaaaaaggcuucaaacuggccuauauauauauucacaguacuauauauauucacaauacuaaaggaaaauaugaugacaaagaaguaaaggaugguaugacacuguugcaucaauuaaagaauauccauaaagauauagaaauuauaaaaaaagaaucaaaugaaaauucuggaguugaaaguacaauaacagcugggcgcgguggcucacaccuguaaucccagcacuuugggaggcugaggcgggcggaucaccugaggucgggaguucgagaccagccugaccaacaugguaaaaccccgucucugcuaaaaauacaaaaauuagccaggcgugguggccggcaccuguagucccagcuacgcgggaggcugaggcaggagaauuccuugaaccugggaggcggagguugcagugagccaagaucgagccacugcacaccagccugggcaacagagcaagacucugucucaaaaaaaaaaaaaaaaaaaaaaaaaguacaauaacaaauuuaaaaauuaacuagagggacucaggacucaauaacagauuugaacugggugaagaaagaauucguuaauuuuuuuuuucuuuuugagacagagucucgcucuguugccuaggcuggagugcaguggggcaaucucggcucacugcaaccucugccucccugguucaagcgauucuccugccucagccaccgcacaguggcuuugggaguacucugggaggcugagguggguggaucaccugaggucaggaguucaagaccagccuggccaacauggugaaaccccaucucuacaaaaauacaaaaauuuaguugggcaugauggcgggugccuguaaccccagcuacuugggagguugaggcgggagaauugcuugaacccgggaggcggagguuguagugagcagagaucgugccacugcccuccaaccugggugacagagcgagacuccaucccugcccugaaaaaaaaaaaaaagaugugaaacacauacaaaaaaaaguaaaauggcaguugaaugccaaguaauuagauaacuucaauaaaauggacaaacuccuagaaagauauaaaccaccaaaauugacccaagaagagacacuaucugaauagaccuauaacaaguaaagauauuaaauuaguaauugaggggacucgugggguaacuugcccuugggaaccaguaguauggcaucgggcugcaagauuggccuguccauccucaaugcuaccuggccaauuuaggggcccagugccucuggaugcuagacucuggggucgauuaucuccaccggaauguaauggaugaacaugcaugugaugguguccaagccagaacaguggguaaagccaauggcuauaagaggagccaaucaguacaucuuucaucucgaggaaacugagaacccaggggcuuugauuaaagacauucaggagaaugggaugaagguuggccuugccauaaaaccaggaaccucaguucaguauuuggcaccaugggcuaaucaacuagguaugaccuugguuaugacaguggaaccaggguuuggagggcauaaauucauggaagauaugauguuaaagguucacugguugaggauccaguucccaucuuuggcuauagaggucgcugguggaauagauccugacacuguccauaggugugcagaggcgaagcuaacaugauugugucuggcagugcuauggugaggagugaagacccuagaucugugaucagccuguuaagaaacauuugcucagaagcugcucagaaagauucucuugauugaugaaaccuuaaggagcccaauguuuguuuaugaaaucuccuuuuuacuggaaaacaggaauauugacuaccaaaucauaguguaguugaagccauucugcguuuuugagcaguuauucguuucagugauuauaauugauugugcagaguauucuaagaaguuagaaauugguguguauaacuacauuuucagugaugcaauuuaaugauuagugagugagauacuguuuuuauugagagccuugauuuuuauaaagaguaaaaauauggcugcauuaaggguacaaacagaaaagugucuuaaugucuaaggagggcauauuagcuacacuauaaaaacaauuuuuuucuguauuucugaaaagaauuuuguuguuucucaguuguuuuccaaaagcaaaggaagucuuaauguuuuuuucuauuucguguuaugugugauuuguuuauaugcuugguaauaugagucuaauggaauuuaaaaauauaaguuuggguaggauaguauacccuuaaaaaauaaauaaauaauuagagagagagagagagagagagaccugggcacaguggcuguugccuguaaucucagcacuuugggaggucaaggcaggaggauccuuugaggccaggagcuugagaccaaccugggcaacauagagagaccccaacucuaaaauauacauacuauaucuaaacucagcuaggcgugguggugugagccuggagucccagcuacucaggagguuaaggugugaggaucacuugaucccaggagguugaggaggcagugagcuaugauugugccacagugcuucagccagggugacagagugagacccugucucuuaaaaaaaagaaaagaggcugggugcaguggcucaugccuguaaucccagcacuuugggaagccaaggugggcagaucacgaggucaggaguucaagaccagccugucuaauauggugaaaccccaucucuacuaaaaauacaaaaauuagccgagcaugguggagugcgccuguagucccagcuacucgagaggcugaggcaggagaaucgcuugaacccgggaaguuggagguugcagugagcugagauugcgccacugcacuccagccugggugacaaagugagacuccaucucaaaaaaaaaaaaaaagaagaaagaaaagcaaagcaaagcccaggccuguaccuacuagagguccugauaacuucaccacugaauucuaucaaacauuucaagaaaaauuaauacaguucuucacaaagucuucaaaaaugaaaaagaggagaaaauacuuacaaacgaauuuuaugagacugguauuacccuguugccaaaaaccaggaaaagacauuacaagaaaagaaaaccauagacaaauauaucuuacaaauguggaagcaaaaauccucaacaaaaauacuagcaaacugaauccaguaacauauaaaaauaauuauauaccauaaacaagcaggauuuauuccaggagugcaagguugguuuaacauccaaaaaugaauuaguguaaauaauguaaugcauuauaucaauagaauaaaaaacaaaaaucaccuugucaucucaguagacacagaaaaagcauuugacaaaauucagcauguuuuucaugauaaaaacacuaaauaaacuaagaagagaagagcaguuccucaaccugauacacagcaguuaugaaaaacccacagcuaacuucauaauagugagacugaggccaggcacaguggcucacgccuguaauccuaacacuuuaggaggccaagguuggagggaucacuugaggucaggaguucaagaacagccuggccaacauggugaaacccugucucuacuacaaauacaaaaaaaaauuagccaggugugguggugcauaccuauaauuguagcuacuugggaggcugaggugggaggauugcuugaaccugggaggcagagguugcagugagcugagauagcacuacugcacacaauaggcugggcgacagagcucaaaacaaacaaacaaacaaacaaaauagugaaagacuguaugcuuauccuuaagauuaggaaaaagagagauaagucuacuuucacuacugcuauucagcauuguacuggagguucuagccagggcaauuaggcaagaaaaugcaauaaaauacaucuauguuggaagggaacaaguaagaucaucucugcagaugacaugaucuugcauauagacccugaggaauccacuaccaaaguauuggaacuaauaaauuauuaguuuaguaagguuauaggauacaagaucauuacacaaaacuuaguuguaaauguauccacuuggaaugaacaaucugaaaaggaaauuaagaaaauuccauuuacaauaaccuaaaaaauaaaaauacuuauaacaaaagagguaucuuuuuuuccauccucugacaguuuaguaaaagaaaguauaaaacuuauacucuaaaagcuguaaaacauuuuugguuuuguuuuuuaaauuaauuuuuuuugaaacggagucucacucugucguccaggcuggaaugcgguggcgcgaucucggcucacugcaaccucugccucccagguuaaagcgauucuccugccucagccuccggaguagcuggagcuacaggugugcaccaccaugccuggcuaauuuuuguauuuuuaguauagaggggguuucaccauguuggccaggcuggucucgaacuccugaccucaggugauccacccgccucagccucugaaaguccugggauuacaggcgugagcuagugcgcccagccuggccuuuuaaaauauuuaauuaauugauuuuuuuuuuucucggacuugcacugaagugagaacaagugcaguggugcaaucauaucucagugcagccuagaccuuccaggcuuaagugauccuccuauaucagccucccaagcagcucagaccacaggcaugcgcgaucaucccuagcuuuuuuuuuuuguuuguuuguuuuuuaauuucuuguagagacagagucucccuguguuacccaggcuggucuugaaccugaccucaagcaaccucccauguuggccccucaaagugcugggauuacaggugugagccaccgugccuggccuguaaaacauuuuuaaaagaaagaagauauaaauaaauaaauaaauagaaaauagcucuuguucauggaucauaagacauaacguugucaaauuggcaguauuuuggaaauugaucuacacguuugacauaaucccugucagaaucccaguuuauuucauuguagaaauugacaagucuccaggcguaguggcucaugccuguaaucccagcacuuugggaggccgaggcaggcggaucaccugaggucaggaguucaagaccagccuggccaacauggagaaacccugucucuacuaaaacuacaaaauuagccgggugugguggcacauaccuguaaucccagguacucgggaggcugaggcagggaaucgcuugaaccugggaggcggagcuugcggugagcugagaucacgcgccacugcacuccagcuugggcaacaagagcgaaacuccaucucaaaaaaaaaaaagaaauugacaagucaauucauaaauuccuauggaaucgcaagggacccacaauagcuaaaucuugaaaaagaacaaagcagaaagacucacgcuuugugauuucaagacauacuauaaaacaacuaaucaagacaacgucaccaggcaccguggcuuaugccuauaaucccaacacuuugggaggccaaggcaggcagaucacuugaggacaggaguucgagaccagccugggcaacauggcgaaaucuugucucuaccaaaaauacaaaaauuaaccgggcgugggggugcacacuuguaguccaagcugcuugggagggcugaggcacaagaaucccuugaacccaggagguggagguugcagugagucgagaucgugcuauugcacuccagccugggggacagagcgagauuccauuucaaaaaaauaaaaauaaaaagacagugugguacugguauaaggauaaauguguagaucaguggcauagaauugagaguccagaaauaaacccaguggaauagaguugagaguucauggucaccugauucuugacaagggugcaaagaccauucagugggggagaacugucuugucuugucuuuucuugcuacaugccacagacugugagaaggaauaguccuuucuuuucuuuuuucuuuuuuuuuuugagauggagucucgcucugucaucuaggcuggagugcaguggugcaaucuuggcucacugcaaccuccgccuccuggguucaagugauuuuccugccucagccuccugaguaccuggacuacaggcgccugucacaacgcccggcuaauuuuuguauuuuuaguagagauaggguuccacuauguuggccaggcuagucucgaacuccugaccucgugauccaccugccucagccucccaaagugcugggauuacaggugugagccaccgcacccggccggaauaguccuuucaacaaauggagcugagacaacuggauagccacaugcaaaaaaaagaagaaauuaaacccuuaccucacacuacauacaaaaauuaacucauggcugggcacgguggcucacaccuguaaucccagcacuuugggaggccaaggcagguggaucaugaggucaggaguucaagacgaggcuggccaacauggugaaaccccaucucuacuaaaaauacaaaaaguaggccgggugcgguggcucaacaccuguaaucccagcacuucgggaggccgagguggguggcucacgaggucaggagaucaagaccauccuggcuaacauggugaaacccugucuguacuaaaaauacaaaaacaaaauuagcugggcgugguggcgggcgccuguagucccagcuacuuaggaggcugaggcaggagaauggcgugaauccaggagguggagcuugcaguaagccgagaucgcacuacugcacuccggccugggcgacagagggagacuccaucuaaaaaaaaaaaaaaaaauuagcugggcaugguggcgggcaccuguaaucacagcuacuugggaggcugaggcaggagaaucgcuugaacccaggggugagcugagaucacgccauugcacucuagccugggugacagggugagucuccaucccccacccaaaaaaaagcuuaaaauggaucaaagggccaguugagguggcucaccccaguaaucugagcacuuuaggauguugagguggauggaucacuugaggccaggaguuugagaccagucuggccaacauggugaaacccugucuauauuaaaaauacagaaauuaggcugggugugguggcucaugccuguaauccuagcacuuugggaggcugaggcagguggacugcuugaggacaggaguucaagacuaccuuggccaacauagcaaaaccccaucucuacuaaaaauacaaaaauuagccagccgugguggcaugcucuuguagugccaucuacucuggaggcugagacaugagaaucacuugaacucgggagguggagguugcagugagcucagauugugcuacugcacuccaaccugggcaacaaagcaagacucugucuggaaaaaacaaaaacaaaaacaaaaaacaaauguggagaaaugugaacccuuuuacacugcugguaagaccguaaaauggugcagccaguuugaaaagcaaacuaguuagccaggcauggugggucauacauguaauuccugcacuuugggagaccaaggugggaggaucacuugaagccagaauuuugagaccagccugggcaacagagugagaccuuuucucuacaaaaaauuuaaaaauuagccaggcgugguggcuugcaccuguagucuuaguuacuugggagguugaggugggaggaucacuugagccugggagaggcuauagugaggcaugacugcaccacugcaccuccagccugguaaucaaagcgagacccugucucaaaaaaaggaagacaauuagcugggugugguagcguuccucuguagucacagcuacuugagaggccaaggugguaggauuccuugagcccagaauuuugagguugcaguuagcugugauuguggugcuauacuccaggcugggcgacagagugagacccagucucaaaaaagauaaaaagaaaaacaugguggcaguuccucaaacaguuaaacacagaguuaccauauaaccccacaauucaacuuacagaugucuucucaagagaaaugaaaacauagcuuuacgagaaaaacuuauaugugaauguuuauaguaguauuauucauaauagccagaagguagaaacaguucaaauauacaucagcugaugaauggauaaacaaaauguggucuauccuuacuauggaauuacuuggcaauaaaauagaaugaaguaccagcacgugcuucaacauggauggaccuugaaaacacuaugcuaugugaaagaaaccagccgcaaaagaacacauaugauuccauucauaugcaaaucuaggauaggcauaucuacagagacaaaguagaucagugguuguucagggcugggaaaaaugggugggguagagggugugauagcugaaauauacaagguuuuauuuaugaagugaugaaaauacucuaaaacugacuggugaugguuguacacacugaauguacuaaaaacuacugaauuauacacuuuaaaugggugaauuuuaggguauaugaauuauauaucaagauguuuaaaaaaaaccuuaggcaaaauguaaacaaugggcaugacuguguuccaagaaaacuuuauggacacagaaauuugaauuucacauaauuuucacaagaaaauaaacauuaaaaaauguaacaugcugggcacuguggcucacgcauguaaucccagcacuucgggaggccgagguggacggaugacgaggucaggaguuucauaccagccuggccaauauguaaaacccugccucuacugaaaauagaaaaauuagcugggcgugauggcacacgccuguaaucccagcuacucgggaggcugaggcaggagaaucacuugaaccuggaaggcggagguuguggugagcugagaucacgccguugcacuccagccugggcaacaagagugaaacuccgucucaagaaaaaaaaaaaaaaaaaguaaaaaucauucuuaguucucaggccacacaaaaauaggugguggguuggauuuguccugugggccauaguuugcugaucucugaucuaaguuacuauuugauagauguuagauguugugagaggguaagagagacuagccuauaaggaaagggauuuuaguuuuuuggggguuuuuuuuuuugagacggagucucgcucugucgcccagguuggaaagcaauggugugaucucagcucacugcaaccucugucacccaggcucaagcgauucuucugccucagccucccaaguagcugggauuacaggcaugugccaccaugcccggcuaauuuuuguauuuuuaguagagaugggcuuucaccauguuggccaggcugaucuugaacuccugacuucaggugauccgcccuccuuggucucccaaagugcugggauuacaggugugaaccacuguguccauccaggaaagggauuuuguaugacauuuuucagccgcaauuuugccaggaaaagcucuuuuuucuucauuaaguagauuccagacccaaagauguuggacaguauuaucagcuagagcaagguuuuucaacccuggcacuauugacauuuuggcuggaugauucuuuguuguggggagcugucuuguauguucuaggauguuuagcaggaucucuggccucuaccuacuagaugccaguagcauucccccaccccaucccaguuguugugacaaccaaaaaugucuucagacauugucaagugucccugggguagggaggacacccuccaaucuccucuuucucccuacccaaccuccaugaccacauugagaaccacugaucuauagaaaaggauaauaguagugacauucagagaggcaggaugguauagugcaaagcuugccaaacuuuaauuuuacauaaaugaccuggggaaucuuggaaaaauguagguucugauucaguaguucugggauggaagugagaauuuuguauuaauaacaaacucucaggugaugauaccugugccaccggcccaaggaccacacuuugaauagcagagcaguaguagaaagugcaucggcuuugaaagaagacagaccugggcuugaauucuagcuaaaauacuucuacuuuggacaaguuacauagcucucuggaccuuauuuucucauugguaaaaugagacuaauaaugcugacccugcagaguucuuauaaggauucauggaaugcauagucccuggcagaaaggaagauauaggagggacuauaauuggccuaaaguaggaggcucugguuaccaugggcacugcccuguugugauuuaucaagccauuacaccucacugaaccucagauuuccaguggaaaaaccuguuuguaaaccauguucacauauucuguugaaaguaaucauaguuugauuuaugaugauagggcucagguaagugauuaguuuuauucuccugccugcuuuuuauguuguccauuaaugagcaaggugcugaugcaaggagauggcagaugcauuuugaaaaaaaaggagagagagaguacuuguagaauucuugacuuuauugaggucaaauguagguggcuuuucaagaaggacucaauuucagaaccgguggcauuuaacauaugagucauguuaccuuaugcuaauaaguucagacuuuuuuucuuuuuacugcagagauagggggaaaaaucuccugcacuacuugcugcauugcucaauuggcuggaugcuuuggaagauuuuuccacuugaaagauuuguuguuugucauuuugagaaagugggugcugaguguaauuugccaggaggcuaaacggcuauguuauuucuuaucuaggcuggaauuuuacucuaauaauucaaucuaucaguaagaaaagccaaauaggaaguuguaagagauccuaauacuaucuuauauugaaaacaaagccuccuucuccuguuguuuggcauucuaaauguuuucacauaccuaagugagauuaugauuguauuaaauaccaacauugcagaucauuccagcauacaaguggacguaaguuguccauaacagaaggaacuuucuaaaggggaagacagauagaacaauucuggcauuuucaguaaaaucuuaaauccuaggcucccuaggaccaggcaaaccauccccuucaaggauguaaacucuggagggcaguguaguuguacaggguaauaguucuauacucuauauuagugcaacaagaaacuucuauuccuguuucagaaguaagacuguuaucuaccuuuuuuuuuuugagauggaguuucacucuuguugcccagacuggagugcaugaucucagcucaccaaaaccucugccuccuggguucaagugauucuccagccucagccucccgaauagcugggaauacaggcaugugccaacacgcccugcuaauuuuuagauuuuuaguaaagacaggguuucuccauguuggucaugcuggucucgaacuccugaccucaggugauccaccugccuuggccucccaaagugcugggauuacaggcacgagccacuacgccuggccuguuaucuaccuuuuuaccgcugugcucucccauggguuuuuuuuguuuguuuguuuguuuguuuguuuugagauggagucucgcucuguugcccaggcuggagugcaguggcgugaucucagcucacuucaaccucugucuccuggguucaagcaauucuccugccucaaccuccugaguagcuggaauuacaggugccugccaucaugccaggcuaauuuuuguauuuuuaguagagauggggucuuaccauguuggucaggcuggucuugaacuccugaccucaugaucugccuggcucggccucccaaagugcugggauuacaggcaugagccaccgugcccgaccucucccauggguuuuaaguagugccuauggauggcaugggugccacuacucaggucuaggacaggcaggggugagugaugagugcgugcgugcugaugaaggggugcgaagaaacagaugcuggcuagugcugcccuccacuggaccccauucugccuuugugugggacaaagggcuagggacuagcaguuacuuugugcuagguaccaugcuaaaugcuuuaaaugcacacuaccucauuugauauaacagggacucauuuauucauucaagagauauuauaaaauaggcuaggcacaguggcugacaccuguaaucccagugggaggccgggguggccagaucacuugaggccaggaguucgagaccaguuugggcacauggugaaauccugucucuacugaaaacacaaaaauuagccaggcgugguagugggcgccuguagucccagcuacuccggagguugaggcaggagaauugcuugaaccugggaggugaggguugcagugagcugagaucgcgucacugcacuccagccugggcgacaagagcgagacucugucucaaaaaaaagacaauaauuaggcgugguugugcgcaccuguaguccuaacuacuugguaggcugagacaagaggaucacuugagcccaggaguucgaggcugcagugagcuauguucguaccacugcaugaagccugggugacagagugagacucugucucuuuuauuuauuuguuuuuuaaauaauagagacaggguuggccgggcaugguggcucauuccuguaaucccagcacuuugggaggcugaggcagguggaucccugaggucaggaguucaagaccagccuggccaacaugggaaaaacucgucucuacuaaaaauagaaaaauuagccgggggcaauggcaugugccuguaauuccagcuacuugggaggcugaggcaggauaauugccugagguggagguugccugagauugagccacugcacuccagccuggaugacagggagagacuccgacuccaaaaaaaaaaauagagaugggggucucccuacguugguugcucaggcuggucucaaacuccugugcucaagggauccuccugccucagccucccaaagugcuaggauuauaggugugaaccaccacacgcagcucugauuuacugggugcccacguugaccaggcagggaacaccuccuagcagugaucaaggacuacuuuggaccuagguucuguaacugacuucaucuuuaaguggggaaacagaggcucagacaggauacauagcaugcuuaaaggcuuagugcagccacuaucuauucugaaagaggcagaauaggacagggacagguagguagugagagaauagggagaauagaugggcacacccuuuaacuuaauaucgaccaguaaagccugcaguugcuuauuugaaccucacauugaggcugacauguaaguugagcaaaucuuaacucaagcuucaguuuccuuguuggggccgcugaggcagcauagccuagagauuacaagcauagacuucagaguuugauuccuggcucugccucuaaccagcuuugcaaccuuaaagcuccuuaacccccucacaugccucuguucccuaacuguaaaauggugaauguaauuaauucuuccugcauaguguuacaagaauuaaauuugaguaauuacugguaaaguacguagaauaguaccuaacacaagauaagugcuauauauaaugguuguuaccuaaagaaauaacagccugggcaacauggcgaaacccuaucucuacaaaaaauacaaaaauuagccgguugugguggugugcaccugugguccuagcaucucgggaggcugaggugggaggaucacaugagccugggaggucgagguugccauaagcuuccugauugcaccacugcacuccagccugggugacagagugagaccuugucucaaaaaauaaauaaauaaaauaaauuaaaaaaauaaaaaggaaauaaguucagugccugucguuagcuugcucccuuucucagccucuccuccacuuccucacgcacccucuugcucugagccuauuauccuggucccuccuucacacugccacaucuuugcauaggcuguucucuuugccuggaaugccauucucauuuguugcuuggcagaacugaacucauucuccuucuaggcucugcucaaggguuuccucuucuuuguguccaaagucaccacauagcuucuaagugaugggacugagauuugaagccaggucaucugucuuucaggccagcccucuuuccacuacccuaugcuacccaaauaggaagcguaaaagagaaguaggagagaaaaaguuagaaaccuggagagaacuuagguauuugguaaacaggaaaaagaaaguggaaagaagagaucauuugaaggacuuccucaacuuaacaacuauuugccuauggcauuauuuuauugcauuugguguaugauacuaucucaaaagcauuuuguaaacuugccaguggcuuacauuuuugccggaugaaugacaugacuaacgauccgugcuacauuaccucagugucuaguuugucauuuugaaucaaguggacauuuucuguaagugaaucauuuucacuugcucaugauauaaugagaauuccuuaccuuuggcuuaaaaugaggcuuauguuauaacaguuaagcauugucuaguugcauauuuaacauagucagaaugcuccugccuguauucagccuggugucuuauaauauuugguaugcccaccuagauagcaauugguaacaucuuuauucugagacucuuucauguauggauuuugaaaaguuaguuaacuguucagacgacauuguuucuuugacuuuuacaauccgcuucccucucacugacaguucaguuuuggaagacccuguauuuuuuuuuuuuuuuuuuuuuuuuuuugagacagagacucgcucugucgcccaggcuggagugcaguggcgugaucucugcucacugcaaccuccaccucccggguucaagcaauucucuugccucagccuccugaguagcugggauuaugggugugcaccaccacacauggcuaauuuuuguauuuuuaguagagacgaaguuucaccauguuggccaggacggucucgaucuccugaccuugugaucagccugccucggccucccaaagugcugggauuacaggcgugaaccaccgugcccggccuuuuuuuuuuuuuuuuuuuuuucgagauggggucucacucagacuggagugcaguggugcuaucacagcucacuacagacuugaccugcugggcucaagugauucuccugccuaagccucccaaguagcugggacuacaggcacaugccaccaauaccuggcuaauuuuuuugaagaaaugggaucccgcuauguugccuaggcuggucuggaacuucugggcucaagcgauccuuccgccucagccucucaaagugcugggauuacaggcaugagccaacaugcccagcuagagaugugugugaauugguagcuucaagcuagauauuggaggcucaugaagcccagguuaaagaggcuuguauucaucagaugcgaugaagagcuuugaaguuuuuacuagaagugugauuuaaagugguuggcaugcaaaaugauuuggaacguuugggguuugggguagggagagagagguuggaaguaggaaacaauuagaaggcaaacgcuuugggcaagguaucacauugaaaccugaacagcagugggacuugcuggggguugggacaaaacuaggcagauguaagcaucuagugaaucuagagauuaggguguucugugaccaagaaugagcagaagaccugcuaggcucaagauucaggagauucucagguccaaagccaguccucagucuccgaagucagucaggcagaagggaaguuggaucaagcuggccagaguugagcucaggaagucagugcacuuucucuugucugguuccugcaucguuuuacuuguguaaaaucaucaagaucccuaaaccgaugucugaacaccaggcuucuaggcagagcuccaccgugugaccuugggcgcaucacuuauuucccccaggccucaguucuucugaaagaugaggggaagaacucacauucaaaggcccucagcuuuagcgucuuauuuuaggugaucugggcagaagagucucacugugcuccucucccuuucauauuuccugcuuugguaggaagucaucucaagacuugaguguauaggcaugaggaagucugcuagaggacaggaagaauauugcuuaaagaauaagagcuacagcccugauggaagggguaaauuggccugggaaaagcccugccucugcuaccugcuucccaagugaccuugaacuuaacucuuuaaaccucaguugcugcaucuauaaaaugagaauaauaguaucuuuuuuauaggguuuuuuuuguuuuguuuguuuguuuuuagacggaaucucccucuguugcccaggcuggagugcaguggcacgaucucggcucacugcaaccuuugccucccggguucaagcgauucucgugccucagccuccugaguagcugggauuauaggagugcaccaccacgccuagcuaauuuuuguauuuuuaguagagaugggguuuugccauguuggcuaggcuggccuggaacuccuaaccucaagugauucuccugccuugaccucccuaagugcuaggauuacaggugugagccaacgugccuggccaggguuguuuugagacaugaaugagguggaccuuuacaggcacuugguucagggccugacccguagugagcauuugauaaauguuaccuaucuauguugucaugggcugggagugugggaacaggaagugucucaugccagaagcacugugaauuuucuccuuuaaucauugccuucauuuucuuugaaccuuauucagauuguccaugccuuuguaauuguagacccucuaaacuauaauuaguccaaauaaaauggacucaccuuaugccauguucuuguugaaggguccucuuucuuucuuucuuucuuucuuucuuucuuucuuucuuucuuucuuucuuucuuucuuucuuucuuucucuuucucuccucuuucugucucucucuucuuucucucucucucucucucucuuucuuucuuucuuucuuucuuuuucuuucuuucucuuuucuugcucuauugccaggcuggagugcaguggugagaucucggcucacugcaaccuccgccucugccucccagguuuaagcgauucuccuuucucagccuuccgagaagcugggacuacaggcgugcgccacuaauuuuuguauuuuuaggagagacgggguuucaccauguuggccaggauggucucgaucucuugaccucgugauccacgcuccucggccucccaaaguguugggauuacaggcacgagccauugcacccggccagaucuucuuuuuuguaacaugcuaaguaauacaaucucuauuuagcuugauguccacggugauagcaggauucuuuucggauuucugccauaguuaauuauucugcauucuuuugucccuagugugucauauugaaauuuuucuuuuuucuuuguuuuugaugacuucuccaguuauucaugcuaguuuugcauuccuguccaagaacauuuuugcugcuuguuuauuuuuaauuucauaaacuaaagcguuugagguuuuaaaaacccagaauugaguuuucucagagcugcuaaucuuucuagccagcuggugacgaggcuucucaauucuuguuacaggaugauguguucuguccuccugucugugcuuugucuaauuuagauucuaaauccacauguuuaggacauuuuuagcgugucaaaauuuauuaccaaaguagugcugacuucagggaaaaauuuuuaauggaaucuuuagucacucauguugacacaaggugcuuguccuagugcaggaaucuguguggcaccacuagguggugccagacugcaucauuuuuaaagacagccuuuucucuuccaacucuuuugccacuguucucuuuuuugcuucuuugccaaauuuggaccgagcuuugaaaacuucauauaaacuuucucuuagugaguuauguugcuuauagcuuuucccuccaccuugccuguuuuagucuucuuguuucaauaguuuugauaguuugacauucagauaaaacuuaaaacugaagcccaaaguaauuacuaaauguaucucgacugaucugugguuuuaaauucaccaacagugcaucucccuacuugcuuaaucauauugauuuugagauuaaaucagucucauaaauauguuagucuucagcccacgguaguucucauccaucugcagacuuuuuuuuuuuuuuuuuuugagauggagucuaacucugucaccaggcuggaguacaguggcgccaucucagcucauggcaaucucugccuccuggguucaagcgauucucuugccucagccucccgaguagcugggacuacaggugcuugcuaccacgcccagcuaauuuuuguauuuuuaguagagacaggguuucaccauguuggccaggauggucucgaucucuugaucucgugauccacccgcuucggucucccaaagugcugggauuacaugugcgagccaccacgcccagccccaucugcagauauuuuuaccaguccuauccacucaugccuguaccuucuaauguuauuaaagucaguuuuauuaucauugaugaccaugagacuuaaucaaaaggucaagcuagaaacagagaauauucaaaauuucuuuccaggcaaacaucuggguucaauagaagcuaguucacaugaauggaucaugcucuagcucuguugugcuggagcuuuuuugaaggaaugcauuguuacauacuaaccacaauuuuuacauuguccagggcaggaguaaccaguugguugauacuuagucagggguuguguuucguaaucugcuaguuguacuugauguuuaggcauuugaaauuuaaccuugugccuuauuugugcugaauuuacuauuguuuccuauuuguagugcucugcaaaauuauucucaguauaucacacauuuguaaucauugccaaucacugaauaucaauaacaugcuaggugauaagaacuucuauuuuucagcagcauuaucauucccaauuuuacuacaucagagaguucaucauuauacagucaacucaugauuauuaggaguaaggaacguaauagcagacccugaaugagggaaaagaaugugaaaccacacauaaacuaaaggugaagucauuuacaucccugaaaaugauuuuaagauacagaaugagauguuaaaggaucaaaagaaaauuaucguagcaaugaaaaaugcuacaugguuuauacaaagucaugucaagcucauagacucagagagugguguuaauccugaagaccacuugaugauuauggaagccgagacccaaagagguuaagugacuuacccagcacagcggguuuggguguuuuauagcuguuugacuauaugagcuaugauugcucucauguugugagcuaaauuccaaagauauugucguguuugcuuuuguggggacuguauugcuuucauagcaugaugguuguauuguuucuuuuugcuuugucaucugucagucaacuuugaagugaaucuucuuuguuuacagcauaguaaaauauggugauugcauggcucauaagagauuuacaaaugaagaaacugaggcccgguugagcugcauggcacacccaagucauagacuugugugugguugaggcagagaaucuaggauacagaccucccugcuggguuccucccgcucccauaacugcucugcacuucagcgggaaagaugccagaaacugcaagcauaaggccuuuuuuuccccuaaaaaacuguaauucauuugguuuugaaagacuuaccagaguuuaaaagcuccauuuuguggcuucccaaggugcugugauuuguuucuuacuagucuccuuuguucuguggaaaauuuucuucuuugguuguuugagauuuagauuuccuugccaagguauuuuuagagagaggaaaucaguauguuucaccaaagggguaaaauauauaccuuaaggccuaauuaugcaauuacauuuuuaauaacgagugucauaaauucuugcuucauugcaaucauuaauuggaagacuguucugcucagaagccucaucuaguuaucaugauuaucaucaacaucgucaaccaaccacaagcaucaagcauuuauggaguauccacagauuaugcagcacuugccaggguucugggagacuuaaucuguguguguguguguguguguguguguguguguguguguguguguacacccuugccuucaaggaguuugugaucugcagaacuggaggaaagacagaaaacuuggggaaagacaaguaccucauuuuucaauauguguaaagcccauacugauucauguauguggcauugggggacauggacagcagggagacaaagggauagaucuuagaaaggucuaguuacaaauaaauggaagcacauaaguuugcugacaugggaggacauaggcuggguuguaauaagguaggguaauugguugaaggagggaggaagaaauuggugaagaguugaaggcaguaauuaaauagauuuggcauaauaacagagaugauuggagaacugggagaagaaaauuacuugcuguaguugauuauggcagaaacugacagggcaagagauuacaguugggauuuuuugcaaagaggagcuuucaaguuugugacaucuuuuuuuuuuuuuuuuuuuuuuugagauagucuugcucugucacccuagcuggagugcaguggcgugaucuugguuuacugcaaccucugccucccaaguucaagcgauucuccugccucagcuucccaaguagcugggacuacagguaugcgccaccacgcccaacuaguuuuuguauuuuuaguagagacgggguuucaccauguuggccaggcuggucucgaacuccugaccucaggugauccaccugucucggccucccaaagugcuggaguuacaggcaugagccacugcgccuggccuccaaguuugugagaucuugcccagauuuaaaugaaggaugugggguucaggauugguacagcagaggaaaaaagucucucucucuccccacuccccucuuuuugcugugaucuauuuuuuuucccacacuuuucacagguguuguccugugaucuauuucuauuugguggaucucuuuuccccucauguugagaauaauggcugaggugugguguauccuuuaauuuugaaaggaaacggcaugaugguuuugcgguuuaaucaugagacacaagaacagcuuuuguuguguggugauaccauacccugaauugagauuaucagugucagacauauauuacugcacuuuuuuaucuucuucgcuuaaucaaaauagauuuuaauggaauuuauuauucacuuacuguacaguaaaauuacuuuuauaacuuuccauuguguuuuucuuguaaauugagguauuuggccucuauuuuucaaaacagacaaaaguuguauucagguuagguuuggaucugguauauuagcaucuuaaauucucaagucuccuauaaaccuguucucuuaggccagcuauggcugcagaagucaguuauagauaaacauugagaggggagaucacaucauccuuuguuuuccauuucugaaauaacggcagacacguggcacauguccugagccugggguggugccguuccuuuuguugcucuaucuguaugggagcuaaccuuuugacaauuuuuauggcaaaugcuagggcagcuugugagcuaauuagaagaaacugauaagugaaugcugaguuugucgauucucuuucauuuucugcagaggagacagccguugaaacggcauucuucguguggcugauaauuuagcccaccagaccccuaugaaagggaauauugcuucucucuuagcuuuuuccacauuuuaguauucucuuuaaagccaacauuucuccauagguucuaauaccuaggcauuucauauauaguagccaaauucaguucacuuucuucaagaaaguuguccuuuucaaacuguggccuuuuccugucaugggucugguuucuuacucaccccgcacuguuguaucagcagguacuaggauuugauugcugaugacuguaugucccaaagaaaacagugggagaaaugcagcugucaaagcaaaaaacaaauagcaguuuuaagguugagucucaaccuggccaguugcaagauggcuguucaguagauguuauuccuaaugcuucccugguuaauagaacucaaucaguccugcagguuauuggugcugguugcuuccuauaacagaaaaguacugcauuccagcuacguuccugcuguggaacauaagugcuuagugcuauuuacuuaaaacauucuagguugauaaauuacaagcccuucacucuggguaaagcucauaaauccagcuccuacaaaaaaaauagcaagcugauagcacuuaguccuguuuauaaaguucauacacaucuauccaugauauaggcacaaguauauaucuaugaaauagcacugcagccuguuaaaguaaugggugagcacagccacaaaggcgagaagcauccgacuuccagacuccuccuauuagucucuaugccugaagggcaccuugaggaggaggucuguggaagggagcuuccaggcauuggaguccacauuugugcuccuuucucucuuucuucuucccgcaagucaccuuucucacgcccuccaccucucucuuuccuucugcaaaaugagcaucugccucuuagccucccucuucgucacuaggcugagaugaggcagggaaccgugguggauccagagcaguuugaacacuuuggcugcguggaaagcgaugggguuaaaugagcauuuaaucagaaccaggagcuguucuuuuggcaaccuguugaggaaaaaugauaaacccuaacaaaaaggcccucaaguggcacgagugcagggccugaaagcguuacgugccaucaguuauccaaaaagaacauuuuuuaaccagaaaauaaacaugagacucaucccacuaguccuagguucuuggagccccacagguauuguugcaggaugcaucauugcuucgaaucagugacugaacaacccaguuccuaaucagcguggagagucagaauugucacacgcacugggcugaagcugcauauucaguacugcauugaacauucaguacugcagauaggauaauuaugcuguuugucagauacuagaaaagugcaaagaacauuccuucacuuugcaacagcuuggacccaaguggcagaccugcuguucccucaggcuggcgugaccucccuauugucagccccuucaccacagcucaacuaccccccuggcuuucaagauacagcucaaacagcaucucuccucaggaaagaccuuacucccggagacccaggcccgaguuguguugccacuguacccuguucuguuagcacuuaccagguugcauuuuugugauccauuuaccugucuucccugucagacaugaacagggacagugucuuguccucaauucaucauuuuucuccuguuuugagcacaaugaccaggacguaguggaugcucaauaaagguuugucaaaugacugauaguaugguuagcucagugagaauugauggugcccuuugugaucugucauccaucauccuuggugugaagcagggcugggaggcuuuaaacagugccacuugagaaucuaaggagagguggcagaguuacaauuaacaauaacuaccccuuacugaguauuuauuugcuaugggccaagcacucucuuaggguuuuuaaaugaaucaaugcacuuaauccuuagaucaaucugcuaagacgaguucuguuuauuauccccuuugcaaagcacaaggaaguucagucacuugcccaaggucacacagugacagugcagagauucauaccaauggagacaaccaucacuuaucuauauuccuuuuagacuaguuccuggaaagauuaagcccucauguccugaggcauccaucuuagguaacaauuuaacuucucucuuguuucuagaaugguauuaguguguucccuacuugggagaauggagaaaauggucaccagauaacuuucuguguuuuuugguucagaugagauagguagaguuaguugacaaagaauugauuuuauguauuuauuuuuauuuuguuuuuuuuguucuugauuuuagaugguaguuucgguccuuuuggaaacauagcauuauccuccagccagacugaacuauccuacucccauuuccuguaaggacgacugaccucuuuuuugccucuagacuugugcauaugcuauucccucugccuggaacauacuuaccugcuugcuccucuuuccccaagcccagucuucacuugguuccucuuuucuaccaugagccaguuuagaugucauuucccuaccugcccaggauaggagguucccacagccgcuggguguccuguuguggcacucacaaguguuauagugcugaaagcccacuccugggguuuuuaugugugcgaugaaggaggugauuaucuuuucccagcuaguucauauccuaguccucugaguguagagacuuguuucuuuuuccccauuuguccccugcaccuugggcggugcuuggacacaauguguguguucacuaacuauuuguggaagaggugggugagcgggaguuaacuggcuuuaagucuuugaguuuuggguuuuugaaguagucaaguccguccacaguccguccuguggacagccauuguuugccaugucuuguauguacacacuugccugggcacuguggggagcagaaagaggacuaauacugcccuugugcugaggcaccuacagucucgggagauguucagaggacagugagucacuucacagcaucagcaugguauaguggaugagugaugacacugaagaugagcuuggucauauucuggcaaguuggcugacaccuggaagucccguccacaccccaagaccucuuuucccaggguguccugagaaccacccagagcaacugugaccaauggcgcuuguuuuuaaagaaguagaaacccaaauuaggaagacugagcaaaccucaugcauuuggggaagggcuuguuggaaaguggaaccugauguagguagcaacauguugagguuagauuuaaccaaacagaaagacuucuuaauugcuuaaagacaaaauuuuauuuuauaaguggaauuagggcuuuaaaucaaauauguuugaacgucuuuacuugguuuccucaggcaccuucacucaucuugucuaaaacuuaauugcuggucuaucccugccagauuugcugcuucuccuugauuccaucucuccuuuaguggaaccaccugguacucaagccagacacacaggugucccucuuaauucugucuccucugguccuguucaggcaccuguucugugacucugccucuuuuccguuucucaggcugccuucucucccuucuacugccuuccuuaugucagggguuggccuacuuucuggccuucuugauccagggcuucuuuuguucaacucauacuccacccuguugucagagcccauccagauugcagauuggagccuaugacucgucugcucaagggucuucaaagacuuugcagcuuuuggcugaaguugagccaccuggucccaaauggagccccauucccgccaugccaccuccugucuguuuaagcuuuacaagaugacuugcaguuuccuguagaaagcaugacuuuuaaaaaaagacuuauuuccuucucuccugcaucuaacucucacuugcucuuuaaagccuucucugaccuaggucuugccuguuucuccugcagaacacugcuuccaccauuuuguagcaucagugucuaacauugguuggcauguagggugugcucuauaauccuuguugaaagaauaagugggagguaacagaggcuuaauucacauugagcuguaaacgagcaauaucugacucuucugagaauggauuuuguuucaaacacugguuacuuacuggaaaaggugucuggggagugcuggacagcaagaacaaagggaccccacagaacaggaaaagaggcacucuagggucugcgguuugccuauguuagaucaccgugaaaaaggccaguguaugcuuuggcagcuggcaaagaauccugugacucaguuuccuuauuugcacaaaaaggguaugagucuacauuagguaauuacucaugcucauuuccaacucuugacagucuacgauccuuugugucaaaguuaaaaaucuaaguagggcauucugaauuggugucagaguugaugcacuucucacuguauugcaagugccaaggggacaaauacauugucuuuuugcauucaacaaagacaguuuugcauuuuaaaaacaaaguagaagggaauacaggaaaacugcauuaauacaauuuuaugcuggagaauuuaaacucccaugucaggaaauucacucaucauucccuuggcagcuuuuguuucucugcacugcacaccccacuuacagacagccccuucuugccaaagcccagcccagccaugaccaugaguuauggcagauugggaaucguuaccuugaucuucucaacccuuggguguuuaccuuuuccaaguuaaugccuguucuuuaauguuacauuaucuuguagcaagguagucauuuauaauuuauauacuagagcugccuuaaaauagagacaagaggauaaucagcauccugaaacuucuaguuuuccaaaauaacauuucuucagugaagucugccuguaggaauuaaaacuuuuggugaauuaaaaagcuuuuuguccuauugucagacugggaaauggaugugcccauuacucagccuuaaaaacgaggaaggagaucaucuguuaaaaauaaaacucaucauuuucuuuuauucuucucaaaauaaucccuaaagaccucaaucuuuauaguguuccaguggccccacuauagucagagaggagacagggcagaaguugaaggacagauaggagaaacggcccugcuaaaagauaaaagccaguaugcaucucagcuacuugucugcugugguccugauauucuuccaucuagguugcugcuuugcuugacuuugacugcaaacacagagaagggaugggcuuuccuguugaguaccuuguagagaacccacuguucauucauauguguuaaaaaugaaaagccuacuugaaaacuccccuguagaaucagguuuuagcaaaaaccaaucagguaucagaggucuaacuuauuuuucccuucuugguuuuauagcaagucucuaaacccuaagauuuuuuguuuguuuguuugagauggagucuugcuuugucgccaggcuggagugcaguggcaugaucucggcucacugcaaccuccgccucccgguuucgagugauuccccugccucagccucccgaguagcugggacuacaggcaugcgcuaccacaccuggcuaauuuuuuaguauuuuacuagagacaggguuucaccauguuggccaggauggucucgaucuccugaccucaugauucgccugccucagccucccaaagugcugggauuacaggugugaaccaccacgcccggcugccuaagaauuuuuuucauuccuuuucauuauauacaucuucagugugccaagacuuugaguggagauuucuaaugagggcaggaagggacggaugcuucugcaauugaguggucucauuuuucccaugucugucgaaagauuacucuuucaugaccaccauuucuaugaugcaucucauaugauccuaaugcacucgaguuuguauuugaauguccaucugauauuuaggggugguuggggcaaggagggggcaagcagcaacuaagggguuguaugggaacauccuggugguuuaacuugaaagccacuagguggcaacauuuacuaaguugccagccauucucuucccuuaagacauugaacuugcuuuuccacauagcagauggaauagcugagaaaagagauugccauugcuucagguucuuuugaaagugaggcuauaggauaaacacacuacaguauauugauaucuauucgucaccuggguuuagauaccaggaguuugaauuugcucugggugacugggugaguagcuuccccuuuggccucaguuaggcauccuugacaggacagaccugugauuggacugucuggucucucaugguucuuuuucuccaugauuuaugacuuugauuaugauuucuuuauauuaaaaaaaaacuuguaguaaaaccagucuuauuuaaaggaauacuagccuuuuaucaaagggcaaaguaaugauuuaaaaaaaaaaucaacaacaaaauuucaagggaaugaaugucccuagaagcuagccaucuccccgaguuaacuuaagaggcuagacucuccuaaaugaggaugcuuauuuaccagcuuuccuaaauuagcagcuuuggagauguuaaaauccguaaggaacuguccaagggauguauuguguaugcuuugcagugauuaagccauuaagcucuaauugguauuuucccacucauggguuuguaaaggaagcuuuaaaauuauuuaggaauucaguccucaucagcugucuuagugucauccccacguuuuggaaccugagaguggagagugcagagaaaagguuuuauuaaugauuuuugcucacaguguccuuccccauugguuuguuauugcagaugaaguggaaagggaaggaccucuuugauuuggugugccggacucuggggcuccgagaaaccugguucuuuggacugcaguacacaaucaaggacacaguggccuggcucaaaauggacaagaagguugggcuagaacucgaugaaacugguggggcugacgugagcuuuccaguuuuucccugagcaggcgccuagcucaucacuggggcgcuguagcuguauaguagagaagggggcacauuccugaauuaagucaugcagaaagcaggacguagagaugcuaccaguuuccuucuccucacaggcucuccugggcaagcagaaguuaccaggauuagacugcugcuggcccuggcuucuuuacccauuguuaccagccugauugcuucuggcuuuaugccuuucaguuuaugaauaaaaacuucaugaauaaaaauuacuguuaucuucauauacuuaaaaauaaccaauuugugucuuuuagagaguauuggggcuuguguucuuuagggaauuuuuuaaagucuuuuugaggaacaccauagucugacaugaaguaaucauuaauaugaucuaaggaauagagagugccugguccccagggugaaagaauguccauuuuguccucaggauucucuggggcuucugacacauggccaagaaagcugggcuccuggcaauuuuaauguggcuuggaaaugaauauugccuaaaggaacugcccucugcauggguucauauguucacacaaggauacacuugcuuacugaccugccuaccuagccaugaaaggcaggcggggagcaggaccauaugcuuuugucaguaacuccuaaaagacaccugaacuucaaaguaagucaaugucuaauucuuaccccaaaugaugcccccuccaguugccuaccugagcauaauaaauaaugaaagcuuccuauuuuuuuuuuuuuuaccaguuugacucaaagcuuaaguguucgaauuguguucacauauguacacaguaaucuaaauaaucacaugggaaucccugcugguuguaaguucaaugguaauucccaaugaucaugagcaucuaagugccacugggggccacugucagugagggugucguagaccagauuuugaaucuccuuggcauugccaucuagaauuugggcaggagcauggagaguuaugugucaaagacagcaaaacuuuuuguauguuuuucaugauucuuagcaaagugaauuuuaaugauagcugaguguaggccaaauggauauuagacugggggcaucaggagccguggaacuugcugcucaagggaaauacaucaugacacauguuaauggagccuuguagccugucacauggcguguuuaugucuugaaauucacucuggagagcagaugguucaagcuuuacaggggugaauggaauuguuagaagauuuaaaggcagugguuuacagacugugcuucaaguauuuuguggggcaucucuggagguuccuugaaacaaaggguugccaugauggacacauuuuauucuguugcucaguuaauguuuagaugacuucauaaugaucuaguucaucaucucuaagcuguauuuuuuuuuuuuuuuuuuaagacagaguuuugcucuuguugcccaggcugcaguacaaugacgcagucucggcucacugcaaccucuaccuccuggguucaagagauucuccugccucagccucccgaguagcuggaauuacagguguccaccaccacaccuggcuaauuuuuuguauuuuuaguagagaugggguuucaccauguuggccaggcuggucuugaacuccugaccucaggugauccacccgcuguggccucccagcgugcugggauuauaggugugagccaccacgcccagcgcucuaagccguauucuaucacggaccuaaauauuggcaguaggcaccaagaaaaaagaaauaaaggaagauuccacuacuucagauaauuaaaaaaccuuccaccuaccauaaaggacaguguccaagacugcugagugauacauuucuaguuuuuaacuauucuguggcccugagaacauuuaugccuuaauccuagcucugcucacuucuuggggcuauugauuaauuuguuucagaaacaccauaggaagugaauauuaccucuugcuauaggugacuuugugaauacuucaaacuguaaaaucacaacuuucaggaaaugugauaaauuuagugggaaaaaaauuuaaugcacgccuugcaaaggcuucuuugaggguagcacaggaggaagugccaauauaguguguuugucuuuugcucugcaauucugcagguacuggaucaugauguuucaaaggaagaaccagucaccuuucacuucuuggccaaauuuuauccugagaaugcugaagaggagcugguucaggagaucacacaacauuuauucuucuuacagguacaucagucaaggcuaccccccaguucugagagaacuugcccaggagugguugcagaguuggccucagaguugaccacaaacaccuuuguauugcaaaaauauucuaccucuggaaggucagccccuuugguucuguaauggaaaaaaggcuucagaacagaacuauacuugagugaugaaaauuggugucagaugaaauugugaaggugugauggugaagaauggauacaaguagcuaccuaacuuaaaaccuccuugaaaauggguccuauuuucuucuagcuaacuuaaaaguacucaauaguuucaaaggaaggcuaaagagagagucuuauaaagcaguaguucuuccaaaaguuuaaaaucugcucucauuaagagaggacuggccgggcaugguggcucaggccuguaaucccagcacuuuaggaggccgaggcgggcagaucacaaggucaggagaucgagaccaucuggcuaacauggugaaaccccgucucuacuaaauauacaaaaauuagccgggugugguggcaggugccuguagucccagcuacucgggaggcugaggcaggagaaucacuugaaccuggaagauggagguugcagugagccaagaucgcgccacugcacuccagcuugggcaacagagugagguuccgucucaaaaaaaaaaaaaaaaaaaaaaaaaaggacuucagccgggcggguuggcucaccccuguaaucccagcacuuugggaggcugaggcgggcagaucacgaggucaggaguucaagaccagccugaccaacauggugaaacuccaugucuacuaaaaauacaaaaauuagccaggcauggugaugcaugccuguaaucccagcuacucaggaggcugaggcaggagaaucacuugaacccaggaggcggagguugcagugagccaaaauugagucacuucacucuagccugggugacagagugagacucugucuuaaaaaaaaaaaaaaaaaaaaaaaaagaggacuucagagcucuagugacacuugguuugucccccauaugugguacuucagacaucgugcuucaugcuaugcugugucucuaauuguccuauuucuuccuuaauuccucauuagauuguaagccccuuaaaggcaagccucauuaaguacacaguaggcauuccauaaguaauugucccaccgaauugaagaaauuaagaaauucacaauuacagguugaccauccagaggcacagggaggggaacuggucugaggaugaaaaccuuaucaguuucacuuauguucuuacugcaggucagaguggcuccccaguuucauggccaguugcagugauuggcacuggggcuauuugugugcucaaagguuucaguaauguaaaagauggcaguaggggcauuaauuacaugauuucccagagauaguuggguagucugucacauagcccuccuguaauuaauuucagccucaguauauuguggucagcaaauauuaaguuaaauauaauaaaacccccuaaauucuuuuuaaaaaaggucuggggggcgugugugugugugugugugugugcacgcgcaaaagaggugacaaauuuauuucugauguuugcagaucaaagggacacucuuaggcugggcgugguggcucaugccuguaaucccagcaauuugggaggccgaggcggguggaucaccugaggucaggaguuugagaccacccugaccaacauggagaaaccccgucccuacuaaaaauacaaaauuagccgggcaugguggcacaugccuguaaucccagcuacuugggagacugaggcaggggaaucacuugaacccgggagguggagguugcagugagccgagauugcgccauugcacuccagccugggcaaccagagugaaacuccuucucaaaagaaaagggauguucuugcaguuuuucuauagcguugcuuuuuccccccucucuuuggaaaugaaaccaagggauuagaaaguugcacugcuugagaaacaucucagguuucauuuucucucuaagaauguaaaaucacuuuuaaaaccuaagaagaauuuuuguguuugaacguaaacaccuaacaaucuccuaggucccagaauguccuaauguuauagaaauggcuuucuuguaaguacuuggaagcacugccugucucuugugugacugacuugauuuuccccauacugaaauguuaaggcauuuuuaugacugagcaaggcaaaauuuacugcuuuuaugaauccggugacuguugacaucugugagaggagagcuggcuuuccugcuguguuuauuucagugucccccugccacgucaugcaguugucuugcuucugugucuggaacaucccaaguugcaccauucuaagaaaauuaagugcaaugaaauauguuaauucaacauuauggcuuaagaauuauauuuccuggaccucacguguacuuaaaaguugaaucgaucaaauuuuauugcuuccuuuucccuuagagcagcacguugagagugaugguuuuuucugcaaucauaacucaguggccuuggugacuuuugucuuguguuaauacuuaaaaguagauccauuuccucuggggccaugcauauucaaaggggcugaggcuguagucauccccagagcugcucuugacacuucuugaguucauagcgcucugucacacagccucuguuguaacuacagagaccguuuuuacucuucagcauugaucaugaagagaagagauaagggguuuuuaugcauagccgucauaccaguaacuucugugacugaacucuccaccugucugcaucaguaaaaaaaaaauuguacccuuugucagaaaauuauuaacaggcugcucuggcagcccucauuagaacgccgugaggccaucuguugugaucagccuacacaccucacuuccacucacagaguaucaugucucccuuguugcuccuuucagguaaagaagcagauuuuagaugaaaagaucuacugcccuccugaggcuucugugcuccuggcuucuuacgccguccaggccaagguaggcucaaagaagaaaaauguauuuuuccugggcguuaauuugggucaugggaucacuccuaucuucucuuucuuuggguuuucuguacuucagagagacuugccccagaaagugagauguuaugggacuuguggacuugaagaaccacugucacuguuccaguguuuguauaaucuuguguguguauguguguguguguguauguguguguguggugugcagaaauuauaaguaucguucuaaugaauuagaauucauucuaagugaauucauucagaaagaugaauuuccuguguaaucucauuauguacaugugguuuaugacauuuacuggaaaaaccuuuuuucuuuuuuuuuuuuaaaccauaaacucaaccaugugguacaaccuuucuauuagccaggaaaaaugaauuuauggucuccaauuuuagccaaacauggccuuuaggucagaaaggcccagguccucacuccaaacucauuugcaaacaagcugccuuguguguggacacuacacuacaccuucagagaaugcccugcuucaucugccccugauugacaugcuagcuguucauguggcuaagcacugcaggugcuguggcccaccaagcccacuugagcugucugguuagcugaaaaucguucacuuccguuaaaucacuauagaccuuuuuuuuuuuuuuacaagaccgaugagaggguuagccacggaguuucaugucccucagauuuuucacuucagucauauaucaccuucucuugguuccccugaucccugccuuucaccagagcacaagauguuguccccagaauuggggcuccuugauuacuugugugauuuuauuuuauuuauguuuuauuuguauuuuuauagagauggggucucacuauguuguccaggcuggucuugaacuccugagcucaagugauccuuccaccuuggccucccaaagugcugggauuacaggucugagucaccaugccuggucuuacuugugugauuuuuuuuuuuuuuuuuauugaucauucuuggguguuucucacagagggggcuuuggcagggucauaggacaauaguggagggaaggucagcagauaaacaagugaacaaaggucucugguuuuccuaggcagaggacccugcggacuuccgcagcguuugugucccuggguacuugagauuagggaguggugaugacucuuaaugagcaugcugccuucaagcaucuguuuaacaaagcacaucuugcaccgcccuuaauccauuuaacccugaguggacauagcacauguuucagagagcacaggguuggggguaaggucacagaucaacaggaucccaaggcagaagaauuuuucuuaguacagaacaaaaugaaaagucucccgugucuacuucuuucuacacagacacggcaaccauccgauuucucaaucuuuuccccaccuuuccccccuuucuauuccacaaagccgccauugucauccuggcccguucucaaugagcuguugggcacaccucccagacggggugguggccgggcagaggggcuccuuacuucccaguaggggcggccgggcagaggcgccccucaccucccggauggggcggcuggccgggcggggggcugaccccccaaccucccucccggacggggcggcuggccuggcggggggcugacccccccaccucccucccggacggggcggcuggccuggccggggggcugacccccccaccucccucccggacgggguggcugccgggcggagacgcuccucacuucccagacgggguggcugccgggcggaggggcuccucacuucucauauggggcggcugccuggcggaggagcuccucacuucacagacggggcgguugccaggcagagggucuccucacuucucagacggggcggccgggcagagaugcuccucaccucccagacgggguggcggccgggcagaggcgcuccucacaucccagacggggcggcggggcagaggcgcuccccacaucccagacgaugggcggccgggcagagacgcuccucacuuccuagaugugauggcggccgggaagaggcgcuccucacuucccagaugggauggcggcugggcagagacgcuccucacuuuccagacugggcagccaggcagaggggcuccucacaucccagacgaugggcggccaggcagagacgcuccucacuucccagacgggguggcggccgggcagaggcugcaaucucggcacuuugggaggccaaggcaggcggcugggagguggagguuguagcgagccgagaucacgccacugcacuccagccugggcaccauugagcacugagugaacgagacuccgucugcaaucccggcaccucgggaggccgaggcuggcggaucacucgcgguuaggagcuggagaccggcccggccaacacagcgaaaccccgucuccaccaaaaaaauacgaaaacccgucaggcgugguggcgcgcgccugcaauugcaggcacucggcaggcugaggcaggagaaucaggcagggagguugcagugagccgagauggcagcaguauaguccagcuuuggcucggcaugagagggagaccguggaaagagagggagagggagaccauggggagagggagaccauggggagagggagagggagagggcacuugugugauuuuaaaacauaaucuuuucacuuauuuuucuuuuuaauuaaagguguucaugaagccauuucccuuaagguuagaaaaaauaauaaaauacucuuaacucacuuuuugggguagauuaaugcaauuucagaucaaagccaggaaguaacugucauuuguggggaaaaaaggcuauacaugcuagucagaccaauagaagcaccaaagucaauuuaaucauuugauggcucauguaauauuugcugaguauucaucaggcccaggguggggagagagcaugagaguuguugaccaucucauaguugcaggcacuaaagcaaguaucugcccucagugauuugcccaagaucauucagacaaucuugggcaaagcuaagagcagaaggguagaauucauggcuuugagauugcauuuugugccuccaauauucuacuuuccugaaaaauuaguaauugagaaaacagaaaaugggcccucauucaacuaaaacauaugcuuccuuuuaugcuuugaucaagaauauuaguaagaggaaaaauguguccuuucaaucaguaucaccccgacagugaugaagcagucauuggcacuuugauuaaauccgagcacuuccuggccuggaguugaguuccuuuucgcacgcuuucuccccagcgagagcagacccagccucucaaggacaccaccucucuuugaagggcuuccaucucaaaggcuacauuuucuuuccauggauuuuugggccacaaauucaaaggccaccuguagaaaaaaauuacuuuucagugaaccagcagauguuugcuuaaacagguuucacuguaggaaagcccugcuaauuuggaucguacuaauuuggagaugaaagugauucacagacgacauauguggcucacauggaggaggauguucuagcuauuuuuucugguguaaauuuuaaggaucuuacaaauaaagguaaucuauggcuuaaagucuucauuugggaaacuaaggcuuacuaugacauacuuccaguuucuaggacugcugguuaauaguuaaaggauaucugauuauaauauuaauaagaucuuacaugcccauaguguuuucuaguuuuaccaaagcaauacaaaugaauauuuugugcgacacucaguguagucuuuccagaagccaaggcuugagaguauuaugccuguuuugcagaugaggaauuuaaggcucagaaagggauuugugacuugugcaaacucacaauacuuuuauguuaagccuauuuuuaugaaauuuuuagcccacuucucgauggagaggauuucaggccaaauagaaugaguggagcugggaugggaacccuaguguccaggcugccuaaguuagcacauugcacuugccugucacugucuagcuugagggaggucuuuggguagcaaccacugccuuucacuaaaggcuaguuucauuuauaugaucacauuugucuaaguucuucaguaagucauacugguuccuuccauuauauucagcuuguuuucuuccacaaccuuucugaaacagaaaggaacuuuagaaguguggaagggaaagcgaauugagcucauuaacacauggaauguaauuaugcacaaauguauucauuacaguauuucagcuguuggaaugauauagacacaguuaauuccaaagcauaaagaaacaauuacccucaaaguauaaauacaauacuaaucacaugguucaguuaacaagaaccauauaugaguuauacuugaaucaaaaguguaggcagggacugggcacaguggcucacaccuguaauccuagcacuuugggaggccaaggaggauggaucaccugaggucaggaguucuagaccagccugaccaauguggugaaaccuaaucucuacuaaaaauacaaaaauuagccaggcguggugguguagucccagcuacuugggaggcugagacaggaggauugcuugaaccugggagguggagguuacagugagcugagauugagccauugcacuccagccugggugacaaagugagacuccaucucaaaaaaaaaaaaaaaaauguagucaggguuuuuuuggugcagucacaugacacacuaaaccaucuugcaauguuuaagucaccuguuggauuguauauugaccauuugguguuggaaauguguucuuauugaaaaugacuuugggagagaauggcauauaauuuaugaaucucauguugcugugugcagacuccuagugaucagaagagagaaaagaauugugggaagggaagcuuaguuucuuaguacucuuuaaugcaaaucagggacagagugccaaaguacaauugaguuagaaaauugaguguguaaaguguagguagagaguggcaagaguugaggcuggagagguaugcaaaaaaucagaucuuaaaaggucuuaacuuuauccuguaggcgaugcagugaaggguuuauauuuuagauagagccuguaguggcugugugauggacagauuggagugagacaacuuuggaaacagggagaccuauuagaaggcugugauaguugcccuggugagagaauauuagguucacacuucaggugguugguuggaugggggcugacugauuuaaaaauauccaggagauaaaaaguugauuagauggugcuauacucugcauaucccuuuuuuucauauccuuuuacagaaugguauuuuucuucccacucagcaucuacuuugagauguauccauguuguguguauagauguagcucacugauuuuaauugauuuaauaugguaaccacugauaaauaaaccuaguuuauuuaucuguuccucuucugagggagagguaguuuguuuccacuuuuuccuuauuaucuaaacagugcucaaaugaagauccuuuuaugugauuccuuauguacaugugcaaaugcuuuuuccccuuaagguaggugccuacgaaaauaaauaaauaaauacauacauacaaaaaauagcugggugcaguggugggcgccuguagucccagcuacuugggagacugaggcagaagaaucgcuugaauccgggaggcagaaguugcagagagccaagaucacaccacugcacuccagccuggacgacagagugagacuccaucucaaaauaaauaaauaaauaaauaaauaaauaaauaaaguaaaaaaauuaaaaaagguaggugucuagaagaagaauugcauagaauugacagaagaggugaaccccaauauaaaaaaaaucuuaaguugauaaaaagacaaaugcuauaaacagggcaugaaacaugcacuuuauagaagagaaaacaagaauggucauaaauacaaaaagauguuucaucucacagguaaucaagaaaaagaaaaaacaacaauaaggcaacauuucaaacccauaagauuggcagggauuacuagauuggguaacugcauuguuggugcucauuuaccugccaaagggauugugaaauuggcauaaccucuguagagcaccaaguguggaagggacggguggaagugaggagacacaccgcuggcuguuccagguggcuacuccagaggaaucucugcacacacauccuuuucacuuaaaacugucacaacagauagacccacuucauuuucuuuuucuuuuugagacagcagucucucucugucacccagguggcacaaucuccacccacuacaacuucugccucccaggcucaagggauccucccaccucagccucagcguaugcccugcuaauuuuuguguuuuuuguagagacaggguuuccccuuguugcccaggcaggucccaaacuccagggcacaaacucuauacccgccucagccucccaaagugcagggauuacaggcaugaaucacugcaccugaccccagcucauuuucauuuaacugccgaacuauguuucauagaaaggagggacuggauuauuuaaauauaucuuuauugguagauauuuagguuuguuuuucuuucuguuguuuuucuauuggugaaacagaugcaauggacauccuugaauaugcaucuuugggcauauauggauaauaucucucuauaauagauaucaagacaugguauaacuggguuaaagaauaagaacauuuaaaauguaaguaaugugaagcaaaaaaaaaagccagacacaaaaggccacauauuuuaugcuuccacuuaccuguagaugaaauguccagaacaggcaaauccauagagacagaaaguagauuuagugguugccagggaaagggagaaggaggaaauuaggagugacugauacuggccaggcacgguggcucacaccuguaaucccaacacuuugggaggcugaaguggguggaucacuggaggccaggagcuugagaccagcuuggccacauggcaaaacccugucucuacuuggccgggugcgguggcucacgccuguaaucccaacucucagggaggcaagaggugggaggauagcuugagcccaggaguucgagaccugccugggcaauauagcgagaccccuuucuccagaaaaaggcaaaaacaaaacaaaacaaaacaaaacaaaagacaaaaaauauauaaaagccagcugugguggcauaugccuguaaucccagcuacucaggaggcugaggcacgagaaucacuugaacccaggaggcagagguugcagugagcugagauugcaccccugcacucuagccuggggugacagagugagacucugucugaaaaauaaaauaaaaauaaaaaaggagccacugguacaaaaaaaaaaaagaaaaaaugaguaagaccuacuauuugauagcacaacagggugacuauagucaauaauaauuauacacuuaaaaauaacuacaagaacauaauuggauuguuuguaaaacaaaggauaaaugcuugaggggauggacaccccauucuccaugaugugauuauuucacauugcacaccguaucaaaacaucucagguaccacacaaauauauauauaccuacuauguacccacaaacauuaaaaauuaaaaauaaauauaacuuacaaagauuaaaaaugaaauuagaagugauggcuaguggguacaggacuucuuuuuggggugauggaaauguucuggaauuagauaguggugaugguugcacaagauucugaauauacuaaaaaacacugaauuguacacuuaauguaaauuuuauguauauaaauuuuaucucaauaaaaaauuuaaauagauauagccaaaucacccuccaaaacugaugucauaauuuaacuuucaauaacagugugugagaauaccuguuuuuccacauucuugcgaacaguagauacuaucagucuuuaaaauuuuugcuaauugauagaaaaagauuuuuuaaaauuugcauuuccuugauugcuauugggacugaacgucuuuucauaaacuuacuguccauuuguauuucuuuguucugugaaucaaccguuuaugacuugccuacuacuguauuguuuguuuguuucuuucuuuuucuuucuuucucuuucucuuucuuucucucucucucuccuuccucccuccccuuccuuuucuuuccuuuuucuuuucuuucucccuucccuucccuucucuccccuuugcuccccuccccuccccuucuguuucuuuuucuuuucuuucuuccuuucuuccuuucccagguucaagugauccauccgccucagccuccagaggagccgggacuauaggcaugcgccaccaugccaagcuaauuuuuguauuuuuaguacagaugagguuucaccauguuggccagacuggucuggaacuccugaccucaggugauccauccgccucggccucucaaagugcugggauuacaggcaugagccacugcacccaaccuguucaucuuuuuccgauugauuuguagaugcuccauguauuaugaguuaucaaccuuuugucuauuuuacguauaggacuggucaaucuuuuucuuuguauguuuugagugacuuuuagaaugcguuuaccaaccauuauuauauccauacucuguuauguuuuguucugguauuuuuauggauuuucauuuauagguuuaagaauuuauugacugguguguggguauaguagggagggggucugucuuuuuucuauauauguaguaaucuaaccuuuauguuuuugugaaauccuacucagagcauuuuaucucauuucucauaguuauagacaggaaauuauuucauauccagauagagccuccguuuaaccuaaguauuggcuccacaagucuuuuaaaugguaaacuccuugaauuuaaauucaauuaguuuaugucacgaguagguccagguuuucugggucugaauuuuaauaauuuaggggauugucuuuaaugcaagaguaccaaauuagguacaggcauaugaaggugcagagaccugaaauccaagcuuccuuagcuucccaguaaauucacccugguuacauuaucagaaugcaucuguuacauaaaacgaugaggagcagccaucuccaucccuggagugguaugacuuucuuuuguauucaccagcuaccacaacuucaggauuuuuuucuucccuuguuguuuaaagagacauuuaagagcagacacauacaucaagguggcuuuaauguuggaagcagaguuaguccaguggagaaguucuuucagcagggucuuugccaccucugcauugcucaaaugugauguauuugaucaguggacuagcugagaacuugguauaauaauggggguuguuaaucuugcaugccuuuggaaccugaauuuacagcuuuaacuuugcauaucugcuugcuuuugcauuagagcuuggucagcacuguugagagauuugcaaaugcaacuaacagggcuuucuuuuagcauccuacccuuucaaaaauccaggaggcaaacaaugaucaauguugucauaaguaaugcagaggauggcaauaauaauaauaccugacuuucaccauaagccaugugcugugcgaaaugcuuaccuguauuguuuuacuucauccucaucauccccuauaaggcagaugcuauuaugacccucacucuacagaugaggaaguugaggcuuagagagaggaugccuuacucaaggccucagaagggguacuucagcacccccccacuucccuucaggauccucuaaggccagugcucucauuugacaaaugaaagacagauuuggagagaccugagaucuuuuggacaucagguuuaugugucaagcauaguuuuauuuauuuuauuuuauuuuguuauuuuuugagauggaguuuugcucuuguugcccaggcuguagugcaauggcaugaucuuggcucacugcaaccuccgccucccggguucaagcgauucuccugccucagccucccgaauagcugggauuacaggcauguaccaccacgccuggcugauuuuguauuuuuaguagagacggguuucuccauuuggucaggcugcucucaaacucucaacuucaggugaucugcccgccuaggccucccaaaagugcugggauuacaggugugagccaccacgcccagccaagcauaguuuuaaaaacuuugcuggucuuauuuaauuaaaucccuguaagaguccugcaagauaaauacuauuauuauuccuguuuuacagaugagaaagcugagacacaaaaauuuccaaggccacauagcuacuaugugaaagauguaggauaaaaccuuaggcagccugccuccagagccaggcuccuacccucacucuacagcugccuugcagggaguacuguuaaagcuuaguacaguuacgacuuacugcaucacaucucugagccucccagaaauagagagauaccaaggccuuucauuuauaauuucuaaguuauuuuuuauuuuuauagacagggucuuccacugucacucaggcuggaguguaguggcacaaucacagcucacuguagccuuaacccgugggcucaagugacccucccauuuuggccucccaaaguccuaggauuacaggcaugagccauggugcccacccuauuuuuuuaaaugaagaaaugccuaaacuguguuacaaaaacuguggcauguuuaaaauguuuaaauuugacaaauuaggccaggcgcgguggcugacgccuguaaucucagcacuuugggaggcugaggcgggcagaucacaacaucagaaguccgagaccagccuggccaacauggugaaacccugucucuacuaaaaauacagaaauuagcccggggugguggcgugcaccuguaaucccaguugcucaggauacugaggcaggagaauugcuugaaccugggagguggagguugcggugagcugagaucacgccauugcacuccagccugggugacagagcgagacucugucucaaaaaaaaaaaaaaaaaaaauugacaaauuaauucucuuaagauucaaaaaaaacaaugcaauacaauucugcuauuugaaagauaauuaugagauucaaaagaaauaugaauucauggggcuuuuacaguuaaggugauaugggaaugagacaugauuuaaaguuaaugaugaauaucuucuuucacuccugugucuguaguuuuaggccgcuucauuuggagaacacaccagaagucuuaacuugaggcucuuugagaaugagagaacauaacgaaauaaugagauuuggugguauauagaaacagcagccuugugccugaccuuuguuuuuucacuguugguggcuaaaagaauaaauguuuauagauuauacugaaguacugagcuuuguuguuuuugguaaaaugaagagccacuguacgcugauugauaagagauaggcuuugauuuuauauucuacuguauguuucaguuaguuucuuuuuaaacauucuuuaacuuuugauuauuuccuuaucagacuugaguuuucuaggaaaggaguuuuuuuuuuuaaucagagaauaaauuuccaagucauuguccccggagggauaaauuaaaaugcagggccuauuuccaaccgcauuagugacuucucuguagcuuuaggaagaucaauuaaccuuuuacucacuucuuugucuguacaauaggaauggcaguguugacaucagauuuuuccaaaguauuuuucagaaacuugggugaaagguauuaaaacuacugccugcauuauuccuggaucccccuaguaaugggcuccaauuaccagucacuuauaagaauuuauagguaagacucuuaucauauguuguuaaucacaacuuucacaguugugauuugguguuuuaauucaaaagcuacuguuuuggaagugacugcuuucuuugaggguuagaaaacaugcccacauuuccauacaagugucacauucuuguuagcacaucacccauccaucucuuacaggauuaugcaacucaguucauagauauaaucagcuuuguauuuucauucaaggauaacaaacuagcaagguugaaaucuugacuugucaucggaauugaauugcucccuggagcugggagggaaugagauugguccagcucuguucagaaauggcaguuaucuuuagaaucucaaucgccugcucucccuuucuucuuuccaguauggugacuacgaccccaguguucacaagcggggauuuuuggcccaagaggaauugcuuccaaaaaggguaagagauuaaauucccuuuucaggaagacauagcagauauguggucuaaaagaaagcuaaccaaaggacuugaaggaauauuggaaguacauagcaauuuaauuuuaauaaauauuuuguaaucuccaguaaacagugugggaucucuguuaagaauauuaaaaagcaaagguuuuuggaguuaguuuggggucaccaggacuagcauggccuguaaauguuuuuucuagcgugguuguuuuuucagaugcaguugagcaucauugauucccaaagaggaggcuggagcagaguguauucagcuuggggaauugagcuguuugcaguggcgaggggcggauagaggagaugagguaggggugggcauugugguuuuuaauccucaguguuguucaucuuauucauuagccacagaagcaggcccgcccucccuuuugcuccugccgauuuuacagcccucacucaucugucacuggguaauaaaggcccguuucucaccucucacucucuuuaccugucccucgauggcuucugagcaugugaaggccugagaugagugagcauugcuucugacugagcuccgcugucagagguggucucugugauguaucgcccaggcagggacaggggcacugccagaugaggguugcaccuaggucugaguuaucaugcagcuuucugaguugcuccuccaauagaauggugccuuauuuacacgcccucucucugugugacuaucucccuggguguagcuuuuuaaaaauagcuuuacuguuuuguaaaaaugaugcauaauuauaaaaguggcaaacaauaccaaauuuacuucauguguagguuuuuuauuuugcucuauuuuuugguagguaauaaaucuguaucagaugacuccggaaaugugggaggagagaauuacugcuugguacgcagagcaccgaggccgagccaggugaggcccauucauuguugguuuacauuccuuuaugggcuuuuuuuuuuuuuuuugccuuaaagaacugcaaaacuaggacaugcuuguuaaacaaaaugcaguacugaagucuauaaaagaaaaggggagagcuggggagcugggaguaacguuggucuucaguuuuguguguguccuuuucuaguacguaugacauaaaguagguauguguacugccugucaagauauauagaccuguacucacugguaauuaaguuuaagauuuuuuuuuuuuuuugagacagagucuugcucuguuguccaggcugaaaugcaguggcgccaucucagcucacugcagccuugaccuccuggguucaagcaaaccuccugccucagcacccccaguagcuggcacuacaggcacacgccaccaugcccagcuaguuuuucuauuuuuaguagagaugggguuucaacauguuacccaggcuggucuucaacuccugggcucaaagcaaucugcccaccucggccucccaaaguguugggauuagaggcgugagcugagccacugugccuagccugaauuuuaagaauucuauuguauggcuaucccauugcuuuugcauccaucccuuuauugauggcauuugaguaucuguagguuuuucacuuuuacaaaaauuucugcagugcacaaucuuuuauuuuuauacaauuguaugaguaguucuggggauauauucuuuuuuuuuuuuuuuuuuuuuuugagacggagucucacucagucacccaggcuggagugcaguggcgcgaucucggcucacugcaucuccgccucccagguucacgccauucuccugccucagccucccgaguagcugggacuacaggcacccgccaccacgccuaggcuaauuuuuuguguuuuuaguagagaugggguuucacuguguuagccgggauggucucgaucuccugaccucgugaucugccugccucggccucccaaagugcugggauuacaggcaugagccaccgcgcccagccaauauauucuuuaaaacaagaguuguugggacaaaggaugugagcauuuugcauuuugccagguaccaccaaauuguucuccaaaaaggcuguaccuguuuauacaugccugucgacaaguguuaugagagugucccaccccccacccccagucuauccucaacaauuguuuuuaucagucuaauuuuuguaaucuaaaaagugaaaaguuguauuauguuagaauuccauucccuugauuaggaauuggucauguuuucauuagccuuuaacauuuuuuucucuucuucaaaucaguuuccuaacacuuuuuuuuuuaaacuuaagugcaacaugcauauggaaaaguagacaaauuauaaguauacaacuugaucaauuauuguaaggugaaaacaccagaggaagaaauaaccugugucucccuacccccaauuccccuuucuuccuccccaaaggcaaccagucuccugauuuuuaauuccagauuggcguugcccaucuuaaacuuugcauucuguuuuuugugucuccuuuuacucagcaucauguugucagauugggguuuguggcauguggcaauaguuuucucauuuucauugcuguauagacuuccacuguauuaguauauuaaaaauuauuuauucauucuacuaaugauggacaguuagguuguuggguuguccccugaguuuugcuauuacaauaaugucaaacaauuucccaaaguaauuguaccaauuuacgucaaugugcaugauuucugauuucuccaccuuuucaccaacacuuggcguucucucaggcuggguuuuuaaaaauucauugagagcauuuggagauuggagagagaaggaagaggacaaggucauagggagacuugaguuaaaauauuucaguaugauaccuguuugggaguuuucugcaaguuauugcuacuucaagagcuuacuuuaaauuauaacuuagaugaaggugaucugacuuggguuuuacaacccagauaacucuugcccuaaccuccaacaauacucaggaagcuugcagagagagcuguuucauuuccagaaccuuccagguaaagaaaguacacaaaggaaaagcaagaacuuaaauaaaauuccaacacccaaaucuguuugaggguagaagauaacauaccacacacucuuguugaauuacuugagaugaguuuacuguuuaccaagggcaaggugggaaacuaaggccaagaaacuccgugaugagucuguucucugacuaucuuuugauggggaugggaaauucugcuugaccucaguguguuuaauagacucagggccgggcagagcuuugcuggugucugcuguggcuuuugucuucuggcagcgacguggcucuagaggaauggcagggucagaaugcuugauuuggugcccacccgcucuccacccaucucacuuagcuccaaugacagugucuuccguucuccccacagggaugaagcugaaauggaauaucugaagauagcucaggaccuggagauguacggugugaacuacuuugcaauccggguguguugaaaccucucugagcuccuuguguaguagacagagacugagugagggccagacugcuaaaaugguuacuucuucauuccaaggcgauagacucuuuuaugguucugugguaaagaaggaaagaggaaggaaagagaggucuuagugccuaacuuucuauuuuuggacuucaauuagaucauagguaauuaagugucacuugagccuugggggacuuggaccugguucugcucucagcagaaaccuguuugaaugcucugaguguaagauuugauuauuucuggcucugugagaucuccguccacagggagcacuuguaaguacuucuccccccaacacacaccccacccccauccccacccccacccccaccccaggcacuaguagaguagaucugccuuuauagauuacugauuuguuugggauucucacuaugaggcuaauugguuuucuauucagacuauuaauagucugcugucugcugggaacccacugcuucugcagggagaggcauuugugugcagcccagaucugggccuuuagaaugucuuucuccugugggucaguaucuggaugcaguguauaggcagcuucuuacaaagggaugcaugcgauuugccaaagcauuucacuacggacuccaaacugcagaugaguagauguuaaaacaaugaggcggguccaccuuuauuuucauagucaugcuuugcuuucccuuauuggguuccuacaguuguuguauuaaauucagguaaauugaaacauauuuuaaauauucuaggauagcuuucuacuucauuuguauuuuguaaauacagauuuguauggauuacacugcauaagaaaauaaggcacacuuaaagugccuaaaagaugcuccauaauaguacaggaaguucuuuucuaaaguucugucaguuuguauuugcuaauugcuugguuucuuuaaggucaaacuaauguaacacauuucugugguuuugucaacucaacuccucuugccccauguucuggccaccuagauucuagaaaacuaaaguuuuauaauccucagaaaacaguuuuuuugguuuuuaaaaaucuuuuuuguuuuuuagagguggaguuuugcuauaucgcccaggccugcuaggcucaagugauccuuccaccccagccuuccaaguagcuggggaguaucacugugccuggcugaaaagguuucuuauuagggaauauuucuacaucagucagacuaauggauacuguuuuuuguguguguuuccuauauugagcaauagacaaagcuacuggcuaucuuagugucuuuuauguuaaauuuccugaaaucucaccauuaacuaaggaagauguaugcuuaaaacaguuuaaaaggggcugcuugaguccucaccucucucucuguuuaaucucuaggaguguuggagucauaaugguaggaggcagaaggcugaaucuuuuuuuaaaaauuuaaacuaaauagucagaaacuauuuucugacuauugaaacacaaugaaacaucucauuuuccaaaauguacugcagauguaaaaguacaaagccucacuucuauuaaugcaguagcuuucauggcuuugcugacgagcagaagagucucucaugguuuggugauagcaccugacuucaggauguuaggaguaaaaagauuuaugcuggaguacucacuccucagucugauaucugcuguuagauggguacuucucuucacagucccaguaccuucucaguuugcagaccuguuuuucugcccuugagucuugguucaguuuccauuaucgucaaggggucaggagcuguaguauccuugugcagcgaguuuccuuccacuccaaaugagggcuagaccacagcacuggcggguggaccugcacgugaagauacagccacucaguccgucgcagguucagugcugugggagcccagggcacccgccgcgggcugcucugacugcuggccaggaccgcugucaggggcagagcauaaguacggcuuuuagacaacuuuguugaugaauagaauucuuuuugauauguauuucccaucaugcaauuauuaaaaauuucaaacuuacaggaaaacugaaagaauuuuucagugaauacccauauauaugcacaaucuagauucuacaguuaacauuuuaccagacuugcuuuaucacaugaagacuacauuuuaucauaaaaugagaccauccagccccaggcacugaaaauuuucuuccuaguaguccaacaaugguuucuuuaaauauaagaaaucauuaaaccuauggguuuuuuuuguuuuguuuuuuaacgaagucucucuuugucgaccaggcuggagugccggggcaccaucucagcucacugcagccuucuggguucaaccaguucuccugcucagccuccugaguagcugggauuacaggcgcgugccaccaugcccggcuaauuuuuuuguguguauuuuuaguagagaugggguuucaccaugcuggccaggcuggucuugaacuccugaccucgugaaccgcccgccucggccucccaaagugcugggauuacaggcaugagccacugcuccccgccuaaaccuaugggcuuuaauucuauaccuaugauagccugcuuauuuaaccagagggaacaacacuuauguuacucuuccuuuagccaucgagccagugacagaagcccucagugauuguucugggggacccagaagucacaagaauggaacaguuuugcuucuaccugccccaauucagaaagcugaaaucuucuugguuuauaagacagcugugacuucuguugggaccugcugaaacuugucacaugugacagugugugccagauucuuuggaagguugaauaaaauuuugagccucagcuggcgcuuacaguagcuguucuuauuggauccacagaauaaaaagggcacagagcugcugcuuggaguggaugcccuggggcuucacauuuaugacccugagaacagacugacccccaagaucuccuucccguggaaugaaauccgaaacaucucguacagugacaaggagguaggacauguguguacugcagauggguccagcagaucuuucccugucugccccccucacuggagccuccccagccagggcaucuccuuguuauucauagaguccuuuaauucccaggcuuugagggugugguuguugauuuucgaagucuuuacagaacaguauuggcaucaauaaccccacuaugacuaauaggaaacugggaagcucaacuggccagggagaaaccccaaagaauagugaacaaaaacaguaacauuuucuuauuacuuggcuuucuauuuuugucgauacauucucuuuguauguuuucuuuucuuuuuuagagacaggauuucauuaugcaugcccagacuggauuugaauccugggcucaagcaauccuuccaccucagccuccugaguagcuacuacaggugugcgccacagcaccuggcuuaaauucucuucguauuuuaaguguggucuuuauugagcuuucuuucuguguccggugcuugauacauguggcagagaaauacauauacacacauauacacauauggacauauauguguuuuguguguguaucucucaguaauuauauaaauaaguauauuagguuaauaugcuuacaagaauuccaaaauaauuaagguggaauaacuuagauaaaugcucuuagaauuuaaauauuuccauauaggguggugacuuuuaccaaaaaggucccauaauguauaaucuuauguuuacucauccauccauucauucauucacucauccauucauucauucuucauucauuuuauuuuauuauuaucauuuuuugagacaggcucucauucugucaccgaggcuggaaugcaguggcacaugaucacggcucacugcagccuugaccucccugggcucaggugauccucucaccucagccucccagguaacagacuacaggcgugugccaccacaucuggcuaauuuuuuguagagaugggguuuugccacauugcccaccaggcuggucuugaacuucugggcuugagcaauccucccaccucagccucccaaagugcuggaauuacaggugugagccacugugcucagcaguucuucauuaauuuuaaaggaauuauugagcaucugcuuuguguuagauuucaugggggaaacaaagauguagaaaauccagucuuagcauucaaggaagucaaguaacuacucaccugcuauaauaaauaagugccguggaagagacaugaugacaacaaauguagucuuccacauacaagcacauucacccugaccgucugaauuuaaucucuauaagaacacugcuguaaaggcaggggcuguguugucaauaucucugugucacaucaggaagcagagacacagaaggaucaagugaccugugucugagugaaguagcagagauuaggagccagaguugcugaugccacagcccccgccuuucagggaggcccagaggcugaguccugagagcacaggggcacuggggagagggaggcuccacucagugaccuccugguaccugcacagccaggacacagacuagagagugaagaacaggaacagcuuauguugcugccugcagagccccaaaccugagcauauuuccuguuuucucuuuuucauggcaacucaaggaagggaacaccaggccccugguuuccaguauaugguugggaucuacucagccaugcuugauaagacagacugagccccuuaauucaaaacauucugacuuugaaguuuuuguuaguaguuagcccaggagauaagcaguuagguauuucuuuuuuaaaguacuuaaauugaaaguuccacaugacauaaagcuguaugugugccaccguaugguaguuuuucaucucccaauuucauaaagucuguuuauugcacguccacacauuugugugcuaaaggcucccuaaacacccguucuucaaagaagccaaggauugaaaucucccauacuauggccugacacaguaaacucuaauaugcccucuccgggggacaggcgccaucauguuccaucaugucaauaacucaugcaguaagcagaccccaagcugacuugacauaaaagaaguagucuugguaguuaugcaugacagccaugcugucaaaacagaaauguuaguuuauuuuaaaugauccauugauucuuuguguacgcccuggcauggugcagagccugcgguuuccccacuacuugugguuucccaaugacagcuccaggguuugacagcaaagccaaaaauaagcucacaaaauucaugaauagcagccuacacaagagcaacacugcuucuaaguuaacuuggcugaaagcuaaacaaaggaucauuuucuguccucaguguacuaaccccuucuugggcaauauaacgugugaaagaaauauaucuucccaaacauauuuaucugcuuagcaagucuuucuugggaauggauauccauuuuguaagugcaucuuggaaaucuaggaucuguuuggucuuaucgggagugguugagagcagcagccauuuguuccuugcaggcuuuccugcuaguggucuaacccuagguucuccuaccaagccaccacccugucuuuaucauucaucuuucucuccauuuugauuucagcaucaagaacuguuuucccuucuacuauaguccauuuuuuccccauuugauucuauuaacagcuuuuaccaaauuauucccauguucagaaaccuguggugagcucagguauccugucacaucaaaccuaaacccuucuuuuuuuugagauaggggucugcucuguugcccagccuggagugcaguugugcaauuacagcucacugcagccucaaacucuuggccucaagcgauccuccugcuuuggccuuccaaaguguugggauuacgggugugagccaccauaucuggccgccucugacuuuuauucucacugccagccccuacacccaccccuuccucccucucaggcuaaaccuauuauaucaucuuagucaccaaaaagcuaauaccacacacacacacacacacacacacacacacacacagcucauuucccugucucuaccuuauuucugguuuugcccugugcagaaugccccuucaccugccuuuuagcuacccuguuggauuguucuucuaagaucagcuucacucucucuugcuuaugguggaucuacucugaaccuccacauauuugugauuuguaccacccagugaagcacuaauauuugaugugauuucuugaguaauuggcuguuguuagccuaguuccaacuagauggugagcuucaugaaggugggcccaugcccucgacuacaguagcccuccaguguuggccucaggguugggcccauuaaggaugcuuauuuuagguugucaagaaucccuucccacacucaugccuaagauggucuagagagcguaccuuuaggguccugagcuuccacagcccgagacuuggugcuccuaauucccugagguuuagugccuggauacugggaagccaggacaaggcauaacuucaugcuggucuguggccagugugguugcgcauuuguggaauuuccaauugcugguaacauuccaggcugucggacugaaacuguguucugcuucauucuuccaguuuacuauuaaaccacuggauaagaaaauugaugucuucaaguuuaacuccucaaagcuucguguuaauaagcugguaaguugagauccugguuuucauuacugauaaugguagcuuuucugagaauugaauacuucuuuuuaaaggauaucagagugacaucuugugaaguauagaaugguaucucacuuggcgcauacuuucuguuuagcuuaaagaguuaaaacuaaauuauaucaugaagaaguuuuuuuuuuuguuuuuuuuuugagacagagucucgcucugucgcccaggcuggagugcaguggcagugccaucucggcucacugcaacguccgccucccagauucaagagauucuccuggcucagccucccaaguagcugggauuacaggcaugagacaccaugcccagcuaauuuuuguauuuucaguagagacgggguuucaccauauugguaaggcuggucucgaacuccugaccucaggugacccauccgccugggcuucccaaagugcugggauuacagucaugacccacugcgcccagccgaugaggaauuuuuaaaaaggauuuuuaaugcaguauuucauacauauaaaaggauaaguguaacauaugaauuauaaagaauaacaaaagugaauagcuguguacccacaaccccacuuuaagaaauagcacaguccuggccgggugcgguggcuuacgccuguaaucccagcacuuuggguggccgagacggguggaucacaaggucaggaaaaaaaaaaaaaaagaaaaagaaaaaggaaaaaagaaauagcacagucccaauacuguugagacccuucauguuaacacccugcuggucucuccuuucccucuccccaagggugaucacuguuuugaguugaguauucaucauccucuugcuuuucaacagaauuuuauuucauauauggcaaaagaaaaauaccauucaaugucauauguuuaugaaauuuaucuaaaugcugucaaguauauauauucuuuugucauuuuccuuuuccuuuuucauuauuuuuuugagauauaucuuuguugaugcuuaaagauagucuguucauucucaccucuguagcacucuguuauauauuuuucugauucuucuguuaauggauaauuaagugcuuuuuacuucuauacuuuuuuuuuugaaauggggucucacucuguugcccaggcacaaucucggcucacugcaaccuccgccucccggauuuaagcaauucuccugccucagccuccugaguagcugggauuacaggcggccacuaccacgcccggcuaauuuuuguauuuuuaguagagaugguguuucaccauguuggucaggcuggucucgaacuccugaccuugugaucugcccaccuuggccucccaaagugcugggauuacaggcgugagccacugcacccagccacuucuauacuguuuuaacaggcuguuaugaaaacuuuuguaucugccuccuggugcacauaggcaauaguuucuuuggagucuugaguauacugggcuaggugggguggcucacgccuguaaucucagcacuuggagaggucaaggcaggauaacuguuugaggccaggaguucgagaccaaccugggcaacauagcaagacccugucuccaaaaaaaugaaaauaaauaaaauuuuuaaauaauaaaaaagagggccaggcacaguggcucaacuccuguaaucccagcacuuugggaggcugaggcaggcggaucaccugaggucaggaguucaagaccagccugaccaacauggagaaauccugucucuacuaaaaauacaaaauuagcugggcgugguggcgcaugccuauaaaucccagcuacuuaggaggcugaggcaggagaucgcuugaacccaggagguggagguugcagugagccgagaucaugccauugcacuccagccugggcaacaagaguaaaacuucgucuccaaaaaaaaaauaaauacauaaaaauaaaucaaaaauagagcuuagaguauauacacaggaguagaaguacagggcuugguauauguuuaaauuucaaaauuaugacacauuguuuucuaaagaaggugaaucgauuuuuacagacccaacaguagugggugaaguuuguuuuuugcuauccuuaauacuuguauuaucagccuuuuaaaauuuuugccaaucuugugcaucuaaaaugguaucucauuaucaaaugaacuuuuuuuuuuugagauuuugagauagggucucacucuguugcccaggcugaaauguaaugacacgaucaugucucacugcagcauggaccugcccaggcucagugauccucccaccucacccuccccaguagcugggacuacagacacacaccaccaugcccagcuaauuuuuuguauuuuuuuuauagagacaaaguuuugccauguuguccaggcuugucuuaaacuccugggcucaagcaaucugccugccuccccuucccaaagugcuaggauuacacuucccaaagugcugagccaccaggucuggccaaauguuuugaguuuuuuguggagauggcgucucacuaugucacccaggcuggucuugaacuccugggcucaaggauccucucaccuuggccuccgaaagugcugggauuacaggugugagcuacugcaccuagccuguuuucuuuauuggcuauaucuuccaguuuguugcucuuuuucuuuuuuuaugucuugacaauaagaauuuuuaauuuuaauguagacaaauauauacauuuuuuccuuaaucacuuuuugugucuuacuuggcaucuucucuuauccuaugaucauaaagauauucuucuauauugucuucuaaaaguuucaagggcuuaaucuuugcauuuaaguauuuaauccuucuggaguugauuuuuguguaagguguaagggagggauacaacuuauuuuuuuccacaugcauaaccuguugccucagcccagcuuacugaacgagcuuuccuauccucccuggucugcagaaccacaucuugauguaggagaguaaggugcacccagaagacauggugaaguguccuccaguccucucuugauuuaugauuuuuaccuccuggcauaucugaggcgccuucauuuugcauguuuccagagcugacggcacuagaggccacuaguagggcuuugguguuucacucuaugcauucaucuucacguuuacugcuaccugcaagagcucaaacugcuauggcacuagugggccaguaggcagugaaguaaauuuguggauauuaaccuuuuugucugcuucuguggccacagauucuccagcuauguaucgggaaccaugaucuauuuaugaggagaaggaaagccgauucuuuggaaguucagcagaugaaagcccaggccagggaggagaaggcuagaaagcaggugagcacaaccuuguuuuaacugaugaugucacuguguggucaguccuggccugggaggcgaggaguggucaugggcuggcaggagucuuuuggccguggacauaccugcucuuguuuuauaccuuuuggaucuucauuugccgaugccuaccuggugggaugucaucucuggaaaugaggaauaaacccuaauagcauaucuaaaagaaacaucucuaguaauuucuacgcuuggagaaauuaagugugauuaacaccaguuugggaugaaauagccaagagugcaugcaucuauccguccggcuagcuagcuugcuuucuuuuuuugccugucugccuccuugugcagccuucuccuuuucuaauuagauggugauagaaugccagguggcauuucagugcuugcggcuggaaugcuaauuugacucuggcugcaauuccccacugcaggucaggccuuauggcaugucaccugccccaggaggugccaggagcaucuaucagcagacuggaugaucugcaucauuguuuucuacucauaaaccuucucugcucauggaaauccacacaacuaauuugggccuuacugcugagaauaucaauuguguuuuuggauaaacuacuagauagaguagcagcagcugcaguuggcugcccgcaggacuugcaagcucagaaguguaauaauuagucugugugcaccuuucugauuuggauacauuggagaggcuggucccagcccuaggauuuagaaugaaaugcccagugugcuuucagcucucuaucucuuugcuuucugagguagugggccacaaauguguucuuugggaugcuuucagggugaugggauggauuuguuggacaaagaaauccuacugagccagcauggggucauaguggcaguuucaugaagagcucguggcaguggcucaucccuauaacuccagcacuuugggaggccaaggcaggaggaucacuugccuaggaauuugaggcugcagugagcuaugauugcaccacuacauuccagccugggugaccaagcaagacccuguuuuaaaacagaagcagaaacaaaauaccaaaauaaauaaauaaauaaguaaauaaauaagaaggaggaggagagcuuucuuugaccuuuuucuuagcagagcaaagcuuagaaguaagaaaucugaaagugucagggaauaugcagucugugggcccuggcagagaauagcaggaacacugcagaucggcacugcuuacagcacagcagagccacaaaccuggcaucugggcaaccacagaucagguggacagacacugaccuuggagccagaucugaaauuuagaaugugaguaagucaaugacuuaccuuccagaccuuaguuuucucauccaucaggugaaacuaaugauauaccuucuccaucucagaugaagggacguauauuacaccuuacagucuuuguaugcaguaaacuucuuuugugaauaggaggucuuuuauauugggguagaggucucagggaaaguacagggccaggaacugaaggagauuaccuggcuuuuuuuuuuaauaaaagggucuuguucugucacugaggcuggagugcaguggugccaucauagcucacuguaaccucaagcuccugggcuugagcaauccuucugccucagccccucaaguagcugggacuacaagugcaugcuaccacaccuaguuaauuuuaauuguuucguagagaucaggucuugcuauguuacccaggcugaucucaaacuccugggcucaaacauuccuccuacuucagccccccaaagugcuaggguuacaggcaugagcugcuaugccugccuggccugacugggcuuuuucuuucuuucuuucuuaguuucuuuuuuuuuaaaagaauuguagauauguaguaagccaccuuauggaaauuguaauaugauggaaauuagagaacaaauuggccaagcuuuucauugacuuacaaggagaaaauuggagaagaacuuucacuguuuuauugcuugucuuugcauuaucuuuuugagcuuguguguguguguguguguguguguguguguguguauuuggcuuaggauuuagaaaaagcagcagucuuagaaaccuuguaugaccagagugugggauaagauugaagcaagaaguaauuaaaugugcuuuaauuauuuaaggcagaaaauagugcaguggucacuucuggguucugcuuuuugaacucaguuaguacccugggaucacagaggaauggcacugucuugugcuuguuccccuuauuaagcucagcauguggcccaauuaaugcagugauccagaaggcaagggagguagugguggcuuugugcuguugccuuaaggacacggggcuguguuucccgccuggcucccuccuguccuaggccuggcucaggaguugucuccacaugaggcugugcaagucugugcuguggcuguugcagcuccccccugugaaauacaaugugugaacuauugaugcaucacguagaaugauuccaucuucucugugggucagaggcaagaguggagcuauuguugaugaaaucagagaugugagagggguccauguggauuagaaauggugagauggcuugccugcccagaugagaaagcugcuuauuucuggggcucuaucugagggaggagguccugcauugcaucccaucggccauggggcagagccaccugggguuucccaacaaaaagcaacauuggcaagguagccauuucagugcaccguguauaagaaugccuccuucugccaggcgcggcggcucaugccuguaaucccagcacuuugggaggccaagguggguggaucauaaggucaggaguucaagaccagccuggccaauauggugaaaccugaucucuacuaaaaauacaaaaauuagccaggcaugguggcgggugccuauagucccagcuacucgggaggcugaggcaggagaauugauugaaccugggaggcggagguugcagugagccgagaucgcgccacugcacuccagccugggugacagagcaaaacucuguccccuccaccaaaaaaaaagaaugccuuuuucuauccgggucaagacucaacagguuuuuauuguuuguucauuuguucauucaccacuagacuguuuuucaaguggcacagcuuucaacucugcaacugguuuagaaggacgggguggggggcaauaagaaugacccuggcuaccuaaaggaaagggaaggaaaaaggucccaaaaggggagacuggagauggggcaucuuugggcccuuguggcacccuaggucucgagcccugugauucaaugacuguuuuucuucaccccucgcagauggagcggcagcgccucgcucgagagaagcagaugagggaggaggcugaacgcacgagggaugaguuggagaggaggcugcugcagaugaaagaagaagcaacaauggccaacgaagcacuggugauuucugaggggcugggguuccaggaggcuacuuggggacuuccuuggcuuuucuggagcuuggucuccugaaaaccaugaguuagcagcguuugcuuugaaauacuuaauuucagcuuugaaaaaaucagugccuuuucuuuucaccuguguuggcagaagcagauuuagguugagcuuaugugcagccaaacuccacuuucaccacgagguugccuuuauagcagggcuucucagccugggcacuacugacauuuggggcugaccauccuuugcuguaggaacuagaucccaguagcagcaccucacccuccauuuguaacaauccaaaacaucuucagacauugccacaugucucuuuuuuuuuuuuuuuuuuuugagacggagucucgcucuguugccuaggcuggaguguacaguggcacgaucucagcuuacugcaaucuucaccucccagguucaagcaauucuccugccucagccuccugagcagcugggauuacaggcaugcaucaccaugcccagcuaauuuuuguauuuuuaguagagaugggguuuccccauguuggucaggcugguuucgaacuccugaccucgugaucugcccgccucagccucccaaagugcugggauuauagguguuagccaccgugcccagcuguacuuuuauuuuuuuuuuuugagauggaguuucacucuuguugcccaagcuggagugcaauggcaugaucuuggcucacugcaaccuccgccuccuggguucaagcgauucuccugccucagccucccaaguagcugggauuacaggugcgcgccaacacauccagcuuuuuuuuuuuuguauuuuuaguagaaauggguuuucaccauguuagccaggcuggucuugaacuccugaccucaggugaucugcccgccucagccucccaaaaggcugggauuauaggcgugagccaccgugccccaccugccacaugucucuugcaggggacaaaaaacuccucugguucuaaccacugauuuaaagggaaagaacagaguuuaaguuguuuuucuccacgugaagcauaagccugagcugagguggguacucagagaaggugcucuuguuacuccccaugggugcagcccgaagggcccuucugaaaaguuggggaauguggcuugucauuucuugucagagggucauggagggcacucagcagcagggccccaggaguccgagacucugguuugucccaucucaguguucaaggcagaucugggcgggagaacagcacaugaucccacuucagcuaagagcacugugcccuccagaugcggucugaggagacagcugaccuguuggcugaaaaggcccagaucaccgaggaggaggcaaaacuucuggcccagaaggccgcagaggcugagcaggaaaugcagcgcaucaaggccacagcgauucgcacggaggaggagaagcgccugauggagcagaaggugcuggaagccgaggugcuggcacugaagauggcugaggagucagagaggaggugagggggcaccgggcaccagacuggcgaggaggcuggcgaagggccgcagaccagccugcccugaggcugagcucuacagcaguuguccucaagcugcuugcccaucuucugggccguggggaggcuccuccuuggcugauggugacuggugcuuuauccauuuuggggcuggcgcuacugguugggcacaggaacucaguucccccuccaggggggccucucuggucauacuugugucucuuugauaagccccugucccucugauggccgugugugcaggaaaaccccugagcauauccacagaccgcuuucagcugaagagaugugaggaggcucuuugugcauuuaaaaaaagugugguucuuuucugcuuucauucaguggggcugcaggagaacagcagcugccuaccuuuaaagggaagcuagugccugcaucccccagccuuucuuggcacaugggggaggagggcuaggaugaucucugugacugggaugucccacucauggccagguugaaggauggaacuguugucuguacuuuugaaagacuauucuaggccugcaaccuucagauaaacacugacacauuccccacagcuuuuggcucuguugauuuagagcacuugaauuuggcuuuuagcuaccaaggugcauucacuacaguuuuccucaccacgcuuugcaugucguucugggaauaugguuccuuuuugccugcccugcuucaggccccuuacuguauucgggggucacucccugugcaugaugcagguugggccaggucccugcaccaggccucacaugccgugaccaccugagccccauaggaugaggaucugcaccagggugcgggugcccucagugacugggcucaucuuucugcuggagaaagugggcacaaggcccacugguguuuuauccgggggcugugaagacgcaguucuugcacauucugcccuuugcgauccaauauaagaacuuugauccuccagguucuuccuuugcccagcucacucucacccaaaaauaaagcagagaaagcugcuggugcccucuccagcuccucugucuccuggcugcagaaggucugguuucucucauuccccaccaguuuuccugcucuuccaguuuagauuuaccaacucaaacaaaaguccucaggaauguuguccuugcuuggaaguucugauuucauguaaauaucccugucucacuguccuuuuucaccucuuugggugccauccucaggguuagcccaggucccuccucugcaggggugggguggugucuuuuccugcuaccugcccucuucugugaagcugacaucucauccuuuccuugcagggccaaagaggcagaucagcugaagcaggaccugcaggaagcacgcgaggcggagcgaagagccaagcagaagcuccuggagauugccaccaagcccacguacccggugagccugggggccaccagcuggggcugccuuaguccuggugauguucucuuuccucccggcccuucaguucaucuggcggugccuucagggugaccauucaggcaaacacauggcuggaugagaggugcagagagccugcaguuagggacuggguagaacauccuggucugccauuuggcuuuggacuaguuaguugucucuuugguugccuggauaacaggcaacagggccuuuuccagcucuggaauguuuuucuuuuucuaaguaauauagucccaaauuauccucaagagaauuugcucucuugccucuuaaugcugagcugaauguaaucuucaacuaucaguauauaccauauaucauaauuauaguucugggaagggauuggcuguacaccucagagugaauuacugccgugcaagaacgagcagccacucucaguuuggggacagagagucagacuuccauuaaauggggucacaaaaugaauagaagccucuuuccuuccuuucuucugugcauucaguuuggcauuuuuuuuuuuuucauauuuguucaguguccacauagugccaugcaguuggaagucucuauccugacagguguucucagggugcacaggugccuagaggaggaggacacagcccacccuggaggagcaggagaggcucaguguggugucuacacugaugcuugaagggggagcaggaaguagccagguggagaagagaacauaggguauucagggugagggcacagaugcacacauggcccagacucacacacagcacagucaucuacauggcacagacacacacacguacccauacauacauugaugcacauagcacauccacacacacagcacggacacacacgcacccauacuuacauucaugcacauggcacaggcacauacaugacccagaugcacaaagggcaccagaggcacaagcugcccaggguuugagguggggaaaauguaagcaguuugcuguugccguauaucccgguucuccguuacuguguaacaacccacccaagccagcuguguggcuuuguuaguaccucugguggcuuguuggguugacugggccagacagagauccuugcuggggaucucucugguggucacagucagaugguagcugggacuggagucgucugagcagucaacugggcugaacaccugagauguguuauguuuuuauuuuuuauuuuauuuauuauuuuuuuuuuuagagagagagaguuuuauuuacucugucacccaggcuggaaugcgguggcagaaucucggcucacugcaaccuuagccucauaggcucaagcgaucuucccgccccagucuccugaguagcugggaccacagacaugcaccaccacgcccagcuaauuuuuuuuuuuauuugguagggacaggguuuugccauguugccacagcuggucucaaacucccgagcucaagugaucugccugccucagcuucccaaagugcugggauuauaggcaugagccacugugcccagccuauauguguuguuuuuaaaauauacacuggagcaaagcuuauacacugcuguaacugcucuuuccucuuagcagucaauccugaaggagaucauccauaucagcuuuuuaaucauguuuuguuguguggauggauuguaauuuauuuaaccagucccucauggaugaguauuuagucuguuuucuuuugcaauuuugaacaaaaugacacugaacaucccugaacacaaaucuugacacacacacguggauauauugguagaauaaauucuuauaauagaacuguggggucaaauuuucgauuuugauacucuccaaagaagucauaccaguucaugcucucacuaguggugcagcaacuaguacgcguuuuugcugaaaauuuuuaugauguguaacauacacauagagaagugcccaaauuacaacuguacaguuugaagaauuuucacaaacugaacauacccauguacccagcacccagaucagaaaacaggacaucccuggcacccaaggagccuucucucagcacccuugcagacggucugccucaggccuugagaaugucucaaaugaauguuccaagccucugcucuuucccagacacuguccuagacucaauacgggauccaaggaugaaaaagaggcagauuguuugcaggaaacuugcaaauaguagaaagaagauacagccaaaaagaaaucuuuuacaggguggaaucgcagaagaaccauuagagaaccguaaacacagcguuaagggacagcaaagaaaaggguugccggcuggcugggaggggcuagaaaggcuuuggugagagaucgugguguuugagaagggccuugaaagagggauggagcauagggaggagaaaugggauaggcagggguacagagaugggaaggcaguaguccaggggauaauaaacaauacugucugugacuuaguagggcaaauaguaggagaagccgggaagcuagauugggguccucuuuagaugacccuuugugcugggaugaaaguccaaaaaaaaaaaaaacuacaccaccccugcuucaggcccuacuccgguuccauuguccaagcccaagccccucggugggccgguggggagcccuuugugguggugcccaucucccaccccaccucuccacacugcauggcagacuccuggcacccucacugggcacugccccacccauugccauacuucccguccggcagaccuucuccuggcacugccuuggaucccagcaaaagcagcaucucuucuagccucuguucgcucccuggcuacaguguuuaccuuuuuuaacagugaugaucugugaacacaucuauuuccugaacaagacuuucagcugcucaaagccaaggaugcugucuuguuuucugcaucuccagccccuugcacagggccugggaguuuccuaaaugaaaaagcgagugggaguuuguguuugauucagcugagcaugaagaacgguuagagauuugagggaugauuuuccuggauuuguagucuuugauauuguuuaccuggcaguggcaaauguggagggagugaaguggagggauggggacucgugguggcauugggaggugggacccgaguugugcccauugccucuguggcugcuggaggaucgguugucaacacaguaguguccuucugugcuuguaugacccaagcuccuaauccgaaauuucucauuaacagcccaugaacccaauuccagcaccguugccuccugacauaccaagcuucaaccucauuggugacagccugucuuucgacuucaaagauacugacaugaagcggcuuuccauggagauagagaaagaaaaguauguagcccccugugcccugcugugggcagcugugaacuagacugagugauuggggccuugggaagcuggggcagaggugagaggucgcugcagcagccugucauuacuccugcaaagguuugcucugcucuuacacccuggaggaagaauuuccuuaaucagaaauuaaggacaacagaucagcauucauucugaacgaauaaaaauaacaauuuuuauccaggauaaaaauaacacuugacuggugagcuggaguuuuugguggcucuaagccucaccuaaaguguaggacuggguuguuagcaucucugagucaguucaacugcuguuauacuacuggacuguagucaccuccuaguuguguucuccagcaacugggaucuguggugguucccaugucuagaacaaacaaaggugagagaagagacucaggcucgaggcuaaggaaagcugacagcugguggggccacuuugcugcaguggguggcacugggcagggccccagcauggccugaucauggcagcaauugcugagcugcccuccgucuucccuuuauuguggguagaaguggaucagagauggaaaggaaaggauccccacugcagaggaaaucuaagcgagggccccuaguucccagagcuagcgguaaguugguuaacugcugcugcuugcuagaggacaaccacaguagcuaccaugcauugagugccugugugucagggguuuuggcuuuugucucauuuaauuccugcuaacuuacaaacaucaaaaugacaucaaagguagguuuucauguucccauuuuauaagugagaacucagauuuagagaguuuagugaacuccaccagcaucccacagcugaugcagagggguugaaaccccucacccaucugacucugcagcccaugugcuuuuaccaugggugguauccucaggaaaacccuuuggggaaagugucuccauggaguccaguaugggcaaccagaacccaggcuguuuuucuuugggcucucacacugaggguauagcuaaguagccaaugaaccagagccucuagcugucauaucugcuguccauguuccuuucaccauuauccagacauauacauuuaugugguugggauccgggaucagggugaagcuguucugugucugcuauuuuauaguuuguauuuuguuacuaucuuaguuuguuuuggcuacuguaacaaaauaccagaggcuggguagcuuauaaacaacagaaauuuauuucuuggccaggcacaguggcucaugccuguaauuccagcacuuugggaguccaaggggggcagaucucuugagccaggaguucaagaccagccugggcaacauggcaaaaccccauuucuacuaagaauacaaaaauuagcugggugugguggcacaugccuguggucccagcuacucgggaggcugaggugggaggauugcuugagccugggaggcagagguugcagugagcccagauugcaccacugcacuccagccugggcaacagagagacacccugucucaaaaaaaaaaaaaagaaaagaaagaaauugauuucucacaguuugggaggcugagaaggccaagaucaaggcacgggcagagguggagucuagugagggcauucuugcugguucauaaucagccccuuuuugcugcaugcucacccaguggaagggaugaggggucucucuggagucucuuuuauaagggcacuaaucccauucaugaggcucuacccucaugacugcccaaaggccccaccuccugacacuuuuuuuuuuuuugagauggagucucacuccaucgcccaggcuggagugcaguggugcgaucucggcucacuguaaccuccaccuccugggugcaagcgauucuccugccucagccuccugaguagcugggauuacaggcgcaugcuaucacgcccagcuaacuuuuguauuuuuaguagagaugggguuucaccauguuggucaggcuggucucgaacuccugaccucaugauccgcccaccuuggccucccaaaguguugggauuacaggcgugagccaccacacccagccggugauuagguuuccacauaugaauuuugaagacacgaacauucagaccauagcacuucuuacccuugcacauauuggcagagucucuauacuaaccauggcaaucccuauggaguguuuuugguauuuguauugcaugguuuuucuggccaugccuuguaguuggacacuuugugggugguuuccagauuuucaccaucauagaugcugucacucaguguuaucuguucucaggugaggguggggaucuuuucuuccuugcguugggugagcuucugagugagcuucugucaucuuuagaugaagucucagaacaagugggaauguggauguggccuaucaaaagagaucacgugaagcugggcgcuguggcuuaugccuauaaucccagcccuuugagaccagggguucaaagccagccugggcagcauagcaagauccuauaaaaaaaaaaaagaguuuacuugaauuacugcuccaagaaggguugagacaaggagauuguucuggguucccaggaagcuuguuucacguauguuuuuuuuuuguacagaacgaaaagcuguccaugagagcugguauuuguagagcccccuaugagaauuuaccaagggcuuuucuacucuuucuuuuucuuuccuuuucuuuuuuuuuuuuuaaaaauagagacagggucuugcuauguuucccaagcuggucuccaacuccugggcucaagcaauccuccugccucagccacccaaaguacugggauuacagguggagccaccgugccuggccuccuacacuguuuuauuuaauccuaaccacggcccugugaucauuaucccaauuuuaaugaugaggaaacauucauagcauuuaagugaccagcccaagcucccauggccugugaguggccaaguagagacgugaaccccaggccucaaacccuagaucgcacaccaagcagcuugugggccgcagagcaccugagccgugucucacugucugcccaagcccugaugcaugauacccucuugccggcagaguggaauacauggaaaagagcaagcaucugcaggagcagcucaaugaacucaagacagaaaucgaggccuugaaacugaaagagagggagacagcucuggauauucugcacaaugagaacuccgacagggguggcagcagcaagcacaauaccauuaaaaagguacccagggucucuuucuuguauuuugcugaucaggaccaucauuaaugaaaugugcgguuggcaucugguuuccucaguagccaagucacuagacuauuggcaucuuuuguauguacuuaguugaggaaauuuuuuaacuuaugccagaaagggaauuuaaucugccaaugacuaugaacccauuggcuggauggaaguugagcuuguguuaaaagcucugauguaaugaaccccuguuacaggguggauuuugagcccucauuuagcaguaaagcauaaugcccuuuuaagccaagggguguuauacccagggagcugccuuacuuuaugagaaagcagaaugaaauggaggcuauugagaauggacuuucccucuagucuuguggugucuuuaaguggcaaggacuauaaaaccaaacugaauuuuuaacuuuuuucauacuuaaaaggaagugucuaggaaagaaccucuuuguuuuaaaagagaagacuuuauuacuuugcaaaugguuucauaucuuucucuacugguauuuugagcuuucagcauugucgagauucagaagcuaaauuccauacuaauuaucagcccaagagcauaccucucucauuugggccaagcagaaggguccucucauaccaaauaaugcucugcucuuaacugauagcccaggaccagguuaacaccuauaaaauagguguuauuaagauaagacuguccauugaguuuaggugauacugauacaguuaauuuuuuauucuuuaccucagucuuuaaaauaggcuuccaguuuuauggacugucucuguuuuuagugguuaagcuguaucugaaaacuccaggggaucuguuucugccugccuucguuguuggguacaguaggcagcccugacuucuaccucucgacuccagucacaacuggcaccggguagagaauuccuuuuaauagugcaaccuagaaggaaaggcauuuccacauuccacauucuucuuuccucuggcuucuguaauuuacugggcuucccuuccaaaacaaaauuauuaaacaguaaaggggaguucaagggaggccucggucauuaaggaaagagguaaaacgauggcugagccagugagccagucagcccuuaaaugaacugccucagacaccccaucucaccccuuacccccagccuugucaucugggucccaggaacagucucaccauuuccacugcugcugcaaugagcagugcccucagccacagaaaccugcagugugagagcuggagagaccccguuccaagccauuaaaacaaacaaaaucacucaucacgauuucaggccuauccaagcauuuugcagauggcacuuauggcauuguugauaucacaggguauguuuuuguuuuucuucauuuuauuuugcugguuuagccucaagcccaaggcagaagaccuaucugcauuugagcccucaaaguagguuguucccagguacucucuauguggugauggugcugcccucugugauacuaacccgugcaugagcuugccugucucuguccucgggccacacugagcccuuacgagggcagguggugccuggguacuggccgcagcaugcuuugagucuaaaaguaggcacccacccugugaagccagaccagccuccagggccccagaagacugccucguuccgaagagcaugucauggggcuguaggaccagccauucuucccaucucgggucauuguugggcuggggaagguuauggcuucuuguccagucaggugugucuaaaaguccuuugucuugguggcauacuccuagcauggaaauggggucaaucugggcacuuuggagacugguguguuuaacucaagaucaagaccuuuuaugcguugacagccucucaagacccauggucacaccuggcagcuucugguaguggggcaaaaggguugcuugugcuggcucauuuuccuuuagagcuuucccuuucugcacacaucccuuuucuuuucaaauaaagcaaacccagagcacagggucugauaugugaguccacggggaguggacugucuguucaucugugcucagccaccucugcuucagcuuccucuccauaggcugagcagagauguggucagagugaacucacauuggaacaguacacucacggcacccuggagaggagcggucacugguugcugagugaauuaaccgaauguuugcugcuuuucuccugcaacaguucauuauuccuccagcaugccuaggcaguggagagaauguauuuugcccaauaauaaaaugacauccugccucuacuucucaccuaauccccaguaguacccaugccaacaagccccacaccaccugacagcagcauaggauguguccuuuggagucuucccugcaguuucugcucauagaguggaauaagcucauuggaaccuuucuaacaaaaagagaucuggcauaagauagauccuacuuguggucguuaucccaucaagagaggucagcuguuaaagucccugauagaucuuauuaaaagguacacuugagcugucagugguuccaagaauccaugacaugaacccuguuuuguaugcgacacuuucauuuagcgggcuccuguuucuucagcuuucauauccuuguuggcauugauacccugauacagaacaguccgcgcucugagcagggcaguuauggccagcauugucacgggcaggccagcucauggcacccagagcagccagguggacccaccuugguuuacugaacuuuuuguaaccaugggggcaagcagaaaaccccgcugcauuucagccagugcugccagguguucccuccaugggaaggugcugcucaaccugaaugugacuuccucuuucuucuuucuauaaugaugcagaaugcugaaauucuucaggguccugauuuugacugucauuucucacugagcuuuuacugcagacaaaagaaguuucauuuuuaguuaaauuugcacugcuccugggacauacauggaugcauuuauuuauucauccauuuuaaugucucgaugugaacuuguuuuuaaagcaggcuaccaggcaguuaaucaaacacucggguuaaucaaggguuaauaaaagcagggacuugauguuuaaugggacaggcauucucucagcaucacuagauucaauaaugcugcacuauuaaauuuugcugcacaugaaguucagugcauguuccauuuucuagacuuuggcagugccuguggucagugaccgggacugaugagcagccacaugccugcacuaggguggcucugggguggugcaugcugcagucuggcuggcacaagccuagcugaagagaaguacugcuuuaggcuuggauguggggauaccuagaugucaagggcagaacuccaucuagaaugccuggggaugagaugcaaaagcugauagugaauggaacaguuuccaauguccaaaagcuugcuaaucugggaucaaaccagccuguguugauguuaguuuugcuuuguuuugagacacggucucccucugucacccaggcugguacauucucggcucacugcaaccuccaccucacaggcucaagugauccuccugccucagccucccaaguagcugagacuagagguacuagccaccacacucaacuaauuuuuguauuuuuuauagagaugggguuucgccauguugcccaggcuggucucgaacuccugagcucaaccaaucugcccgccucugccucccagagugcugggauuauaaaagugagccacugugccuggccuguuuuguuuuuaauaagguuuuuuguuuguuuuguuuuguuugagacaggaucucacucugucacccaccuuggugacagccucgaccuccugggcucaagcgauccucccacgucagccucccaaguagcugggacuacaggcauuugccaccaugccugacugauuuuuuuauuuuuauuuuuguaaagauggguuucgccauguuuccaggcuggucucgaacuccugagcucaagugaucuuccugccacagccucccaaaaugcugggauuacagacaugagccaucuugccuggccauuguauuuguccucguuuucaguacucuucugccucacugagaggucucagagucugcugugugguuucagcaguacccaugggggcuguguaacauugaagcugauucaaggaguuugcccuuagguuaccagggguuaccgcauucccugaggaaugcugagcggccauccagucugauuaaccgagguuccuacuucucugccacuuccuuucucuauaauucuuacucgcucgcucucucuuuuuuuuuuuuuauuauacuuuaaguucuaggguacaugugcacaacgugcagguuuguuacauauguauacaugcagcuauaaaaaaggaugaauucuuacucucucuugaggcacaguguccucaccugcaaaagguggauaaaaauagucuuugcccccaggaguguugugaggaauaaaugagagaaugugugugcaacacucagugcacagucagagcucaguaagggguuaaaacucugaaaagggaaaaucugcuugugauccugcagcaaagggcgaaggacggcaugugggccacaccgccacaucuagguacacugcuugugcugggcauauucauucauuguauuaauugcuacguggcugaaaguaaaaacuuuuaaaaagccauaauuggccgggcacaguggcucaugccuauaaucccagcacguugggaggccgaggcaggugaaucaccugaggucaggaguucgagaccagccugaccaacauggagaaaccccgucucuaccaaaaauacaaaauuugccaggugugguggcgcaugccuguaaacccagcuacuugggaggcugaggcaggagaauugcuugaaccugggagguggggguugcagugagccaagaucgugccauugcacuccagccugggcaacaagagcaagauuccaucucauaaauaaauaaauaaauagccauaauuaacuucacuguuuccuuguaauauuucacuuggguuugcaaggauguauuuuucuccucuugcuaaucuuaacuuccuguauuuccauuuuucccaauugaugaucaguacaacuaguuugccauuugcaucugagucagagcagugcuagcgaucaaaagccgcccuggggaaccuggaauuguuucauucucagugggagcgacacguguccuggcaucugagccuuccgagugaggggagugagucuggccaucaggcugggguugagggacacagggugccuugagccuggcuuucgugccuucagagccacagugccaaugaugggagugguggcuugguguggcguaacuguaccaccauaccuugaugguagaaugcaguccuggaauauauacauucagggucuuucuuucaucgcuucucaagagagggguuucagucucccgauccugagcuggucugagugccagcaaacaaagucaucacuuuugugccuguggucucccaaggagcacaggauuuccaaggaaauugacggaugagaaaucaugggggugguggagcuuagaaagcuuauuucauuaguaaaugguuugaaccgucaagguccagcugugguuuccacugauggaggaacaggaagaagaggagccuugacauuuaucucaagcgccagcagcuucucuuggaucaggaagacauaaaaguccaaugucaucuucaauuugugcaggcuccccuuggaguugcagagccagugaagugaaguagaacaguuaaaaaaacacccggggaagugauaaaucacagagagagauugcauaugcgggaaaggugucucccacaauuaaaacaaguggccagagccucccuggcgaccucuggucugcauugccagcccugaagauggcuccuaaauuacuuaaguuuaauagguaguuaauauagccaacccuccuuaugaccccagugggcugaauggcucugcuugcuuuaggaacugggcguuguaugguagagcaucuuggccuugacauaaaagguagcauacuggcuccccagcccugaaccuucccugcuagagcaaggcaggggugagagggggaaggaaagaaaaaggaguggggagugggguggggagcaaggauuaacagggagcaguagcagcaccagaugugggcauagcacacugggaagaaauugcaguggcgaucugaacucuuccucuccgccuccuggcucuguggaagcccagggaaggcauuaggaacugcaggcugcucuuagugcuccucccggaugggacaccuugggcucaucccugaaggccacuccuaccacucucacacacugaguuccuggugucucguaacuguugagagcuuaguuuucuugcuuguuucugguagcucuagauagaagacuguaucggccucuucuaaaagucaacaagccaauccuguuuuugguuaagagacuuuaccuggucaagcaguuguucuuugggagguguugaagagccuacaaaccugccuugccugccuagguacuuuaccaccauuuggagaugccugaggauauuaccaggccuuauuugaggcaguaaaacacccuguucggccccucggcacugaagauguguuucagugcagcucuccucggcaccggauucguugcugcaacagugggagggaagagccagaugcaaacucguucugcgagcccgagguucuguucucaugauccuugcugugauuucucuuuugauguuggcaauuuuaaaaugacaucagucuaucuggaccuuuuuccuaaggcucuugcucagaccacucaguagauagccgccaccugcccagugaggugaaucaggcccauuaggccauuugucaggggaaggaacagaggagcagcggagggccccgccggccagugccacagggcagccugcaaagcagguagacagguuuucaggcagcuuuugcugcuuugggucccucagggauuaauacacaaaaagggccccuuggguauucaguggcagauuucucuugagagcagauaaagucgcuaauaacaaauuggauuuguucauugggguggacuuggccuuucguuccaccucuguguaggauaaguguguggauagugcucccacugugcacaucaccauauggcauuugggugcagcugucccuagccagacugcagaaaagcuugaucugggccggacgcgguggcuuaugccuguaaucccagcacuuugggaggccgaggcaggcggaucacgaagucaagagauugagaccauccuggccaacauggugaaacccugucucuacuaaaaauacaaaaauuagcugggcgugguggcaugcgccuguaguuccagcuacucaggaggcugaggcaggagaaucacuuaaacccaggaggcagaggcugcagugagcggagaucgcgccacugcaguucagccuggcaacggagugagacuccgucucaaaaaaaaaaaaaaaaaaaaaaagagaaaguaaagaaaagcuugaucuggccacuuaguacagccaucccccuuuacuggcccuuccucuuugcuuauuuggaagggggaagguuucccacaccccaaaccaaagauucuuuuggaauuugcugcugcuggauucagcugucaccuuucugcucugagucugcuuucucccuguggauccggugccagaggaucugcacguccuuuugugucuacacccucccccgcuccuucguuuucaauauguaguaguggagaggaaguguaacaugauuuuagggcucacauuucaauuccacugcauuuuuaugggacaagcagagacccagcgccuggaguuauuagguuaguaucuaaaauggguucaguacugugagucuuauuguuuaaaaugaaugagaugguccccuccuaccuucuuuucuccuccccugggaugaguggauugaggcaaggcccccagagacuaguugaaggaauccuggugcucugauuaguuuuguuccccagcuuaauuguacagcuuccuuucucucaccacugauagccaaaguagcucugugucucccccaaccuucccuugcuuuaggaacaagaugaucacaaugcagccuugugaaucaauuuucugucugugcugaugaaaguguaauucauucuuaaucaagcagccuugcugcugcaggcuccgugccggaauacauuuaguuacccucccaucacuuugggaaacgaucccccaaaagggcuuuuagaggagagcuggaaggagaguuggccgugcgccucaugcugugguuuuccagcagggggcacucaggaacgaugcuggcggaggcuuuguagcuggaagccgucugcugcuggcagggcagcaggagaauguuugucacaggugccuuccaggcuugcuuucuccagacccuggggccauuucucagaaguacccuaaugggccacccaaaauccucagguagcagugaggaggaacaguugaagaugcagauugcaugccuggguuagagagugccggcuggguaccagguucuuuuagccagccucuucugucuuuuuaaguagacagaugugucuccugaaucugaacuuguuuagauuggguggaugugucuguuuuugucacaccacacacaauuuggggagcguaaggaggcccagcucugccagaauggaacucuccuaaguucuccccugccgucucacagccugcuggcugucacaaacagcuggcaguuuuauggacaagugggcaggggaaaagggacccugccggggcugagucucgauguugggcaggaaguaaaagccaggacccaacaaguggaucagaggggggaugugaagaugaacagucagauagcaauaaagccucauagaucugccccagagaaagaaaaggaaguucgucuccucagaauggaauuggauuagugacagacuugagcagccgguucagucgagagagaacuuaauuccuccuguguuauucacacggcugauucuaaucagaugugaagagacagcuggaggagagcagcgggucagcccaugccuggugcggaggcuucauguucuuguaggcaucuucagggaacuggcaggagcgcuuuggguuggagacucugagcagggcccuuggguuuauagccugcccaaggaacugggccuggcugcgggacucccaugguuggaccuugucuagauucagugaaaguuuugaaggacagugcaugacagacgucacuggucagguucaccagagcuuggcucacuugucuucagaaggauucaaaggcaguugaccagacuuggcaagucccagacuggugcagccacuguccucgagacccugguuguacacccugaggugcuucugcuucauuaccugcugaaauuuggagaccucuucuuccuggauaaccuucaagauacucauugugcaugcgaggaauuccccgcccuccuggggggacuccacuccccaggcaggcaagguugggcaaggggagggcuguugcuggauugccaaagggagcauggacauuuuuguuuggaauucagggugggaaugggacucaccagaguggcuucagugcucaacucacagugcaacauaggacaaggugaaggccuucuugggaggccucuucuggcucuagcaagcagguguugcugggcaguguagagggacccaggccgguugcugagcaggaagauguaccuaacacugaugggccugcacaccuuaggguaugagagcaucgcaggggaaccaggaaacuuguuagcugguuuucauguguuuaaaaagaagacucggaggcagaguuuauuuuaugaagggcuagcuuuuugccauuucuucugagcuuuugccuuuuccuuuaugaauacuuccugccuauggguguacuguaaauguaacagccagugagcuuucuagaagcagcagauggugaaagauccacaggugaggagccugcccacuggaggggcgagacagugcccaggcagggcgugcagguggcagagcuguuugcaugcuccgcgggguggcuucccaagcucucuguagaaaaacugccugagggcaaauggcuccacugagcugcuaccugcaggaaagaagcucaagggcucuccucgucucacugccugccuucuucaccugcugggaggagggcauuguggugucugagauaaaggauacccccaagguggaagcagagccauggggguggccuccagcagcagggaggagcauugugcaguaaauucugacuccggggcuccuguggggauuggaacccauaggaauugcacaaugaggguaaaggauggggcggcagcagccaggucugucuaaggggcgagcagcaguggccgaaggcucccagggcccucgggcagcagcccuugcugaccagugcagccaggucguggcugccuccagcuggugggucugccuuccccucugaccgccucagugccuucuggaggacuguggcucucucuccugcccaguggcuguggugccuuccuacuucugugugggcagacugauuucccucucuaccuuuacuuguggcugaggcgaagcuccugcucuugcaagauaagagguggggcugaggcgcugcagugcagcucagguggggcucaggaagcaccccacccaccccagagcacucugcauccuaauaagcacaugcucgagucacuggaaucuggugcugcuggcagugccagaacccuccccuagcaccucgaggggacagccagcaugcuccucggguggaggauccaggaauucuuggagccaacauugcacaaaugggcaggagccucucaaggcccccacagccugggcucccugccuggggaaguggccaggcuucauaggggcaucacuuggcccgccugguaggcauggaggccagugccauacgugaccuuguuguugccugcaccccuuccuaacgagcacccugcuccccacuggaaggagaggggccagggcuccucccuccccagggaggggagaaacgugauguugcuauuagcaauaacagcugccgaguucccaccaugcgccaggugcaguguugagugcaucacacgcgguucccaauuccucugccugucaccccacgaggaaggggcugccaucacgcccgcuucacagugaggaacugaggcuagaggggagcaagugaccugcccagggccacacagcuggucaguggcccagcugggccuugcaccaggcagcugacugugccuguaucugacucaaaguggcuguucuuuucagaaaccugagcggagauacugggcucacaugcuuucauuuaaacccucucucauuuuugccccaguaguuaucuggcagcuaaaucucuuccuccuuucuuccccagugaccauucugguucccaucaucacagggcacauaacuccuggcccuucuccucugauuacauuuagggagaagcccauccugaugcagcucccuucuagagggaguuccauuuaggcaaaaaagcgcucuccauucccaucagaaccgggcuuuccaaagggcucugaaauugguuccacugaagaaggcagcugagcugccuccccacauuccgcuuguuagucgggaacuucaaggccaaaagauuuggcaggauuuaaagaguugcucucaagcugucucauucugagcacacuaaugcugucugucuucugauggugaagugguggguuuggagucucccuccccugcccuuuauggagccgccgauaguaccgaggacucuucacaugcagacucgagggguccagagaaugggccagaccaucuugccugccccauggcaaccuccagaggaaagaggcucagagaggucaggggugucugcagugagcugcugauggcagagagugagcucucggaccuucucagccggguguggagcucuugccucucccgcgaaccucaguuuaguuaucuucauagcccacguccuggucgcuuaacaaacauugagcuccugaucggcacauaacacuaagccagauauuugggggauaugaagaugaaugguacagacucccuccccuccacccccgcacuccugugggaagucccggagcuggaaauggaacacagucacacccaaggcauugauuucaggagucagcagagagcagggaguagggagagugcuggcuccagaugcuucuauccagggagaugcugggaaguggcccagagucaagggcuuaggagguugcaaaccucacuaugccaagagcucggucccugauccaccccauccccuuccacaucucccugacuguccuucuuuacauuugcugggcagagugccaccugugugcaccagcccucccugccugcacaagccacacugagaaagccguugccuccagcucauggagagaaacaccuucucagcugccacgucaugagcaaguuugcuucgggaccaccugggaaaccaggaguagaagggguaaacucuuccucaucugccacaggccugccuugccucaggccacgucaccuuaccccagccauguugccagggcaugaggacuaagaugcuugcccugccaagcccggaggggaugagcagccucagcuggugccgccacagacagcacaccacagagguggcucagggaccuugguagaugggaaugugagaaucuauuaaaauaggcagggaucuccgguccucugucaagaggcaaugcugacggcuuuuuccugcuggcgugccucugcccaccagccuuccccuugcacauccucauuugucaccuccuaauuugaauuauugggcaaaucuggccgcuuauuugggacugacagccaacuucuugagcaucuauuugaacagccuucccuuucgcucccagccaccuuugaggugaguccaaguggcaggacaggacccugugugacagagcggaggucuugugcccucucagcuucuucucugcuuucuuacagcucaccuugcagagcgccaagucccgaguggccuucuuugaagagcucuagcaggugacccagccaccccaggaccugccacuucuccugcuaccgggaccgcgggauggaccagauaucaagagagccauccauagggagcuggcuggggguuuccgugggagcuccagaacuuuccccagcugagugaagagcccagccccucuuaugugcaauugccuugaacuacgacccuguagagauuucucucauggcguucuaguucucugaccugagucuuuguuuuaagaaguauuugucuuccuuugucuaaugugggauuccugacucccuucguccaaggcaccggugugugugugucuugcacuccagagcugaccuccaccgcccagccugggaagucauuguagggagugagacacugaagcccugagaagccagugccaucauccccaccccgcccaggguuccggaacauucauucccccaccggugaggaccuggcaugcagcgaagcagcccagcccggcggaucccaggccagcacgccugccggcuucucaucgucagggagcccgcccagagcucgugacgagcaagugcuggguccccgccaggcaccccgaggcggcgcucuggcuggcagcugguggggaauaggcagggcagcuguggcuggggagagacuuuaggcagaagcugugaugcaggcugacugccagccgaggggcuggguagugccgugcgggagcugaugguacagggcacucgcugucccccuccggccacccuagaccaggguccgagaggcaggcaggagccacucaugucuuccccauugcccgacgcccauagacgcuccuuccuguguggggcugggguacucccuggucguacugcagucagcacccguaacccggcuaugaccagggaucuguaagcccuguggcuccacaggugcugcuucucacuggcccagacucugagcuccaccggcccagucugcacggcccaucugcuucaccuucccucccagccacgugccaguggccacagcccacuucccaacccacuguuguacccaggccucacuuugcuguugcccuugucccucuucgggcccugaauuuucuguucccugggggccagccagggcccuuugugccccucccagcacaggccugaugcagguguccacucacagguggcgcucaccuaggcugucacaggacccaccuccaugccaggcaacagagggccacagaaccacccccacggcucacuccuuggucuggggccaccuucuugcccuuucuuuuuuuuuuuuuuuuuuuuuuuccgagauggagucucucucugucacccaggugggagugugguggcacaaucucggcucacugcaaccuccaccuccugaguucaagcaauucuccugccucagccucccaaguagcugggacuacaggcaugcaccaccacacuuggccaauguucuguauuuuuaauagggacgggguuuugccauguuagcuaggcuggucucaaacucacaccugggauuacaggcaugagccacugcacccagccccuucuugcccuuucuuuucuccauggcugaugcugcuguggccagccagggcccuugagauccuuccaguuuggcuguuaugcaaagcaggugauuugucuuaaucagauaaaagauagaggcuaugggggccucaagauuuuuggagagcagagguggucucuggcaauuccaucugguuuugagaaacuuagcagcucacagagcacagagauccugccuucuuccuacuaucaggcugaccuaaugggguugggcugcucggcaacugcuugggucaccuugccccaaggaaaccagcccugggugccacccagccacuuagggucuacagggugggacuccagaccuagagcguaaguauggauguuguggcccugugucuuccuagugugacccagccaggagcggaagcuucaggcguuuguaaagugaggucuggcucugccuccuccguuuuuuuuuuuuuucuguuucuguuucuguuuuuuuuuugagauggagucucgcucugucgcccaggcuggagugcagugucacgaucucagcucacugcaaccuccgccucccagguacaagagauucuccugccucagccucccgaguagcugggacuacaggcgugugccaccaugccuggcuaauuuuuguauuuuuaguagagaugggguuucgccauguuagccagacuggucucgaacuccugaccucaggugauccucccaccccggcuucccaaaguucugggauuauaggcgugagccaccaugcccggucucuucucagucuugaagcccaucccuggauuuccaccaggaguuacuuuccuccugaccuguaaauuuguucuuuaacaauggcugcaggugggagcauauggugguuuauaaaaacgcugucgggcuuuguuuccuucuuuagcugccgugucuacuucugaagucugggaagugccaagccacgcggccucaagggagcuggcugguguuugagcuguggcagaagcaccuggggcuccagggagcaggcugggaacugcaggaccuugcucagccaggagcacuucccccuccuugaggcaggaauacugaggugccuccccacagauggagaagguggagaggaggaugggccucaggagcaucucaagccccaguagcaggagaaagaaagaaagagaugccugguuuucacagacugguuccuguggcugggaugacugcauccuuuuuuuuuuuuuuuugagacggaguuuuugccuuugucgcccaggcuggagugcaauggcgugaucucggcucaccgcaaccuccgccucccggauucaagcaauucuccugccucagccucccgaguagcugggauuacaggcacgcaccuccacguccggcuaauuuuguauuuuuaguggagacgggguuucuccaugucggucaggcuggucucgaacucccgaccucaggugaucugcccaccucggccucccaaagugcugggauuacaggcaugagccaccgcgcuuggccagacugcguccuuuuuaagcgaacauuuuagggccugggaguuugucaaguaaggaagucucaagcccaaagagcagcguccugaccauggugguuucauuacgagcccuucugcuggcucucaggcagaagccccacagcaccgggaccauucaugaggucacugcccagcucaugauguccgugaggcuguccuuuuggccaguagccgugugcagcuguguggcacagauggcuucguucauccugaucaaggccccaccucagccacagcaguccccccaaccuguguuguccacccuauuauucauguaccugccaggcccugcuagauagcaccccguggcauuacauaacacuucaugaguggcugugucuuguaauuuuggggacagguuucucucuuucccucucuuuuuuuugucaaaagcccagagacugacaaccagcugcagugucuaaguguuccucacugacaggguggggccucaccaccccuggagggagcagcguuggcagggagacagccuggcccagugacccugggcccaagccagccccuccagggcuuucagggaagcgccauccauuuucaaagaugucaaacgucacuucuuccuguagggcccgaguccugccuccuaucagggccagaucauagaaggcuauuuucuauucuggggaacgauuauaacuuaaaugauuguuuuaauaaaaauucuaagcuggaaaaua

SEQ ID NO: 6342 - RNA, 95045 nt, Homo sapiens; identical to SEQ ID NO: 6341

SEQ ID NO: 6343 - RNA, 95045 nt, Homo sapiens; identical to SEQ ID NO: 6341

SEQ ID NO: 6344 - RNA, 95045 nt, Homo sapiens; identical to SEQ ID NO: 6341

SEQ ID NO: 6345 - RNA, 95045 nt, Homo sapiens; identical to SEQ ID NO: 6341

SEQ ID NO: 6346 - RNA, 95045 nt, Homo sapiens; identical to SEQ ID NO: 6341

SEQ ID NO: 6347 - RNA, 95045 nt, Homo sapiens; identical to SEQ ID NO: 6341

SEQ ID NO: 6348 - RNA, 58571 nt, Homo sapiens
auggacggccccggggccagcgccguggucgugcgcgucggcaucccggaccugcagcagacggugagccccgccgcccugggcccggccgugccccugcgcuccccgcccgggauucccccacccccgccgggcgcgcccggcgcccgggacccccggcccacggcuacucaccccucccccgccgccuccgccgggacccuccccaucgccagggcggggccccgggaagcccggccccuggggcggggcuucggccgcgguucgcggaggcgcggggucccgggcgccggcacccgagccccggacuccuucggcgggggcccggggcucggcaccccgcauggggccggcggggcggguccgcgcucccgggaccugagcucacgagcccgcuccgcugcagaagugccugcgccuggacccggccgcgcccgugugggccgccaagcagcgcgugcucugcgcccucaaccacagccuccaggacgcgcucaacuaugggcuuuuccagccgcccucccggggccgcgccggcaaguuccuggaugaggagcggcuccugcaggaguacccgcccaaccuggacacgccccugcccuaccuggagguaaguggccggcgcgggggugagcugaggagcgcgcaggguggaucaccaagccccguggcgggaccagugaagggcacggcaguggggaaacacaagugggaggggugagggguggaggcuguguguguguguguguguguguguguguggugcugugugcagagugcagugagcguguacagggugcagcgagcggacacaguguaugcgaugaguaggcgcggugugugcagugagcgggcagggcgagcaguaaggauguacagugugggcagugugcgagcauguguagugagcaggcagugugugcaguuagcaggcacagugugugcagugagugggcagugugcacagcauguacagugugaguggugugugcugugugccgugagcauguguagugagugggcacagugcagucagugugcacaaaguaugcagugggcacguaccgugugugcagugaguggugugcaguguguagugugcagugagcaguguguacagcauugcaguguggggcagugaguacagugugaguguugugauugugguaagcaggaugcgcaguauacagugaacagugugcacagugugugcagugugggcugugugccacagagucagugugguguguguaguuugaacagugugugcauugagcagcauggaugguguggacgcugagcauuguucuccagggaggagugugagcacgagagagugccagagggguguguggugugagcagggcuaucugugugcacguuuguuccuuucuccagcugugaagucuugugaaggccaaccaaguccccuccuuuacucacccaugcauggugugaagauguauugagugccuugcuaggcauggggacguagacggggucaguccuguggaaggucuuggaguuuggcaggguggaggggggugcccaacugcagugggcauugaauaaagauuuugugagcugagcucaaaguugggcgggccuccgugguggcacaggaaaguggggucaguucuaccuggagaguggagggggaugucuaggaugguaagccuggaaucaggccuucagagaggagugggauuuugccgagaauccuggggaugggaaggcgacgggacagugcaggcugcgggcagcuaggcacgugccuuccaucgggcugcaucaugccugaguguggugggugcauggcagcuguuagcucuguccacugugguaguaugacugaugguguguacaggagggcagugaggggugcgguguggccagcaugagcgggacgggguuugugcauggacucacuugcucagccggggugggggcauuuucucuaccuuuucuuuaucugagcaguuucgauacaagcggcgaguuuaugcccagaaccucaucgaugauaagcaguuugcaaagcuucacacaaagguaaaggaucacggggagggggcuccugagguucccuccugccucccuguggcugcugucccccaccccagcuuggggcugaccacagucccccagcuuuagcucaguccauuuccccaucaucaggggcccagagccuguacuggguguggcugaagggcugggcacagauuccuggccccaugguuggggucaggugguacagugauguguuccaguuagaucagacucuugccgaccccccuggcuuaggggcuggaguguccugugagaagcuggguggagagggaguggacaagcaucugaugugauggcugucgggacaaggcacccagcaucgaguggucgaccagugcuaggcauuugugauuagaccucucauuaauccucuuccagagggacuauuauaacccuguuucacagauggggacacagaguacccgacuguguagacagugaagcuggggcugaacccagaucugucugauuccaggcccugugcccaggcaugccuuugaggugucuacugcugggugccacccccaacugggccugaccccaaaugcucuugaggggggcaccuuacuauuucccgcugaaugucagaggggcagggugggugccacagccccuccccaggggcuuccacccgcagcucacaguccagcaggcacuuguuugcuggauacuuuaugggcggucucgagcucaggagaggggucagaauggagggucucuggagcccaggagaggaaucagaacugucagcccuguguccuaauggucccaucagugacuuuggagccucaggcuucugugccaggcuuuucugcugccccagggcaggcgguggucaacggccuuggcacuauggcugggcagaguccacuguggaaaggucccccucuccugccacuggcccucacuugaccuugucagccuggguuccuaccccauggccaccucucccuccggaucucucuucagugaccaacaagacaugagugacucacucugaaguaggucucguuuguuuuuaggaugagccugaacuucuuacauagcccguguuucugcuugccugggcuccagcuggccuuucccucuccccugguagugagcacuuccuccucuuucacugccuggcccgccugaggagguugccucccaaggcaggggucccuauggcacccuccccuauuucugagguacacuggguguuuauggaagggccccggccuuuggccagggcaccuugccuugugugugugguguccguagugccggcuggggaagugaggccuuguggggugagugaauaaacugggugaaugaguacaaggccaucaaagucaugucacaggaugggucccuggggugggggucugcgguggggugagcuggagaggaagaugggccgaagaaggagcagguugucucagggugcugaggauucagggcugcuguggggcugguuccugccuggguggaccucgggcucuucuaggccaggcaggucggggcagcagggccggagagacggagccagggcagugacugggccuggagugggggacuugcuuggggccccaccagggugaccuggccuuggugaggggcuacuuggguacaagcugacagucgugacugguuuggcuaucagggcgcaaggaagggcuuugagccgugcaugggcccacccgagugggaauuggggccguggugggagugcaggaccgugguugacaauugugaugucaggugacaggucagacugguagggauguggcggggguugccugaagguggccugaggcuugccggaggaaggcgggugauguucagaugauggaggccuuggugccaggcugacugacggccgguguuccaggcgaaccugaagaaguucauggacuacguccagcugcauagcacggacaagguggcacgccuguuggacaaggggcuggaccccaacuuccaugacccugacucaggaggugaggaguggagucggggaggggcauggccuuugcgcggcugggagccugacccuuaucugucugugaacccagagugcccccugagccucgcagcccagcuggacaacgccacggaccugcuaaaggugcugaagaaugguggugcccaccuggacuuccgcacucgcgaugggcucacugccgugcacugugccacacgccagcggaaugcggcagcacugacggucagugagggcggggccuggccuggaggggcucuugccuggugauggggcugggggcagcugggccugguguggauacugaggcugcucacccucagacccugcuggaccugggggcuucaccugacuacaaggacagccgcggcuugacaccccucuaccacagcgcccugggggguggggaugcccucugcugugagcugcuucuccacgaccacgcucagcuggggaucaccgacgagaauggcuggcaggagauccaccaggugugcagggagccgagguggggucccggccucugugugcuggguuggggguccuggcucugucuguaggggugggggcccuagccucugcccagggacccuacagcaccuugcucuucccccaggccugccgcuuugggcacgugcagcaucuggagcaccugcuguucuauggggcagacaugggggcccagaacgccucggggaacacagcccugcacaucugugcccucuacaaccaggugcgacuguguguccugcacaugccugcaccagcgagugugcauauacuugccucuucuggggguguaugugugugugggcacacaggugacccuguacggugauugcaugugugcaccgaguguggauauacuugccuguucuggggguguacguguguuugugugcacacaggugacccuguacagugauugcaugcgugcaccagggaguguggauauacuugccuguucugggguuguacaugugugugcacacagaugacccuguacagugauuguaugcgugcaccagugaguguggauauacuugccuguucuggggguguacguguguuugugugcacacaggugacccuguacagugauugcaugugugcaccagggaguguggauauacuugccuguucuggggguguacacguguguuugcacacagaugacccuguacagugauugcaugcgugcaccagggaguguggauauacuugccuguucuggggguguacacgugugugugcacacagaugacccuguacagugauugcaugcgugcaccagguaguguggauauacuugccuguucuggggguguacacguguguuugcacacagaugaccuuguacagugauugcaugcgugcaccagggaguguggauauacuugucuguucuggggguguacacguguguuugcacacagaugacccuguacagugauugcaugcgugcaccagggaguguggauauacuugccuguucuggggguguacacguguguuugcacacaggugacccuguacagugaucguacacguguaccagggaguguggauauacuugccuguucugggguuguacgugugugugugcacacagaugacucuguacagugauugcaugcgugcaccagguaguguggauauacuugucuguucuggggguguacacguguguuugcacacagaugaccuuguacagugauugcaugcgugcaccagggaguguggauauacuugccuguucuggggguguacaugugugugcacacagaugacccuguacagugauugcaugcgugcaccagggaguguggauauacuugccuguucuggggguguacacguguguuugcacacaggugacccuguacagugauuguacacguguaccagggaguguggauauacuugccuguucugggguuguacgugugugugugcacacagaugacucuguacagugauugcaugcgugcaccagguaguguggauauacuugucuguucuggggguguacacguguguuugcacacagaugaccuuguacagugauugcaugcgugcaccagggaguguggauauacuugccuguucuggggguguacaugugugugcacacagaugacccuguacacugauugcaugcgugcaccagggaguguggauauacuugccuguucuggggguguacaugugugugcacacagaugacccuguacagugauugcaugcgugcaccagggaguguggauauacuugccuguucuggggguguacaugugugugcacacagaugacccuguacacugauugcaugcgugcaccagggaguguggauauacuugccuguucugguguuguacaugugugugugugcacacagaugacucuacagugauuguaugcgugcagcagguaguguggauauacuugccuguucuggggguguacacguguguuugcacacagaugacccuguacagugauuguaugcguguaccagggaguguggauauacuugccuguucuggggguguacaugugugugcacacagaugacccuguacagugauuguaugcgugcaccagguaguguggauauacuugccuguucuggggguguacacguguguuugcacacagaugacccuguacagugauugcaugcgugcaccagggaguguggauauacuugccuguucugggguuguacaugugucugugugcacacagaugacucuguacagugauuguaugcauguaccagugaguguggauauacuugucuguucuggggguguacguguguuugugugcacacaggugacccuguacagugauuguacacguguaccagggaguguggauauacuugccuguucuggggguguacguguguuugugugcacacaggugacccuguacagugauugcaugcgugcaccagggaguguggauauacuugccuguucuggggguguacacgugugugcacacagaugacccuguacagugauuguacacguguaccagggaguguggauauacuugccuguucuggggguguacacguguguuugcacacagaugacccuguacagugauuguacacguguaccagggaguguggauauacuugccuguucuggggguguacacgugugugcacacagaugacccuguacagugauuguacacguguaccagggaguguggauauacuugccuguucuggggguguacacguguguuugcacacagaugacccuguacagugauuguacacguguaccagggaguguggauauacuugccuguucuggggguguacaugugugugcacacagaugacccuguacagugauugcaugcgugcacuagggaguguggauauacuugccuguucuggggguguacacauguguuugcacacagaugacccuguacagugauuguacacguguaucagggaguguggauauacuugccuguucuggggguguacacguguguuugcacacagaugacccuguacagugauuguacacguguaccagggaguguggauauacuugccuguucuggggguguacaugugugugcacacagaugacccuguacagugauugcaugcgugcaccagggaguguggauauacuugccuguucuggggguguacacgugugugugcacacaggugacccuguacagugauugcaugcgugcaccagggaguguggauauacuugccuguucuggggguguacacgugugugugcacacaggugauccuguacagugauugcaugcgugcaccagggaguguggauauacuugccuguucuggggguguacacauguguuugcacacagaugacccuguacagugauugcaugcgugcaccagggaguguggauauacuugccuguucuggggguguacacgugugugugcacacaggugacccuguacagugauugcaugcgugcaccagggaguguggauauacuugccuguucuggggguguacacgugugugugcacacaggugacccuguacagugauugcaugcgugcaccagggaguguggauauacuugccuguucuggggguguacaugugugugcacacaggugacccuguacagugauugcaugcgugcaccagggaguguggaaauacuugccuguucuggggguguacacgugugugugcacacagaugacccuguacagugauuguguaugugcaucccugccucugugccaugguauauauaugugcucuguguccugcagugaguuguggcugcagcacagccucauaggcauaugugugcacauuuguucucugaacacacaggggcuucacaugugugcacguguguucugaauaaccagguaugaauuggguacaucuaggcccucugggccaggugagaccugagcguguauaccuacuggcuugucucugcaacucagguguacauggaacaaauaggugugaguccgugugugugagccugugcccugcgcacgccaugugugcauuccugugugcgcaugugcuguugugcucggauggucucuccagccacccagcugugauucccucuuccccgcaacaggagagcugugcucguguccugcucuuccguggagcuaacagggauguccgcaacuacaacagccagacagccuuccagguacaccggugguuuacaggagcucaaggcugccccagaggugucugucucuguguccaugugacuugacuucucugaaccuugguucuucccuggaaggcccuaagggagcaccucccccaggacugcccacaggagguguugggggacgagcccagcacgcgagggguauuugguguugauguucccuucguccccucgccagggagagaggagggucagcagggcucuggggcagggguauggggaaaaugagaagacuggggugacaggugugggucugaccccccaaccccgagagaccagcaggggugcagaagccaaacugcagaggggguggagaggggggugguggaggggggugguggagaggggggugguggagggggaugguggaggggggaugguggaggggggugguggagagggggugguggagaggggggugguggagaggggugugauccuagccgcugauguaauucaggggagguuuccgggcccuuucucuggccagguugguuggcacugaugaccagguggacguggucucugacuuggaguuuguuggggagucgggaauauuguggggguuugcggaccaggaacagagccagaacuccucuauuuucaguaggagugagaugugggaagaguggucaggcugcugagguuguguggucauagaagguggaggcagcagugggcugccagauggguuugggcacacugggaagcagauacgcccgggccuguuggaugacugggugcagggucacaggaaggggaggaugagcuuggcagcuugggcagcugcggggccuuggcugagaugggaaacauggcugcauguugggacagaccagugugcccguuugcuugggacugcugguuuuagcucugaacuucuguccaggcagccccucagucccaggcagacagagggugggucacuccaguuauagggugugccuguggcaucccaguuacagacaagagugugugucaguagagaagaggaaugggcuggggucuccggggcccccaaccaaggaagacuccacacacgaacuggagaaggagcagcuggggcuggcuggcgaggcaaagcuggugcugcucagccccucccugcuccucaaggccuugaccuccccuuucccucagguggccaucaucgcagggaacuuugagcuugcagagguuaucaagacccacaaagacucggauguuggugaguucugcccaccugggcgacccugcugaauguagauucgugugguuuucuggggcccagcagaugugggggucaguggugacauaaaggggccccacaccccacaucuacacuguguggccaguggucucugaguggccacugcgggcaugaggaacgggccacagggccuguguugagugaacauuguuuuuggucugggagaagagcauggugagguuugggcugugggccggggcuagcauucagcuuagggggcagcauagguugagagugggguugaaguuagggucagagucccuguuucccguuaaauccuaggaagagccagcaggagacaugggggugguggaccucacuucacccuggagcaagcaugagucuuggugguccguagcaagcucucagcauggaaagaucauguaaacgacacauaaggaaaacaacagugaugggaaagcagaauggggcugggaauagugccauagccauccucagggcaaggagcucugagcccccugcugccugcgaguagaggaaagccuggugugugcgugacucacgguccuggaaggaaaaccaggagacacacacguggccucagccaggauacccgagccucuuggaggucucugguggguguggggccaggcugggaccguccuguuguagcugccggaguccccucugggagaguuguagcugccggaguccccucugggagaguugcugcuggccaggcugggaccguccuguuguagcugccggaguccccucugggagaguuguagcugccggaguccccucugggagaguugcugcuggccaggcugggacgguccuguuguagcugccggaguccccucugggagaguugcugcuggccaggcugggaccguccuguuguagcugccggaguccccucugggagaguuguagcugccggaguccccucugggagaguugcugcuggccaggcugggacgguccuguuguagcugccggaguccccucugggagaguuguagcuggccaggcugggaccguccuguuguagcugccggaguccccucugggagaguuguagcugccggaguccccucugggagaguugcugcuggccaggcugggaugguccuguuguagcugccggaguccccucugggagaguugcugcuggccaggcugggaccguccuguuguagcugcuggaguccccucugggagaguuguagcugccggaguccccucugggagaguugcugcuggccaggcugggaccguccuguuguagcugccggaguccccucugggagaguugcugcuggccaggcugggacgguccuguuguagcugccggaguccccucugggagaguugcuguuggccaggcugggaccguccuguuguagcugccggaguccccucugggagaguuguagcugccggaguccccucugggagaguugcugcuggccaggcugggaccguccuguuguagcugccggaguccccucugggagaguugcugcuggccaggcugggaccauccuguuguagcugccggaguccccucugggagaguuguagcuggccaggcugggaccguccuguuguagcugccggaguccccucugggagaguugcugcuggccaggcugggacuguccuguuguagcugccggaguccccucugggagaguugcugcuggccaggcugggaccguccuguuguagcugccggaguccccucugggagaguugcugcuggccaggcugggacuguccuguuguagcugccggaguccccucugggagaguuguagcugccggaguccccucugggagaguugcugcuggccaggcugggacgguccuguuguagcugccggaguccccucugggagaguugcugcuggccaggcugggacgguccuguuguagcugccggaguccccucugggagaguuguagcuggccaggcugggaccguccuguuguagcugccggaguccccucugggagaguugcugcuggccaggcugggaccguccuguuguagcugccggaguccccucugggagaguuguagcugccggaguccccucugggagaguugcugcuggccaggcugggaccguccuguuguagcugccggaguccccucugggcgaguugcugcuggccaggcugggacgguccuguuguagcugccggaguccccucugggagaguugcugcuggccaggcugggaccauccuguuguagcugccggaguccccucuggugccugugccucucucugguauauggacucccaggacccccuuccugccaugaguguuuacucguggguguccccauuuuuuguuuuuguuuuaauuugaagugacagcgggcagcaaacgucuggagcagauguuaggguuggacucucacuugguucuaaugugaggucauggucagggcuggaguugaauuuuggacugggguuaagauuaaggucgguuucauguuuaagggcccuucuucuguagaguucccccugaacaucccccuguaaggcuugguuaugagccccuccaccccaggcugugucaguugaaccaucugaggcuguggcagacccucggugaaugccacagcugcucucaaggccacugcagggaaguguguguugaggaaguaacugggccagugggauggguaggaucggaguccagggucaggucaggggagaacugugguaagguuuggguuugcauaaggggcagcagauaguuacuucugguuugggcugguguuuuggagguggcccuuaguguuggaaggcccugguuugugcauguguggggccucuuccucuuuuuuuuuuuuuuuuugagauggagucugccuauguagcccaggcaggagugcaguggcgcgaucuuggcucacugcaagcuccgccuccuggguucucaccauucuccugccucagccucccgaguagcugggauuacaggugcccaccaucaugccuggcuaauuuucuguauuuuuaguagagacgggguuucaccguguuagccaggauggucuugaucuccugaccucgugauccacccgccucggcuucccaaagugcugggauuacaggcaugagccacugugcccggccagggccuccucuucugccuauaauugucuaaccgugggaaagcugucugggaccucugcgccucaguuucucuuaagugaaacauggucucuuauggucauuugcauccccuucccccugugguguccuguggcguuugauccuggguggggcuggacucuugccgguggccuuggucuaguugcuuggagggagggcgggaaggccccaucugccccucaucugugcguuguggacagauaccccagggcucuuggagucaccaugguugcgacuuacuggcuauccaaccuaggugugcuugcuugguuggaguuagacacacgucccucagugguaaggagcaggcaccugugucaguucauccugauguggucgucggcuccaugggccaacaacacccuuaccugaucaggugccacacacagacacuagggugacaccgccagauuucccugaguacaggcagcauauuugucaggauuuaauacaagccccuuaucucaauuugcccucucaacaaccccccaaggagugauuagacuguuuuacggagaaggaaacugaggcacagaggggguuaauucagaccugauugauucagggucugccuuugucacucccaugcccuccguacacauuugcuccaaggacaggacagucaugacuugcuacauccuaugcccacuggggucccagaguggggccuguacacagaagaggaacuggaaggaggugccgccuucucuggugggcaggugccacccggugggaucugguagacugggaccuguguaacccuucaggcaacaggauagcuugcugccucucgacagccuugcuugcccccucuagacugacaggccuuggguggggucccuggccugggcguggaaugggcaucccacagugcuuuugaugaguaccuuggggaaaugcuucuccagggugcugucaugcccaugagaacacaccugugccugggagugugugccugagagaggguaagagacaauguggacccaaagagugacccgacgugacagaggcaaggaagcagaggugaccacuucuaggccagaaugauucaguagcguucuguauauucacgguguugugcagccgauucuauugaauucaaaacauuuucaucaccacaaaagaagacccuggacacauuaagcaauaauucugcaucaauuacccucucccuccaacucugucagccauuaacacacuuucgucucuguggacuauagauuuaccuauucuugauauuucaugucaauggaaucauauaauaagugacacuuagugucuggcugcuuuuacucaacauguuuuugagcuucaccuuguaggauauaucacugcuucauuccuucuuauggcugaauaauauuucacuguugguauaaaugacauuuuguuuaugcauucaucugucaauggauauguggguuucuaccuuuugacuguuuugaauauugcugcugucaacauguguguacauguacuuguuugaauaucuauuuucaaucucuuagguauauaccuaagaauggaauuuuggaaucauaugauaauucuauguuuaacuucuugaggaacugccaaacuguuuuccaccauuuugcauucccaccagugauguaugaggcuuccgguuuuuucacaucuucaccaacaguuguuacuaucuuuuuuuuuugaccguagccauccuaguaagugugaaaugguauuucauugugauuuugacuuguauuucccuagugacuaaugauguuuugcaucuuuucaugugcuuauugggcauuuguauaucuucuuuggagaaaagucaaguccuuuguccauuuuuaaauugggucauuuauuuuuguuguugaguuguaaggguucuuuauauauucugaauacuaaacuuguguggaauaugugauuuguaaauauuuucucuguagaauaggagauccuugucacuuuuuugauaauguccuuugauguacaagaauuuuuaauuuugauaaaguucaagguaucuauuuuuuucuuuuguuguucaugcuuuuggugucauaggucacgaggguuuauccucuagguuuucuucuaagaauuuuacgguuuucacucuuaggucacugauccauuuuaaguuuuaacuucuguuuauggugugagguagggagccaucuucauuauuuugcauaugaauauccaauuguccagcaccauuuguugaagagacuauucuuuucccauugaauggucuuggcacccuuguugaaaaugaauugauccuagauauguggguuuauuuggacucucaauucuaucccaguggucuacauguauauucuuaugccaggaccacaugguuugauuacugcagcuuuguaguaacuuuuuauuuuuauuuuuuuggagauggaguuuugcucuugucacccaggcuggagugcaauggcgcagucucagcucacugcaaccuccgccucccagguucaagcaauucuccugccucagccuccaaaguagcugggauuacaggugugugccaccaugcccagcuaaguuuuguauuauuaguagagaugggguuuuaccauguugggcaggcuggucucgaacucuugaccucaggugauccacccgccucugucucccaaaguguugggauuacaggcaugagccacugcacccggaguguaguaacuuuugaaaucaggagguuugagugcuucaacuuguucuuauuuguuaucguuuuggcuaaucagggccccuggcaauuccauauagacuugaacauugcuuuucuauuugugcaaaaagggacauuggaauuuugcauugaaucugucaucacucugggugacauuaacauuuuaacaccauugucuuccaauuaaugaacaugggauguccuuuuauuuauuuaggucaucucuaagcaguguuuugucauuuucaguauauagauuuuuuuacuuccuuaguuaaauuuauucuugauuauuuucuucuucuggaugcuauuauaaauggaauuauuuucuuaauuuccuuuuuggauuguucauugcugguguguaaaaacaagugauuuuugugugcugaucuugugcccuacaacuuugcugaauuuguuuauuagcucuaguagcucuuuugguguauucuuugggauuuucuacauauaggaucaugccaucugcaaauagagauaguuuuacuucuuccuucccaauuugggugccuuuuuuuuaauuuuuauuuuugccugucuagaacuuucaguacgguguugaauaccaguaguaaaagcaggcaucuuugccuuguuccugaucuuagggggaaagcauucaaucuuucaccauuguguauggugcuaucuauguguguuuuuuuuguuuguuuguuuuuuguuuuuuaaauauggaaugcuucauuaauuugcaugucauccuugugcaggggacaugcuaaucucugaaucauucuaauuuuaguauaugugcugcagaagcaagcacuucggauuuuuaauaaauuuccuuuauuauguugaggaaguuacuagcuucuauuacuaguuuccugaguguuuuuauaaugaaagaguguuggauuauggcagaugcuuuuuaugcaucaauugaaaugaucauuuuucccccuuuguucuauuaaugugauguauuauauugauuacauuagucuguagauuucuuuuccugcaaugcccuuaucuggcuuugguagcaggguaauacuggccucgugaaaugagggaguguucccuccucuucuguuuuuuggaagaguuugagaauuugugucaauucuuuaaauuucuaguagagugcaccagugaugccaucuggugguggacuuuucuucguugggaggcuugugguuaaggauucaaucucuuugcuuguuauaggucuguuuaaauuuucuguuucuucuugagucaguuuugguaauuuguguuuuucuagaaauuugucuaccucaucuagcuuuucuauuuguuggcauguaauuguucauaguguuauauuccuuuuuaacuucuguaacacugauaguaaguccccaaauuucauuugugauuuuaguuauuucuguccaucuucucuccuuacuagucaaucuagccaaagguuugucaauuauguugauauugucaaagaaacaaccuuuuauuuccuugauucuccgcuguuuuucucuuuuguuuaucucugcucuaaucuuacuguuuccuuccuucugcuagcuuuucuuucuuuugcuaguuugguuugcucuucuuucucuuguuuuuuuguuuguuucuuuuuggucuuucucuagucuguccgucccuccgucccucccucucuugcuuccuuccucuuuauuuuguuugcucuucuuucucuaguuucuucuuuucuucucucucuuuuuuuuuuuggagauggaguuucgcucuuguugcccaggcuguagugcaauggugugaucucagcucaccacaaccuccgccaacuggguucaagcgauucuccugccucagccucccgaguagcugggauuacagggacccaccaccaugccuggcuaauuuuguauuuuuuagaggcagaguuucuucauguuggucaggcuggucucgaacucccaaccucaggugaucugccugccucggccucccaagugcugggauuacaggcaugagccacugugcccggccucuuuucuuuucuuuuauugguucauucauacagacaaggucucacuauguugcuaggcuggucuugagcuccugggcugaagugaugcucccgcuuuggccucccaaagugcugggauuacaggcaugagccacugagccucgccuucucguuucuuuuuuguuucuuuuuuuucgugagauggaguuucacucuuggugcccaggcgguagugcaauggcgcaaucuuggcucaccaccaccuccgccuccuggguucaagcaauucucaugccucagccuccugaguagcugggauuacaggcaugcacugccacacccggccaauuuuuguauuauuaguagagacgggguuucuccauguuggucaggcugguuucgaacucccgaccucaagugaucuaccugccuuggccucccaaagugcuaggauuacaggcgugagccacugaacccggccuucucuuguuucuuaagauguauaauuagguuauugauuugagauuguuuuccuuuuuaaaaguaaguguuuacagcguuguuucccuuuaaguacugcuuuugcuccauauguuguauuuuuguucuuguuugucuuaaaguguuuucuaauuuuccuuaugauugauuucuuuuuucucuuucuuucuuuuuuuuuuuuaagagaugggaucucacucuauggcccaggcuggagugcccuggcuugauuuuggcucacugcagccucaaccuccuagucucaagccauccucccaccucagcuuccugaguagcuguaacuacagggugcagcaccacaccuggcuuuuucuauuuuuuauagagaugggggugucacuauguuguccaggcuggucucaaacuccugacuucaagugauccuccugccuugaccucccaaagugcugggauuauaggcuugagccaccauuucuuuuuugagccugguuucuuuuuugacacauugguugcuuaggaguaugguguuuaauuuccacauauuugugaauuuuccaguuuucuuucacuucucgauuucuagcuuuguuucguugugguugaaaaagauacuuuguaugauuucagucuuuuaaaacuuuaucaagacuuguuuugcggccaaacauacagucugucugggagaauguuccauguguacucgagaagaauucuugaauauauucugcucuuguuggguggcauguucuguacguaucguugagucuaauugguuuaagucuucuauguccuuauugaucucuccagauguucuacccauuauugaaaguaagguauuaaaguuucuuacuauuauuguggaacugucuauuucucucuuaaauuguguuguuuguaucauauuuugauguucuguuguucgguguguauauguuaguaauuguuaaucaacauauaauguccuucucugucucuuguuacaguuuuuaucuuaaaguuuauuuuguaugauguuaauauaaccacccagcucucuuuugguuacuauuuacauuagauugcuuuuuuuauccuuucacuuugaaccuauuugugucuuuggauuuaaagugauuauuuuguaaguagcauauaguuggauaauacuuuuuaaucacuaucugcuuuuuaaguaaaauucuauuggaacacaaacacaccuaucugcuuguauguuguuuguggugguuuucaugcugcgguggcagaguugagucauugcaacacagacuauauagcuugcaaagccuuaaguaguuacuguccaauucuuuccagaaaagguuugcugaucccuggucuagaaugucuuuuauaguuucccugguuauaguuaacugcaaaugguccuguucagcaguagucuggugagauucgucacauguagccuguuuugucucuccugaagcuugugaaaugcaguucuuagagcauaucugagcacccucaaggccccuuucggcugagaggagaagcaggcuucuaccucugaagcuagggugagaggcaguuugacugggauguggccccuuaaugguagcuucauuuguaggguggccaacucuuuugguuugccuggaaccaaggcaguuccuggaacauaggauuuaguuuuaacaucuggaaagccugggcaaacuggacaaguuggucacccagcuggcuguucagagucuuaccuaugcccccuuaccccaguaccauucagggaaacccccagcuaugcgaagcggcggcgacuggcuggccccaguggcuuggcauccccucggccucugcagcgcucagccagcgauaucaaccugaagggggaggcacagccagcagcuucuccuggacccucgcugagaagccucccccaccagcugcugcuccagcggcugcaagaggagaaagaucgugaccgggaugccgaccaggagagcaacaucaguggcccuuuagcaggcagggccggccaaagcaagaucagguaggagggggcuggcaggcccuggagggguugggaggguggggugccgggaccugagccaggaggagccagcaccgggaggcagagagaggccugguggugccuagcaccuguguagugaugggcuagggcuuccugguuggggaagggaagaaggcaucucuggagguggggacaggcacaugcacgcugauuuccgguuggagcugggcuugccaugaggacagugggcaguugagggagcguguuagguggagaggguaugcuccuaccugugauuuagaaaacacacugcauugucaggcauggcugggaagagucagggcugguggccugugguaagggggacagggauggaguugccacuccaguagggcccaaaaccuacagguaagccccagcccuguccccaggguauacucaugguuucccccagcccuggcacaccuacaggacucuguggcuucuauucuuuacccucacccugaggccugggucccugaggcagggaugccuggaccggagcccacuggccucucugggcugugcauugggugcugaggugggcgcacuggcucucagccacuuugugccugggcuucucaucaguaagugggaauaguccuaccuaagucauugucuuugggaagccuuccagaaugcccugggcaggugagggaucaccuggcagagucuggcaacugccgguaaaagcaccugcccucccugugccuugaaggcaggcaccgucuuugucguuuccuaguuucaucagagccaggcacugaggaggguguuuggcagacauuguugaguggaagaguuacauaaacaguauguuguugucaggauggccgccggccuuuacaguucugucaguccaggcccgcuguugggcugaauggcauguguauacuagcuccuuuaaccuugacgaacguacauguucaugcucuauuaauaccauguuacagaugagcguccugguacgcagguggggccugugacggguccagagucacagagcuacggaucagcuucacugggccccagguagacccaauccccaacuuucuaagccugaguguucagcagagggcucagggugcagcagggccuauggaaggcgccccuuccugugcugccgccccugcucugcagccuggucucagcgaugucuccgugucugucuuugccugggcuuguuggacucgcaaggcuggcuguacugccccaaaucucaauucuccccugaagcuuucuuauagacccgcggauuuucuaagggcugggcggcccaguggcugaaagaacacauucugcauuccggauguuuccaucccgcagaaaggcugcuccugaguuggaggcacgcguugccacaggcuccucccugcauucauuuuuuguacguguucauucauccuuucagcagacacaaaacuaagaccugcugugugaggggcuccagcucaccugcucuguggggauggcagaauucuguuuuuuccuuccucgcaaacauuuauugggugccuggugcgucagagguggugggucucaggaaguugacagccgagggcccgggcuaagcagcaguuaggugggcagugauccccuuauggggcugcccuggugaguggacaagggucugcagcucucgggaggggcugaggaaguucggugccccgaggagagaagucacccccugggggaggcgaggcugggcccugcaccgcgcgggucgcugcgcccucugucgguugagccggaccgggacccgacccccaucagccccccaguaucacacggggcacggcgggggaguuugggcugagagcccgucacuuaacagcuggcccaggggucaggauguuagaguaguucagguguuggcaacugcgugacggacagcccacaggaggggaaggagaggugccccgugugacuagagcguagcaaacugccaagcccgagggagccuggcucuuggaaaagcggguggcucuggccugccuggguacuagggagccacugcaggcuucugagcagagccccaguggaggagugagagcucaggcucuaccccagucugggaguggucuggggaaggugggcaucacgcagugggcgugggcaggggccgguguccaggacgaggggacccaggccuagagggggacugggcacccagcgauccgggcccuggaccuggagggguggggggggcgccccucccucccguucaccggcuccaggcggcuuugcuggugcccgaagcccccgccccaucccccgcucccacuaggcugcccugaccaccgucccgcguccgcguccgaacucccccucccgggggucggcggcgaggggagggcgggagggagggcgcgagggccgccaccaccgcccgcagagggaggagcccggccguggaggaggcggggcgcggggcggccgcggcauggagcgagccuggcgcgcccaggagcuguauucgaauucgagcucgguuccccgcgcccccugcgccccccgcaccgccgccccggggcccgaagcggaaacuuuacagcgccguccccggccgcaaguucaucgccgugaaggcgcacagcccgcagggugaaggcgagaucccgcugcaccgcggcgaggccgugaagggugaggggcgcgggggggcgcgggggggcgggcccggcgcggggagggggcggcgccgcgcgcggugcuggccgggccggggcaguggcucuggggucuccucugccggggcggcccugggcccuugugggaucccuggugucacggugaagggcucugccuggggaagguuccugccgugcgggucccuccggugcucugucguuccgggcucccugugucaccacggaggcuccucucucgccacgggcguuucuguguccccgggggucucugccugaaggacccugucccauuacagagcuuccuugcauugcgggguucccguggcacuucugcagcuucuccauuggaggccccugcgaugugggggacccuugccgucguggggugucugugaccgucauguggguguuuguguuaugcaggcuucugucaccggggcuuccuguguucuggggggaucgcgugccaugacaaaccccucucauucugggggucucggggccaucacugggcuccuagccucagggccggcugagguggaaacagcccagcuggugcaucacguggccucacccacuggccacagcacgaugaccccgagcucucggcagugaccccugggugggugacagagccaggaugggggucgguugaaggggcugggggagcauggucagcugggggugggggcagcagcaggaguguggccccugccccugccugcgccccuccccgaguguguccaucugugugucucucugucccccacaugcccacccugugccgagcccaucuguuccuuucucucuucugcguggaucccaaaaucuucccagggaaaaagcugggagaaagugggaagggaaggagggaaagggcagggggugggugggcagaaccugcuccugaggugggguaggcgcccagcucugcuccccacugacggccugucuggcuucuuccuccagugcucagcauuggggagggcgguuucugggagggaaccgugaaaggccgcacgggcugguucccggccgacugcguggaggaagugcagaugaggcagcaugacacacggccuggugagugaccccacggcuccccgggcagcucccaaggggaccaccccuuccaguuucccuuuguucucucuuggugcuaaauccacauggauauucauagagaaaagacuagagguaaacucaaacaaacacucaaaguagaugcaaacuuguguacaugacacagacacgugugcacacacucugcauauacuugggaacaugcguguauguaaccugacgcuucacgugcaguggagacacauaggacgugugugacggggccucugucugugugaucccacauugacucccagugacuugcaccccaccagcacaguccuucagaaacaccagguguguggaacgcaugauuccugcguagcuggcagacauguaaggaggucagugugagaaaagaggcguuuuuccaaaguggacagauuguccaagugggcagagcaggcaggcccggagcagccaagaggaaaugaggccaguugggccuggaggugcccuggugagugcccuggggcagggauggucugagggcagcaggugaggcugggcugguccucagccugcagggaggaugugaaggugaaggcugcagcuccuggguuggugaguggcugcuguccagcccugcugaccaucugguccuuugggggcccccgggcuggagcugggugcgugucuugggggugcccuugcaaggaacccucaggggucccgggaggcccccagauccaugcaugugcuucuguccuggagagcuggugggccaagcaaaccucuccugagugauggucacugggggccaucgguggugugucuggaucaagggugcaugcacccucccucugcaugugaagggcucaggccugggguuacuguguccccaucucuguguccccaccucugagaguuucccagcgacuccaccccuguacggccuggaccccugcccugugcugagcucagcagaggcccagggaggcaggagcuucgccacugaccuuuuccugggccggugcccuuuccuccuuccuuggccuuguucugccuugcucugacugguggcuuagaguguggaagggacuuggcccccuguucucagcccgcggaggguggauagggcaggguccagaugggaaaugguuucagagauuugggcccugguucagacaguaugggagaggggaggggaaggagagguagggggauccacaccuguggcgggagcgggucuugagcucccccacgugguggugaggaagguucugguuugaggacuguguggagugaggggcauuuggaccuacgucugaagcugacggggagggagggggguuuaggcuggagucagaauuggagagcagcaaauguuuuuuagguguuugucaugugcugggcccugugcugggagccgggaucacggaggcucagcuggaagccuugugggagcaguggcugugacgggggccgugugagcgugggagcucccugggcuggccugaaggagucagagagggccucaaaacagaggcauugucugagcugaguccucuagguggucagcggcuggggcugaggggacagccgugugugcaggguccguguggcgcucuacagcugugugucagcacggccugcucugagugccuggcacaguuuuagcacuucuacacguauaagucguugacucaucccagcagucccaagagguggggccacuuguuguuauuccauuucuagggggucacauggcccugaggggcaaagucuuguuugcaacacaggcagcaaguucuaugugagugaaacgccugcauggggugaggggcgaggcugguguggggaccacgggguggucagguggcauggagucaagugacaguguggcaucauggcggagggaacccagccgcagugucugauugugcagguuguguaggaucaaagcccgggcugggcagagcagagcaauggagaggaggguucaggucugggcuccagccagcagccauggugugugugaccuggggagugagugucagaggucccgggguagacgggaguauuucaugagugggcagcgggagagggaccugcggaggcugccugcgaagggcagggagugggagcagugacagugcccucugaccuuggcugcaggcccugcuggccacacugcgcagagccucugcucugggaucccggggccgaguucugccagaggccagagugcagcccaggaacaggaaccugcuuccaacaggcccagaucugcuccccccaccccccaaaaaaauccauuuccgggacuggaguggggacagaaaaggacuuaaagguuagggaggggacauagucccugugcgugcaggggcuggugcccagagccggugccugcugugggaucgggaggcgaguccuggucacuuacccagcagagagcagucucccacggcaccuccuggcaggcagaggguggagcugugagggagggaauggagaagcgaggucagguguguucuggaggcccagcaggagcaggcccugugccuucccuccccucccuccuucccuuucuuugcaguaaggucagcacuuggguggguaguaggagauggcuguguugggcauuuucucuucagcuggcuuuuaugugucuuauuaacaaaacuggaaaaaugaguuuguguuauguaauccauacaauuuguuugguugacaacaucugaaaacaggaggcuggucaagugcaaguguggcggguucuucagcaggcagcaccaugacacuuccgugccucugucgacguggagaagggugugauggaggaaaggaggggucugaugccccaccugaguggugaugaggcuuggccugagcuggccuuagguucagcgggaugaggggugcaggugugguuggggaaugccaggauaagauauaggucaucagaaccaaggggauccuccaaguuggauuucucuauucuauaugggcgggcuuagagggggcuguugacuuacugagagucacacaacguaguagcugggaccuggaauccagcccgauacuuuuuugauaucugugccuucugauagaaauaggcacucuuuccucuuuccguccggccacugcuccaccuauguuuacagccaucuauccuuugacucacccacccaucccaccaucaucuucuuaaccguugacucaccagccaacccaauccaccaccccucccuuccuccauccauccaccucuccaccuaccugucuacacacccaguccauccauccaucuacccauguaucugucugcucuuugaccuaucuacccauggcccucuccuucccucccuccauccacugguccagugccuuucaauccacccuucuguccgucuaucucagaugcaccuguccaccauuuacucuccuagucagcaucccuucuguccgucuaucucagaugcaccuguccaccauuuacucuccuagucagcaugcagaaugccugugacgugccaggugcugugcugggugcuaggaucacagagauaaagaacauguggcccuuacccucaaggagcucacaauuagugggggaaacaggucaucgaaagcugcagguuaucuuucugaucucauuuccugccacucucucuagcucccucugcuccagcugcacaggcucugaacucucucaaaugcugcaggcugaugccugccgugggcuuccccugaccacccccgcuccugggaagcccuuugcccacauauccacaggcugcuccccauccucagccucugcucagcccucccgugggggugaggccuuugcgugccuuucucugcccucccugaucugcucgcuggucuccugagcacuugccagcauucgcaugcuaugucuuuauccucuguuuauccugucucccagaacagauuauaaaccccacgagugcagagacuuuguucucuucucugcuguauuugcagagcugguacacaguaggagcucaauaaauacuugcugaaggaaaacauggaucuugagaaaugcuaccaagagaggaaaugaggaaggugcugagggaugaaagcgaggcagugguggugcugccuguggggccuuugcgguccuggagaguggagcugcggggcugggaaggcugguggguggggcucgcaggcagcuggaggagcucgugggagcagagaggucauggcuggagguguggcucgaaccuucaggucagugaggguggaguggugggcagacagcuggcuagcuuggugcuggccaugugggacuugagaucaagaggacaguuggggaccaagcucugugggaugcaucgaggucagggcaggggacccagcccacacaccuagauccccugccccacucacaguuagucugaagcaagggaccccaugagguugagcaucaaggagcuauugugaagaaguuggugaagacagaacgcugcuuccaugccagcgccuauaggcacauagcacggcauuuguacaugaguguggguaaugcagauucagaugugcacacacacaugcaugaacacaccucacacgcacaugacggcaggucacacagacacaugagcacggcacuugcacacagugggcucauauagagacacgugcaugagcacagcaucuacacaugaccacggaucucucacacacacacguaugugcacaccccccucuuugcucgcagccuuggggcucacuuacgcucuguggacggcucuggccuuguuuggacuccugguucagcagcuacuuaggaaagagaugagcugcugcccccucuugggcccugacccacggaggucagaauucccuacaucauccccucagccuucuuaccucuggacccaggacuccaggauuuggggcccccuacuuccaucuggacacaaccaggccaagggggugugugugggcagagacuggugaccagcaugggugagggcaguugaggcaggccagcuggaggccacgacuguccaucagcucccgauacucccuucagaaacgcgggaggaccggacgaagcggcucuuucggcacuacacagugggcuccuacgacagccucaccucacacagguacgugcagggacccuggcuggcgggagcaugcaugugggacguggggcaggaccugcaguguagagggaggccagguaugaagaggucagaggagggcaagggaaugugccuggccgaccucucuucugcugcccggccugucagucccggggugacugcaggguggacuguggccggccaaccucgaggcagggcuuaccucacuccucccugcuuuccuucaucagcgauuaugucauugaugacaaaguggcuguccugcagaaacgggaccacgagggcuuugguuuugugcuccggggagccaaagguaauggggagugggugcccgggggucaggcaggcaggggcugcacaccgcucagggaugucuucagcuucuugcuucugcccccaacucugcucugccccacacucccucccugccuugccccugcggcucccgcuuuuggccccggcuuuccugguuccucugcucggucgcgaccgucgugguuugcaacgucccggcccaggcggcaauuccuucccuucguuguuuuccacugucuuugcucuagagucuaaccgagugggggcuuuucuggcaugggcaaagggaguuuugcagagggucaugucuaggauccuugggccggcucgucccugcgcuguggcuccccguggcccucccccagccccgggucacugccccccgcagucaucucuuuccugugcugagccacucggagguugcuguguggcagccgcccccacccgaaccuagcuggugaagcgccuuccuaauugccccccgcagcagagacccccaucgaggaguucacgcccacgccagccuucccggcgcugcaguaucucgagucgguggacguggaggguguggccuggagggccgggcugcgcacgggagacuuccucaucgaggugaggucguucuggccggugcugcccagugggaugcugagcccugagcccugugguggacgugccuggggcguccccacccagcugccugucuaucccaggugaacggggugaacguggugaaggucggacacaagcaggugguggcucugauucgccaggguggcaaccgccucgucaugaagguugugucugugacaaggaagccagaagaggacggggcucggcgcagaggugaggggucacgcuucaggccucugugcccaaacuuuccccugaccuuagaccuuugacuucaggcccacauuccucuucccaucccugacccccaacugcugacaucagauuccugaaccucaaugaaccacccacacgugugggcugggaccccucccgaucccuggugcuagacugccaguccuguccccuggccugaggccuuugaccccugaccccugaccucaggcugccccuccucagaucccugcccccuccuucccggcguucccccagccccuggcguggcagagcccuccuucccuacaccgccagcagcugccuggaggccgggguugccauagcaacugugagguugacgcugccgcgcugcuuauugucggagggaagggggaggcggcaccugagggaagaggaaaagcgucuucuccccgcgacgacgcggcacagccugggcccaggaggcuuugccggccaggcccagcccaggcccguggcuuggcugaccacacccuggccccacaaggggcaguggccacccgggccuggggggagcccuggagcagcaggagccccgcccgcaaggagaccccucccagcccccaccccauggcucuggugcccccuugcuuagcccucgaagccugcagggugggugcucaggccagagccagccggcaccgugacccccgccagcacccuugaucgucuccugaggcccugauucuggggguucccagggccccugaggcccugaccgcccgcccccccccccccgcacucccugagcuccuugagccaugaagaaguuugcguccagccguaaccugaacaagauccuggcacagugcgacucauccucgcgggaguacgaggagauccaggcgguggagcgcaaguggcaccugcaccuggccacgccgcgccgccugcugcuggacaggagguccaaggccucccucuucuuugcagccccaccgccccccaagagggcccccagcaccacacugacccugcgcuccaaguccaugacagcugagcucgaggaacuuggugaguggcggggguggcgguggagguggacgcagguggacgguccaugaugggcagacagggccgggagacacaggugguacgggagggcaggcgguccagccagaggguaggaaggacagguggguacaagagcaggucagaggugaaugggugggugcuggcgcgauggggaaauuuggugcuuguggggugaggagaggguggcauguggaaggggugagaugugagaggcuggggauggacagugggguguccaggacagaugacggggagcagggccuggcccaccaguauguuugcaugugugugcaugugugugcgugugcugccucugguuuuccacgucuccacuuugacuuuacuccugcauuucauccaagugaggagagagcgguagugaggugaccagggucugcugcuggcucugccaggcacuggcugugucagcucuguguuuauuuuacccucuuggugacugugcacucauugacagguggcccugcugaccccacaggccacaggaguacugucggugggaugauggggcagggccucgagcgcggcaggaggggagcaggaguguguugggguuugauggggcauguucugggcacaagcccugguugaccaucaacagccucuucaugggcaggucuuauauauguguccauuaacaaccuugucaugugcacguccagauauacuugaucauguccugacgugacagucaguagccucuucaugggacugucccauuacgugugaccguuguccucacuguggguaugugcuauacauguggccaucaacagccucgucaugggcaugucccacuguacgugacaguugacaggcucuuucuuucuuuuuuuuuuucuuuuuuuuuuuuuuugagacaguuucacucuuguugcccaggcuggagugcaaugacacguucucggcucacugcaaccuccacuucuuggguucaagugauucuccugccucagccucccaaguagcugggauuacaggcacccgccaccaugcacggcuaauuuuuuuuuuuuuuuuuuuguauuuuuaguagaggcggggugucaccauguuggccgggcuggucucgaacuccugaccucagguaaucugccugccucggccucccaaagugcugggauuacaggcgugaggcucuuucuuucugugaucugagcccaguucuguucccagacuuaacucugccucuggucauagaaggaaccccaacuuugguccuaaacugaacccugaaguccuggccacaggaagggaccccauucugguucuaggcugagcccuaucccuggcuucagucuugguucuaccccagccauagaaggaacccuuuuccugguccccagaauuaucccugaccucacucaugaaccaagcccugacccuguccuugccacaggcugagcugccccaugccaagcagguggucuuaacugcaguuuaguucaggguggagaacagcuaccaacguccauugggcugacguggucagaauuuucaccauagcuauuccaaauaaaauaaaacccaaagaaaaaaacaaaaaaccccauguagauaauucagaaugaaaaggagagaaaccaaagccagaggcuuccauagcucguuaucuaguacgcaggggcaagggguugggguccugaggcccccacaaggcugggagacguggcuggaccugugagaagcgggaagguuaaaaaccaagcccaaccacuggaauuagcuucgaaagaacuggaaaucagagaagaauaugaaaaacauuaaaauaaaguaaauugucacaaagauuaaaagaacuaacagaacuaaugagagaauaggacagaacaaacaagcaaaaaaagaauaagcacauuuuagaaugauucuuuuuuuuuuuuuuuuuuuuuuagacugagucucguucuauuaccagcuggagugcaguggcgcgaucucggcucacugcauccuccgccucccggguucaagugauucucuuggcucagccuccugaguagcugggauuacaggcgcacaacaccacacccagcuaauuuuuuguauuuuuaguagagaugggguuucaccauguuggccaggcuggucucgaacugcugaccuugugauucaccugccucggccucccaaagugcugggauuacaggcgugagccacugcgcccagccagaaggauucuuaaagaacuguuauugaaacaaaaaguguagucacugagauaaaaaagaaagccaugccugggauaaacaguacacuagacccaggugaagaaagaaacagcaaguuagaagauaaaucugagguuacccagaauauagcacagaaauauaaggagauagaaaauaucaaagagcaguuaggacacacacacacaaaaaucacauagauaauucaaugggacuauugggaaaaucccagcaucuaccuaaugcaaggcguggaagcaaaaauaaaauguugccuggaggcaauauuuggagaugagauggcuuaagaauuuccgaaaguugaacaaagacaugagucuucaguuuaaagaaauauaagucucagcaaggaaauaaaaacaaaucuguauccacaucuuucauaguaaaacuguagaaugcugugagcaagcagaaaucuuuaaaacaaugagagaggcugggugcgguggcucaugccuguacucucagcacucugggaggccaagacagguggaucacuugagucuaggaguuugagaccagccuggggaacauggcgaaacccuaucucuacuaaaaauacaaaaauuauccuggcaugguggugugugccuguggucccagcuacucaggaggcugaggugggaggauugcuuaagccugggacguggagguugcagugagccaagaucaugccagugcacuccagccugggcaacagagcgagacccugucucaaaacaaaacaaagcaaaaaaugaugagagagagagagagaugggcugcuggaugucuuagacgggagcagugguccaacugacaacagacuucucaucagcaguggcagaugacaguagaugauggaagaagagcuucaaaguguggagucaaaauucuuuuccaccuagaauucuauaccccgcuaauccugcucauucaggagugaggcagagaggcuaauccuagaccucuggcacucgggucaugaggguccaaggucagucacggggagcugaccugucaauugaagauccaaacugaucaauaagccagcaccaguaggcagcugggucccaggauucuccugccagaggcugucacauagccacagucagcugcauguucagaagggacucuucuauucagcaccacggggcuuuugggcagccugagauccguaauccugggacccagggacucugcccuauggaaacggaaggacugcgcuuugcucucugggcuuuucugccugaagaaacuggugaaugaagacgcuccuuucccuccccucugggcugaguguucccucuucugcaacaagccucaggacagguugcuggagucacuuugcagagcccggucuuccagaggaguugcucacagcuucaggccaccauaauuuuccaggcuuuuuucugagcagagucugggggaggaugaagggacagcuuagcgcagagccucuacccacacuucuggagcucaggaagccacccuguccccagaagacagcuguccugggaagccagcagggcuucuggaaguccccucuggaaaugccugauuugaggacgccaugccagcaucaggguuuccccagguaccuaagggaccaucccacaacccaguguuuuugcuuucagaagauagaaaugaggccuguuggucacugcuggcaugaacacaucagaacugccucacacugucaagagcuauuagagcccuuuaggauccauagucuaucgagaaggugccuggacaccuaaaaagaaaagaaagugaggugucagagaaagcaggugcaagucggaggcuccuguccagguggcuguuugcugcucggaggaugugggagaggcauggcccuguuggaggaaggggagggaagggguauccugugggggaauggggugagcaaaggcuggugccuggaaaauggaggguugcagagcugggagugagaggaaggggcuggguggggacccuccugagauagguggugagagagagaagagggcagaacaccccuccuccccucagcacugggggcuccucauggucgccacaugcaugucugcucgguuuguaccaggaaugugcuggggccacaggucaguggagacccaggccagggaaggcccuguggcggguccaagcccuuccuguguauucacguucccgggagaacucuggacuucccuguaauuucugggccccuuuuucuuuugugaugagaacaucaggguaggugccacacccagcaucuaugugaguggccuuguccuggaaaagguuucugugccaaacacacuugcccugccuuuuaagaccgacuuugaacagaacacagaggugaccaccuuaauuuucagcgacaccugaacuuguuuucuaugggguuuugccuuuuuucugaacaaacguuugacugagccaagcaugauggaguugugcauaucugugugugugugcgugucugugcguuggugagcggacacgcgcugucugcaccugcgugcaugcggcacacaugucugugcgugggugaguggacacgugcugugugcaccugcaugcguguggcacacgugugugcaugggugagcggauacgcacugugugcgccugcaugcguguggcacacaugucugugcgugggugagcagacgcgcugugugcaccugcaugcguguggcacacgugugugcgugggugagcggauacgcgcuguaugcaccugcgugcaugcagcacacgucugugcgugggugagcggauacgcgcugugugcgccugcaugcguguggcacacgucugugcgugggugagcggauaugcagugugcgccugcaugcguguggcacacgugugugcgugggugagcggauacgcgcugugugccccugcgugcaugcagcacacaugucugugcgugggugaguggacaugcgcugugugcaccugcaugcauguggcacacacacacaagucccugcuugugguuguuuccuccuuggcuuucaaggcauguaccaacugacuccagaguugggcagauuugcuauucacggucugauaaagagguguaggcugggggcagauuugggaggucaugguuuuugggggaggugguggugagagggaugggguggggaaaugaguguggauaauggggcccgggugccgagccugccucuuacucccuuuacucuguuucuugauuccaagccuccauucggagaagaaaagggggugagucaucugccuguguccccagggccuuggcuuugccugaccccugucugggggagugcuggugugugaggagguuccagcgcaagucaggguggccuggaagccugggcugcacccuccuguuggccuucucccugggcaucugguaggggcaugagagaagggccugcaaggauggauggggaguucccaggggugugacccucugagacugugauggccuugggggcucaggugagccuggggccugugagcugugcagauagccugauggaggcagcccguggggaggagcugggagagccccguggaggccacugcaugcaccauggcccggacagcaggagggaaagggcuccgagggucccagagggggagcucuagggagcagggagacugggccguguuggcgugcacguugcuucuuucugcugguccucucggggccugugcuuggguugugggaccuacucccgugcugguugguuguagggccaagcccagagcugauggucccuucagagcaggggucugagucccacagcacuggggaaggagcuuggagcuccccuggccaaagaccccaggcuguugacuacccuccugaacccccguucaggccucccucuacccuuuggggcugcucccuguauguccuuuauguucagccugguugcaggggagggcgcauucagguggggacagucaccugggccuggguacugagguccacugucuggugaaguccugggacccggcuuccggcagccuccucugccucucggguggaugggaaucagggcccagacagaggcuugagguggcuuucuccacccaggccuguauauuugcuccacguccguguaccugaugcccaucccucccucucucucgacccacugggcuuucccugggugaggacacaucugccaggcccuuggcccagcccucuugagguccccuugcugccucuugccccagcccaggugaagggcuuccccagugucuucucagguauuaaaaacaggugacaaggucuccuccagugaccuuuucugcaugccuuuggggcagacauacaagcuauuucuggaaucuucuggcucugcccucuagcucguuaguggggcucccagggugcuguguugcagcccaggugcugcuccaguuguggaagaagugauggcugguugaucaucccgcaggcuggggcccuguugaucaaacagcugcaaacccagcuguguccugcugugcacccagagggcccugggagugagcggguccacuugguuccugaugggcuuuguuucccuuaauuaucuaaaauuauuuauuuaagaauauauccucuaauauuggggggagauuuaugucaaccucaucaguuuguaauuugcagaauucuugaugaauccuuucccuuuugaaaacacuucucacccggcuccagcaccaucgccggaugaccagaaacagcugcucacuaaacguuaugugcgucccgcugugggucucugggaugggucuuccagaccuagagagacagccucuccuagcccguggcucaggcggcaacgugucucccaugaugcugagccgugugugccucacggaguuuucucuccauucauaucuuuacuucugcaguuuccggggaguauggugcuuaagucucaucucuuacuuccuagucagagauuuauggcaauuucgcuucaguuugcuccuggguuggauaagggugaugauaaaauccucguguaguugugggaugagaggagugguuugcauaaagucccgcauacucuagaaaucaccaagaacuuaacagaugguggcaauggugacuucaacucccaaaaagaaaucauucacuucaugacaaaagcaaaugagaaguccccucaaaccagcagccccuggucuguaccugggccccugucaccugguggcacugggagcugugcacaggcccagauaucugcaguuggagccuguuuugcugguaaacucuuguaucguucaggacacaggcugggcgcugauggaacacagagaacaguauuugcucuguucugcagacccggaagcugucuggggagauggggcacacagacaugaauuguacugaauuguguccagugccagcacaguuguaagccuuucuucugugcuaauucucacuagagacacgugagcgagcacuguuuuuaugccuguuuuaucaaugaggacacagaggucacaaagagguuaugucaggacagagucaguguacagggugggucuggucuggguuggguacaggacagucuuggggaguuccuuccuuccagcaaugcuaagcuuggggaguuccuuccuuccuuccagcaaugcuaagcagauugcagagguagaaucagcaggugcugugaacagcugcagauuggaguuggaaggaguaggagguguccagucugaccguugaaauucuccaacaaggggccaagacaagagugaaaggugccaagacaaguguggccagacaguggucccucuaggguuggcauagccccaaagaguggagaagggcuugggguugggugcagccugagugauggguggggugcaguggggcugcugaaugagagggccggugcagcagccagguggacaugagugcugccccagcccuugcugcaugcugcacgcacugguccucaguggacccacagggggcgagagcugcuuauguccugggggagccauccaaccagggcucugaugguccugagauacacguauuaguuuaacaguuuccaagucacuuugaucuucuguggaaaccugcuuguacaucagggucuguccucgggcugugacccgcugugaacagcuucccuuccagugcgguacagauagccaagaguggccuguaugugcugagaacagugacaggacgaagggaaauggagggaaauccagggagacuguggucucugaaucguuugucuguccugugcccuggucuucucccucauggucagaguggccuuuccuuaagugagguccacagggucaccuggagucuccuugaggcuagagaggcugccugggguggggucugaguucuggggugagggccuugucuugggagccuggggugggagcucaaggagggaggggagcgguggccucugucagcaucacggguggccggguuggggaggacauggcaguggggcaggagguggcccaggcagcugagauggagccuccuugcugugcagagaagcuggacgagaugcuggcagccgccgcagagccaacgcugcggccagacaucgcagacgcagacuccagagccgccaccgucaaacagaggcccaccagucggaggaucacacccgccgagauuagcguaagggccacgggcggcugggagcgcugggucgggcaggcaugggggucagacuguccugggcccucuugacggaggugagagccuaucauguggaccccucuccagaggggugugugcaccccauggccucucucagagacucuuggggcugucucugcccccuaaauggccacagcucagcaccugcuggguuugcucuuguagcuuuuggugccucugccuucaggcagucccugucucacgccugagaccaccaagguaccccagcuccgcugagaacacgacaaagcaugucucuguucccugcccacuugccaacccggcgccuucuaggcuccucccccacccucacccagggucggccagggucugcacccacccugcccaacaccgucuacacuguaccaccaucugcacugcccacacagcccaggcuccaaugggcugcauccucugcucccugagggcagaguccagacgugauuccuggguccaggcacccacaggcacuagugccauuggagugagagcguggggugucucaccucuggcuuaggaggaggacugggggcccccagugcccuggaaccuccauauuccccucccugacccccacagucauuguuugaacgccagggccucccaggcccagagaagcugccgggcuccuugcggaaggggauuccacggaccaagucuguagguauggcugcgcuguggggcugcaugggguggggaggaacggggcuggggccggcaggguggacuuggguuugaaggacacugccucucucugcccauaacugggguuuccaguuucccucucaguccugucucuuccuggccccagcuaaaggaucucauacguugauggacauguggggauuaggccuuccccaacccagagcuuucccccggcagccgacacucccuguccagugggcaccgccccccaucgccucaucccucccaugggcagucucaucccuguccccagcugccacucccuguccacugggcacccccaccuccccaucaccucucaucccucccaugggcagccucaucccuguccccagcugccacucccuguccacugggcacccccaccuccccaucaccucucauccuucccaugggcagccucaucccuguccccagcucagcugccuccaucgcgguugcucccuugcagcccaagugcaugugaaguuucugacccucaaacccccugaacuugccucuccccuacuucuccauguauugcugucuccccccuucacagccaguuuuccccaaaaagucaccucuacuguccaucuugucucccgucccccaccggcuccucagccugcggcagacuuccucucuccauacccaaauugaaacugcucccaccagggucaccggcggccuccagggccuuccuccccauggaugcauggccagcacuccugcugaccucagcuggcauuugguuucuuugcuccuucuuccgugaaacgcuccuccccaaagcuuuaggacaacacuuacugguuuuccccuccuuucucagauggcaccuauuucaacccugccgccccagccucccaaauaugggaccuuuucaaggcugugucuucagccuccuuccccucugugccucaccacuccccagccaccaucacacuccacacucaccgucuccuuuccugacccagauggggacauguaacaagcccugcccacugugcaucccuccagacauccacucucccguccccugcccaccugugcaucuguccacccacacaccugcccacuugaccguccguuguccauacaaaccccagcacaccucccaucuguuacacauaggaguaaaccucucagcacuuacuacgggcuggacacugagcauuuaauacuuagaauaaccauauugagguugagaccacuaguaccuccauuuuacagaugagaaaacugaagcaaggaggguaaaugaccugcccaagaucacacagcugcccaaacucggauuccucaccugccucaggacccugccaauuuguguucacacaaggccgauccugggccaagucuggggcuugguuagggaaugugacgugugcagagagcucagcgggcacauugugggugccagggcucacggaccaauggagcccacuggggggcuccaagcacaccuggugucacagaaggcugugugugucgggguggggguacuuuugagcuaagaugugcaagauaaaugggaguuucugggcgauaauggggugaacugacagagcaguguggaaaaggcauaugggugugugaccuggucccucagagacugccaagaguuauuucuguaggugggauuguggggaagaaggcuggugaggcugcagcuacuuuggagcugagaagcgcucuccccugcucucccuggccuaaacacugagugucuuccaugguuucuuucuuauccucugccucaccugaugugucgggguggguggccucacagcccugcccugcacaggucucaucaccuugcagcuggaccauggcuuuguucucaugacugccugcccuggcucugcccucugguccaucccucuggccaaaucaggcuuuccgcagagcugcuaucaccccauauccguccagcuugacccucugugcacuccucauugccucagggcccuggagaucggccccagugcucuccugcuucaucuggaaacauuugucucugccucccuugaccugggucuucugacucuugcuguuccugggcccgacccugcaggucuagguccaugcaccugcccugcaggccuugagccacucuccuaggacugccaguucugcacuggucccucaggcacccucuuguacucgguugauggauggguggacaggugcuccuuuuuggcuccucuuggccugcugggccucagcugccagcaugcacauugguuggguugucagacuccccaggccccugccccaugcccuggcucuguugcucugggcacacgaugcagcccuugaaacaucaggauuuugauccauaaacauggagaccaccuauuacccaccuccaaggaccacucugagucucccccgguagauggcacucacagaccgcguggcaugcugggagugcucagcagcugccaguguuaguagacguagaugcugccucuugagguuggcacacagugggugcucgagaaaugcucucugcuaugaccuaggcagacaaagagggucugccucugcccccaaggggucccacccccgccccagaugguaucagaacagauuccccauuccaugcugaggcaagugacuuuucuuuacccuaagucagaacuuggcaugcuauuagcauuaaguuuccccuuauuucaucuuugcacgucacucccgccuucugcauccucaaggugcgcucauucugcgucgcuccaucuaacacauaggcuguggguguucacugcguguucauacacagugcagggaaugcagcaggagacccaggacgaacugggcacaauuucucuguccagcgguuggggauggggggaaggcagaccuaaaaaucacgaugaugaugaccucggcccccuucccccauucccaggauacugcugcaguucagcccugcacuguaaaggugaaaucgccccacaauaguugcaggcuguccucuugacaugaggaaacugaaguuccuagaggcuucugaaguuccuggcagaucuaaaauucaagccuaggucuguacacaaaagcccacccuugguaccuuggcuacaaagagauauuaugcccagcaagaagcaguguaguacuggaggccucauuagcacugcgguggcuggaggaggaugcgaucaggaacaggcagucuguauuuuagcgaguucauaaaaauguugaccaaucucagagugaggcugggaacaggagcaccacgagaccuggguguguggguguggggccguccgcccccugcagccucacugaacacaccugcagcacguguguccgcaucaugauguccacagggguguucaggagguugugucagguucugcuggacagcaggagcaugagggcccugagcacuccagccccugcacaggacccuaacaaugaugucugagcaaggcaugcagagggggguuacugaagcucaaaggggcucagggccuggccuggggucacgcugccaguagggguuaaaaugaaacaugcugggugcucagccugcaguuccauuuugauugauccguccguucuucccuucacccacucacccaugcgggucucugggaggagccucucaaggcuuccuccacagggcaccuccuuaccugggugggcauuaggucuuucucugcuggaggccuggcuccaguggccacagcccugcugccccucacccugccagugugucacuccugcucauuuccgacuaucuuccucucaccucugguugccuccagggcugguacuucugcgucggccuuguugauucugggguggggagcccuguacuggccccuccaagccccucagcaguucuguccccaugucuugcggggcugucccugccuuucugggauaucuucucagggccugcuugaugacccuggguuugggcaggucuuggccccaacccaggccgucagaguuuguguccuuucucagggguccccgguggggcccuccuccauccuguaacugaacgcacaccucucuccuguccucuucacaagagcccuccccgugcagcccugggccuggggcacagagcuugggcauccagggaccagcccagaccagggucuugcucggagcccgggcucugggcucccuguuucuccccugcccuccauuccccgcccaccacgggucccaaccccaucuucccgagcauucuagcuccucgcgccggguucugccgcgggcguccauuguguccggacgguggcuuccccgggguggagucgggucaaggcuggccucugugggaggggguugccgggguccccaggaaccucuccgaaggcagcaccaccccccgcccagcgcccuggcuggucucaccggcccuuccguccgcaggggaggacgagaagcuggcgucccugcuggaagggcgcuucccgcggagcaccucgaugcaagacccggugcgcgagggucgcggcaucccgcccccgccgcagaccgcgccgccucccccgcccgcgcccuacuacuucgacucggggccgcccccggccuucucgccgccgcccccgccgggccgcgccuacgacacggugcgcuccagcuucaagcccggccuggaggcgcgccugggcgcgggcgcugccggccuguacgagccgggcgcggcccucggcccgcugccguaucccgagcggcagaagcgcgcgcgcuccaugaucauccugcaggacucggcgcccgagucgggcgacgccccucgacccccgcccgcggccaccccgcccgagcgacccaagcgccggccgcggccgcccggccccgacagccccuacgccaaccugggcgccuucagcgccagccucuucgcuccguccaagccgcagcgccgcaagagcccccuggugaagcagcugcagguggaggacgcgcaggagcgcgcggcccuggccgugggcagccccggucccggcggcggcagcuucgcccgcgagcccuccccgacccaccgcgguccgcgcccggguggccucgacuacggcgcgggcgauggcccggggcucgcguucggcggcccgggcccggccaaggaccggcggcuggaggagcggcgccgcuccacuguguuccuguccgugggggccaucgagggcagcgcccccggcgcggaucugccaucccuacagcccucccgcuccaucgacgagcgccuccuggggaccggccccaccgccggccgcgaccugcugcugcccuccccggugucugcccugaagccguuggucagcggcccgagccuggggcccucggguuccaccuucauccacccacucaccggcaaaccccuggaccccagcucaccccuggcccuugcccuggcugcccgagagcgagcucuggccucccaggcgcccucccggucccccacacccgugcacagucccgacgccgaccgccccggaccccuguuuguggauguacaggcccgggacccagagcgagggucccuggcuuccccggcuuucuccccacggagcccagccuggauuccugugccugcucgcagggaggcagagaaggucccccgggaggagcggaagucacccgaggacaagaaguccaugauccucagcguccuggacacaucccugcagcggccagcuggccucaucguugugcacgccaccagcaacgggcaggagcccagcaggcuggggggggccgaagaggagcgcccgggcaccccggaguuggccccggcccccaugcagucagcggcuguggcagagccccugcccagcccccgggcccagcccccugguggcaccccggcagacgccgggccaggccagggcagcucagaggaagagccagagcugguguuugcugugaaccugccaccugcccagcugucguccagcgaugaggagaccagggaggagcuggcccgaauuggguuggugccacccccugaagaguuugccaacgggguccugcuggccaccccacucgcuggcccgggccccucgcccaccacggugcccagcccggccucagggaagcccagcagugagccacccccugccccugagucugcagccgacucugggguggaggaggcugacacacgcagcuccagcgacccccaccuggagaccacaagcaccaucuccacgguguccagcauguccaccuugagcucggagagcggggaacucacugacacccacaccuccuucgcugacggacacacuuuucuacucgagaagccaccagugccucccaagcccaagcucaaguccccgcuggggaaggggccggugaccuucagggacccgcugcugaagcaguccucggacagcgagcucauggcccagcagcaccacgccgccucugccgggcuggccucugccgccgggccugcccgcccucgcuaccucuuccagagaagguccaagcuauggggggaccccguggagagccgggggcucccugggccugaagacgacaaaccaacugugaucagugagcucagcucccgccugcagcagcugaacaaggacacgcguucccugggggaggaaccaguugguggccugggcagccugcuggacccugccaagaagucgcccaucgcagcagcucggugagcagggcggugcggggagggauccgugccuuguccguggccccgucugucauuccucuugucuguucucuggcucuccuguuccuccuuguucuguuccauuccuucuguggcaacccccaacccgcccccgccauccaccucugaauccggucuugcuuggccugcccgagagaggagguucuucugggcgucugacacgucaggguugcugcucacugugucccuguuggugccagaagugggagcugggcuccccucagagacucagguugggcaugaggcgccuccauggcccuccuggaggcucuuggccccagggauuccugugaguucucucucucccucccgacacaggcugucuuuaccauuaaggguuguuuuguguuuuacuuuggagguacgccucccuccucccauccucucuguggccauguggcugcccaguguggcugauacccucugccuuacagcugccuccugccuugcuuccucuggcggcuuggagcacacugacuccuuuucuuuugggggaucugccacuaacucccuauuucccaucccagaaacauuugucucuuggcaccaccuuagaaucccuuaaacauggauucccgugugucauuucuaaagugcaguaagaagauagauggaagucacgccaucucccugcacuccaucugcccucuugccuucuccccaccacuuccccgucuguccugccccugcccagaaggaucugagcaggggccuggcuugcugcugaggcugucacagcugccagagcccugggcugaucccauaggucuuuccuugaggacccgacucccaaggcuccuuccaaagaggagcccuucgggcccgugggcugcauggaugcuggcggcagagcuggucaucccccacccgcccccuugucugccuuuuuaaagcugcuuuugccuucugugccccuaggucuccccucuccucuuugggucugggggggugguauguggaugccaccucuugacuccugcuucuugcugccuggaagaccaaccuagugggccccguacugucagccuuggaggacagaguucacagcguagcaacguguucagaacuuaaggacuuugcaggucuuacaaaggccuggccauucuaccuucuuuaguucaggauucaaaagacagguaggagcuugggaagcucaugaggccucuccuaaggucccgggaugcugccuccagcuccugucauccuggggaauugcucugggguccucuccccuuuuagccuuuuccaacucucagccaaacuggaaagcccucuucccagcagugcaguguugaaggugcccguagaauggguguuauaaucagagugagcagccugguccuaggccucuguacaggaccagaccccugaggcuggggucuccugacccacaccugaccagcccccaucuucccucucugcuucucccuccgcucuucucugccucuuggucuugaugaaaaucaaagccauuuuaaaaagugcauagcacagugccuggccugguucgggcccucaauaaacauuucuuaaauggaugaaagaacaaagcaaaaugcaaaugcuguguuuugugauuugagaucuagggagguggcuuaggacaaaaacccacagaaggacuuacucagcguucagacucaucaggugucgaucccccauggucgggcucaggugggcccaggucucgucauuggcucuguccucuccugugaggcagcugcagcaguugcagggcagggucaggggauuccucagccggaaccucuggcacuuccccuucucugaguucauccucccacggugcucuuuagcauucugucuugaucaggguacgguucucuuagcccuuggcucuggcuuucaccaggacccuguuuguuuuucuuucucagaugugggauggggaaggacaagaccagcagcccugacccuuacgugacgucuguucuuuuacucaguaguuccugcaaaauucugaucucugauuggguucauguggguccucugcuuuucccugacugaucacuggggucuggggacauagggcugucaucggccaagcuugaguccucuguucucccaggagccagggggauggguccgcccaccuagcaagcaggugcugagagugaggggagggggcucuccagauggaaguccagugcugucccuugaguaaguagaugcuggacagccuguagcaaccaauguucugugacacggcccccacuggcaucagcaacucacuuccuugccggucauuggcuuggagccaucagagggcccugaugucggugcucaggaggucacagcuuagugcuguaucccuccccugugaaguguauuuacagcgagccaacugcacaggcuaucgcgaggcugcacacggcaucaccugugaagcaccugguaggcccagggcuggggccuguggaccccucacuggugugagcugccauugucuuugcugucacugacgacaccuaggugaggucuuagaguccuuugugggaaaacaagccuguuggaugcagcacuggagacgguccugccguaucaguuugucuucacaccguucuguuagacggacacuaacagaauccucauguuccagacaaugaaacugagguaccagagagcuuccuugcagacagaaaacgguggucugccugaccaugagcccugcucucuggcugccguaaccagggccgcuguuguuaagccccuucugaugacacacaaugggcuuuugcccaguaacgccccuccacagaaguggcaggugugugcauggcacagacucacccccgcuguuuacuggucauguuugucauaaguagcaccuggugccaccugaguggccuacccgggccugcuuuuccuucucaguuugccucuguguuaccuucuguuccagcucacucuuccuuucacccucuugcgcuccuucucgcccucagaccugggcugaacuacagccaucuggaggggccccugcccacccugggcccuuaacuuccggugcuucuggcugcaggcagcggagcggagcacaggacacuuggugaugucugaguccaguccuguuucagaucugguccuugugugcccaccguggcuguugucagcucuuguccugcggccccuaauggcuggaguccgguacucacugcucacuuagggauaaaacugcugguggaacugccuaaagugugggagguucugacauccagguauggcugcuuccuucccagggccagucguggcagaggcgcuaggucacccucagggccauacccugagcugugucuccagccccuuguguuccacaguguuugucucccaggcccauccuucuccucccugaccgacaccaugaggaagggaaugcccacccaccuuuuccagagauggcucauuccugaugugcuuuagccacaagguguucuguggccugagagcuuucuggacaaguuaagcuguccuguaugucguggaaccaaagcucgguaaccuguggaaaaaugaugagcucuggggccaccuuugauuuucaggggaaccuggaggauguggcacucucaugcugccucuggaagguccaggaccuucggccuuuugaauccucgaucccagauuguccaccugcucugugcucccagcuccaagucuagcucugcuggacagaccauucaucugcccagagccccuccucggucucugggccccacaccugacucugaggcuacauuugggcaugauucagaccugacuccgagccccacaacuggccacaggcaccccaucugucugaggcucucacuugucucugagacccuggcuucacaccuggcucuaaacuccauuugucuuccaggccccgugcucggaucugaaucccauguggggucugagguccauaguaaggcucacgucugccuuggcacuuagcuuuacaugggacucucacaucugguuuuguagguaaaguucauggcaaaguagcuuuggaaacacaaaaagagguucuuugcugcaguacuucuggugccuuugacaagcuuguguggaggagggcacugugugccguggucuccagaccugcuagagucaguuccuaggucucccagaagacccauguuccucaaaauggucaagaagcccugcccugguggccugcugcagacccugccugcuaauauauuugucagggcucuggacaaagcacugugugcuugguggaucacacugguaagcagggccaaggccagcagggccugcucuuuugaaacccagacugaaugugucacauaccugccagugggggccccugcaggccacaugcagcuggggcagguguguucccaggaucccugaacccuguucggggaguaggaaggagguacagaggaggggucauaggacacuggggcccaucagagcuggagcugggaacaggcggggugccgaggagcaagacguguuaccgcagaggaugcacuggaagcuuccgagcccaugucugguuuugugcuccucugagaauuaguucccuuaaugaggccccuaguuugcaaaaggccacaggccuagaccggccccacgugagugcaguggcagaaggcccgaggcaguaucccgggcccgaguguggacauuuuccugccuguuggcccuagugggcugacugaguugggcacgccuggcagggacaugucauacauacuauuuuugcauuuuguuagugcaucucguauuccuggcuuugugcuagguaccaggaggcaaggagaacugguaagaaguggggugaagggccugagaccaugaacggucuggauccagaaauggcaagggguaaagagaaggucuggguugauauuaggaguuagccauuggcuguaggguaaaaagaggagcugaugguggcucccaggcucuguguguggcaaugacagggugccguucacugaguuggggauggagggacauguguggauaccccaguagagguguuggacucaucagaggcugucugggucucacauguagcauuccugggcacacuggccauagcaaagggugugaguggauaauguugcccaggagaaacugcaaacuaagaggggagcucuccgaaaauccaucuaggaaggaagaggccugggaaagaaugucucgaagggaaacaugaacaggucagcagcggggucuugcugaccgccuggccaacuguggggcagagggcggaguggggaggguguggcaaggccagaccucucucacuggcugagagucacugggaaacagugagacggugcaggauucaaauguagguggaaagacguggggccgugggggccucagugugaucuggacucagccucuucagcguggcugcuggagguguucgugggugacggugccuggugaaguaucauguguuagaggguggguggcccagaagcucucugggaggcuggcaggugcugugauguggcuguuuggcggccggagccuggccagggagguggccagacggcugagagugacagugggugugcagagaggccauggaaacauggaagucagacauggacacugcucggguuugugcccuggggauggugugggcaguacccucuuccccaagagaaagaggagaagcagacaccugggccaugggugaccccaggccccucccuccugugcccuggggccuuuggcaggcacagccuuccuugggcguuuucucuuggccuccugacaucuccagcaugcucugggaggcgggagcaaugugaauggcucuccucacaucucuugcccucgggccccuggcuccgugggugccucuggagccagccugcccucugcccaggucuccagcucagccccugccaguacuacccagacaggcacaacucugcucugcccagcucggaccuccuggagcccagacccugcucugggcuccggccgagccuccuggcugcgcugcccgcgccugcccugugccucugccuucacugcugugguccugcaacucaucagugugcuucagucacaccugagacuccagguacaccugccaucacaacuccacugaaagcuaagccuuggggcaggggcagggccaggguagguguccauccugugauacagguccccaggccagggccacuuuguuggggcugguggguggaggccaggugcauauuccugguccugccccucucuggguguccacagucaggucccucugagugauucucucggagucuccucuggcaagccccuccagcagucaccaccaccugggcacccacccccaggggaccccccgacccaacaccaccuggcaccuccccuugggaauccccccaaccuuggcugccuccccacuuuggcccacugugcagguggauccauggaggccagguccaaugggagcaaagacagcuuauucuggugguuggugccugugcugaggcccaccucagguguucuugaagccccuuucuguuugggggcacaguguggccucuucaggaaguucugcucuggaucugagcagcugggaggaggcaguagggacagaggcugaggagaggacagaaaugaggucccaugggagagacagagcucagaucuccacagagggcugaccucucacaggugggagacaaaagacgaaaccugcuuuaaggggagccccaugcguguguggggcaggcacuggugaugcuguguggugaggacagccuuuaaggggagccccaugccuguauggggcagggacuggugaugcuguguggugaggacagcacagagguugggguggggggacucagccugggcaggggcagggagagggggugggagggccacuggagaggggcccggccaaagaggaugucaggggcucagcacccccaggcggccaggcaccugccgagcacugcagccacgcuugugguucaccugcacuuggagacucucgcacaggcgccucuccuccaccagcagcuccagcuuugucccucccacagcagcugggcccucugcaccugaguuccucccuccacaccuggcugcccauugugugguugcagcugugggucgcgugggccuggccggcuaacucucucucucauugcucucuccugcccaucugcauguggcugcucugucgagcugcgccguggucccgagcgccggcuguguaagugagcaugcccaucccaugccucuugccguccacacgcugugccugucugccugggucucugcucugcguggcugugagaggcucuggugccacugacagccccuugaggcuuccccugacacaguggggauagggaugggaaugggaggacaugggaguggguuuucucuggagcuaucaccccagguaggccucccaccacggcagagccaaggaggggcuagagcucuaggguccugucaggugaggcugggaagugagcugccaucgguucuugugugugugcgugcgugcaugugugcguguugcgugucugcgugugugugcugcugccaccgcagcaugucuguaacgcgugugggcaccguugcugcuguugugugccgucugugcaggaggcugccuuuguguugagggugugcacggccucacaccugcccugcaugugcugcugcuccauacggguacgagcccugccuagugucugucuccugugucacggaccuguucaaccucgugcugcugccagccuuuaucgcgacucagcugucccuggaaccugcccaggauccccugggucuucucaugagagcagagcuguguggggggugggcggugaaggguacugcccaagucucagcgucccggguaucuguggaucccgccaugcccagagccggugucggaggcuggcaggagggagaagcccgcccuuugccaugagaggcugucuuuucuuugguugggcugcacuuggagccuggauggaguggagggggccaccagucauuccucauauuccagccagucgcuggcucuggucccaggggccaaagaaaagggccaggguaaccguaggaucccacccuuuauuucuuccucuggccgggcuacucccgccagccgcagccccagcccguuuccuccuggacccugcccgcuccccuccgcccguccccccuuggcugugcgccccucaccuggcgcugaccccucucccuccgcaggcucuucagcagccucggugagcugagcuccauuucagcgcagcgcagccccgggggcccgggcggcggggccucguacucggugaggcccaguggccgcuaccccguggcgagacgcgccccgagcccggugaagcccgcgucgcuggagcggguggaggggcugggggcgggcgcggggggcgcagggcggcccuucggccucacgccccccaccauccucaagucguccagccucuccaucccgcacgagcccaaggaggugcgcuucguggugcgcagcgugagcgcgcgcagucgcucccccucgccgucgccgcugcccucgcccgcguccggccccggccccggcgcccccggcccacgccgacccuuccagcagaagccgcugcagcucuggagcaaguucgacgugggcgacuggcuggagagcauccaccuaggcgagcaccgcgaccgcuucgaggaccaugagauagaaggcgcgcaccuacccgcgcuuaccaaggacgacuucguggagcugggcgucacgcgcgugggccaccgcaugaacaucgagcgcgcgcucaggcagcuggacggcagcugacgccccacccccacucccgccccggccgugcccugccggcagggccccccacccccaccccgggccgcgggcucggccugccccuuacgacggcgcccgggccaggaauguugcaugaaucguccuguuugcuguugcucggagacucgcccuguacauugcuuagugcccucaccggccgcccagcccacccagcgcacagucaggaagggcguggaccagggaggcuggggcgggaggugccggggguggggugcccuagcgugaccaccuccuucgcagcuccugguggccauucucccagagggggaaccuaguccagcaugcgaggucaggacccgccuuggugacucggggggaggggggagacauugggauucucgaugggggccaaggagccccccuguuuugcauauuuuaauccacucuauauuuggaacgagaaaaggaacaaauaucucuguccguaauaguuuccucuccccucccuucuacuuccacuggucccacugcagcugcccagucuuccaucuccggccccucacugccacugccaccccacaacggggcaggggacgcuccagcuggucugggguuggccagggcccuaguggcccgcccuggggccccagcucggccccucgccucgcugagcucuagugugccccaccgacccuucaggugcugcucguggugggaggggcggcaggccgcggguccugcugugcacccgcgggaccagccggccugggagaccaucggccgggggggaugagggcagggcccugccgcuccaccgcagccaucuuccucacagggucucuccccaaggagggggcuagcuugguccccaugcucuugggcaacuacagcagagaagccucccugccuuggaccccaaagucuccuguccugcccuuuaugugugugggugaaacugggugcgucugagcacgugggagccgugugugugccugauuacugaguggccaccaggggccgcucuggacuagcgcggggccguggaggcgugcaccgugugcaugcgugggguguaccugugagagcacccugucuccucuuccaaagaaagucagaggccauccugcacccuggguccagcuguuugcccagccuguccuuccagagccucacccagccugagcgggguucccuggugaaucccugcugcuuggggaggccccaagggccccuuggaggcagcgcccccaccuugggcuucugagggcaucauagggggaccccuagagucaguucaccacaggcccuggggagagucaaagacccccgagggugcccagccccccacacugugacuccucacacucagcgaugaccugugggguggggggcccugggacguuuuuaaaccuaggguuuggagucuggacuaagcuccauccacgucacucacaaguuucuguuuauauuucuagcuuuuuuuaauaaaauaaaaaaaaaaagaaaacagaaguuuucacaacccaggggccuggcacgccggucugugccugcccgccccgcccuggcccaccggccccacucccugggcacagagucacacccacucauccuuccgccaacaguccaggucacacagcagcagucacuguaacagacugccacauacacacucggucucacacucaccuguggguuuugguuccguucaauuuggguuuuuaacuuuacagggucaguuccgcuucaccuccuuuuguauggaguuccauccgggggguuucacccccugcuccaguccugaggccuccugacccugacguugugauacgccccacagagaucuauguuucuuauauuauuauuauugauaauaauuauuauaauauuauuauguaauaaauuuauaagaaaugaa

SEQ ID NO: 6349 - RNA, 5420 nt, Homo sapiens
cacaggucacggggcggggccgaggcggaagcgcccgcagcccgguaccggcuccuccugggcucccucuagcgccuuccccccggcccgacuccgcuggucagcgccaagugacuuacgcccccgacccugagcccggaccgcuaggcgaggaggaucagaucuccgcucgagaaucugaaggugcccugguccuggaggaguuccgucccagcccgcggucucccgguacugucgggccccggcccucuggagcuucaggaggcggccgucagggucggggaguauuuggguccggggucucagggaagggcggcgccugggucugcgguaucggaaagagccugcuggagccaaguagcccucccucucuugggacagaccccucggucccauguccaugggggcaccgcggucccuccuccuggcccuggcugcuggccuggccguugcccguccgcccaacaucgugcugaucuuugccgacgaccucggcuauggggaccugggcugcuaugggcaccccagcucuaccacucccaaccuggaccagcuggcggcgggagggcugcgguucacagacuucuacgugccugugucucugugcacacccucuagguaaagagggggccgcgccucuuccccgccccgacccuccaucccuuuccucccaauggauugcaggggggcgggaaaaacgucugucucucucucuagggaaggccacauuucugucugucucagggacucugugacuugucccgcagggccgcccuccugaccggccggcucccgguucggaugggcauguacccuggcguccuggugcccagcucccgggggggccugccccuggaggaggugaccguggccgaaguccuggcugcccgaggcuaccucacaggaauggccggcaaguggcaccuugggguggggccugagggggccuuccugcccccccaucagggcuuccaucgauuucuaggcaucccguacucccacgaccagguaggaaccacccgggcccucagccacccucccaccucccaaagucccccagcccuugaugcucccgcagccccaccugccagcccagcccucacggcagcugcccgccucagggccccugccagaaccugaccugcuucccgccggccacuccuugcgacgguggcugugaccagggccugguccccaucccacuguuggccaaccuguccguggaggcgcagccccccuggcugcccggacuagaggcccgcuacauggcuuucgcccaugaccucauggccgacgcccagcgccaggaucgccccuucuuccuguacuaugccucucacguaagugaucuuggcccaacccccuggcugcccgugaccccuacccagugcuaacuccagucuuugcccccagcacacccacuacccucaguucagugggcagagcuuugcagagcguucaggccgcgggccauuuggggacucccugauggagcuggaugcagcuguggggacccugaugacagccauaggggaccuggggcugcuugaagagacgcuggucaucuucacugcagacaauggguaugccagcagggcagcugggugcuccggcccugucacgggccagggcccuggaggccuugcaguucagcugcuugccaagaacauagugggugagggggugccaggagaugcuggccacguugcaggggcccaagguguagucaggagacacagugcacagagagcuggucuugguaggccugggaggugccgggcucaugcugggcaccuccgggcaagcuuugugacuuagagguguggggccacuggucacccucgguggcucagaggcuguggcuccauggcucaugagcgccuccugugucccagaccugagaccaugcguaugucccgaggcggcugcuccggucucuugcgguguggaaagggaacgaccuacgagggcgguguccgagagccugccuuggccuucuggccaggucauaucgcucccggucaguccgcaggcccucuccuuggaacccuggccccaccaccccaaccuugauggcgaacugagugacugaccagccuccugcccccaggcgugacccacgagcuggccagcucccuggaccugcugccuacccuggcagcccuggcuggggccccacugcccaaugucaccuuggauggcuuugaccucagcccccugcugcugggcacaggcaagguagggccggugaccccugaucccagauccuuggccccuguccuggccuuccccuggggugagugugggcagugccugagagucugugccucagugccuccugcacugaguggcauccaaguggcgccaccucucagguuccugggugggcaagaagcggugcacguccagggccucccaccagggcuggcagccccagguaugugcagugcuuggggccugccccgccccgugaccccugacucugcccccagagcccucggcagucucucuucuucuacccguccuacccagacgagguccgugggguuuuugcugugcggacuggaaaguacaaggcucacuucuucacccaggguaaccccuccccguggaucccuccccccgaccugcugaccccuccccggagcccuagaucccuggccccuccucucgcccuugcccugugcacagaauuggcccccuccccaggcucugcccacagugauaccacugcagacccugccugccacgccuccagcucucugacugcucaugagcccccgcugcucuaugaccuguccaaggacccuggugagaacuacaaccugcugggggguguggccggggccaccccagaggugcugcaagcccugaaacagcuucagcugcucaaggcccaguuagacgcagcugugaccuucggccccagccagguggcccggggcgaggaccccgcccugcagaucugcugucauccuggcugcaccccccgcccagcuugcugccauugcccagauccccaugccugagggccccucggcuggccugggcaugugauggcuccucacugggagccugugggggaggcucaggugucuggaggggguuugugccugauaacguaauaacaccaguggagacuugcagaugugacaauucguccaauccugggguaaugcugugugcuggugccgguccccugugguacgaaugaggaaacugaggugcagagagguucaggacuuguacaagaucacccagccagaaagagguugggcugggauuugaacccuggugucguggcucuggaagcugcccuggcgccuuggugaucugcgugggucagugcacacaggcacacgucagccucaaggacaugggcacaucuguucacaggagcagcgccacgugccuuugagugccaggaacggggugggagggugggagggugugagggccagaagacucagaagaugcaaagugccugagagagacgggauauucccccagaagaagcauucuuagagacacaggcacuggaccuccuugguucuuauaagaaaccugucugaagcugggugaugaguugcacacuccagguggggcuaaggggccuggagccccugcuggcuccuaggaaggcacagcagcaggcccugagacggcuccucuggggccccuccacccucccaggccucugcauuucaccugugcccacacuucugucuccugccuucaccuuuugacccacuacuaacgauucuccacccagcagacaaagugaucucuuaaaaauaucuguuggcugggcacgguggcucacgccuguaaucccagcacuuuaggaagccgaggcggguggaucaccugaggucgggaguucgagaccagccugaccaacauggagaaaccccaucucuacuaaaaauacaaaauuagccagguguaguggugcaucccuguaaucccagcuacuugggagucugaggcuggagaaucacuugaaccugggaggcggugguugcagugagccgagaucgcaccauugcacuccagccugggcaacaagagaaaaacucugucucaaaaaacaaaaaaucuguuaggcugcacacggcgauucacuccuguauucccagugcuuugggaggcugaggugagaggaugccugaggccaggaauucagaccagccugggcaacauagugagaccccagcucuaaagauuuguuuuuguuuuuuuuuuuuuuuuuuuuuuuuuuuuuuuuuuuuuuuugagacggagucucgcucugucgcccaggcuagagugcagugguaccaucuccgcucacugcaaccuccgccucccggguuccagggauucuccugccucagccucccuaguagcuggaacuacaggugugugcugccaugcccagcuaauuuuuuuuuauuuaauagagacaagauuucaccauguuggccaggcuggucucaaacuccugaccucaggugauccacccgccucagccucccaaagugcugggauuacaggugugaaccaccacaccuggccaacaauauuuguuuuaauuagccaggcgugguagcauuuguccuagcaauuugggagguugaggugggagaaucacuucagcccacuaggucgaggcuguagugagcuauaauuguaccacugcacuccagccucggggacagagugagacccugucugcaaauaaacaaauaaaacaucaggcugggcuugagcaucuauuccugcucaaaauuucgcaggcuucucagaagaaaauccaaaccccuuacagugacccaguuugcccuugaggccuccacccacacccccuuccccccagucuuaggggguggccuggcuguucccuucaacggcaacgcucugccuccauuguuggccuccucugcagggagggacugucugagcaccugcccgugucugugcagcauggcacacugacgucaggcccacgugcaugcccagguggccagucacacgccaggugcucccucaguguuggccaagugagaggagcacaccuuccgggcguucagacaccuccccguggcagacaccguucguugcuaccaaacagccaccuccuuccuaaugggcucccauuuuucagugcugggcaaaggucccuugaucuuggaguugcagccucuuucucuccaaggagggcggugaccagccugagccagucaauccagugauugguucaggaguagccugugaccaggaguccugguagugaacgacuggggcagcccugggggugaggaccuugcgcagccgucacaggcccugauuggacacugggcagcugcuaacccagugucuccagcugccuaccuggagagcuccaagcguaagaaaauaaacccugccuguugaagcca

SEQ ID NO: 6350 - RNA, 5420 nt, Homo sapiens; identical to SEQ ID NO: 6349

SEQ ID NO: 6351 - RNA, 5420 nt, Homo sapiens; identical to SEQ ID NO: 6349

SEQ ID NO: 6352 - RNA, 5420 nt, Homo sapiens; identical to SEQ ID NO: 6349

SEQ ID NO: 6353 - RNA, 5420 nt, Homo sapiens; identical to SEQ ID NO: 6349

SEQ ID NO: 6354 - RNA, 18 nt, Artificial Sequence
  Description of Artificial Sequence: Synthetic oligonucleotide
guauccgcugagggaaua

SEQ ID NO: 6355 - RNA, 18 nt, Artificial Sequence
  Description of Artificial Sequence: Synthetic oligonucleotide
guguaguauccgcugagg

SEQ ID NO: 6356 - RNA, 18 nt, Artificial Sequence
  Description of Artificial Sequence: Synthetic oligonucleotide
gauggguguaguauccgc

SEQ ID NO: 6357 - RNA, 18 nt, Artificial Sequence
  Description of Artificial Sequence: Synthetic oligonucleotide
aaauggauggguguagua

SEQ ID NO: 6358 - RNA, 18 nt, Artificial Sequence
  Description of Artificial Sequence: Synthetic oligonucleotide
ccuugaaauggaugggug

SEQ ID NO: 6359 - RNA, 18 nt, Artificial Sequence
  Description of Artificial Sequence: Synthetic oligonucleotide
cauagccuugaaauggau

SEQ ID NO: 6360 - RNA, 18 nt, Artificial Sequence
  Description of Artificial Sequence: Synthetic oligonucleotide
gugcucauagccuugaaa

SEQ ID NO: 6361 - RNA, 18 nt, Artificial Sequence
  Description of Artificial Sequence: Synthetic oligonucleotide
ugucugugcucauagccu

SEQ ID NO: 6362 - RNA, 18 nt, Artificial Sequence
  Description of Artificial Sequence: Synthetic oligonucleotide
ugagcugucugugcucau

SEQ ID NO: 6363 - RNA, 18 nt, Artificial Sequence
  Description of Artificial Sequence: Synthetic oligonucleotide
guaccugagcugucugug

SEQ ID NO: 6364 - RNA, 18 nt, Artificial Sequence
  Description of Artificial Sequence: Synthetic oligonucleotide
ugcugguaccugagcugu

SEQ ID NO: 6365 - RNA, 18 nt, Artificial Sequence
  Description of Artificial Sequence: Synthetic oligonucleotide
caggcugcugguaccuga

SEQ ID NO: 6366 - RNA, 18 nt, Artificial Sequence
  Description of Artificial Sequence: Synthetic oligonucleotide
uggcccaggcugcuggua

SEQ ID NO: 6367 - RNA, 18 nt, Artificial Sequence
  Description of Artificial Sequence: Synthetic oligonucleotide
gauccuggcccaggcugc

SEQ ID NO: 6368 - RNA, 18 nt, Artificial Sequence
  Description of Artificial Sequence: Synthetic oligonucleotide
gggaagauccuggcccag

SEQ ID NO: 6369 - RNA, 18 nt, Artificial Sequence
  Description of Artificial Sequence: Synthetic oligonucleotide
aagcaggaaacuacuggg

SEQ ID NO: 6370 - RNA, 18 nt, Artificial Sequence
  Description of Artificial Sequence: Synthetic oligonucleotide
cuuaagcaggaaacuacu

SEQ ID NO: 6371 - RNA, 18 nt, Artificial Sequence
  Description of Artificial Sequence: Synthetic oligonucleotide
auuugcuuaagcaggaaa

SEQ ID NO: 6372 - RNA, 18 nt, Artificial Sequence
  Description of Artificial Sequence: Synthetic oligonucleotide
auucuauuugcuuaagca

SEQ ID NO: 6373 - RNA, 18 nt, Artificial Sequence
  Description of Artificial Sequence: Synthetic oligonucleotide
gagaaauucuauuugcuu

SEQ ID NO: 6374 - RNA, 18 nt, Artificial Sequence
  Description of Artificial Sequence: Synthetic oligonucleotide
cccuugagaaauucuauu

SEQ ID NO: 6375 - RNA, 18 nt, Artificial Sequence
  Description of Artificial Sequence: Synthetic oligonucleotide
gcugccccuugagaaauu

SEQ ID NO: 6376 - RNA, 18 nt, Artificial Sequence
  Description of Artificial Sequence: Synthetic oligonucleotide
ugggagcugccccuugag

SEQ ID NO: 6377 - RNA, 18 nt, Artificial Sequence
  Description of Artificial Sequence: Synthetic oligonucleotide
gcuucugggagcugcccc

SEQ ID NO: 6378 - RNA, 18 nt, Artificial Sequence
  Description of Artificial Sequence: Synthetic oligonucleotide
ccggugcuucugggagcu

SEQ ID NO: 6379 - RNA, 18 nt, Artificial Sequence
  Description of Artificial Sequence: Synthetic oligonucleotide
aaucaccggugcuucugg

SEQ ID NO: 6380 - RNA, 18 nt, Artificial Sequence
  Description of Artificial Sequence: Synthetic oligonucleotide
uuuccaaucaccggugcu

SEQ ID NO: 6381 - RNA, 18 nt, Artificial Sequence
  Description of Artificial Sequence: Synthetic oligonucleotide
ucugcuuuccaaucaccg

SEQ ID NO: 6382 - RNA, 18 nt, Artificial Sequence
  Description of Artificial Sequence: Synthetic oligonucleotide
cggugucugcuuuccaau

SEQ ID NO: 6383 - RNA, 18 nt, Artificial Sequence
  Description of Artificial Sequence: Synthetic oligonucleotide
agugacggugucugcuuu

SEQ ID NO: 6384 - RNA, 18 nt, Artificial Sequence
  Description of Artificial Sequence: Synthetic oligonucleotide
guggcagugacggugucu

SEQ ID NO: 6385 - RNA, 18 nt, Artificial Sequence
  Description of Artificial Sequence: Synthetic oligonucleotide
ggaagguggcagugacgg

SEQ ID NO: 6386 - RNA, 18 nt, Artificial Sequence
  Description of Artificial Sequence: Synthetic oligonucleotide
gggagggaagguggcagu

SEQ ID NO: 6387 - RNA, 18 nt, Artificial Sequence
  Description of Artificial Sequence: Synthetic oligonucleotide
guccugggagggaaggug

SEQ ID NO: 6388 - RNA, 18 nt, Artificial Sequence
  Description of Artificial Sequence: Synthetic oligonucleotide
ccggaguccugggaggga

SEQ ID NO: 6389 - RNA, 18 nt, Artificial Sequence
  Description of Artificial Sequence: Synthetic oligonucleotide
cuuggccggaguccuggg

SEQ ID NO: 6390 - RNA, 18 nt, Artificial Sequence
  Description of Artificial Sequence: Synthetic oligonucleotide
gaaaccuuggccggaguc

SEQ ID NO: 6391 - RNA, 18 nt, Artificial Sequence
  Description of Artificial Sequence: Synthetic oligonucleotide
uacuggaaaccuuggccg

SEQ ID NO: 6392 - RNA, 18 nt, Artificial Sequence
  Description of Artificial Sequence: Synthetic oligonucleotide
aguaguacuggaaaccuu

SEQ ID NO: 6393 - RNA, 18 nt, Artificial Sequence
  Description of Artificial Sequence: Synthetic oligonucleotide
aggcaaguaguacuggaa

SEQ ID NO: 6394 - RNA, 18 nt, Artificial Sequence
  Description of Artificial Sequence: Synthetic oligonucleotide
acuggaggcaaguaguac

SEQ ID NO: 6395 - RNA, 18 nt, Artificial Sequence
  Description of Artificial Sequence: Synthetic oligonucleotide
cugguacuggaggcaagu

SEQ ID NO: 6396 - RNA, 18 nt, Artificial Sequence
  Description of Artificial Sequence: Synthetic oligonucleotide
ugccucugguacuggagg

SEQ ID NO: 6397 - RNA, 18 nt, Artificial Sequence
  Description of Artificial Sequence: Synthetic oligonucleotide
uugccugccucugguacu

SEQ ID NO: 6398 - RNA, 18 nt, Artificial Sequence
  Description of Artificial Sequence: Synthetic oligonucleotide
uccacuugccugccucug

SEQ ID NO: 6399 - RNA, 18 nt, Artificial Sequence
  Description of Artificial Sequence: Synthetic oligonucleotide
ugauguccacuugccugc

SEQ ID NO: 6400 - RNA, 18 nt, Artificial Sequence
  Description of Artificial Sequence: Synthetic oligonucleotide
accccugauguccacuug

SEQ ID NO: 6401 - RNA, 18 nt, Artificial Sequence
  Description of Artificial Sequence: Synthetic oligonucleotide
gggacaccccugaugucc

SEQ ID NO: 6402 - RNA, 18 nt, Artificial Sequence
  Description of Artificial Sequence: Synthetic oligonucleotide
gagaugcacgccccuggg

SEQ ID NO: 6403 - RNA, 18 nt, Artificial Sequence
  Description of Artificial Sequence: Synthetic oligonucleotide
uucugagaugcacgcccc

SEQ ID NO: 6404 - RNA, 18 nt, Artificial Sequence
  Description of Artificial Sequence: Synthetic oligonucleotide
cugacuucugagaugcac

SEQ ID NO: 6405 - RNA, 18 nt, Artificial Sequence
  Description of Artificial Sequence: Synthetic oligonucleotide
agccccugacuucugaga

SEQ ID NO: 6406 - RNA, 18 nt, Artificial Sequence
  Description of Artificial Sequence: Synthetic oligonucleotide
ucuggagccccugacuuc

SEQ ID NO: 6407 - RNA, 18 nt, Artificial Sequence
  Description of Artificial Sequence: Synthetic oligonucleotide
cccucucuggagccccug

SEQ ID NO: 6408 - RNA, 18 nt, Artificial Sequence
  Description of Artificial Sequence: Synthetic oligonucleotide
uggaacccucucuggagc

SEQ ID NO: 6409 - RNA, 18 nt, Artificial Sequence
  Description of Artificial Sequence: Synthetic oligonucleotide
gaugcuggaacccucucu

SEQ ID NO: 6410 - RNA, 18 nt, Artificial Sequence
  Description of Artificial Sequence: Synthetic oligonucleotide
ugaaggaugcuggaaccc

SEQ ID NO: 6411 - RNA, 18 nt, Artificial Sequence
  Description of Artificial Sequence: Synthetic oligonucleotide
cguggugaaggaugcugg

SEQ ID NO: 6412 - RNA, 18 nt, Artificial Sequence
  Description of Artificial Sequence: Synthetic oligonucleotide
ugccacguggugaaggau

SEQ ID NO: 6413 - RNA, 18 nt, Artificial Sequence
  Description of Artificial Sequence: Synthetic oligonucleotide
acuccugccacgugguga

SEQ ID NO: 6414 - RNA, 18 nt, Artificial Sequence
  Description of Artificial Sequence: Synthetic oligonucleotide
ggcagacuccugccacgu

SEQ ID NO: 6415 - RNA, 18 nt, Artificial Sequence
  Description of Artificial Sequence: Synthetic oligonucleotide
ucuguggcagacuccugc

SEQ ID NO: 6416 - RNA, 18 nt, Artificial Sequence
  Description of Artificial Sequence: Synthetic oligonucleotide
accucucuguggcagacu

SEQ ID NO: 6417 - RNA, 18 nt, Artificial Sequence
  Description of Artificial Sequence: Synthetic oligonucleotide
ucaacaccucucuguggc

SEQ ID NO: 6418 - RNA, 18 nt, Artificial Sequence
  Description of Artificial Sequence: Synthetic oligonucleotide
ggcaaucaacaccucucu

SEQ ID NO: 6419 - RNA, 18 nt, Artificial Sequence
  Description of Artificial Sequence: Synthetic oligonucleotide
ggaaaggcaaucaacacc

SEQ ID NO: 6420 - RNA, 18 nt, Artificial Sequence
  Description of Artificial Sequence: Synthetic oligonucleotide
ugugaggaaaggcaauca

SEQ ID NO: 6421 - RNA, 18 nt, Artificial Sequence
  Description of Artificial Sequence: Synthetic oligonucleotide
ggaaaugugaggaaaggc

SEQ ID NO: 6422 - RNA, 18 nt, Artificial Sequence
  Description of Artificial Sequence: Synthetic oligonucleotide
uuccuggaaaugugagga

SEQ ID NO: 6423 - RNA, 18 nt, Artificial Sequence
  Description of Artificial Sequence: Synthetic oligonucleotide
cucaguuccuggaaaugu

SEQ ID NO: 6424 - RNA, 18 nt, Artificial Sequence
  Description of Artificial Sequence: Synthetic oligonucleotide
agauacucaguuccugga

SEQ ID NO: 6425 - RNA, 18 nt, Artificial Sequence
  Description of Artificial Sequence: Synthetic oligonucleotide
uugguagauacucaguuc

SEQ ID NO: 6426 - RNA, 18 nt, Artificial Sequence
  Description of Artificial Sequence: Synthetic oligonucleotide
ugaucuugguagauacuc

SEQ ID NO: 6427 - RNA, 18 nt, Artificial Sequence
  Description of Artificial Sequence: Synthetic oligonucleotide
guuccugaucuugguaga

SEQ ID NO: 6428 - RNA, 18 nt, Artificial Sequence
  Description of Artificial Sequence: Synthetic oligonucleotide
ccuuuguuccugaucuug

SEQ ID NO: 6429 - RNA, 18 nt, Artificial Sequence
  Description of Artificial Sequence: Synthetic oligonucleotide
aagauccuuuguuccuga

SEQ ID NO: 6430 - RNA, 18 nt, Artificial Sequence
  Description of Artificial Sequence: Synthetic oligonucleotide
acuuuaagauccuuuguu

SEQ ID NO: 6431 - RNA, 18 nt, Artificial Sequence
  Description of Artificial Sequence: Synthetic oligonucleotide
caggaacuuuaagauccu

SEQ ID NO: 6432 - RNA, 18 nt, Artificial Sequence
  Description of Artificial Sequence: Synthetic oligonucleotide
ucuuccaggaacuuuaag

SEQ ID NO: 6433 - RNA, 18 nt, Artificial Sequence
  Description of Artificial Sequence: Synthetic oligonucleotide
caagcucuuccaggaacu

SEQ ID NO: 6434 - RNA, 18 nt, Artificial Sequence
  Description of Artificial Sequence: Synthetic oligonucleotide
uuccccaagcucuuccag

SEQ ID NO: 6435 - RNA, 18 nt, Artificial Sequence
  Description of Artificial Sequence: Synthetic oligonucleotide
uucccuuccccaagcucu

SEQ ID NO: 6436 - RNA, 18 nt, Artificial Sequence
  Description of Artificial Sequence: Synthetic oligonucleotide
uggccuucccuuccccaa

SEQ ID NO: 6437 - RNA, 18 nt, Artificial Sequence
  Description of Artificial Sequence: Synthetic oligonucleotide
ugugguggccuucccuuc

SEQ ID NO: 6438 - RNA, 18 nt, Artificial Sequence
  Description of Artificial Sequence: Synthetic oligonucleotide
ugugcugugguggccuuc

SEQ ID NO: 6439 - RNA, 18 nt, Artificial Sequence
  Description of Artificial Sequence: Synthetic oligonucleotide
gaucaugugcuguggugg

SEQ ID NO: 6440 - RNA, 18 nt, Artificial Sequence
  Description of Artificial Sequence: Synthetic oligonucleotide
agacagaucaugugcugu

SEQ ID NO: 6441 - RNA, 18 nt, Artificial Sequence
  Description of Artificial Sequence: Synthetic oligonucleotide
uucccagacagaucaugu

SEQ ID NO: 6442 - RNA, 18 nt, Artificial Sequence
  Description of Artificial Sequence: Synthetic oligonucleotide
caaguuucccagacagau

SEQ ID NO: 6443 - RNA, 18 nt, Artificial Sequence
  Description of Artificial Sequence: Synthetic oligonucleotide
agucccaaguuucccaga

SEQ ID NO: 6444 - RNA, 18 nt, Artificial Sequence
  Description of Artificial Sequence: Synthetic oligonucleotide
uucggagucccaaguuuc

SEQ ID NO: 6445 - RNA, 18 nt, Artificial Sequence
  Description of Artificial Sequence: Synthetic oligonucleotide
cuuucuucggagucccaa

SEQ ID NO: 6446 - RNA, 18 nt, Artificial Sequence
  Description of Artificial Sequence: Synthetic oligonucleotide
gauuucuuucuucggagu

SEQ ID NO: 6447 - RNA, 18 nt, Artificial Sequence
  Description of Artificial Sequence: Synthetic oligonucleotide
cgauugauuucuuucuuc

SEQ ID NO: 6448 - RNA, 18 nt, Artificial Sequence
  Description of Artificial Sequence: Synthetic oligonucleotide
aaacucgauugauuucuu

SEQ ID NO: 6449 - RNA, 18 nt, Artificial Sequence
  Description of Artificial Sequence: Synthetic oligonucleotide
guauaaaacucgauugau

SEQ ID NO: 6450 - RNA, 18 nt, Artificial Sequence
  Description of Artificial Sequence: Synthetic oligonucleotide
agggaguauaaaacucga

SEQ ID NO: 6451 - RNA, 18 nt, Artificial Sequence
  Description of Artificial Sequence: Synthetic oligonucleotide
uugccagggaguauaaaa

SEQ ID NO: 6452 - RNA, 18 nt, Artificial Sequence
  Description of Artificial Sequence: Synthetic oligonucleotide
cuucuuugccagggagua

SEQ ID NO: 6453 - RNA, 18 nt, Artificial Sequence
  Description of Artificial Sequence: Synthetic oligonucleotide
uugcccuucuuugccagg

SEQ ID NO: 6454 - RNA, 18 nt, Artificial Sequence
  Description of Artificial Sequence: Synthetic oligonucleotide
guagcuugcccuucuuug

SEQ ID NO: 6455 - RNA, 18 nt, Artificial Sequence
  Description of Artificial Sequence: Synthetic oligonucleotide
uuucuguagcuugcccuu

SEQ ID NO: 6456 - RNA, 18 nt, Artificial Sequence
  Description of Artificial Sequence: Synthetic oligonucleotide
gccucuuucuguagcuug

SEQ ID NO: 6457 - RNA, 18 nt, Artificial Sequence
  Description of Artificial Sequence: Synthetic oligonucleotide
uuccugccucuuucugua

SEQ ID NO: 6458 - RNA, 18 nt, Artificial Sequence
  Description of Artificial Sequence: Synthetic oligonucleotide
ggguguuccugccucuuu

SEQ ID NO: 6459 - RNA, 18 nt, Artificial Sequence
  Description of Artificial Sequence: Synthetic oligonucleotide
gcgauuuuccacaaaggg

SEQ ID NO: 6460 - RNA, 18 nt, Artificial Sequence
  Description of Artificial Sequence: Synthetic oligonucleotide
accgcgauuuuccacaaa

SEQ ID NO: 6461 - RNA, 18 nt, Artificial Sequence
  Description of Artificial Sequence: Synthetic oligonucleotide
uggagaccgcgauuuucc

SEQ ID NO: 6462 - RNA, 18 nt, Artificial Sequence
  Description of Artificial Sequence: Synthetic oligonucleotide
cugaguggagaccgcgau

SEQ ID NO: 6463 - RNA, 18 nt, Artificial Sequence
  Description of Artificial Sequence: Synthetic oligonucleotide
caagccugaguggagacc

SEQ ID NO: 6464 - RNA, 18 nt, Artificial Sequence
  Description of Artificial Sequence: Synthetic oligonucleotide
gguuccaagccugagugg

SEQ ID NO: 6465 - RNA, 18 nt, Artificial Sequence
  Description of Artificial Sequence: Synthetic oligonucleotide
gugcugguuccaagccug

SEQ ID NO: 6466 - RNA, 18 nt, Artificial Sequence
  Description of Artificial Sequence: Synthetic oligonucleotide
ccgcugugcugguuccaa

SEQ ID NO: 6467 - RNA, 18 nt, Artificial Sequence
  Description of Artificial Sequence: Synthetic oligonucleotide
ccacuccgcugugcuggu

SEQ ID NO: 6468 - RNA, 18 nt, Artificial Sequence
  Description of Artificial Sequence: Synthetic oligonucleotide
ucuuaccacuccgcugug

SEQ ID NO: 6469 - RNA, 18 nt, Artificial Sequence
  Description of Artificial Sequence: Synthetic oligonucleotide
ucuggucuuaccacuccg

SEQ ID NO: 6470 - RNA, 18 nt, Artificial Sequence
  Description of Artificial Sequence: Synthetic oligonucleotide
gaccgucuggucuuacca

SEQ ID NO: 6471 - RNA, 18 nt, Artificial Sequence
  Description of Artificial Sequence: Synthetic oligonucleotide
gcuaugaccgucuggucu

SEQ ID NO: 6472 - RNA, 18 nt, Artificial Sequence
  Description of Artificial Sequence: Synthetic oligonucleotide
ccuuggcuaugaccgucu

SEQ ID NO: 6473 - RNA, 18 nt, Artificial Sequence
  Description of Artificial Sequence: Synthetic oligonucleotide
gggcuccuuggcuaugac

SEQ ID NO: 6474 - RNA, 18 nt, Artificial Sequence
  Description of Artificial Sequence: Synthetic oligonucleotide
cucgggucugaguuuggg

SEQ ID NO: 6475 - RNA, 18 nt, Artificial Sequence
  Description of Artificial Sequence: Synthetic oligonucleotide
acucgggucugaguuugg

SEQ ID NO: 6476 - RNA, 18 nt, Artificial Sequence
  Description of Artificial Sequence: Synthetic oligonucleotide
uccaaacucgggucugag

SEQ ID NO: 6477 - RNA, 18 nt, Artificial Sequence
  Description of Artificial Sequence: Synthetic oligonucleotide
ccgguuccaaacucgggu

SEQ ID NO: 6478 - RNA, 18 nt, Artificial Sequence
  Description of Artificial Sequence: Synthetic oligonucleotide
gucuuccgguuccaaacu

SEQ ID NO: 6479 - RNA, 18 nt, Artificial Sequence
  Description of Artificial Sequence: Synthetic oligonucleotide
uuucugucuuccgguucc

SEQ ID NO: 6480 - RNA, 18 nt, Artificial Sequence
  Description of Artificial Sequence: Synthetic oligonucleotide
uggaguuucugucuuccg

SEQ ID NO: 6481 - RNA, 18 nt, Artificial Sequence
  Description of Artificial Sequence: Synthetic oligonucleotide
agauguggaguuucuguc

SEQ ID NO: 6482 - RNA, 18 nt, Artificial Sequence
  Description of Artificial Sequence: Synthetic oligonucleotide
gagacagauguggaguuu

SEQ ID NO: 6483 - RNA, 18 nt, Artificial Sequence
  Description of Artificial Sequence: Synthetic oligonucleotide
cuucugagacagaugugg

SEQ ID NO: 6484 - RNA, 18 nt, Artificial Sequence
  Description of Artificial Sequence: Synthetic oligonucleotide
aagaucuucugagacaga

SEQ ID NO: 6485 - RNA, 18 nt, Artificial Sequence
  Description of Artificial Sequence: Synthetic oligonucleotide
ucaagaagaucuucugag

SEQ ID NO: 6486 - RNA, 18 nt, Artificial Sequence
  Description of Artificial Sequence: Synthetic oligonucleotide
aaggcucaagaagaucuu

SEQ ID NO: 6487 - RNA, 18 nt, Artificial Sequence
  Description of Artificial Sequence: Synthetic oligonucleotide
aauaaaaggcucaagaag

SEQ ID NO: 6488 - RNA, 18 nt, Artificial Sequence
  Description of Artificial Sequence: Synthetic oligonucleotide
acugcaauaaaaggcuca

SEQ ID NO: 6489 - RNA, 18 nt, Artificial Sequence
  Description of Artificial Sequence: Synthetic oligonucleotide
cugagacugcaauaaaag

SEQ ID NO: 6490 - RNA, 18 nt, Artificial Sequence
  Description of Artificial Sequence: Synthetic oligonucleotide
cugagcugagacugcaau

SEQ ID NO: 6491 - RNA, 18 nt, Artificial Sequence
  Description of Artificial Sequence: Synthetic oligonucleotide
caagccugagcugagacu

SEQ ID NO: 6492 - RNA, 18 nt, Artificial Sequence
  Description of Artificial Sequence: Synthetic oligonucleotide
gguuccaagccugagcug

SEQ ID NO: 6493 - RNA, 18 nt, Artificial Sequence
  Description of Artificial Sequence: Synthetic oligonucleotide
gugcugguuccaagccug

SEQ ID NO: 6494 - RNA, 18 nt, Artificial Sequence
  Description of Artificial Sequence: Synthetic oligonucleotide
ccgcugugcugguuccaa

SEQ ID NO: 6495 - RNA, 18 nt, Artificial Sequence
  Description of Artificial Sequence: Synthetic oligonucleotide
ccacuccgcugugcuggu

SEQ ID NO: 6496 - RNA, 18 nt, Artificial Sequence
  Description of Artificial Sequence: Synthetic oligonucleotide
ucuuaccacuccgcugug

SEQ ID NO: 6497 - RNA, 18 nt, Artificial Sequence
  Description of Artificial Sequence: Synthetic oligonucleotide
ucuggucuuaccacuccg

SEQ ID NO: 6498 - RNA, 18 nt, Artificial Sequence
  Description of Artificial Sequence: Synthetic oligonucleotide
gacugucuggucuuacca

SEQ ID NO: 6499 - RNA, 18 nt, Artificial Sequence
  Description of Artificial Sequence: Synthetic oligonucleotide
gcuaugacugucuggucu

SEQ ID NO: 6500 - RNA, 18 nt, Artificial Sequence
  Description of Artificial Sequence: Synthetic oligonucleotide
ccuuggcuaugacugucu

SEQ ID NO: 6501 - RNA, 18 nt, Artificial Sequence
  Description of Artificial Sequence: Synthetic oligonucleotide
gggauccuuggcuaugac

SEQ ID NO: 6502 - RNA, 18 nt, Artificial Sequence
  Description of Artificial Sequence: Synthetic oligonucleotide
ccugggucugaguuuggg

SEQ ID NO: 6503 - RNA, 18 nt, Artificial Sequence
  Description of Artificial Sequence: Synthetic oligonucleotide
caaaccugggucugaguu

SEQ ID NO: 6504 - RNA, 18 nt, Artificial Sequence
  Description of Artificial Sequence: Synthetic oligonucleotide
gguuccaaaccugggucu

SEQ ID NO: 6505 - RNA, 18 nt, Artificial Sequence
  Description of Artificial Sequence: Synthetic oligonucleotide
cuucagguuccaaaccug

SEQ ID NO: 6506 - RNA, 18 nt, Artificial Sequence
  Description of Artificial Sequence: Synthetic oligonucleotide
gcugucuucagguuccaa

SEQ ID NO: 6507 - RNA, 18 nt, Artificial Sequence
  Description of Artificial Sequence: Synthetic oligonucleotide
gaguugcugucuucaggu

SEQ ID NO: 6508 - RNA, 18 nt, Artificial Sequence
  Description of Artificial Sequence: Synthetic oligonucleotide
auguggaguugcugucuu

SEQ ID NO: 6509 - RNA, 18 nt, Artificial Sequence
  Description of Artificial Sequence: Synthetic oligonucleotide
ggcagauguggaguugcu

SEQ ID NO: 6510 - RNA, 18 nt, Artificial Sequence
  Description of Artificial Sequence: Synthetic oligonucleotide
uccaaggcagauguggag

SEQ ID NO: 6511 - RNA, 18 nt, Artificial Sequence
  Description of Artificial Sequence: Synthetic oligonucleotide
gaucuuccaaggcagaug

SEQ ID NO: 6512 - RNA, 18 nt, Artificial Sequence
  Description of Artificial Sequence: Synthetic oligonucleotide
aagaggaucuuccaaggc

SEQ ID NO: 6513 - RNA, 18 nt, Artificial Sequence
  Description of Artificial Sequence: Synthetic oligonucleotide
aacucaagaggaucuucc

SEQ ID NO: 6514 - RNA, 18 nt, Artificial Sequence
  Description of Artificial Sequence: Synthetic oligonucleotide
cuaaaaacucaagaggau

SEQ ID NO: 6515 - RNA, 18 nt, Artificial Sequence
  Description of Artificial Sequence: Synthetic oligonucleotide
caugucuaaaaacucaag

SEQ ID NO: 6516 - RNA, 18 nt, Artificial Sequence
  Description of Artificial Sequence: Synthetic oligonucleotide
ucggccaugucuaaaaac

SEQ ID NO: 6517 - RNA, 18 nt, Artificial Sequence
  Description of Artificial Sequence: Synthetic oligonucleotide
ugaucucggccaugucua

SEQ ID NO: 6518 - RNA, 18 nt, Artificial Sequence
  Description of Artificial Sequence: Synthetic oligonucleotide
cuccuugaucucggccau

SEQ ID NO: 6519 - RNA, 18 nt, Artificial Sequence
  Description of Artificial Sequence: Synthetic oligonucleotide
auuuucuccuugaucucg

SEQ ID NO: 6520 - RNA, 18 nt, Artificial Sequence
  Description of Artificial Sequence: Synthetic oligonucleotide
cgcagauuuucuccuuga

SEQ ID NO: 6521 - RNA, 18 nt, Artificial Sequence
  Description of Artificial Sequence: Synthetic oligonucleotide
auagucgcagauuuucuc

SEQ ID NO: 6522 - RNA, 18 nt, Artificial Sequence
  Description of Artificial Sequence: Synthetic oligonucleotide
aagagauagucgcagauu

SEQ ID NO: 6523 - RNA, 18 nt, Artificial Sequence
  Description of Artificial Sequence: Synthetic oligonucleotide
cauugaagagauagucgc

SEQ ID NO: 6524 - RNA, 18 nt, Artificial Sequence
  Description of Artificial Sequence: Synthetic oligonucleotide
agacacauugaagagaua

SEQ ID NO: 6525 - RNA, 18 nt, Artificial Sequence
  Description of Artificial Sequence: Synthetic oligonucleotide
gagucagacacauugaag

SEQ ID NO: 6526 - RNA, 18 nt, Artificial Sequence
  Description of Artificial Sequence: Synthetic oligonucleotide
cagaggagucagacacau

SEQ ID NO: 6527 - RNA, 18 nt, Artificial Sequence
  Description of Artificial Sequence: Synthetic oligonucleotide
cagggcagaggagucaga

SEQ ID NO: 6528 - RNA, 18 nt, Artificial Sequence
  Description of Artificial Sequence: Synthetic oligonucleotide
aaauucagggcagaggag

SEQ ID NO: 6529 - RNA, 18 nt, Artificial Sequence
  Description of Artificial Sequence: Synthetic oligonucleotide
uagccaaauucagggcag

SEQ ID NO: 6530 - RNA, 18 nt, Artificial Sequence
  Description of Artificial Sequence: Synthetic oligonucleotide
auuuuuagccaaauucag

SEQ ID NO: 6531 - RNA, 18 nt, Artificial Sequence
  Description of Artificial Sequence: Synthetic oligonucleotide
ccaauauuuuuagccaaa

SEQ ID NO: 6532 - RNA, 18 nt, Artificial Sequence
  Description of Artificial Sequence: Synthetic oligonucleotide
uaaggccaauauuuuuag

SEQ ID NO: 6533 - RNA, 18 nt, Artificial Sequence
  Description of Artificial Sequence: Synthetic oligonucleotide
cuugguaaggccaauauu

SEQ ID NO: 6534 - RNA, 18 nt, Artificial Sequence
  Description of Artificial Sequence: Synthetic oligonucleotide
cgggccuugguaaggcca

SEQ ID NO: 6535 - RNA, 18 nt, Artificial Sequence
  Description of Artificial Sequence: Synthetic oligonucleotide
uaucucgggccuugguaa

SEQ ID NO: 6536 - RNA, 18 nt, Artificial Sequence
  Description of Artificial Sequence: Synthetic oligonucleotide
auuuauaucucgggccuu

SEQ ID NO: 6537 - RNA, 18 nt, Artificial Sequence
  Description of Artificial Sequence: Synthetic oligonucleotide
acagcauuuauaucucgg

SEQ ID NO: 6538 - RNA, 18 nt, Artificial Sequence
  Description of Artificial Sequence: Synthetic oligonucleotide
uuagcacagcauuuauau

SEQ ID NO: 6539 - RNA, 18 nt, Artificial Sequence
  Description of Artificial Sequence: Synthetic oligonucleotide
gucaauuagcacagcauu

SEQ ID NO: 6540 - RNA, 18 nt, Artificial Sequence
  Description of Artificial Sequence: Synthetic oligonucleotide
uccaugucaauuagcaca

SEQ ID NO: 6541 - RNA, 18 nt, Artificial Sequence
  Description of Artificial Sequence: Synthetic oligonucleotide
gccuuuccaugucaauua

SEQ ID NO: 6542 - RNA, 18 nt, Artificial Sequence
  Description of Artificial Sequence: Synthetic oligonucleotide
ccccugccuuuccauguc

SEQ ID NO: 6543 - RNA, 18 nt, Artificial Sequence
  Description of Artificial Sequence: Synthetic oligonucleotide
acaucccccugccuuucc

SEQ ID NO: 6544 - RNA, 18 nt, Artificial Sequence
  Description of Artificial Sequence: Synthetic oligonucleotide
uauagacaucccccugcc

SEQ ID NO: 6545 - RNA, 18 nt, Artificial Sequence
  Description of Artificial Sequence: Synthetic oligonucleotide
uugucuauagacaucccc

SEQ ID NO: 6546 - RNA, 18 nt, Artificial Sequence
  Description of Artificial Sequence: Synthetic oligonucleotide
gucccuugucuauagaca

SEQ ID NO: 6547 - RNA, 18 nt, Artificial Sequence
  Description of Artificial Sequence: Synthetic oligonucleotide
ggguugucccuugucuau

SEQ ID NO: 6548 - RNA, 18 nt, Artificial Sequence
  Description of Artificial Sequence: Synthetic oligonucleotide
aaaugccauaugggaggg

SEQ ID NO: 6549 - RNA, 18 nt, Artificial Sequence
  Description of Artificial Sequence: Synthetic oligonucleotide
gucaaaugccauauggga

SEQ ID NO: 6550 - RNA, 18 nt, Artificial Sequence
  Description of Artificial Sequence: Synthetic oligonucleotide
ugucugucaaaugccaua

SEQ ID NO: 6551 - RNA, 18 nt, Artificial Sequence
  Description of Artificial Sequence: Synthetic oligonucleotide
cuucuugucugucaaaug

SEQ ID NO: 6552 - RNA, 18 nt, Artificial Sequence
  Description of Artificial Sequence: Synthetic oligonucleotide
ucucgcuucuugucuguc

SEQ ID NO: 6553 - RNA, 18 nt, Artificial Sequence
  Description of Artificial Sequence: Synthetic oligonucleotide
uccucucucgcuucuugu

SEQ ID NO: 6554 - RNA, 18 nt, Artificial Sequence
  Description of Artificial Sequence: Synthetic oligonucleotide
uugcauccucucucgcuu

SEQ ID NO: 6555 - RNA, 18 nt, Artificial Sequence
  Description of Artificial Sequence: Synthetic oligonucleotide
uugauuugcauccucucu

SEQ ID NO: 6556 - RNA, 18 nt, Artificial Sequence
  Description of Artificial Sequence: Synthetic oligonucleotide
uucucuugauuugcaucc

SEQ ID NO: 6557 - RNA, 18 nt, Artificial Sequence
  Description of Artificial Sequence: Synthetic oligonucleotide
cguauuucucuugauuug

SEQ ID NO: 6558 - RNA, 18 nt, Artificial Sequence
  Description of Artificial Sequence: Synthetic oligonucleotide
cuguucguauuucucuug

SEQ ID NO: 6559 - RNA, 18 nt, Artificial Sequence
  Description of Artificial Sequence: Synthetic oligonucleotide
gaacacuguucguauuuc

SEQ ID NO: 6560 - RNA, 18 nt, Artificial Sequence
  Description of Artificial Sequence: Synthetic oligonucleotide
uucaggaacacuguucgu

SEQ ID NO: 6561 - RNA, 18 nt, Artificial Sequence
  Description of Artificial Sequence: Synthetic oligonucleotide
gcgguuucaggaacacug

SEQ ID NO: 6562 - RNA, 18 nt, Artificial Sequence
  Description of Artificial Sequence: Synthetic oligonucleotide
cuggagcgguuucaggaa

SEQ ID NO: 6563 - RNA, 18 nt, Artificial Sequence
  Description of Artificial Sequence: Synthetic oligonucleotide
ugcagcuggagcgguuuc

SEQ ID NO: 6564 - RNA, 18 nt, Artificial Sequence
  Description of Artificial Sequence: Synthetic oligonucleotide
gggauugcagcuggagcg

SEQ ID NO: 6565 - RNA, 18 nt, Artificial Sequence
  Description of Artificial Sequence: Synthetic oligonucleotide
ucucagggauugcagcug

SEQ ID NO: 6566 - RNA, 18 nt, Artificial Sequence
  Description of Artificial Sequence: Synthetic oligonucleotide
uuuggucucagggauugc

SEQ ID NO: 6567 - RNA, 18 nt, Artificial Sequence
  Description of Artificial Sequence: Synthetic oligonucleotide
uuucuuuuggucucaggg

SEQ ID NO: 6568 - RNA, 18 nt, Artificial Sequence
  Description of Artificial Sequence: Synthetic oligonucleotide
cugcguuucuuuuggucu

SEQ ID NO: 6569 - RNA, 18 nt, Artificial Sequence
  Description of Artificial Sequence: Synthetic oligonucleotide
gaacucugcguuucuuuu

SEQ ID NO: 6570 - RNA, 18 nt, Artificial Sequence
  Description of Artificial Sequence: Synthetic oligonucleotide
gugaggaacucugcguuu

SEQ ID NO: 6571 - RNA, 18 nt, Artificial Sequence
  Description of Artificial Sequence: Synthetic oligonucleotide
uacaggugaggaacucug

SEQ ID NO: 6572 - RNA, 18 nt, Artificial Sequence
  Description of Artificial Sequence: Synthetic oligonucleotide
uauauuacaggugaggaa

SEQ ID NO: 6573 - RNA, 18 nt, Artificial Sequence
  Description of Artificial Sequence: Synthetic oligonucleotide
guggguauauuacaggug

SEQ ID NO: 6574 - RNA, 18 nt, Artificial Sequence
  Description of Artificial Sequence: Synthetic oligonucleotide
uugauguggguauauuac

SEQ ID NO: 6575 - RNA, 18 nt, Artificial Sequence
  Description of Artificial Sequence: Synthetic oligonucleotide
ggcauuugauguggguau

SEQ ID NO: 6576 - RNA, 18 nt, Artificial Sequence
  Description of Artificial Sequence: Synthetic oligonucleotide
uuugaggcauuugaugug

SEQ ID NO: 6577 - RNA, 18 nt, Artificial Sequence
  Description of Artificial Sequence: Synthetic oligonucleotide
uguuauuugaggcauuug

SEQ ID NO: 6578 - RNA, 18 nt, Artificial Sequence
  Description of Artificial Sequence: Synthetic oligonucleotide
uaccauguuauuugaggc

SEQ ID NO: 6579 - RNA, 18 nt, Artificial Sequence
  Description of Artificial Sequence: Synthetic oligonucleotide
gugguuaccauguuauuu

SEQ ID NO: 6580 - RNA, 18 nt, Artificial Sequence
  Description of Artificial Sequence: Synthetic oligonucleotide
uuucugugguuaccaugu

SEQ ID NO: 6581 - RNA, 18 nt, Artificial Sequence
  Description of Artificial Sequence: Synthetic oligonucleotide
cacuuuuucugugguuac

SEQ ID NO: 6582 - RNA, 18 nt, Artificial Sequence
  Description of Artificial Sequence: Synthetic oligonucleotide
uucuccacuuuuucugug

SEQ ID NO: 6583 - RNA, 18 nt, Artificial Sequence
  Description of Artificial Sequence: Synthetic oligonucleotide
gcccauucuccacuuuuu

SEQ ID NO: 6584 - RNA, 18 nt, Artificial Sequence
  Description of Artificial Sequence: Synthetic oligonucleotide
uuccugcccauucuccac

SEQ ID NO: 6585 - RNA, 18 nt, Artificial Sequence
  Description of Artificial Sequence: Synthetic oligonucleotide
acagguuccugcccauuc

SEQ ID NO: 6586 - RNA, 18 nt, Artificial Sequence
  Description of Artificial Sequence: Synthetic oligonucleotide
uuaugacagguuccugcc

SEQ ID NO: 6587 - RNA, 18 nt, Artificial Sequence
  Description of Artificial Sequence: Synthetic oligonucleotide
uaacuuuaugacagguuc

SEQ ID NO: 6588 - RNA, 18 nt, Artificial Sequence
  Description of Artificial Sequence: Synthetic oligonucleotide
uuuucuaacuuuaugaca

SEQ ID NO: 6589 - RNA, 18 nt, Artificial Sequence
  Description of Artificial Sequence: Synthetic oligonucleotide
gccuguuuucuaacuuua

SEQ ID NO: 6590 - RNA, 18 nt, Artificial Sequence
  Description of Artificial Sequence: Synthetic oligonucleotide
cucuugccuguuuucuaa

SEQ ID NO: 6591 - RNA, 18 nt, Artificial Sequence
  Description of Artificial Sequence: Synthetic oligonucleotide
cuggccucuugccuguuu

SEQ ID NO: 6592 - RNA, 18 nt, Artificial Sequence
  Description of Artificial Sequence: Synthetic oligonucleotide
cuggucuggccucuugcc

SEQ ID NO: 6593 - RNA, 18 nt, Artificial Sequence
  Description of Artificial Sequence: Synthetic oligonucleotide
ugguucuggucuggccuc

SEQ ID NO: 6594 - RNA, 18 nt, Artificial Sequence
  Description of Artificial Sequence: Synthetic oligonucleotide
cuugcugguucuggucug

SEQ ID NO: 6595 - RNA, 18 nt, Artificial Sequence
  Description of Artificial Sequence: Synthetic oligonucleotide
ucagucuugcugguucug

SEQ ID NO: 6596 - RNA, 18 nt, Artificial Sequence
  Description of Artificial Sequence: Synthetic oligonucleotide
ugguuucagucuugcugg

SEQ ID NO: 6597 - RNA, 18 nt, Artificial Sequence
  Description of Artificial Sequence: Synthetic oligonucleotide
acaggugguuucagucuu

SEQ ID NO: 6598 - RNA, 18 nt, Artificial Sequence
  Description of Artificial Sequence: Synthetic oligonucleotide
aaugaacaggugguuuca

SEQ ID NO: 6599 - RNA, 18 nt, Artificial Sequence
  Description of Artificial Sequence: Synthetic oligonucleotide
auuguaaugaacaggugg

SEQ ID NO: 6600 - RNA, 18 nt, Artificial Sequence
  Description of Artificial Sequence: Synthetic oligonucleotide
gggccauuguaaugaaca

SEQ ID NO: 6601 - RNA, 18 nt, Artificial Sequence
  Description of Artificial Sequence: Synthetic oligonucleotide
auacccugcuuuugaggg

SEQ ID NO: 6602 - RNA, 18 nt, Artificial Sequence
  Description of Artificial Sequence: Synthetic oligonucleotide
aacauacccugcuuuuga

SEQ ID NO: 6603 - RNA, 18 nt, Artificial Sequence
  Description of Artificial Sequence: Synthetic oligonucleotide
aagucaacauacccugcu

SEQ ID NO: 6604 - RNA, 18 nt, Artificial Sequence
  Description of Artificial Sequence: Synthetic oligonucleotide
uuucaaagucaacauacc

SEQ ID NO: 6605 - RNA, 18 nt, Artificial Sequence
  Description of Artificial Sequence: Synthetic oligonucleotide
gccauuuucaaagucaac

SEQ ID NO: 6606 - RNA, 18 nt, Artificial Sequence
  Description of Artificial Sequence: Synthetic oligonucleotide
cacuggccauuuucaaag

SEQ ID NO: 6607 - RNA, 18 nt, Artificial Sequence
  Description of Artificial Sequence: Synthetic oligonucleotide
uggcccacuggccauuuu

SEQ ID NO: 6608 - RNA, 18 nt, Artificial Sequence
  Description of Artificial Sequence: Synthetic oligonucleotide
aucuguggcccacuggcc

SEQ ID NO: 6609 - RNA, 18 nt, Artificial Sequence
  Description of Artificial Sequence: Synthetic oligonucleotide
augucaucuguggcccac

SEQ ID NO: 6610 - RNA, 18 nt, Artificial Sequence
  Description of Artificial Sequence: Synthetic oligonucleotide
cugggaugucaucugugg

SEQ ID NO: 6611 - RNA, 18 nt, Artificial Sequence
  Description of Artificial Sequence: Synthetic oligonucleotide
gucaucugggaugucauc

SEQ ID NO: 6612 - RNA, 18 nt, Artificial Sequence
  Description of Artificial Sequence: Synthetic oligonucleotide
uucaagucaucugggaug

SEQ ID NO: 6613 - RNA, 18 nt, Artificial Sequence
  Description of Artificial Sequence: Synthetic oligonucleotide
uacuauucaagucaucug

SEQ ID NO: 6614 - RNA, 18 nt, Artificial Sequence
  Description of Artificial Sequence: Synthetic oligonucleotide
gcggauacuauucaaguc

SEQ ID NO: 6615 - RNA, 18 nt, Artificial Sequence
  Description of Artificial Sequence: Synthetic oligonucleotide
gcugcgcggauacuauuc

SEQ ID NO: 6616 - RNA, 18 nt, Artificial Sequence
  Description of Artificial Sequence: Synthetic oligonucleotide
cuggugcugcgcggauac

SEQ ID NO: 6617 - RNA, 18 nt, Artificial Sequence
  Description of Artificial Sequence: Synthetic oligonucleotide
cucaccuggugcugcgcg

SEQ ID NO: 6618 - RNA, 18 nt, Artificial Sequence
  Description of Artificial Sequence: Synthetic oligonucleotide
cgaaacucaccuggugcu

SEQ ID NO: 6619 - RNA, 18 nt, Artificial Sequence
  Description of Artificial Sequence: Synthetic oligonucleotide
uggcucgaaacucaccug

SEQ ID NO: 6620 - RNA, 18 nt, Artificial Sequence
  Description of Artificial Sequence: Synthetic oligonucleotide
caugauggcucgaaacuc

SEQ ID NO: 6621 - RNA, 18 nt, Artificial Sequence
  Description of Artificial Sequence: Synthetic oligonucleotide
aucuccaugauggcucga

SEQ ID NO: 6622 - RNA, 18 nt, Artificial Sequence
  Description of Artificial Sequence: Synthetic oligonucleotide
agggcaucuccaugaugg

SEQ ID NO: 6623 - RNA, 18 nt, Artificial Sequence
  Description of Artificial Sequence: Synthetic oligonucleotide
gaaggagggcaucuccau

SEQ ID NO: 6624 - RNA, 18 nt, Artificial Sequence
  Description of Artificial Sequence: Synthetic oligonucleotide
cuguagaaggagggcauc

SEQ ID NO: 6625 - RNA, 18 nt, Artificial Sequence
  Description of Artificial Sequence: Synthetic oligonucleotide
caugacuguagaaggagg

SEQ ID NO: 6626 - RNA, 18 nt, Artificial Sequence
  Description of Artificial Sequence: Synthetic oligonucleotide
caagccaugacuguagaa

SEQ ID NO: 6627 - RNA, 18 nt, Artificial Sequence
  Description of Artificial Sequence: Synthetic oligonucleotide
cguggcaagccaugacug

SEQ ID NO: 6628 - RNA, 18 nt, Artificial Sequence
  Description of Artificial Sequence: Synthetic oligonucleotide
aacaccguggcaagccau

SEQ ID NO: 6629 - RNA, 18 nt, Artificial Sequence
  Description of Artificial Sequence: Synthetic oligonucleotide
gggugaacaccguggcaa

SEQ ID NO: 6630 - RNA, 18 nt, Artificial Sequence
  Description of Artificial Sequence: Synthetic oligonucleotide
uuguagggugaacaccgu

SEQ ID NO: 6631 - RNA, 18 nt, Artificial Sequence
  Description of Artificial Sequence: Synthetic oligonucleotide
guuucuuguagggugaac

SEQ ID NO: 6632 - RNA, 18 nt, Artificial Sequence
  Description of Artificial Sequence: Synthetic oligonucleotide
ugucaguuucuuguaggg

SEQ ID NO: 6633 - RNA, 18 nt, Artificial Sequence
  Description of Artificial Sequence: Synthetic oligonucleotide
cacucugucaguuucuug

SEQ ID NO: 6634 - RNA, 18 nt, Artificial Sequence
  Description of Artificial Sequence: Synthetic oligonucleotide
gcuggcacucugucaguu

SEQ ID NO: 6635 - RNA, 18 nt, Artificial Sequence
  Description of Artificial Sequence: Synthetic oligonucleotide
cuucagcuggcacucugu

SEQ ID NO: 6636 - RNA, 18 nt, Artificial Sequence
  Description of Artificial Sequence: Synthetic oligonucleotide
ggguucuucagcuggcac

SEQ ID NO: 6637 - RNA, 18 nt, Artificial Sequence
  Description of Artificial Sequence: Synthetic oligonucleotide
uaacagcccgcugauggg

SEQ ID NO: 6638 - RNA, 18 nt, Artificial Sequence
  Description of Artificial Sequence: Synthetic oligonucleotide
cuaacagcccgcugaugg

SEQ ID NO: 6639 - RNA, 18 nt, Artificial Sequence
  Description of Artificial Sequence: Synthetic oligonucleotide
auauucuaacagcccgcu

SEQ ID NO: 6640 - RNA, 18 nt, Artificial Sequence
  Description of Artificial Sequence: Synthetic oligonucleotide
ugggcauauucuaacagc

SEQ ID NO: 6641 - RNA, 18 nt, Artificial Sequence
  Description of Artificial Sequence: Synthetic oligonucleotide
cgaacugggcauauucua

SEQ ID NO: 6642 - RNA, 18 nt, Artificial Sequence
  Description of Artificial Sequence: Synthetic oligonucleotide
acuagcgaacugggcaua

SEQ ID NO: 6643 - RNA, 18 nt, Artificial Sequence
  Description of Artificial Sequence: Synthetic oligonucleotide
guuugacuagcgaacugg

SEQ ID NO: 6644 - RNA, 18 nt, Artificial Sequence
  Description of Artificial Sequence: Synthetic oligonucleotide
cacagguuugacuagcga

SEQ ID NO: 6645 - RNA, 18 nt, Artificial Sequence
  Description of Artificial Sequence: Synthetic oligonucleotide
gaacucacagguuugacu

SEQ ID NO: 6646 - RNA, 18 nt, Artificial Sequence
  Description of Artificial Sequence: Synthetic oligonucleotide
auguugaacucacagguu

SEQ ID NO: 6647 - RNA, 18 nt, Artificial Sequence
  Description of Artificial Sequence: Synthetic oligonucleotide
cuaucauguugaacucac

SEQ ID NO: 6648 - RNA, 18 nt, Artificial Sequence
  Description of Artificial Sequence: Synthetic oligonucleotide
cugcucuaucauguugaa

SEQ ID NO: 6649 - RNA, 18 nt, Artificial Sequence
  Description of Artificial Sequence: Synthetic oligonucleotide
ccacucugcucuaucaug

SEQ ID NO: 6650 - RNA, 18 nt, Artificial Sequence
  Description of Artificial Sequence: Synthetic oligonucleotide
gugguccacucugcucua

SEQ ID NO: 6651 - RNA, 18 nt, Artificial Sequence
  Description of Artificial Sequence: Synthetic oligonucleotide
acaguuccuggguggucu

SEQ ID NO: 6652 - RNA, 18 nt, Artificial Sequence
  Description of Artificial Sequence: Synthetic oligonucleotide
uagguacaguuccugggu

SEQ ID NO: 6653 - RNA, 18 nt, Artificial Sequence
  Description of Artificial Sequence: Synthetic oligonucleotide
aacccuagguacaguucc

SEQ ID NO: 6654 - RNA, 18 nt, Artificial Sequence
  Description of Artificial Sequence: Synthetic oligonucleotide
accccaacccuagguaca

SEQ ID NO: 6655 - RNA, 18 nt, Artificial Sequence
  Description of Artificial Sequence: Synthetic oligonucleotide
accugaccccaacccuag

SEQ ID NO: 6656 - RNA, 18 nt, Artificial Sequence
  Description of Artificial Sequence: Synthetic oligonucleotide
aaagcaccugaccccaac

SEQ ID NO: 6657 - RNA, 18 nt, Artificial Sequence
  Description of Artificial Sequence: Synthetic oligonucleotide
gagcaaaagcaccugacc

SEQ ID NO: 6658 - RNA, 18 nt, Artificial Sequence
  Description of Artificial Sequence: Synthetic oligonucleotide
gucaggagcaaaagcacc

SEQ ID NO: 6659 - RNA, 18 nt, Artificial Sequence
  Description of Artificial Sequence: Synthetic oligonucleotide
acugcgucaggagcaaaa

SEQ ID NO: 6660 - RNA, 18 nt, Artificial Sequence
  Description of Artificial Sequence: Synthetic oligonucleotide
ccaagacugcgucaggag

SEQ ID NO: 6661 - RNA, 18 nt, Artificial Sequence
  Description of Artificial Sequence: Synthetic oligonucleotide
aucagccaagacugcguc

SEQ ID NO: 6662 - RNA, 18 nt, Artificial Sequence
  Description of Artificial Sequence: Synthetic oligonucleotide
cacaaaucagccaagacu

SEQ ID NO: 6663 - RNA, 18 nt, Artificial Sequence
  Description of Artificial Sequence: Synthetic oligonucleotide
cugcucacaaaucagcca

SEQ ID NO: 6664 - RNA, 18 nt, Artificial Sequence
  Description of Artificial Sequence: Synthetic oligonucleotide
cagcacugcucacaaauc

SEQ ID NO: 6665 - RNA, 18 nt, Artificial Sequence
  Description of Artificial Sequence: Synthetic oligonucleotide
ccaaacagcacugcucac

SEQ ID NO: 6666 - RNA, 18 nt, Artificial Sequence
  Description of Artificial Sequence: Synthetic oligonucleotide
cgccaccaaacagcacug

SEQ ID NO: 6667 - RNA, 18 nt, Artificial Sequence
  Description of Artificial Sequence: Synthetic oligonucleotide
auaggcgccaccaaacag

SEQ ID NO: 6668 - RNA, 18 nt, Artificial Sequence
  Description of Artificial Sequence: Synthetic oligonucleotide
aaaagauaggcgccacca

SEQ ID NO: 6669 - RNA, 18 nt, Artificial Sequence
  Description of Artificial Sequence: Synthetic oligonucleotide
ggaggaaaagauaggcgc

SEQ ID NO: 6670 - RNA, 18 nt, Artificial Sequence
  Description of Artificial Sequence: Synthetic oligonucleotide
gggaaggaggaaaagaua

SEQ ID NO: 6671 - RNA, 18 nt, Artificial Sequence
  Description of Artificial Sequence: Synthetic oligonucleotide
cagaagggaaggaggaaa

SEQ ID NO: 6672 - RNA, 18 nt, Artificial Sequence
  Description of Artificial Sequence: Synthetic oligonucleotide
aaaggcagaagggaagga

SEQ ID NO: 6673 - RNA, 18 nt, Artificial Sequence
  Description of Artificial Sequence: Synthetic oligonucleotide
agcuaaaaggcagaaggg

SEQ ID NO: 6674 - RNA, 18 nt, Artificial Sequence
  Description of Artificial Sequence: Synthetic oligonucleotide
aauuuagcuaaaaggcag

SEQ ID NO: 6675 - RNA, 18 nt, Artificial Sequence
  Description of Artificial Sequence: Synthetic oligonucleotide
gggaauuuagcuaaaagg

SEQ ID NO: 6676 - RNA, 18 nt, Artificial Sequence
  Description of Artificial Sequence: Synthetic oligonucleotide
gaaagggccaaucaaggg

SEQ ID NO: 6677 - RNA, 18 nt, Artificial Sequence
  Description of Artificial Sequence: Synthetic oligonucleotide
cuggagaaagggccaauc

SEQ ID NO: 6678 - RNA, 18 nt, Artificial Sequence
  Description of Artificial Sequence: Synthetic oligonucleotide
aauaucuggagaaagggc

SEQ ID NO: 6679 - RNA, 18 nt, Artificial Sequence
  Description of Artificial Sequence: Synthetic oligonucleotide
ugcucaauaucuggagaa

SEQ ID NO: 6680 - RNA, 18 nt, Artificial Sequence
  Description of Artificial Sequence: Synthetic oligonucleotide
uucccugcucaauaucug

SEQ ID NO: 6681 - RNA, 18 nt, Artificial Sequence
  Description of Artificial Sequence: Synthetic oligonucleotide
cuauauucccugcucaau

SEQ ID NO: 6682 - RNA, 18 nt, Artificial Sequence
  Description of Artificial Sequence: Synthetic oligonucleotide
aaggucuauauucccugc

SEQ ID NO: 6683 - RNA, 18 nt, Artificial Sequence
  Description of Artificial Sequence: Synthetic oligonucleotide
gguccaaggucuauauuc

SEQ ID NO: 6684 - RNA, 18 nt, Artificial Sequence
  Description of Artificial Sequence: Synthetic oligonucleotide
uggcugguccaaggucua

SEQ ID NO: 6685 - RNA, 18 nt, Artificial Sequence
  Description of Artificial Sequence: Synthetic oligonucleotide
gauucuggcugguccaag

SEQ ID NO: 6686 - RNA, 18 nt, Artificial Sequence
  Description of Artificial Sequence: Synthetic oligonucleotide
gccaagauucuggcuggu

SEQ ID NO: 6687 - RNA, 18 nt, Artificial Sequence
  Description of Artificial Sequence: Synthetic oligonucleotide
guucagccaagauucugg

SEQ ID NO: 6688 - RNA, 18 nt, Artificial Sequence
  Description of Artificial Sequence: Synthetic oligonucleotide
cccuuguucagccaagau

SEQ ID NO: 6689 - RNA, 18 nt, Artificial Sequence
  Description of Artificial Sequence: Synthetic oligonucleotide
ccucccccuuguucagcc

SEQ ID NO: 6690 - RNA, 18 nt, Artificial Sequence
  Description of Artificial Sequence: Synthetic oligonucleotide
gucaaccucccccuuguu

SEQ ID NO: 6691 - RNA, 18 nt, Artificial Sequence
  Description of Artificial Sequence: Synthetic oligonucleotide
acagagucaaccuccccc

SEQ ID NO: 6692 - RNA, 18 nt, Artificial Sequence
  Description of Artificial Sequence: Synthetic oligonucleotide
agccaacagagucaaccu

SEQ ID NO: 6693 - RNA, 18 nt, Artificial Sequence
  Description of Artificial Sequence: Synthetic oligonucleotide
auuacagccaacagaguc

SEQ ID NO: 6694 - RNA, 18 nt, Artificial Sequence
  Description of Artificial Sequence: Synthetic oligonucleotide
gcuucauuacagccaaca

SEQ ID NO: 6695 - RNA, 18 nt, Artificial Sequence
  Description of Artificial Sequence: Synthetic oligonucleotide
aagaagcuucauuacagc

SEQ ID NO: 6696 - RNA, 18 nt, Artificial Sequence
  Description of Artificial Sequence: Synthetic oligonucleotide
uucuaaagaagcuucauu

SEQ ID NO: 6697 - RNA, 18 nt, Artificial Sequence
  Description of Artificial Sequence: Synthetic oligonucleotide
aucauuucuaaagaagcu

SEQ ID NO: 6698 - RNA, 18 nt, Artificial Sequence
  Description of Artificial Sequence: Synthetic oligonucleotide
aaccaaucauuucuaaag

SEQ ID NO: 6699 - RNA, 18 nt, Artificial Sequence
  Description of Artificial Sequence: Synthetic oligonucleotide
gccaaaaccaaucauuuc

SEQ ID NO: 6700 - RNA, 18 nt, Artificial Sequence
  Description of Artificial Sequence: Synthetic oligonucleotide
guacggccaaaaccaauc

SEQ ID NO: 6701 - RNA, 18 nt, Artificial Sequence
  Description of Artificial Sequence: Synthetic oligonucleotide
accgcguacggccaaaac

SEQ ID NO: 6702 - RNA, 18 nt, Artificial Sequence
  Description of Artificial Sequence: Synthetic oligonucleotide
gagccaccgcguacggcc

SEQ ID NO: 6703 - RNA, 18 nt, Artificial Sequence
  Description of Artificial Sequence: Synthetic oligonucleotide
ggcaugagccaccgcgua

SEQ ID NO: 6704 - RNA, 18 nt, Artificial Sequence
  Description of Artificial Sequence: Synthetic oligonucleotide
uuacaggcaugagccacc

SEQ ID NO: 6705 - RNA, 18 nt, Artificial Sequence
  Description of Artificial Sequence: Synthetic oligonucleotide
ugggauuacaggcaugag

SEQ ID NO: 6706 - RNA, 18 nt, Artificial Sequence
  Description of Artificial Sequence: Synthetic oligonucleotide
agugcugggauuacaggc

SEQ ID NO: 6707 - RNA, 18 nt, Artificial Sequence
  Description of Artificial Sequence: Synthetic oligonucleotide
caaaaagugcugggauua

SEQ ID NO: 6708 - RNA, 18 nt, Artificial Sequence
  Description of Artificial Sequence: Synthetic oligonucleotide
ggccucaaaaagugcugg

SEQ ID NO: 6709 - RNA, 18 nt, Artificial Sequence
  Description of Artificial Sequence: Synthetic oligonucleotide
gccucggccucaaaaagu

SEQ ID NO: 6710 - RNA, 18 nt, Artificial Sequence
  Description of Artificial Sequence: Synthetic oligonucleotide
ugccugccucggccucaa

SEQ ID NO: 6711 - RNA, 18 nt, Artificial Sequence
  Description of Artificial Sequence: Synthetic oligonucleotide
ugauaugccugccucggc

SEQ ID NO: 6712 - RNA, 18 nt, Artificial Sequence
  Description of Artificial Sequence: Synthetic oligonucleotide
ccucgugauaugccugcc

SEQ ID NO: 6713 - RNA, 18 nt, Artificial Sequence
  Description of Artificial Sequence: Synthetic oligonucleotide
ccugaccucgugauaugc

SEQ ID NO: 6714 - RNA, 18 nt, Artificial Sequence
  Description of Artificial Sequence: Synthetic oligonucleotide
aaacuccugaccucguga

SEQ ID NO: 6715 - RNA, 18 nt, Artificial Sequence
  Description of Artificial Sequence: Synthetic oligonucleotide
gucucaaacuccugaccu

SEQ ID NO: 6716 - RNA, 18 nt, Artificial Sequence
  Description of Artificial Sequence: Synthetic oligonucleotide
ggcuggucucaaacuccu

SEQ ID NO: 6717 - RNA, 18 nt, Artificial Sequence
  Description of Artificial Sequence: Synthetic oligonucleotide
ggccaggcuggucucaaa

SEQ ID NO: 6718 - RNA, 18 nt, Artificial Sequence
  Description of Artificial Sequence: Synthetic oligonucleotide
auguuggccaggcugguc

SEQ ID NO: 6719 - RNA, 18 nt, Artificial Sequence
  Description of Artificial Sequence: Synthetic oligonucleotide
ucaccauguuggccaggc

SEQ ID NO: 6720 - RNA, 18 nt, Artificial Sequence
  Description of Artificial Sequence: Synthetic oligonucleotide
ggguuucaccauguuggc

SEQ ID NO: 6721 - RNA, 18 nt, Artificial Sequence
  Description of Artificial Sequence: Synthetic oligonucleotide
agacaggguuucaccaug

SEQ ID NO: 6722 - RNA, 18 nt, Artificial Sequence
  Description of Artificial Sequence: Synthetic oligonucleotide
aguagagacaggguuuca

SEQ ID NO: 6723 - RNA, 18 nt, Artificial Sequence
  Description of Artificial Sequence: Synthetic oligonucleotide
uuuuuaguagagacaggg

SEQ ID NO: 6724 - RNA, 18 nt, Artificial Sequence
  Description of Artificial Sequence: Synthetic oligonucleotide
uuguauuuuuaguagaga

SEQ ID NO: 6725 - RNA, 18 nt, Artificial Sequence
  Description of Artificial Sequence: Synthetic oligonucleotide
aauuuuuguauuuuuagu

SEQ ID NO: 6726 - RNA, 18 nt, Artificial Sequence
  Description of Artificial Sequence: Synthetic oligonucleotide
cagcuaauuuuuguauuu

SEQ ID NO: 6727 - RNA, 18 nt, Artificial Sequence
  Description of Artificial Sequence: Synthetic oligonucleotide
acgcccagcuaauuuuug

SEQ ID NO: 6728 - RNA, 18 nt, Artificial Sequence
  Description of Artificial Sequence: Synthetic oligonucleotide
ccaccacgcccagcuaau

SEQ ID NO: 6729 - RNA, 18 nt, Artificial Sequence
  Description of Artificial Sequence: Synthetic oligonucleotide
gcacgccaccacgcccag

SEQ ID NO: 6730 - RNA, 18 nt, Artificial Sequence
  Description of Artificial Sequence: Synthetic oligonucleotide
caggugcacgccaccacg

SEQ ID NO: 6731 - RNA, 18 nt, Artificial Sequence
  Description of Artificial Sequence: Synthetic oligonucleotide
gacuacaggugcacgcca

SEQ ID NO: 6732 - RNA, 18 nt, Artificial Sequence
  Description of Artificial Sequence: Synthetic oligonucleotide
gcugggacuacaggugca

SEQ ID NO: 6733 - RNA, 18 nt, Artificial Sequence
  Description of Artificial Sequence: Synthetic oligonucleotide
gaguagcugggacuacag

SEQ ID NO: 6734 - RNA, 18 nt, Artificial Sequence
  Description of Artificial Sequence: Synthetic oligonucleotide
uuccugaguagcugggac

SEQ ID NO: 6735 - RNA, 18 nt, Artificial Sequence
  Description of Artificial Sequence: Synthetic oligonucleotide
ucagcuuccugaguagcu

SEQ ID NO: 6736 - RNA, 18 nt, Artificial Sequence
  Description of Artificial Sequence: Synthetic oligonucleotide
cugucucagcuuccugag

SEQ ID NO: 6737 - RNA, 18 nt, Artificial Sequence
  Description of Artificial Sequence: Synthetic oligonucleotide
uucuccugucucagcuuc

SEQ ID NO: 6738 - RNA, 18 nt, Artificial Sequence
  Description of Artificial Sequence: Synthetic oligonucleotide
agugauucuccugucuca

SEQ ID NO: 6739 - RNA, 18 nt, Artificial Sequence
  Description of Artificial Sequence: Synthetic oligonucleotide
guucaagugauucuccug

SEQ ID NO: 6740 - RNA, 18 nt, Artificial Sequence
  Description of Artificial Sequence: Synthetic oligonucleotide
ccuggguucaagugauuc

SEQ ID NO: 6741 - RNA, 18 nt, Artificial Sequence
  Description of Artificial Sequence: Synthetic oligonucleotide
ugccuccuggguucaagu

SEQ ID NO: 6742 - RNA, 18 nt, Artificial Sequence
  Description of Artificial Sequence: Synthetic oligonucleotide
accucugccuccuggguu

SEQ ID NO: 6743 - RNA, 18 nt, Artificial Sequence
  Description of Artificial Sequence: Synthetic oligonucleotide
cugcaaccucugccuccu

SEQ ID NO: 6744 - RNA, 18 nt, Artificial Sequence
  Description of Artificial Sequence: Synthetic oligonucleotide
guucacugcaaccucugc

SEQ ID NO: 6745 - RNA, 18 nt, Artificial Sequence
  Description of Artificial Sequence: Synthetic oligonucleotide
ucucaguucacugcaacc

SEQ ID NO: 6746 - RNA, 18 nt, Artificial Sequence
  Description of Artificial Sequence: Synthetic oligonucleotide
cgcaaucucaguucacug

SEQ ID NO: 6747 - RNA, 18 nt, Artificial Sequence
  Description of Artificial Sequence: Synthetic oligonucleotide
aguggcgcaaucucaguu

SEQ ID NO: 6748 - RNA, 18 nt, Artificial Sequence
  Description of Artificial Sequence: Synthetic oligonucleotide
agugcaguggcgcaaucu

SEQ ID NO: 6749 - RNA, 18 nt, Artificial Sequence
  Description of Artificial Sequence: Synthetic oligonucleotide
uuugucccuagaccuaua

SEQ ID NO: 6750 - RNA, 18 nt, Artificial Sequence
  Description of Artificial Sequence: Synthetic oligonucleotide
cugcuuuugucccuagac

SEQ ID NO: 6751 - RNA, 18 nt, Artificial Sequence
  Description of Artificial Sequence: Synthetic oligonucleotide
guggccugcuuuuguccc

SEQ ID NO: 6752 - RNA, 18 nt, Artificial Sequence
  Description of Artificial Sequence: Synthetic oligonucleotide
uaucaguggccugcuuuu

SEQ ID NO: 6753 - RNA, 18 nt, Artificial Sequence
  Description of Artificial Sequence: Synthetic oligonucleotide
ccacuuaucaguggccug

SEQ ID NO: 6754 - RNA, 18 nt, Artificial Sequence
  Description of Artificial Sequence: Synthetic oligonucleotide
aucugccacuuaucagug

SEQ ID NO: 6755 - RNA, 18 nt, Artificial Sequence
  Description of Artificial Sequence: Synthetic oligonucleotide
caggcaucugccacuuau

SEQ ID NO: 6756 - RNA, 18 nt, Artificial Sequence
  Description of Artificial Sequence: Synthetic oligonucleotide
gggaucaggcaucugcca

SEQ ID NO: 6757 - RNA, 18 nt, Artificial Sequence
  Description of Artificial Sequence: Synthetic oligonucleotide
acuccccacuaccuaggg

SEQ ID NO: 6758 - RNA, 18 nt, Artificial Sequence
  Description of Artificial Sequence: Synthetic oligonucleotide
ucacacuccccacuaccu

SEQ ID NO: 6759 - RNA, 18 nt, Artificial Sequence
  Description of Artificial Sequence: Synthetic oligonucleotide
cagucucacacuccccac

SEQ ID NO: 6760 - RNA, 18 nt, Artificial Sequence
  Description of Artificial Sequence: Synthetic oligonucleotide
uaacccagucucacacuc

SEQ ID NO: 6761 - RNA, 18 nt, Artificial Sequence
  Description of Artificial Sequence: Synthetic oligonucleotide
ucuuauaacccagucuca

SEQ ID NO: 6762 - RNA, 18 nt, Artificial Sequence
  Description of Artificial Sequence: Synthetic oligonucleotide
aggcuucuuauaacccag

SEQ ID NO: 6763 - RNA, 18 nt, Artificial Sequence
  Description of Artificial Sequence: Synthetic oligonucleotide
agugaaggcuucuuauaa

SEQ ID NO: 6764 - RNA, 18 nt, Artificial Sequence
  Description of Artificial Sequence: Synthetic oligonucleotide
aagauagugaaggcuucu

SEQ ID NO: 6765 - RNA, 18 nt, Artificial Sequence
  Description of Artificial Sequence: Synthetic oligonucleotide
ccuaaaagauagugaagg

SEQ ID NO: 6766 - RNA, 18 nt, Artificial Sequence
  Description of Artificial Sequence: Synthetic oligonucleotide
aggguccuaaaagauagu

SEQ ID NO: 6767 - RNA, 18 nt, Artificial Sequence
  Description of Artificial Sequence: Synthetic oligonucleotide
aagggaggguccuaaaag

SEQ ID NO: 6768 - RNA, 18 nt, Artificial Sequence
  Description of Artificial Sequence: Synthetic oligonucleotide
uccucaagggaggguccu

SEQ ID NO: 6769 - RNA, 18 nt, Artificial Sequence
  Description of Artificial Sequence: Synthetic oligonucleotide
uggccuccucaagggagg

SEQ ID NO: 6770 - RNA, 18 nt, Artificial Sequence
  Description of Artificial Sequence: Synthetic oligonucleotide
uagacuggccuccucaag

SEQ ID NO: 6771 - RNA, 18 nt, Artificial Sequence
  Description of Artificial Sequence: Synthetic oligonucleotide
ugugguagacuggccucc

SEQ ID NO: 6772 - RNA, 18 nt, Artificial Sequence
  Description of Artificial Sequence: Synthetic oligonucleotide
gcaauugugguagacugg

SEQ ID NO: 6773 - RNA, 18 nt, Artificial Sequence
  Description of Artificial Sequence: Synthetic oligonucleotide
cuaaagcaauugugguag

SEQ ID NO: 6774 - RNA, 18 nt, Artificial Sequence
  Description of Artificial Sequence: Synthetic oligonucleotide
ucauucuaaagcaauugu

SEQ ID NO: 6775 - RNA, 18 nt, Artificial Sequence
  Description of Artificial Sequence: Synthetic oligonucleotide
gaccuucauucuaaagca

SEQ ID NO: 6776 - RNA, 18 nt, Artificial Sequence
  Description of Artificial Sequence: Synthetic oligonucleotide
caaaagaccuucauucua

SEQ ID NO: 6777 - RNA, 18 nt, Artificial Sequence
  Description of Artificial Sequence: Synthetic oligonucleotide
gcaaccaaaagaccuuca

SEQ ID NO: 6778 - RNA, 18 nt, Artificial Sequence
  Description of Artificial Sequence: Synthetic oligonucleotide
ugugagcaaccaaaagac

SEQ ID NO: 6779 - RNA, 18 nt, Artificial Sequence
  Description of Artificial Sequence: Synthetic oligonucleotide
agucuugugagcaaccaa

SEQ ID NO: 6780 - RNA, 18 nt, Artificial Sequence
  Description of Artificial Sequence: Synthetic oligonucleotide
auuauagucuugugagca

SEQ ID NO: 6781 - RNA, 18 nt, Artificial Sequence
  Description of Artificial Sequence: Synthetic oligonucleotide
uuaccauuauagucuugu

SEQ ID NO: 6782 - RNA, 18 nt, Artificial Sequence
  Description of Artificial Sequence: Synthetic oligonucleotide
aaaaauuaccauuauagu

SEQ ID NO: 6783 - RNA, 18 nt, Artificial Sequence
  Description of Artificial Sequence: Synthetic oligonucleotide
gagccaaaaauuaccauu

SEQ ID NO: 6784 - RNA, 18 nt, Artificial Sequence
  Description of Artificial Sequence: Synthetic oligonucleotide
augaugagccaaaaauua

SEQ ID NO: 6785 - RNA, 18 nt, Artificial Sequence
  Description of Artificial Sequence: Synthetic oligonucleotide
caaaaaugaugagccaaa

SEQ ID NO: 6786 - RNA, 18 nt, Artificial Sequence
  Description of Artificial Sequence: Synthetic oligonucleotide
acacacaaaaaugaugag

SEQ ID NO: 6787 - RNA, 18 nt, Artificial Sequence
  Description of Artificial Sequence: Synthetic oligonucleotide
cccacacacacaaaaaug

SEQ ID NO: 6788 - RNA, 18 nt, Artificial Sequence
  Description of Artificial Sequence: Synthetic oligonucleotide
uaaaacccacacacacaa

SEQ ID NO: 6789 - RNA, 18 nt, Artificial Sequence
  Description of Artificial Sequence: Synthetic oligonucleotide
uaagauaaaacccacaca

SEQ ID NO: 6790 - RNA, 18 nt, Artificial Sequence
  Description of Artificial Sequence: Synthetic oligonucleotide
ugaauuaagauaaaaccc

SEQ ID NO: 6791 - RNA, 18 nt, Artificial Sequence
  Description of Artificial Sequence: Synthetic oligonucleotide
aacaaugaauuaagauaa

SEQ ID NO: 6792 - RNA, 18 nt, Artificial Sequence
  Description of Artificial Sequence: Synthetic oligonucleotide
ucuuuaacaaugaauuaa

SEQ ID NO: 6793 - RNA, 18 nt, Artificial Sequence
  Description of Artificial Sequence: Synthetic oligonucleotide
cuaucucuuuaacaauga

SEQ ID NO: 6794 - RNA, 18 nt, Artificial Sequence
  Description of Artificial Sequence: Synthetic oligonucleotide
acccacuaucucuuuaac

SEQ ID NO: 6795 - RNA, 18 nt, Artificial Sequence
  Description of Artificial Sequence: Synthetic oligonucleotide
gggaaacccacuaucucu

SEQ ID NO: 6796 - RNA, 18 nt, Artificial Sequence
  Description of Artificial Sequence: Synthetic oligonucleotide
uaggaaacuagcucaggg

SEQ ID NO: 6797 - RNA, 18 nt, Artificial Sequence
  Description of Artificial Sequence: Synthetic oligonucleotide
ugauaggaaacuagcuca

SEQ ID NO: 6798 - RNA, 18 nt, Artificial Sequence
  Description of Artificial Sequence: Synthetic oligonucleotide
acagaugauaggaaacua

SEQ ID NO: 6799 - RNA, 18 nt, Artificial Sequence
  Description of Artificial Sequence: Synthetic oligonucleotide
uaggcacagaugauagga

SEQ ID NO: 6800 - RNA, 18 nt, Artificial Sequence
  Description of Artificial Sequence: Synthetic oligonucleotide
aaacauaggcacagauga

SEQ ID NO: 6801 - RNA, 18 nt, Artificial Sequence
  Description of Artificial Sequence: Synthetic oligonucleotide
gaagcaaacauaggcaca

SEQ ID NO: 6802 - RNA, 18 nt, Artificial Sequence
  Description of Artificial Sequence: Synthetic oligonucleotide
ucagugaagcaaacauag

SEQ ID NO: 6803 - RNA, 18 nt, Artificial Sequence
  Description of Artificial Sequence: Synthetic oligonucleotide
auagcucagugaagcaaa

SEQ ID NO: 6804 - RNA, 18 nt, Artificial Sequence
  Description of Artificial Sequence: Synthetic oligonucleotide
uccccauagcucagugaa

SEQ ID NO: 6805 - RNA, 18 nt, Artificial Sequence
  Description of Artificial Sequence: Synthetic oligonucleotide
cucuuuccccauagcuca

SEQ ID NO: 6806 - RNA, 18 nt, Artificial Sequence
  Description of Artificial Sequence: Synthetic oligonucleotide
agugacucuuuccccaua

SEQ ID NO: 6807 - RNA, 18 nt, Artificial Sequence
  Description of Artificial Sequence: Synthetic oligonucleotide
cagccagugacucuuucc

SEQ ID NO: 6808 - RNA, 18 nt, Artificial Sequence
  Description of Artificial Sequence: Synthetic oligonucleotide
caaagcagccagugacuc

SEQ ID NO: 6809 - RNA, 18 nt, Artificial Sequence
  Description of Artificial Sequence: Synthetic oligonucleotide
guaaacaaagcagccagu

SEQ ID NO: 6810 - RNA, 18 nt, Artificial Sequence
  Description of Artificial Sequence: Synthetic oligonucleotide
uuuuuguaaacaaagcag

SEQ ID NO: 6811 - RNA, 18 nt, Artificial Sequence
  Description of Artificial Sequence: Synthetic oligonucleotide
cuuucuuuuuguaaacaa

SEQ ID NO: 6812 - RNA, 18 nt, Artificial Sequence
  Description of Artificial Sequence: Synthetic oligonucleotide
cuguccuuucuuuuugua

SEQ ID NO: 6813 - RNA, 18 nt, Artificial Sequence
  Description of Artificial Sequence: Synthetic oligonucleotide
ucagccuguccuuucuuu

SEQ ID NO: 6814 - RNA, 18 nt, Artificial Sequence
  Description of Artificial Sequence: Synthetic oligonucleotide
aaggcucagccuguccuu

SEQ ID NO: 6815 - RNA, 18 nt, Artificial Sequence
  Description of Artificial Sequence: Synthetic oligonucleotide
uccuuaaggcucagccug

SEQ ID NO: 6816 - RNA, 18 nt, Artificial Sequence
  Description of Artificial Sequence: Synthetic oligonucleotide
ccuacuccuuaaggcuca

SEQ ID NO: 6817 - RNA, 18 nt, Artificial Sequence
  Description of Artificial Sequence: Synthetic oligonucleotide
uccuuccuacuccuuaag

SEQ ID NO: 6818 - RNA, 18 nt, Artificial Sequence
  Description of Artificial Sequence: Synthetic oligonucleotide
ggaacuccuuccuacucc

SEQ ID NO: 6819 - RNA, 18 nt, Artificial Sequence
  Description of Artificial Sequence: Synthetic oligonucleotide
gccaaggaacuccuuccu

SEQ ID NO: 6820 - RNA, 18 nt, Artificial Sequence
  Description of Artificial Sequence: Synthetic oligonucleotide
gguaggccaaggaacucc

SEQ ID NO: 6821 - RNA, 18 nt, Artificial Sequence
  Description of Artificial Sequence: Synthetic oligonucleotide
ugaaggguaggccaagga

SEQ ID NO: 6822 - RNA, 18 nt, Artificial Sequence
  Description of Artificial Sequence: Synthetic oligonucleotide
ggagaugaaggguaggcc

SEQ ID NO: 6823 - RNA, 18 nt, Artificial Sequence
  Description of Artificial Sequence: Synthetic oligonucleotide
cuuguggagaugaagggu

SEQ ID NO: 6824 - RNA, 18 nt, Artificial Sequence
  Description of Artificial Sequence: Synthetic oligonucleotide
uuucacuuguggagauga

SEQ ID NO: 6825 - RNA, 18 nt, Artificial Sequence
  Description of Artificial Sequence: Synthetic oligonucleotide
gggcuuuucacuugugga

SEQ ID NO: 6826 - RNA, 18 nt, Artificial Sequence
  Description of Artificial Sequence: Synthetic oligonucleotide
uuucugcuacgcuaaggg

SEQ ID NO: 6827 - RNA, 18 nt, Artificial Sequence
  Description of Artificial Sequence: Synthetic oligonucleotide
auuuucugcuacgcuaag

SEQ ID NO: 6828 - RNA, 18 nt, Artificial Sequence
  Description of Artificial Sequence: Synthetic oligonucleotide
cuggaauuuucugcuacg

SEQ ID NO: 6829 - RNA, 18 nt, Artificial Sequence
  Description of Artificial Sequence: Synthetic oligonucleotide
ucaaccuggaauuuucug

SEQ ID NO: 6830 - RNA, 18 nt, Artificial Sequence
  Description of Artificial Sequence: Synthetic oligonucleotide
gaccuucaaccuggaauu

SEQ ID NO: 6831 - RNA, 18 nt, Artificial Sequence
  Description of Artificial Sequence: Synthetic oligonucleotide
aaagagaccuucaaccug

SEQ ID NO: 6832 - RNA, 18 nt, Artificial Sequence
  Description of Artificial Sequence: Synthetic oligonucleotide
ucuccaaagagaccuuca

SEQ ID NO: 6833 - RNA, 18 nt, Artificial Sequence
  Description of Artificial Sequence: Synthetic oligonucleotide
ugccuucuccaaagagac

SEQ ID NO: 6834 - RNA, 18 nt, Artificial Sequence
  Description of Artificial Sequence: Synthetic oligonucleotide
ccuucugccuucuccaaa

SEQ ID NO: 6835 - RNA, 18 nt, Artificial Sequence
  Description of Artificial Sequence: Synthetic oligonucleotide
ucacuccuucugccuucu

SEQ ID NO: 6836 - RNA, 18 nt, Artificial Sequence
  Description of Artificial Sequence: Synthetic oligonucleotide
cuaggucacuccuucugc

SEQ ID NO: 6837 - RNA, 18 nt, Artificial Sequence
  Description of Artificial Sequence: Synthetic oligonucleotide
ggagucuaggucacuccu

SEQ ID NO: 6838 - RNA, 18 nt, Artificial Sequence
  Description of Artificial Sequence: Synthetic oligonucleotide
gaacaggagucuagguca

SEQ ID NO: 6839 - RNA, 18 nt, Artificial Sequence
  Description of Artificial Sequence: Synthetic oligonucleotide
ugugugaacaggagucua

SEQ ID NO: 6840 - RNA, 18 nt, Artificial Sequence
  Description of Artificial Sequence: Synthetic oligonucleotide
uuagaugugugaacagga

SEQ ID NO: 6841 - RNA, 18 nt, Artificial Sequence
  Description of Artificial Sequence: Synthetic oligonucleotide
gacaaccuggaauuuaaa

SEQ ID NO: 6842 - RNA, 18 nt, Artificial Sequence
  Description of Artificial Sequence: Synthetic oligonucleotide
uugaugacaaccuggaau

SEQ ID NO: 6843 - RNA, 18 nt, Artificial Sequence
  Description of Artificial Sequence: Synthetic oligonucleotide
ggccauugaugacaaccu

SEQ ID NO: 6844 - RNA, 18 nt, Artificial Sequence
  Description of Artificial Sequence: Synthetic oligonucleotide
cucucggccauugaugac

SEQ ID NO: 6845 - RNA, 18 nt, Artificial Sequence
  Description of Artificial Sequence: Synthetic oligonucleotide
ggaaacucucggccauug

SEQ ID NO: 6846 - RNA, 18 nt, Artificial Sequence
  Description of Artificial Sequence: Synthetic oligonucleotide
gggaaacucucggccauu

SEQ ID NO: 6847 - RNA, 18 nt, Artificial Sequence
  Description of Artificial Sequence: Synthetic oligonucleotide
cuuccagcuucagcuggg

SEQ ID NO: 6848 - RNA, 18 nt, Artificial Sequence
  Description of Artificial Sequence: Synthetic oligonucleotide
ucuugcuuccagcuucag

SEQ ID NO: 6849 - RNA, 18 nt, Artificial Sequence
  Description of Artificial Sequence: Synthetic oligonucleotide
cacuuucuugcuuccagc

SEQ ID NO: 6850 - RNA, 18 nt, Artificial Sequence
  Description of Artificial Sequence: Synthetic oligonucleotide
uuggccacuuucuugcuu

SEQ ID NO: 6851 - RNA, 18 nt, Artificial Sequence
  Description of Artificial Sequence: Synthetic oligonucleotide
ccugcuuggccacuuucu

SEQ ID NO: 6852 - RNA, 18 nt, Artificial Sequence
  Description of Artificial Sequence: Synthetic oligonucleotide
ugcauccugcuuggccac

SEQ ID NO: 6853 - RNA, 18 nt, Artificial Sequence
  Description of Artificial Sequence: Synthetic oligonucleotide
auagcugcauccugcuug

SEQ ID NO: 6854 - RNA, 18 nt, Artificial Sequence
  Description of Artificial Sequence: Synthetic oligonucleotide
cuuucauagcugcauccu

SEQ ID NO: 6855 - RNA, 18 nt, Artificial Sequence
  Description of Artificial Sequence: Synthetic oligonucleotide
cauggcuuucauagcugc

SEQ ID NO: 6856 - RNA, 18 nt, Artificial Sequence
  Description of Artificial Sequence: Synthetic oligonucleotide
auugucauggcuuucaua

SEQ ID NO: 6857 - RNA, 18 nt, Artificial Sequence
  Description of Artificial Sequence: Synthetic oligonucleotide
gcagaauugucauggcuu

SEQ ID NO: 6858 - RNA, 18 nt, Artificial Sequence
  Description of Artificial Sequence: Synthetic oligonucleotide
cucuagcagaauugucau

SEQ ID NO: 6859 - RNA, 18 nt, Artificial Sequence
  Description of Artificial Sequence: Synthetic oligonucleotide
gcuuccucuagcagaauu

SEQ ID NO: 6860 - RNA, 18 nt, Artificial Sequence
  Description of Artificial Sequence: Synthetic oligonucleotide
cuuuggcuuccucuagca

SEQ ID NO: 6861 - RNA, 18 nt, Artificial Sequence
  Description of Artificial Sequence: Synthetic oligonucleotide
cuuggcuuuggcuuccuc

SEQ ID NO: 6862 - RNA, 18 nt, Artificial Sequence
  Description of Artificial Sequence: Synthetic oligonucleotide
cuguccuuggcuuuggcu

SEQ ID NO: 6863 - RNA, 18 nt, Artificial Sequence
  Description of Artificial Sequence: Synthetic oligonucleotide
uuccacuguccuuggcuu

SEQ ID NO: 6864 - RNA, 18 nt, Artificial Sequence
  Description of Artificial Sequence: Synthetic oligonucleotide
ugauuuuccacuguccuu

SEQ ID NO: 6865 - RNA, 18 nt, Artificial Sequence
  Description of Artificial Sequence: Synthetic oligonucleotide
ucuucugauuuuccacug

SEQ ID NO: 6866 - RNA, 18 nt, Artificial Sequence
  Description of Artificial Sequence: Synthetic oligonucleotide
augauucuucugauuuuc

SEQ ID NO: 6867 - RNA, 18 nt, Artificial Sequence
  Description of Artificial Sequence: Synthetic oligonucleotide
gugggaugauucuucuga

SEQ ID NO: 6868 - RNA, 18 nt, Artificial Sequence
  Description of Artificial Sequence: Synthetic oligonucleotide
gaauagugggaugauucu

SEQ ID NO: 6869 - RNA, 18 nt, Artificial Sequence
  Description of Artificial Sequence: Synthetic oligonucleotide
cuguggaauagugggaug

SEQ ID NO: 6870 - RNA, 18 nt, Artificial Sequence
  Description of Artificial Sequence: Synthetic oligonucleotide
uuucucuguggaauagug

SEQ ID NO: 6871 - RNA, 18 nt, Artificial Sequence
  Description of Artificial Sequence: Synthetic oligonucleotide
gauucuuucucuguggaa

SEQ ID NO: 6872 - RNA, 18 nt, Artificial Sequence
  Description of Artificial Sequence: Synthetic oligonucleotide
ucucugauucuuucucug

SEQ ID NO: 6873 - RNA, 18 nt, Artificial Sequence
  Description of Artificial Sequence: Synthetic oligonucleotide
guauccgcugagggaaua

SEQ ID NO: 6874 - RNA, 18 nt, Artificial Sequence
  Description of Artificial Sequence: Synthetic oligonucleotide
guguaguauccgcugagg

SEQ ID NO: 6875 - RNA, 18 nt, Artificial Sequence
  Description of Artificial Sequence: Synthetic oligonucleotide
gauggguguaguauccgc

SEQ ID NO: 6876 - RNA, 18 nt, Artificial Sequence
  Description of Artificial Sequence: Synthetic oligonucleotide
aaauggauggguguagua

SEQ ID NO: 6877 - RNA, 18 nt, Artificial Sequence
  Description of Artificial Sequence: Synthetic oligonucleotide
ccuugaaauggaugggug

SEQ ID NO: 6878 - RNA, 18 nt, Artificial Sequence
  Description of Artificial Sequence: Synthetic oligonucleotide
cauagccuugaaauggau

SEQ ID NO: 6879 - RNA, 18 nt, Artificial Sequence
  Description of Artificial Sequence: Synthetic oligonucleotide
gugcucauagccuugaaa

SEQ ID NO: 6880 - RNA, 18 nt, Artificial Sequence
  Description of Artificial Sequence: Synthetic oligonucleotide
ugucugugcucauagccu

SEQ ID NO: 6881 - RNA, 18 nt, Artificial Sequence
  Description of Artificial Sequence: Synthetic oligonucleotide
ugagcugucugugcucau

SEQ ID NO: 6882 - RNA, 18 nt, Artificial Sequence
  Description of Artificial Sequence: Synthetic oligonucleotide
guaccugagcugucugug

SEQ ID NO: 6883 - RNA, 18 nt, Artificial Sequence
  Description of Artificial Sequence: Synthetic oligonucleotide
ugcugguaccugagcugu

SEQ ID NO: 6884 - RNA, 18 nt, Artificial Sequence
  Description of Artificial Sequence: Synthetic oligonucleotide
caggcugcugguaccuga

SEQ ID NO: 6885 - RNA, 18 nt, Artificial Sequence
  Description of Artificial Sequence: Synthetic oligonucleotide
uggcccaggcugcuggua

SEQ ID NO: 6886 - RNA, 18 nt, Artificial Sequence
  Description of Artificial Sequence: Synthetic oligonucleotide
gauccuggcccaggcugc

SEQ ID NO: 6887 - RNA, 18 nt, Artificial Sequence
  Description of Artificial Sequence: Synthetic oligonucleotide
gggaagauccuggcccag

SEQ ID NO: 6888 - RNA, 18 nt, Artificial Sequence
  Description of Artificial Sequence: Synthetic oligonucleotide
aagcaggaaacuacuggg

SEQ ID NO: 6889 - RNA, 18 nt, Artificial Sequence
  Description of Artificial Sequence: Synthetic oligonucleotide
cuuaagcaggaaacuacu

SEQ ID NO: 6890 - RNA, 18 nt, Artificial Sequence
  Description of Artificial Sequence: Synthetic oligonucleotide
auuugcuuaagcaggaaa

SEQ ID NO: 6891 - RNA, 18 nt, Artificial Sequence
  Description of Artificial Sequence: Synthetic oligonucleotide
auucuauuugcuuaagca

SEQ ID NO: 6892 - RNA, 18 nt, Artificial Sequence
  Description of Artificial Sequence: Synthetic oligonucleotide
gagaaauucuauuugcuu

SEQ ID NO: 6893 - RNA, 18 nt, Artificial Sequence
  Description of Artificial Sequence: Synthetic oligonucleotide
cccuugagaaauucuauu

SEQ ID NO: 6894 - RNA, 18 nt, Artificial Sequence
  Description of Artificial Sequence: Synthetic oligonucleotide
gcugccccuugagaaauu

SEQ ID NO: 6895 - RNA, 18 nt, Artificial Sequence
  Description of Artificial Sequence: Synthetic oligonucleotide
ugggagcugccccuugag

SEQ ID NO: 6896 - RNA, 18 nt, Artificial Sequence
  Description of Artificial Sequence: Synthetic oligonucleotide
gcuucugggagcugcccc

SEQ ID NO: 6897 - RNA, 18 nt, Artificial Sequence
  Description of Artificial Sequence: Synthetic oligonucleotide
ccggugcuucugggagcu

SEQ ID NO: 6898 - RNA, 18 nt, Artificial Sequence
  Description of Artificial Sequence: Synthetic oligonucleotide
aaucaccggugcuucugg

SEQ ID NO: 6899 - RNA, 18 nt, Artificial Sequence
  Description of Artificial Sequence: Synthetic oligonucleotide
uuuccaaucaccggugcu

SEQ ID NO: 6900 - RNA, 18 nt, Artificial Sequence
  Description of Artificial Sequence: Synthetic oligonucleotide
ucugcuuuccaaucaccg

SEQ ID NO: 6901 - RNA, 18 nt, Artificial Sequence
  Description of Artificial Sequence: Synthetic oligonucleotide
cggugucugcuuuccaau

SEQ ID NO: 6902 - RNA, 18 nt, Artificial Sequence
  Description of Artificial Sequence: Synthetic oligonucleotide
agugacggugucugcuuu

SEQ ID NO: 6903 - RNA, 18 nt, Artificial Sequence
  Description of Artificial Sequence: Synthetic oligonucleotide
guggcagugacggugucu

SEQ ID NO: 6904 - RNA, 18 nt, Artificial Sequence
  Description of Artificial Sequence: Synthetic oligonucleotide
ggaagguggcagugacgg

SEQ ID NO: 6905 - RNA, 18 nt, Artificial Sequence
  Description of Artificial Sequence: Synthetic oligonucleotide
gggagggaagguggcagu

SEQ ID NO: 6906 - RNA, 18 nt, Artificial Sequence
  Description of Artificial Sequence: Synthetic oligonucleotide
guccugggagggaaggug

SEQ ID NO: 6907 - RNA, 18 nt, Artificial Sequence
  Description of Artificial Sequence: Synthetic oligonucleotide
ccggaguccugggaggga

SEQ ID NO: 6908 - RNA, 18 nt, Artificial Sequence
  Description of Artificial Sequence: Synthetic oligonucleotide
cuuggccggaguccuggg

SEQ ID NO: 6909 - RNA, 18 nt, Artificial Sequence
  Description of Artificial Sequence: Synthetic oligonucleotide
gaaaccuuggccggaguc

SEQ ID NO: 6910 - RNA, 18 nt, Artificial Sequence
  Description of Artificial Sequence: Synthetic oligonucleotide
uacuggaaaccuuggccg

SEQ ID NO: 6911 - RNA, 18 nt, Artificial Sequence
  Description of Artificial Sequence: Synthetic oligonucleotide
aguaguacuggaaaccuu

SEQ ID NO: 6912 - RNA, 18 nt, Artificial Sequence
  Description of Artificial Sequence: Synthetic oligonucleotide
aggcaaguaguacuggaa

SEQ ID NO: 6913 - RNA, 18 nt, Artificial Sequence
  Description of Artificial Sequence: Synthetic oligonucleotide
acuggaggcaaguaguac

SEQ ID NO: 6914 - RNA, 18 nt, Artificial Sequence
  Description of Artificial Sequence: Synthetic oligonucleotide
cugguacuggaggcaagu

SEQ ID NO: 6915 - RNA, 18 nt, Artificial Sequence
  Description of Artificial Sequence: Synthetic oligonucleotide
ugccucugguacuggagg

SEQ ID NO: 6916 - RNA, 18 nt, Artificial Sequence
  Description of Artificial Sequence: Synthetic oligonucleotide
uugccugccucugguacu

SEQ ID NO: 6917 - RNA, 18 nt, Artificial Sequence
  Description of Artificial Sequence: Synthetic oligonucleotide
uccacuugccugccucug

SEQ ID NO: 6918 - RNA, 18 nt, Artificial Sequence
  Description of Artificial Sequence: Synthetic oligonucleotide
ugauguccacuugccugc

SEQ ID NO: 6919 - RNA, 18 nt, Artificial Sequence
  Description of Artificial Sequence: Synthetic oligonucleotide
accccugauguccacuug

SEQ ID NO: 6920 - RNA, 18 nt, Artificial Sequence
  Description of Artificial Sequence: Synthetic oligonucleotide
gggacaccccugaugucc

SEQ ID NO: 6921 - RNA, 18 nt, Artificial Sequence
  Description of Artificial Sequence: Synthetic oligonucleotide
gagaugcacgccccuggg

SEQ ID NO: 6922 - RNA, 18 nt, Artificial Sequence
  Description of Artificial Sequence: Synthetic oligonucleotide
uucugagaugcacgcccc

SEQ ID NO: 6923 - RNA, 18 nt, Artificial Sequence
  Description of Artificial Sequence: Synthetic oligonucleotide
cugacuucugagaugcac

SEQ ID NO: 6924 - RNA, 18 nt, Artificial Sequence
  Description of Artificial Sequence: Synthetic oligonucleotide
agccccugacuucugaga

SEQ ID NO: 6925 - RNA, 18 nt, Artificial Sequence
  Description of Artificial Sequence: Synthetic oligonucleotide
ucuggagccccugacuuc

SEQ ID NO: 6926 - RNA, 18 nt, Artificial Sequence
  Description of Artificial Sequence: Synthetic oligonucleotide
cccucucuggagccccug

SEQ ID NO: 6927 - RNA, 18 nt, Artificial Sequence
  Description of Artificial Sequence: Synthetic oligonucleotide
uggaacccucucuggagc

SEQ ID NO: 6928 - RNA, 18 nt, Artificial Sequence
  Description of Artificial Sequence: Synthetic oligonucleotide
gaugcuggaacccucucu

SEQ ID NO: 6929 - RNA, 18 nt, Artificial Sequence
  Description of Artificial Sequence: Synthetic oligonucleotide
ugaaggaugcuggaaccc

SEQ ID NO: 6930 - RNA, 18 nt, Artificial Sequence
  Description of Artificial Sequence: Synthetic oligonucleotide
cguggugaaggaugcugg

SEQ ID NO: 6931 - RNA, 18 nt, Artificial Sequence
  Description of Artificial Sequence: Synthetic oligonucleotide
ugccacguggugaaggau

SEQ ID NO: 6932 - RNA, 18 nt, Artificial Sequence
  Description of Artificial Sequence: Synthetic oligonucleotide
acuccugccacgugguga

SEQ ID NO: 6933 - RNA, 18 nt, Artificial Sequence
  Description of Artificial Sequence: Synthetic oligonucleotide
ggcagacuccugccacgu

SEQ ID NO: 6934 - RNA, 18 nt, Artificial Sequence
  Description of Artificial Sequence: Synthetic oligonucleotide
ucuguggcagacuccugc

SEQ ID NO: 6935 - RNA, 18 nt, Artificial Sequence
  Description of Artificial Sequence: Synthetic oligonucleotide
accucucuguggcagacu

SEQ ID NO: 6936 - RNA, 18 nt, Artificial Sequence
  Description of Artificial Sequence: Synthetic oligonucleotide
ucaacaccucucuguggc

SEQ ID NO: 6937 - RNA, 18 nt, Artificial Sequence
  Description of Artificial Sequence: Synthetic oligonucleotide
ggcaaucaacaccucucu

SEQ ID NO: 6938 - RNA, 18 nt, Artificial Sequence
  Description of Artificial Sequence: Synthetic oligonucleotide
ggaaaggcaaucaacacc

SEQ ID NO: 6939 - RNA, 18 nt, Artificial Sequence
  Description of Artificial Sequence: Synthetic oligonucleotide
ugugaggaaaggcaauca

SEQ ID NO: 6940 - RNA, 18 nt, Artificial Sequence
  Description of Artificial Sequence: Synthetic oligonucleotide
ggaaaugugaggaaaggc

SEQ ID NO: 6941 - RNA, 18 nt, Artificial Sequence
  Description of Artificial Sequence: Synthetic oligonucleotide
uuccuggaaaugugagga

SEQ ID NO: 6942 - RNA, 18 nt, Artificial Sequence
  Description of Artificial Sequence: Synthetic oligonucleotide
cucaguuccuggaaaugu

SEQ ID NO: 6943 - RNA, 18 nt, Artificial Sequence
  Description of Artificial Sequence: Synthetic oligonucleotide
agauacucaguuccugga

SEQ ID NO: 6944 - RNA, 18 nt, Artificial Sequence
  Description of Artificial Sequence: Synthetic oligonucleotide
uugguagauacucaguuc

SEQ ID NO: 6945 - RNA, 18 nt, Artificial Sequence
  Description of Artificial Sequence: Synthetic oligonucleotide
ugaucuugguagauacuc

SEQ ID NO: 6946 - RNA, 18 nt, Artificial Sequence
  Description of Artificial Sequence: Synthetic oligonucleotide
guuccugaucuugguaga

SEQ ID NO: 6947 - RNA, 18 nt, Artificial Sequence
  Description of Artificial Sequence: Synthetic oligonucleotide
ccuuuguuccugaucuug

SEQ ID NO: 6948 - RNA, 18 nt, Artificial Sequence
  Description of Artificial Sequence: Synthetic oligonucleotide
aagauccuuuguuccuga

SEQ ID NO: 6949 - RNA, 18 nt, Artificial Sequence
  Description of Artificial Sequence: Synthetic oligonucleotide
acuuuaagauccuuuguu

SEQ ID NO: 6950 - RNA, 18 nt, Artificial Sequence
  Description of Artificial Sequence: Synthetic oligonucleotide
caggaacuuuaagauccu

SEQ ID NO: 6951 - RNA, 18 nt, Artificial Sequence
  Description of Artificial Sequence: Synthetic oligonucleotide
ucuuccaggaacuuuaag

SEQ ID NO: 6952 - RNA, 18 nt, Artificial Sequence
  Description of Artificial Sequence: Synthetic oligonucleotide
caagcucuuccaggaacu

SEQ ID NO: 6953 - RNA, 18 nt, Artificial Sequence
  Description of Artificial Sequence: Synthetic oligonucleotide
uuccccaagcucuuccag

SEQ ID NO: 6954 - RNA, 18 nt, Artificial Sequence
  Description of Artificial Sequence: Synthetic oligonucleotide
uucccuuccccaagcucu

SEQ ID NO: 6955 - RNA, 18 nt, Artificial Sequence
  Description of Artificial Sequence: Synthetic oligonucleotide
uggccuucccuuccccaa

SEQ ID NO: 6956 - RNA, 18 nt, Artificial Sequence
  Description of Artificial Sequence: Synthetic oligonucleotide
ugugguggccuucccuuc

SEQ ID NO: 6957 - RNA, 18 nt, Artificial Sequence
  Description of Artificial Sequence: Synthetic oligonucleotide
ugugcugugguggccuuc

SEQ ID NO: 6958 - RNA, 18 nt, Artificial Sequence
  Description of Artificial Sequence: Synthetic oligonucleotide
gaucaugugcuguggugg

SEQ ID NO: 6959 - RNA, 18 nt, Artificial Sequence
  Description of Artificial Sequence: Synthetic oligonucleotide
agacagaucaugugcugu

SEQ ID NO: 6960 - RNA, 18 nt, Artificial Sequence
  Description of Artificial Sequence: Synthetic oligonucleotide
uucccagacagaucaugu

SEQ ID NO: 6961 - RNA, 18 nt, Artificial Sequence
  Description of Artificial Sequence: Synthetic oligonucleotide
caaguuucccagacagau

SEQ ID NO: 6962 - RNA, 18 nt, Artificial Sequence
  Description of Artificial Sequence: Synthetic oligonucleotide
agucccaaguuucccaga

SEQ ID NO: 6963 - RNA, 18 nt, Artificial Sequence
  Description of Artificial Sequence: Synthetic oligonucleotide
uucggagucccaaguuuc

SEQ ID NO: 6964 - RNA, 18 nt, Artificial Sequence
  Description of Artificial Sequence: Synthetic oligonucleotide
cuuucuucggagucccaa

SEQ ID NO: 6965 - RNA, 18 nt, Artificial Sequence
  Description of Artificial Sequence: Synthetic oligonucleotide
gauuucuuucuucggagu

SEQ ID NO: 6966 - RNA, 18 nt, Artificial Sequence
  Description of Artificial Sequence: Synthetic oligonucleotide
cgauugauuucuuucuuc

SEQ ID NO: 6967 - RNA, 18 nt, Artificial Sequence
  Description of Artificial Sequence: Synthetic oligonucleotide
aaacucgauugauuucuu

SEQ ID NO: 6968 - RNA, 18 nt, Artificial Sequence
  Description of Artificial Sequence: Synthetic oligonucleotide
guauaaaacucgauugau

SEQ ID NO: 6969 - RNA, 18 nt, Artificial Sequence
  Description of Artificial Sequence: Synthetic oligonucleotide
agggaguauaaaacucga

SEQ ID NO: 6970 - RNA, 18 nt, Artificial Sequence
  Description of Artificial Sequence: Synthetic oligonucleotide
uugccagggaguauaaaa

SEQ ID NO: 6971 - RNA, 18 nt, Artificial Sequence
  Description of Artificial Sequence: Synthetic oligonucleotide
cuucuuugccagggagua

SEQ ID NO: 6972 - RNA, 18 nt, Artificial Sequence
  Description of Artificial Sequence: Synthetic oligonucleotide
uugcccuucuuugccagg

SEQ ID NO: 6973 - RNA, 18 nt, Artificial Sequence
  Description of Artificial Sequence: Synthetic oligonucleotide
guagcuugcccuucuuug

SEQ ID NO: 6974 - RNA, 18 nt, Artificial Sequence
  Description of Artificial Sequence: Synthetic oligonucleotide
uuucuguagcuugcccuu

SEQ ID NO: 6975 - RNA, 18 nt, Artificial Sequence
  Description of Artificial Sequence: Synthetic oligonucleotide
gccucuuucuguagcuug

SEQ ID NO: 6976 - RNA, 18 nt, Artificial Sequence
  Description of Artificial Sequence: Synthetic oligonucleotide
uuccugccucuuucugua

SEQ ID NO: 6977 - RNA, 18 nt, Artificial Sequence
  Description of Artificial Sequence: Synthetic oligonucleotide
ggguguuccugccucuuu

SEQ ID NO: 6978 - RNA, 18 nt, Artificial Sequence
  Description of Artificial Sequence: Synthetic oligonucleotide
gcgauuuuccacaaaggg

SEQ ID NO: 6979 - RNA, 18 nt, Artificial Sequence
  Description of Artificial Sequence: Synthetic oligonucleotide
accgcgauuuuccacaaa

SEQ ID NO: 6980 - RNA, 18 nt, Artificial Sequence
  Description of Artificial Sequence: Synthetic oligonucleotide
uggagaccgcgauuuucc

SEQ ID NO: 6981 - RNA, 18 nt, Artificial Sequence
  Description of Artificial Sequence: Synthetic oligonucleotide
cugaguggagaccgcgau

SEQ ID NO: 6982 - RNA, 18 nt, Artificial Sequence
  Description of Artificial Sequence: Synthetic oligonucleotide
caagccugaguggagacc

SEQ ID NO: 6983 - RNA, 18 nt, Artificial Sequence
  Description of Artificial Sequence: Synthetic oligonucleotide
gguuccaagccugagugg

SEQ ID NO: 6984 - RNA, 18 nt, Artificial Sequence
  Description of Artificial Sequence: Synthetic oligonucleotide
gugcugguuccaagccug

SEQ ID NO: 6985 - RNA, 18 nt, Artificial Sequence
  Description of Artificial Sequence: Synthetic oligonucleotide
ccgcugugcugguuccaa

SEQ ID NO: 6986 - RNA, 18 nt, Artificial Sequence
  Description of Artificial Sequence: Synthetic oligonucleotide
ccacuccgcugugcuggu

SEQ ID NO: 6987 - RNA, 18 nt, Artificial Sequence
  Description of Artificial Sequence: Synthetic oligonucleotide
ucuuaccacuccgcugug

SEQ ID NO: 6988 - RNA, 18 nt, Artificial Sequence
  Description of Artificial Sequence: Synthetic oligonucleotide
ucuggucuuaccacuccg

SEQ ID NO: 6989 - RNA, 18 nt, Artificial Sequence
  Description of Artificial Sequence: Synthetic oligonucleotide
gaccgucuggucuuacca

SEQ ID NO: 6990 - RNA, 18 nt, Artificial Sequence
  Description of Artificial Sequence: Synthetic oligonucleotide
gcuaugaccgucuggucu

SEQ ID NO: 6991 - RNA, 18 nt, Artificial Sequence
  Description of Artificial Sequence: Synthetic oligonucleotide
ccuuggcuaugaccgucu

SEQ ID NO: 6992 - RNA, 18 nt, Artificial Sequence
  Description of Artificial Sequence: Synthetic oligonucleotide
gggcuccuuggcuaugac

SEQ ID NO: 6993 - RNA, 18 nt, Artificial Sequence
  Description of Artificial Sequence: Synthetic oligonucleotide
cucgggucugaguuuggg

SEQ ID NO: 6994 - RNA, 18 nt, Artificial Sequence
  Description of Artificial Sequence: Synthetic oligonucleotide
acucgggucugaguuugg

SEQ ID NO: 6995 - RNA, 18 nt, Artificial Sequence
  Description of Artificial Sequence: Synthetic oligonucleotide
uccaaacucgggucugag

SEQ ID NO: 6996 - RNA, 18 nt, Artificial Sequence
  Description of Artificial Sequence: Synthetic oligonucleotide
ccgguuccaaacucgggu

SEQ ID NO: 6997 - RNA, 18 nt, Artificial Sequence
  Description of Artificial Sequence: Synthetic oligonucleotide
gucuuccgguuccaaacu

SEQ ID NO: 6998 - RNA, 18 nt, Artificial Sequence
  Description of Artificial Sequence: Synthetic oligonucleotide
uuucugucuuccgguucc

SEQ ID NO: 6999 - RNA, 18 nt, Artificial Sequence
  Description of Artificial Sequence: Synthetic oligonucleotide
uggaguuucugucuuccg

SEQ ID NO: 7000 - RNA, 18 nt, Artificial Sequence
  Description of Artificial Sequence: Synthetic oligonucleotide
agauguggaguuucuguc

SEQ ID NO: 7001 - RNA, 18 nt, Artificial Sequence
  Description of Artificial Sequence: Synthetic oligonucleotide
gagacagauguggaguuu

SEQ ID NO: 7002 - RNA, 18 nt, Artificial Sequence
  Description of Artificial Sequence: Synthetic oligonucleotide
cuucugagacagaugugg

SEQ ID NO: 7003 - RNA, 18 nt, Artificial Sequence
  Description of Artificial Sequence: Synthetic oligonucleotide
aagaucuucugagacaga

SEQ ID NO: 7004 - RNA, 18 nt, Artificial Sequence
  Description of Artificial Sequence: Synthetic oligonucleotide
ucaagaagaucuucugag

SEQ ID NO: 7005 - RNA, 18 nt, Artificial Sequence
  Description of Artificial Sequence: Synthetic oligonucleotide
aaggcucaagaagaucuu

SEQ ID NO: 7006 - RNA, 18 nt, Artificial Sequence
  Description of Artificial Sequence: Synthetic oligonucleotide
aauaaaaggcucaagaag

SEQ ID NO: 7007 - RNA, 18 nt, Artificial Sequence
  Description of Artificial Sequence: Synthetic oligonucleotide
acugcaauaaaaggcuca

SEQ ID NO: 7008 - RNA, 18 nt, Artificial Sequence
  Description of Artificial Sequence: Synthetic oligonucleotide
cugagacugcaauaaaag

SEQ ID NO: 7009 - RNA, 18 nt, Artificial Sequence
  Description of Artificial Sequence: Synthetic oligonucleotide
cugagcugagacugcaau

SEQ ID NO: 7010 - RNA, 18 nt, Artificial Sequence
  Description of Artificial Sequence: Synthetic oligonucleotide
caagccugagcugagacu

SEQ ID NO: 7011 - RNA, 18 nt, Artificial Sequence
  Description of Artificial Sequence: Synthetic oligonucleotide
gguuccaagccugagcug

SEQ ID NO: 7012 - RNA, 18 nt, Artificial Sequence
  Description of Artificial Sequence: Synthetic oligonucleotide
gugcugguuccaagccug

SEQ ID NO: 7013 - RNA, 18 nt, Artificial Sequence
  Description of Artificial Sequence: Synthetic oligonucleotide
ccgcugugcugguuccaa

SEQ ID NO: 7014 - RNA, 18 nt, Artificial Sequence
  Description of Artificial Sequence: Synthetic oligonucleotide
ccacuccgcugugcuggu

SEQ ID NO: 7015 - RNA, 18 nt, Artificial Sequence
  Description of Artificial Sequence: Synthetic oligonucleotide
ucuuaccacuccgcugug

SEQ ID NO: 7016 - RNA, 18 nt, Artificial Sequence
  Description of Artificial Sequence: Synthetic oligonucleotide
ucuggucuuaccacuccg

SEQ ID NO: 7017 - RNA, 18 nt, Artificial Sequence
  Description of Artificial Sequence: Synthetic oligonucleotide
gacugucuggucuuacca

SEQ ID NO: 7018 - RNA, 18 nt, Artificial Sequence
  Description of Artificial Sequence: Synthetic oligonucleotide
gcuaugacugucuggucu

SEQ ID NO: 7019 - RNA, 18 nt, Artificial Sequence
  Description of Artificial Sequence: Synthetic oligonucleotide
ccuuggcuaugacugucu

SEQ ID NO: 7020 - RNA, 18 nt, Artificial Sequence
  Description of Artificial Sequence: Synthetic oligonucleotide
gggauccuuggcuaugac

SEQ ID NO: 7021 - RNA, 18 nt, Artificial Sequence
  Description of Artificial Sequence: Synthetic oligonucleotide
ccugggucugaguuuggg

SEQ ID NO: 7022 - RNA, 18 nt, Artificial Sequence
  Description of Artificial Sequence: Synthetic oligonucleotide
caaaccugggucugaguu

SEQ ID NO: 7023 - RNA, 18 nt, Artificial Sequence
  Description of Artificial Sequence: Synthetic oligonucleotide
gguuccaaaccugggucu

SEQ ID NO: 7024 - RNA, 18 nt, Artificial Sequence
  Description of Artificial Sequence: Synthetic oligonucleotide
cuucagguuccaaaccug

SEQ ID NO: 7025 - RNA, 18 nt, Artificial Sequence
  Description of Artificial Sequence: Synthetic oligonucleotide
gcugucuucagguuccaa

SEQ ID NO: 7026 - RNA, 18 nt, Artificial Sequence
  Description of Artificial Sequence: Synthetic oligonucleotide
gaguugcugucuucaggu

SEQ ID NO: 7027 - RNA, 18 nt, Artificial Sequence
  Description of Artificial Sequence: Synthetic oligonucleotide
auguggaguugcugucuu

SEQ ID NO: 7028 - RNA, 18 nt, Artificial Sequence
  Description of Artificial Sequence: Synthetic oligonucleotide
ggcagauguggaguugcu

SEQ ID NO: 7029 - RNA, 18 nt, Artificial Sequence
  Description of Artificial Sequence: Synthetic oligonucleotide
uccaaggcagauguggag

SEQ ID NO: 7030 - RNA, 18 nt, Artificial Sequence
  Description of Artificial Sequence: Synthetic oligonucleotide
gaucuuccaaggcagaug

SEQ ID NO: 7031 - RNA, 18 nt, Artificial Sequence
  Description of Artificial Sequence: Synthetic oligonucleotide
aagaggaucuuccaaggc

SEQ ID NO: 7032 - RNA, 18 nt, Artificial Sequence
  Description of Artificial Sequence: Synthetic oligonucleotide
aacucaagaggaucuucc

SEQ ID NO: 7033 - RNA, 18 nt, Artificial Sequence
  Description of Artificial Sequence: Synthetic oligonucleotide
cuaaaaacucaagaggau

SEQ ID NO: 7034 - RNA, 18 nt, Artificial Sequence
  Description of Artificial Sequence: Synthetic oligonucleotide
caugucuaaaaacucaag

SEQ ID NO: 7035 - RNA, 18 nt, Artificial Sequence
  Description of Artificial Sequence: Synthetic oligonucleotide
ucggccaugucuaaaaac

SEQ ID NO: 7036 - RNA, 18 nt, Artificial Sequence
  Description of Artificial Sequence: Synthetic oligonucleotide
ugaucucggccaugucua

SEQ ID NO: 7037 - RNA, 18 nt, Artificial Sequence
  Description of Artificial Sequence: Synthetic oligonucleotide
cuccuugaucucggccau

SEQ ID NO: 7038 - RNA, 18 nt, Artificial Sequence
  Description of Artificial Sequence: Synthetic oligonucleotide
auuuucuccuugaucucg

SEQ ID NO: 7039 - RNA, 18 nt, Artificial Sequence
  Description of Artificial Sequence: Synthetic oligonucleotide
cgcagauuuucuccuuga

SEQ ID NO: 7040 - RNA, 18 nt, Artificial Sequence
  Description of Artificial Sequence: Synthetic oligonucleotide
auagucgcagauuuucuc

SEQ ID NO: 7041 - RNA, 18 nt, Artificial Sequence
  Description of Artificial Sequence: Synthetic oligonucleotide
aagagauagucgcagauu

SEQ ID NO: 7042 - RNA, 18 nt, Artificial Sequence
  Description of Artificial Sequence: Synthetic oligonucleotide
cauugaagagauagucgc

SEQ ID NO: 7043 - RNA, 18 nt, Artificial Sequence
  Description of Artificial Sequence: Synthetic oligonucleotide
agacacauugaagagaua

SEQ ID NO: 7044 - RNA, 18 nt, Artificial Sequence
  Description of Artificial Sequence: Synthetic oligonucleotide
gagucagacacauugaag

SEQ ID NO: 7045 - RNA, 18 nt, Artificial Sequence
  Description of Artificial Sequence: Synthetic oligonucleotide
cagaggagucagacacau

SEQ ID NO: 7046 - RNA, 18 nt, Artificial Sequence
  Description of Artificial Sequence: Synthetic oligonucleotide
cagggcagaggagucaga

SEQ ID NO: 7047 - RNA, 18 nt, Artificial Sequence
  Description of Artificial Sequence: Synthetic oligonucleotide
aaauucagggcagaggag

SEQ ID NO: 7048 - RNA, 18 nt, Artificial Sequence
  Description of Artificial Sequence: Synthetic oligonucleotide
uagccaaauucagggcag

SEQ ID NO: 7049 - RNA, 18 nt, Artificial Sequence
  Description of Artificial Sequence: Synthetic oligonucleotide
auuuuuagccaaauucag

SEQ ID NO: 7050 - RNA, 18 nt, Artificial Sequence
  Description of Artificial Sequence: Synthetic oligonucleotide
ccaauauuuuuagccaaa

SEQ ID NO: 7051 - RNA, 18 nt, Artificial Sequence
  Description of Artificial Sequence: Synthetic oligonucleotide
uaaggccaauauuuuuag

SEQ ID NO: 7052 - RNA, 18 nt, Artificial Sequence
  Description of Artificial Sequence: Synthetic oligonucleotide
cuugguaaggccaauauu

SEQ ID NO: 7053 - RNA, 18 nt, Artificial Sequence
  Description of Artificial Sequence: Synthetic oligonucleotide
cgggccuugguaaggcca

SEQ ID NO: 7054 - RNA, 18 nt, Artificial Sequence
  Description of Artificial Sequence: Synthetic oligonucleotide
uaucucgggccuugguaa

SEQ ID NO: 7055 - RNA, 18 nt, Artificial Sequence
  Description of Artificial Sequence: Synthetic oligonucleotide
auuuauaucucgggccuu

SEQ ID NO: 7056 - RNA, 18 nt, Artificial Sequence
  Description of Artificial Sequence: Synthetic oligonucleotide
acagcauuuauaucucgg

SEQ ID NO: 7057 - RNA, 18 nt, Artificial Sequence
  Description of Artificial Sequence: Synthetic oligonucleotide
uuagcacagcauuuauau

SEQ ID NO: 7058 - RNA, 18 nt, Artificial Sequence
  Description of Artificial Sequence: Synthetic oligonucleotide
gucaauuagcacagcauu

SEQ ID NO: 7059 - RNA, 18 nt, Artificial Sequence
  Description of Artificial Sequence: Synthetic oligonucleotide
uccaugucaauuagcaca

SEQ ID NO: 7060 - RNA, 18 nt, Artificial Sequence
  Description of Artificial Sequence: Synthetic oligonucleotide
gccuuuccaugucaauua

SEQ ID NO: 7061 - RNA, 18 nt, Artificial Sequence
  Description of Artificial Sequence: Synthetic oligonucleotide
ccccugccuuuccauguc

SEQ ID NO: 7062 - RNA, 18 nt, Artificial Sequence
  Description of Artificial Sequence: Synthetic oligonucleotide
acaucccccugccuuucc

SEQ ID NO: 7063 - RNA, 18 nt, Artificial Sequence
  Description of Artificial Sequence: Synthetic oligonucleotide
uauagacaucccccugcc

SEQ ID NO: 7064 - RNA, 18 nt, Artificial Sequence
  Description of Artificial Sequence: Synthetic oligonucleotide
uugucuauagacaucccc

SEQ ID NO: 7065 - RNA, 18 nt, Artificial Sequence
  Description of Artificial Sequence: Synthetic oligonucleotide
gucccuugucuauagaca

SEQ ID NO: 7066 - RNA, 18 nt, Artificial Sequence
  Description of Artificial Sequence: Synthetic oligonucleotide
ggguugucccuugucuau

SEQ ID NO: 7067 - RNA, 18 nt, Artificial Sequence
  Description of Artificial Sequence: Synthetic oligonucleotide
aaaugccauaugggaggg

SEQ ID NO: 7068 - RNA, 18 nt, Artificial Sequence
  Description of Artificial Sequence: Synthetic oligonucleotide
gucaaaugccauauggga

SEQ ID NO: 7069 - RNA, 18 nt, Artificial Sequence
  Description of Artificial Sequence: Synthetic oligonucleotide
ugucugucaaaugccaua

SEQ ID NO: 7070 - RNA, 18 nt, Artificial Sequence
  Description of Artificial Sequence: Synthetic oligonucleotide
cuucuugucugucaaaug

SEQ ID NO: 7071 - RNA, 18 nt, Artificial Sequence
  Description of Artificial Sequence: Synthetic oligonucleotide
ucucgcuucuugucuguc

SEQ ID NO: 7072 - RNA, 18 nt, Artificial Sequence
  Description of Artificial Sequence: Synthetic oligonucleotide
uccucucucgcuucuugu

SEQ ID NO: 7073 - RNA, 18 nt, Artificial Sequence
  Description of Artificial Sequence: Synthetic oligonucleotide
uugcauccucucucgcuu

SEQ ID NO: 7074 - RNA, 18 nt, Artificial Sequence
  Description of Artificial Sequence: Synthetic oligonucleotide
uugauuugcauccucucu

SEQ ID NO: 7075 - RNA, 18 nt, Artificial Sequence
  Description of Artificial Sequence: Synthetic oligonucleotide
uucucuugauuugcaucc

SEQ ID NO: 7076 - RNA, 18 nt, Artificial Sequence
  Description of Artificial Sequence: Synthetic oligonucleotide
cguauuucucuugauuug

SEQ ID NO: 7077 - RNA, 18 nt, Artificial Sequence
  Description of Artificial Sequence: Synthetic oligonucleotide
cuguucguauuucucuug

SEQ ID NO: 7078 - RNA, 18 nt, Artificial Sequence
  Description of Artificial Sequence: Synthetic oligonucleotide
gaacacuguucguauuuc

SEQ ID NO: 7079 - RNA, 18 nt, Artificial Sequence
  Description of Artificial Sequence: Synthetic oligonucleotide
uucaggaacacuguucgu

SEQ ID NO: 7080 - RNA, 18 nt, Artificial Sequence
  Description of Artificial Sequence: Synthetic oligonucleotide
gcgguuucaggaacacug

SEQ ID NO: 7081 - RNA, 18 nt, Artificial Sequence
  Description of Artificial Sequence: Synthetic oligonucleotide
cuggagcgguuucaggaa

SEQ ID NO: 7082 - RNA, 18 nt, Artificial Sequence
  Description of Artificial Sequence: Synthetic oligonucleotide
ugcagcuggagcgguuuc

SEQ ID NO: 7083 - RNA, 18 nt, Artificial Sequence
  Description of Artificial Sequence: Synthetic oligonucleotide
gggauugcagcuggagcg

SEQ ID NO: 7084 - RNA, 18 nt, Artificial Sequence
  Description of Artificial Sequence: Synthetic oligonucleotide
ucucagggauugcagcug

SEQ ID NO: 7085 - RNA, 18 nt, Artificial Sequence
  Description of Artificial Sequence: Synthetic oligonucleotide
uuuggucucagggauugc

SEQ ID NO: 7086 - RNA, 18 nt, Artificial Sequence
  Description of Artificial Sequence: Synthetic oligonucleotide
uuucuuuuggucucaggg

SEQ ID NO: 7087 - RNA, 18 nt, Artificial Sequence
  Description of Artificial Sequence: Synthetic oligonucleotide
cugcguuucuuuuggucu

SEQ ID NO: 7088 - RNA, 18 nt, Artificial Sequence
  Description of Artificial Sequence: Synthetic oligonucleotide
gaacucugcguuucuuuu

SEQ ID NO: 7089 - RNA, 18 nt, Artificial Sequence
  Description of Artificial Sequence: Synthetic oligonucleotide
gugaggaacucugcguuu

SEQ ID NO: 7090 - RNA, 18 nt, Artificial Sequence
  Description of Artificial Sequence: Synthetic oligonucleotide
uacaggugaggaacucug

SEQ ID NO: 7091 - RNA, 18 nt, Artificial Sequence
  Description of Artificial Sequence: Synthetic oligonucleotide
uauauuacaggugaggaa

SEQ ID NO: 7092 - RNA, 18 nt, Artificial Sequence
  Description of Artificial Sequence: Synthetic oligonucleotide
guggguauauuacaggug

SEQ ID NO: 7093 - RNA, 18 nt, Artificial Sequence
  Description of Artificial Sequence: Synthetic oligonucleotide
uugauguggguauauuac

SEQ ID NO: 7094 - RNA, 18 nt, Artificial Sequence
  Description of Artificial Sequence: Synthetic oligonucleotide
ggcauuugauguggguau

SEQ ID NO: 7095 - RNA, 18 nt, Artificial Sequence
  Description of Artificial Sequence: Synthetic oligonucleotide
uuugaggcauuugaugug

SEQ ID NO: 7096 - RNA, 18 nt, Artificial Sequence
  Description of Artificial Sequence: Synthetic oligonucleotide
uguuauuugaggcauuug

SEQ ID NO: 7097 - RNA, 18 nt, Artificial Sequence
  Description of Artificial Sequence: Synthetic oligonucleotide
uaccauguuauuugaggc

SEQ ID NO: 7098 - RNA, 18 nt, Artificial Sequence
  Description of Artificial Sequence: Synthetic oligonucleotide
gugguuaccauguuauuu

SEQ ID NO: 7099 - RNA, 18 nt, Artificial Sequence
  Description of Artificial Sequence: Synthetic oligonucleotide
uuucugugguuaccaugu

SEQ ID NO: 7100 - RNA, 18 nt, Artificial Sequence
  Description of Artificial Sequence: Synthetic oligonucleotide
cacuuuuucugugguuac

SEQ ID NO: 7101 - RNA, 18 nt, Artificial Sequence
  Description of Artificial Sequence: Synthetic oligonucleotide
uucuccacuuuuucugug

SEQ ID NO: 7102 - RNA, 18 nt, Artificial Sequence
  Description of Artificial Sequence: Synthetic oligonucleotide
gcccauucuccacuuuuu

SEQ ID NO: 7103 - RNA, 18 nt, Artificial Sequence
  Description of Artificial Sequence: Synthetic oligonucleotide
uuccugcccauucuccac

SEQ ID NO: 7104 - RNA, 18 nt, Artificial Sequence
  Description of Artificial Sequence: Synthetic oligonucleotide
acagguuccugcccauuc

SEQ ID NO: 7105 - RNA, 18 nt, Artificial Sequence
  Description of Artificial Sequence: Synthetic oligonucleotide
uuaugacagguuccugcc

SEQ ID NO: 7106 - RNA, 18 nt, Artificial Sequence
  Description of Artificial Sequence: Synthetic oligonucleotide
uaacuuuaugacagguuc

SEQ ID NO: 7107 - RNA, 18 nt, Artificial Sequence
  Description of Artificial Sequence: Synthetic oligonucleotide
uuuucuaacuuuaugaca

SEQ ID NO: 7108 - RNA, 18 nt, Artificial Sequence
  Description of Artificial Sequence: Synthetic oligonucleotide
gccuguuuucuaacuuua

SEQ ID NO: 7109 - RNA, 18 nt, Artificial Sequence
  Description of Artificial Sequence: Synthetic oligonucleotide
cucuugccuguuuucuaa

SEQ ID NO: 7110 - RNA, 18 nt, Artificial Sequence
  Description of Artificial Sequence: Synthetic oligonucleotide
cuggccucuugccuguuu

SEQ ID NO: 7111 - RNA, 18 nt, Artificial Sequence
  Description of Artificial Sequence: Synthetic oligonucleotide
cuggucuggccucuugcc

SEQ ID NO: 7112 - RNA, 18 nt, Artificial Sequence
  Description of Artificial Sequence: Synthetic oligonucleotide
ugguucuggucuggccuc

SEQ ID NO: 7113 - RNA, 18 nt, Artificial Sequence
  Description of Artificial Sequence: Synthetic oligonucleotide
cuugcugguucuggucug

SEQ ID NO: 7114 - RNA, 18 nt, Artificial Sequence
  Description of Artificial Sequence: Synthetic oligonucleotide
ucagucuugcugguucug

SEQ ID NO: 7115 - RNA, 18 nt, Artificial Sequence
  Description of Artificial Sequence: Synthetic oligonucleotide
ugguuucagucuugcugg

SEQ ID NO: 7116 - RNA, 18 nt, Artificial Sequence
  Description of Artificial Sequence: Synthetic oligonucleotide
acaggugguuucagucuu

SEQ ID NO: 7117 - RNA, 18 nt, Artificial Sequence
  Description of Artificial Sequence: Synthetic oligonucleotide
aaugaacaggugguuuca

SEQ ID NO: 7118 - RNA, 18 nt, Artificial Sequence
  Description of Artificial Sequence: Synthetic oligonucleotide
auuguaaugaacaggugg

SEQ ID NO: 7119 - RNA, 18 nt, Artificial Sequence
  Description of Artificial Sequence: Synthetic oligonucleotide
gggccauuguaaugaaca

SEQ ID NO: 7120 - RNA, 18 nt, Artificial Sequence
  Description of Artificial Sequence: Synthetic oligonucleotide
auacccugcuuuugaggg

SEQ ID NO: 7121 - RNA, 18 nt, Artificial Sequence
  Description of Artificial Sequence: Synthetic oligonucleotide
aacauacccugcuuuuga

SEQ ID NO: 7122 - RNA, 18 nt, Artificial Sequence
  Description of Artificial Sequence: Synthetic oligonucleotide
aagucaacauacccugcu

SEQ ID NO: 7123 - RNA, 18 nt, Artificial Sequence
  Description of Artificial Sequence: Synthetic oligonucleotide
uuucaaagucaacauacc

SEQ ID NO: 7124 - RNA, 18 nt, Artificial Sequence
  Description of Artificial Sequence: Synthetic oligonucleotide
gccauuuucaaagucaac

SEQ ID NO: 7125 - RNA, 18 nt, Artificial Sequence
  Description of Artificial Sequence: Synthetic oligonucleotide
cacuggccauuuucaaag

SEQ ID NO: 7126 - RNA, 18 nt, Artificial Sequence
  Description of Artificial Sequence: Synthetic oligonucleotide
uggcccacuggccauuuu

SEQ ID NO: 7127 - RNA, 18 nt, Artificial Sequence
  Description of Artificial Sequence: Synthetic oligonucleotide
aucuguggcccacuggcc

SEQ ID NO: 7128 - RNA, 18 nt, Artificial Sequence
  Description of Artificial Sequence: Synthetic oligonucleotide
augucaucuguggcccac

SEQ ID NO: 7129 - RNA, 18 nt, Artificial Sequence
  Description of Artificial Sequence: Synthetic oligonucleotide
cugggaugucaucugugg

SEQ ID NO: 7130 - RNA, 18 nt, Artificial Sequence
  Description of Artificial Sequence: Synthetic oligonucleotide
gucaucugggaugucauc

SEQ ID NO: 7131 - RNA, 18 nt, Artificial Sequence
  Description of Artificial Sequence: Synthetic oligonucleotide
uucaagucaucugggaug

SEQ ID NO: 7132 - RNA, 18 nt, Artificial Sequence
  Description of Artificial Sequence: Synthetic oligonucleotide
uacuauucaagucaucug

SEQ ID NO: 7133 - RNA, 18 nt, Artificial Sequence
  Description of Artificial Sequence: Synthetic oligonucleotide
gcggauacuauucaaguc

SEQ ID NO: 7134 - RNA, 18 nt, Artificial Sequence
  Description of Artificial Sequence: Synthetic oligonucleotide
gcugcgcggauacuauuc

SEQ ID NO: 7135 - RNA, 18 nt, Artificial Sequence
  Description of Artificial Sequence: Synthetic oligonucleotide
cuggugcugcgcggauac

SEQ ID NO: 7136 - RNA, 18 nt, Artificial Sequence
  Description of Artificial Sequence: Synthetic oligonucleotide
cucaccuggugcugcgcg

SEQ ID NO: 7137 - RNA, 18 nt, Artificial Sequence
  Description of Artificial Sequence: Synthetic oligonucleotide
cgaaacucaccuggugcu

SEQ ID NO: 7138 - RNA, 18 nt, Artificial Sequence
  Description of Artificial Sequence: Synthetic oligonucleotide
uggcucgaaacucaccug

SEQ ID NO: 7139 - RNA, 18 nt, Artificial Sequence
  Description of Artificial Sequence: Synthetic oligonucleotide
caugauggcucgaaacuc

SEQ ID NO: 7140 - RNA, 18 nt, Artificial Sequence
  Description of Artificial Sequence: Synthetic oligonucleotide
aucuccaugauggcucga

SEQ ID NO: 7141 - RNA, 18 nt, Artificial Sequence
  Description of Artificial Sequence: Synthetic oligonucleotide
agggcaucuccaugaugg

SEQ ID NO: 7142 - RNA, 18 nt, Artificial Sequence
  Description of Artificial Sequence: Synthetic oligonucleotide
gaaggagggcaucuccau

SEQ ID NO: 7143 - RNA, 18 nt, Artificial Sequence
  Description of Artificial Sequence: Synthetic oligonucleotide
cuguagaaggagggcauc

SEQ ID NO: 7144 - RNA, 18 nt, Artificial Sequence
  Description of Artificial Sequence: Synthetic oligonucleotide
caugacuguagaaggagg

SEQ ID NO: 7145 - RNA, 18 nt, Artificial Sequence
  Description of Artificial Sequence: Synthetic oligonucleotide
caagccaugacuguagaa

SEQ ID NO: 7146 - RNA, 18 nt, Artificial Sequence
  Description of Artificial Sequence: Synthetic oligonucleotide
cguggcaagccaugacug

SEQ ID NO: 7147 - RNA, 18 nt, Artificial Sequence
  Description of Artificial Sequence: Synthetic oligonucleotide
aacaccguggcaagccau

SEQ ID NO: 7148 - RNA, 18 nt, Artificial Sequence
  Description of Artificial Sequence: Synthetic oligonucleotide
gggugaacaccguggcaa

SEQ ID NO: 7149 - RNA, 18 nt, Artificial Sequence
  Description of Artificial Sequence: Synthetic oligonucleotide
uuguagggugaacaccgu

SEQ ID NO: 7150 - RNA, 18 nt, Artificial Sequence
  Description of Artificial Sequence: Synthetic oligonucleotide
guuucuuguagggugaac

SEQ ID NO: 7151 - RNA, 18 nt, Artificial Sequence
  Description of Artificial Sequence: Synthetic oligonucleotide
ugucaguuucuuguaggg

SEQ ID NO: 7152 - RNA, 18 nt, Artificial Sequence
  Description of Artificial Sequence: Synthetic oligonucleotide
cacucugucaguuucuug

SEQ ID NO: 7153 - RNA, 18 nt, Artificial Sequence
  Description of Artificial Sequence: Synthetic oligonucleotide
gcuggcacucugucaguu

SEQ ID NO: 7154 - RNA, 18 nt, Artificial Sequence
  Description of Artificial Sequence: Synthetic oligonucleotide
cuucagcuggcacucugu

SEQ ID NO: 7155 - RNA, 18 nt, Artificial Sequence
  Description of Artificial Sequence: Synthetic oligonucleotide
ggguucuucagcuggcac

SEQ ID NO: 7156 - RNA, 18 nt, Artificial Sequence
  Description of Artificial Sequence: Synthetic oligonucleotide
uaacagcccgcugauggg

SEQ ID NO: 7157 - RNA, 18 nt, Artificial Sequence
  Description of Artificial Sequence: Synthetic oligonucleotide
cuaacagcccgcugaugg

SEQ ID NO: 7158 - RNA, 18 nt, Artificial Sequence
  Description of Artificial Sequence: Synthetic oligonucleotide
auauucuaacagcccgcu

SEQ ID NO: 7159 - RNA, 18 nt, Artificial Sequence
  Description of Artificial Sequence: Synthetic oligonucleotide
ugggcauauucuaacagc

SEQ ID NO: 7160 - RNA, 18 nt, Artificial Sequence
  Description of Artificial Sequence: Synthetic oligonucleotide
cgaacugggcauauucua

SEQ ID NO: 7161 - RNA, 18 nt, Artificial Sequence
  Description of Artificial Sequence: Synthetic oligonucleotide
acuagcgaacugggcaua

SEQ ID NO: 7162 - RNA, 18 nt, Artificial Sequence
  Description of Artificial Sequence: Synthetic oligonucleotide
guuugacuagcgaacugg

SEQ ID NO: 7163 - RNA, 18 nt, Artificial Sequence
  Description of Artificial Sequence: Synthetic oligonucleotide
cacagguuugacuagcga

SEQ ID NO: 7164 - RNA, 18 nt, Artificial Sequence
  Description of Artificial Sequence: Synthetic oligonucleotide
gaacucacagguuugacu

SEQ ID NO: 7165 - RNA, 18 nt, Artificial Sequence
  Description of Artificial Sequence: Synthetic oligonucleotide
auguugaacucacagguu

SEQ ID NO: 7166 - RNA, 18 nt, Artificial Sequence
  Description of Artificial Sequence: Synthetic oligonucleotide
cuaucauguugaacucac

SEQ ID NO: 7167 - RNA, 18 nt, Artificial Sequence
  Description of Artificial Sequence: Synthetic oligonucleotide
cugcucuaucauguugaa

SEQ ID NO: 7168 - RNA, 18 nt, Artificial Sequence
  Description of Artificial Sequence: Synthetic oligonucleotide
ccacucugcucuaucaug

SEQ ID NO: 7169 - RNA, 18 nt, Artificial Sequence
  Description of Artificial Sequence: Synthetic oligonucleotide
gugguccacucugcucua

SEQ ID NO: 7170 - RNA, 18 nt, Artificial Sequence
  Description of Artificial Sequence: Synthetic oligonucleotide
acaguuccuggguggucu

SEQ ID NO: 7171 - RNA, 18 nt, Artificial Sequence
  Description of Artificial Sequence: Synthetic oligonucleotide
uagguacaguuccugggu

SEQ ID NO: 7172 - RNA, 18 nt, Artificial Sequence
  Description of Artificial Sequence: Synthetic oligonucleotide
aacccuagguacaguucc

SEQ ID NO: 7173 - RNA, 18 nt, Artificial Sequence
  Description of Artificial Sequence: Synthetic oligonucleotide
accccaacccuagguaca

SEQ ID NO: 7174 - RNA, 18 nt, Artificial Sequence
  Description of Artificial Sequence: Synthetic oligonucleotide
accugaccccaacccuag

SEQ ID NO: 7175 - RNA, 18 nt, Artificial Sequence
  Description of Artificial Sequence: Synthetic oligonucleotide
aaagcaccugaccccaac

SEQ ID NO: 7176 - RNA, 18 nt, Artificial Sequence
  Description of Artificial Sequence: Synthetic oligonucleotide
gagcaaaagcaccugacc

SEQ ID NO: 7177 - RNA, 18 nt, Artificial Sequence
  Description of Artificial Sequence: Synthetic oligonucleotide
gucaggagcaaaagcacc

SEQ ID NO: 7178 - RNA, 18 nt, Artificial Sequence
  Description of Artificial Sequence: Synthetic oligonucleotide
acugcgucaggagcaaaa

SEQ ID NO: 7179 - RNA, 18 nt, Artificial Sequence
  Description of Artificial Sequence: Synthetic oligonucleotide
ccaagacugcgucaggag

SEQ ID NO: 7180 - RNA, 18 nt, Artificial Sequence
  Description of Artificial Sequence: Synthetic oligonucleotide
aucagccaagacugcguc

SEQ ID NO: 7181 - RNA, 18 nt, Artificial Sequence
  Description of Artificial Sequence: Synthetic oligonucleotide
cacaaaucagccaagacu

SEQ ID NO: 7182 - RNA, 18 nt, Artificial Sequence
  Description of Artificial Sequence: Synthetic oligonucleotide
cugcucacaaaucagcca

SEQ ID NO: 7183 - RNA, 18 nt, Artificial Sequence
  Description of Artificial Sequence: Synthetic oligonucleotide
cagcacugcucacaaauc

SEQ ID NO: 7184 - RNA, 18 nt, Artificial Sequence
  Description of Artificial Sequence: Synthetic oligonucleotide
ccaaacagcacugcucac

SEQ ID NO: 7185 - RNA, 18 nt, Artificial Sequence
  Description of Artificial Sequence: Synthetic oligonucleotide
cgccaccaaacagcacug

SEQ ID NO: 7186 - RNA, 18 nt, Artificial Sequence
  Description of Artificial Sequence: Synthetic oligonucleotide
auaggcgccaccaaacag

SEQ ID NO: 7187 - RNA, 18 nt, Artificial Sequence
  Description of Artificial Sequence: Synthetic oligonucleotide
aaaagauaggcgccacca

SEQ ID NO: 7188 - RNA, 18 nt, Artificial Sequence
  Description of Artificial Sequence: Synthetic oligonucleotide
ggaggaaaagauaggcgc

SEQ ID NO: 7189 - RNA, 18 nt, Artificial Sequence
  Description of Artificial Sequence: Synthetic oligonucleotide
gggaaggaggaaaagaua

SEQ ID NO: 7190 - RNA, 18 nt, Artificial Sequence
  Description of Artificial Sequence: Synthetic oligonucleotide
cagaagggaaggaggaaa

SEQ ID NO: 7191 - RNA, 18 nt, Artificial Sequence
  Description of Artificial Sequence: Synthetic oligonucleotide
aaaggcagaagggaagga

SEQ ID NO: 7192 - RNA, 18 nt, Artificial Sequence
  Description of Artificial Sequence: Synthetic oligonucleotide
agcuaaaaggcagaaggg

SEQ ID NO: 7193 - RNA, 18 nt, Artificial Sequence
  Description of Artificial Sequence: Synthetic oligonucleotide
aauuuagcuaaaaggcag

SEQ ID NO: 7194 - RNA, 18 nt, Artificial Sequence
  Description of Artificial Sequence: Synthetic oligonucleotide
gggaauuuagcuaaaagg

SEQ ID NO: 7195 - RNA, 18 nt, Artificial Sequence
  Description of Artificial Sequence: Synthetic oligonucleotide
gaaagggccaaucaaggg

SEQ ID NO: 7196 - RNA, 18 nt, Artificial Sequence
  Description of Artificial Sequence: Synthetic oligonucleotide
cuggagaaagggccaauc

SEQ ID NO: 7197 - RNA, 18 nt, Artificial Sequence
  Description of Artificial Sequence: Synthetic oligonucleotide
aauaucuggagaaagggc

SEQ ID NO: 7198 - RNA, 18 nt, Artificial Sequence
  Description of Artificial Sequence: Synthetic oligonucleotide
ugcucaauaucuggagaa

SEQ ID NO: 7199 - RNA, 18 nt, Artificial Sequence
  Description of Artificial Sequence: Synthetic oligonucleotide
uucccugcucaauaucug

SEQ ID NO: 7200 - RNA, 18 nt, Artificial Sequence
  Description of Artificial Sequence: Synthetic oligonucleotide
cuauauucccugcucaau

SEQ ID NO: 7201 - RNA, 18 nt, Artificial Sequence
  Description of Artificial Sequence: Synthetic oligonucleotide
aaggucuauauucccugc

SEQ ID NO: 7202 - RNA, 18 nt, Artificial Sequence
  Description of Artificial Sequence: Synthetic oligonucleotide
gguccaaggucuauauuc

SEQ ID NO: 7203 - RNA, 18 nt, Artificial Sequence
  Description of Artificial Sequence: Synthetic oligonucleotide
uggcugguccaaggucua

SEQ ID NO: 7204 - RNA, 18 nt, Artificial Sequence
  Description of Artificial Sequence: Synthetic oligonucleotide
gauucuggcugguccaag

SEQ ID NO: 7205 - RNA, 18 nt, Artificial Sequence
  Description of Artificial Sequence: Synthetic oligonucleotide
gccaagauucuggcuggu

SEQ ID NO: 7206 - RNA, 18 nt, Artificial Sequence
  Description of Artificial Sequence: Synthetic oligonucleotide
guucagccaagauucugg

SEQ ID NO: 7207 - RNA, 18 nt, Artificial Sequence
  Description of Artificial Sequence: Synthetic oligonucleotide
cccuuguucagccaagau

SEQ ID NO: 7208 - RNA, 18 nt, Artificial Sequence
  Description of Artificial Sequence: Synthetic oligonucleotide
ccucccccuuguucagcc

SEQ ID NO: 7209 - RNA, 18 nt, Artificial Sequence
  Description of Artificial Sequence: Synthetic oligonucleotide
gucaaccucccccuuguu

SEQ ID NO: 7210 - RNA, 18 nt, Artificial Sequence
  Description of Artificial Sequence: Synthetic oligonucleotide
acagagucaaccuccccc

SEQ ID NO: 7211 - RNA, 18 nt, Artificial Sequence
  Description of Artificial Sequence: Synthetic oligonucleotide
agccaacagagucaaccu

SEQ ID NO: 7212 - RNA, 18 nt, Artificial Sequence
  Description of Artificial Sequence: Synthetic oligonucleotide
auuacagccaacagaguc

SEQ ID NO: 7213 - RNA, 18 nt, Artificial Sequence
  Description of Artificial Sequence: Synthetic oligonucleotide
gcuucauuacagccaaca

SEQ ID NO: 7214 - RNA, 18 nt, Artificial Sequence
  Description of Artificial Sequence: Synthetic oligonucleotide
aagaagcuucauuacagc

SEQ ID NO: 7215 - RNA, 18 nt, Artificial Sequence
  Description of Artificial Sequence: Synthetic oligonucleotide
uucuaaagaagcuucauu

SEQ ID NO: 7216 - RNA, 18 nt, Artificial Sequence
  Description of Artificial Sequence: Synthetic oligonucleotide
aucauuucuaaagaagcu

SEQ ID NO: 7217 - RNA, 18 nt, Artificial Sequence
  Description of Artificial Sequence: Synthetic oligonucleotide
aaccaaucauuucuaaag

SEQ ID NO: 7218 - RNA, 18 nt, Artificial Sequence
  Description of Artificial Sequence: Synthetic oligonucleotide
gccaaaaccaaucauuuc

SEQ ID NO: 7219 - RNA, 18 nt, Artificial Sequence
  Description of Artificial Sequence: Synthetic oligonucleotide
guacggccaaaaccaauc

SEQ ID NO: 7220 - RNA, 18 nt, Artificial Sequence
  Description of Artificial Sequence: Synthetic oligonucleotide
accgcguacggccaaaac

SEQ ID NO: 7221 - RNA, 18 nt, Artificial Sequence
  Description of Artificial Sequence: Synthetic oligonucleotide
gagccaccgcguacggcc

SEQ ID NO: 7222 - RNA, 18 nt, Artificial Sequence
  Description of Artificial Sequence: Synthetic oligonucleotide
ggcaugagccaccgcgua

SEQ ID NO: 7223 - RNA, 18 nt, Artificial Sequence
  Description of Artificial Sequence: Synthetic oligonucleotide
uuacaggcaugagccacc

SEQ ID NO: 7224 - RNA, 18 nt, Artificial Sequence
  Description of Artificial Sequence: Synthetic oligonucleotide
ugggauuacaggcaugag

SEQ ID NO: 7225 - RNA, 18 nt, Artificial Sequence
  Description of Artificial Sequence: Synthetic oligonucleotide
agugcugggauuacaggc

SEQ ID NO: 7226 - RNA, 18 nt, Artificial Sequence
  Description of Artificial Sequence: Synthetic oligonucleotide
caaaaagugcugggauua

SEQ ID NO: 7227 - RNA, 18 nt, Artificial Sequence
  Description of Artificial Sequence: Synthetic oligonucleotide
ggccucaaaaagugcugg

SEQ ID NO: 7228 - RNA, 18 nt, Artificial Sequence
  Description of Artificial Sequence: Synthetic oligonucleotide
gccucggccucaaaaagu

SEQ ID NO: 7229 - RNA, 18 nt, Artificial Sequence
  Description of Artificial Sequence: Synthetic oligonucleotide
ugccugccucggccucaa

SEQ ID NO: 7230 - RNA, 18 nt, Artificial Sequence
  Description of Artificial Sequence: Synthetic oligonucleotide
ugauaugccugccucggc

SEQ ID NO: 7231 - RNA, 18 nt, Artificial Sequence
  Description of Artificial Sequence: Synthetic oligonucleotide
ccucgugauaugccugcc

SEQ ID NO: 7232 - RNA, 18 nt, Artificial Sequence
  Description of Artificial Sequence: Synthetic oligonucleotide
ccugaccucgugauaugc

SEQ ID NO: 7233 - RNA, 18 nt, Artificial Sequence
  Description of Artificial Sequence: Synthetic oligonucleotide
aaacuccugaccucguga

SEQ ID NO: 7234 - RNA, 18 nt, Artificial Sequence
  Description of Artificial Sequence: Synthetic oligonucleotide
gucucaaacuccugaccu

SEQ ID NO: 7235 - RNA, 18 nt, Artificial Sequence
  Description of Artificial Sequence: Synthetic oligonucleotide
ggcuggucucaaacuccu

SEQ ID NO: 7236 - RNA, 18 nt, Artificial Sequence
  Description of Artificial Sequence: Synthetic oligonucleotide
ggccaggcuggucucaaa

SEQ ID NO: 7237 - RNA, 18 nt, Artificial Sequence
  Description of Artificial Sequence: Synthetic oligonucleotide
auguuggccaggcugguc

SEQ ID NO: 7238 - RNA, 18 nt, Artificial Sequence
  Description of Artificial Sequence: Synthetic oligonucleotide
ucaccauguuggccaggc

SEQ ID NO: 7239 - RNA, 18 nt, Artificial Sequence
  Description of Artificial Sequence: Synthetic oligonucleotide
ggguuucaccauguuggc

SEQ ID NO: 7240 - RNA, 18 nt, Artificial Sequence
  Description of Artificial Sequence: Synthetic oligonucleotide
agacaggguuucaccaug

SEQ ID NO: 7241 - RNA, 18 nt, Artificial Sequence
  Description of Artificial Sequence: Synthetic oligonucleotide
aguagagacaggguuuca

SEQ ID NO: 7242 - RNA, 18 nt, Artificial Sequence
  Description of Artificial Sequence: Synthetic oligonucleotide
uuuuuaguagagacaggg

SEQ ID NO: 7243 - RNA, 18 nt, Artificial Sequence
  Description of Artificial Sequence: Synthetic oligonucleotide
uuguauuuuuaguagaga

SEQ ID NO: 7244 - RNA, 18 nt, Artificial Sequence
  Description of Artificial Sequence: Synthetic oligonucleotide
aauuuuuguauuuuuagu

SEQ ID NO: 7245 - RNA, 18 nt, Artificial Sequence
  Description of Artificial Sequence: Synthetic oligonucleotide
cagcuaauuuuuguauuu

SEQ ID NO: 7246 - RNA, 18 nt, Artificial Sequence
  Description of Artificial Sequence: Synthetic oligonucleotide
acgcccagcuaauuuuug

SEQ ID NO: 7247 - RNA, 18 nt, Artificial Sequence
  Description of Artificial Sequence: Synthetic oligonucleotide
ccaccacgcccagcuaau

SEQ ID NO: 7248 - RNA, 18 nt, Artificial Sequence
  Description of Artificial Sequence: Synthetic oligonucleotide
gcacgccaccacgcccag

SEQ ID NO: 7249 - RNA, 18 nt, Artificial Sequence
  Description of Artificial Sequence: Synthetic oligonucleotide
caggugcacgccaccacg

SEQ ID NO: 7250 - RNA, 18 nt, Artificial Sequence
  Description of Artificial Sequence: Synthetic oligonucleotide
gacuacaggugcacgcca

SEQ ID NO: 7251 - RNA, 18 nt, Artificial Sequence
  Description of Artificial Sequence: Synthetic oligonucleotide
gcugggacuacaggugca

SEQ ID NO: 7252 - RNA, 18 nt, Artificial Sequence
  Description of Artificial Sequence: Synthetic oligonucleotide
gaguagcugggacuacag

SEQ ID NO: 7253 - RNA, 18 nt, Artificial Sequence
  Description of Artificial Sequence: Synthetic oligonucleotide
uuccugaguagcugggac

SEQ ID NO: 7254 - RNA, 18 nt, Artificial Sequence
  Description of Artificial Sequence: Synthetic oligonucleotide
ucagcuuccugaguagcu

SEQ ID NO: 7255 - RNA, 18 nt, Artificial Sequence
  Description of Artificial Sequence: Synthetic oligonucleotide
cugucucagcuuccugag

SEQ ID NO: 7256 - RNA, 18 nt, Artificial Sequence
  Description of Artificial Sequence: Synthetic oligonucleotide
uucuccugucucagcuuc

SEQ ID NO: 7257 - RNA, 18 nt, Artificial Sequence
  Description of Artificial Sequence: Synthetic oligonucleotide
agugauucuccugucuca

SEQ ID NO: 7258 - RNA, 18 nt, Artificial Sequence
  Description of Artificial Sequence: Synthetic oligonucleotide
guucaagugauucuccug

SEQ ID NO: 7259 - RNA, 18 nt, Artificial Sequence
  Description of Artificial Sequence: Synthetic oligonucleotide
ccuggguucaagugauuc

SEQ ID NO: 7260 - RNA, 18 nt, Artificial Sequence
  Description of Artificial Sequence: Synthetic oligonucleotide
ugccuccuggguucaagu

SEQ ID NO: 7261 - RNA, 18 nt, Artificial Sequence
  Description of Artificial Sequence: Synthetic oligonucleotide
accucugccuccuggguu

SEQ ID NO: 7262 - RNA, 18 nt, Artificial Sequence
  Description of Artificial Sequence: Synthetic oligonucleotide
cugcaaccucugccuccu

SEQ ID NO: 7263 - RNA, 18 nt, Artificial Sequence
  Description of Artificial Sequence: Synthetic oligonucleotide
guucacugcaaccucugc

SEQ ID NO: 7264 - RNA, 18 nt, Artificial Sequence
  Description of Artificial Sequence: Synthetic oligonucleotide
ucucaguucacugcaacc

SEQ ID NO: 7265 - RNA, 18 nt, Artificial Sequence
  Description of Artificial Sequence: Synthetic oligonucleotide
cgcaaucucaguucacug

SEQ ID NO: 7266 - RNA, 18 nt, Artificial Sequence
  Description of Artificial Sequence: Synthetic oligonucleotide
aguggcgcaaucucaguu

SEQ ID NO: 7267 - RNA, 18 nt, Artificial Sequence
  Description of Artificial Sequence: Synthetic oligonucleotide
agugcaguggcgcaaucu

SEQ ID NO: 7268 - RNA, 18 nt, Artificial Sequence
  Description of Artificial Sequence: Synthetic oligonucleotide
uuugucccuagaccuaua

SEQ ID NO: 7269 - RNA, 18 nt, Artificial Sequence
  Description of Artificial Sequence: Synthetic oligonucleotide
cugcuuuugucccuagac

SEQ ID NO: 7270 - RNA, 18 nt, Artificial Sequence
  Description of Artificial Sequence: Synthetic oligonucleotide
guggccugcuuuuguccc

SEQ ID NO: 7271 - RNA, 18 nt, Artificial Sequence
  Description of Artificial Sequence: Synthetic oligonucleotide
uaucaguggccugcuuuu

SEQ ID NO: 7272 - RNA, 18 nt, Artificial Sequence
  Description of Artificial Sequence: Synthetic oligonucleotide
ccacuuaucaguggccug

SEQ ID NO: 7273 - RNA, 18 nt, Artificial Sequence
  Description of Artificial Sequence: Synthetic oligonucleotide
aucugccacuuaucagug

SEQ ID NO: 7274 - RNA, 18 nt, Artificial Sequence
  Description of Artificial Sequence: Synthetic oligonucleotide
caggcaucugccacuuau

SEQ ID NO: 7275 - RNA, 18 nt, Artificial Sequence
  Description of Artificial Sequence: Synthetic oligonucleotide
gggaucaggcaucugcca

SEQ ID NO: 7276 - RNA, 18 nt, Artificial Sequence
  Description of Artificial Sequence: Synthetic oligonucleotide
acuccccacuaccuaggg

SEQ ID NO: 7277 - RNA, 18 nt, Artificial Sequence
  Description of Artificial Sequence: Synthetic oligonucleotide
ucacacuccccacuaccu

SEQ ID NO: 7278 - RNA, 18 nt, Artificial Sequence
  Description of Artificial Sequence: Synthetic oligonucleotide
cagucucacacuccccac

SEQ ID NO: 7279 - RNA, 18 nt, Artificial Sequence
  Description of Artificial Sequence: Synthetic oligonucleotide
uaacccagucucacacuc

SEQ ID NO: 7280 - RNA, 18 nt, Artificial Sequence
  Description of Artificial Sequence: Synthetic oligonucleotide
ucuuauaacccagucuca

SEQ ID NO: 7281 - RNA, 18 nt, Artificial Sequence
  Description of Artificial Sequence: Synthetic oligonucleotide
aggcuucuuauaacccag

SEQ ID NO: 7282 - RNA, 18 nt, Artificial Sequence
  Description of Artificial Sequence: Synthetic oligonucleotide
agugaaggcuucuuauaa

SEQ ID NO: 7283 - RNA, 18 nt, Artificial Sequence
  Description of Artificial Sequence: Synthetic oligonucleotide
aagauagugaaggcuucu

SEQ ID NO: 7284 - RNA, 18 nt, Artificial Sequence
  Description of Artificial Sequence: Synthetic oligonucleotide
ccuaaaagauagugaagg

SEQ ID NO: 7285 - RNA, 18 nt, Artificial Sequence
  Description of Artificial Sequence: Synthetic oligonucleotide
aggguccuaaaagauagu

SEQ ID NO: 7286 - RNA, 18 nt, Artificial Sequence
  Description of Artificial Sequence: Synthetic oligonucleotide
aagggaggguccuaaaag

SEQ ID NO: 7287 - RNA, 18 nt, Artificial Sequence
  Description of Artificial Sequence: Synthetic oligonucleotide
uccucaagggaggguccu

SEQ ID NO: 7288 - RNA, 18 nt, Artificial Sequence
  Description of Artificial Sequence: Synthetic oligonucleotide
uggccuccucaagggagg

SEQ ID NO: 7289 - RNA, 18 nt, Artificial Sequence
  Description of Artificial Sequence: Synthetic oligonucleotide
uagacuggccuccucaag

SEQ ID NO: 7290 - RNA, 18 nt, Artificial Sequence
  Description of Artificial Sequence: Synthetic oligonucleotide
ugugguagacuggccucc

SEQ ID NO: 7291 - RNA, 18 nt, Artificial Sequence
  Description of Artificial Sequence: Synthetic oligonucleotide
gcaauugugguagacugg

SEQ ID NO: 7292 - RNA, 18 nt, Artificial Sequence
  Description of Artificial Sequence: Synthetic oligonucleotide
cuaaagcaauugugguag

SEQ ID NO: 7293 - RNA, 18 nt, Artificial Sequence
  Description of Artificial Sequence: Synthetic oligonucleotide
ucauucuaaagcaauugu

SEQ ID NO: 7294 - RNA, 18 nt, Artificial Sequence
  Description of Artificial Sequence: Synthetic oligonucleotide
gaccuucauucuaaagca

SEQ ID NO: 7295 - RNA, 18 nt, Artificial Sequence
  Description of Artificial Sequence: Synthetic oligonucleotide
caaaagaccuucauucua

SEQ ID NO: 7296 - RNA, 18 nt, Artificial Sequence
  Description of Artificial Sequence: Synthetic oligonucleotide
gcaaccaaaagaccuuca

SEQ ID NO: 7297 - RNA, 18 nt, Artificial Sequence
  Description of Artificial Sequence: Synthetic oligonucleotide
ugugagcaaccaaaagac

SEQ ID NO: 7298 - RNA, 18 nt, Artificial Sequence
  Description of Artificial Sequence: Synthetic oligonucleotide
agucuugugagcaaccaa

SEQ ID NO: 7299 - RNA, 18 nt, Artificial Sequence
  Description of Artificial Sequence: Synthetic oligonucleotide
auuauagucuugugagca

SEQ ID NO: 7300 - RNA, 18 nt, Artificial Sequence
  Description of Artificial Sequence: Synthetic oligonucleotide
uuaccauuauagucuugu

SEQ ID NO: 7301 - RNA, 18 nt, Artificial Sequence
  Description of Artificial Sequence: Synthetic oligonucleotide
aaaaauuaccauuauagu

SEQ ID NO: 7302 - RNA, 18 nt, Artificial Sequence
  Description of Artificial Sequence: Synthetic oligonucleotide
gagccaaaaauuaccauu

SEQ ID NO: 7303 - RNA, 18 nt, Artificial Sequence
  Description of Artificial Sequence: Synthetic oligonucleotide
augaugagccaaaaauua

SEQ ID NO: 7304 - RNA, 18 nt, Artificial Sequence
  Description of Artificial Sequence: Synthetic oligonucleotide
caaaaaugaugagccaaa

SEQ ID NO: 7305 - RNA, 18 nt, Artificial Sequence
  Description of Artificial Sequence: Synthetic oligonucleotide
acacacaaaaaugaugag

SEQ ID NO: 7306 - RNA, 18 nt, Artificial Sequence
  Description of Artificial Sequence: Synthetic oligonucleotide
cccacacacacaaaaaug

SEQ ID NO: 7307 - RNA, 18 nt, Artificial Sequence
  Description of Artificial Sequence: Synthetic oligonucleotide
uaaaacccacacacacaa

SEQ ID NO: 7308 - RNA, 18 nt, Artificial Sequence
  Description of Artificial Sequence: Synthetic oligonucleotide
uaagauaaaacccacaca

SEQ ID NO: 7309 - RNA, 18 nt, Artificial Sequence
  Description of Artificial Sequence: Synthetic oligonucleotide
ugaauuaagauaaaaccc

SEQ ID NO: 7310 - RNA, 18 nt, Artificial Sequence
  Description of Artificial Sequence: Synthetic oligonucleotide
aacaaugaauuaagauaa

SEQ ID NO: 7311 - RNA, 18 nt, Artificial Sequence
  Description of Artificial Sequence: Synthetic oligonucleotide
ucuuuaacaaugaauuaa

SEQ ID NO: 7312 - RNA, 18 nt, Artificial Sequence
  Description of Artificial Sequence: Synthetic oligonucleotide
cuaucucuuuaacaauga

SEQ ID NO: 7313 - RNA, 18 nt, Artificial Sequence
  Description of Artificial Sequence: Synthetic oligonucleotide
acccacuaucucuuuaac

SEQ ID NO: 7314 - RNA, 18 nt, Artificial Sequence
  Description of Artificial Sequence: Synthetic oligonucleotide
gggaaacccacuaucucu

SEQ ID NO: 7315 - RNA, 18 nt, Artificial Sequence
  Description of Artificial Sequence: Synthetic oligonucleotide
uaggaaacuagcucaggg

SEQ ID NO: 7316 - RNA, 18 nt, Artificial Sequence
  Description of Artificial Sequence: Synthetic oligonucleotide
ugauaggaaacuagcuca

SEQ ID NO: 7317 - RNA, 18 nt, Artificial Sequence
  Description of Artificial Sequence: Synthetic oligonucleotide
acagaugauaggaaacua

SEQ ID NO: 7318 - RNA, 18 nt, Artificial Sequence
  Description of Artificial Sequence: Synthetic oligonucleotide
uaggcacagaugauagga

SEQ ID NO: 7319 - RNA, 18 nt, Artificial Sequence
  Description of Artificial Sequence: Synthetic oligonucleotide
aaacauaggcacagauga

SEQ ID NO: 7320 - RNA, 18 nt, Artificial Sequence
  Description of Artificial Sequence: Synthetic oligonucleotide
gaagcaaacauaggcaca

SEQ ID NO: 7321 - RNA, 18 nt, Artificial Sequence
  Description of Artificial Sequence: Synthetic oligonucleotide
ucagugaagcaaacauag

SEQ ID NO: 7322 - RNA, 18 nt, Artificial Sequence
  Description of Artificial Sequence: Synthetic oligonucleotide
auagcucagugaagcaaa

SEQ ID NO: 7323 - RNA, 18 nt, Artificial Sequence
  Description of Artificial Sequence: Synthetic oligonucleotide
uccccauagcucagugaa

SEQ ID NO: 7324 - RNA, 18 nt, Artificial Sequence
  Description of Artificial Sequence: Synthetic oligonucleotide
cucuuuccccauagcuca

SEQ ID NO: 7325 - RNA, 18 nt, Artificial Sequence
  Description of Artificial Sequence: Synthetic oligonucleotide
agugacucuuuccccaua

SEQ ID NO: 7326 - RNA, 18 nt, Artificial Sequence
  Description of Artificial Sequence: Synthetic oligonucleotide
cagccagugacucuuucc

SEQ ID NO: 7327 - RNA, 18 nt, Artificial Sequence
  Description of Artificial Sequence: Synthetic oligonucleotide
caaagcagccagugacuc

SEQ ID NO: 7328 - RNA, 18 nt, Artificial Sequence
  Description of Artificial Sequence: Synthetic oligonucleotide
guaaacaaagcagccagu

SEQ ID NO: 7329 - RNA, 18 nt, Artificial Sequence
  Description of Artificial Sequence: Synthetic oligonucleotide
uuuuuguaaacaaagcag

SEQ ID NO: 7330 - RNA, 18 nt, Artificial Sequence
  Description of Artificial Sequence: Synthetic oligonucleotide
cuuucuuuuuguaaacaa

SEQ ID NO: 7331 - RNA, 18 nt, Artificial Sequence
  Description of Artificial Sequence: Synthetic oligonucleotide
cuguccuuucuuuuugua

SEQ ID NO: 7332 - RNA, 18 nt, Artificial Sequence
  Description of Artificial Sequence: Synthetic oligonucleotide
ucagccuguccuuucuuu

SEQ ID NO: 7333 - RNA, 18 nt, Artificial Sequence
  Description of Artificial Sequence: Synthetic oligonucleotide
aaggcucagccuguccuu

SEQ ID NO: 7334 - RNA, 18 nt, Artificial Sequence
  Description of Artificial Sequence: Synthetic oligonucleotide
uccuuaaggcucagccug

SEQ ID NO: 7335 - RNA, 18 nt, Artificial Sequence
  Description of Artificial Sequence: Synthetic oligonucleotide
ccuacuccuuaaggcuca

SEQ ID NO: 7336 - RNA, 18 nt, Artificial Sequence
  Description of Artificial Sequence: Synthetic oligonucleotide
uccuuccuacuccuuaag

SEQ ID NO: 7337 - RNA, 18 nt, Artificial Sequence
  Description of Artificial Sequence: Synthetic oligonucleotide
ggaacuccuuccuacucc

SEQ ID NO: 7338 - RNA, 18 nt, Artificial Sequence
  Description of Artificial Sequence: Synthetic oligonucleotide
gccaaggaacuccuuccu

SEQ ID NO: 7339 - RNA, 18 nt, Artificial Sequence
  Description of Artificial Sequence: Synthetic oligonucleotide
gguaggccaaggaacucc

SEQ ID NO: 7340 - RNA, 18 nt, Artificial Sequence
  Description of Artificial Sequence: Synthetic oligonucleotide
ugaaggguaggccaagga

SEQ ID NO: 7341 - RNA, 18 nt, Artificial Sequence
  Description of Artificial Sequence: Synthetic oligonucleotide
ggagaugaaggguaggcc

SEQ ID NO: 7342 - RNA, 18 nt, Artificial Sequence
  Description of Artificial Sequence: Synthetic oligonucleotide
cuuguggagaugaagggu

SEQ ID NO: 7343 - RNA, 18 nt, Artificial Sequence
  Description of Artificial Sequence: Synthetic oligonucleotide
uuucacuuguggagauga

SEQ ID NO: 7344 - RNA, 18 nt, Artificial Sequence
  Description of Artificial Sequence: Synthetic oligonucleotide
gggcuuuucacuugugga

SEQ ID NO: 7345 - RNA, 18 nt, Artificial Sequence
  Description of Artificial Sequence: Synthetic oligonucleotide
uuucugcuacgcuaaggg

SEQ ID NO: 7346 - RNA, 18 nt, Artificial Sequence
  Description of Artificial Sequence: Synthetic oligonucleotide
auuuucugcuacgcuaag

SEQ ID NO: 7347 - RNA, 18 nt, Artificial Sequence
  Description of Artificial Sequence: Synthetic oligonucleotide
cuggaauuuucugcuacg

SEQ ID NO: 7348 - RNA, 18 nt, Artificial Sequence
  Description of Artificial Sequence: Synthetic oligonucleotide
ucaaccuggaauuuucug

SEQ ID NO: 7349 - RNA, 18 nt, Artificial Sequence
  Description of Artificial Sequence: Synthetic oligonucleotide
gaccuucaaccuggaauu

SEQ ID NO: 7350 - RNA, 18 nt, Artificial Sequence
  Description of Artificial Sequence: Synthetic oligonucleotide
aaagagaccuucaaccug

SEQ ID NO: 7351 - RNA, 18 nt, Artificial Sequence
  Description of Artificial Sequence: Synthetic oligonucleotide
ucuccaaagagaccuuca

SEQ ID NO: 7352 - RNA, 18 nt, Artificial Sequence
  Description of Artificial Sequence: Synthetic oligonucleotide
ugccuucuccaaagagac

SEQ ID NO: 7353 - RNA, 18 nt, Artificial Sequence
  Description of Artificial Sequence: Synthetic oligonucleotide
ccuucugccuucuccaaa

SEQ ID NO: 7354 - RNA, 18 nt, Artificial Sequence
  Description of Artificial Sequence: Synthetic oligonucleotide
ucacuccuucugccuucu

SEQ ID NO: 7355 - RNA, 18 nt, Artificial Sequence
  Description of Artificial Sequence: Synthetic oligonucleotide
cuaggucacuccuucugc

SEQ ID NO: 7356 - RNA, 18 nt, Artificial Sequence
  Description of Artificial Sequence: Synthetic oligonucleotide
ggagucuaggucacuccu

SEQ ID NO: 7357 - RNA, 18 nt, Artificial Sequence
  Description of Artificial Sequence: Synthetic oligonucleotide
gaacaggagucuagguca

SEQ ID NO: 7358 - RNA, 18 nt, Artificial Sequence
  Description of Artificial Sequence: Synthetic oligonucleotide
ugugugaacaggagucua

SEQ ID NO: 7359 - RNA, 18 nt, Artificial Sequence
  Description of Artificial Sequence: Synthetic oligonucleotide
uuagaugugugaacagga

SEQ ID NO: 7360 - RNA, 18 nt, Artificial Sequence
  Description of Artificial Sequence: Synthetic oligonucleotide
gacaaccuggaauuuaaa

SEQ ID NO: 7361 - RNA, 18 nt, Artificial Sequence
  Description of Artificial Sequence: Synthetic oligonucleotide
uugaugacaaccuggaau

SEQ ID NO: 7362 - RNA, 18 nt, Artificial Sequence
  Description of Artificial Sequence: Synthetic oligonucleotide
ggccauugaugacaaccu

SEQ ID NO: 7363 - RNA, 18 nt, Artificial Sequence
  Description of Artificial Sequence: Synthetic oligonucleotide
cucucggccauugaugac

SEQ ID NO: 7364 - RNA, 18 nt, Artificial Sequence
  Description of Artificial Sequence: Synthetic oligonucleotide
ggaaacucucggccauug

SEQ ID NO: 7365 - RNA, 18 nt, Artificial Sequence
  Description of Artificial Sequence: Synthetic oligonucleotide
gggaaacucucggccauu

SEQ ID NO: 7366 - RNA, 18 nt, Artificial Sequence
  Description of Artificial Sequence: Synthetic oligonucleotide
cuuccagcuucagcuggg

SEQ ID NO: 7367 - RNA, 18 nt, Artificial Sequence
  Description of Artificial Sequence: Synthetic oligonucleotide
ucuugcuuccagcuucag

SEQ ID NO: 7368 - RNA, 18 nt, Artificial Sequence
  Description of Artificial Sequence: Synthetic oligonucleotide
cacuuucuugcuuccagc

SEQ ID NO: 7369 - RNA, 18 nt, Artificial Sequence
  Description of Artificial Sequence: Synthetic oligonucleotide
uuggccacuuucuugcuu

SEQ ID NO: 7370 - RNA, 18 nt, Artificial Sequence
  Description of Artificial Sequence: Synthetic oligonucleotide
ccugcuuggccacuuucu

SEQ ID NO: 7371 - RNA, 18 nt, Artificial Sequence
  Description of Artificial Sequence: Synthetic oligonucleotide
ugcauccugcuuggccac

SEQ ID NO: 7372 - RNA, 18 nt, Artificial Sequence
  Description of Artificial Sequence: Synthetic oligonucleotide
auagcugcauccugcuug

SEQ ID NO: 7373 - RNA, 18 nt, Artificial Sequence
  Description of Artificial Sequence: Synthetic oligonucleotide
cuuucauagcugcauccu

SEQ ID NO: 7374 - RNA, 18 nt, Artificial Sequence
  Description of Artificial Sequence: Synthetic oligonucleotide
cauggcuuucauagcugc

SEQ ID NO: 7375 - RNA, 18 nt, Artificial Sequence
  Description of Artificial Sequence: Synthetic oligonucleotide
auugucauggcuuucaua

SEQ ID NO: 7376 - RNA, 18 nt, Artificial Sequence
  Description of Artificial Sequence: Synthetic oligonucleotide
gcagaauugucauggcuu

SEQ ID NO: 7377 - RNA, 18 nt, Artificial Sequence
  Description of Artificial Sequence: Synthetic oligonucleotide
cucuagcagaauugucau

SEQ ID NO: 7378 - RNA, 18 nt, Artificial Sequence
  Description of Artificial Sequence: Synthetic oligonucleotide
gcuuccucuagcagaauu

SEQ ID NO: 7379 - RNA, 18 nt, Artificial Sequence
  Description of Artificial Sequence: Synthetic oligonucleotide
cuuuggcuuccucuagca

SEQ ID NO: 7380 - RNA, 18 nt, Artificial Sequence
  Description of Artificial Sequence: Synthetic oligonucleotide
cuuggcuuuggcuuccuc

SEQ ID NO: 7381 - RNA, 18 nt, Artificial Sequence
  Description of Artificial Sequence: Synthetic oligonucleotide
cuguccuuggcuuuggcu

SEQ ID NO: 7382 - RNA, 18 nt, Artificial Sequence
  Description of Artificial Sequence: Synthetic oligonucleotide
uuccacuguccuuggcuu

SEQ ID NO: 7383 - RNA, 18 nt, Artificial Sequence
  Description of Artificial Sequence: Synthetic oligonucleotide
ugauuuuccacuguccuu

SEQ ID NO: 7384 - RNA, 18 nt, Artificial Sequence
  Description of Artificial Sequence: Synthetic oligonucleotide
ucuucugauuuuccacug

SEQ ID NO: 7385 - RNA, 18 nt, Artificial Sequence
  Description of Artificial Sequence: Synthetic oligonucleotide
augauucuucugauuuuc

SEQ ID NO: 7386 - RNA, 18 nt, Artificial Sequence
  Description of Artificial Sequence: Synthetic oligonucleotide
gugggaugauucuucuga

SEQ ID NO: 7387 - RNA, 18 nt, Artificial Sequence
  Description of Artificial Sequence: Synthetic oligonucleotide
gaauagugggaugauucu

SEQ ID NO: 7388 - RNA, 18 nt, Artificial Sequence
  Description of Artificial Sequence: Synthetic oligonucleotide
cuguggaauagugggaug

SEQ ID NO: 7389 - RNA, 18 nt, Artificial Sequence
  Description of Artificial Sequence: Synthetic oligonucleotide
uuucucuguggaauagug

SEQ ID NO: 7390 - RNA, 18 nt, Artificial Sequence
  Description of Artificial Sequence: Synthetic oligonucleotide
gauucuuucucuguggaa

SEQ ID NO: 7391 - RNA, 18 nt, Artificial Sequence
  Description of Artificial Sequence: Synthetic oligonucleotide
ucucugauucuuucucug

SEQ ID NO: 7392 - RNA, 18 nt, Artificial Sequence
  Description of Artificial Sequence: Synthetic oligonucleotide
guauccgcugagggaaua

SEQ ID NO: 7393 - RNA, 18 nt, Artificial Sequence
  Description of Artificial Sequence: Synthetic oligonucleotide
guguaguauccgcugagg

SEQ ID NO: 7394 - RNA, 18 nt, Artificial Sequence
  Description of Artificial Sequence: Synthetic oligonucleotide
gauggguguaguauccgc

SEQ ID NO: 7395 - RNA, 18 nt, Artificial Sequence
  Description of Artificial Sequence: Synthetic oligonucleotide
aaauggauggguguagua

SEQ ID NO: 7396 - RNA, 18 nt, Artificial Sequence
  Description of Artificial Sequence: Synthetic oligonucleotide
ccuugaaauggaugggug

SEQ ID NO: 7397 - RNA, 18 nt, Artificial Sequence
  Description of Artificial Sequence: Synthetic oligonucleotide
cauagccuugaaauggau

SEQ ID NO: 7398 - RNA, 18 nt, Artificial Sequence
  Description of Artificial Sequence: Synthetic oligonucleotide
gugcucauagccuugaaa

SEQ ID NO: 7399 - RNA, 18 nt, Artificial Sequence
  Description of Artificial Sequence: Synthetic oligonucleotide
ugucugugcucauagccu

SEQ ID NO: 7400 - RNA, 18 nt, Artificial Sequence
  Description of Artificial Sequence: Synthetic oligonucleotide
ugagcugucugugcucau

SEQ ID NO: 7401 - RNA, 18 nt, Artificial Sequence
  Description of Artificial Sequence: Synthetic oligonucleotide
guaccugagcugucugug

SEQ ID NO: 7402 - RNA, 18 nt, Artificial Sequence
  Description of Artificial Sequence: Synthetic oligonucleotide
ugcugguaccugagcugu

SEQ ID NO: 7403 - RNA, 18 nt, Artificial Sequence
  Description of Artificial Sequence: Synthetic oligonucleotide
caggcugcugguaccuga

SEQ ID NO: 7404 - RNA, 18 nt, Artificial Sequence
  Description of Artificial Sequence: Synthetic oligonucleotide
uggcccaggcugcuggua

SEQ ID NO: 7405 - RNA, 18 nt, Artificial Sequence
  Description of Artificial Sequence: Synthetic oligonucleotide
gauccuggcccaggcugc

SEQ ID NO: 7406 - RNA, 18 nt, Artificial Sequence
  Description of Artificial Sequence: Synthetic oligonucleotide
gggaagauccuggcccag

SEQ ID NO: 7407 - RNA, 18 nt, Artificial Sequence
  Description of Artificial Sequence: Synthetic oligonucleotide
aagcaggaaacuacuggg

SEQ ID NO: 7408 - RNA, 18 nt, Artificial Sequence
  Description of Artificial Sequence: Synthetic oligonucleotide
cuuaagcaggaaacuacu

SEQ ID NO: 7409 - RNA, 18 nt, Artificial Sequence
  Description of Artificial Sequence: Synthetic oligonucleotide
auuugcuuaagcaggaaa

SEQ ID NO: 7410 - RNA, 18 nt, Artificial Sequence
  Description of Artificial Sequence: Synthetic oligonucleotide
auucuauuugcuuaagca

SEQ ID NO: 7411 - RNA, 18 nt, Artificial Sequence
  Description of Artificial Sequence: Synthetic oligonucleotide
gagaaauucuauuugcuu

SEQ ID NO: 7412 - RNA, 18 nt, Artificial Sequence
  Description of Artificial Sequence: Synthetic oligonucleotide
cccuugagaaauucuauu

SEQ ID NO: 7413 - RNA, 18 nt, Artificial Sequence
  Description of Artificial Sequence: Synthetic oligonucleotide
gcugccccuugagaaauu

SEQ ID NO: 7414 - RNA, 18 nt, Artificial Sequence
  Description of Artificial Sequence: Synthetic oligonucleotide
ugggagcugccccuugag

SEQ ID NO: 7415 - RNA, 18 nt, Artificial Sequence
  Description of Artificial Sequence: Synthetic oligonucleotide
gcuucugggagcugcccc

SEQ ID NO: 7416 - RNA, 18 nt, Artificial Sequence
  Description of Artificial Sequence: Synthetic oligonucleotide
ccggugcuucugggagcu

SEQ ID NO: 7417 - RNA, 18 nt, Artificial Sequence
  Description of Artificial Sequence: Synthetic oligonucleotide
aaucaccggugcuucugg

SEQ ID NO: 7418 - RNA, 18 nt, Artificial Sequence
  Description of Artificial Sequence: Synthetic oligonucleotide
uuuccaaucaccggugcu

SEQ ID NO: 7419 - RNA, 18 nt, Artificial Sequence
  Description of Artificial Sequence: Synthetic oligonucleotide
ucugcuuuccaaucaccg

SEQ ID NO: 7420 - RNA, 18 nt, Artificial Sequence
  Description of Artificial Sequence: Synthetic oligonucleotide
cggugucugcuuuccaau

SEQ ID NO: 7421 - RNA, 18 nt, Artificial Sequence
  Description of Artificial Sequence: Synthetic oligonucleotide
agugacggugucugcuuu

SEQ ID NO: 7422 - RNA, 18 nt, Artificial Sequence
  Description of Artificial Sequence: Synthetic oligonucleotide
guggcagugacggugucu

SEQ ID NO: 7423 - RNA, 18 nt, Artificial Sequence
  Description of Artificial Sequence: Synthetic oligonucleotide
ggaagguggcagugacgg

SEQ ID NO: 7424 - RNA, 18 nt, Artificial Sequence
  Description of Artificial Sequence: Synthetic oligonucleotide
gggagggaagguggcagu

SEQ ID NO: 7425 - RNA, 18 nt, Artificial Sequence
  Description of Artificial Sequence: Synthetic oligonucleotide
guccugggagggaaggug

SEQ ID NO: 7426 - RNA, 18 nt, Artificial Sequence
  Description of Artificial Sequence: Synthetic oligonucleotide
ccggaguccugggaggga

SEQ ID NO: 7427 - RNA, 18 nt, Artificial Sequence
  Description of Artificial Sequence: Synthetic oligonucleotide
cuuggccggaguccuggg

SEQ ID NO: 7428 - RNA, 18 nt, Artificial Sequence
  Description of Artificial Sequence: Synthetic oligonucleotide
gaaaccuuggccggaguc

SEQ ID NO: 7429 - RNA, 18 nt, Artificial Sequence
  Description of Artificial Sequence: Synthetic oligonucleotide
uacuggaaaccuuggccg

SEQ ID NO: 7430 - RNA, 18 nt, Artificial Sequence
  Description of Artificial Sequence: Synthetic oligonucleotide
aguaguacuggaaaccuu

SEQ ID NO: 7431 - RNA, 18 nt, Artificial Sequence
  Description of Artificial Sequence: Synthetic oligonucleotide
aggcaaguaguacuggaa

SEQ ID NO: 7432 - RNA, 18 nt, Artificial Sequence
  Description of Artificial Sequence: Synthetic oligonucleotide
acuggaggcaaguaguac

SEQ ID NO: 7433 - RNA, 18 nt, Artificial Sequence
  Description of Artificial Sequence: Synthetic oligonucleotide
cugguacuggaggcaagu

SEQ ID NO: 7434 - RNA, 18 nt, Artificial Sequence
  Description of Artificial Sequence: Synthetic oligonucleotide
ugccucugguacuggagg

SEQ ID NO: 7435 - RNA, 18 nt, Artificial Sequence
  Description of Artificial Sequence: Synthetic oligonucleotide
uugccugccucugguacu

SEQ ID NO: 7436 - RNA, 18 nt, Artificial Sequence
  Description of Artificial Sequence: Synthetic oligonucleotide
uccacuugccugccucug

SEQ ID NO: 7437 - RNA, 18 nt, Artificial Sequence
  Description of Artificial Sequence: Synthetic oligonucleotide
ugauguccacuugccugc

SEQ ID NO: 7438 - RNA, 18 nt, Artificial Sequence
  Description of Artificial Sequence: Synthetic oligonucleotide
accccugauguccacuug

SEQ ID NO: 7439 - RNA, 18 nt, Artificial Sequence
  Description of Artificial Sequence: Synthetic oligonucleotide
gggacaccccugaugucc

SEQ ID NO: 7440 - RNA, 18 nt, Artificial Sequence
  Description of Artificial Sequence: Synthetic oligonucleotide
gagaugcacgccccuggg

SEQ ID NO: 7441 - RNA, 18 nt, Artificial Sequence
  Description of Artificial Sequence: Synthetic oligonucleotide
uucugagaugcacgcccc

SEQ ID NO: 7442 - RNA, 18 nt, Artificial Sequence
  Description of Artificial Sequence: Synthetic oligonucleotide
cugacuucugagaugcac

SEQ ID NO: 7443 - RNA, 18 nt, Artificial Sequence
  Description of Artificial Sequence: Synthetic oligonucleotide
agccccugacuucugaga

SEQ ID NO: 7444 - RNA, 18 nt, Artificial Sequence
  Description of Artificial Sequence: Synthetic oligonucleotide
ucuggagccccugacuuc

SEQ ID NO: 7445 - RNA, 18 nt, Artificial Sequence
  Description of Artificial Sequence: Synthetic oligonucleotide
cccucucuggagccccug

SEQ ID NO: 7446 - RNA, 18 nt, Artificial Sequence
  Description of Artificial Sequence: Synthetic oligonucleotide
uggaacccucucuggagc

SEQ ID NO: 7447 - RNA, 18 nt, Artificial Sequence
  Description of Artificial Sequence: Synthetic oligonucleotide
gaugcuggaacccucucu

SEQ ID NO: 7448 - RNA, 18 nt, Artificial Sequence
  Description of Artificial Sequence: Synthetic oligonucleotide
ugaaggaugcuggaaccc

SEQ ID NO: 7449 - RNA, 18 nt, Artificial Sequence
  Description of Artificial Sequence: Synthetic oligonucleotide
cguggugaaggaugcugg

SEQ ID NO: 7450 - RNA, 18 nt, Artificial Sequence
  Description of Artificial Sequence: Synthetic oligonucleotide
ugccacguggugaaggau

SEQ ID NO: 7451 - RNA, 18 nt, Artificial Sequence
  Description of Artificial Sequence: Synthetic oligonucleotide
acuccugccacgugguga

SEQ ID NO: 7452 - RNA, 18 nt, Artificial Sequence
  Description of Artificial Sequence: Synthetic oligonucleotide
ggcagacuccugccacgu

SEQ ID NO: 7453 - RNA, 18 nt, Artificial Sequence
  Description of Artificial Sequence: Synthetic oligonucleotide
ucuguggcagacuccugc

SEQ ID NO: 7454 - RNA, 18 nt, Artificial Sequence
  Description of Artificial Sequence: Synthetic oligonucleotide
accucucuguggcagacu

SEQ ID NO: 7455 - RNA, 18 nt, Artificial Sequence
  Description of Artificial Sequence: Synthetic oligonucleotide
ucaacaccucucuguggc

SEQ ID NO: 7456 - RNA, 18 nt, Artificial Sequence
  Description of Artificial Sequence: Synthetic oligonucleotide
ggcaaucaacaccucucu

SEQ ID NO: 7457 - RNA, 18 nt, Artificial Sequence
  Description of Artificial Sequence: Synthetic oligonucleotide
ggaaaggcaaucaacacc

SEQ ID NO: 7458 - RNA, 18 nt, Artificial Sequence
  Description of Artificial Sequence: Synthetic oligonucleotide
ugugaggaaaggcaauca

SEQ ID NO: 7459 - RNA, 18 nt, Artificial Sequence
  Description of Artificial Sequence: Synthetic oligonucleotide
ggaaaugugaggaaaggc

SEQ ID NO: 7460 - RNA, 18 nt, Artificial Sequence
  Description of Artificial Sequence: Synthetic oligonucleotide
uuccuggaaaugugagga

SEQ ID NO: 7461 - RNA, 18 nt, Artificial Sequence
  Description of Artificial Sequence: Synthetic oligonucleotide
cucaguuccuggaaaugu

SEQ ID NO: 7462 - RNA, 18 nt, Artificial Sequence
  Description of Artificial Sequence: Synthetic oligonucleotide
agauacucaguuccugga

SEQ ID NO: 7463 - RNA, 18 nt, Artificial Sequence
  Description of Artificial Sequence: Synthetic oligonucleotide
uugguagauacucaguuc

SEQ ID NO: 7464 - RNA, 18 nt, Artificial Sequence
  Description of Artificial Sequence: Synthetic oligonucleotide
ugaucuugguagauacuc

SEQ ID NO: 7465 - RNA, 18 nt, Artificial Sequence
  Description of Artificial Sequence: Synthetic oligonucleotide
guuccugaucuugguaga

SEQ ID NO: 7466 - RNA, 18 nt, Artificial Sequence
  Description of Artificial Sequence: Synthetic oligonucleotide
ccuuuguuccugaucuug

SEQ ID NO: 7467 - RNA, 18 nt, Artificial Sequence
  Description of Artificial Sequence: Synthetic oligonucleotide
aagauccuuuguuccuga

SEQ ID NO: 7468 - RNA, 18 nt, Artificial Sequence
  Description of Artificial Sequence: Synthetic oligonucleotide
acuuuaagauccuuuguu

SEQ ID NO: 7469 - RNA, 18 nt, Artificial Sequence
  Description of Artificial Sequence: Synthetic oligonucleotide
caggaacuuuaagauccu

SEQ ID NO: 7470 - RNA, 18 nt, Artificial Sequence
  Description of Artificial Sequence: Synthetic oligonucleotide
ucuuccaggaacuuuaag

SEQ ID NO: 7471 - RNA, 18 nt, Artificial Sequence
  Description of Artificial Sequence: Synthetic oligonucleotide
caagcucuuccaggaacu

SEQ ID NO: 7472 - RNA, 18 nt, Artificial Sequence
  Description of Artificial Sequence: Synthetic oligonucleotide
uuccccaagcucuuccag

SEQ ID NO: 7473 - RNA, 18 nt, Artificial Sequence
  Description of Artificial Sequence: Synthetic oligonucleotide
uucccuuccccaagcucu

SEQ ID NO: 7474 - RNA, 18 nt, Artificial Sequence
  Description of Artificial Sequence: Synthetic oligonucleotide
uggccuucccuuccccaa

SEQ ID NO: 7475 - RNA, 18 nt, Artificial Sequence
  Description of Artificial Sequence: Synthetic oligonucleotide
ugugguggccuucccuuc

SEQ ID NO: 7476 - RNA, 18 nt, Artificial Sequence
  Description of Artificial Sequence: Synthetic oligonucleotide
ugugcugugguggccuuc

SEQ ID NO: 7477 - RNA, 18 nt, Artificial Sequence
  Description of Artificial Sequence: Synthetic oligonucleotide
gaucaugugcuguggugg

SEQ ID NO: 7478 - RNA, 18 nt, Artificial Sequence
  Description of Artificial Sequence: Synthetic oligonucleotide
agacagaucaugugcugu

SEQ ID NO: 7479 - RNA, 18 nt, Artificial Sequence
  Description of Artificial Sequence: Synthetic oligonucleotide
uucccagacagaucaugu

SEQ ID NO: 7480 - RNA, 18 nt, Artificial Sequence
  Description of Artificial Sequence: Synthetic oligonucleotide
caaguuucccagacagau

SEQ ID NO: 7481 - RNA, 18 nt, Artificial Sequence
  Description of Artificial Sequence: Synthetic oligonucleotide
agucccaaguuucccaga

SEQ ID NO: 7482 - RNA, 18 nt, Artificial Sequence
  Description of Artificial Sequence: Synthetic oligonucleotide
uucggagucccaaguuuc

SEQ ID NO: 7483 - RNA, 18 nt, Artificial Sequence
  Description of Artificial Sequence: Synthetic oligonucleotide
cuuucuucggagucccaa

SEQ ID NO: 7484 - RNA, 18 nt, Artificial Sequence
  Description of Artificial Sequence: Synthetic oligonucleotide
gauuucuuucuucggagu

SEQ ID NO: 7485 - RNA, 18 nt, Artificial Sequence
  Description of Artificial Sequence: Synthetic oligonucleotide
cgauugauuucuuucuuc

SEQ ID NO: 7486 - RNA, 18 nt, Artificial Sequence
  Description of Artificial Sequence: Synthetic oligonucleotide
aaacucgauugauuucuu

SEQ ID NO: 7487 - RNA, 18 nt, Artificial Sequence
  Description of Artificial Sequence: Synthetic oligonucleotide
guauaaaacucgauugau

SEQ ID NO: 7488 - RNA, 18 nt, Artificial Sequence
  Description of Artificial Sequence: Synthetic oligonucleotide
agggaguauaaaacucga

SEQ ID NO: 7489 - RNA, 18 nt, Artificial Sequence
  Description of Artificial Sequence: Synthetic oligonucleotide
uugccagggaguauaaaa

SEQ ID NO: 7490 - RNA, 18 nt, Artificial Sequence
  Description of Artificial Sequence: Synthetic oligonucleotide
cuucuuugccagggagua

SEQ ID NO: 7491 - RNA, 18 nt, Artificial Sequence
  Description of Artificial Sequence: Synthetic oligonucleotide
uugcccuucuuugccagg

SEQ ID NO: 7492 - RNA, 18 nt, Artificial Sequence
  Description of Artificial Sequence: Synthetic oligonucleotide
guagcuugcccuucuuug

SEQ ID NO: 7493 - RNA, 18 nt, Artificial Sequence
  Description of Artificial Sequence: Synthetic oligonucleotide
uuucuguagcuugcccuu

SEQ ID NO: 7494 - RNA, 18 nt, Artificial Sequence
  Description of Artificial Sequence: Synthetic oligonucleotide
gccucuuucuguagcuug

SEQ ID NO: 7495 - RNA, 18 nt, Artificial Sequence
  Description of Artificial Sequence: Synthetic oligonucleotide
uuccugccucuuucugua

SEQ ID NO: 7496 - RNA, 18 nt, Artificial Sequence
  Description of Artificial Sequence: Synthetic oligonucleotide
ggguguuccugccucuuu

SEQ ID NO: 7497 - RNA, 18 nt, Artificial Sequence
  Description of Artificial Sequence: Synthetic oligonucleotide
gcgauuuuccacaaaggg

SEQ ID NO: 7498 - RNA, 18 nt, Artificial Sequence
  Description of Artificial Sequence: Synthetic oligonucleotide
accgcgauuuuccacaaa

SEQ ID NO: 7499 - RNA, 18 nt, Artificial Sequence
  Description of Artificial Sequence: Synthetic oligonucleotide
uggagaccgcgauuuucc

SEQ ID NO: 7500 - RNA, 18 nt, Artificial Sequence
  Description of Artificial Sequence: Synthetic oligonucleotide
cugaguggagaccgcgau

SEQ ID NO: 7501 - RNA, 18 nt, Artificial Sequence
  Description of Artificial Sequence: Synthetic oligonucleotide
caagccugaguggagacc

SEQ ID NO: 7502 - RNA, 18 nt, Artificial Sequence
  Description of Artificial Sequence: Synthetic oligonucleotide
gguuccaagccugagugg

SEQ ID NO: 7503 - RNA, 18 nt, Artificial Sequence
  Description of Artificial Sequence: Synthetic oligonucleotide
gugcugguuccaagccug

SEQ ID NO: 7504 - RNA, 18 nt, Artificial Sequence
  Description of Artificial Sequence: Synthetic oligonucleotide
ccgcugugcugguuccaa

SEQ ID NO: 7505 - RNA, 18 nt, Artificial Sequence
  Description of Artificial Sequence: Synthetic oligonucleotide
ccacuccgcugugcuggu

SEQ ID NO: 7506 - RNA, 18 nt, Artificial Sequence
  Description of Artificial Sequence: Synthetic oligonucleotide
ucuuaccacuccgcugug

SEQ ID NO: 7507 - RNA, 18 nt, Artificial Sequence
  Description of Artificial Sequence: Synthetic oligonucleotide
ucuggucuuaccacuccg

SEQ ID NO: 7508 - RNA, 18 nt, Artificial Sequence
  Description of Artificial Sequence: Synthetic oligonucleotide
gaccgucuggucuuacca

SEQ ID NO: 7509 - RNA, 18 nt, Artificial Sequence
  Description of Artificial Sequence: Synthetic oligonucleotide
gcuaugaccgucuggucu

SEQ ID NO: 7510 - RNA, 18 nt, Artificial Sequence
  Description of Artificial Sequence: Synthetic oligonucleotide
ccuuggcuaugaccgucu

SEQ ID NO: 7511 - RNA, 18 nt, Artificial Sequence
  Description of Artificial Sequence: Synthetic oligonucleotide
gggcuccuuggcuaugac

SEQ ID NO: 7512 - RNA, 18 nt, Artificial Sequence
  Description of Artificial Sequence: Synthetic oligonucleotide
cucgggucugaguuuggg

SEQ ID NO: 7513 - RNA, 18 nt, Artificial Sequence
  Description of Artificial Sequence: Synthetic oligonucleotide
acucgggucugaguuugg

SEQ ID NO: 7514 - RNA, 18 nt, Artificial Sequence
  Description of Artificial Sequence: Synthetic oligonucleotide
uccaaacucgggucugag

SEQ ID NO: 7515 - RNA, 18 nt, Artificial Sequence
  Description of Artificial Sequence: Synthetic oligonucleotide
ccgguuccaaacucgggu

SEQ ID NO: 7516 - RNA, 18 nt, Artificial Sequence
  Description of Artificial Sequence: Synthetic oligonucleotide
gucuuccgguuccaaacu

SEQ ID NO: 7517 - RNA, 18 nt, Artificial Sequence
  Description of Artificial Sequence: Synthetic oligonucleotide
uuucugucuuccgguucc

SEQ ID NO: 7518 - RNA, 18 nt, Artificial Sequence
  Description of Artificial Sequence: Synthetic oligonucleotide
uggaguuucugucuuccg

SEQ ID NO: 7519 - RNA, 18 nt, Artificial Sequence
  Description of Artificial Sequence: Synthetic oligonucleotide
agauguggaguuucuguc

SEQ ID NO: 7520 - RNA, 18 nt, Artificial Sequence
  Description of Artificial Sequence: Synthetic oligonucleotide
gagacagauguggaguuu

SEQ ID NO: 7521 - RNA, 18 nt, Artificial Sequence
  Description of Artificial Sequence: Synthetic oligonucleotide
cuucugagacagaugugg

SEQ ID NO: 7522 - RNA, 18 nt, Artificial Sequence
  Description of Artificial Sequence: Synthetic oligonucleotide
aagaucuucugagacaga

SEQ ID NO: 7523 - RNA, 18 nt, Artificial Sequence
  Description of Artificial Sequence: Synthetic oligonucleotide
ucaagaagaucuucugag

SEQ ID NO: 7524 - RNA, 18 nt, Artificial Sequence
  Description of Artificial Sequence: Synthetic oligonucleotide
aaggcucaagaagaucuu

SEQ ID NO: 7525 - RNA, 18 nt, Artificial Sequence
  Description of Artificial Sequence: Synthetic oligonucleotide
aauaaaaggcucaagaag

SEQ ID NO: 7526 - RNA, 18 nt, Artificial Sequence
  Description of Artificial Sequence: Synthetic oligonucleotide
acugcaauaaaaggcuca

SEQ ID NO: 7527 - RNA, 18 nt, Artificial Sequence
  Description of Artificial Sequence: Synthetic oligonucleotide
cugagacugcaauaaaag

SEQ ID NO: 7528 - RNA, 18 nt, Artificial Sequence
  Description of Artificial Sequence: Synthetic oligonucleotide
cugagcugagacugcaau

SEQ ID NO: 7529 - RNA, 18 nt, Artificial Sequence
  Description of Artificial Sequence: Synthetic oligonucleotide
caagccugagcugagacu

SEQ ID NO: 7530 - RNA, 18 nt, Artificial Sequence
  Description of Artificial Sequence: Synthetic oligonucleotide
gguuccaagccugagcug

SEQ ID NO: 7531 - RNA, 18 nt, Artificial Sequence
  Description of Artificial Sequence: Synthetic oligonucleotide
gugcugguuccaagccug

SEQ ID NO: 7532 - RNA, 18 nt, Artificial Sequence
  Description of Artificial Sequence: Synthetic oligonucleotide
ccgcugugcugguuccaa

SEQ ID NO: 7533 - RNA, 18 nt, Artificial Sequence
  Description of Artificial Sequence: Synthetic oligonucleotide
ccacuccgcugugcuggu

SEQ ID NO: 7534 - RNA, 18 nt, Artificial Sequence
  Description of Artificial Sequence: Synthetic oligonucleotide
ucuuaccacuccgcugug

SEQ ID NO: 7535 - RNA, 18 nt, Artificial Sequence
  Description of Artificial Sequence: Synthetic oligonucleotide
ucuggucuuaccacuccg

SEQ ID NO: 7536 - RNA, 18 nt, Artificial Sequence
  Description of Artificial Sequence: Synthetic oligonucleotide
gacugucuggucuuacca

SEQ ID NO: 7537 - RNA, 18 nt, Artificial Sequence
  Description of Artificial Sequence: Synthetic oligonucleotide
gcuaugacugucuggucu

SEQ ID NO: 7538 - RNA, 18 nt, Artificial Sequence
  Description of Artificial Sequence: Synthetic oligonucleotide
ccuuggcuaugacugucu

SEQ ID NO: 7539 - RNA, 18 nt, Artificial Sequence
  Description of Artificial Sequence: Synthetic oligonucleotide
gggauccuuggcuaugac

SEQ ID NO: 7540 - RNA, 18 nt, Artificial Sequence
  Description of Artificial Sequence: Synthetic oligonucleotide
ccugggucugaguuuggg

SEQ ID NO: 7541 - RNA, 18 nt, Artificial Sequence
  Description of Artificial Sequence: Synthetic oligonucleotide
caaaccugggucugaguu

SEQ ID NO: 7542 - RNA, 18 nt, Artificial Sequence
  Description of Artificial Sequence: Synthetic oligonucleotide
gguuccaaaccugggucu

SEQ ID NO: 7543 - RNA, 18 nt, Artificial Sequence
  Description of Artificial Sequence: Synthetic oligonucleotide
cuucagguuccaaaccug

SEQ ID NO: 7544 - RNA, 18 nt, Artificial Sequence
  Description of Artificial Sequence: Synthetic oligonucleotide
gcugucuucagguuccaa

SEQ ID NO: 7545 - RNA, 18 nt, Artificial Sequence
  Description of Artificial Sequence: Synthetic oligonucleotide
gaguugcugucuucaggu

SEQ ID NO: 7546 - RNA, 18 nt, Artificial Sequence
  Description of Artificial Sequence: Synthetic oligonucleotide
auguggaguugcugucuu

SEQ ID NO: 7547 - RNA, 18 nt, Artificial Sequence
  Description of Artificial Sequence: Synthetic oligonucleotide
ggcagauguggaguugcu

SEQ ID NO: 7548 - RNA, 18 nt, Artificial Sequence
  Description of Artificial Sequence: Synthetic oligonucleotide
uccaaggcagauguggag

SEQ ID NO: 7549 - RNA, 18 nt, Artificial Sequence
  Description of Artificial Sequence: Synthetic oligonucleotide
gaucuuccaaggcagaug

SEQ ID NO: 7550 - RNA, 18 nt, Artificial Sequence
  Description of Artificial Sequence: Synthetic oligonucleotide
aagaggaucuuccaaggc

SEQ ID NO: 7551 - RNA, 18 nt, Artificial Sequence
  Description of Artificial Sequence: Synthetic oligonucleotide
aacucaagaggaucuucc

SEQ ID NO: 7552 - RNA, 18 nt, Artificial Sequence
  Description of Artificial Sequence: Synthetic oligonucleotide
cuaaaaacucaagaggau

SEQ ID NO: 7553 - RNA, 18 nt, Artificial Sequence
  Description of Artificial Sequence: Synthetic oligonucleotide
caugucuaaaaacucaag

SEQ ID NO: 7554 - RNA, 18 nt, Artificial Sequence
  Description of Artificial Sequence: Synthetic oligonucleotide
ucggccaugucuaaaaac

SEQ ID NO: 7555 - RNA, 18 nt, Artificial Sequence
  Description of Artificial Sequence: Synthetic oligonucleotide
ugaucucggccaugucua

SEQ ID NO: 7556 - RNA, 18 nt, Artificial Sequence
  Description of Artificial Sequence: Synthetic oligonucleotide
cuccuugaucucggccau

SEQ ID NO: 7557 - RNA, 18 nt, Artificial Sequence
  Description of Artificial Sequence: Synthetic oligonucleotide
auuuucuccuugaucucg

SEQ ID NO: 7558 - RNA, 18 nt, Artificial Sequence
  Description of Artificial Sequence: Synthetic oligonucleotide
cgcagauuuucuccuuga

SEQ ID NO: 7559 - RNA, 18 nt, Artificial Sequence
  Description of Artificial Sequence: Synthetic oligonucleotide
auagucgcagauuuucuc

SEQ ID NO: 7560 - RNA, 18 nt, Artificial Sequence
  Description of Artificial Sequence: Synthetic oligonucleotide
aagagauagucgcagauu

SEQ ID NO: 7561 - RNA, 18 nt, Artificial Sequence
  Description of Artificial Sequence: Synthetic oligonucleotide
cauugaagagauagucgc

SEQ ID NO: 7562 - RNA, 18 nt, Artificial Sequence
  Description of Artificial Sequence: Synthetic oligonucleotide
agacacauugaagagaua

SEQ ID NO: 7563 - RNA, 18 nt, Artificial Sequence
  Description of Artificial Sequence: Synthetic oligonucleotide
gagucagacacauugaag

SEQ ID NO: 7564 - RNA, 18 nt, Artificial Sequence
  Description of Artificial Sequence: Synthetic oligonucleotide
cagaggagucagacacau

SEQ ID NO: 7565 - RNA, 18 nt, Artificial Sequence
  Description of Artificial Sequence: Synthetic oligonucleotide
cagggcagaggagucaga

SEQ ID NO: 7566 - RNA, 18 nt, Artificial Sequence
  Description of Artificial Sequence: Synthetic oligonucleotide
aaauucagggcagaggag

SEQ ID NO: 7567 - RNA, 18 nt, Artificial Sequence
  Description of Artificial Sequence: Synthetic oligonucleotide
uagccaaauucagggcag

SEQ ID NO: 7568 - RNA, 18 nt, Artificial Sequence
  Description of Artificial Sequence: Synthetic oligonucleotide
auuuuuagccaaauucag

SEQ ID NO: 7569 - RNA, 18 nt, Artificial Sequence
  Description of Artificial Sequence: Synthetic oligonucleotide
ccaauauuuuuagccaaa

SEQ ID NO: 7570 - RNA, 18 nt, Artificial Sequence
  Description of Artificial Sequence: Synthetic oligonucleotide
uaaggccaauauuuuuag

SEQ ID NO: 7571 - RNA, 18 nt, Artificial Sequence
  Description of Artificial Sequence: Synthetic oligonucleotide
cuugguaaggccaauauu

SEQ ID NO: 7572 - RNA, 18 nt, Artificial Sequence
  Description of Artificial Sequence: Synthetic oligonucleotide
cgggccuugguaaggcca

SEQ ID NO: 7573 - RNA, 18 nt, Artificial Sequence
  Description of Artificial Sequence: Synthetic oligonucleotide
uaucucgggccuugguaa

SEQ ID NO: 7574 - RNA, 18 nt, Artificial Sequence
  Description of Artificial Sequence: Synthetic oligonucleotide
auuuauaucucgggccuu

SEQ ID NO: 7575 - RNA, 18 nt, Artificial Sequence
  Description of Artificial Sequence: Synthetic oligonucleotide
acagcauuuauaucucgg

SEQ ID NO: 7576 - RNA, 18 nt, Artificial Sequence
  Description of Artificial Sequence: Synthetic oligonucleotide
uuagcacagcauuuauau

SEQ ID NO: 7577 - RNA, 18 nt, Artificial Sequence
  Description of Artificial Sequence: Synthetic oligonucleotide
gucaauuagcacagcauu

SEQ ID NO: 7578 - RNA, 18 nt, Artificial Sequence
  Description of Artificial Sequence: Synthetic oligonucleotide
uccaugucaauuagcaca

SEQ ID NO: 7579 - RNA, 18 nt, Artificial Sequence
  Description of Artificial Sequence: Synthetic oligonucleotide
gccuuuccaugucaauua

SEQ ID NO: 7580 - RNA, 18 nt, Artificial Sequence
  Description of Artificial Sequence: Synthetic oligonucleotide
ccccugccuuuccauguc

SEQ ID NO: 7581 - RNA, 18 nt, Artificial Sequence
  Description of Artificial Sequence: Synthetic oligonucleotide
acaucccccugccuuucc

SEQ ID NO: 7582 - RNA, 18 nt, Artificial Sequence
  Description of Artificial Sequence: Synthetic oligonucleotide
uauagacaucccccugcc

SEQ ID NO: 7583 - RNA, 18 nt, Artificial Sequence
  Description of Artificial Sequence: Synthetic oligonucleotide
uugucuauagacaucccc

SEQ ID NO: 7584 - RNA, 18 nt, Artificial Sequence
  Description of Artificial Sequence: Synthetic oligonucleotide
gucccuugucuauagaca

SEQ ID NO: 7585 - RNA, 18 nt, Artificial Sequence
  Description of Artificial Sequence: Synthetic oligonucleotide
ggguugucccuugucuau

SEQ ID NO: 7586 - RNA, 18 nt, Artificial Sequence
  Description of Artificial Sequence: Synthetic oligonucleotide
aaaugccauaugggaggg

SEQ ID NO: 7587 - RNA, 18 nt, Artificial Sequence
  Description of Artificial Sequence: Synthetic oligonucleotide
gucaaaugccauauggga

SEQ ID NO: 7588 - RNA, 18 nt, Artificial Sequence
  Description of Artificial Sequence: Synthetic oligonucleotide
ugucugucaaaugccaua

SEQ ID NO: 7589 - RNA, 18 nt, Artificial Sequence
  Description of Artificial Sequence: Synthetic oligonucleotide
cuucuugucugucaaaug

SEQ ID NO: 7590 - RNA, 18 nt, Artificial Sequence
  Description of Artificial Sequence: Synthetic oligonucleotide
ucucgcuucuugucuguc

SEQ ID NO: 7591 - RNA, 18 nt, Artificial Sequence
  Description of Artificial Sequence: Synthetic oligonucleotide
uccucucucgcuucuugu

SEQ ID NO: 7592 - RNA, 18 nt, Artificial Sequence
  Description of Artificial Sequence: Synthetic oligonucleotide
uugcauccucucucgcuu

SEQ ID NO: 7593 - RNA, 18 nt, Artificial Sequence
  Description of Artificial Sequence: Synthetic oligonucleotide
uugauuugcauccucucu

SEQ ID NO: 7594 - RNA, 18 nt, Artificial Sequence
  Description of Artificial Sequence: Synthetic oligonucleotide
uucucuugauuugcaucc

SEQ ID NO: 7595 - RNA, 18 nt, Artificial Sequence
  Description of Artificial Sequence: Synthetic oligonucleotide
cguauuucucuugauuug

SEQ ID NO: 7596 - RNA, 18 nt, Artificial Sequence
  Description of Artificial Sequence: Synthetic oligonucleotide
cuguucguauuucucuug

SEQ ID NO: 7597 - RNA, 18 nt, Artificial Sequence
  Description of Artificial Sequence: Synthetic oligonucleotide
gaacacuguucguauuuc

SEQ ID NO: 7598 - RNA, 18 nt, Artificial Sequence
  Description of Artificial Sequence: Synthetic oligonucleotide
uucaggaacacuguucgu

SEQ ID NO: 7599 - RNA, 18 nt, Artificial Sequence
  Description of Artificial Sequence: Synthetic oligonucleotide
gcgguuucaggaacacug

SEQ ID NO: 7600 - RNA, 18 nt, Artificial Sequence
  Description of Artificial Sequence: Synthetic oligonucleotide
cuggagcgguuucaggaa

SEQ ID NO: 7601 - RNA, 18 nt, Artificial Sequence
  Description of Artificial Sequence: Synthetic oligonucleotide
ugcagcuggagcgguuuc

SEQ ID NO: 7602 - RNA, 18 nt, Artificial Sequence
  Description of Artificial Sequence: Synthetic oligonucleotide
gggauugcagcuggagcg

SEQ ID NO: 7603 - RNA, 18 nt, Artificial Sequence
  Description of Artificial Sequence: Synthetic oligonucleotide
ucucagggauugcagcug

SEQ ID NO: 7604 - RNA, 18 nt, Artificial Sequence
  Description of Artificial Sequence: Synthetic oligonucleotide
uuuggucucagggauugc

SEQ ID NO: 7605 - RNA, 18 nt, Artificial Sequence
  Description of Artificial Sequence: Synthetic oligonucleotide
uuucuuuuggucucaggg

SEQ ID NO: 7606 - RNA, 18 nt, Artificial Sequence
  Description of Artificial Sequence: Synthetic oligonucleotide
cugcguuucuuuuggucu

SEQ ID NO: 7607 - RNA, 18 nt, Artificial Sequence
  Description of Artificial Sequence: Synthetic oligonucleotide
gaacucugcguuucuuuu

SEQ ID NO: 7608 - RNA, 18 nt, Artificial Sequence
  Description of Artificial Sequence: Synthetic oligonucleotide
gugaggaacucugcguuu

SEQ ID NO: 7609 - RNA, 18 nt, Artificial Sequence
  Description of Artificial Sequence: Synthetic oligonucleotide
uacaggugaggaacucug

SEQ ID NO: 7610 - RNA, 18 nt, Artificial Sequence
  Description of Artificial Sequence: Synthetic oligonucleotide
uauauuacaggugaggaa

SEQ ID NO: 7611 - RNA, 18 nt, Artificial Sequence
  Description of Artificial Sequence: Synthetic oligonucleotide
guggguauauuacaggug

SEQ ID NO: 7612 - RNA, 18 nt, Artificial Sequence
  Description of Artificial Sequence: Synthetic oligonucleotide
uugauguggguauauuac

SEQ ID NO: 7613 - RNA, 18 nt, Artificial Sequence
  Description of Artificial Sequence: Synthetic oligonucleotide
ggcauuugauguggguau

SEQ ID NO: 7614 - RNA, 18 nt, Artificial Sequence
  Description of Artificial Sequence: Synthetic oligonucleotide
uuugaggcauuugaugug

SEQ ID NO: 7615 - RNA, 18 nt, Artificial Sequence
  Description of Artificial Sequence: Synthetic oligonucleotide
uguuauuugaggcauuug

SEQ ID NO: 7616 - RNA, 18 nt, Artificial Sequence
  Description of Artificial Sequence: Synthetic oligonucleotide
uaccauguuauuugaggc

SEQ ID NO: 7617 - RNA, 18 nt, Artificial Sequence
  Description of Artificial Sequence: Synthetic oligonucleotide
gugguuaccauguuauuu

SEQ ID NO: 7618 - RNA, 18 nt, Artificial Sequence
  Description of Artificial Sequence: Synthetic oligonucleotide
uuucugugguuaccaugu

SEQ ID NO: 7619 - RNA, 18 nt, Artificial Sequence
  Description of Artificial Sequence: Synthetic oligonucleotide
cacuuuuucugugguuac

SEQ ID NO: 7620 - RNA, 18 nt, Artificial Sequence
  Description of Artificial Sequence: Synthetic oligonucleotide
uucuccacuuuuucugug

SEQ ID NO: 7621 - RNA, 18 nt, Artificial Sequence
  Description of Artificial Sequence: Synthetic oligonucleotide
gcccauucuccacuuuuu

SEQ ID NO: 7622 - RNA, 18 nt, Artificial Sequence
  Description of Artificial Sequence: Synthetic oligonucleotide
uuccugcccauucuccac

SEQ ID NO: 7623 - RNA, 18 nt, Artificial Sequence
  Description of Artificial Sequence: Synthetic oligonucleotide
acagguuccugcccauuc

SEQ ID NO: 7624 - RNA, 18 nt, Artificial Sequence
  Description of Artificial Sequence: Synthetic oligonucleotide
uuaugacagguuccugcc

SEQ ID NO: 7625 - RNA, 18 nt, Artificial Sequence
  Description of Artificial Sequence: Synthetic oligonucleotide
uaacuuuaugacagguuc

SEQ ID NO: 7626 - RNA, 18 nt, Artificial Sequence
  Description of Artificial Sequence: Synthetic oligonucleotide
uuuucuaacuuuaugaca

SEQ ID NO: 7627 - RNA, 18 nt, Artificial Sequence
  Description of Artificial Sequence: Synthetic oligonucleotide
gccuguuuucuaacuuua

SEQ ID NO: 7628 - RNA, 18 nt, Artificial Sequence
  Description of Artificial Sequence: Synthetic oligonucleotide
cucuugccuguuuucuaa

SEQ ID NO: 7629 - RNA, 18 nt, Artificial Sequence
  Description of Artificial Sequence: Synthetic oligonucleotide
cuggccucuugccuguuu

SEQ ID NO: 7630 - RNA, 18 nt, Artificial Sequence
  Description of Artificial Sequence: Synthetic oligonucleotide
cuggucuggccucuugcc

SEQ ID NO: 7631 - RNA, 18 nt, Artificial Sequence
  Description of Artificial Sequence: Synthetic oligonucleotide
ugguucuggucuggccuc

SEQ ID NO: 7632 - RNA, 18 nt, Artificial Sequence
  Description of Artificial Sequence: Synthetic oligonucleotide
cuugcugguucuggucug

SEQ ID NO: 7633 - RNA, 18 nt, Artificial Sequence
  Description of Artificial Sequence: Synthetic oligonucleotide
ucagucuugcugguucug

SEQ ID NO: 7634 - RNA, 18 nt, Artificial Sequence
  Description of Artificial Sequence: Synthetic oligonucleotide
ugguuucagucuugcugg

SEQ ID NO: 7635 - RNA, 18 nt, Artificial Sequence
  Description of Artificial Sequence: Synthetic oligonucleotide
acaggugguuucagucuu

SEQ ID NO: 7636 - RNA, 18 nt, Artificial Sequence
  Description of Artificial Sequence: Synthetic oligonucleotide
aaugaacaggugguuuca

SEQ ID NO: 7637 - RNA, 18 nt, Artificial Sequence
  Description of Artificial Sequence: Synthetic oligonucleotide
auuguaaugaacaggugg

SEQ ID NO: 7638 - RNA, 18 nt, Artificial Sequence
  Description of Artificial Sequence: Synthetic oligonucleotide
gggccauuguaaugaaca

SEQ ID NO: 7639 - RNA, 18 nt, Artificial Sequence
  Description of Artificial Sequence: Synthetic oligonucleotide
auacccugcuuuugaggg

SEQ ID NO: 7640 - RNA, 18 nt, Artificial Sequence
  Description of Artificial Sequence: Synthetic oligonucleotide
aacauacccugcuuuuga

SEQ ID NO: 7641 - RNA, 18 nt, Artificial Sequence
  Description of Artificial Sequence: Synthetic oligonucleotide
aagucaacauacccugcu

SEQ ID NO: 7642 - RNA, 18 nt, Artificial Sequence
  Description of Artificial Sequence: Synthetic oligonucleotide
uuucaaagucaacauacc

SEQ ID NO: 7643 - RNA, 18 nt, Artificial Sequence
  Description of Artificial Sequence: Synthetic oligonucleotide
gccauuuucaaagucaac

SEQ ID NO: 7644 - RNA, 18 nt, Artificial Sequence
  Description of Artificial Sequence: Synthetic oligonucleotide
cacuggccauuuucaaag

SEQ ID NO: 7645 - RNA, 18 nt, Artificial Sequence
  Description of Artificial Sequence: Synthetic oligonucleotide
uggcccacuggccauuuu

SEQ ID NO: 7646 - RNA, 18 nt, Artificial Sequence
  Description of Artificial Sequence: Synthetic oligonucleotide
aucuguggcccacuggcc

SEQ ID NO: 7647 - RNA, 18 nt, Artificial Sequence
  Description of Artificial Sequence: Synthetic oligonucleotide
augucaucuguggcccac

SEQ ID NO: 7648 - RNA, 18 nt, Artificial Sequence
  Description of Artificial Sequence: Synthetic oligonucleotide
cugggaugucaucugugg

SEQ ID NO: 7649 - RNA, 18 nt, Artificial Sequence
  Description of Artificial Sequence: Synthetic oligonucleotide
gucaucugggaugucauc

SEQ ID NO: 7650 - RNA, 18 nt, Artificial Sequence
  Description of Artificial Sequence: Synthetic oligonucleotide
uucaagucaucugggaug

SEQ ID NO: 7651 - RNA, 18 nt, Artificial Sequence
  Description of Artificial Sequence: Synthetic oligonucleotide
uacuauucaagucaucug

SEQ ID NO: 7652 - RNA, 18 nt, Artificial Sequence
  Description of Artificial Sequence: Synthetic oligonucleotide
gcggauacuauucaaguc

SEQ ID NO: 7653 - RNA, 18 nt, Artificial Sequence
  Description of Artificial Sequence: Synthetic oligonucleotide
gcugcgcggauacuauuc

SEQ ID NO: 7654 - RNA, 18 nt, Artificial Sequence
  Description of Artificial Sequence: Synthetic oligonucleotide
cuggugcugcgcggauac

SEQ ID NO: 7655 - RNA, 18 nt, Artificial Sequence
  Description of Artificial Sequence: Synthetic oligonucleotide
cucaccuggugcugcgcg

SEQ ID NO: 7656 - RNA, 18 nt, Artificial Sequence
  Description of Artificial Sequence: Synthetic oligonucleotide
cgaaacucaccuggugcu

SEQ ID NO: 7657 - RNA, 18 nt, Artificial Sequence
  Description of Artificial Sequence: Synthetic oligonucleotide
uggcucgaaacucaccug

SEQ ID NO: 7658 - RNA, 18 nt, Artificial Sequence
  Description of Artificial Sequence: Synthetic oligonucleotide
caugauggcucgaaacuc

SEQ ID NO: 7659 - RNA, 18 nt, Artificial Sequence
  Description of Artificial Sequence: Synthetic oligonucleotide
aucuccaugauggcucga

SEQ ID NO: 7660 - RNA, 18 nt, Artificial Sequence
  Description of Artificial Sequence: Synthetic oligonucleotide
agggcaucuccaugaugg

SEQ ID NO: 7661 - RNA, 18 nt, Artificial Sequence
  Description of Artificial Sequence: Synthetic oligonucleotide
gaaggagggcaucuccau

SEQ ID NO: 7662 - RNA, 18 nt, Artificial Sequence
  Description of Artificial Sequence: Synthetic oligonucleotide
cuguagaaggagggcauc

SEQ ID NO: 7663 - RNA, 18 nt, Artificial Sequence
  Description of Artificial Sequence: Synthetic oligonucleotide
caugacuguagaaggagg

SEQ ID NO: 7664 - RNA, 18 nt, Artificial Sequence
  Description of Artificial Sequence: Synthetic oligonucleotide
caagccaugacuguagaa

SEQ ID NO: 7665 - RNA, 18 nt, Artificial Sequence
  Description of Artificial Sequence: Synthetic oligonucleotide
cguggcaagccaugacug

SEQ ID NO: 7666 - RNA, 18 nt, Artificial Sequence
  Description of Artificial Sequence: Synthetic oligonucleotide
aacaccguggcaagccau

SEQ ID NO: 7667 - RNA, 18 nt, Artificial Sequence
  Description of Artificial Sequence: Synthetic oligonucleotide
gggugaacaccguggcaa

SEQ ID NO: 7668 - RNA, 18 nt, Artificial Sequence
  Description of Artificial Sequence: Synthetic oligonucleotide
uuguagggugaacaccgu

SEQ ID NO: 7669 - RNA, 18 nt, Artificial Sequence
  Description of Artificial Sequence: Synthetic oligonucleotide
guuucuuguagggugaac

SEQ ID NO: 7670 - RNA, 18 nt, Artificial Sequence
  Description of Artificial Sequence: Synthetic oligonucleotide
ugucaguuucuuguaggg

SEQ ID NO: 7671 - RNA, 18 nt, Artificial Sequence
  Description of Artificial Sequence: Synthetic oligonucleotide
cacucugucaguuucuug

SEQ ID NO: 7672 - RNA, 18 nt, Artificial Sequence
  Description of Artificial Sequence: Synthetic oligonucleotide
gcuggcacucugucaguu

SEQ ID NO: 7673 - RNA, 18 nt, Artificial Sequence
  Description of Artificial Sequence: Synthetic oligonucleotide
cuucagcuggcacucugu

SEQ ID NO: 7674 - RNA, 18 nt, Artificial Sequence
  Description of Artificial Sequence: Synthetic oligonucleotide
ggguucuucagcuggcac

SEQ ID NO: 7675 - RNA, 18 nt, Artificial Sequence
  Description of Artificial Sequence: Synthetic oligonucleotide
uaacagcccgcugauggg

SEQ ID NO: 7676 - RNA, 18 nt, Artificial Sequence
  Description of Artificial Sequence: Synthetic oligonucleotide
cuaacagcccgcugaugg

SEQ ID NO: 7677 - RNA, 18 nt, Artificial Sequence
  Description of Artificial Sequence: Synthetic oligonucleotide
auauucuaacagcccgcu

SEQ ID NO: 7678 - RNA, 18 nt, Artificial Sequence
  Description of Artificial Sequence: Synthetic oligonucleotide
ugggcauauucuaacagc

SEQ ID NO: 7679 - RNA, 18 nt, Artificial Sequence
  Description of Artificial Sequence: Synthetic oligonucleotide
cgaacugggcauauucua

SEQ ID NO: 7680 - RNA, 18 nt, Artificial Sequence
  Description of Artificial Sequence: Synthetic oligonucleotide
acuagcgaacugggcaua

SEQ ID NO: 7681 - RNA, 18 nt, Artificial Sequence
  Description of Artificial Sequence: Synthetic oligonucleotide
guuugacuagcgaacugg

SEQ ID NO: 7682 - RNA, 18 nt, Artificial Sequence
  Description of Artificial Sequence: Synthetic oligonucleotide
cacagguuugacuagcga

SEQ ID NO: 7683 - RNA, 18 nt, Artificial Sequence
  Description of Artificial Sequence: Synthetic oligonucleotide
gaacucacagguuugacu

SEQ ID NO: 7684 - RNA, 18 nt, Artificial Sequence
  Description of Artificial Sequence: Synthetic oligonucleotide
auguugaacucacagguu

SEQ ID NO: 7685 - RNA, 18 nt, Artificial Sequence
  Description of Artificial Sequence: Synthetic oligonucleotide
cuaucauguugaacucac

SEQ ID NO: 7686 - RNA, 18 nt, Artificial Sequence
  Description of Artificial Sequence: Synthetic oligonucleotide
cugcucuaucauguugaa

SEQ ID NO: 7687 - RNA, 18 nt, Artificial Sequence
  Description of Artificial Sequence: Synthetic oligonucleotide
ccacucugcucuaucaug

SEQ ID NO: 7688 - RNA, 18 nt, Artificial Sequence
  Description of Artificial Sequence: Synthetic oligonucleotide
gugguccacucugcucua

SEQ ID NO: 7689 - RNA, 18 nt, Artificial Sequence
  Description of Artificial Sequence: Synthetic oligonucleotide
acaguuccuggguggucu

SEQ ID NO: 7690 - RNA, 18 nt, Artificial Sequence
  Description of Artificial Sequence: Synthetic oligonucleotide
uagguacaguuccugggu

SEQ ID NO: 7691 - RNA, 18 nt, Artificial Sequence
  Description of Artificial Sequence: Synthetic oligonucleotide
aacccuagguacaguucc

SEQ ID NO: 7692 - RNA, 18 nt, Artificial Sequence
  Description of Artificial Sequence: Synthetic oligonucleotide
accccaacccuagguaca

SEQ ID NO: 7693 - RNA, 18 nt, Artificial Sequence
  Description of Artificial Sequence: Synthetic oligonucleotide
accugaccccaacccuag

SEQ ID NO: 7694 - RNA, 18 nt, Artificial Sequence
  Description of Artificial Sequence: Synthetic oligonucleotide
aaagcaccugaccccaac

SEQ ID NO: 7695 - RNA, 18 nt, Artificial Sequence
  Description of Artificial Sequence: Synthetic oligonucleotide
gagcaaaagcaccugacc

SEQ ID NO: 7696 - RNA, 18 nt, Artificial Sequence
  Description of Artificial Sequence: Synthetic oligonucleotide
gucaggagcaaaagcacc

SEQ ID NO: 7697 - RNA, 18 nt, Artificial Sequence
  Description of Artificial Sequence: Synthetic oligonucleotide
acugcgucaggagcaaaa

SEQ ID NO: 7698 - RNA, 18 nt, Artificial Sequence
  Description of Artificial Sequence: Synthetic oligonucleotide
ccaagacugcgucaggag

SEQ ID NO: 7699 - RNA, 18 nt, Artificial Sequence
  Description of Artificial Sequence: Synthetic oligonucleotide
aucagccaagacugcguc

SEQ ID NO: 7700 - RNA, 18 nt, Artificial Sequence
  Description of Artificial Sequence: Synthetic oligonucleotide
cacaaaucagccaagacu

SEQ ID NO: 7701 - RNA, 18 nt, Artificial Sequence
  Description of Artificial Sequence: Synthetic oligonucleotide
cugcucacaaaucagcca

SEQ ID NO: 7702 - RNA, 18 nt, Artificial Sequence
  Description of Artificial Sequence: Synthetic oligonucleotide
cagcacugcucacaaauc

SEQ ID NO: 7703 - RNA, 18 nt, Artificial Sequence
  Description of Artificial Sequence: Synthetic oligonucleotide
ccaaacagcacugcucac

SEQ ID NO: 7704 - RNA, 18 nt, Artificial Sequence
  Description of Artificial Sequence: Synthetic oligonucleotide
cgccaccaaacagcacug

SEQ ID NO: 7705 - RNA, 18 nt, Artificial Sequence
  Description of Artificial Sequence: Synthetic oligonucleotide
auaggcgccaccaaacag

SEQ ID NO: 7706 - RNA, 18 nt, Artificial Sequence
  Description of Artificial Sequence: Synthetic oligonucleotide
aaaagauaggcgccacca

SEQ ID NO: 7707 - RNA, 18 nt, Artificial Sequence
  Description of Artificial Sequence: Synthetic oligonucleotide
ggaggaaaagauaggcgc

SEQ ID NO: 7708 - RNA, 18 nt, Artificial Sequence
  Description of Artificial Sequence: Synthetic oligonucleotide
gggaaggaggaaaagaua

SEQ ID NO: 7709 - RNA, 18 nt, Artificial Sequence
  Description of Artificial Sequence: Synthetic oligonucleotide
cagaagggaaggaggaaa

SEQ ID NO: 7710 - RNA, 18 nt, Artificial Sequence
  Description of Artificial Sequence: Synthetic oligonucleotide
aaaggcagaagggaagga

SEQ ID NO: 7711 - RNA, 18 nt, Artificial Sequence
  Description of Artificial Sequence: Synthetic oligonucleotide
agcuaaaaggcagaaggg

SEQ ID NO: 7712 - RNA, 18 nt, Artificial Sequence
  Description of Artificial Sequence: Synthetic oligonucleotide
aauuuagcuaaaaggcag

SEQ ID NO: 7713 - RNA, 18 nt, Artificial Sequence
  Description of Artificial Sequence: Synthetic oligonucleotide
gggaauuuagcuaaaagg

SEQ ID NO: 7714 - RNA, 18 nt, Artificial Sequence
  Description of Artificial Sequence: Synthetic oligonucleotide
gaaagggccaaucaaggg

SEQ ID NO: 7715 - RNA, 18 nt, Artificial Sequence
  Description of Artificial Sequence: Synthetic oligonucleotide
cuggagaaagggccaauc

SEQ ID NO: 7716 - RNA, 18 nt, Artificial Sequence
  Description of Artificial Sequence: Synthetic oligonucleotide
aauaucuggagaaagggc

SEQ ID NO: 7717 - RNA, 18 nt, Artificial Sequence
  Description of Artificial Sequence: Synthetic oligonucleotide
ugcucaauaucuggagaa

SEQ ID NO: 7718 - RNA, 18 nt, Artificial Sequence
  Description of Artificial Sequence: Synthetic oligonucleotide
uucccugcucaauaucug

SEQ ID NO: 7719 - RNA, 18 nt, Artificial Sequence
  Description of Artificial Sequence: Synthetic oligonucleotide
cuauauucccugcucaau

SEQ ID NO: 7720 - RNA, 18 nt, Artificial Sequence
  Description of Artificial Sequence: Synthetic oligonucleotide
aaggucuauauucccugc

SEQ ID NO: 7721 - RNA, 18 nt, Artificial Sequence
  Description of Artificial Sequence: Synthetic oligonucleotide
gguccaaggucuauauuc

SEQ ID NO: 7722 - RNA, 18 nt, Artificial Sequence
  Description of Artificial Sequence: Synthetic oligonucleotide
uggcugguccaaggucua

SEQ ID NO: 7723 - RNA, 18 nt, Artificial Sequence
  Description of Artificial Sequence: Synthetic oligonucleotide
gauucuggcugguccaag

SEQ ID NO: 7724 - RNA, 18 nt, Artificial Sequence
  Description of Artificial Sequence: Synthetic oligonucleotide
gccaagauucuggcuggu

SEQ ID NO: 7725 - RNA, 18 nt, Artificial Sequence
  Description of Artificial Sequence: Synthetic oligonucleotide
guucagccaagauucugg

SEQ ID NO: 7726 - RNA, 18 nt, Artificial Sequence
  Description of Artificial Sequence: Synthetic oligonucleotide
cccuuguucagccaagau

SEQ ID NO: 7727 - RNA, 18 nt, Artificial Sequence
  Description of Artificial Sequence: Synthetic oligonucleotide
ccucccccuuguucagcc

SEQ ID NO: 7728 - RNA, 18 nt, Artificial Sequence
  Description of Artificial Sequence: Synthetic oligonucleotide
gucaaccucccccuuguu

SEQ ID NO: 7729 - RNA, 18 nt, Artificial Sequence
  Description of Artificial Sequence: Synthetic oligonucleotide
acagagucaaccuccccc

SEQ ID NO: 7730 - RNA, 18 nt, Artificial Sequence
  Description of Artificial Sequence: Synthetic oligonucleotide
agccaacagagucaaccu

SEQ ID NO: 7731 - RNA, 18 nt, Artificial Sequence
  Description of Artificial Sequence: Synthetic oligonucleotide
auuacagccaacagaguc

SEQ ID NO: 7732 - RNA, 18 nt, Artificial Sequence
  Description of Artificial Sequence: Synthetic oligonucleotide
gcuucauuacagccaaca

SEQ ID NO: 7733 - RNA, 18 nt, Artificial Sequence
  Description of Artificial Sequence: Synthetic oligonucleotide
aagaagcuucauuacagc

SEQ ID NO: 7734 - RNA, 18 nt, Artificial Sequence
  Description of Artificial Sequence: Synthetic oligonucleotide
uucuaaagaagcuucauu

SEQ ID NO: 7735 - RNA, 18 nt, Artificial Sequence
  Description of Artificial Sequence: Synthetic oligonucleotide
aucauuucuaaagaagcu

SEQ ID NO: 7736 - RNA, 18 nt, Artificial Sequence
  Description of Artificial Sequence: Synthetic oligonucleotide
aaccaaucauuucuaaag

SEQ ID NO: 7737 - RNA, 18 nt, Artificial Sequence
  Description of Artificial Sequence: Synthetic oligonucleotide
gccaaaaccaaucauuuc

SEQ ID NO: 7738 - RNA, 18 nt, Artificial Sequence
  Description of Artificial Sequence: Synthetic oligonucleotide
guacggccaaaaccaauc

SEQ ID NO: 7739 - RNA, 18 nt, Artificial Sequence
  Description of Artificial Sequence: Synthetic oligonucleotide
accgcguacggccaaaac

SEQ ID NO: 7740 - RNA, 18 nt, Artificial Sequence
  Description of Artificial Sequence: Synthetic oligonucleotide
gagccaccgcguacggcc

SEQ ID NO: 7741 - RNA, 18 nt, Artificial Sequence
  Description of Artificial Sequence: Synthetic oligonucleotide
ggcaugagccaccgcgua

SEQ ID NO: 7742 - RNA, 18 nt, Artificial Sequence
  Description of Artificial Sequence: Synthetic oligonucleotide
uuacaggcaugagccacc

SEQ ID NO: 7743 - RNA, 18 nt, Artificial Sequence
  Description of Artificial Sequence: Synthetic oligonucleotide
ugggauuacaggcaugag

SEQ ID NO: 7744 - RNA, 18 nt, Artificial Sequence
  Description of Artificial Sequence: Synthetic oligonucleotide
agugcugggauuacaggc

SEQ ID NO: 7745 - RNA, 18 nt, Artificial Sequence
  Description of Artificial Sequence: Synthetic oligonucleotide
caaaaagugcugggauua

SEQ ID NO: 7746 - RNA, 18 nt, Artificial Sequence
  Description of Artificial Sequence: Synthetic oligonucleotide
ggccucaaaaagugcugg

SEQ ID NO: 7747 - RNA, 18 nt, Artificial Sequence
  Description of Artificial Sequence: Synthetic oligonucleotide
gccucggccucaaaaagu

SEQ ID NO: 7748 - RNA, 18 nt, Artificial Sequence
  Description of Artificial Sequence: Synthetic oligonucleotide
ugccugccucggccucaa

SEQ ID NO: 7749 - RNA, 18 nt, Artificial Sequence
  Description of Artificial Sequence: Synthetic oligonucleotide
ugauaugccugccucggc

SEQ ID NO: 7750 - RNA, 18 nt, Artificial Sequence
  Description of Artificial Sequence: Synthetic oligonucleotide
ccucgugauaugccugcc

SEQ ID NO: 7751 - RNA, 18 nt, Artificial Sequence
  Description of Artificial Sequence: Synthetic oligonucleotide
ccugaccucgugauaugc

SEQ ID NO: 7752 - RNA, 18 nt, Artificial Sequence
  Description of Artificial Sequence: Synthetic oligonucleotide
aaacuccugaccucguga

SEQ ID NO: 7753 - RNA, 18 nt, Artificial Sequence
  Description of Artificial Sequence: Synthetic oligonucleotide
gucucaaacuccugaccu

SEQ ID NO: 7754 - RNA, 18 nt, Artificial Sequence
  Description of Artificial Sequence: Synthetic oligonucleotide
ggcuggucucaaacuccu

SEQ ID NO: 7755 - RNA, 18 nt, Artificial Sequence
  Description of Artificial Sequence: Synthetic oligonucleotide
ggccaggcuggucucaaa

SEQ ID NO: 7756 - RNA, 18 nt, Artificial Sequence
  Description of Artificial Sequence: Synthetic oligonucleotide
auguuggccaggcugguc

SEQ ID NO: 7757 - RNA, 18 nt, Artificial Sequence
  Description of Artificial Sequence: Synthetic oligonucleotide
ucaccauguuggccaggc

SEQ ID NO: 7758 - RNA, 18 nt, Artificial Sequence
  Description of Artificial Sequence: Synthetic oligonucleotide
ggguuucaccauguuggc

SEQ ID NO: 7759 - RNA, 18 nt, Artificial Sequence
  Description of Artificial Sequence: Synthetic oligonucleotide
agacaggguuucaccaug

SEQ ID NO: 7760 - RNA, 18 nt, Artificial Sequence
  Description of Artificial Sequence: Synthetic oligonucleotide
aguagagacaggguuuca

SEQ ID NO: 7761 - RNA, 18 nt, Artificial Sequence
  Description of Artificial Sequence: Synthetic oligonucleotide
uuuuuaguagagacaggg

SEQ ID NO: 7762 - RNA, 18 nt, Artificial Sequence
  Description of Artificial Sequence: Synthetic oligonucleotide
uuguauuuuuaguagaga

SEQ ID NO: 7763 - RNA, 18 nt, Artificial Sequence
  Description of Artificial Sequence: Synthetic oligonucleotide
aauuuuuguauuuuuagu

SEQ ID NO: 7764 - RNA, 18 nt, Artificial Sequence
  Description of Artificial Sequence: Synthetic oligonucleotide
cagcuaauuuuuguauuu

SEQ ID NO: 7765 - RNA, 18 nt, Artificial Sequence
  Description of Artificial Sequence: Synthetic oligonucleotide
acgcccagcuaauuuuug

SEQ ID NO: 7766 - RNA, 18 nt, Artificial Sequence
  Description of Artificial Sequence: Synthetic oligonucleotide
ccaccacgcccagcuaau

SEQ ID NO: 7767 - RNA, 18 nt, Artificial Sequence
  Description of Artificial Sequence: Synthetic oligonucleotide
gcacgccaccacgcccag

SEQ ID NO: 7768 - RNA, 18 nt, Artificial Sequence
  Description of Artificial Sequence: Synthetic oligonucleotide
caggugcacgccaccacg

SEQ ID NO: 7769 - RNA, 18 nt, Artificial Sequence
  Description of Artificial Sequence: Synthetic oligonucleotide
gacuacaggugcacgcca

SEQ ID NO: 7770 - RNA, 18 nt, Artificial Sequence
  Description of Artificial Sequence: Synthetic oligonucleotide
gcugggacuacaggugca

SEQ ID NO: 7771 - RNA, 18 nt, Artificial Sequence
  Description of Artificial Sequence: Synthetic oligonucleotide
gaguagcugggacuacag

SEQ ID NO: 7772 - RNA, 18 nt, Artificial Sequence
  Description of Artificial Sequence: Synthetic oligonucleotide
uuccugaguagcugggac

SEQ ID NO: 7773 - RNA, 18 nt, Artificial Sequence
  Description of Artificial Sequence: Synthetic oligonucleotide
ucagcuuccugaguagcu

SEQ ID NO: 7774 - RNA, 18 nt, Artificial Sequence
  Description of Artificial Sequence: Synthetic oligonucleotide
cugucucagcuuccugag

SEQ ID NO: 7775 - RNA, 18 nt, Artificial Sequence
  Description of Artificial Sequence: Synthetic oligonucleotide
uucuccugucucagcuuc

SEQ ID NO: 7776 - RNA, 18 nt, Artificial Sequence
  Description of Artificial Sequence: Synthetic oligonucleotide
agugauucuccugucuca

SEQ ID NO: 7777 - RNA, 18 nt, Artificial Sequence
  Description of Artificial Sequence: Synthetic oligonucleotide
guucaagugauucuccug

SEQ ID NO: 7778 - RNA, 18 nt, Artificial Sequence
  Description of Artificial Sequence: Synthetic oligonucleotide
ccuggguucaagugauuc

SEQ ID NO: 7779 - RNA, 18 nt, Artificial Sequence
  Description of Artificial Sequence: Synthetic oligonucleotide
ugccuccuggguucaagu

SEQ ID NO: 7780 - RNA, 18 nt, Artificial Sequence
  Description of Artificial Sequence: Synthetic oligonucleotide
accucugccuccuggguu

SEQ ID NO: 7781 - RNA, 18 nt, Artificial Sequence
  Description of Artificial Sequence: Synthetic oligonucleotide
cugcaaccucugccuccu

SEQ ID NO: 7782 - RNA, 18 nt, Artificial Sequence
  Description of Artificial Sequence: Synthetic oligonucleotide
guucacugcaaccucugc

SEQ ID NO: 7783 - RNA, 18 nt, Artificial Sequence
  Description of Artificial Sequence: Synthetic oligonucleotide
ucucaguucacugcaacc

SEQ ID NO: 7784 - RNA, 18 nt, Artificial Sequence
  Description of Artificial Sequence: Synthetic oligonucleotide
cgcaaucucaguucacug

SEQ ID NO: 7785 - RNA, 18 nt, Artificial Sequence
  Description of Artificial Sequence: Synthetic oligonucleotide
aguggcgcaaucucaguu

SEQ ID NO: 7786 - RNA, 18 nt, Artificial Sequence
  Description of Artificial Sequence: Synthetic oligonucleotide
agugcaguggcgcaaucu

SEQ ID NO: 7787 - RNA, 18 nt, Artificial Sequence
  Description of Artificial Sequence: Synthetic oligonucleotide
uuugucccuagaccuaua

SEQ ID NO: 7788 - RNA, 18 nt, Artificial Sequence
  Description of Artificial Sequence: Synthetic oligonucleotide
cugcuuuugucccuagac

SEQ ID NO: 7789 - RNA, 18 nt, Artificial Sequence
  Description of Artificial Sequence: Synthetic oligonucleotide
guggccugcuuuuguccc

SEQ ID NO: 7790 - RNA, 18 nt, Artificial Sequence
  Description of Artificial Sequence: Synthetic oligonucleotide
uaucaguggccugcuuuu

SEQ ID NO: 7791 - RNA, 18 nt, Artificial Sequence
  Description of Artificial Sequence: Synthetic oligonucleotide
ccacuuaucaguggccug

SEQ ID NO: 7792 - RNA, 18 nt, Artificial Sequence
  Description of Artificial Sequence: Synthetic oligonucleotide
aucugccacuuaucagug

SEQ ID NO: 7793 - RNA, 18 nt, Artificial Sequence
  Description of Artificial Sequence: Synthetic oligonucleotide
caggcaucugccacuuau

SEQ ID NO: 7794 - RNA, 18 nt, Artificial Sequence
  Description of Artificial Sequence: Synthetic oligonucleotide
gggaucaggcaucugcca

SEQ ID NO: 7795 - RNA, 18 nt, Artificial Sequence
  Description of Artificial Sequence: Synthetic oligonucleotide
acuccccacuaccuaggg

SEQ ID NO: 7796 - RNA, 18 nt, Artificial Sequence
  Description of Artificial Sequence: Synthetic oligonucleotide
ucacacuccccacuaccu

SEQ ID NO: 7797 - RNA, 18 nt, Artificial Sequence
  Description of Artificial Sequence: Synthetic oligonucleotide
cagucucacacuccccac

SEQ ID NO: 7798 - RNA, 18 nt, Artificial Sequence
  Description of Artificial Sequence: Synthetic oligonucleotide
uaacccagucucacacuc

SEQ ID NO: 7799 - RNA, 18 nt, Artificial Sequence
  Description of Artificial Sequence: Synthetic oligonucleotide
ucuuauaacccagucuca

SEQ ID NO: 7800 - RNA, 18 nt, Artificial Sequence
  Description of Artificial Sequence: Synthetic oligonucleotide
aggcuucuuauaacccag

SEQ ID NO: 7801 - RNA, 18 nt, Artificial Sequence
  Description of Artificial Sequence: Synthetic oligonucleotide
agugaaggcuucuuauaa

SEQ ID NO: 7802 - RNA, 18 nt, Artificial Sequence
  Description of Artificial Sequence: Synthetic oligonucleotide
aagauagugaaggcuucu

SEQ ID NO: 7803 - RNA, 18 nt, Artificial Sequence
  Description of Artificial Sequence: Synthetic oligonucleotide
ccuaaaagauagugaagg

SEQ ID NO: 7804 - RNA, 18 nt, Artificial Sequence
  Description of Artificial Sequence: Synthetic oligonucleotide
aggguccuaaaagauagu

SEQ ID NO: 7805 - RNA, 18 nt, Artificial Sequence
  Description of Artificial Sequence: Synthetic oligonucleotide
aagggaggguccuaaaag

SEQ ID NO: 7806 - RNA, 18 nt, Artificial Sequence
  Description of Artificial Sequence: Synthetic oligonucleotide
uccucaagggaggguccu

SEQ ID NO: 7807 - RNA, 18 nt, Artificial Sequence
  Description of Artificial Sequence: Synthetic oligonucleotide
uggccuccucaagggagg

SEQ ID NO: 7808 - RNA, 18 nt, Artificial Sequence
  Description of Artificial Sequence: Synthetic oligonucleotide
uagacuggccuccucaag

SEQ ID NO: 7809 - RNA, 18 nt, Artificial Sequence
  Description of Artificial Sequence: Synthetic oligonucleotide
ugugguagacuggccucc

SEQ ID NO: 7810 - RNA, 18 nt, Artificial Sequence
  Description of Artificial Sequence: Synthetic oligonucleotide
gcaauugugguagacugg

SEQ ID NO: 7811 - RNA, 18 nt, Artificial Sequence
  Description of Artificial Sequence: Synthetic oligonucleotide
cuaaagcaauugugguag

SEQ ID NO: 7812 - RNA, 18 nt, Artificial Sequence
  Description of Artificial Sequence: Synthetic oligonucleotide
ucauucuaaagcaauugu

SEQ ID NO: 7813 - RNA, 18 nt, Artificial Sequence
  Description of Artificial Sequence: Synthetic oligonucleotide
gaccuucauucuaaagca

SEQ ID NO: 7814 - RNA, 18 nt, Artificial Sequence
  Description of Artificial Sequence: Synthetic oligonucleotide
caaaagaccuucauucua

SEQ ID NO: 7815 - RNA, 18 nt, Artificial Sequence
  Description of Artificial Sequence: Synthetic oligonucleotide
gcaaccaaaagaccuuca

SEQ ID NO: 7816 - RNA, 18 nt, Artificial Sequence
  Description of Artificial Sequence: Synthetic oligonucleotide
ugugagcaaccaaaagac

SEQ ID NO: 7817 - RNA, 18 nt, Artificial Sequence
  Description of Artificial Sequence: Synthetic oligonucleotide
agucuugugagcaaccaa

SEQ ID NO: 7818 - RNA, 18 nt, Artificial Sequence
  Description of Artificial Sequence: Synthetic oligonucleotide
auuauagucuugugagca

SEQ ID NO: 7819 - RNA, 18 nt, Artificial Sequence
  Description of Artificial Sequence: Synthetic oligonucleotide
uuaccauuauagucuugu

SEQ ID NO: 7820 - RNA, 18 nt, Artificial Sequence
  Description of Artificial Sequence: Synthetic oligonucleotide
aaaaauuaccauuauagu

SEQ ID NO: 7821 - RNA, 18 nt, Artificial Sequence
  Description of Artificial Sequence: Synthetic oligonucleotide
gagccaaaaauuaccauu

SEQ ID NO: 7822 - RNA, 18 nt, Artificial Sequence
  Description of Artificial Sequence: Synthetic oligonucleotide
augaugagccaaaaauua

SEQ ID NO: 7823 - RNA, 18 nt, Artificial Sequence
  Description of Artificial Sequence: Synthetic oligonucleotide
caaaaaugaugagccaaa

SEQ ID NO: 7824 - RNA, 18 nt, Artificial Sequence
  Description of Artificial Sequence: Synthetic oligonucleotide
acacacaaaaaugaugag

SEQ ID NO: 7825 - RNA, 18 nt, Artificial Sequence
  Description of Artificial Sequence: Synthetic oligonucleotide
cccacacacacaaaaaug

SEQ ID NO: 7826 - RNA, 18 nt, Artificial Sequence
  Description of Artificial Sequence: Synthetic oligonucleotide
uaaaacccacacacacaa

SEQ ID NO: 7827 - RNA, 18 nt, Artificial Sequence
  Description of Artificial Sequence: Synthetic oligonucleotide
uaagauaaaacccacaca

SEQ ID NO: 7828 - RNA, 18 nt, Artificial Sequence
  Description of Artificial Sequence: Synthetic oligonucleotide
ugaauuaagauaaaaccc

SEQ ID NO: 7829 - RNA, 18 nt, Artificial Sequence
  Description of Artificial Sequence: Synthetic oligonucleotide
aacaaugaauuaagauaa

SEQ ID NO: 7830 - RNA, 18 nt, Artificial Sequence
  Description of Artificial Sequence: Synthetic oligonucleotide
ucuuuaacaaugaauuaa

SEQ ID NO: 7831 - RNA, 18 nt, Artificial Sequence
  Description of Artificial Sequence: Synthetic oligonucleotide
cuaucucuuuaacaauga

SEQ ID NO: 7832 - RNA, 18 nt, Artificial Sequence
  Description of Artificial Sequence: Synthetic oligonucleotide
acccacuaucucuuuaac

SEQ ID NO: 7833 - RNA, 18 nt, Artificial Sequence
  Description of Artificial Sequence: Synthetic oligonucleotide
gggaaacccacuaucucu

SEQ ID NO: 7834 - RNA, 18 nt, Artificial Sequence
  Description of Artificial Sequence: Synthetic oligonucleotide
uaggaaacuagcucaggg

SEQ ID NO: 7835 - RNA, 18 nt, Artificial Sequence
  Description of Artificial Sequence: Synthetic oligonucleotide
ugauaggaaacuagcuca

SEQ ID NO: 7836 - RNA, 18 nt, Artificial Sequence
  Description of Artificial Sequence: Synthetic oligonucleotide
acagaugauaggaaacua

SEQ ID NO: 7837 - RNA, 18 nt, Artificial Sequence
  Description of Artificial Sequence: Synthetic oligonucleotide
uaggcacagaugauagga

SEQ ID NO: 7838 - RNA, 18 nt, Artificial Sequence
  Description of Artificial Sequence: Synthetic oligonucleotide
aaacauaggcacagauga

SEQ ID NO: 7839 - RNA, 18 nt, Artificial Sequence
  Description of Artificial Sequence: Synthetic oligonucleotide
gaagcaaacauaggcaca

SEQ ID NO: 7840 - RNA, 18 nt, Artificial Sequence
  Description of Artificial Sequence: Synthetic oligonucleotide
ucagugaagcaaacauag

SEQ ID NO: 7841 - RNA, 18 nt, Artificial Sequence
  Description of Artificial Sequence: Synthetic oligonucleotide
auagcucagugaagcaaa

SEQ ID NO: 7842 - RNA, 18 nt, Artificial Sequence
  Description of Artificial Sequence: Synthetic oligonucleotide
uccccauagcucagugaa

SEQ ID NO: 7843 - RNA, 18 nt, Artificial Sequence
  Description of Artificial Sequence: Synthetic oligonucleotide
cucuuuccccauagcuca

SEQ ID NO: 7844 - RNA, 18 nt, Artificial Sequence
  Description of Artificial Sequence: Synthetic oligonucleotide
agugacucuuuccccaua

SEQ ID NO: 7845 - RNA, 18 nt, Artificial Sequence
  Description of Artificial Sequence: Synthetic oligonucleotide
cagccagugacucuuucc

SEQ ID NO: 7846 - RNA, 18 nt, Artificial Sequence
  Description of Artificial Sequence: Synthetic oligonucleotide
caaagcagccagugacuc

SEQ ID NO: 7847 - RNA, 18 nt, Artificial Sequence
  Description of Artificial Sequence: Synthetic oligonucleotide
guaaacaaagcagccagu

SEQ ID NO: 7848 - RNA, 18 nt, Artificial Sequence
  Description of Artificial Sequence: Synthetic oligonucleotide
uuuuuguaaacaaagcag

SEQ ID NO: 7849 - RNA, 18 nt, Artificial Sequence
  Description of Artificial Sequence: Synthetic oligonucleotide
cuuucuuuuuguaaacaa

SEQ ID NO: 7850 - RNA, 18 nt, Artificial Sequence
  Description of Artificial Sequence: Synthetic oligonucleotide
cuguccuuucuuuuugua

SEQ ID NO: 7851 - RNA, 18 nt, Artificial Sequence
  Description of Artificial Sequence: Synthetic oligonucleotide
ucagccuguccuuucuuu

SEQ ID NO: 7852 - RNA, 18 nt, Artificial Sequence
  Description of Artificial Sequence: Synthetic oligonucleotide
aaggcucagccuguccuu

SEQ ID NO: 7853 - RNA, 18 nt, Artificial Sequence
  Description of Artificial Sequence: Synthetic oligonucleotide
uccuuaaggcucagccug

SEQ ID NO: 7854 - RNA, 18 nt, Artificial Sequence
  Description of Artificial Sequence: Synthetic oligonucleotide
ccuacuccuuaaggcuca

SEQ ID NO: 7855 - RNA, 18 nt, Artificial Sequence
  Description of Artificial Sequence: Synthetic oligonucleotide
uccuuccuacuccuuaag

SEQ ID NO: 7856 - RNA, 18 nt, Artificial Sequence
  Description of Artificial Sequence: Synthetic oligonucleotide
ggaacuccuuccuacucc

SEQ ID NO: 7857 - RNA, 18 nt, Artificial Sequence
  Description of Artificial Sequence: Synthetic oligonucleotide
gccaaggaacuccuuccu

SEQ ID NO: 7858 - RNA, 18 nt, Artificial Sequence
  Description of Artificial Sequence: Synthetic oligonucleotide
gguaggccaaggaacucc

SEQ ID NO: 7859 - RNA, 18 nt, Artificial Sequence
  Description of Artificial Sequence: Synthetic oligonucleotide
ugaaggguaggccaagga

SEQ ID NO: 7860 - RNA, 18 nt, Artificial Sequence
  Description of Artificial Sequence: Synthetic oligonucleotide
ggagaugaaggguaggcc

SEQ ID NO: 7861 - RNA, 18 nt, Artificial Sequence
  Description of Artificial Sequence: Synthetic oligonucleotide
cuuguggagaugaagggu

SEQ ID NO: 7862 - RNA, 18 nt, Artificial Sequence
  Description of Artificial Sequence: Synthetic oligonucleotide
uuucacuuguggagauga

SEQ ID NO: 7863 - RNA, 18 nt, Artificial Sequence
  Description of Artificial Sequence: Synthetic oligonucleotide
gggcuuuucacuugugga

SEQ ID NO: 7864 - RNA, 18 nt, Artificial Sequence
  Description of Artificial Sequence: Synthetic oligonucleotide
uuucugcuacgcuaaggg

SEQ ID NO: 7865 - RNA, 18 nt, Artificial Sequence
  Description of Artificial Sequence: Synthetic oligonucleotide
auuuucugcuacgcuaag

SEQ ID NO: 7866 - RNA, 18 nt, Artificial Sequence
  Description of Artificial Sequence: Synthetic oligonucleotide
cuggaauuuucugcuacg

SEQ ID NO: 7867 - RNA, 18 nt, Artificial Sequence
  Description of Artificial Sequence: Synthetic oligonucleotide
ucaaccuggaauuuucug

SEQ ID NO: 7868 - RNA, 18 nt, Artificial Sequence
  Description of Artificial Sequence: Synthetic oligonucleotide
gaccuucaaccuggaauu

SEQ ID NO: 7869 - RNA, 18 nt, Artificial Sequence
  Description of Artificial Sequence: Synthetic oligonucleotide
aaagagaccuucaaccug

SEQ ID NO: 7870 - RNA, 18 nt, Artificial Sequence
  Description of Artificial Sequence: Synthetic oligonucleotide
ucuccaaagagaccuuca

SEQ ID NO: 7871 - RNA, 18 nt, Artificial Sequence
  Description of Artificial Sequence: Synthetic oligonucleotide
ugccuucuccaaagagac

SEQ ID NO: 7872 - RNA, 18 nt, Artificial Sequence
  Description of Artificial Sequence: Synthetic oligonucleotide
ccuucugccuucuccaaa

SEQ ID NO: 7873 - RNA, 18 nt, Artificial Sequence
  Description of Artificial Sequence: Synthetic oligonucleotide
ucacuccuucugccuucu

SEQ ID NO: 7874 - RNA, 18 nt, Artificial Sequence
  Description of Artificial Sequence: Synthetic oligonucleotide
cuaggucacuccuucugc

SEQ ID NO: 7875 - RNA, 18 nt, Artificial Sequence
  Description of Artificial Sequence: Synthetic oligonucleotide
ggagucuaggucacuccu

SEQ ID NO: 7876 - RNA, 18 nt, Artificial Sequence
  Description of Artificial Sequence: Synthetic oligonucleotide
gaacaggagucuagguca

SEQ ID NO: 7877 - RNA, 18 nt, Artificial Sequence
  Description of Artificial Sequence: Synthetic oligonucleotide
ugugugaacaggagucua

SEQ ID NO: 7878 - RNA, 18 nt, Artificial Sequence
  Description of Artificial Sequence: Synthetic oligonucleotide
uuagaugugugaacagga

SEQ ID NO: 7879 - RNA, 18 nt, Artificial Sequence
  Description of Artificial Sequence: Synthetic oligonucleotide
gacaaccuggaauuuaaa

SEQ ID NO: 7880 - RNA, 18 nt, Artificial Sequence
  Description of Artificial Sequence: Synthetic oligonucleotide
uugaugacaaccuggaau

SEQ ID NO: 7881 - RNA, 18 nt, Artificial Sequence
  Description of Artificial Sequence: Synthetic oligonucleotide
ggccauugaugacaaccu

SEQ ID NO: 7882 - RNA, 18 nt, Artificial Sequence
  Description of Artificial Sequence: Synthetic oligonucleotide
cucucggccauugaugac

SEQ ID NO: 7883 - RNA, 18 nt, Artificial Sequence
  Description of Artificial Sequence: Synthetic oligonucleotide
ggaaacucucggccauug

SEQ ID NO: 7884 - RNA, 18 nt, Artificial Sequence
  Description of Artificial Sequence: Synthetic oligonucleotide
gggaaacucucggccauu

SEQ ID NO: 7885 - RNA, 18 nt, Artificial Sequence
  Description of Artificial Sequence: Synthetic oligonucleotide
cuuccagcuucagcuggg

SEQ ID NO: 7886 - RNA, 18 nt, Artificial Sequence
  Description of Artificial Sequence: Synthetic oligonucleotide
ucuugcuuccagcuucag

SEQ ID NO: 7887 - RNA, 18 nt, Artificial Sequence
  Description of Artificial Sequence: Synthetic oligonucleotide
cacuuucuugcuuccagc

SEQ ID NO: 7888 - RNA, 18 nt, Artificial Sequence
  Description of Artificial Sequence: Synthetic oligonucleotide
uuggccacuuucuugcuu

SEQ ID NO: 7889 - RNA, 18 nt, Artificial Sequence
  Description of Artificial Sequence: Synthetic oligonucleotide
ccugcuuggccacuuucu

SEQ ID NO: 7890 - RNA, 18 nt, Artificial Sequence
  Description of Artificial Sequence: Synthetic oligonucleotide
ugcauccugcuuggccac

SEQ ID NO: 7891 - RNA, 18 nt, Artificial Sequence
  Description of Artificial Sequence: Synthetic oligonucleotide
auagcugcauccugcuug

SEQ ID NO: 7892 - RNA, 18 nt, Artificial Sequence
  Description of Artificial Sequence: Synthetic oligonucleotide
cuuucauagcugcauccu

SEQ ID NO: 7893 - RNA, 18 nt, Artificial Sequence
  Description of Artificial Sequence: Synthetic oligonucleotide
cauggcuuucauagcugc

SEQ ID NO: 7894 - RNA, 18 nt, Artificial Sequence
  Description of Artificial Sequence: Synthetic oligonucleotide
auugucauggcuuucaua

SEQ ID NO: 7895 - RNA, 18 nt, Artificial Sequence
  Description of Artificial Sequence: Synthetic oligonucleotide
gcagaauugucauggcuu

SEQ ID NO: 7896 - RNA, 18 nt, Artificial Sequence
  Description of Artificial Sequence: Synthetic oligonucleotide
cucuagcagaauugucau

SEQ ID NO: 7897 - RNA, 18 nt, Artificial Sequence
  Description of Artificial Sequence: Synthetic oligonucleotide
gcuuccucuagcagaauu

SEQ ID NO: 7898 - RNA, 18 nt, Artificial Sequence
  Description of Artificial Sequence: Synthetic oligonucleotide
cuuuggcuuccucuagca

SEQ ID NO: 7899 - RNA, 18 nt, Artificial Sequence
  Description of Artificial Sequence: Synthetic oligonucleotide
cuuggcuuuggcuuccuc

SEQ ID NO: 7900 - RNA, 18 nt, Artificial Sequence
  Description of Artificial Sequence: Synthetic oligonucleotide
cuguccuuggcuuuggcu

SEQ ID NO: 7901 - RNA, 18 nt, Artificial Sequence
  Description of Artificial Sequence: Synthetic oligonucleotide
uuccacuguccuuggcuu

SEQ ID NO: 7902 - RNA, 18 nt, Artificial Sequence
  Description of Artificial Sequence: Synthetic oligonucleotide
ugauuuuccacuguccuu

SEQ ID NO: 7903 - RNA, 18 nt, Artificial Sequence
  Description of Artificial Sequence: Synthetic oligonucleotide
ucuucugauuuuccacug

SEQ ID NO: 7904 - RNA, 18 nt, Artificial Sequence
  Description of Artificial Sequence: Synthetic oligonucleotide
augauucuucugauuuuc

SEQ ID NO: 7905 - RNA, 18 nt, Artificial Sequence
  Description of Artificial Sequence: Synthetic oligonucleotide
gugggaugauucuucuga

SEQ ID NO: 7906 - RNA, 18 nt, Artificial Sequence
  Description of Artificial Sequence: Synthetic oligonucleotide
gaauagugggaugauucu

SEQ ID NO: 7907 - RNA, 18 nt, Artificial Sequence
  Description of Artificial Sequence: Synthetic oligonucleotide
cuguggaauagugggaug

SEQ ID NO: 7908 - RNA, 18 nt, Artificial Sequence
  Description of Artificial Sequence: Synthetic oligonucleotide
uuucucuguggaauagug

SEQ ID NO: 7909 - RNA, 18 nt, Artificial Sequence
  Description of Artificial Sequence: Synthetic oligonucleotide
gauucuuucucuguggaa

SEQ ID NO: 7910 - RNA, 18 nt, Artificial Sequence
  Description of Artificial Sequence: Synthetic oligonucleotide
ucucugauucuuucucug

SEQ ID NO: 7911 - RNA, 18 nt, Artificial Sequence
  Description of Artificial Sequence: Synthetic oligonucleotide
guauccgcugagggaaua

SEQ ID NO: 7912 - RNA, 18 nt, Artificial Sequence
  Description of Artificial Sequence: Synthetic oligonucleotide
guguaguauccgcugagg

SEQ ID NO: 7913 - RNA, 18 nt, Artificial Sequence
  Description of Artificial Sequence: Synthetic oligonucleotide
gauggguguaguauccgc

SEQ ID NO: 7914 - RNA, 18 nt, Artificial Sequence
  Description of Artificial Sequence: Synthetic oligonucleotide
aaauggauggguguagua

SEQ ID NO: 7915 - RNA, 18 nt, Artificial Sequence
  Description of Artificial Sequence: Synthetic oligonucleotide
ccuugaaauggaugggug

SEQ ID NO: 7916 - RNA, 18 nt, Artificial Sequence
  Description of Artificial Sequence: Synthetic oligonucleotide
cauagccuugaaauggau

SEQ ID NO: 7917 - RNA, 18 nt, Artificial Sequence
  Description of Artificial Sequence: Synthetic oligonucleotide
gugcucauagccuugaaa

SEQ ID NO: 7918 - RNA, 18 nt, Artificial Sequence
  Description of Artificial Sequence: Synthetic oligonucleotide
ugucugugcucauagccu

SEQ ID NO: 7919 - RNA, 18 nt, Artificial Sequence
  Description of Artificial Sequence: Synthetic oligonucleotide
ugagcugucugugcucau

SEQ ID NO: 7920 - RNA, 18 nt, Artificial Sequence
  Description of Artificial Sequence: Synthetic oligonucleotide
guaccugagcugucugug

SEQ ID NO: 7921 - RNA, 18 nt, Artificial Sequence
  Description of Artificial Sequence: Synthetic oligonucleotide
ugcugguaccugagcugu

SEQ ID NO: 7922 - RNA, 18 nt, Artificial Sequence
  Description of Artificial Sequence: Synthetic oligonucleotide
caggcugcugguaccuga

SEQ ID NO: 7923 - RNA, 18 nt, Artificial Sequence
  Description of Artificial Sequence: Synthetic oligonucleotide
uggcccaggcugcuggua

SEQ ID NO: 7924 - RNA, 18 nt, Artificial Sequence
  Description of Artificial Sequence: Synthetic oligonucleotide
gauccuggcccaggcugc

SEQ ID NO: 7925 - RNA, 18 nt, Artificial Sequence
  Description of Artificial Sequence: Synthetic oligonucleotide
gggaagauccuggcccag

SEQ ID NO: 7926 - RNA, 18 nt, Artificial Sequence
  Description of Artificial Sequence: Synthetic oligonucleotide
aagcaggaaacuacuggg

SEQ ID NO: 7927 - RNA, 18 nt, Artificial Sequence
  Description of Artificial Sequence: Synthetic oligonucleotide
cuuaagcaggaaacuacu

SEQ ID NO: 7928 - RNA, 18 nt, Artificial Sequence
  Description of Artificial Sequence: Synthetic oligonucleotide
auuugcuuaagcaggaaa

SEQ ID NO: 7929 - RNA, 18 nt, Artificial Sequence
  Description of Artificial Sequence: Synthetic oligonucleotide
auucuauuugcuuaagca

SEQ ID NO: 7930 - RNA, 18 nt, Artificial Sequence
  Description of Artificial Sequence: Synthetic oligonucleotide
gagaaauucuauuugcuu

SEQ ID NO: 7931 - RNA, 18 nt, Artificial Sequence
  Description of Artificial Sequence: Synthetic oligonucleotide
cccuugagaaauucuauu

SEQ ID NO: 7932 - RNA, 18 nt, Artificial Sequence
  Description of Artificial Sequence: Synthetic oligonucleotide
gcugccccuugagaaauu

SEQ ID NO: 7933 - RNA, 18 nt, Artificial Sequence
  Description of Artificial Sequence: Synthetic oligonucleotide
ugggagcugccccuugag

SEQ ID NO: 7934 - RNA, 18 nt, Artificial Sequence
  Description of Artificial Sequence: Synthetic oligonucleotide
gcuucugggagcugcccc

SEQ ID NO: 7935 - RNA, 18 nt, Artificial Sequence
  Description of Artificial Sequence: Synthetic oligonucleotide
ccggugcuucugggagcu

SEQ ID NO: 7936 - RNA, 18 nt, Artificial Sequence
  Description of Artificial Sequence: Synthetic oligonucleotide
aaucaccggugcuucugg

SEQ ID NO: 7937 - RNA, 18 nt, Artificial Sequence
  Description of Artificial Sequence: Synthetic oligonucleotide
uuuccaaucaccggugcu

SEQ ID NO: 7938 - RNA, 18 nt, Artificial Sequence
  Description of Artificial Sequence: Synthetic oligonucleotide
ucugcuuuccaaucaccg

SEQ ID NO: 7939 - RNA, 18 nt, Artificial Sequence
  Description of Artificial Sequence: Synthetic oligonucleotide
cggugucugcuuuccaau

SEQ ID NO: 7940 - RNA, 18 nt, Artificial Sequence
  Description of Artificial Sequence: Synthetic oligonucleotide
agugacggugucugcuuu

SEQ ID NO: 7941 - RNA, 18 nt, Artificial Sequence
  Description of Artificial Sequence: Synthetic oligonucleotide
guggcagugacggugucu

SEQ ID NO: 7942 - RNA, 18 nt, Artificial Sequence
  Description of Artificial Sequence: Synthetic oligonucleotide
ggaagguggcagugacgg

SEQ ID NO: 7943 - RNA, 18 nt, Artificial Sequence
  Description of Artificial Sequence: Synthetic oligonucleotide
gggagggaagguggcagu

SEQ ID NO: 7944 - RNA, 18 nt, Artificial Sequence
  Description of Artificial Sequence: Synthetic oligonucleotide
guccugggagggaaggug

SEQ ID NO: 7945 - RNA, 18 nt, Artificial Sequence
  Description of Artificial Sequence: Synthetic oligonucleotide
ccggaguccugggaggga

SEQ ID NO: 7946 - RNA, 18 nt, Artificial Sequence
  Description of Artificial Sequence: Synthetic oligonucleotide
cuuggccggaguccuggg

SEQ ID NO: 7947 - RNA, 18 nt, Artificial Sequence
  Description of Artificial Sequence: Synthetic oligonucleotide
gaaaccuuggccggaguc

SEQ ID NO: 7948 - RNA, 18 nt, Artificial Sequence
  Description of Artificial Sequence: Synthetic oligonucleotide
uacuggaaaccuuggccg

SEQ ID NO: 7949 - RNA, 18 nt, Artificial Sequence
  Description of Artificial Sequence: Synthetic oligonucleotide
aguaguacuggaaaccuu

SEQ ID NO: 7950 - RNA, 18 nt, Artificial Sequence
  Description of Artificial Sequence: Synthetic oligonucleotide
aggcaaguaguacuggaa

SEQ ID NO: 7951 - RNA, 18 nt, Artificial Sequence
  Description of Artificial Sequence: Synthetic oligonucleotide
acuggaggcaaguaguac

SEQ ID NO: 7952 - RNA, 18 nt, Artificial Sequence
  Description of Artificial Sequence: Synthetic oligonucleotide
cugguacuggaggcaagu

SEQ ID NO: 7953 - RNA, 18 nt, Artificial Sequence
  Description of Artificial Sequence: Synthetic oligonucleotide
ugccucugguacuggagg

SEQ ID NO: 7954 - RNA, 18 nt, Artificial Sequence
  Description of Artificial Sequence: Synthetic oligonucleotide
uugccugccucugguacu

SEQ ID NO: 7955 - RNA, 18 nt, Artificial Sequence
  Description of Artificial Sequence: Synthetic oligonucleotide
uccacuugccugccucug

SEQ ID NO: 7956 - RNA, 18 nt, Artificial Sequence
  Description of Artificial Sequence: Synthetic oligonucleotide
ugauguccacuugccugc

SEQ ID NO: 7957 - RNA, 18 nt, Artificial Sequence
  Description of Artificial Sequence: Synthetic oligonucleotide
accccugauguccacuug

SEQ ID NO: 7958 - RNA, 18 nt, Artificial Sequence
  Description of Artificial Sequence: Synthetic oligonucleotide
gggacaccccugaugucc

SEQ ID NO: 7959 - RNA, 18 nt, Artificial Sequence
  Description of Artificial Sequence: Synthetic oligonucleotide
gagaugcacgccccuggg

SEQ ID NO: 7960 - RNA, 18 nt, Artificial Sequence
  Description of Artificial Sequence: Synthetic oligonucleotide
uucugagaugcacgcccc

SEQ ID NO: 7961 - RNA, 18 nt, Artificial Sequence
  Description of Artificial Sequence: Synthetic oligonucleotide
cugacuucugagaugcac

SEQ ID NO: 7962 - RNA, 18 nt, Artificial Sequence
  Description of Artificial Sequence: Synthetic oligonucleotide
agccccugacuucugaga

SEQ ID NO: 7963 - RNA, 18 nt, Artificial Sequence
  Description of Artificial Sequence: Synthetic oligonucleotide
ucuggagccccugacuuc

SEQ ID NO: 7964 - RNA, 18 nt, Artificial Sequence
  Description of Artificial Sequence: Synthetic oligonucleotide
cccucucuggagccccug

SEQ ID NO: 7965 - RNA, 18 nt, Artificial Sequence
  Description of Artificial Sequence: Synthetic oligonucleotide
uggaacccucucuggagc

SEQ ID NO: 7966 - RNA, 18 nt, Artificial Sequence
  Description of Artificial Sequence: Synthetic oligonucleotide
gaugcuggaacccucucu

SEQ ID NO: 7967 - RNA, 18 nt, Artificial Sequence
  Description of Artificial Sequence: Synthetic oligonucleotide
ugaaggaugcuggaaccc

SEQ ID NO: 7968 - RNA, 18 nt, Artificial Sequence
  Description of Artificial Sequence: Synthetic oligonucleotide
cguggugaaggaugcugg

SEQ ID NO: 7969 - RNA, 18 nt, Artificial Sequence
  Description of Artificial Sequence: Synthetic oligonucleotide
ugccacguggugaaggau

SEQ ID NO: 7970 - RNA, 18 nt, Artificial Sequence
  Description of Artificial Sequence: Synthetic oligonucleotide
acuccugccacgugguga

SEQ ID NO: 7971 - RNA, 18 nt, Artificial Sequence
  Description of Artificial Sequence: Synthetic oligonucleotide
ggcagacuccugccacgu

SEQ ID NO: 7972 - RNA, 18 nt, Artificial Sequence
  Description of Artificial Sequence: Synthetic oligonucleotide
ucuguggcagacuccugc

SEQ ID NO: 7973 - RNA, 18 nt, Artificial Sequence
  Description of Artificial Sequence: Synthetic oligonucleotide
accucucuguggcagacu

SEQ ID NO: 7974 - RNA, 18 nt, Artificial Sequence
  Description of Artificial Sequence: Synthetic oligonucleotide
ucaacaccucucuguggc

SEQ ID NO: 7975 - RNA, 18 nt, Artificial Sequence
  Description of Artificial Sequence: Synthetic oligonucleotide
ggcaaucaacaccucucu

SEQ ID NO: 7976 - RNA, 18 nt, Artificial Sequence
  Description of Artificial Sequence: Synthetic oligonucleotide
ggaaaggcaaucaacacc

SEQ ID NO: 7977 - RNA, 18 nt, Artificial Sequence
  Description of Artificial Sequence: Synthetic oligonucleotide
ugugaggaaaggcaauca

SEQ ID NO: 7978 - RNA, 18 nt, Artificial Sequence
  Description of Artificial Sequence: Synthetic oligonucleotide
ggaaaugugaggaaaggc

SEQ ID NO: 7979 - RNA, 18 nt, Artificial Sequence
  Description of Artificial Sequence: Synthetic oligonucleotide
uuccuggaaaugugagga

SEQ ID NO: 7980 - RNA, 18 nt, Artificial Sequence
  Description of Artificial Sequence: Synthetic oligonucleotide
cucaguuccuggaaaugu

SEQ ID NO: 7981 - RNA, 18 nt, Artificial Sequence
  Description of Artificial Sequence: Synthetic oligonucleotide
agauacucaguuccugga

SEQ ID NO: 7982 - RNA, 18 nt, Artificial Sequence
  Description of Artificial Sequence: Synthetic oligonucleotide
uugguagauacucaguuc

SEQ ID NO: 7983 - RNA, 18 nt, Artificial Sequence
  Description of Artificial Sequence: Synthetic oligonucleotide
ugaucuugguagauacuc

SEQ ID NO: 7984 - RNA, 18 nt, Artificial Sequence
  Description of Artificial Sequence: Synthetic oligonucleotide
guuccugaucuugguaga

SEQ ID NO: 7985 - RNA, 18 nt, Artificial Sequence
  Description of Artificial Sequence: Synthetic oligonucleotide
ccuuuguuccugaucuug

SEQ ID NO: 7986 - RNA, 18 nt, Artificial Sequence
  Description of Artificial Sequence: Synthetic oligonucleotide
aagauccuuuguuccuga

SEQ ID NO: 7987 - RNA, 18 nt, Artificial Sequence
  Description of Artificial Sequence: Synthetic oligonucleotide
acuuuaagauccuuuguu

SEQ ID NO: 7988 - RNA, 18 nt, Artificial Sequence
  Description of Artificial Sequence: Synthetic oligonucleotide
caggaacuuuaagauccu

SEQ ID NO: 7989 - RNA, 18 nt, Artificial Sequence
  Description of Artificial Sequence: Synthetic oligonucleotide
ucuuccaggaacuuuaag

SEQ ID NO: 7990 - RNA, 18 nt, Artificial Sequence
  Description of Artificial Sequence: Synthetic oligonucleotide
caagcucuuccaggaacu

SEQ ID NO: 7991 - RNA, 18 nt, Artificial Sequence
  Description of Artificial Sequence: Synthetic oligonucleotide
uuccccaagcucuuccag

SEQ ID NO: 7992 - RNA, 18 nt, Artificial Sequence
  Description of Artificial Sequence: Synthetic oligonucleotide
uucccuuccccaagcucu

SEQ ID NO: 7993 - RNA, 18 nt, Artificial Sequence
  Description of Artificial Sequence: Synthetic oligonucleotide
uggccuucccuuccccaa

SEQ ID NO: 7994 - RNA, 18 nt, Artificial Sequence
  Description of Artificial Sequence: Synthetic oligonucleotide
ugugguggccuucccuuc

SEQ ID NO: 7995 - RNA, 18 nt, Artificial Sequence
  Description of Artificial Sequence: Synthetic oligonucleotide
ugugcugugguggccuuc

SEQ ID NO: 7996 - RNA, 18 nt, Artificial Sequence
  Description of Artificial Sequence: Synthetic oligonucleotide
gaucaugugcuguggugg

SEQ ID NO: 7997 - RNA, 18 nt, Artificial Sequence
  Description of Artificial Sequence: Synthetic oligonucleotide
agacagaucaugugcugu

SEQ ID NO: 7998 - RNA, 18 nt, Artificial Sequence
  Description of Artificial Sequence: Synthetic oligonucleotide
uucccagacagaucaugu

SEQ ID NO: 7999 - RNA, 18 nt, Artificial Sequence
  Description of Artificial Sequence: Synthetic oligonucleotide
caaguuucccagacagau

SEQ ID NO: 8000 - RNA, 18 nt, Artificial Sequence
  Description of Artificial Sequence: Synthetic oligonucleotide
agucccaaguuucccaga

SEQ ID NO: 8001 - RNA, 18 nt, Artificial Sequence
  Description of Artificial Sequence: Synthetic oligonucleotide
uucggagucccaaguuuc

SEQ ID NO: 8002 - RNA, 18 nt, Artificial Sequence
  Description of Artificial Sequence: Synthetic oligonucleotide
cuuucuucggagucccaa

SEQ ID NO: 8003 - RNA, 18 nt, Artificial Sequence
  Description of Artificial Sequence: Synthetic oligonucleotide
gauuucuuucuucggagu

SEQ ID NO: 8004 - RNA, 18 nt, Artificial Sequence
  Description of Artificial Sequence: Synthetic oligonucleotide
cgauugauuucuuucuuc

SEQ ID NO: 8005 - RNA, 18 nt, Artificial Sequence
  Description of Artificial Sequence: Synthetic oligonucleotide
aaacucgauugauuucuu

SEQ ID NO: 8006 - RNA, 18 nt, Artificial Sequence
  Description of Artificial Sequence: Synthetic oligonucleotide
guauaaaacucgauugau

SEQ ID NO: 8007 - RNA, 18 nt, Artificial Sequence
  Description of Artificial Sequence: Synthetic oligonucleotide
agggaguauaaaacucga

SEQ ID NO: 8008 - RNA, 18 nt, Artificial Sequence
  Description of Artificial Sequence: Synthetic oligonucleotide
uugccagggaguauaaaa

SEQ ID NO: 8009 - RNA, 18 nt, Artificial Sequence
  Description of Artificial Sequence: Synthetic oligonucleotide
cuucuuugccagggagua

SEQ ID NO: 8010 - RNA, 18 nt, Artificial Sequence
  Description of Artificial Sequence: Synthetic oligonucleotide
uugcccuucuuugccagg

SEQ ID NO: 8011 - RNA, 18 nt, Artificial Sequence
  Description of Artificial Sequence: Synthetic oligonucleotide
guagcuugcccuucuuug

SEQ ID NO: 8012 - RNA, 18 nt, Artificial Sequence
  Description of Artificial Sequence: Synthetic oligonucleotide
uuucuguagcuugcccuu

SEQ ID NO: 8013 - RNA, 18 nt, Artificial Sequence
  Description of Artificial Sequence: Synthetic oligonucleotide
gccucuuucuguagcuug

SEQ ID NO: 8014 - RNA, 18 nt, Artificial Sequence
  Description of Artificial Sequence: Synthetic oligonucleotide
uuccugccucuuucugua

SEQ ID NO: 8015 - RNA, 18 nt, Artificial Sequence
  Description of Artificial Sequence: Synthetic oligonucleotide
ggguguuccugccucuuu

SEQ ID NO: 8016 - RNA, 18 nt, Artificial Sequence
  Description of Artificial Sequence: Synthetic oligonucleotide
gcgauuuuccacaaaggg

SEQ ID NO: 8017 - RNA, 18 nt, Artificial Sequence
  Description of Artificial Sequence: Synthetic oligonucleotide
accgcgauuuuccacaaa

SEQ ID NO: 8018 - RNA, 18 nt, Artificial Sequence
  Description of Artificial Sequence: Synthetic oligonucleotide
uggagaccgcgauuuucc

SEQ ID NO: 8019 - RNA, 18 nt, Artificial Sequence
  Description of Artificial Sequence: Synthetic oligonucleotide
cugaguggagaccgcgau

SEQ ID NO: 8020 - RNA, 18 nt, Artificial Sequence
  Description of Artificial Sequence: Synthetic oligonucleotide
caagccugaguggagacc

SEQ ID NO: 8021 - RNA, 18 nt, Artificial Sequence
  Description of Artificial Sequence: Synthetic oligonucleotide
gguuccaagccugagugg

SEQ ID NO: 8022 - RNA, 18 nt, Artificial Sequence
  Description of Artificial Sequence: Synthetic oligonucleotide
gugcugguuccaagccug

SEQ ID NO: 8023 - RNA, 18 nt, Artificial Sequence
  Description of Artificial Sequence: Synthetic oligonucleotide
ccgcugugcugguuccaa

SEQ ID NO: 8024 - RNA, 18 nt, Artificial Sequence
  Description of Artificial Sequence: Synthetic oligonucleotide
ccacuccgcugugcuggu

SEQ ID NO: 8025 - RNA, 18 nt, Artificial Sequence
  Description of Artificial Sequence: Synthetic oligonucleotide
ucuuaccacuccgcugug

SEQ ID NO: 8026 - RNA, 18 nt, Artificial Sequence
  Description of Artificial Sequence: Synthetic oligonucleotide
ucuggucuuaccacuccg

SEQ ID NO: 8027 - RNA, 18 nt, Artificial Sequence
  Description of Artificial Sequence: Synthetic oligonucleotide
gaccgucuggucuuacca

SEQ ID NO: 8028 - RNA, 18 nt, Artificial Sequence
  Description of Artificial Sequence: Synthetic oligonucleotide
gcuaugaccgucuggucu

SEQ ID NO: 8029 - RNA, 18 nt, Artificial Sequence
  Description of Artificial Sequence: Synthetic oligonucleotide
ccuuggcuaugaccgucu

SEQ ID NO: 8030 - RNA, 18 nt, Artificial Sequence
  Description of Artificial Sequence: Synthetic oligonucleotide
gggcuccuuggcuaugac

SEQ ID NO: 8031 - RNA, 18 nt, Artificial Sequence
  Description of Artificial Sequence: Synthetic oligonucleotide
cucgggucugaguuuggg

SEQ ID NO: 8032 - RNA, 18 nt, Artificial Sequence
  Description of Artificial Sequence: Synthetic oligonucleotide
acucgggucugaguuugg

SEQ ID NO: 8033 - RNA, 18 nt, Artificial Sequence
  Description of Artificial Sequence: Synthetic oligonucleotide
uccaaacucgggucugag

SEQ ID NO: 8034 - RNA, 18 nt, Artificial Sequence
  Description of Artificial Sequence: Synthetic oligonucleotide
ccgguuccaaacucgggu

SEQ ID NO: 8035 - RNA, 18 nt, Artificial Sequence
  Description of Artificial Sequence: Synthetic oligonucleotide
gucuuccgguuccaaacu

SEQ ID NO: 8036 - RNA, 18 nt, Artificial Sequence
  Description of Artificial Sequence: Synthetic oligonucleotide
uuucugucuuccgguucc

SEQ ID NO: 8037 - RNA, 18 nt, Artificial Sequence
  Description of Artificial Sequence: Synthetic oligonucleotide
uggaguuucugucuuccg

SEQ ID NO: 8038 - RNA, 18 nt, Artificial Sequence
  Description of Artificial Sequence: Synthetic oligonucleotide
agauguggaguuucuguc

SEQ ID NO: 8039 - RNA, 18 nt, Artificial Sequence
  Description of Artificial Sequence: Synthetic oligonucleotide
gagacagauguggaguuu

SEQ ID NO: 8040 - RNA, 18 nt, Artificial Sequence
  Description of Artificial Sequence: Synthetic oligonucleotide
cuucugagacagaugugg

SEQ ID NO: 8041 - RNA, 18 nt, Artificial Sequence
  Description of Artificial Sequence: Synthetic oligonucleotide
aagaucuucugagacaga

SEQ ID NO: 8042 - RNA, 18 nt, Artificial Sequence
  Description of Artificial Sequence: Synthetic oligonucleotide
ucaagaagaucuucugag

SEQ ID NO: 8043 - RNA, 18 nt, Artificial Sequence
  Description of Artificial Sequence: Synthetic oligonucleotide
aaggcucaagaagaucuu

SEQ ID NO: 8044 - RNA, 18 nt, Artificial Sequence
  Description of Artificial Sequence: Synthetic oligonucleotide
aauaaaaggcucaagaag

SEQ ID NO: 8045 - RNA, 18 nt, Artificial Sequence
  Description of Artificial Sequence: Synthetic oligonucleotide
acugcaauaaaaggcuca

SEQ ID NO: 8046 - RNA, 18 nt, Artificial Sequence
  Description of Artificial Sequence: Synthetic oligonucleotide
cugagacugcaauaaaag

SEQ ID NO: 8047 - RNA, 18 nt, Artificial Sequence
  Description of Artificial Sequence: Synthetic oligonucleotide
cugagcugagacugcaau

SEQ ID NO: 8048 - RNA, 18 nt, Artificial Sequence
  Description of Artificial Sequence: Synthetic oligonucleotide
caagccugagcugagacu

SEQ ID NO: 8049 - RNA, 18 nt, Artificial Sequence
  Description of Artificial Sequence: Synthetic oligonucleotide
gguuccaagccugagcug

SEQ ID NO: 8050 - RNA, 18 nt, Artificial Sequence
  Description of Artificial Sequence: Synthetic oligonucleotide
gugcugguuccaagccug

SEQ ID NO: 8051 - RNA, 18 nt, Artificial Sequence
  Description of Artificial Sequence: Synthetic oligonucleotide
ccgcugugcugguuccaa

SEQ ID NO: 8052 - RNA, 18 nt, Artificial Sequence
  Description of Artificial Sequence: Synthetic oligonucleotide
ccacuccgcugugcuggu

SEQ ID NO: 8053 - RNA, 18 nt, Artificial Sequence
  Description of Artificial Sequence: Synthetic oligonucleotide
ucuuaccacuccgcugug

SEQ ID NO: 8054 - RNA, 18 nt, Artificial Sequence
  Description of Artificial Sequence: Synthetic oligonucleotide
ucuggucuuaccacuccg

SEQ ID NO: 8055 - RNA, 18 nt, Artificial Sequence
  Description of Artificial Sequence: Synthetic oligonucleotide
gacugucuggucuuacca

SEQ ID NO: 8056 - RNA, 18 nt, Artificial Sequence
  Description of Artificial Sequence: Synthetic oligonucleotide
gcuaugacugucuggucu

SEQ ID NO: 8057 - RNA, 18 nt, Artificial Sequence
  Description of Artificial Sequence: Synthetic oligonucleotide
ccuuggcuaugacugucu

SEQ ID NO: 8058 - RNA, 18 nt, Artificial Sequence
  Description of Artificial Sequence: Synthetic oligonucleotide
gggauccuuggcuaugac

SEQ ID NO: 8059 - RNA, 18 nt, Artificial Sequence
  Description of Artificial Sequence: Synthetic oligonucleotide
ccugggucugaguuuggg

SEQ ID NO: 8060 - RNA, 18 nt, Artificial Sequence
  Description of Artificial Sequence: Synthetic oligonucleotide
caaaccugggucugaguu

SEQ ID NO: 8061 - RNA, 18 nt, Artificial Sequence
  Description of Artificial Sequence: Synthetic oligonucleotide
gguuccaaaccugggucu

SEQ ID NO: 8062 - RNA, 18 nt, Artificial Sequence
  Description of Artificial Sequence: Synthetic oligonucleotide
cuucagguuccaaaccug

SEQ ID NO: 8063 - RNA, 18 nt, Artificial Sequence
  Description of Artificial Sequence: Synthetic oligonucleotide
gcugucuucagguuccaa

SEQ ID NO: 8064 - RNA, 18 nt, Artificial Sequence
  Description of Artificial Sequence: Synthetic oligonucleotide
gaguugcugucuucaggu

SEQ ID NO: 8065 - RNA, 18 nt, Artificial Sequence
  Description of Artificial Sequence: Synthetic oligonucleotide
auguggaguugcugucuu

SEQ ID NO: 8066 - RNA, 18 nt, Artificial Sequence
  Description of Artificial Sequence: Synthetic oligonucleotide
ggcagauguggaguugcu

SEQ ID NO: 8067 - RNA, 18 nt, Artificial Sequence
  Description of Artificial Sequence: Synthetic oligonucleotide
uccaaggcagauguggag

SEQ ID NO: 8068 - RNA, 18 nt, Artificial Sequence
  Description of Artificial Sequence: Synthetic oligonucleotide
gaucuuccaaggcagaug

SEQ ID NO: 8069 - RNA, 18 nt, Artificial Sequence
  Description of Artificial Sequence: Synthetic oligonucleotide
aagaggaucuuccaaggc

SEQ ID NO: 8070 - RNA, 18 nt, Artificial Sequence
  Description of Artificial Sequence: Synthetic oligonucleotide
aacucaagaggaucuucc

SEQ ID NO: 8071 - RNA, 18 nt, Artificial Sequence
  Description of Artificial Sequence: Synthetic oligonucleotide
cuaaaaacucaagaggau

SEQ ID NO: 8072 - RNA, 18 nt, Artificial Sequence
  Description of Artificial Sequence: Synthetic oligonucleotide
caugucuaaaaacucaag

SEQ ID NO: 8073 - RNA, 18 nt, Artificial Sequence
  Description of Artificial Sequence: Synthetic oligonucleotide
ucggccaugucuaaaaac

SEQ ID NO: 8074 - RNA, 18 nt, Artificial Sequence
  Description of Artificial Sequence: Synthetic oligonucleotide
ugaucucggccaugucua

SEQ ID NO: 8075 - RNA, 18 nt, Artificial Sequence
  Description of Artificial Sequence: Synthetic oligonucleotide
cuccuugaucucggccau

SEQ ID NO: 8076 - RNA, 18 nt, Artificial Sequence
  Description of Artificial Sequence: Synthetic oligonucleotide
auuuucuccuugaucucg

SEQ ID NO: 8077 - RNA, 18 nt, Artificial Sequence
  Description of Artificial Sequence: Synthetic oligonucleotide
cgcagauuuucuccuuga

SEQ ID NO: 8078 - RNA, 18 nt, Artificial Sequence
  Description of Artificial Sequence: Synthetic oligonucleotide
auagucgcagauuuucuc

SEQ ID NO: 8079 - RNA, 18 nt, Artificial Sequence
  Description of Artificial Sequence: Synthetic oligonucleotide
aagagauagucgcagauu

SEQ ID NO: 8080 - RNA, 18 nt, Artificial Sequence
  Description of Artificial Sequence: Synthetic oligonucleotide
cauugaagagauagucgc

SEQ ID NO: 8081 - RNA, 18 nt, Artificial Sequence
  Description of Artificial Sequence: Synthetic oligonucleotide
agacacauugaagagaua

SEQ ID NO: 8082 - RNA, 18 nt, Artificial Sequence
  Description of Artificial Sequence: Synthetic oligonucleotide
gagucagacacauugaag

SEQ ID NO: 8083 - RNA, 18 nt, Artificial Sequence
  Description of Artificial Sequence: Synthetic oligonucleotide
cagaggagucagacacau

SEQ ID NO: 8084 - RNA, 18 nt, Artificial Sequence
  Description of Artificial Sequence: Synthetic oligonucleotide
cagggcagaggagucaga

SEQ ID NO: 8085 - RNA, 18 nt, Artificial Sequence
  Description of Artificial Sequence: Synthetic oligonucleotide
aaauucagggcagaggag

SEQ ID NO: 8086 - RNA, 18 nt, Artificial Sequence
  Description of Artificial Sequence: Synthetic oligonucleotide
uagccaaauucagggcag

SEQ ID NO: 8087 - RNA, 18 nt, Artificial Sequence
  Description of Artificial Sequence: Synthetic oligonucleotide
auuuuuagccaaauucag

SEQ ID NO: 8088 - RNA, 18 nt, Artificial Sequence
  Description of Artificial Sequence: Synthetic oligonucleotide
ccaauauuuuuagccaaa

SEQ ID NO: 8089 - RNA, 18 nt, Artificial Sequence
  Description of Artificial Sequence: Synthetic oligonucleotide
uaaggccaauauuuuuag

SEQ ID NO: 8090 - RNA, 18 nt, Artificial Sequence
  Description of Artificial Sequence: Synthetic oligonucleotide
cuugguaaggccaauauu

SEQ ID NO: 8091 - RNA, 18 nt, Artificial Sequence
  Description of Artificial Sequence: Synthetic oligonucleotide
cgggccuugguaaggcca

SEQ ID NO: 8092 - RNA, 18 nt, Artificial Sequence
  Description of Artificial Sequence: Synthetic oligonucleotide
uaucucgggccuugguaa

SEQ ID NO: 8093 - RNA, 18 nt, Artificial Sequence
  Description of Artificial Sequence: Synthetic oligonucleotide
auuuauaucucgggccuu

SEQ ID NO: 8094 - RNA, 18 nt, Artificial Sequence
  Description of Artificial Sequence: Synthetic oligonucleotide
acagcauuuauaucucgg

SEQ ID NO: 8095 - RNA, 18 nt, Artificial Sequence
  Description of Artificial Sequence: Synthetic oligonucleotide
uuagcacagcauuuauau

SEQ ID NO: 8096 - RNA, 18 nt, Artificial Sequence
  Description of Artificial Sequence: Synthetic oligonucleotide
gucaauuagcacagcauu

SEQ ID NO: 8097 - RNA, 18 nt, Artificial Sequence
  Description of Artificial Sequence: Synthetic oligonucleotide
uccaugucaauuagcaca

SEQ ID NO: 8098 - RNA, 18 nt, Artificial Sequence
  Description of Artificial Sequence: Synthetic oligonucleotide
gccuuuccaugucaauua

SEQ ID NO: 8099 - RNA, 18 nt, Artificial Sequence
  Description of Artificial Sequence: Synthetic oligonucleotide
ccccugccuuuccauguc

SEQ ID NO: 8100 - RNA, 18 nt, Artificial Sequence
  Description of Artificial Sequence: Synthetic oligonucleotide
acaucccccugccuuucc

SEQ ID NO: 8101 - RNA, 18 nt, Artificial Sequence
  Description of Artificial Sequence: Synthetic oligonucleotide
uauagacaucccccugcc

SEQ ID NO: 8102 - RNA, 18 nt, Artificial Sequence
  Description of Artificial Sequence: Synthetic oligonucleotide
uugucuauagacaucccc

SEQ ID NO: 8103 - RNA, 18 nt, Artificial Sequence
  Description of Artificial Sequence: Synthetic oligonucleotide
gucccuugucuauagaca

SEQ ID NO: 8104 - RNA, 18 nt, Artificial Sequence
  Description of Artificial Sequence: Synthetic oligonucleotide
ggguugucccuugucuau

SEQ ID NO: 8105 - RNA, 18 nt, Artificial Sequence
  Description of Artificial Sequence: Synthetic oligonucleotide
aaaugccauaugggaggg

SEQ ID NO: 8106 - RNA, 18 nt, Artificial Sequence
  Description of Artificial Sequence: Synthetic oligonucleotide
gucaaaugccauauggga

SEQ ID NO: 8107 - RNA, 18 nt, Artificial Sequence
  Description of Artificial Sequence: Synthetic oligonucleotide
ugucugucaaaugccaua

SEQ ID NO: 8108 - RNA, 18 nt, Artificial Sequence
  Description of Artificial Sequence: Synthetic oligonucleotide
cuucuugucugucaaaug

SEQ ID NO: 8109 - RNA, 18 nt, Artificial Sequence
  Description of Artificial Sequence: Synthetic oligonucleotide
ucucgcuucuugucuguc

SEQ ID NO: 8110 - RNA, 18 nt, Artificial Sequence
  Description of Artificial Sequence: Synthetic oligonucleotide
uccucucucgcuucuugu

SEQ ID NO: 8111 - RNA, 18 nt, Artificial Sequence
  Description of Artificial Sequence: Synthetic oligonucleotide
uugcauccucucucgcuu

SEQ ID NO: 8112 - RNA, 18 nt, Artificial Sequence
  Description of Artificial Sequence: Synthetic oligonucleotide
uugauuugcauccucucu

SEQ ID NO: 8113 - RNA, 18 nt, Artificial Sequence
  Description of Artificial Sequence: Synthetic oligonucleotide
uucucuugauuugcaucc

SEQ ID NO: 8114 - RNA, 18 nt, Artificial Sequence
  Description of Artificial Sequence: Synthetic oligonucleotide
cguauuucucuugauuug

SEQ ID NO: 8115 - RNA, 18 nt, Artificial Sequence
  Description of Artificial Sequence: Synthetic oligonucleotide
cuguucguauuucucuug

SEQ ID NO: 8116 - RNA, 18 nt, Artificial Sequence
  Description of Artificial Sequence: Synthetic oligonucleotide
gaacacuguucguauuuc

SEQ ID NO: 8117 - RNA, 18 nt, Artificial Sequence
  Description of Artificial Sequence: Synthetic oligonucleotide
uucaggaacacuguucgu

SEQ ID NO: 8118 - RNA, 18 nt, Artificial Sequence
  Description of Artificial Sequence: Synthetic oligonucleotide
gcgguuucaggaacacug

SEQ ID NO: 8119 - RNA, 18 nt, Artificial Sequence
  Description of Artificial Sequence: Synthetic oligonucleotide
cuggagcgguuucaggaa

SEQ ID NO: 8120 - RNA, 18 nt, Artificial Sequence
  Description of Artificial Sequence: Synthetic oligonucleotide
ugcagcuggagcgguuuc

SEQ ID NO: 8121 - RNA, 18 nt, Artificial Sequence
  Description of Artificial Sequence: Synthetic oligonucleotide
gggauugcagcuggagcg

SEQ ID NO: 8122 - RNA, 18 nt, Artificial Sequence
  Description of Artificial Sequence: Synthetic oligonucleotide
ucucagggauugcagcug

SEQ ID NO: 8123 - RNA, 18 nt, Artificial Sequence
  Description of Artificial Sequence: Synthetic oligonucleotide
uuuggucucagggauugc

SEQ ID NO: 8124 - RNA, 18 nt, Artificial Sequence
  Description of Artificial Sequence: Synthetic oligonucleotide
uuucuuuuggucucaggg

SEQ ID NO: 8125 - RNA, 18 nt, Artificial Sequence
  Description of Artificial Sequence: Synthetic oligonucleotide
cugcguuucuuuuggucu

SEQ ID NO: 8126 - RNA, 18 nt, Artificial Sequence
  Description of Artificial Sequence: Synthetic oligonucleotide
gaacucugcguuucuuuu

SEQ ID NO: 8127 - RNA, 18 nt, Artificial Sequence
  Description of Artificial Sequence: Synthetic oligonucleotide
gugaggaacucugcguuu

SEQ ID NO: 8128 - RNA, 18 nt, Artificial Sequence
  Description of Artificial Sequence: Synthetic oligonucleotide
uacaggugaggaacucug

SEQ ID NO: 8129 - RNA, 18 nt, Artificial Sequence
  Description of Artificial Sequence: Synthetic oligonucleotide
uauauuacaggugaggaa

SEQ ID NO: 8130 - RNA, 18 nt, Artificial Sequence
  Description of Artificial Sequence: Synthetic oligonucleotide
guggguauauuacaggug

SEQ ID NO: 8131 - RNA, 18 nt, Artificial Sequence
  Description of Artificial Sequence: Synthetic oligonucleotide
uugauguggguauauuac

SEQ ID NO: 8132 - RNA, 18 nt, Artificial Sequence
  Description of Artificial Sequence: Synthetic oligonucleotide
ggcauuugauguggguau

SEQ ID NO: 8133 - RNA, 18 nt, Artificial Sequence
  Description of Artificial Sequence: Synthetic oligonucleotide
uuugaggcauuugaugug

SEQ ID NO: 8134 - RNA, 18 nt, Artificial Sequence
  Description of Artificial Sequence: Synthetic oligonucleotide
uguuauuugaggcauuug

SEQ ID NO: 8135 - RNA, 18 nt, Artificial Sequence
  Description of Artificial Sequence: Synthetic oligonucleotide
uaccauguuauuugaggc

SEQ ID NO: 8136 - RNA, 18 nt, Artificial Sequence
  Description of Artificial Sequence: Synthetic oligonucleotide
gugguuaccauguuauuu

SEQ ID NO: 8137 - RNA, 18 nt, Artificial Sequence
  Description of Artificial Sequence: Synthetic oligonucleotide
uuucugugguuaccaugu

SEQ ID NO: 8138 - RNA, 18 nt, Artificial Sequence
  Description of Artificial Sequence: Synthetic oligonucleotide
cacuuuuucugugguuac

SEQ ID NO: 8139 - RNA, 18 nt, Artificial Sequence
  Description of Artificial Sequence: Synthetic oligonucleotide
uucuccacuuuuucugug

SEQ ID NO: 8140 - RNA, 18 nt, Artificial Sequence
  Description of Artificial Sequence: Synthetic oligonucleotide
gcccauucuccacuuuuu

SEQ ID NO: 8141 - RNA, 18 nt, Artificial Sequence
  Description of Artificial Sequence: Synthetic oligonucleotide
uuccugcccauucuccac

SEQ ID NO: 8142 - RNA, 18 nt, Artificial Sequence
  Description of Artificial Sequence: Synthetic oligonucleotide
acagguuccugcccauuc

SEQ ID NO: 8143 - RNA, 18 nt, Artificial Sequence
  Description of Artificial Sequence: Synthetic oligonucleotide
uuaugacagguuccugcc

SEQ ID NO: 8144 - RNA, 18 nt, Artificial Sequence
  Description of Artificial Sequence: Synthetic oligonucleotide
uaacuuuaugacagguuc

SEQ ID NO: 8145 - RNA, 18 nt, Artificial Sequence
  Description of Artificial Sequence: Synthetic oligonucleotide
uuuucuaacuuuaugaca

SEQ ID NO: 8146 - RNA, 18 nt, Artificial Sequence
  Description of Artificial Sequence: Synthetic oligonucleotide
gccuguuuucuaacuuua

SEQ ID NO: 8147 - RNA, 18 nt, Artificial Sequence
  Description of Artificial Sequence: Synthetic oligonucleotide
cucuugccuguuuucuaa

SEQ ID NO: 8148 - RNA, 18 nt, Artificial Sequence
  Description of Artificial Sequence: Synthetic oligonucleotide
cuggccucuugccuguuu

SEQ ID NO: 8149 - RNA, 18 nt, Artificial Sequence
  Description of Artificial Sequence: Synthetic oligonucleotide
cuggucuggccucuugcc

SEQ ID NO: 8150 - RNA, 18 nt, Artificial Sequence
  Description of Artificial Sequence: Synthetic oligonucleotide
ugguucuggucuggccuc

SEQ ID NO: 8151 - RNA, 18 nt, Artificial Sequence
  Description of Artificial Sequence: Synthetic oligonucleotide
cuugcugguucuggucug

SEQ ID NO: 8152 - RNA, 18 nt, Artificial Sequence
  Description of Artificial Sequence: Synthetic oligonucleotide
ucagucuugcugguucug

SEQ ID NO: 8153 - RNA, 18 nt, Artificial Sequence
  Description of Artificial Sequence: Synthetic oligonucleotide
ugguuucagucuugcugg

SEQ ID NO: 8154 - RNA, 18 nt, Artificial Sequence
  Description of Artificial Sequence: Synthetic oligonucleotide
acaggugguuucagucuu

SEQ ID NO: 8155 - RNA, 18 nt, Artificial Sequence
  Description of Artificial Sequence: Synthetic oligonucleotide
aaugaacaggugguuuca

SEQ ID NO: 8156 - RNA, 18 nt, Artificial Sequence
  Description of Artificial Sequence: Synthetic oligonucleotide
auuguaaugaacaggugg

SEQ ID NO: 8157 - RNA, 18 nt, Artificial Sequence
  Description of Artificial Sequence: Synthetic oligonucleotide
gggccauuguaaugaaca

SEQ ID NO: 8158 - RNA, 18 nt, Artificial Sequence
  Description of Artificial Sequence: Synthetic oligonucleotide
auacccugcuuuugaggg

SEQ ID NO: 8159 - RNA, 18 nt, Artificial Sequence
  Description of Artificial Sequence: Synthetic oligonucleotide
aacauacccugcuuuuga

SEQ ID NO: 8160 - RNA, 18 nt, Artificial Sequence
  Description of Artificial Sequence: Synthetic oligonucleotide
aagucaacauacccugcu

SEQ ID NO: 8161 - RNA, 18 nt, Artificial Sequence
  Description of Artificial Sequence: Synthetic oligonucleotide
uuucaaagucaacauacc

SEQ ID NO: 8162 - RNA, 18 nt, Artificial Sequence
  Description of Artificial Sequence: Synthetic oligonucleotide
gccauuuucaaagucaac

SEQ ID NO: 8163 - RNA, 18 nt, Artificial Sequence
  Description of Artificial Sequence: Synthetic oligonucleotide
cacuggccauuuucaaag

SEQ ID NO: 8164 - RNA, 18 nt, Artificial Sequence
  Description of Artificial Sequence: Synthetic oligonucleotide
uggcccacuggccauuuu

SEQ ID NO: 8165 - RNA, 18 nt, Artificial Sequence
  Description of Artificial Sequence: Synthetic oligonucleotide
aucuguggcccacuggcc

SEQ ID NO: 8166 - RNA, 18 nt, Artificial Sequence
  Description of Artificial Sequence: Synthetic oligonucleotide
augucaucuguggcccac

SEQ ID NO: 8167 - RNA, 18 nt, Artificial Sequence
  Description of Artificial Sequence: Synthetic oligonucleotide
cugggaugucaucugugg

SEQ ID NO: 8168 - RNA, 18 nt, Artificial Sequence
  Description of Artificial Sequence: Synthetic oligonucleotide
gucaucugggaugucauc

SEQ ID NO: 8169 - RNA, 18 nt, Artificial Sequence
  Description of Artificial Sequence: Synthetic oligonucleotide
uucaagucaucugggaug

SEQ ID NO: 8170 - RNA, 18 nt, Artificial Sequence
  Description of Artificial Sequence: Synthetic oligonucleotide
uacuauucaagucaucug

SEQ ID NO: 8171 - RNA, 18 nt, Artificial Sequence
  Description of Artificial Sequence: Synthetic oligonucleotide
gcggauacuauucaaguc

SEQ ID NO: 8172 - RNA, 18 nt, Artificial Sequence
  Description of Artificial Sequence: Synthetic oligonucleotide
gcugcgcggauacuauuc

SEQ ID NO: 8173 - RNA, 18 nt, Artificial Sequence
  Description of Artificial Sequence: Synthetic oligonucleotide
cuggugcugcgcggauac

SEQ ID NO: 8174 - RNA, 18 nt, Artificial Sequence
  Description of Artificial Sequence: Synthetic oligonucleotide
cucaccuggugcugcgcg

SEQ ID NO: 8175 - RNA, 18 nt, Artificial Sequence
  Description of Artificial Sequence: Synthetic oligonucleotide
cgaaacucaccuggugcu

SEQ ID NO: 8176 - RNA, 18 nt, Artificial Sequence
  Description of Artificial Sequence: Synthetic oligonucleotide
uggcucgaaacucaccug

SEQ ID NO: 8177 - RNA, 18 nt, Artificial Sequence
  Description of Artificial Sequence: Synthetic oligonucleotide
caugauggcucgaaacuc

SEQ ID NO: 8178 - RNA, 18 nt, Artificial Sequence
  Description of Artificial Sequence: Synthetic oligonucleotide
aucuccaugauggcucga

SEQ ID NO: 8179 - RNA, 18 nt, Artificial Sequence
  Description of Artificial Sequence: Synthetic oligonucleotide
agggcaucuccaugaugg

SEQ ID NO: 8180 - RNA, 18 nt, Artificial Sequence
  Description of Artificial Sequence: Synthetic oligonucleotide
gaaggagggcaucuccau

SEQ ID NO: 8181 - RNA, 18 nt, Artificial Sequence
  Description of Artificial Sequence: Synthetic oligonucleotide
cuguagaaggagggcauc

SEQ ID NO: 8182 - RNA, 18 nt, Artificial Sequence
  Description of Artificial Sequence: Synthetic oligonucleotide
caugacuguagaaggagg

SEQ ID NO: 8183 - RNA, 18 nt, Artificial Sequence
  Description of Artificial Sequence: Synthetic oligonucleotide
caagccaugacuguagaa

SEQ ID NO: 8184 - RNA, 18 nt, Artificial Sequence
  Description of Artificial Sequence: Synthetic oligonucleotide
cguggcaagccaugacug

SEQ ID NO: 8185 - RNA, 18 nt, Artificial Sequence
  Description of Artificial Sequence: Synthetic oligonucleotide
aacaccguggcaagccau

SEQ ID NO: 8186 - RNA, 18 nt, Artificial Sequence
  Description of Artificial Sequence: Synthetic oligonucleotide
gggugaacaccguggcaa

SEQ ID NO: 8187 - RNA, 18 nt, Artificial Sequence
  Description of Artificial Sequence: Synthetic oligonucleotide
uuguagggugaacaccgu

SEQ ID NO: 8188 - RNA, 18 nt, Artificial Sequence
  Description of Artificial Sequence: Synthetic oligonucleotide
guuucuuguagggugaac

SEQ ID NO: 8189 - RNA, 18 nt, Artificial Sequence
  Description of Artificial Sequence: Synthetic oligonucleotide
ugucaguuucuuguaggg

SEQ ID NO: 8190 - RNA, 18 nt, Artificial Sequence
  Description of Artificial Sequence: Synthetic oligonucleotide
cacucugucaguuucuug

SEQ ID NO: 8191 - RNA, 18 nt, Artificial Sequence
  Description of Artificial Sequence: Synthetic oligonucleotide
gcuggcacucugucaguu

SEQ ID NO: 8192 - RNA, 18 nt, Artificial Sequence
  Description of Artificial Sequence: Synthetic oligonucleotide
cuucagcuggcacucugu

SEQ ID NO: 8193 - RNA, 18 nt, Artificial Sequence
  Description of Artificial Sequence: Synthetic oligonucleotide
ggguucuucagcuggcac

SEQ ID NO: 8194 - RNA, 18 nt, Artificial Sequence
  Description of Artificial Sequence: Synthetic oligonucleotide
uaacagcccgcugauggg

SEQ ID NO: 8195 - RNA, 18 nt, Artificial Sequence
  Description of Artificial Sequence: Synthetic oligonucleotide
cuaacagcccgcugaugg

SEQ ID NO: 8196 - RNA, 18 nt, Artificial Sequence
  Description of Artificial Sequence: Synthetic oligonucleotide
auauucuaacagcccgcu

SEQ ID NO: 8197 - RNA, 18 nt, Artificial Sequence
  Description of Artificial Sequence: Synthetic oligonucleotide
ugggcauauucuaacagc

SEQ ID NO: 8198 - RNA, 18 nt, Artificial Sequence
  Description of Artificial Sequence: Synthetic oligonucleotide
cgaacugggcauauucua

SEQ ID NO: 8199 - RNA, 18 nt, Artificial Sequence
  Description of Artificial Sequence: Synthetic oligonucleotide
acuagcgaacugggcaua

SEQ ID NO: 8200 - RNA, 18 nt, Artificial Sequence
  Description of Artificial Sequence: Synthetic oligonucleotide
guuugacuagcgaacugg

SEQ ID NO: 8201 - RNA, 18 nt, Artificial Sequence
  Description of Artificial Sequence: Synthetic oligonucleotide
cacagguuugacuagcga

SEQ ID NO: 8202 - RNA, 18 nt, Artificial Sequence
  Description of Artificial Sequence: Synthetic oligonucleotide
gaacucacagguuugacu

SEQ ID NO: 8203 - RNA, 18 nt, Artificial Sequence
  Description of Artificial Sequence: Synthetic oligonucleotide
auguugaacucacagguu

SEQ ID NO: 8204 - RNA, 18 nt, Artificial Sequence
  Description of Artificial Sequence: Synthetic oligonucleotide
cuaucauguugaacucac

SEQ ID NO: 8205 - RNA, 18 nt, Artificial Sequence
  Description of Artificial Sequence: Synthetic oligonucleotide
cugcucuaucauguugaa

SEQ ID NO: 8206 - RNA, 18 nt, Artificial Sequence
  Description of Artificial Sequence: Synthetic oligonucleotide
ccacucugcucuaucaug

SEQ ID NO: 8207 - RNA, 18 nt, Artificial Sequence
  Description of Artificial Sequence: Synthetic oligonucleotide
gugguccacucugcucua

SEQ ID NO: 8208 - RNA, 18 nt, Artificial Sequence
  Description of Artificial Sequence: Synthetic oligonucleotide
acaguuccuggguggucu

SEQ ID NO: 8209 - RNA, 18 nt, Artificial Sequence
  Description of Artificial Sequence: Synthetic oligonucleotide
uagguacaguuccugggu

SEQ ID NO: 8210 - RNA, 18 nt, Artificial Sequence
  Description of Artificial Sequence: Synthetic oligonucleotide
aacccuagguacaguucc

SEQ ID NO: 8211 - RNA, 18 nt, Artificial Sequence
  Description of Artificial Sequence: Synthetic oligonucleotide
accccaacccuagguaca

SEQ ID NO: 8212 - RNA, 18 nt, Artificial Sequence
  Description of Artificial Sequence: Synthetic oligonucleotide
accugaccccaacccuag

SEQ ID NO: 8213 - RNA, 18 nt, Artificial Sequence
  Description of Artificial Sequence: Synthetic oligonucleotide
aaagcaccugaccccaac

SEQ ID NO: 8214 - RNA, 18 nt, Artificial Sequence
  Description of Artificial Sequence: Synthetic oligonucleotide
gagcaaaagcaccugacc

SEQ ID NO: 8215 - RNA, 18 nt, Artificial Sequence
  Description of Artificial Sequence: Synthetic oligonucleotide
gucaggagcaaaagcacc

SEQ ID NO: 8216 - RNA, 18 nt, Artificial Sequence
  Description of Artificial Sequence: Synthetic oligonucleotide
acugcgucaggagcaaaa

SEQ ID NO: 8217 - RNA, 18 nt, Artificial Sequence
  Description of Artificial Sequence: Synthetic oligonucleotide
ccaagacugcgucaggag

SEQ ID NO: 8218 - RNA, 18 nt, Artificial Sequence
  Description of Artificial Sequence: Synthetic oligonucleotide
aucagccaagacugcguc

SEQ ID NO: 8219 - RNA, 18 nt, Artificial Sequence
  Description of Artificial Sequence: Synthetic oligonucleotide
cacaaaucagccaagacu

SEQ ID NO: 8220 - RNA, 18 nt, Artificial Sequence
  Description of Artificial Sequence: Synthetic oligonucleotide
cugcucacaaaucagcca

SEQ ID NO: 8221 - RNA, 18 nt, Artificial Sequence
  Description of Artificial Sequence: Synthetic oligonucleotide
cagcacugcucacaaauc

SEQ ID NO: 8222 - RNA, 18 nt, Artificial Sequence
  Description of Artificial Sequence: Synthetic oligonucleotide
ccaaacagcacugcucac

SEQ ID NO: 8223 - RNA, 18 nt, Artificial Sequence
  Description of Artificial Sequence: Synthetic oligonucleotide
cgccaccaaacagcacug

SEQ ID NO: 8224 - RNA, 18 nt, Artificial Sequence
  Description of Artificial Sequence: Synthetic oligonucleotide
auaggcgccaccaaacag

SEQ ID NO: 8225 - RNA, 18 nt, Artificial Sequence
  Description of Artificial Sequence: Synthetic oligonucleotide
aaaagauaggcgccacca

SEQ ID NO: 8226 - RNA, 18 nt, Artificial Sequence
  Description of Artificial Sequence: Synthetic oligonucleotide
ggaggaaaagauaggcgc

SEQ ID NO: 8227 - RNA, 18 nt, Artificial Sequence
  Description of Artificial Sequence: Synthetic oligonucleotide
gggaaggaggaaaagaua

SEQ ID NO: 8228 - RNA, 18 nt, Artificial Sequence
  Description of Artificial Sequence: Synthetic oligonucleotide
cagaagggaaggaggaaa

SEQ ID NO: 8229 - RNA, 18 nt, Artificial Sequence
  Description of Artificial Sequence: Synthetic oligonucleotide
aaaggcagaagggaagga

SEQ ID NO: 8230 - RNA, 18 nt, Artificial Sequence
  Description of Artificial Sequence: Synthetic oligonucleotide
agcuaaaaggcagaaggg

SEQ ID NO: 8231 - RNA, 18 nt, Artificial Sequence
  Description of Artificial Sequence: Synthetic oligonucleotide
aauuuagcuaaaaggcag

SEQ ID NO: 8232 - RNA, 18 nt, Artificial Sequence
  Description of Artificial Sequence: Synthetic oligonucleotide
gggaauuuagcuaaaagg

SEQ ID NO: 8233 - RNA, 18 nt, Artificial Sequence
  Description of Artificial Sequence: Synthetic oligonucleotide
gaaagggccaaucaaggg

SEQ ID NO: 8234 - RNA, 18 nt, Artificial Sequence
  Description of Artificial Sequence: Synthetic oligonucleotide
cuggagaaagggccaauc

SEQ ID NO: 8235 - RNA, 18 nt, Artificial Sequence
  Description of Artificial Sequence: Synthetic oligonucleotide
aauaucuggagaaagggc

SEQ ID NO: 8236 - RNA, 18 nt, Artificial Sequence
  Description of Artificial Sequence: Synthetic oligonucleotide
ugcucaauaucuggagaa

SEQ ID NO: 8237 - RNA, 18 nt, Artificial Sequence
  Description of Artificial Sequence: Synthetic oligonucleotide
uucccugcucaauaucug

SEQ ID NO: 8238 - RNA, 18 nt, Artificial Sequence
  Description of Artificial Sequence: Synthetic oligonucleotide
cuauauucccugcucaau

SEQ ID NO: 8239 - RNA, 18 nt, Artificial Sequence
  Description of Artificial Sequence: Synthetic oligonucleotide
aaggucuauauucccugc

SEQ ID NO: 8240 - RNA, 18 nt, Artificial Sequence
  Description of Artificial Sequence: Synthetic oligonucleotide
gguccaaggucuauauuc

SEQ ID NO: 8241 - RNA, 18 nt, Artificial Sequence
  Description of Artificial Sequence: Synthetic oligonucleotide
uggcugguccaaggucua

SEQ ID NO: 8242 - RNA, 18 nt, Artificial Sequence
  Description of Artificial Sequence: Synthetic oligonucleotide
gauucuggcugguccaag

SEQ ID NO: 8243 - RNA, 18 nt, Artificial Sequence
  Description of Artificial Sequence: Synthetic oligonucleotide
gccaagauucuggcuggu

SEQ ID NO: 8244 - RNA, 18 nt, Artificial Sequence
  Description of Artificial Sequence: Synthetic oligonucleotide
guucagccaagauucugg

SEQ ID NO: 8245 - RNA, 18 nt, Artificial Sequence
  Description of Artificial Sequence: Synthetic oligonucleotide
cccuuguucagccaagau

SEQ ID NO: 8246 - RNA, 18 nt, Artificial Sequence
  Description of Artificial Sequence: Synthetic oligonucleotide
ccucccccuuguucagcc

SEQ ID NO: 8247 - RNA, 18 nt, Artificial Sequence
  Description of Artificial Sequence: Synthetic oligonucleotide
gucaaccucccccuuguu

SEQ ID NO: 8248 - RNA, 18 nt, Artificial Sequence
  Description of Artificial Sequence: Synthetic oligonucleotide
acagagucaaccuccccc

SEQ ID NO: 8249 - RNA, 18 nt, Artificial Sequence
  Description of Artificial Sequence: Synthetic oligonucleotide
agccaacagagucaaccu

SEQ ID NO: 8250 - RNA, 18 nt, Artificial Sequence
  Description of Artificial Sequence: Synthetic oligonucleotide
auuacagccaacagaguc

SEQ ID NO: 8251 - RNA, 18 nt, Artificial Sequence
  Description of Artificial Sequence: Synthetic oligonucleotide
gcuucauuacagccaaca

SEQ ID NO: 8252 - RNA, 18 nt, Artificial Sequence
  Description of Artificial Sequence: Synthetic oligonucleotide
aagaagcuucauuacagc

SEQ ID NO: 8253 - RNA, 18 nt, Artificial Sequence
  Description of Artificial Sequence: Synthetic oligonucleotide
uucuaaagaagcuucauu

SEQ ID NO: 8254 - RNA, 18 nt, Artificial Sequence
  Description of Artificial Sequence: Synthetic oligonucleotide
aucauuucuaaagaagcu

SEQ ID NO: 8255 - RNA, 18 nt, Artificial Sequence
  Description of Artificial Sequence: Synthetic oligonucleotide
aaccaaucauuucuaaag

SEQ ID NO: 8256 - RNA, 18 nt, Artificial Sequence
  Description of Artificial Sequence: Synthetic oligonucleotide
gccaaaaccaaucauuuc

SEQ ID NO: 8257 - RNA, 18 nt, Artificial Sequence
  Description of Artificial Sequence: Synthetic oligonucleotide
guacggccaaaaccaauc

SEQ ID NO: 8258 - RNA, 18 nt, Artificial Sequence
  Description of Artificial Sequence: Synthetic oligonucleotide
accgcguacggccaaaac

SEQ ID NO: 8259 - RNA, 18 nt, Artificial Sequence
  Description of Artificial Sequence: Synthetic oligonucleotide
gagccaccgcguacggcc

SEQ ID NO: 8260 - RNA, 18 nt, Artificial Sequence
  Description of Artificial Sequence: Synthetic oligonucleotide
ggcaugagccaccgcgua

SEQ ID NO: 8261 - RNA, 18 nt, Artificial Sequence
  Description of Artificial Sequence: Synthetic oligonucleotide
uuacaggcaugagccacc

SEQ ID NO: 8262 - RNA, 18 nt, Artificial Sequence
  Description of Artificial Sequence: Synthetic oligonucleotide
ugggauuacaggcaugag

SEQ ID NO: 8263 - RNA, 18 nt, Artificial Sequence
  Description of Artificial Sequence: Synthetic oligonucleotide
agugcugggauuacaggc

SEQ ID NO: 8264 - RNA, 18 nt, Artificial Sequence
  Description of Artificial Sequence: Synthetic oligonucleotide
caaaaagugcugggauua

SEQ ID NO: 8265 - RNA, 18 nt, Artificial Sequence
  Description of Artificial Sequence: Synthetic oligonucleotide
ggccucaaaaagugcugg

SEQ ID NO: 8266 - RNA, 18 nt, Artificial Sequence
  Description of Artificial Sequence: Synthetic oligonucleotide
gccucggccucaaaaagu

SEQ ID NO: 8267 - RNA, 18 nt, Artificial Sequence
  Description of Artificial Sequence: Synthetic oligonucleotide
ugccugccucggccucaa

SEQ ID NO: 8268 - RNA, 18 nt, Artificial Sequence
  Description of Artificial Sequence: Synthetic oligonucleotide
ugauaugccugccucggc

SEQ ID NO: 8269 - RNA, 18 nt, Artificial Sequence
  Description of Artificial Sequence: Synthetic oligonucleotide
ccucgugauaugccugcc

SEQ ID NO: 8270 - RNA, 18 nt, Artificial Sequence
  Description of Artificial Sequence: Synthetic oligonucleotide
ccugaccucgugauaugc

SEQ ID NO: 8271 - RNA, 18 nt, Artificial Sequence
  Description of Artificial Sequence: Synthetic oligonucleotide
aaacuccugaccucguga

SEQ ID NO: 8272 - RNA, 18 nt, Artificial Sequence
  Description of Artificial Sequence: Synthetic oligonucleotide
gucucaaacuccugaccu

SEQ ID NO: 8273 - RNA, 18 nt, Artificial Sequence
  Description of Artificial Sequence: Synthetic oligonucleotide
ggcuggucucaaacuccu

SEQ ID NO: 8274 - RNA, 18 nt, Artificial Sequence
  Description of Artificial Sequence: Synthetic oligonucleotide
ggccaggcuggucucaaa

SEQ ID NO: 8275 - RNA, 18 nt, Artificial Sequence
  Description of Artificial Sequence: Synthetic oligonucleotide
auguuggccaggcugguc

SEQ ID NO: 8276 - RNA, 18 nt, Artificial Sequence
  Description of Artificial Sequence: Synthetic oligonucleotide
ucaccauguuggccaggc

SEQ ID NO: 8277 - RNA, 18 nt, Artificial Sequence
  Description of Artificial Sequence: Synthetic oligonucleotide
ggguuucaccauguuggc

SEQ ID NO: 8278 - RNA, 18 nt, Artificial Sequence
  Description of Artificial Sequence: Synthetic oligonucleotide
agacaggguuucaccaug

SEQ ID NO: 8279 - RNA, 18 nt, Artificial Sequence
  Description of Artificial Sequence: Synthetic oligonucleotide
aguagagacaggguuuca

SEQ ID NO: 8280 - RNA, 18 nt, Artificial Sequence
  Description of Artificial Sequence: Synthetic oligonucleotide
uuuuuaguagagacaggg

SEQ ID NO: 8281 - RNA, 18 nt, Artificial Sequence
  Description of Artificial Sequence: Synthetic oligonucleotide
uuguauuuuuaguagaga

SEQ ID NO: 8282 - RNA, 18 nt, Artificial Sequence
  Description of Artificial Sequence: Synthetic oligonucleotide
aauuuuuguauuuuuagu

SEQ ID NO: 8283 - RNA, 18 nt, Artificial Sequence
  Description of Artificial Sequence: Synthetic oligonucleotide
cagcuaauuuuuguauuu

SEQ ID NO: 8284 - RNA, 18 nt, Artificial Sequence
  Description of Artificial Sequence: Synthetic oligonucleotide
acgcccagcuaauuuuug

SEQ ID NO: 8285 - RNA, 18 nt, Artificial Sequence
  Description of Artificial Sequence: Synthetic oligonucleotide
ccaccacgcccagcuaau

SEQ ID NO: 8286 - RNA, 18 nt, Artificial Sequence
  Description of Artificial Sequence: Synthetic oligonucleotide
gcacgccaccacgcccag

SEQ ID NO: 8287 - RNA, 18 nt, Artificial Sequence
  Description of Artificial Sequence: Synthetic oligonucleotide
caggugcacgccaccacg

SEQ ID NO: 8288 - RNA, 18 nt, Artificial Sequence
  Description of Artificial Sequence: Synthetic oligonucleotide
gacuacaggugcacgcca

SEQ ID NO: 8289 - RNA, 18 nt, Artificial Sequence
  Description of Artificial Sequence: Synthetic oligonucleotide
gcugggacuacaggugca

SEQ ID NO: 8290 - RNA, 18 nt, Artificial Sequence
  Description of Artificial Sequence: Synthetic oligonucleotide
gaguagcugggacuacag

SEQ ID NO: 8291 - RNA, 18 nt, Artificial Sequence
  Description of Artificial Sequence: Synthetic oligonucleotide
uuccugaguagcugggac

SEQ ID NO: 8292 - RNA, 18 nt, Artificial Sequence
  Description of Artificial Sequence: Synthetic oligonucleotide
ucagcuuccugaguagcu

SEQ ID NO: 8293 - RNA, 18 nt, Artificial Sequence
  Description of Artificial Sequence: Synthetic oligonucleotide
cugucucagcuuccugag

SEQ ID NO: 8294 - RNA, 18 nt, Artificial Sequence
  Description of Artificial Sequence: Synthetic oligonucleotide
uucuccugucucagcuuc

SEQ ID NO: 8295 - RNA, 18 nt, Artificial Sequence
  Description of Artificial Sequence: Synthetic oligonucleotide
agugauucuccugucuca

SEQ ID NO: 8296 - RNA, 18 nt, Artificial Sequence
  Description of Artificial Sequence: Synthetic oligonucleotide
guucaagugauucuccug

SEQ ID NO: 8297 - RNA, 18 nt, Artificial Sequence
  Description of Artificial Sequence: Synthetic oligonucleotide
ccuggguucaagugauuc

SEQ ID NO: 8298 - RNA, 18 nt, Artificial Sequence
  Description of Artificial Sequence: Synthetic oligonucleotide
ugccuccuggguucaagu

SEQ ID NO: 8299 - RNA, 18 nt, Artificial Sequence
  Description of Artificial Sequence: Synthetic oligonucleotide
accucugccuccuggguu

SEQ ID NO: 8300 - RNA, 18 nt, Artificial Sequence
  Description of Artificial Sequence: Synthetic oligonucleotide
cugcaaccucugccuccu

SEQ ID NO: 8301 - RNA, 18 nt, Artificial Sequence
  Description of Artificial Sequence: Synthetic oligonucleotide
guucacugcaaccucugc

SEQ ID NO: 8302 - RNA, 18 nt, Artificial Sequence
  Description of Artificial Sequence: Synthetic oligonucleotide
ucucaguucacugcaacc

SEQ ID NO: 8303 - RNA, 18 nt, Artificial Sequence
  Description of Artificial Sequence: Synthetic oligonucleotide
cgcaaucucaguucacug

SEQ ID NO: 8304 - RNA, 18 nt, Artificial Sequence
  Description of Artificial Sequence: Synthetic oligonucleotide
aguggcgcaaucucaguu

SEQ ID NO: 8305 - RNA, 18 nt, Artificial Sequence
  Description of Artificial Sequence: Synthetic oligonucleotide
agugcaguggcgcaaucu

SEQ ID NO: 8306 - RNA, 18 nt, Artificial Sequence
  Description of Artificial Sequence: Synthetic oligonucleotide
uuugucccuagaccuaua

SEQ ID NO: 8307 - RNA, 18 nt, Artificial Sequence
  Description of Artificial Sequence: Synthetic oligonucleotide
cugcuuuugucccuagac

SEQ ID NO: 8308 - RNA, 18 nt, Artificial Sequence
  Description of Artificial Sequence: Synthetic oligonucleotide
guggccugcuuuuguccc

SEQ ID NO: 8309 - RNA, 18 nt, Artificial Sequence
  Description of Artificial Sequence: Synthetic oligonucleotide
uaucaguggccugcuuuu

SEQ ID NO: 8310 - RNA, 18 nt, Artificial Sequence
  Description of Artificial Sequence: Synthetic oligonucleotide
ccacuuaucaguggccug

SEQ ID NO: 8311 - RNA, 18 nt, Artificial Sequence
  Description of Artificial Sequence: Synthetic oligonucleotide
aucugccacuuaucagug

SEQ ID NO: 8312 - RNA, 18 nt, Artificial Sequence
  Description of Artificial Sequence: Synthetic oligonucleotide
caggcaucugccacuuau

SEQ ID NO: 8313 - RNA, 18 nt, Artificial Sequence
  Description of Artificial Sequence: Synthetic oligonucleotide
gggaucaggcaucugcca

SEQ ID NO: 8314 - RNA, 18 nt, Artificial Sequence
  Description of Artificial Sequence: Synthetic oligonucleotide
acuccccacuaccuaggg

SEQ ID NO: 8315 - RNA, 18 nt, Artificial Sequence
  Description of Artificial Sequence: Synthetic oligonucleotide
ucacacuccccacuaccu

SEQ ID NO: 8316 - RNA, 18 nt, Artificial Sequence
  Description of Artificial Sequence: Synthetic oligonucleotide
cagucucacacuccccac

SEQ ID NO: 8317 - RNA, 18 nt, Artificial Sequence
  Description of Artificial Sequence: Synthetic oligonucleotide
uaacccagucucacacuc

SEQ ID NO: 8318 - RNA, 18 nt, Artificial Sequence
  Description of Artificial Sequence: Synthetic oligonucleotide
ucuuauaacccagucuca

SEQ ID NO: 8319 - RNA, 18 nt, Artificial Sequence
  Description of Artificial Sequence: Synthetic oligonucleotide
aggcuucuuauaacccag

SEQ ID NO: 8320 - RNA, 18 nt, Artificial Sequence
  Description of Artificial Sequence: Synthetic oligonucleotide
agugaaggcuucuuauaa

SEQ ID NO: 8321 - RNA, 18 nt, Artificial Sequence
  Description of Artificial Sequence: Synthetic oligonucleotide
aagauagugaaggcuucu

SEQ ID NO: 8322 - RNA, 18 nt, Artificial Sequence
  Description of Artificial Sequence: Synthetic oligonucleotide
ccuaaaagauagugaagg

SEQ ID NO: 8323 - RNA, 18 nt, Artificial Sequence
  Description of Artificial Sequence: Synthetic oligonucleotide
aggguccuaaaagauagu

SEQ ID NO: 8324 - RNA, 18 nt, Artificial Sequence
  Description of Artificial Sequence: Synthetic oligonucleotide
aagggaggguccuaaaag

SEQ ID NO: 8325 - RNA, 18 nt, Artificial Sequence
  Description of Artificial Sequence: Synthetic oligonucleotide
uccucaagggaggguccu

SEQ ID NO: 8326 - RNA, 18 nt, Artificial Sequence
  Description of Artificial Sequence: Synthetic oligonucleotide
uggccuccucaagggagg

SEQ ID NO: 8327 - RNA, 18 nt, Artificial Sequence
  Description of Artificial Sequence: Synthetic oligonucleotide
uagacuggccuccucaag

SEQ ID NO: 8328 - RNA, 18 nt, Artificial Sequence
  Description of Artificial Sequence: Synthetic oligonucleotide
ugugguagacuggccucc

SEQ ID NO: 8329 - RNA, 18 nt, Artificial Sequence
  Description of Artificial Sequence: Synthetic oligonucleotide
gcaauugugguagacugg

SEQ ID NO: 8330 - RNA, 18 nt, Artificial Sequence
  Description of Artificial Sequence: Synthetic oligonucleotide
cuaaagcaauugugguag

SEQ ID NO: 8331 - RNA, 18 nt, Artificial Sequence
  Description of Artificial Sequence: Synthetic oligonucleotide
ucauucuaaagcaauugu

SEQ ID NO: 8332 - RNA, 18 nt, Artificial Sequence
  Description of Artificial Sequence: Synthetic oligonucleotide
gaccuucauucuaaagca

SEQ ID NO: 8333 - RNA, 18 nt, Artificial Sequence
  Description of Artificial Sequence: Synthetic oligonucleotide
caaaagaccuucauucua

SEQ ID NO: 8334 - RNA, 18 nt, Artificial Sequence
  Description of Artificial Sequence: Synthetic oligonucleotide
gcaaccaaaagaccuuca

SEQ ID NO: 8335 - RNA, 18 nt, Artificial Sequence
  Description of Artificial Sequence: Synthetic oligonucleotide
ugugagcaaccaaaagac

SEQ ID NO: 8336 - RNA, 18 nt, Artificial Sequence
  Description of Artificial Sequence: Synthetic oligonucleotide
agucuugugagcaaccaa

SEQ ID NO: 8337 - RNA, 18 nt, Artificial Sequence
  Description of Artificial Sequence: Synthetic oligonucleotide
auuauagucuugugagca

SEQ ID NO: 8338 - RNA, 18 nt, Artificial Sequence
  Description of Artificial Sequence: Synthetic oligonucleotide
uuaccauuauagucuugu

SEQ ID NO: 8339 - RNA, 18 nt, Artificial Sequence
  Description of Artificial Sequence: Synthetic oligonucleotide
aaaaauuaccauuauagu

SEQ ID NO: 8340 - RNA, 18 nt, Artificial Sequence
  Description of Artificial Sequence: Synthetic oligonucleotide
gagccaaaaauuaccauu

SEQ ID NO: 8341 - RNA, 18 nt, Artificial Sequence
  Description of Artificial Sequence: Synthetic oligonucleotide
augaugagccaaaaauua

SEQ ID NO: 8342 - RNA, 18 nt, Artificial Sequence
  Description of Artificial Sequence: Synthetic oligonucleotide
caaaaaugaugagccaaa

SEQ ID NO: 8343 - RNA, 18 nt, Artificial Sequence
  Description of Artificial Sequence: Synthetic oligonucleotide
acacacaaaaaugaugag

SEQ ID NO: 8344 - RNA, 18 nt, Artificial Sequence
  Description of Artificial Sequence: Synthetic oligonucleotide
cccacacacacaaaaaug

SEQ ID NO: 8345 - RNA, 18 nt, Artificial Sequence
  Description of Artificial Sequence: Synthetic oligonucleotide
uaaaacccacacacacaa

SEQ ID NO: 8346 - RNA, 18 nt, Artificial Sequence
  Description of Artificial Sequence: Synthetic oligonucleotide
uaagauaaaacccacaca

SEQ ID NO: 8347 - RNA, 18 nt, Artificial Sequence
  Description of Artificial Sequence: Synthetic oligonucleotide
ugaauuaagauaaaaccc

SEQ ID NO: 8348 - RNA, 18 nt, Artificial Sequence
  Description of Artificial Sequence: Synthetic oligonucleotide
aacaaugaauuaagauaa

SEQ ID NO: 8349 - RNA, 18 nt, Artificial Sequence
  Description of Artificial Sequence: Synthetic oligonucleotide
ucuuuaacaaugaauuaa

SEQ ID NO: 8350 - RNA, 18 nt, Artificial Sequence
  Description of Artificial Sequence: Synthetic oligonucleotide
cuaucucuuuaacaauga

SEQ ID NO: 8351 - RNA, 18 nt, Artificial Sequence
  Description of Artificial Sequence: Synthetic oligonucleotide
acccacuaucucuuuaac

SEQ ID NO: 8352 - RNA, 18 nt, Artificial Sequence
  Description of Artificial Sequence: Synthetic oligonucleotide
gggaaacccacuaucucu

SEQ ID NO: 8353 - RNA, 18 nt, Artificial Sequence
  Description of Artificial Sequence: Synthetic oligonucleotide
uaggaaacuagcucaggg

SEQ ID NO: 8354 - RNA, 18 nt, Artificial Sequence
  Description of Artificial Sequence: Synthetic oligonucleotide
ugauaggaaacuagcuca

SEQ ID NO: 8355 - RNA, 18 nt, Artificial Sequence
  Description of Artificial Sequence: Synthetic oligonucleotide
acagaugauaggaaacua

SEQ ID NO: 8356 - RNA, 18 nt, Artificial Sequence
  Description of Artificial Sequence: Synthetic oligonucleotide
uaggcacagaugauagga

SEQ ID NO: 8357 - RNA, 18 nt, Artificial Sequence
  Description of Artificial Sequence: Synthetic oligonucleotide
aaacauaggcacagauga

SEQ ID NO: 8358 - RNA, 18 nt, Artificial Sequence
  Description of Artificial Sequence: Synthetic oligonucleotide
gaagcaaacauaggcaca

SEQ ID NO: 8359 - RNA, 18 nt, Artificial Sequence
  Description of Artificial Sequence: Synthetic oligonucleotide
ucagugaagcaaacauag

SEQ ID NO: 8360 - RNA, 18 nt, Artificial Sequence
  Description of Artificial Sequence: Synthetic oligonucleotide
auagcucagugaagcaaa

SEQ ID NO: 8361 - RNA, 18 nt, Artificial Sequence
  Description of Artificial Sequence: Synthetic oligonucleotide
uccccauagcucagugaa

SEQ ID NO: 8362 - RNA, 18 nt, Artificial Sequence
  Description of Artificial Sequence: Synthetic oligonucleotide
cucuuuccccauagcuca

SEQ ID NO: 8363 - RNA, 18 nt, Artificial Sequence
  Description of Artificial Sequence: Synthetic oligonucleotide
agugacucuuuccccaua

SEQ ID NO: 8364 - RNA, 18 nt, Artificial Sequence
  Description of Artificial Sequence: Synthetic oligonucleotide
cagccagugacucuuucc

SEQ ID NO: 8365 - RNA, 18 nt, Artificial Sequence
  Description of Artificial Sequence: Synthetic oligonucleotide
caaagcagccagugacuc

SEQ ID NO: 8366 - RNA, 18 nt, Artificial Sequence
  Description of Artificial Sequence: Synthetic oligonucleotide
guaaacaaagcagccagu

SEQ ID NO: 8367 - RNA, 18 nt, Artificial Sequence
  Description of Artificial Sequence: Synthetic oligonucleotide
uuuuuguaaacaaagcag

SEQ ID NO: 8368 - RNA, 18 nt, Artificial Sequence
  Description of Artificial Sequence: Synthetic oligonucleotide
cuuucuuuuuguaaacaa

SEQ ID NO: 8369 - RNA, 18 nt, Artificial Sequence
  Description of Artificial Sequence: Synthetic oligonucleotide
cuguccuuucuuuuugua

SEQ ID NO: 8370 - RNA, 18 nt, Artificial Sequence
  Description of Artificial Sequence: Synthetic oligonucleotide
ucagccuguccuuucuuu

SEQ ID NO: 8371 - RNA, 18 nt, Artificial Sequence
  Description of Artificial Sequence: Synthetic oligonucleotide
aaggcucagccuguccuu

SEQ ID NO: 8372 - RNA, 18 nt, Artificial Sequence
  Description of Artificial Sequence: Synthetic oligonucleotide
uccuuaaggcucagccug

SEQ ID NO: 8373 - RNA, 18 nt, Artificial Sequence
  Description of Artificial Sequence: Synthetic oligonucleotide
ccuacuccuuaaggcuca

SEQ ID NO: 8374 - RNA, 18 nt, Artificial Sequence
  Description of Artificial Sequence: Synthetic oligonucleotide
uccuuccuacuccuuaag

SEQ ID NO: 8375 - RNA, 18 nt, Artificial Sequence
  Description of Artificial Sequence: Synthetic oligonucleotide
ggaacuccuuccuacucc

SEQ ID NO: 8376 - RNA, 18 nt, Artificial Sequence
  Description of Artificial Sequence: Synthetic oligonucleotide
gccaaggaacuccuuccu

SEQ ID NO: 8377 - RNA, 18 nt, Artificial Sequence
  Description of Artificial Sequence: Synthetic oligonucleotide
gguaggccaaggaacucc

SEQ ID NO: 8378 - RNA, 18 nt, Artificial Sequence
  Description of Artificial Sequence: Synthetic oligonucleotide
ugaaggguaggccaagga

SEQ ID NO: 8379 - RNA, 18 nt, Artificial Sequence
  Description of Artificial Sequence: Synthetic oligonucleotide
ggagaugaaggguaggcc

SEQ ID NO: 8380 - RNA, 18 nt, Artificial Sequence
  Description of Artificial Sequence: Synthetic oligonucleotide
cuuguggagaugaagggu

SEQ ID NO: 8381 - RNA, 18 nt, Artificial Sequence
  Description of Artificial Sequence: Synthetic oligonucleotide
uuucacuuguggagauga

SEQ ID NO: 8382 - RNA, 18 nt, Artificial Sequence
  Description of Artificial Sequence: Synthetic oligonucleotide
gggcuuuucacuugugga

SEQ ID NO: 8383 - RNA, 18 nt, Artificial Sequence
  Description of Artificial Sequence: Synthetic oligonucleotide
uuucugcuacgcuaaggg

SEQ ID NO: 8384 - RNA, 18 nt, Artificial Sequence
  Description of Artificial Sequence: Synthetic oligonucleotide
auuuucugcuacgcuaag

SEQ ID NO: 8385 - RNA, 18 nt, Artificial Sequence
  Description of Artificial Sequence: Synthetic oligonucleotide
cuggaauuuucugcuacg

SEQ ID NO: 8386 - RNA, 18 nt, Artificial Sequence
  Description of Artificial Sequence: Synthetic oligonucleotide
ucaaccuggaauuuucug

SEQ ID NO: 8387 - RNA, 18 nt, Artificial Sequence
  Description of Artificial Sequence: Synthetic oligonucleotide
gaccuucaaccuggaauu

SEQ ID NO: 8388 - RNA, 18 nt, Artificial Sequence
  Description of Artificial Sequence: Synthetic oligonucleotide
aaagagaccuucaaccug

SEQ ID NO: 8389 - RNA, 18 nt, Artificial Sequence
  Description of Artificial Sequence: Synthetic oligonucleotide
ucuccaaagagaccuuca

SEQ ID NO: 8390 - RNA, 18 nt, Artificial Sequence
  Description of Artificial Sequence: Synthetic oligonucleotide
ugccuucuccaaagagac

SEQ ID NO: 8391 - RNA, 18 nt, Artificial Sequence
  Description of Artificial Sequence: Synthetic oligonucleotide
ccuucugccuucuccaaa

SEQ ID NO: 8392 - RNA, 18 nt, Artificial Sequence
  Description of Artificial Sequence: Synthetic oligonucleotide
ucacuccuucugccuucu

SEQ ID NO: 8393 - RNA, 18 nt, Artificial Sequence
  Description of Artificial Sequence: Synthetic oligonucleotide
cuaggucacuccuucugc

SEQ ID NO: 8394 - RNA, 18 nt, Artificial Sequence
  Description of Artificial Sequence: Synthetic oligonucleotide
ggagucuaggucacuccu

SEQ ID NO: 8395 - RNA, 18 nt, Artificial Sequence
  Description of Artificial Sequence: Synthetic oligonucleotide
gaacaggagucuagguca

SEQ ID NO: 8396 - RNA, 18 nt, Artificial Sequence
  Description of Artificial Sequence: Synthetic oligonucleotide
ugugugaacaggagucua

SEQ ID NO: 8397 - RNA, 18 nt, Artificial Sequence
  Description of Artificial Sequence: Synthetic oligonucleotide
uuagaugugugaacagga

SEQ ID NO: 8398 - RNA, 18 nt, Artificial Sequence
  Description of Artificial Sequence: Synthetic oligonucleotide
gacaaccuggaauuuaaa

SEQ ID NO: 8399 - RNA, 18 nt, Artificial Sequence
  Description of Artificial Sequence: Synthetic oligonucleotide
uugaugacaaccuggaau

SEQ ID NO: 8400 - RNA, 18 nt, Artificial Sequence
  Description of Artificial Sequence: Synthetic oligonucleotide
ggccauugaugacaaccu

SEQ ID NO: 8401 - RNA, 18 nt, Artificial Sequence
  Description of Artificial Sequence: Synthetic oligonucleotide
cucucggccauugaugac

SEQ ID NO: 8402 - RNA, 18 nt, Artificial Sequence
  Description of Artificial Sequence: Synthetic oligonucleotide
ggaaacucucggccauug

SEQ ID NO: 8403 - RNA, 18 nt, Artificial Sequence
  Description of Artificial Sequence: Synthetic oligonucleotide
gggaaacucucggccauu

SEQ ID NO: 8404 - RNA, 18 nt, Artificial Sequence
  Description of Artificial Sequence: Synthetic oligonucleotide
cuuccagcuucagcuggg

SEQ ID NO: 8405 - RNA, 18 nt, Artificial Sequence
  Description of Artificial Sequence: Synthetic oligonucleotide
ucuugcuuccagcuucag

SEQ ID NO: 8406 - RNA, 18 nt, Artificial Sequence
  Description of Artificial Sequence: Synthetic oligonucleotide
cacuuucuugcuuccagc

SEQ ID NO: 8407 - RNA, 18 nt, Artificial Sequence
  Description of Artificial Sequence: Synthetic oligonucleotide
uuggccacuuucuugcuu

SEQ ID NO: 8408 - RNA, 18 nt, Artificial Sequence
  Description of Artificial Sequence: Synthetic oligonucleotide
ccugcuuggccacuuucu

SEQ ID NO: 8409 - RNA, 18 nt, Artificial Sequence
  Description of Artificial Sequence: Synthetic oligonucleotide
ugcauccugcuuggccac

SEQ ID NO: 8410 - RNA, 18 nt, Artificial Sequence
  Description of Artificial Sequence: Synthetic oligonucleotide
auagcugcauccugcuug

SEQ ID NO: 8411 - RNA, 18 nt, Artificial Sequence
  Description of Artificial Sequence: Synthetic oligonucleotide
cuuucauagcugcauccu

SEQ ID NO: 8412 - RNA, 18 nt, Artificial Sequence
  Description of Artificial Sequence: Synthetic oligonucleotide
cauggcuuucauagcugc

SEQ ID NO: 8413 - RNA, 18 nt, Artificial Sequence
  Description of Artificial Sequence: Synthetic oligonucleotide
auugucauggcuuucaua

SEQ ID NO: 8414 - RNA, 18 nt, Artificial Sequence
  Description of Artificial Sequence: Synthetic oligonucleotide
gcagaauugucauggcuu

SEQ ID NO: 8415 - RNA, 18 nt, Artificial Sequence
  Description of Artificial Sequence: Synthetic oligonucleotide
cucuagcagaauugucau

SEQ ID NO: 8416 - RNA, 18 nt, Artificial Sequence
  Description of Artificial Sequence: Synthetic oligonucleotide
gcuuccucuagcagaauu

SEQ ID NO: 8417 - RNA, 18 nt, Artificial Sequence
  Description of Artificial Sequence: Synthetic oligonucleotide
cuuuggcuuccucuagca

SEQ ID NO: 8418 - RNA, 18 nt, Artificial Sequence
  Description of Artificial Sequence: Synthetic oligonucleotide
cuuggcuuuggcuuccuc

SEQ ID NO: 8419 - RNA, 18 nt, Artificial Sequence
  Description of Artificial Sequence: Synthetic oligonucleotide
cuguccuuggcuuuggcu

SEQ ID NO: 8420 - RNA, 18 nt, Artificial Sequence
  Description of Artificial Sequence: Synthetic oligonucleotide
uuccacuguccuuggcuu

SEQ ID NO: 8421 - RNA, 18 nt, Artificial Sequence
  Description of Artificial Sequence: Synthetic oligonucleotide
ugauuuuccacuguccuu

SEQ ID NO: 8422 - RNA, 18 nt, Artificial Sequence
  Description of Artificial Sequence: Synthetic oligonucleotide
ucuucugauuuuccacug

SEQ ID NO: 8423 - RNA, 18 nt, Artificial Sequence
  Description of Artificial Sequence: Synthetic oligonucleotide
augauucuucugauuuuc

SEQ ID NO: 8424 - RNA, 18 nt, Artificial Sequence
  Description of Artificial Sequence: Synthetic oligonucleotide
gugggaugauucuucuga

SEQ ID NO: 8425 - RNA, 18 nt, Artificial Sequence
  Description of Artificial Sequence: Synthetic oligonucleotide
gaauagugggaugauucu

SEQ ID NO: 8426 - RNA, 18 nt, Artificial Sequence
  Description of Artificial Sequence: Synthetic oligonucleotide
cuguggaauagugggaug

SEQ ID NO: 8427 - RNA, 18 nt, Artificial Sequence
  Description of Artificial Sequence: Synthetic oligonucleotide
uuucucuguggaauagug

SEQ ID NO: 8428 - RNA, 18 nt, Artificial Sequence
  Description of Artificial Sequence: Synthetic oligonucleotide
gauucuuucucuguggaa

SEQ ID NO: 8429 - RNA, 18 nt, Artificial Sequence
  Description of Artificial Sequence: Synthetic oligonucleotide
ucucugauucuuucucug

SEQ ID NO: 8430 - RNA, 18 nt, Artificial Sequence
  Description of Artificial Sequence: Synthetic oligonucleotide
guauccgcugagggaaua

SEQ ID NO: 8431 - RNA, 18 nt, Artificial Sequence
  Description of Artificial Sequence: Synthetic oligonucleotide
guguaguauccgcugagg

SEQ ID NO: 8432 - RNA, 18 nt, Artificial Sequence
  Description of Artificial Sequence: Synthetic oligonucleotide
gauggguguaguauccgc

SEQ ID NO: 8433 - RNA, 18 nt, Artificial Sequence
  Description of Artificial Sequence: Synthetic oligonucleotide
aaauggauggguguagua

SEQ ID NO: 8434 - RNA, 18 nt, Artificial Sequence
  Description of Artificial Sequence: Synthetic oligonucleotide
ccuugaaauggaugggug

SEQ ID NO: 8435 - RNA, 18 nt, Artificial Sequence
  Description of Artificial Sequence: Synthetic oligonucleotide
cauagccuugaaauggau

SEQ ID NO: 8436 - RNA, 18 nt, Artificial Sequence
  Description of Artificial Sequence: Synthetic oligonucleotide
gugcucauagccuugaaa

SEQ ID NO: 8437 - RNA, 18 nt, Artificial Sequence
  Description of Artificial Sequence: Synthetic oligonucleotide
ugucugugcucauagccu

SEQ ID NO: 8438 - RNA, 18 nt, Artificial Sequence
  Description of Artificial Sequence: Synthetic oligonucleotide
ugagcugucugugcucau

SEQ ID NO: 8439 - RNA, 18 nt, Artificial Sequence
  Description of Artificial Sequence: Synthetic oligonucleotide
guaccugagcugucugug

SEQ ID NO: 8440 - RNA, 18 nt, Artificial Sequence
  Description of Artificial Sequence: Synthetic oligonucleotide
ugcugguaccugagcugu

SEQ ID NO: 8441 - RNA, 18 nt, Artificial Sequence
  Description of Artificial Sequence: Synthetic oligonucleotide
caggcugcugguaccuga

SEQ ID NO: 8442 - RNA, 18 nt, Artificial Sequence
  Description of Artificial Sequence: Synthetic oligonucleotide
uggcccaggcugcuggua

SEQ ID NO: 8443 - RNA, 18 nt, Artificial Sequence
  Description of Artificial Sequence: Synthetic oligonucleotide
gauccuggcccaggcugc

SEQ ID NO: 8444 - RNA, 18 nt, Artificial Sequence
  Description of Artificial Sequence: Synthetic oligonucleotide
gggaagauccuggcccag

SEQ ID NO: 8445 - RNA, 18 nt, Artificial Sequence
  Description of Artificial Sequence: Synthetic oligonucleotide
aagcaggaaacuacuggg

SEQ ID NO: 8446 - RNA, 18 nt, Artificial Sequence
  Description of Artificial Sequence: Synthetic oligonucleotide
cuuaagcaggaaacuacu

SEQ ID NO: 8447 - RNA, 18 nt, Artificial Sequence
  Description of Artificial Sequence: Synthetic oligonucleotide
auuugcuuaagcaggaaa

SEQ ID NO: 8448 - RNA, 18 nt, Artificial Sequence
  Description of Artificial Sequence: Synthetic oligonucleotide
auucuauuugcuuaagca

SEQ ID NO: 8449 - RNA, 18 nt, Artificial Sequence
  Description of Artificial Sequence: Synthetic oligonucleotide
gagaaauucuauuugcuu

SEQ ID NO: 8450 - RNA, 18 nt, Artificial Sequence
  Description of Artificial Sequence: Synthetic oligonucleotide
cccuugagaaauucuauu

SEQ ID NO: 8451 - RNA, 18 nt, Artificial Sequence
  Description of Artificial Sequence: Synthetic oligonucleotide
gcugccccuugagaaauu

SEQ ID NO: 8452 - RNA, 18 nt, Artificial Sequence
  Description of Artificial Sequence: Synthetic oligonucleotide
ugggagcugccccuugag

SEQ ID NO: 8453 - RNA, 18 nt, Artificial Sequence
  Description of Artificial Sequence: Synthetic oligonucleotide
gcuucugggagcugcccc

SEQ ID NO: 8454 - RNA, 18 nt, Artificial Sequence
  Description of Artificial Sequence: Synthetic oligonucleotide
ccggugcuucugggagcu

SEQ ID NO: 8455 - RNA, 18 nt, Artificial Sequence
  Description of Artificial Sequence: Synthetic oligonucleotide
aaucaccggugcuucugg

SEQ ID NO: 8456 - RNA, 18 nt, Artificial Sequence
  Description of Artificial Sequence: Synthetic oligonucleotide
uuuccaaucaccggugcu

SEQ ID NO: 8457 - RNA, 18 nt, Artificial Sequence
  Description of Artificial Sequence: Synthetic oligonucleotide
ucugcuuuccaaucaccg

SEQ ID NO: 8458 - RNA, 18 nt, Artificial Sequence
  Description of Artificial Sequence: Synthetic oligonucleotide
cggugucugcuuuccaau

SEQ ID NO: 8459 - RNA, 18 nt, Artificial Sequence
  Description of Artificial Sequence: Synthetic oligonucleotide
agugacggugucugcuuu

SEQ ID NO: 8460 - RNA, 18 nt, Artificial Sequence
  Description of Artificial Sequence: Synthetic oligonucleotide
guggcagugacggugucu

SEQ ID NO: 8461 - RNA, 18 nt, Artificial Sequence
  Description of Artificial Sequence: Synthetic oligonucleotide
ggaagguggcagugacgg

SEQ ID NO: 8462 - RNA, 18 nt, Artificial Sequence
  Description of Artificial Sequence: Synthetic oligonucleotide
gggagggaagguggcagu

SEQ ID NO: 8463 - RNA, 18 nt, Artificial Sequence
  Description of Artificial Sequence: Synthetic oligonucleotide
guccugggagggaaggug

SEQ ID NO: 8464 - RNA, 18 nt, Artificial Sequence
  Description of Artificial Sequence: Synthetic oligonucleotide
ccggaguccugggaggga

SEQ ID NO: 8465 - RNA, 18 nt, Artificial Sequence
  Description of Artificial Sequence: Synthetic oligonucleotide
cuuggccggaguccuggg

SEQ ID NO: 8466 - RNA, 18 nt, Artificial Sequence
  Description of Artificial Sequence: Synthetic oligonucleotide
gaaaccuuggccggaguc

SEQ ID NO: 8467 - RNA, 18 nt, Artificial Sequence
  Description of Artificial Sequence: Synthetic oligonucleotide
uacuggaaaccuuggccg

SEQ ID NO: 8468 - RNA, 18 nt, Artificial Sequence
  Description of Artificial Sequence: Synthetic oligonucleotide
aguaguacuggaaaccuu

SEQ ID NO: 8469 - RNA, 18 nt, Artificial Sequence
  Description of Artificial Sequence: Synthetic oligonucleotide
aggcaaguaguacuggaa

SEQ ID NO: 8470 - RNA, 18 nt, Artificial Sequence
  Description of Artificial Sequence: Synthetic oligonucleotide
acuggaggcaaguaguac

SEQ ID NO: 8471 - RNA, 18 nt, Artificial Sequence
  Description of Artificial Sequence: Synthetic oligonucleotide
cugguacuggaggcaagu

SEQ ID NO: 8472 - RNA, 18 nt, Artificial Sequence
  Description of Artificial Sequence: Synthetic oligonucleotide
ugccucugguacuggagg

SEQ ID NO: 8473 - RNA, 18 nt, Artificial Sequence
  Description of Artificial Sequence: Synthetic oligonucleotide
uugccugccucugguacu

SEQ ID NO: 8474 - RNA, 18 nt, Artificial Sequence
  Description of Artificial Sequence: Synthetic oligonucleotide
uccacuugccugccucug

SEQ ID NO: 8475 - RNA, 18 nt, Artificial Sequence
  Description of Artificial Sequence: Synthetic oligonucleotide
ugauguccacuugccugc

SEQ ID NO: 8476 - RNA, 18 nt, Artificial Sequence
  Description of Artificial Sequence: Synthetic oligonucleotide
accccugauguccacuug

SEQ ID NO: 8477 - RNA, 18 nt, Artificial Sequence
  Description of Artificial Sequence: Synthetic oligonucleotide
gggacaccccugaugucc

SEQ ID NO: 8478 - RNA, 18 nt, Artificial Sequence
  Description of Artificial Sequence: Synthetic oligonucleotide
gagaugcacgccccuggg

SEQ ID NO: 8479 - RNA, 18 nt, Artificial Sequence
  Description of Artificial Sequence: Synthetic oligonucleotide
uucugagaugcacgcccc

SEQ ID NO: 8480 - RNA, 18 nt, Artificial Sequence
  Description of Artificial Sequence: Synthetic oligonucleotide
cugacuucugagaugcac

SEQ ID NO: 8481 - RNA, 18 nt, Artificial Sequence
  Description of Artificial Sequence: Synthetic oligonucleotide
agccccugacuucugaga

SEQ ID NO: 8482 - RNA, 18 nt, Artificial Sequence
  Description of Artificial Sequence: Synthetic oligonucleotide
ucuggagccccugacuuc

SEQ ID NO: 8483 - RNA, 18 nt, Artificial Sequence
  Description of Artificial Sequence: Synthetic oligonucleotide
cccucucuggagccccug

SEQ ID NO: 8484 - RNA, 18 nt, Artificial Sequence
  Description of Artificial Sequence: Synthetic oligonucleotide
uggaacccucucuggagc

SEQ ID NO: 8485 - RNA, 18 nt, Artificial Sequence
  Description of Artificial Sequence: Synthetic oligonucleotide
gaugcuggaacccucucu

SEQ ID NO: 8486 - RNA, 18 nt, Artificial Sequence
  Description of Artificial Sequence: Synthetic oligonucleotide
ugaaggaugcuggaaccc

SEQ ID NO: 8487 - RNA, 18 nt, Artificial Sequence
  Description of Artificial Sequence: Synthetic oligonucleotide
cguggugaaggaugcugg

SEQ ID NO: 8488 - RNA, 18 nt, Artificial Sequence
  Description of Artificial Sequence: Synthetic oligonucleotide
ugccacguggugaaggau

SEQ ID NO: 8489 - RNA, 18 nt, Artificial Sequence
  Description of Artificial Sequence: Synthetic oligonucleotide
acuccugccacgugguga

SEQ ID NO: 8490 - RNA, 18 nt, Artificial Sequence
  Description of Artificial Sequence: Synthetic oligonucleotide
ggcagacuccugccacgu

SEQ ID NO: 8491 - RNA, 18 nt, Artificial Sequence
  Description of Artificial Sequence: Synthetic oligonucleotide
ucuguggcagacuccugc

SEQ ID NO: 8492 - RNA, 18 nt, Artificial Sequence
  Description of Artificial Sequence: Synthetic oligonucleotide
accucucuguggcagacu

SEQ ID NO: 8493 - RNA, 18 nt, Artificial Sequence
  Description of Artificial Sequence: Synthetic oligonucleotide
ucaacaccucucuguggc

SEQ ID NO: 8494 - RNA, 18 nt, Artificial Sequence
  Description of Artificial Sequence: Synthetic oligonucleotide
ggcaaucaacaccucucu

SEQ ID NO: 8495 - RNA, 18 nt, Artificial Sequence
  Description of Artificial Sequence: Synthetic oligonucleotide
ggaaaggcaaucaacacc

SEQ ID NO: 8496 - RNA, 18 nt, Artificial Sequence
  Description of Artificial Sequence: Synthetic oligonucleotide
ugugaggaaaggcaauca

SEQ ID NO: 8497 - RNA, 18 nt, Artificial Sequence
  Description of Artificial Sequence: Synthetic oligonucleotide
ggaaaugugaggaaaggc

SEQ ID NO: 8498 - RNA, 18 nt, Artificial Sequence
  Description of Artificial Sequence: Synthetic oligonucleotide
uuccuggaaaugugagga

SEQ ID NO: 8499 - RNA, 18 nt, Artificial Sequence
  Description of Artificial Sequence: Synthetic oligonucleotide
cucaguuccuggaaaugu

SEQ ID NO: 8500 - RNA, 18 nt, Artificial Sequence
  Description of Artificial Sequence: Synthetic oligonucleotide
agauacucaguuccugga

SEQ ID NO: 8501 - RNA, 18 nt, Artificial Sequence
  Description of Artificial Sequence: Synthetic oligonucleotide
uugguagauacucaguuc

SEQ ID NO: 8502 - RNA, 18 nt, Artificial Sequence
  Description of Artificial Sequence: Synthetic oligonucleotide
ugaucuugguagauacuc

SEQ ID NO: 8503 - RNA, 18 nt, Artificial Sequence
  Description of Artificial Sequence: Synthetic oligonucleotide
guuccugaucuugguaga

SEQ ID NO: 8504 - RNA, 18 nt, Artificial Sequence
  Description of Artificial Sequence: Synthetic oligonucleotide
ccuuuguuccugaucuug

SEQ ID NO: 8505 - RNA, 18 nt, Artificial Sequence
  Description of Artificial Sequence: Synthetic oligonucleotide
aagauccuuuguuccuga

SEQ ID NO: 8506 - RNA, 18 nt, Artificial Sequence
  Description of Artificial Sequence: Synthetic oligonucleotide
acuuuaagauccuuuguu

SEQ ID NO: 8507 - RNA, 18 nt, Artificial Sequence
  Description of Artificial Sequence: Synthetic oligonucleotide
caggaacuuuaagauccu

SEQ ID NO: 8508 - RNA, 18 nt, Artificial Sequence
  Description of Artificial Sequence: Synthetic oligonucleotide
ucuuccaggaacuuuaag

SEQ ID NO: 8509 - RNA, 18 nt, Artificial Sequence
  Description of Artificial Sequence: Synthetic oligonucleotide
caagcucuuccaggaacu

SEQ ID NO: 8510 - RNA, 18 nt, Artificial Sequence
  Description of Artificial Sequence: Synthetic oligonucleotide
uuccccaagcucuuccag

SEQ ID NO: 8511 - RNA, 18 nt, Artificial Sequence
  Description of Artificial Sequence: Synthetic oligonucleotide
uucccuuccccaagcucu

SEQ ID NO: 8512 - RNA, 18 nt, Artificial Sequence
  Description of Artificial Sequence: Synthetic oligonucleotide
uggccuucccuuccccaa

SEQ ID NO: 8513 - RNA, 18 nt, Artificial Sequence
  Description of Artificial Sequence: Synthetic oligonucleotide
ugugguggccuucccuuc

SEQ ID NO: 8514 - RNA, 18 nt, Artificial Sequence
  Description of Artificial Sequence: Synthetic oligonucleotide
ugugcugugguggccuuc

SEQ ID NO: 8515 - RNA, 18 nt, Artificial Sequence
  Description of Artificial Sequence: Synthetic oligonucleotide
gaucaugugcuguggugg

SEQ ID NO: 8516 - RNA, 18 nt, Artificial Sequence
  Description of Artificial Sequence: Synthetic oligonucleotide
agacagaucaugugcugu

SEQ ID NO: 8517 - RNA, 18 nt, Artificial Sequence
  Description of Artificial Sequence: Synthetic oligonucleotide
uucccagacagaucaugu

SEQ ID NO: 8518 - RNA, 18 nt, Artificial Sequence
  Description of Artificial Sequence: Synthetic oligonucleotide
caaguuucccagacagau

SEQ ID NO: 8519 - RNA, 18 nt, Artificial Sequence
  Description of Artificial Sequence: Synthetic oligonucleotide
agucccaaguuucccaga

SEQ ID NO: 8520 - RNA, 18 nt, Artificial Sequence
  Description of Artificial Sequence: Synthetic oligonucleotide
uucggagucccaaguuuc

SEQ ID NO: 8521 - RNA, 18 nt, Artificial Sequence
  Description of Artificial Sequence: Synthetic oligonucleotide
cuuucuucggagucccaa

SEQ ID NO: 8522 - RNA, 18 nt, Artificial Sequence
  Description of Artificial Sequence: Synthetic oligonucleotide
gauuucuuucuucggagu

SEQ ID NO: 8523 - RNA, 18 nt, Artificial Sequence
  Description of Artificial Sequence: Synthetic oligonucleotide
cgauugauuucuuucuuc

SEQ ID NO: 8524 - RNA, 18 nt, Artificial Sequence
  Description of Artificial Sequence: Synthetic oligonucleotide
aaacucgauugauuucuu

SEQ ID NO: 8525 - RNA, 18 nt, Artificial Sequence
  Description of Artificial Sequence: Synthetic oligonucleotide
guauaaaacucgauugau

SEQ ID NO: 8526 - RNA, 18 nt, Artificial Sequence
  Description of Artificial Sequence: Synthetic oligonucleotide
agggaguauaaaacucga

SEQ ID NO: 8527 - RNA, 18 nt, Artificial Sequence
  Description of Artificial Sequence: Synthetic oligonucleotide
uugccagggaguauaaaa

SEQ ID NO: 8528 - RNA, 18 nt, Artificial Sequence
  Description of Artificial Sequence: Synthetic oligonucleotide
cuucuuugccagggagua

SEQ ID NO: 8529 - RNA, 18 nt, Artificial Sequence
  Description of Artificial Sequence: Synthetic oligonucleotide
uugcccuucuuugccagg

SEQ ID NO: 8530 - RNA, 18 nt, Artificial Sequence
  Description of Artificial Sequence: Synthetic oligonucleotide
guagcuugcccuucuuug

SEQ ID NO: 8531 - RNA, 18 nt, Artificial Sequence
  Description of Artificial Sequence: Synthetic oligonucleotide
uuucuguagcuugcccuu

SEQ ID NO: 8532 - RNA, 18 nt, Artificial Sequence
  Description of Artificial Sequence: Synthetic oligonucleotide
gccucuuucuguagcuug

SEQ ID NO: 8533 - RNA, 18 nt, Artificial Sequence
  Description of Artificial Sequence: Synthetic oligonucleotide
uuccugccucuuucugua

SEQ ID NO: 8534 - RNA, 18 nt, Artificial Sequence
  Description of Artificial Sequence: Synthetic oligonucleotide
ggguguuccugccucuuu

SEQ ID NO: 8535 - RNA, 18 nt, Artificial Sequence
  Description of Artificial Sequence: Synthetic oligonucleotide
gcgauuuuccacaaaggg

SEQ ID NO: 8536 - RNA, 18 nt, Artificial Sequence
  Description of Artificial Sequence: Synthetic oligonucleotide
accgcgauuuuccacaaa

SEQ ID NO: 8537 - RNA, 18 nt, Artificial Sequence
  Description of Artificial Sequence: Synthetic oligonucleotide
uggagaccgcgauuuucc

SEQ ID NO: 8538 - RNA, 18 nt, Artificial Sequence
  Description of Artificial Sequence: Synthetic oligonucleotide
cugaguggagaccgcgau

SEQ ID NO: 8539 - RNA, 18 nt, Artificial Sequence
  Description of Artificial Sequence: Synthetic oligonucleotide
caagccugaguggagacc

SEQ ID NO: 8540 - RNA, 18 nt, Artificial Sequence
  Description of Artificial Sequence: Synthetic oligonucleotide
gguuccaagccugagugg

SEQ ID NO: 8541 - RNA, 18 nt, Artificial Sequence
  Description of Artificial Sequence: Synthetic oligonucleotide
gugcugguuccaagccug

SEQ ID NO: 8542 - RNA, 18 nt, Artificial Sequence
  Description of Artificial Sequence: Synthetic oligonucleotide
ccgcugugcugguuccaa

SEQ ID NO: 8543 - RNA, 18 nt, Artificial Sequence
  Description of Artificial Sequence: Synthetic oligonucleotide
ccacuccgcugugcuggu

SEQ ID NO: 8544 - RNA, 18 nt, Artificial Sequence
  Description of Artificial Sequence: Synthetic oligonucleotide
ucuuaccacuccgcugug

SEQ ID NO: 8545 - RNA, 18 nt, Artificial Sequence
  Description of Artificial Sequence: Synthetic oligonucleotide
ucuggucuuaccacuccg

SEQ ID NO: 8546 - RNA, 18 nt, Artificial Sequence
  Description of Artificial Sequence: Synthetic oligonucleotide
gaccgucuggucuuacca

SEQ ID NO: 8547 - RNA, 18 nt, Artificial Sequence
  Description of Artificial Sequence: Synthetic oligonucleotide
gcuaugaccgucuggucu

SEQ ID NO: 8548 - RNA, 18 nt, Artificial Sequence
  Description of Artificial Sequence: Synthetic oligonucleotide
ccuuggcuaugaccgucu

SEQ ID NO: 8549 - RNA, 18 nt, Artificial Sequence
  Description of Artificial Sequence: Synthetic oligonucleotide
gggcuccuuggcuaugac

SEQ ID NO: 8550 - RNA, 18 nt, Artificial Sequence
  Description of Artificial Sequence: Synthetic oligonucleotide
cucgggucugaguuuggg

SEQ ID NO: 8551 - RNA, 18 nt, Artificial Sequence
  Description of Artificial Sequence: Synthetic oligonucleotide
acucgggucugaguuugg

SEQ ID NO: 8552 - RNA, 18 nt, Artificial Sequence
  Description of Artificial Sequence: Synthetic oligonucleotide
uccaaacucgggucugag

SEQ ID NO: 8553 - RNA, 18 nt, Artificial Sequence
  Description of Artificial Sequence: Synthetic oligonucleotide
ccgguuccaaacucgggu

SEQ ID NO: 8554 - RNA, 18 nt, Artificial Sequence
  Description of Artificial Sequence: Synthetic oligonucleotide
gucuuccgguuccaaacu

SEQ ID NO: 8555 - RNA, 18 nt, Artificial Sequence
  Description of Artificial Sequence: Synthetic oligonucleotide
uuucugucuuccgguucc

SEQ ID NO: 8556 - RNA, 18 nt, Artificial Sequence
  Description of Artificial Sequence: Synthetic oligonucleotide
uggaguuucugucuuccg

SEQ ID NO: 8557 - RNA, 18 nt, Artificial Sequence
  Description of Artificial Sequence: Synthetic oligonucleotide
agauguggaguuucuguc

SEQ ID NO: 8558 - RNA, 18 nt, Artificial Sequence
  Description of Artificial Sequence: Synthetic oligonucleotide
gagacagauguggaguuu

SEQ ID NO: 8559 - RNA, 18 nt, Artificial Sequence
  Description of Artificial Sequence: Synthetic oligonucleotide
cuucugagacagaugugg

SEQ ID NO: 8560 - RNA, 18 nt, Artificial Sequence
  Description of Artificial Sequence: Synthetic oligonucleotide
aagaucuucugagacaga

SEQ ID NO: 8561 - RNA, 18 nt, Artificial Sequence
  Description of Artificial Sequence: Synthetic oligonucleotide
ucaagaagaucuucugag

SEQ ID NO: 8562 - RNA, 18 nt, Artificial Sequence
  Description of Artificial Sequence: Synthetic oligonucleotide
aaggcucaagaagaucuu

SEQ ID NO: 8563 - RNA, 18 nt, Artificial Sequence
  Description of Artificial Sequence: Synthetic oligonucleotide
aauaaaaggcucaagaag

SEQ ID NO: 8564 - RNA, 18 nt, Artificial Sequence
  Description of Artificial Sequence: Synthetic oligonucleotide
acugcaauaaaaggcuca

SEQ ID NO: 8565 - RNA, 18 nt, Artificial Sequence
  Description of Artificial Sequence: Synthetic oligonucleotide
cugagacugcaauaaaag

SEQ ID NO: 8566 - RNA, 18 nt, Artificial Sequence
  Description of Artificial Sequence: Synthetic oligonucleotide
cugagcugagacugcaau

SEQ ID NO: 8567 - RNA, 18 nt, Artificial Sequence
  Description of Artificial Sequence: Synthetic oligonucleotide
caagccugagcugagacu

SEQ ID NO: 8568 - RNA, 18 nt, Artificial Sequence
  Description of Artificial Sequence: Synthetic oligonucleotide
gguuccaagccugagcug

SEQ ID NO: 8569 - RNA, 18 nt, Artificial Sequence
  Description of Artificial Sequence: Synthetic oligonucleotide
gugcugguuccaagccug

SEQ ID NO: 8570 - RNA, 18 nt, Artificial Sequence
  Description of Artificial Sequence: Synthetic oligonucleotide
ccgcugugcugguuccaa

SEQ ID NO: 8571 - RNA, 18 nt, Artificial Sequence
  Description of Artificial Sequence: Synthetic oligonucleotide
ccacuccgcugugcuggu

SEQ ID NO: 8572 - RNA, 18 nt, Artificial Sequence
  Description of Artificial Sequence: Synthetic oligonucleotide
ucuuaccacuccgcugug

SEQ ID NO: 8573 - RNA, 18 nt, Artificial Sequence
  Description of Artificial Sequence: Synthetic oligonucleotide
ucuggucuuaccacuccg

SEQ ID NO: 8574 - RNA, 18 nt, Artificial Sequence
  Description of Artificial Sequence: Synthetic oligonucleotide
gacugucuggucuuacca

SEQ ID NO: 8575 - RNA, 18 nt, Artificial Sequence
  Description of Artificial Sequence: Synthetic oligonucleotide
gcuaugacugucuggucu

SEQ ID NO: 8576 - RNA, 18 nt, Artificial Sequence
  Description of Artificial Sequence: Synthetic oligonucleotide
ccuuggcuaugacugucu

SEQ ID NO: 8577 - RNA, 18 nt, Artificial Sequence
  Description of Artificial Sequence: Synthetic oligonucleotide
gggauccuuggcuaugac

SEQ ID NO: 8578 - RNA, 18 nt, Artificial Sequence
  Description of Artificial Sequence: Synthetic oligonucleotide
ccugggucugaguuuggg

SEQ ID NO: 8579 - RNA, 18 nt, Artificial Sequence
  Description of Artificial Sequence: Synthetic oligonucleotide
caaaccugggucugaguu

SEQ ID NO: 8580 - RNA, 18 nt, Artificial Sequence
  Description of Artificial Sequence: Synthetic oligonucleotide
gguuccaaaccugggucu

SEQ ID NO: 8581 - RNA, 18 nt, Artificial Sequence
  Description of Artificial Sequence: Synthetic oligonucleotide
cuucagguuccaaaccug

SEQ ID NO: 8582 - RNA, 18 nt, Artificial Sequence
  Description of Artificial Sequence: Synthetic oligonucleotide
gcugucuucagguuccaa

SEQ ID NO: 8583 - RNA, 18 nt, Artificial Sequence
  Description of Artificial Sequence: Synthetic oligonucleotide
gaguugcugucuucaggu

SEQ ID NO: 8584 - RNA, 18 nt, Artificial Sequence
  Description of Artificial Sequence: Synthetic oligonucleotide
auguggaguugcugucuu

SEQ ID NO: 8585 - RNA, 18 nt, Artificial Sequence
  Description of Artificial Sequence: Synthetic oligonucleotide
ggcagauguggaguugcu

SEQ ID NO: 8586 - RNA, 18 nt, Artificial Sequence
  Description of Artificial Sequence: Synthetic oligonucleotide
uccaaggcagauguggag

SEQ ID NO: 8587 - RNA, 18 nt, Artificial Sequence
  Description of Artificial Sequence: Synthetic oligonucleotide
gaucuuccaaggcagaug

SEQ ID NO: 8588 - RNA, 18 nt, Artificial Sequence
  Description of Artificial Sequence: Synthetic oligonucleotide
aagaggaucuuccaaggc

SEQ ID NO: 8589 - RNA, 18 nt, Artificial Sequence
  Description of Artificial Sequence: Synthetic oligonucleotide
aacucaagaggaucuucc

SEQ ID NO: 8590 - RNA, 18 nt, Artificial Sequence
  Description of Artificial Sequence: Synthetic oligonucleotide
cuaaaaacucaagaggau

SEQ ID NO: 8591 - RNA, 18 nt, Artificial Sequence
  Description of Artificial Sequence: Synthetic oligonucleotide
caugucuaaaaacucaag

SEQ ID NO: 8592 - RNA, 18 nt, Artificial Sequence
  Description of Artificial Sequence: Synthetic oligonucleotide
ucggccaugucuaaaaac

SEQ ID NO: 8593 - RNA, 18 nt, Artificial Sequence
  Description of Artificial Sequence: Synthetic oligonucleotide
ugaucucggccaugucua

SEQ ID NO: 8594 - RNA, 18 nt, Artificial Sequence
  Description of Artificial Sequence: Synthetic oligonucleotide
cuccuugaucucggccau

SEQ ID NO: 8595 - RNA, 18 nt, Artificial Sequence
  Description of Artificial Sequence: Synthetic oligonucleotide
auuuucuccuugaucucg

SEQ ID NO: 8596 - RNA, 18 nt, Artificial Sequence
  Description of Artificial Sequence: Synthetic oligonucleotide
cgcagauuuucuccuuga

SEQ ID NO: 8597 - RNA, 18 nt, Artificial Sequence
  Description of Artificial Sequence: Synthetic oligonucleotide
auagucgcagauuuucuc

SEQ ID NO: 8598 - RNA, 18 nt, Artificial Sequence
  Description of Artificial Sequence: Synthetic oligonucleotide
aagagauagucgcagauu

SEQ ID NO: 8599 - RNA, 18 nt, Artificial Sequence
  Description of Artificial Sequence: Synthetic oligonucleotide
cauugaagagauagucgc

SEQ ID NO: 8600 - RNA, 18 nt, Artificial Sequence
  Description of Artificial Sequence: Synthetic oligonucleotide
agacacauugaagagaua

SEQ ID NO: 8601 - RNA, 18 nt, Artificial Sequence
  Description of Artificial Sequence: Synthetic oligonucleotide
gagucagacacauugaag

SEQ ID NO: 8602 - RNA, 18 nt, Artificial Sequence
  Description of Artificial Sequence: Synthetic oligonucleotide
cagaggagucagacacau

SEQ ID NO: 8603 - RNA, 18 nt, Artificial Sequence
  Description of Artificial Sequence: Synthetic oligonucleotide
cagggcagaggagucaga

SEQ ID NO: 8604 - RNA, 18 nt, Artificial Sequence
  Description of Artificial Sequence: Synthetic oligonucleotide
aaauucagggcagaggag

SEQ ID NO: 8605 - RNA, 18 nt, Artificial Sequence
  Description of Artificial Sequence: Synthetic oligonucleotide
uagccaaauucagggcag

SEQ ID NO: 8606 - RNA, 18 nt, Artificial Sequence
  Description of Artificial Sequence: Synthetic oligonucleotide
auuuuuagccaaauucag

SEQ ID NO: 8607 - RNA, 18 nt, Artificial Sequence
  Description of Artificial Sequence: Synthetic oligonucleotide
ccaauauuuuuagccaaa

SEQ ID NO: 8608 - RNA, 18 nt, Artificial Sequence
  Description of Artificial Sequence: Synthetic oligonucleotide
uaaggccaauauuuuuag

SEQ ID NO: 8609 - RNA, 18 nt, Artificial Sequence
  Description of Artificial Sequence: Synthetic oligonucleotide
cuugguaaggccaauauu

SEQ ID NO: 8610 - RNA, 18 nt, Artificial Sequence
  Description of Artificial Sequence: Synthetic oligonucleotide
cgggccuugguaaggcca

SEQ ID NO: 8611 - RNA, 18 nt, Artificial Sequence
  Description of Artificial Sequence: Synthetic oligonucleotide
uaucucgggccuugguaa

SEQ ID NO: 8612 - RNA, 18 nt, Artificial Sequence
  Description of Artificial Sequence: Synthetic oligonucleotide
auuuauaucucgggccuu

SEQ ID NO: 8613 - RNA, 18 nt, Artificial Sequence
  Description of Artificial Sequence: Synthetic oligonucleotide
acagcauuuauaucucgg

SEQ ID NO: 8614 - RNA, 18 nt, Artificial Sequence
  Description of Artificial Sequence: Synthetic oligonucleotide
uuagcacagcauuuauau

SEQ ID NO: 8615 - RNA, 18 nt, Artificial Sequence
  Description of Artificial Sequence: Synthetic oligonucleotide
gucaauuagcacagcauu

SEQ ID NO: 8616 - RNA, 18 nt, Artificial Sequence
  Description of Artificial Sequence: Synthetic oligonucleotide
uccaugucaauuagcaca

SEQ ID NO: 8617 - RNA, 18 nt, Artificial Sequence
  Description of Artificial Sequence: Synthetic oligonucleotide
gccuuuccaugucaauua

SEQ ID NO: 8618 - RNA, 18 nt, Artificial Sequence
  Description of Artificial Sequence: Synthetic oligonucleotide
ccccugccuuuccauguc

SEQ ID NO: 8619 - RNA, 18 nt, Artificial Sequence
  Description of Artificial Sequence: Synthetic oligonucleotide
acaucccccugccuuucc

SEQ ID NO: 8620 - RNA, 18 nt, Artificial Sequence
  Description of Artificial Sequence: Synthetic oligonucleotide
uauagacaucccccugcc

SEQ ID NO: 8621 - RNA, 18 nt, Artificial Sequence
  Description of Artificial Sequence: Synthetic oligonucleotide
uugucuauagacaucccc

SEQ ID NO: 8622 - RNA, 18 nt, Artificial Sequence
  Description of Artificial Sequence: Synthetic oligonucleotide
gucccuugucuauagaca

SEQ ID NO: 8623 - RNA, 18 nt, Artificial Sequence
  Description of Artificial Sequence: Synthetic oligonucleotide
ggguugucccuugucuau

SEQ ID NO: 8624 - RNA, 18 nt, Artificial Sequence
  Description of Artificial Sequence: Synthetic oligonucleotide
aaaugccauaugggaggg

SEQ ID NO: 8625 - RNA, 18 nt, Artificial Sequence
  Description of Artificial Sequence: Synthetic oligonucleotide
gucaaaugccauauggga

SEQ ID NO: 8626 - RNA, 18 nt, Artificial Sequence
  Description of Artificial Sequence: Synthetic oligonucleotide
ugucugucaaaugccaua

SEQ ID NO: 8627 - RNA, 18 nt, Artificial Sequence
  Description of Artificial Sequence: Synthetic oligonucleotide
cuucuugucugucaaaug

SEQ ID NO: 8628 - RNA, 18 nt, Artificial Sequence
  Description of Artificial Sequence: Synthetic oligonucleotide
ucucgcuucuugucuguc

SEQ ID NO: 8629 - RNA, 18 nt, Artificial Sequence
  Description of Artificial Sequence: Synthetic oligonucleotide
uccucucucgcuucuugu

SEQ ID NO: 8630 - RNA, 18 nt, Artificial Sequence
  Description of Artificial Sequence: Synthetic oligonucleotide
uugcauccucucucgcuu

SEQ ID NO: 8631 - RNA, 18 nt, Artificial Sequence
  Description of Artificial Sequence: Synthetic oligonucleotide
uugauuugcauccucucu
